United States Patent 9,254,311 (MODIFIED POLYNUCLEOTIDES FOR THE PRODUCTION OF PROTEINS) - sequence listing, part 25

SEQ ID NO: 53108 - DNA, 1992 bp, Artificial Sequence
  Description of Artificial Sequence: Synthetic coding sequence
atgggaaacattctcacatgccgtgtgcacccctccgtctccctggagttcgatcagcagcaggggtcagtctgtcctagcgaatcagagatctacgaagccggagctggggatcgcatggcgggagcgccaatggcggcagctgtacagcctgcggaggttactgtggaggtaggggaagaccttcatatgcatcacgtgagagatcgcgagatgcccgaagccctggagttcaatccaagcgccaatcctgaggcatccacaattttccagaggaactcacaaactgacgttgttgaaattaggcggagtaactgtaccaatcacgtgagtaccgttcgcttcagtcagcaatactctctgtgcagcaccatattcttggatgacagcacagctatccagcattacctgaccatgacaatcattagcgtgacactggagattcctcaccacattacacagagagacgccgatagatctctcagcatcccagacgaacagctgcactcctttgctgtgtctaccgtccacatcatgaaaaaacgtaacgggggagggtccttgaacaattacagttcatccatacctagcaccccctcaacttcccaggaggatccacagttcagcgttcctccaactgccaacactcccaccccagtgtgtaagagatccatgcggtggtccaacttgtttaccagtgagaagggctccgatcccgacaaagagcgcaaagcccctgagaatcacgcggatacgatcggttctggaagggcaattccgatcaagcagggcatgctcctgaagaggtcaggaaagtggttaaagacctggaaaaaaaagtatgtcactctctgttctaacggtgtgctgacctattacagttcgctgggggattatatgaagaatatccacaagaaggaaatcgatctgcaaacatctaccattaaagtgcccggtaagtggccctcactggctacctcggcctgcacacctatttctacaagtaagtcaaatggcttgagcaaggatatggacacaggcttaggagattctatctgctttagccccagcatcagctctacaactagccccaagctgaacccacctccctccccccacgctaataagaaaaagcacctaaagaaaaaaagtacaaataactttatgatagtgagcgctacagggcagacctggcacttcgaggccacaacttatgaggagagggacgcatgggtgcaagcaatacaatcacagatccttgcaagccttcaatcgtgcgagtcaagtaagagtaagagccagctgacaagccagtccaaggctatggcacttcagagcatccaaaacatgaggggaaatgctcactgcgttgactgcgaaacacaaaatcccaagtgggcaagtctgaacctaggcgtcctgatgtgcatagaatgtagcggaattcaccgctccctgggaacgaggctcagcagagtccgttcactggagctggatgattggcctgtggagctgaggaaggtgatgagctccatagggaatgacctggcaaacagcatttgggagggatcatctcagggacaaactaagccttcggaaaagtcgacccgcgaagagaaagagcggtggatccgttccaagtacgaggaaaagttgttccttgctcccctgccctgtaccgaactgtccctaggtcaacagctactcagagctacagctgatgaggatctgcagactgctatcctacttcttgcccacggaagcagggaagaagtaaatgaaacctgcggagaaggggacgggtgtaccgcacttcacttagcttgcaggaaaggcaacgtggtgttggctcagctgctgatttggtatggcgtggacgtaatggcacgagacgcccatggtaacaccgctcttacttatgctaggcaagcgtctagccaagaatgcattaatgtgcttttgcaatacggctgcccggacaagtgcgtttag

SEQ ID NO: 53109 - DNA, 2061 bp, Artificial Sequence
  Description of Artificial Sequence: Synthetic coding sequence
atggggaatatactcacttgttgtgtccacccttcggtgtctctggagtttgaccagcagcagggatccgtgtgtccctctgaatccgagatttatgaagcaggcgcaggcgatagaatggcgggtgccccaatggccgctgccgttcaacctgctgaagtcaccgtggaggtgggggaggacctccatatgcatcatatccgtgatcaggagatgccagaggctctagaatttagcttgtcagccaaccccgaggccagtactatattccagcgaaacagtcaaacagacgcgctggaatttaacccttcagccaatcccgaagctagcacgatattccagcggaattcgcagaccgacgtagtcgaaatcagacgctccaactgcacaaatcatgtttcaaccgaaaggttcagtcaacaatattcaagctgctcaacaatttttcttgacgacagcacagcctcacagcattacttgactatgactattatatccgtgacactagagatcccccaccacattacacagcgcgatgccgaccgttctctatcgatacccgacgaacagctgcactcattcgccgtctcgacagtgcatataactaagaatcggaacggcggaggctcactcaacaattacagctcctccatcccttcaaccccatctacaagccaggaggacccccagttttccgttccgccaacagccaatactccgacacccgtttgtaagcgctcaatgaggtggtctaatctgttcacatcggagaagggcagtcatccagataaagaacggaaggctccagaaaatcatgcggataccattgggtcgggcagggcaattcccatcaaacaaggtatgttacttaagcgtagtggaaaatggcttaagacttggaaaaagaaatacgtgacactgtgctccaacggggtgttgacatactattcttccctaggtgattacatgaaaaatatccacaagaaggaaattgatctgcgcacttctaccatcaaggttccgggtaagtggcctagcctagctactagcgcctgtgctcccatcagcagttctaaatctaatgggctcagcaaagacatggacactggattaggcgatagcatttgcttctcccccagcattagctcgaccacgagccccaagcttaatccgccaccttcaccgcatgcaaataaaaagaagcacttaaaaaaaaagtctaccaacaacttcatgatcgtgtcagctacagggcaaacttggcacttcgaggctaccacctacgaggagagagatgcgtgggtccaggcaattcagtcacagattctggccagtctgcagtcttgcgagagcagcaaaagcaaatcacagctgaccagtcagtccgaggctatggcattgcagtcaatacagaatatgcggggaaacgctcattgcgttgactatgaaacacagaatccaaagtgggcttccctgaatctcggcgtactgatgtgtatcgagtgcagcggcattcataggtctctgggtacccggttgtcaagggtgcgctccttggagctggacgattggccggtggagctgagaaaggtaatgtcctctatcgggaacgacctggccaacagcatctgggaaggcagctctcaagggcagactaaaccgtctgtcaagtcaacacgggaagaaaaagagcgctggatccgctcaaagtatgaggaaaaactgttcctcgcgccactgccctgtacagagctgtccctcggacaacatctccttagagctactgctgatgaggatctccagactgctattctccttctagcccatggcagtcgagaggaagtgaacgagacctgcggcgaaggcgacggctgcaccgcattgcacctggcatgtcgcaagggcaacgtagttttagctcagctactcatttggtatggggtggacgtgatggctagagacgctcacggcaatacagccctaacctatgcacgacaggccagttcgcaggaatgtatcaacgtgctcctccagtacggctgtcctgatgagtgcgtctag

SEQ ID NO: 53110 - DNA, 1992 bp, Artificial Sequence
  Description of Artificial Sequence: Synthetic coding sequence
atgggcaacattctcacctgctgtgtgcacccttctgtctctctagaatttgaccagcagcaaggaagtgtgtgtccgtccgagtctgagatctatgaagcaggagctggcgaccgcatggctggagctccaatggcagccgctgtgcaacccgctgaagtaaccgtagaggttggggaggacttgcacatgcatcacattcgagatcaggagatgccggaagcgctggaatttaatccgagtgccaatcctgaggcctcaacaatatttcagcgaaactcacagacggacgttgtcgagattcgcaggtccaactgcactaatcacgtctccaccgagcgcttctcccaacaatattccagctgctccaccatttttctggacgactctaccgcctcccagcactatctgaccatgacaattatcagcgttacattggaaatcccacatcatattacccaaagagatgcagatcgatcgctgagcatacctgatgagcaactccactcttttgctgtatctacggttcatataactaaaaaccggaacggaggcggtagtctgaataattatagctcatctatcccttcgactccgtccacatcacaggaggaccctcagttttcagttcctccaacagcgaacactcccaccccagtgtgtaaaagaagcatgcgctggagcaacttgttcacctcagagaaaggatcccatcccgataaagagcggaaggcacccgagaatcatgccgacaccatcggctccggcagggcaatccccattaaacaggggatgttgctgaagcgttccggcaaatggttgaagacctggaagaagaagtatgtcacactatgctctaacggcgtgctcacatactactcctctttaggggattatatgaagaatatccacaaaaaggaaatcgaccttagaacttccaccataaaagtgcctggcaagtggcctagccttgcaacttccgcctgtgctccaatctcatcatcaaagtcaaacggcctatccaaggatatggatactggtctgggagactctatttgttttagtccatccatcagttcaacaacatcccccaaacttaatcctccacctagccctcatgctaataagaagaagcatctaaagaaaaagtccacaaacaactttatgatagttagcgcaacaggacagacctggcactttgaagcaacgacgtacgaggaaagggatgcttgggtgcaagccatccagtctcagattctggcatccctccagtcctgtgaatcatccaagtcaaagagtcagctcaccagccagagcgaggcgatggctctgcagtcaattcagaatatgagaggcaacgcacattgtgtcgactacgagacgcagaatccaaagtgggcctctctaaatcttggggtgctgatgtgcatcgagtgttccggcattcacagaagcctcggcacaagactttcccgcgtaagatctctagagctggatgattggcctgttgagttgaggaaggtgatgagtagcatcggcaacgacctggcaaattccatttgggaaggcagctctcaaggccagacaaaaccgagtgtgaagtccactcgggaagagaaagagagatggattaggtcaaagtatgaggagaaacttttcttggctccgttgccctgtaccgagctgtctttggggcagcacttactcagggccaccgcagatgaggacctacaaactgccatcctgctgcttgctcatggatcacgtgaggaagtcaatgaaacgtgcggcgagggggacggctgcaccgctttgcacctcgcctgtcgtaagggtaacgtggtcttagcacagctgctgatatggtacggcgtcgatgtcatggcacgcgacgcccacggaaacaccgctctgacttatgctcgccaggcttcaagtcaggaatgcatcaatgtcctgctacagtacggttgccctgacgagtgcgtctag

SEQ ID NO: 53111 - DNA, 2061 bp, Artificial Sequence
  Description of Artificial Sequence: Synthetic coding sequence
atgggtaacatcttaacttgtcgggtccacccttcagtgtcactagagttcgatcagcagcaaggcagcgtctgtccaagcgagtctgagacctacgaggccggtgcgcgagaccgcatggccggtgcccctatggccgctgcggttcagcccgcagaggtgaccgtcgaggtgggagaagacttacatatgcaccacgttagagatagagagatgccagaagccctggagtttaacctgagtgccaaccctgaatcttcaaccattttccagcgcaacagtcagacggaggccctggagttcaacccatcagccaaccctgaggcatctacaatcttccagagaaactcccaaaccgacgtggtagagattcggcgatccaactgcactaaccatgtgtccgctgtgcgcttcagccagcagtatagcctgtgttctaccatattcctcgatgactctactgccattcagcactatcttactatgaccattatctcggtgaccctcgagatccctcaccatattacacagcgtgacgctgaccgaacattgagcatcccagatgagcaattgcatagttttgctgtcagcaccgtgcacattatgaagaagcggaatgggggaggtagcctgaacaattattccagctcaatcccatctactccatcaacttcccaagaagacccacaattctcggttccacctactgcgaatacgcctactccagtttgtaagcgcagtatgagatggtctaatttgttcacgagtgagaagggatccgatccggacaaggaacgcaaagcgccagaaaatcatgccgatacaataggatcaggcagagccatacccatcaagcagggcatgctgctgaaacggtccgggaaatggttgaaaacctggaagaaaaaatacgtgacactctgtagcaacggcatgctcacatactattccagcttaggtgactacatgaagaacatacacaaaaaggaaatagacttacagacctcaacgatcaaggttccaggcaaatggccttctctcgctaccagtgcttgcactccgatttcttcctcgaaatctaatggactgagcaaggatatggacaccgggcttggggacagcatatgtttctccccgtctatcagttcaaccacttcccccaaactgaacccacctcccagtccccacgcaaataaaaaaaagcatctcaaaaaaaaaagtaccaataatttcatgattgtatccgccaccggacaaacttggcattttgaagctactacttacgaggaacgagacgcttgggtgcaagctatccagagccagatcctcgcttctttgcagagttgcgagtctagcaaatctaaaagtcaactgacaagtcagtccgaggctatggctcttcagagtatccagaatatgaggggaaatgctcactgcgttgactgtgagactcaaaaccccaaatgggcttcactgaacctgggagttctgatgtgtattgagtgcagtggcatccaccgctctctgggtcctcatttgtcgagagtgcgatccttggaactcgatgattggccagtggaactgcggaaggtgatgtctagcattgtgaatgatctggctaactctatctgggaggggtcttcacagggtcagaccaaaccctctgaaaaaagcactagagaagaaaaagagcgctggatcaggtccaaatacgaagagaagctgttcctggctccccttccttgcaccgagttatcgctagggcagcaattgctcagggcaactgccgacgaggacctgcagactgctatcctcctgcttgcccatgggagttgcgaagaggttaacgagacatgtggagaaggggatggctgtacagccctgcaccttgcttgcagaaagggcaacgtggtactggcccagttgctgatctggtatggtgtcgacgtaatggctagggacgctcacggcaataccgcacttacgtacgcccgacaggcttcatctcaggaatgtattaacgtgctgctgcagtacggatgccctgatgagtgtgtgtag

SEQ ID NO: 53112 - DNA, 1992 bp, Artificial Sequence
  Description of Artificial Sequence: Synthetic coding sequence
atgggcaatatcctgacctgtcgcgtccaccctagtgtcagcctcgagtttgatcagcaacaggggtccgtgtgtccgagcgagtcagagacctatgaggccggtgccagagatcgcatggccggagcaccaatggctgcagccgtccagcctgccgaggtgacagttgaagttggcgaggatctccacatgcaccacgttagggatagggaaatgcccgaggctctggaatttaacccttcagccaaccccgaagctagcaccatatttcaacgaaattcccagacggacgtggtggaaataagaagaagtaattgtactaatcatgtaagtgccgttcggtttagccaacagtattccctctgctctaccatcttcctggacgactccacagctatccaacattatttaactatgaccatcatttctgtgacacttgagatcccccaccacattacacaacgtgacgctgacaggaccctctccatcccggacgagcagctgcacagtttcgccgtgtccactgttcatatcatgaaaaaacgcaatggagggggatctctcaacaattactcttccagtatcccaagcacaccatcaacatcacaggaagaccctcagttctccgttccccctaccgcaaacactcccactcccgtatgcaaacgttcgatgaggtggagcaacctgttcaccagcgaaaagggaagtgaccccgacaaggagagaaaagcaccagaaaaccacgctgatacgataggctccggtcgggcaattccaatcaagcagggaatgctgttaaagagaagcgggaaatggctgaagacctggaagaaaaagtacgtgactttatgctcaaacgggatgcttacgtactactcttctttaggcgactatatgaagaatatccataagaaggaaatcgacttgcaaacctctactataaaggtgccaggaaagtggcctagcttggcaacctcggcttgcacacctatttcaagttcaaagagcaacggactgagcaaggatatggatactgggttaggtgattcaatttgcttctctccctccatttcctcaaccacgtcacccaaactgaacccccctcctagtccacacgctaacaagaagaaacacctcaaaaaaaagtcgaccaacaactttatgattgtatccgctacaggtcaaacctggcacttcgaggccaccacatacgaggagcgtgatgcgtgggtgcaagcaatacaatctcaaatcttggcctccttacagagttgtgagagtagcaaatccaagagccagctgaccagccaatcagaagctatggcactgcaaagtattcagaacatgagggggaacgcacactgtgtcgattgcgaaactcagaatcctaaatgggcttctctcaatctgggggtcttaatgtgcattgaatgcagcggaatccataggtcccttgggcctcacctcagtcgcgtgcggtccctggagttggacgattggcctgtggagctgcggaaagtcatgtcatctatcgtgaacgaccttgctaactctatttgggagggaagttcacaggggcagaccaagccttcagaaaagtccactcgggaggaaaaggagaggtggattagatccaagtacgaggaaaagctctttctggcgcctctcccttgtaccgaactctccctaggccagcagctgttacgtgcgaccgccgacgaagatctgcagaccgctatcctgcttctcgcccacggttcttgcgaggaagttaacgaaacatgcggggaaggcgatggctgtactgctttgcatcttgcctgtcgcaaaggcaatgtagtccttgcccagcttctaatctggtatggggtcgatgtcatggcacgggacgcccatggcaacacagctctgacctacgctcggcaagcctcttcacaggagtgcattaatgtcctccttcagtatggctgtccagatgaatgcgtctag

SEQ ID NO: 53113 - DNA, 1992 bp, Artificial Sequence
  Description of Artificial Sequence: Synthetic coding sequence
atgggcaacatcctcacgtgcagggttcacccctcagtgtctctagaatttgaccagcaacagggatccgtttgcccctccgagagtgagatctacgaggctggcgctgaggacaggatggcaggtgcccctatggccgctgcagtgcaacccgctgaggtaaccgtggaagtgggagaagatctccatatgcatcacgtccgggaccgtgagatgccagaagctttggagttcaacccgtccgccaatccagaggcaagtaccatatttcagcgtaactctcagactgatgtggtggagattcggaggtccaactgcacaaaccacgtttccaccgtacatttttctcagcaatattccctgtgctccactatttttctggacgattctaccgccatccaacactatctcacaatgacaatcattagcgtgacactagagatcccacaccatattacgcagcgggatgcagatcgatcactgtctatcccagatgagcagctgcacagctttgcggtcagtactgtgcacattacaaaaaatcgcaatggtggcggtagtctgaacaactactcgtcaagtatcccatccacccccagcaccagccaggaggatccccagttctctgtgccacctactgctaacacaccaactcccgtttgtaaacgcagcatgcgatggtctaacctctttaccagcgagaaaggttccgaccccgataaagagaggaaggcgccagagaaccatgcggacactatcgggtctggacgagctatccctataaaacaggggatgctcctgaaacgatccggtaaatggcttaagacctggaagaaaaaatatgtaacgttgtgttcaaacggcgtgctaacgtactattcatctctgggcgactatatgaagtatatccataaaaaggagatagacttgcagacgtcaaccatcaaagtgccgggaaagtggcccagtctggccactctggcatgcacacccatcagctcctccaagagcgacggtctgtctaaggacatggatactgggctcggcgattctatctgttttagtccatcaatctcttctacaaccatccccaagctcaatcccccaccaagtcctcatgctaacaaaaaaaaacatctgaagaagaaatccacaaataatttcatgattgtctccgctaccggtcaaacatggcatttcgaggctactacttacgaagagcgggacgcatgggttcaggctatccagtcacagattttagcaagccttcagtcctgtgagtcttctaagtctaagtcccagctaacgtctcagtcggaggcgatggctctgcagtcaattcagaacatgcgcggaaatgcacactgcgtcgactgcgaaacacaaaatccaaagtgggcttcactgaatctaggagttctcatgtgtattgagtgctccggcatacacaggagtctcggcacacggttatctagggttagaagtctggagctggacgactggcccgtggaactcaggaaggtgatgtcgtctatcggaaatgacctggccaatagcatctgggaaggctcttctcagggtagaactaagccaactgagaagtctacacgggaggagaaggaacgctggattagaagcaaatatgaggaaaaattgttcttagctccactgccatgcactgaactgtccttgggtcagcagcttctgagagccaccgcagacgaagacctacaaaccgccatcttactgctggcccacggaagcagggaagaagtcaacgagacttgcggagaaggagacgggtgtacagccctgcatcttgcctgtcgcaagggcaacgtagttcttgcgcaacttctcatctggtatggagtggacgtgatggcacgagatgcacacgggaataccgcactgacatatgctcgacaggcaagttctcaagaatgcatcaacgtgctactccagtatggatgtcctgatgaatgtgtttag

SEQ ID NO: 53114 - DNA, 1320 bp, Artificial Sequence
  Description of Artificial Sequence: Synthetic coding sequence
atgaggtggtccaatctgtttacaagcgaaaaaggtagcgatccggacaaggagcggaaggccccagaaaatcatgctgacactattgggagcggacgcgctatccctataaaacagggcatgttactgaagcggtccgggaaatggcttaaaacctggaaaaagaaatatgtgactctatgtagcaatggtgtcctgacatattactcttcccttggagattatatgaaaaacattcacaagaaggagatcgatttacagaccagtacaatcaaggtgccaggcaagtggcctagtcttgcaaccagtgcgtgcacacccatcagcagtagcaaaagcaacggactatcaaaggatatggacactggccttggggattccatttgctttagcccctctattagttcaacgacgtctcctaagttaaaccctcctccaagtcctcatgctaacaaaaagaagcacctaaagaagaagagcaccaacaattttatgatcgtttccgcgaccgggcagacctggcactttgaggccaccacttatgaggaacgcgatgcttgggttcaggcaatccagtcacagatactcgcctctctccagagttgtgagtcatctaagagcaaaagtcagctgactagccagtccgaagcgatggccctacagagtatacaaaatatgagagggaatgcccactgtgtcgattgtgagacccagaatcccaagtgggcatccctgaatctcggggtcctcatgtgtatagaatgctccggaatccaccactctctgggaacccgactgtcgcgcgtgcggtcattggagttggatgattggcctgtggaacttcggaaggtgatgtcaagcatcggcaatgatctagcaaacagtatatgggaagggtcatcacagggccagaccaagccaagcgaaaaatctactcgggaggaaaaagaacgctggatcaggtccaaatacgaggagaagctgttcttagccccactgccatgtactgaactatctcttgggcaacaattactgtgggctaccgccgacgaagaccttcaaactgccatcctgttattggctcatggcagccgcgaggaggttaacgaaacctgtggagagggagacggctgtactgctctacatctcgcatgccgtaaggggaacgttgtcctagcccagctcctcatctggtacggcgtggatgtgatggcgagagacgcacatggcaatacggccctgacatatgcaaggcaggcttcttcccaggaatgtataaacgtgctactccagtacggctgcccggacgagtgtgtatag

SEQ ID NO: 53115 - DNA, 1992 bp, Artificial Sequence
  Description of Artificial Sequence: Synthetic coding sequence
atggggaacatcctcacttgccgcgttcacccgtccgtcagccttgaatttgatcagcagcagggcagtgtgtgccccagtgaatccgaaatttatgaagccggagctggcgacaggatggcaggcgcacccatggccgctgccgtgcagcccgctgaggtcactgtagaggtcggagaggatctacatatgcaccacgtgagagacagagagatgcccgaggctcttgagtttaatccctcagctaatccagaagccagcaccattttccagaggaactctcagaccgacgttgtggagatccggagatcgaattgcaccaatcacgtctccaccgtgcgcttttctcagcaatacagtttgtgttcaaccatattcctggacgatagtaccgctattcagcactatctgactatgacaattatttccgtgaccctggaaatcccccaccacattacacagcgcgatgctgaccggtctctgtctatacctgatgagcagttgcactctttcgcagtatccactgtccacatcatgaagaagcgcaacgggggtggctctctgaacaactattcctcctcaataccaagtactccttcaactagtcaagaggacccacagttctctgtgccgccaaccgctaacaccccaaccccagtgtgtaaacggagcatgcggtggagcaatctctttacctcagaaaaaggcagtgatcctgacaaggagcgtaaggctccagagaatcatgccgataccattggctccggtagagctatccctattaagcagggaatgctgctgaagaggtcagggaaatggttgaagacttggaaaaaaaagtatgtgaccctctgctctaatggagttctgacttattatagcagcttgggagactatatgaagaatatccacaagaaggaaattgatctgcaaacctctaccattaaagtgccagggaagtggccttcactagccacatccgcatgtactcctatctcaagcagtaagtccaatgggctctcaaaggacatggacacaggccttggagattccatctgcttctcgccctcaatttcatcaaccaccagccctaagctgaatccaccacctagcccacatgctaacaagaaaaagcacctcaagaaaaaaagcaccaacaactttatgattgtatcagcaaccggacaaacttggcattttgaggcaaccacatatgaggagcgcgacgcctgggtgcaggcaatccagtcccaaattctggccagcttacagtcctgtgaaagtagcaaatcaaagtctcagctgacctctcagtcagaggcaatggccctgcagagcatccagaatatgcgcggtaatgcccactgtgtggactgcgagactcagaaccccaagtgggcttctctcaacctcggggttctgatgtgtatagagtgcagcggtatccaccattccctaggcaccagattgagcagggttcgttctctggaacttgatgactggcccgtggaactgaggaaggtgatgtcatccatcggaaacgacctggcaaattctatatgggagggatcatctcaagggcagactaaaccaagtgaaaagagcaccagagaggagaaagaaaggtggatccgcagcaaatacgaggagaaactgttcctcgcccctctaccttgcacagagctgtcgctcggacaacagctcctgtgggctactgctgacgaagacctccaaaccgccattcttttgctggcccatggatcgagagaggaggtgaatgaaacctgtggcgaaggagacggttgtaccgcactccacctggcttgccgcaagggcaacgtggttctcgcccagctgctcatatggtatggcgtcgacgtcatggcaagggatgcgcatggaaataccgccctgacttatgcaaggcaagctagctcccaggagtgcatcaatgtgctcttgcaatacggctgccctgatgagtgcgtgtag

SEQ ID NO: 53116 - DNA, 1992 bp, Artificial Sequence
  Description of Artificial Sequence: Synthetic coding sequence
gagctccttcgaatcagtcctgaccttctcgccgcagccgtcatctcggcacaggaggagcccttaaccaatatccagcgagcctcaggacctacagggttgctatggtccgtcagcctggaatttgatcaacagcagggttcggtgtgccccagcgagagtgagatctatgaggcaggcgcagaggaccgcatggctggagcacccatggccgcagctgtgcagcccgcagaagttacggtggaagtcggagaagatctccatatgcaccaagtgcgggatcgagagatgccggaggcattagaatttaacctgagcgcaaacccagaagcctccactattttccagcgcaactcacagacggatgcacttgaatttaatagctccgctaaccccgaggcaagtacgatattccagagaaattcccagacagatgtggtggagatccgccgatcaaattgcacgaaccatgtgtcgacagaaagattcagtcagcagtatagctcatgttccacaattttcctggacgatagtacggccattcagcactaccttaccatgacaataatctcggtgaccctagagatcccccatcatattacacagagggatgcagaccgttccctgagtattcctgacgaacagttgcattcatttgctgtctcgacagtccatataatgaagaagagaaatggaggaggctctctaaacaactattcttcttccattccacccacaccttccaccagccaggaggatccacagttttcagtgcctcctacagccaatactcctactccagtgtgcaaacgaagtatgcggtggagtaatttgttcacaagtgagaaagggtctgaccccgacaaagaacgtaaggccccagagaatcacgctgacacaattggcagtggccgagccataccaatcaaacagggtatgctgctgaagcgaagcggcaagtggctcaaaacttggaaaaaaaagtacgtgacactgtgttcaaatggtgtgctcacctactactctagtttgggcgactacatgaaaaatatacacaagaaagaaatagatctgcggacatccaccatcaaggtgcctggaaaatggccttccctggcaaccagtgcctgtgccccaatttcctcctcgaaatccaatggcctgagcaaggatatggatacgggcttaggagactccatttgtttttcaccgggaatctcaagtacgacatcccccaagttgaatccccctccctcaccacacgccaacaagaaaaagcacctcaaaaagaaatctaccaacaacttcatgatcgtctctgccaccggccagacatggcattttgaggctacaacctatgaagagagggacgcatgggttcaggcaatccagtcccaatctgaagcaatggccctacaatcgatccagaacatgcggggtaacgctcattgcgtggattgtgagacgcagaatccaaaatgggcgtcgctcaacttaggcgtcttaatgtgtatcgagtgtagcggcatacaccgctcctttgggaccaggttatcgcgggtgcgaagtctcgaactcgatgactggcctgtggagctgagaaaggttatgagcagcattgggaatgaactagccaatagcatctgggaggggagttcccaaggacagacaaaaccttctattaagtccactagagaggagaaagagtggtggattcggtccaagtatgaggaaaaacttttcctggcgcctctcccatgcaccgagctttcgctcggccagcagctactgagagccaccacagatgaggatctccagactgctatcctgctgctcgcgcatggctcaagagaggaggttaacgaaacctgtggggagggagacgggtgcaccgccctccacctagcctgtcggaaaggcaacgtggtcctggaacaactgttgaccggatggacctcctggcctgaaatgccaaccggaacccagcggtag

SEQ ID NO: 53117 - DNA, 1047 bp, Artificial Sequence
  Description of Artificial Sequence: Synthetic coding sequence
taggccgaggacaggatggcaggcgctccgatggcggctgccgtccaaccagcagaggtcactgtcgaggtcggagaagatttgcatatgcaccaggtgcgggatcgcgaaatgccggaggccctagaatttaacttgtctgcgaaccccgaggcctctaccatcttccagcggaacagccagacagacgccctcgaattcaatagctccgcaaaccccgaggcctccacaattttccaacggaatagccaaacggacgtagtcgagattcggaggagcaactgcactaaccacgttagcacggagagattctctcagcagtattcctcctgcagcacaatcttcctggatgatagcacagccatacagcactacttgaccatgacaatcatttctgttacattggagattccgcaccacatcacccagcgcgatgcagatcgatccctttctatcccggacgagcaactgcactccttcgcggtgtctaccgtccacattatgaagaagaggaatgggggtggctcattgaacaactatagcagtagtatccccccaacaccatccacctctcaggaggatccacagttctccgtgccacccactgccaatacacctacccccgtgtgtaagagatctatgaggtggagtaacctcttcacgtcggaaaaaggctccgatcctgacaaggagagaaaagccccagagaatcacgctgataccattggcagcggccgagccatcccgatcaaacaggggatgctactgaagaggtccggaaagtggctgaaaacctggaagaagaagtacgtcacactatgcagtaacggcgttctaacttactatagctcactcggggattacatgaaaaatatacacaaaaaagagattgaccttcggacctcaacaataaaagtgccaggcaaatggccaagtctcgctacatcagcctgtgcaccaatatccagttcaaagtcaaatgggctaagcaaagatatggataccgggctgggagacagtatttgcttctcccccggaatttcctag

SEQ ID NO: 53118 - DNA, 2112 bp, Artificial Sequence
  Description of Artificial Sequence: Synthetic coding sequence
atgtttgaggatgttttctctgactcaggcaacaccggcaacttcgatcgtggtaaaaaacggaggcttaccatcatcgagtgcggttgtgatattaacatgatgatcgacttggcaaaggttgccgatctcgtactaatgctgatcgacgctagctttgggtttgaaatggagatgtttgagtttctaaacatctgtcaggcccatggtttcccaaagatcctgggagttcttactcatcttgatagctttaaacacaacaaacaactgaagaaaactaagaaacggctcaaacatcgcttttggaccgaggtgtaccaagacaaggttggactgactcacgagcttgtgcagtctctgatttccacttactccacaatcgatgccaaaatggcctcttctcgtgtgacgctgttgagcaattcaaaacccctggggtcagaggcgatcgataatcagggggtatcactggaattcgaccagcagcaaggatcagtctgtcccagcgaatcggaaatttacgaggccggagcggaagaccgtatggccggagcccctatggcagcagccgtccagccagcagaggtcaccgtggaggtaggcgaggaccttcacatgcatcaggtccgtgaccgtgaaatgcctgaggttgtggagatcaggcgctccaactgtacgaatcattgtgatcttggcgacaccagttcctaccatactaaagtgtcaacagtgcacatcatgaaaaaaagaaatgggggtgggagcctgaataactatagctcttctattcccccaactccctctacctcccaagaggaccctcaattttctgttcctcccaccgcaaatacgccgacaccagtgtgcaaacggtccatgcgttggagcaatctcttcacatcagaaaagggatcagaccccgacaaggaacgtaaagcccctgaaaatcatgcagacacaatcgggtccgggagggcaatcccaatcaagcagggaatgctgctcaaaaggtctggcaagtggctgaaaacatggaaaaaaaaatatgtgaccttgtgctcgaacggcgtactgacctattatagttccttaggagactatatgaagaacattcataaaaaggagatcgatctccgcacgtccaccataaaagtacctggaaagtggccaagcctggctacctccgcctgtgctccaatctcctcctctaagagtaacggcctgtcgaaagatatggacaccggcctaggcgactccatttgtttttctcctggcatctcgtctaccacgagtcctaagctaaatccgcctccttctcctcacgccaacaaaaagaaacacttgaaaaagaagtccacgaacaacttcatgattgtgtcagctaccgggcagacctggcacttcgaagctacaacatacgaagaacgggacgcatgggtccaggctatacagtctcagattctggcaagcctgcaatcctgcaaaagctcaaagtccaagagccagctgaccagccagagtgaggcaatggcactgcaaagcatccagaacatgcggggaaacgcacattgcgtcgattgcgagacccagaaccccaaatgggcctcgttgaacctcggagtcttgatgtgcatagagtgcagcgggatccatagatcctttggcactcggctgagcagagtgcgctctttggaactggacgattggccagtcgaactaagaaaagtgatgtccagcatcggcaatgagctggccaactccatttgggagggtagctcccagggacagaccaagccttcaatcaagagtactcgagaggaaaaggagtggtggatccggagtaagtacgaagaaaagttatttttggctcccctcccctgcaccgagctgtccttggggcaacaattactacgcgcaacgacagacgaagacttacagaccgctatactgctgttagcccacggcagtagagaagaagtcaatgagacttgtggtgagggagacggttgtacagccctccacctggcatgccggaaggggaatgtcgttctagaacaactcctcaccggatggacatcctggcccgaaatgccaacgggtacacagcggtag

SEQ ID NO: 53119 - DNA, 1977 bp, Artificial Sequence
  Description of Artificial Sequence: Synthetic coding sequence
atgggaaacattctgacctgtagggtccacccatctgtgtcactcgagtttgatcagcagcagggctccgtgtgtcccagtgagagcgagatatacgaggcaggcgcagaggatcgcatggccggagctcccatggccgctgctgtgcaacccgctgaggtgactgtggaagtgggcgaggacctccatatgcaccaggtgcgcgatcgcgagatgcctgaggccctggaattcaatctgagtgcaaatcccgaagcctctactatatttcagcgtaacagtcagaccgatgctttggagttcaacagctcggccaacccagaggcgtctaccatcttccagcgcaattcgcagaccgatgtcgtggaaatccgcagatcaaactgcaccaaccacgtgtctacagaaagattctctcagcagtacagctcttgcagcaccattttcctggatgattccacagcgatccaacactatctgaccatgaccatcatatctgtcacactggaaattccccaccacataacccagagagatgcagatcgcagcttgtccatacctgacgagcagctccacagttttgctgtttcaacggtgcacattatgaagaaaaggaacgggggaggcagtttgaacaactacagctcttccattccaccgaccccctctaccagccaggaggacccacaattttcggttccccctactgcaaacacacctacccccgtttgtaaaaggtctatgcgctggtctaacttatttacttccgagaaggggtctgaccctgacaaggaacgcaaagcaccggaaaatcacgcggatacaattggatccggacgcgctattccaatcaaacaaggcatgctgctcaagcggagtggaaaatggctaaaaacttggaagaagaaatacgtgactctctgcagcaatggggttctcacctactacagctctcttggtgattacatgaagaacatacacaaaaaagaaatagatctcaggacatccacaatcaaagtccctggaaaatggccctcactcgccactagtgcctgcgccccaatctcctcctcaaagtctaatggcttatcaaaggatatggatacgggactgggagactctatctgtttctcacctggaattagttcaacaacatccccaaaattaaatccacccccatcccctcatgcgaacaagaagaagcacctcaaaaaaaagagtactaataatttcatgatcgtctcggcaacaggacagacgtggcactttgaggccaccacttacgaggagcgagacgcatgggttcaggccatccagtcccaaatcttggcctcactccagagctgcaagtcatcaaagtccaagagccaacttacaagtcagagcgaggccatggcactccagagcatacagaacatgagaggtaatgcccattgtgtagattgtgaaacccaaaacccaaagtgggcatccttgaatcttggggtcctgatgtgcatagaatgttccggaattcaccgctccttcggcacacgcctgagtagagtgagatctcttgagcttgacgattggcctgtggagctcagaaaagtcatgtccagcatcggcaacgaactggccaatagcatctgggaagggtctagtcaggggcagaccaagccgtccattaaaagtactagggaagagaaagagtggtggatcaggtctaagtacgaggagaaactgtttctggcccctttgccttgcacagaattaagcttgggccagcaactactgcgtgcgactacagacgaggacctgcagacagcaatactgttgctcgcccacggttctcgggaggaagtgaacgagacatgtggagaaggagatggttgcaccgctctccacttggcctgtagaaaaggcaacgtggttttggaacagttactgacaggatggacgtcctggcctgagatgcccacgggcactcagcgttag

SEQ ID NO: 53120 - DNA, 4635 bp, Artificial Sequence
  Description of Artificial Sequence: Synthetic coding sequence
atggcagctccacaggacctggatattgcggtgtggctggctaccgtccacctagagcagtacgccgatacattcagaagacatgggttggccaccgctggcgctgctcgaggtctggggcacgaagagttgaagcagctgggtatatccgccacaggtcaccgaaagcgcatcctgcgtcttctgcagaccgggactgaggaggggtcactggaccctaaatcagatagtgctatggaaccatctccttcgccggcaccacaggcccagcctcccaagcccgtcccaaagcctcgtaccgtattcggcggtctgtccgggccagccaccacacaacgcccaggattaagtcctgcattaggaggccctggagtttcacgatcacccgagccatcacccaggcctccaccactgcctacaagcagttcagagcagtcttcggcattaaatacagtggaaatgatgcctaacagtatctatttcgggttagacagtcgaggacgggcacaagccgctcaggacaaagcacccgacagttcacaaatcagtgccccaacccccgctctgcgccctaccacagggactgtccacattatggatcccggttgcctgtattatggggtacaacccgtgggcacaccaggcgctcctgatcggcgagaatccaggggcgtgtgccagggcagagccgagcacaggttatctcggcaagaccttgaggctcgcgaggatgcgggatacgcatccctggagctgccaggcgactccacactcctatcgcctacgctcgaaactgaggaaacgtccgacgatctcatcagtccctacgcgagtttttcatttacagctgatcgactcactcccttgctctccggatggctcgacaagttatcgccacagggaaattacgtcttccagcgtcgcttcgtgcagtttaatggacgcagcctgatgtactttggatcggataaggatcctttcccaaaaggcgtgatcccacttaccgcaattgagatgacacgtagctccaaggacaataagtttcaagtaattacaggtcaacgcgtttttgtgttccggactgaaagtgaagcccaacgggacatgtggtgctctacactgcaatcctgtctgaaagaacagcggcttctcggtcacccccgacctcctcagccaccacggcctctgcggacaggtatgctggaactgcggggtcataaggctaaggtcttcgcggctttgtcacctggcgaactcgccctgtataagtccgagcaggcattttccctgggaataggtatctgctttatagaactccagggttgcagcgtcagagaaaccaaaagtcgcagctttgacctgttaaccccacataggtgttttagttttaccgctgaaagtggcggagcacgacagtcctgggcagccgcactgcaggaggccgtgactgaaacactgtctgactatgaggtggcagagaagatctggagcaatagagctaatagacaatgtgcggattgtggtagctcacggcctgactgggccgcagtaaacttaggtgtcgtgatctgtaaacagtgtgcgggacagcaccgggctttgggtagcggcatttctaaagtacagtctttgaagctggacacttcagtatggagtaacgaaatcgtgcagttatttatagtgctcggaaacgaccgcgctaaccggttttgggccggaactcttccccctggagagggactacatcctgatgccactccgggtcctaggggcgagttcatcagtaggaagtacaggctcggcctgttccggaagccgcacccccagtatcctgatcactcccagcttttgcaagccctatgcgcagcagtagcacgcccaaatctgctcaaaaacatgacacaactattgtgcgtcgaggcatttgaaggcgaagaaccctggtttcccccagcgcctgacgggagctgccccggtctcctgccatcagatccttccccaggcgtgtataatgaggtggttgtgcgagcgacatactcgggttttctctactgctcgccagtatctaacaaagcaggcccatcccctcccaggcgtgggagggacgctccacctcgtttatggtgtgtcttaggagctgccctcgaaatgttcgcctctgagaacagccccgagccattatctctgattcaacctcaggacatagtctgtctgggcgtgtccccacctccgacggacccaggagatagatttcccttttctttcgaattaatactcgctggaggacgaattcagcactttggaactgatggcgcagactctctggaggcctggacgagtgcagtgggcaagtggttcagtccgctcagctgtcaccaactcctcgggcctgggctgctgagactgggcagattatggctacgatctccttcccacaccgccccagctccaggcctgtggctaagcggtttcggactccttagaggcgatcatctctttctgtgctccgccccaggtccaggtcctccagcaccagaggatatggtgcatcttaggcggctacaggagatttccgttgtatcagccgctgatactccagataagaaagaacatcttgtcctcgtggaaacgggtagaacgctttatttacagggtgaggggaggctcgacttcacagcttggaacgctgcaatcggcggagctgccggtggagggggaaccggtctccaggagcagcagatgtctcgcggagatattccaattatagtcgacgcctgcattagcttcgtgactcagcacgggctccgacttgaaggggtgtatagaaaggggggtgcgagggcgaggagcttgagactgttggccgagttccgcagggacgccagaagcgtaaagttgcgacccggtgaacattttgttgaggatgttacagataccctgaagcgcttctttagggagctggacgatcccgtcacgagtgcgaggttgttgccgaggtggagagaggcggcagagttgccgcaaaagaaccagagactggagaaatacaaggacgtgatcggttgtctccctagagtgaaccggcgaacccttgctacccttatcggacacctgtaccgggtgcagaagtgtgcggctctaaaccagatgtgcacccgtaacctcgcactgctgttcgcccctagtgtttttcaaacagatgggagaggggagcacgaggttagggtcttacaggaactgatcgatggatatatttctgtgttcgatatcgattcagaccaagtcgcccagattgaccttgaggtctcccttataactacttggaaggacgtgcagctcagtcaagccggagatctgatcatggaagtgtatatcgaacaacagcttcctgacaattgtgtcacactgaaggtttcccctacactaactgcggaggagttgaccaaccaggtcctagagatgaggggaaccgctgccggaatggacctttgggtaaccttcgagatcagagagcacggtgagctcgagcgcccactgcaccccaaagagaaggtcctggaacaggccctacagtggtgccagttgccagaaccatgcagtgcgtccttgctgctcaagaaggtacctctcgctcaggccggttgcctgttcacaggaatccggagagaatcgccccgagtaggcctccttaggtgccgcgaagagcctccacggctactaggatctcggtttcaagagagattctttctcctgcggggtcggtgccttttgctgctcaaagagaaaaagtctagcaaaccagaaagagaatggcctttggagggtgccaaagtgtacttgggaatcagaaaaaagctgaagccccctacaccttgggggttcacactgattctggaaaagatgcacctctacctgagctgtaccgatgaggatgagatgtgggattggaccacgagcatcttgaaagcccagcatgacgatcaacagcctgtcgtgctaaggcgacactcctcaagcgacttagcccgacagaagtttgggactatgccactcctgccaattcgaggggatgacagtggggctactcttctcagcgcaaaccagacactgaggcgcctacataaccggaggacactatccatgttcttccctatgaagagctctcagggtagcgtcgaggagcaggaggaactagaggaaccagtttacgaagagcctgtatatgaggaggtcggcgctttcccagaactcattcaggatacaagcacttcctttagcaccacccgggaatggaccgtcaagcctgaaaatccccttacctctcaaaaatccctagaccagcccttcttgagcaaaagttcgacactgggccaggaggaacgcccaccggagccccctccaggtcccccttcaaagtcttcgccgcaagcaaggggctccctggaggagcagctgctccaagagttatcctcgctgatcctgcgtaagggcgaaactaccgctggtctgggctctcccagtcagccatcttcccctcaaagtccctcccctaccggccttcccacacaaacgccagggttccccacccagcctccatgcacttcgtctcccccttcctctcaacccctgacatag

SEQ ID NO: 53121 - DNA, 1422 bp, Artificial Sequence
  Description of Artificial Sequence: Synthetic coding sequence
atggctgccccacaagatctcgacattgccgtgtggttagccaccgttcacttagaacagtacgctgatactttccgtaggcatggactggccacagcaggagctgcaagaggactcggccacgaagagctgaagcagctgggcatcagtgcaacaggacatcgcaaaaggatcctgaggctgctgcagaccggcaccgaggagggttcacttgacccgaagtcagattccgctatggagccatcgccgtcacccgcaccacaggctcaacccccaaagccagtccccaaaccaagaaccgtattcggtggcctctcagggcctgcaacgacacagaggccaggtttgagcccggcactcggtgggccaggagtgagcaggtcacccgagccctccccgaggcctcccccactccccacttcctcctccgaacagtcaagcgccctgaatacagtagagatgatgcccaacagcatctattttggcctcgactccaggggccgagctcaggctgcccaggataaagcacctgacagcagtcagattagtgctccaacccccgctctgcgacctactacgggtacggtccatataatggatcctggatgcctttactatggggtgcaaccggtcggaaccccaggagcccctgaccgcagggaatctcggggtgtgtgccaggggagggccgagcacagactgtctcgacaggatttggaagccagagaggatgcaggatacgcatcgttggaactgccgggtgacagcacactgctgtctcctacattagaaaccgaggaaacctccgacgatcttatctctccttatgcttctttcagcttcactgctgaccggctgacgcctctgctgtcaggatggctcgacaagctgtctccccagggaaattacgtgtttcagcgacgctttgtgcagtttaacgggaggtctctgatgtacttcggaagcgataaggaccccttccctaaaggcgttattccactgacggcgatcgaaatgacccggtctagtaaggacaacaaattccaagtgattacaggacagcgggtcttcgtctttcggactgagtccgaagcccagagggacatgtggtgctctacactgcagtcctgtttaaaggaacagcgcctcctggggcaccctcgtccaccacagcctccgcgacccctccggacaggaatgcttgagttacgtggccacaaggctaaagtcttcgccgcactttcccccggagagctggctttatacaagagcgagcaggcattctcacttggcattggcatctgttttatcgagttgcagggctgctcagttagagagaccaagagccgatctttcgacctccttactccccacagatgcttttcctttacagccgagagtggcggagcccgtcagtcttag

SEQ ID NO: 53122 - DNA, 4128 bp, Artificial Sequence
  Description of Artificial Sequence: Synthetic coding sequence
atggagccctcaccttcccccgctcctcaggctcagccccctaaacccgtcccaaagcccagaacggtgtttgggggtctgtccgggcctgccaccacgcaacggcctggcctttcacctgctctcggaggacccggtgtttctcggagtcccgagccctcacccagacctcctccacttccaacctctagtagtgagcagtcgagcgctctgaacacggttgagatgatgccaaactctatttactttggattagactctcggggaagggctcaagcagctcaggacaaggcccctgactcctcacagatctccgcgcctacgcctgcgctgcggcctaccaccggaacggtgcatataatggacccagggtgcctgtactacggtgtacagccagtgggaaccccaggcgctcctgacagacgggagtctaggggtgtgtgccagggaagagcagagcaccgcctaagcaggcaagacctcgaggccagggaagatgccggttatgcctcattagagctgcctggggattctactttgctttctccaactctggaaacagaagagacatcggacgacctcatatccccatacgcatcattttcatttactgcagaccgcctgactccattgctatccggctggctggacaagctcagcccgcagggaaactacgtgttccaaaggcggttcgtgcagttcaacggacgctctctaatgtatttcgggtccgacaaagacccattcccaaagggggttattcccctcactgccattgagatgaccaggagctctaaagacaataagttccaagttataacgggccagcgcgtgtttgtgtttagaaccgaatccgaagctcaacgggacatgtggtgctctacgctccagtcttgcctcaaggagcagcgcttactcggtcatcctagacctccacagccacccagaccgctcaggacgggcatgttggaactgcgcggtcataaagccaaagtgttcgcagccctgtctcccggagaactcgccctatataagtcagaacaggccttcagcctgggaattgggatctgcttcatagagctacaagggtgctctgtaagagagaccaagtcccgaagttttgacttactgacccctcacaggtgtttctccttcacggcagagagcggcggtgcaaggcagagctgggccgcagcactccaagaggccgtaacagaaacccttagtgactacgaggtcgccgaaaaaatctggtccaatcgggctaatcgccagtgtgcagattgcggaagtagccgtcccgactgggccgctgtgaacctgggtgtcgtgatatgtaaacagtgcgcaggccagcatcgcgctctgggaagtggaatttccaaagttcagtcactgaagctggatactagtgtatggagcaacgaaatcgtgcagctatttatagttctgggcaacgaccgggcaaaccgtttctgggccggtacgttacccccaggcgaaggattgcaccctgacgcaacgcccggaccacggggagagttcatctcgagaaaatatcgccttggcctctttcgtaagcctcacccgcaataccccgatcactcccaactcctacaggcattatgtgctgcagtggccagaccgaacctgttgaagaatatgacgcaactgctctgcgtcgaggctttcgaggatccatcccctggggtctataacgaagtggtggtgagagccacctacagcggcttcctatactgtagccctgtgtcgaacaaggcgggaccatcccccccacgacggggacgagacgcccctccgaggctctggtgtgtcctaggcgcagcactcgagatgtttgccagcgaaaactcccccgagccactgtctttaatccagccccaggatatcgtgtgcctgggagtgtctccgccacctactgacccaggggatcgcttcccgttttcgttcgagctgatcctagctggtggacgcatacagcacttcggtacggatggggcagatagcctcgaagcttggacaagtgccgtcggcaagtggtttagccctctatcctgtcatcagctactcggccctgggctgctgagactggggagactgtggctgcgctctcccagtcatacggctcccgcaccagggctgtggctaagcggtttcggcctgcttaggggagatcacctgttcctttgttcggcaccaggccctggccctcctgcacctgaagatatggtacatctgaggcgactccaagagatctccgtcgtgagcgcggctgacacacctgacaaaaaggagcacctcgtgctagttgaaaccggaagaaccctgtatttacagggagaggggaggcttgattttactgcgtggaacgctgctattggaggtgcggctggaggcggaggcacaggcttacaagagcagcagatgtctcgcggagacattcctatcatcgttgatgcatgcatcagcttcgtaacacagcacgagttgccacagaaaaatcaacgcctcgaaaagtacaaggacgttataggatgtctgcccagagtaaatcggagaacactggctacactgataggtcatctgtaccgcgttcagaagtgcgcagcattaaatcaaatgtgtactcgcaatcttgcactgctctttgccccttcagtatttcaaactgacggcaggggggagcacgaggtgagagtgcttcaagaacttatcgatggttacatttcagtgtttgacattgactcggatcaggttgcccagatcgacttagaagtgtctctcattaccacttggaaggatgtgcagctgtcacaggctggcgacctgattatggaggtgtacattgaacagcagcttcctgacaactgcgtaaccctcaaggtgtcccccactctgactgctgaagagctgaccaaccaagtgctggaaatgcgcggaactgcagcaggcatggacctgtgggtaaccttcgagattcgggaacatggtgaacttgagcggcctctgcatccaaaggagaaggtcctcgaacaggcgcttcagtggtgccagcttcctgagccttgtagcgcaagtttgcttttgaaaaaagtcccactggcccaggccggatgtcttttcacaggaatcagacgtgaaagccctagggtggggctgttgagatgtagagaggaacctccgaggctgcttgggtccagatttcaggaaaggttcttcttacttcgcggacgctgcctgctgctcctgaaggagaaaaaaagttccaaacctgagagagaatggcctcttgaaggcgctaaggtctaccttggaattagaaaaaagctgaaaccacccaccccatggggctttaccttaatcctcgagaaaatgcatctatatttatcttgtaccgacgaagacgagatgtgggattggaccacaagcattctgaaggcccagcacgacgaccagcaaccagtcgtgctcaggcggcacagtagctctgatctagccagacagaaatttggcaccatgccgctgctaccaattagaggcgatgattccggggcaacactactgtctgcgaatcagaccctccgtcggttgcacaacagacgcaccttgagcatgttttttcctatgaaatcatctcagggatcggtcgaggagcaggaggaactcgaagaacccgtctatgaagaacccgtgtatgaagaagttggcgctttcccagaactcatacaggacacctcaacttcattcagtacaacccgagaatggacagtcaagccagaaaacccactcacatcccagaaatccctggatcagccattcctgtccaaatcctctacattaggccaggaggagcggcctccagaaccgccacccggaccgccttccaagagctccccccaggctcggggtagtctggaggagcagttgctgcaggagctttcttcactgatcctgaggaagggggaaaccacagcaggactggggtcaccaagccagccatcaagtccacagtcccctagtcctaccggtcttcccacccagacacccggtttccccacacagccgccatgtactagttctccaccttcaagtcagcctttgacctag

SEQ ID NO: 53123 - DNA, 3582 bp, Artificial Sequence
  Description of Artificial Sequence: Synthetic coding sequence
atgacaagaagtagcaaggacaataaatttcaagtgatcactggtcagagggtcttcgtgtttaggacagaaagcgaggcgcaacgcgacatgtggtgtagcacgttgcagtcctgtctgaaggagcaaaggcttcttggccatcccaggccccctcagcccccacgtcctctgcgaacaggcatgctggagctgcggggtcacaaggctaaagtcttcgcagcactcagcccaggcgagctggccctgtacaagtctgaacaggcgttttctctcggcatcggaatatgttttatcgagctacagggatgcagtgtgagagagaccaaatcccggtccttcgacttacttacacctcaccgttgttttagttttaccgccgaaagtgggggagctaggcagtcctgggctgctgcgctgcaggaggccgttacagaaacccttagtgactatgaggtggcggaaaagatatggtcaaacagagccaaccggcagtgcgccgactgcggtagtagtaggcccgactgggccgcagtgaatctcggagtcgtaatctgtaaacagtgcgcaggtcagcaccgggctcttggcagcggtatcagcaaggtgcaatccctaaagcttgatacaagcgtgtggtctaacgagattgtgcaactttttattgtactcggcaatgatagagctaatagattttgggctgggactctcccccctggcgaaggcctgcacccagatgccacacctgggccacggggtgaattcattagcaggaagtacagactgggcctgttccggaaaccacacccgcagtatccggaccattcacagctgttgcaagctctgtgtgctgccgttgcccgacctaatttgctaaaaaatatgacgcagttgttatgtgtggaagcctttgagggggaagaaccatggttcccgccagctccagatggttcttgtcccggactactgccaagcgatccttcccccggtgtctacaacgaggttgttgtgagagcaacctattcgggcttcttgtattgctcccccgtctctaacaaggccggaccctctccaccgaggcggggacgcgatgccccaccccgtttatggtgcgtacttggcgctgctctcgagatgtttgcctctgagaacagcccagaacctcttagtttgatacaaccgcaagacattgtttgtttaggtgtctctcccccacccactgacccgggtgatagattccccttcagcttcgaattaatactggccggtgggcgtatccagcactttgggaccgacggcgctgattctctggaggcttggacaagtgccgtagggaagtggttctctcccctgagctgccaccaactccttgggccaggactcctgcgcctgggccgactctggctgcgtagcccgtcacatactgctcctgccccagggctgtggctgtcaggatttgggctgctgaggggagaccacttgtttctctgcagtgcaccaggacctggacccccagccccagaggacatggtgcacttaaggcggctgcaggagatttccgtggtttcggccgcagacactccggacaaaaaagaacaccttgtcctagttgagacgggaagaaccctgtacctccagggcgaaggcagattagattttaccgcgtggaatgctgccattggtggcgcagccggaggagggggaacagggcttcaagagcagcagatgagtcggggagatatcccgatcatcgtggatgcctgcatcagctttgtgactcagcatggacttcgcttagagggtgtttataggaaagggggagctcgcgctcgttccctccggctgctggccgagtttagacgggatgctagaagtgtgaagcttcggcctggagagcacttcgtagaggatgtgactgacacactgaaacgcttttttcgcgaattagacgaccctgtcacatccgcccgtctgctgcccagatggcgggaggcagcagagctcccgcagaagaaccaacgcctggaaaagtataaagacgtgatagggtgtctgcctagagtcaatagacggacactagctaccctgatcggtcatctgtatcgtgtgcagaagtgcgcagccctcaatcagatgtgtactcgaaatctagcactcctcttcgcaccttcagtgttccaaacggatggccgaggcgaacacgaagtccgagtactgcaggagctgatagacggatacatcagcgtcttcgacatcgacagcgaccaggtcgcacagattgatctcgaagtctcgcttatcactacatggaaagacgttcagctgagtcaggctggggatctgattatggaagtgtacatcgagcagcagctgcctgacaattgtgtcaccctcaaggtatcacccacgctcaccgcagaggagctgacaaaccaggtcctcgagatgcgaggaactgccgcaggcatggatctctgggtgactttcgagatccgggaacacggcgagctggaacgtccgctgcacccaaaagaaaaggtactggagcaggcactgcagtggtgtcagcttccagaaccatgctcggcgtcattgttgcttaagaaagttcccctggcccaggcgggttgcttgttcaccggtatccgtcgggagagcccgagagtgggccttctacggtgtcgagaagagccacctcgactcttgggcagccgttttcaggagcggtttttcctcctccggggacgctgcctgcttctactgaaggagaaaaagagcagtaagccggagcgggaatggcccctggaaggggctaaggtgtacctaggcattaggaagaaactcaagccaccgactccctgggggtttacgttaattctggagaaaatgcatctgtacctgtcttgtaccgatgaggatgaaatgtgggattggacaaccagtatactcaaggcacagcacgatgatcagcaaccagttgtgctgaggcgccattcctcatcggaccttgcacggcagaaatttgggaccatgcctctcctgcccatccgtggagatgatagcggggctaccctactgtctgcaaaccagactctgccaatgaagtcgtcacaggggtctgtggaggagcaggaagagttggaagagcctgtgtacgaagagcctgtttatgaagaagtgggagctttcccagagctgattcaggacacaagcacttcattctccactacccgagaatggaccgtgaaacccgaaaaccctttgacctcacagaagtcattggaccagccctttctcagcaaatcatctacgctgggccaggaggaacgccctcccgaacccccacccggaccccctagcaagagttctccccaggccagagggtcgctggaggagcaactattgcaagagttatcctcccttatcctgcggaagggggagaccacagccggtctcggctccccttcccagccatcttctccgcagagccccagccccacagggcttcctacacaaacaccgggttttccaacccagccaccatgcactagttcacctccttcaagtcagccattgacatag

SEQ ID NO: 53124 - DNA, 1116 bp, Artificial Sequence
  Description of Artificial Sequence: Synthetic coding sequence
atgttgatggcatctaccactagcgcagtgccaggccacccaagcctgccatctctaccttcgaactcctcccaggaacggccattggacacacgcgatcccttgctggcccgagccgagctggcactgttgagcattgtatttgtcgccgtagctctgtccaacggtctggtcctggcagccctggcaagacgtgggagaagggggcactgggccccaattcatgtattcatcggacacctgtgtcttgcggatctagcagtggctctcttccaggttctccctcagctggcctggaaggccaccgatcgcttcagagggcctgacgccctgtgtcgtgcagtgaagtacctacagatggtaggaatgtatgccagttcttatatgatattagcaatgactctggatcgtcacagggcgatatgcagacctatgctagcataccgacacggatccggggcacattggaaccggcctgtgctggtggcttgggcgtttagtctactcctatctcttccccaactgttcattttcgcacagcgtaacgtggaaggtggaagtggagtgacagactgttgggcctgctttgccgaaccctggggccgtcgaacctatgtgacgtggattgcgctgatggtgtttgtagctccaactttaggcatagccgcatgtcaggtgcttatcttccgggagatccatgcctctttggtgccgggtccttctgaacgacctggaggacggaggaggggaaggcgcacggggagtccgggagagggagcacacgtgtccgccgctgtagccaagactgtgcgtatgactttggtgatcgtggtggtgtatgtcctgtgctgggcacccttcttcctggtgcagctctgggccgcttgggatcccgaggcaccactggaaggagccccttttgtgttactcatgctcttagcctctttgaactcctgtactaacccctggatttatgcctctttttctagctcagtgtcgagtgaactgcgctcgctgctgtgttgcgcgaggggacgcactcccccttctctcggcccacaggatgagagctgcactactgcaagtagcagtctggccaaggacacctcttcctag

SEQ ID NO: 53125 - DNA, 444 bp, Artificial Sequence
  Description of Artificial Sequence: Synthetic coding sequence
atggggacccccgctagcgtcgtgtcggagcctcccccatggcaggcacctatcgaggccagaggcaggaagcaagccagtgccaatatttttcaggacgctgaactgctgcaaattcaggcccttttccagcgctccggagaccagctggccgaggagcgtgcacagattatatgggagtgtgctggggatcacagagtggcggaagcccttaagcggttacggagaaagcgccctcctcggcagaagcccttggggcacagcctccaccactgttcacggctacgcattttggagcctcattcagcactcgccaatccccagtcagcaacagagactgcgagctccgagcagtacctccacagccgcaagaaatctgcacgaattcggcgaaattggcgtaaaagcgggccaacaagctacttgcatcagatcaggcattag

SEQ ID NO: 53126 - DNA, 1305 bp, Artificial Sequence
  Description of Artificial Sequence: Synthetic coding sequence
atggctgctagtgacactgagcgagacgggctcgcccctgagaagactagccctgatagggacaagaagaaggaacagtctgaggtgagcgtaagtcctcgggcttccaaacaccattactcacgatcaagaagcagatcacgtgagcggaaaagaaaatccgataatgaggggagaaagcataggagtagatcgcgcagtaaagagggaaggcgacacgaatccaaggacaagtcctccaagaagcataagtcagaggaacacaacgacaaggaacactctagtgataaggggagggagaggctcaactcttctgaaaatggagaagacagacataagaggaaagagaggaagtctagtcgcggtcgttctcacagcaggtctcgatcccgggaacgaaggcatagaagtagatcaagggagcgaaaaaaatcacggagccggtccagagagcggaaaaagagccgcagccgcagccgtgaacgtaagaagtcccggtcccgcagcagagaaagaaagcgcaggatacggagtcgctcacggtcaaggtctaggcatagacatagaactaggtcgcgatctcggacccgctctagatcacgggacaggaagaagagaatcgagaagcccaggcggtttagtcggagtctgagccgcaccccaagtccacctcccttccgcggtcggaacaccgctatggacgcccaggaggcgcttgcccgacgtctggagcgggctaaaaagcttcaggagcagcgagaaaaagagatggttgaaaaacaaaaacagcaggaaatagcagcagctgccgctacagggggaagtgtccttaatgtggctgccctcctcgcatcaggcacgcaggtcactccacagatcgccatggcagcccagatggccgctttgcaggccaaggctctggctgagacaggtatcgctgtcccaagctattataaccccgctgctgtcaaccccatgaagttcgccgaacaggaaaagaagaggaaaatgctgtggcaaggcaagaaggagggggataagagccagagtgccgagatctgggagaaactcaattttggcaataaagaccagaacgtgaaattccggaagcttatgggtattaagagcgaggatgaagccggttgctcttccgtggatgaggaaagttataaaaccttgaaacaacaagaagaggtgttccgcaacttggatgcccagtatgagatggccaggagtcagacacacacccagaggggaatgggcctgggtttcacctctagtatgcggggtatggacgccgtctag

SEQ ID NO: 53127 - DNA, 1161 bp, Artificial Sequence
  Description of Artificial Sequence: Synthetic coding sequence
atgaaggaggaaaatacgggtgcgggtgcggaggccaaacgaacaaattttttcctcaagcaggggaggcggcatgagagcaaggacaagtctagcaaaaagcacaagtcagaggagcacaacgataaagaacattctagtgacaagggtagggaaaggcttaactctagcgagaatggggaagacaggcacaagcgcaaagaaaggaaaagctctaggggaagaagccatagccgctcacgctctagggaacgccgtcatcggtcacgctcccgggaaaggaagaaaagccggtctcgatcaagagagaggaagaagtcacggtcgcgctcccgtgagcgcaaaaaatctagatcaaggtctagggagcgaaaacgacgaattaggagccgttcacgctcacggtctcggcaccgccaccgcaccagaagccgcagcagaacgcgcagccggtccagggatcgaaagaaacgaattgagaagccacggaggttcagcaggtcattgtcccgtacaccgagtccacccccatttagaggacgtaacaccgctatggatgctcaggaagcgctggcacggagactggagcgtgcgaaaaagcttcaggagcagcgggagaaggagatggtagagaagcagaagcaacaggaaattgccgcagccgcagcaaccggaggcagtgttttgaacgtggccgcactgctggcttctgggactcaggttactcctcaaatcgctatggcagcccaaatggctgcgctgcaggccaaggctctggccgagacagggattgccgtgcccagctattacaacccggcagcggtaaatcctatgaagtttgctgagcaggagaagaagaggaagatgctttggcagggcaaaaaggagggtgataaaagccagagcgctgagatctgggagaaattaaattttggaaataaggaccaaaacgtaaagttcagaaagttaatgggcatcaagtctgaagacgaagctggttgttcaagcgtggacgaggaaagttacaaaactcttaagcagcaggaggaggtctttagaaacctggacgcccagtacgaaatggctcgctcacagacacatactcagcgcggaatgggcctgggattcacttcatctatgcgcggaatggatgcggtgtag

SEQ ID NO: 53128 - DNA, 1110 bp, Artificial Sequence
  Description of Artificial Sequence: Synthetic coding sequence
atggctgcttctgacacagagagggacggcttggccccagagaagacatcccccgatcgcgataaaaagaaggaacagtctgaggtgagcgtgtctccccgagccagcaaacaccactatagtagaagtcgaagtcgcagtagagagaggaaaagaaaatcagacaatgagggtagaaagcatcgaagtcgatcaaggtcgaaggagggcagaagacacgaatctaaagataagagcagcaagaagcataagtcagaagagcacaacgacaaagaacattcttctgataaaggtcgggagcgccttaatagctctgaaaatggagaagatcggcacaaacggaaggagaggaaaagtagtcggggacggtcacattcaaggtctcggagtcgggagagacggcacaggtcgcggagccgagagcgcaagaaatccaggtcccggtcccgagagaggaaaaaatcgcgatcccgttccagagagcgcaaaaagtccaggtctcggagtagggagaggaaacgacggatcagaagccgcagccgatcgcgctctcgacatcgccatcgcacccggagcaggagccgcacacggtctcgctctagggacaggaaaaagagaattgaaaagccacgacggttctcccggtcccttagccggacaccatcaccccctccgtttcgcggaagaaatactgcaatggatgcacaggaggcactcgcaaggagactcgaacgtgctaagaaattgcaggaacagcgcgagaaagaaatggtggagaaacagaagcagcaagaaattgccgcagcggctgccgctactggaggaagcgtactcaacgtcgccgcactgttggcatccgggacacaagtcaccccacaaatcgcgatggctgcccagatggccgcactgcaagcgaaagctctcgctgaaaccggcatcgctgtaccaagttactacaatcctgctgccgtgaatcccatgaaattcgcagagcaggaaaaaaaacgaaagatgctgtggcagggcaaaaaggaggggttcatccccaactatctggagatcatggggaagatcgagttctggaagcaggggcagaacgtgaagttttag

SEQ ID NO: 53129 - DNA, 333 bp, Artificial Sequence
  Description of Artificial Sequence: Synthetic coding sequence
ggggctcgatccccaggcagtacacatcaaggatccttagcctccggcgtgctcccgattaagtgtagccacgtcgaatttgggatgtggaagggcggaaggagccaccccttcctgccccattccagtcgttgtgcaggatcgggcggacaactggactcaattctgccccaccagagtcctgcctggggaccatggggatgcaaagatctgagtagcgggtttccgtcatttttgacctcttcgatcctttggaaatcggcagtggtccgggaaccccatatctccccacatcaggctcccccttataagacgagcgactgtataacctag

SEQ ID NO: 53130 - DNA, 1104 bp, Artificial Sequence
  Description of Artificial Sequence: Synthetic coding sequence
atggggaagagcatcccacagtatctggggcaattagatattcgaaaatcagtggtcagcttggccaccggcgctggagccatttacctgctctataaggcaattaaagccggaatcaagtgtaaaccaccactctgtagcaactctccaatctgtatcgcaagggagtgcccaggcccaggcgaacgggcactaccgcaggaagcacctgccccagaggcctcagccgtaggtggccctaaggggttagcagtcgagagggagcgccatggcagggacagtggggagcttcggagactcctgaatagcttagagtgcaagcaggatgaatatgcaaagagcatgattcttcattctattacacgctgcgtttaccttttagaggctgaagctagcgcctgcactacagacgatatcgtgttgctagggtacatgctcgacgataaagataacagcgtcaaaactcaggcattaaataccctcaaagccttttccgggatccggaaattcagattaaagattcaagagcactctataaaagtcttggagcttatctcgaccatctgggataccgagttacatattgccggtctaagattgctcaacaatctccctctacccgactacgtgcatccacagctacggagagtgatgcccgcactcatggagattctgcagagcgactatatactggcacaggtgcaggctgtgcgacttctttcctatctagctcagaagaacgatttgctttacgatatccttaattgtcaggtgcacagtaattttctgaatctgtttcaacccacccagtcaggctctcttttatatgaagtgctggtttttgcagagcggctgagtgagggaagaaatgcaccccattatcatgtagtaaagtggcactacaacgagcagagcctgcacgaaagcctgttcggcgaagagtccaggctggcggatcgactgctggccctggtgatccatcccgaagaggatgtccagattcaggcctgtaaagttatcgttagtctccaatacccccaggacctcagagccaggccgtcctcttgccaaccaagccgtagctacttcaaaaacacagaatag

SEQ ID NO: 53131 - DNA, 1023 bp, Artificial Sequence
  Description of Artificial Sequence: Synthetic coding sequence
atgggaaaatccattccgcagtacctgggccagctggacatccgcaaatcagttgtcagtttagcaaccggcgctggggcaatttacctgctgtataaagctatcaaggcgggaatcaagtgtaaaccacccctatgctctaacagccccatttgtattgcccgactggccgttgagagggagcgtcatggacgtgactctggggagctacggagacttctcaacagcctggagtgcaaacaggacgagtatgcgaagtcaatgatattgcactccattactagatgtgtgtaccttctggaagccgaggcatctgcctgcacaacagatgatatcgtacttctggggtatatgctcgacgataaggacaactccgttaagacccaggctctaaatacacttaaggcattctctggtatccgcaaattccgactaaaaatacaggaacacagcatcaaggtgttggaactgatttccacaatttgggacactgaactgcatatagccggtctgcgtctgctgaacaatctgcctctccctgactacgtgcaccctcagctacggagggtgatgcccgctctgatggaaattctgcaatcagactacatcctggcccaggtgcaggcagtgcgcttgttgagctatctggcccaaaaaaacgacttactatatgacattttaaactgtcaagtgcatagtaatttccttaatctgtttcaacctacacagtctggttctttgctttacgaggtgttagtgttcgctgagcgcctgagcgaggggagaaacgcaccccactaccacgttgtgaagtggcactataacgagcagtccctgcatgagtctctgtttggcgaggagtcaagactcgccgaccgcctccttgccctagtgatccaccctgaggaggacgtccagattcaggcttgtaaagttattgtaagccttcagtacccacaggacctccgagctaggcctagtagctgtcagccgagtaggtcatactttaagaataccgagtag

SEQ ID NO: 53132 - DNA, 993 bp, Artificial Sequence
  Description of Artificial Sequence: Synthetic coding sequence
atggggaaatccattcctcagtacctcggacagctggatatccggaagtcagtggtctcattagctacaggagcaggtgccatctatttgctgtataaggcaatcaaggccggaattaagtgcaagcccccactctgtagtaattcacccatttgtatagcaaggctcgctgtggaaagggaacggcatggcagagacagcggtgagctgaggagactgctaaattccttggaatgtaaacaggacgagtacgcgaaatctatgatcctacatagcatcacgagatgtgtatatctcctggaagccgaagccagcgcttgtacgacagacgatatcgtgctcctggggtatatgctcgatgacaaagacaactccgtgaagacccaggctttaaataccctgaaggctttctccggcatcaggaagttccgactcaagatccaggagcactcaataaaagttcttgagctcatctctacaatctgggatactgagttacacattgccggacttcgcttgctcaataacctgccgctgccggattacgtgcatccccagctgcgtcgcgtcatgcccgcattaatggagattttacagtccgactatattctggcccaggtccaagctgtccggctcctaagttacttagcacagaagaatgacctgttatacgacatcctgaattgtcagcctactcaatcagggtctcttttgtatgaagtgctggttttcgccgaaaggctttcagaaggaaggaacgctccacattaccatgtcgtgaagtggcactacaacgaacaatccctacacgagtccctgttcggagaggagtcgcggctggccgacagactgctcgccctggttatccatccagaggaagatgtgcaaattcaagcctgcaaagtcattgtaagcctgcaataccctcaggacctgcgggctcgcccatcatcttgccagccgtctaggagttattttaagaataccgaatag

SEQ ID NO: 53133 - DNA, 672 bp, Artificial Sequence
  Description of Artificial Sequence: Synthetic coding sequence
atgttgagccctaatgataaaatgttaggtaaacttgaccccttctatcagccatcagtgtcgaagcagaaaacaagtgcagagattatctccgaggctcgcaacgcccttcgtacggtcaggacacagcgcccattcacgccccaggaggcgcagaggaagctgttcggcccagcctccagtcggacctcggagaacaggcctccctcatcttttagcctgcacgcgtcttccttcgagtcctccgacagcagacccatttctggaacacgcctgtcgccacttgaattgaaaccaaaggtccccgcttcccccacgcgggaagaagattcatgcttctcttttcctaaacctcctgttgatccagccaaaatccgacgcgtgtccaatgccagagcaagactgtttcgcgcagccagccagcgtgcgctactgcccgacaggtctttgccgccatctgattctaaaaagacagtggaatccaaggagacagtcatgatgggtgacagcatggtaaaaataaacggaatctatctgaccaagtccaacgccatttgccacttaaagagtcatccactccaactgaccgatgacggaggcttcagcgagattaaggaacaagagatgttcaagggcactacgagccttcctagtcatttaaagaatggatag

SEQ ID NO: 53134 - DNA, 2109 bp, Artificial Sequence
  Description of Artificial Sequence: Synthetic coding sequence
atgatgggcgacagtatggttaagattaatggcatctaccttacaaagagtaatgcaatttgtcacctaaagagccaccccctgcagctcaccgacgacgggggtttctctgaaattaaggaacaggagatgttcaaaggaaccactagtctcccatctcatctgaagaatgggggagaccagggaaagcgacatgcaagggcttcttcatgcccatcctcctcagatctcagtagactgcaaaccaaagctgtacccaaggcggatttacaggaagaagatgccgaaattgaggttgacgaggtcttttggaacacaagaattgttcccatactcagggaattagagaaagaggagaacatcgaaactgtctgtgccgcttgcacacaactccaccacgcgttggaagagggcaacatgctcggaaacaagttcaagggcagatcgattttattaaaaactctgtgcaagctggtggatgtcggatctgactcgctctctctcaagctcgccaagattatcctcgcgctgaaagtgtcgagaaaaaatcttctgaacgtctgcaaactaatcttcaagatcagtcgaaacgagaagaacgattctctgatccaaaatgactcaatcctggagtcgctgctcgaggttcttcgctctgaagacctgcaaacaaatatggaagcttttctctactgcatgggatcgatcaagtttatatcaggcaatcttggcttcctcaacgaaatgattagcaaaggcgctgttgagatccttattaatctaatcaagcagataaacgagaatattaaaaagtgcggcacattcctgcctaatagcggccacctactggtccaggttactgccaccctgaggaatctggtcgatagcagcttggtacgaagcaaatttctgaacatcagcgccttgccacagctgtgtacagccatggaacaatataaaggtgacaaggatgtttgtacaaacattgccaggatatttagtaaactcacaagctatcgggactgctgtactgctctcgcttcctatagcaggtgctatgccctgtttctgaatcttatcaataagtatcagaagaagcaggacctggtcgtacgggtggtgttcattctagggaatcttaccgcgaagaacaaccaggccagggagcagttttcaaaagagaagggctccatccaaacactattaagcctcttccagacatttcatcagctcgacttgcatagccagaagcccgttggccagaggggcgaacaacatagagcccaaaggccgcctagtgaagcagaggacgtactgatcaaactgactcgggtgttggcaaacatagccattcatccaggggtgggccctgtgctggccgcaaatccaggcattgtgggactgctcctgaccacattggagtataagtctctcgatgattgcgaagaattggtaataaatgcgactgcaacaattaacaacctgagctattatcaagttaagaatagcattatccaagataaaaaactctacattgccgagttgctgctgaaacttctggtgtccaacaacatggatggaatattagaggctgtccgtgtgtttggaaatttatcacaggatcacgatgtctgtgattttattgtgcaaaacaatgtgcaccggttcatgatggcattactggacgcccaacatcaggatatatgtttctcggcctgcggagtgctcctgaacctgaccgtcgataaggacaaacgtgtgattctcaaagagggcggaggcatcaagaaactggtggattgcctccgtgatttagggccaaccgattggcaattggcctgtttagtttgtaagaccttgtggaacttctctgaaaacattaccaacgcatcgagctgtttcggcaacgaagataccaacacattgctgttgctgctgtctagtttcctcgacgaagagcttgcactggatgggtctttcgatccagacctcaagaattatcataagttgcactgggaaactgagtttaagccggtggcacaacagctgctcaatagaatacagcgtcaccacacatttcttgagccgctgcctatacccagcttctag

SEQ ID NO: 53135 - DNA, 2604 bp, Artificial Sequence
  Description of Artificial Sequence: Synthetic coding sequence
atgctttctcctaacgacaagatgttggggaaattagatcctttctaccagcccagcgtgtccaaacagaaaaccagtgctgagatcatctccgaggccaggaacgcactgcggaccgtgcgaacacagcggccatttactcctcaggaagcccagaggaagctgtttggccctgccagttctcggacctcagaaaaccgcccacccagtagtttcagccttcatgcatcatctttcgagtcttccgatagtagacccatctccggtacccgcctgtccccattggagctgaagccaaaggtccccgcttctcctaccagggaggaggattcatgtttctcatttcctaagcctccggttgatcctgcgaagattcgtagagtcagcaatgctcgggcacgactgttccgcgctgcctcacaaagggctttactcccggaccggagccttcccccaagtgactctaaaaagactgtggagtccaaggagactgttatgatgggtgattccatggtcaagataaatggaatctatctgactaagtcgaacgccatctgccatctgaagagccatccactgcagctgactgacgacgggggattctcggagatcaaggagcaagagatgttcaagggcactacatcactgcccagtcacttaaagaacgggggagaccagggtaaacgacatgctcgggcatcatcatgtccgtcgtctagcgacctttcaaggctccagaccaaagctgtccccaaggcggatctccaagaagaggatgctgaaatagaagtggatgaggtgttctggaacacacgaattgtcccaatcctcagagagttagagaaagaagaaaatattgaaactgtttgcgcagcatgtacacaactgcaccacgcgctggaggaggggaatatgctcggaaacaaattcaaggggaggagcattcttcttaaaaccctgtgcaagttggttgacgtagggagcgactccttatcgctgaaattagcgaaaataatcctggcccttaaggtttcaaggaaaaacctgttgaatgtgtgtaaacttatttttaagattagccggaatgagaagaatgacagtctgatacaaaacgacagcattttagagtccctgttggaagtcctccgcagcgaagatttgcaaacgaatatggaagctttcctgtactgtatgggttccatcaagttcattagcggcaacctcggcttcctgaacgagatgatctctaagggagctgtggaaattctgatcaacttgataaagcagatcaacgaaaatataaagaaatgtggcacatttctgccaaatagtgggcatctgctagtccaggtgaccgccacccttcgcaatttagtcgacagttccctggtgcggtcgaagttccttaacataagtgccctgcctcagttgtgcacagccatggaacagtataaaggtgacaaagatgtatgtactaacatagcacggatcttttcaaaactgacttcttacagagactgctgcaccgctcttgcttcctattcccgttgctacgctctctttctgaacttaattaacaagtatcagaagaagcaggatctggtggtgcgtgtagtcttcatcctcggcaacctcactgccaaaaataaccaggcacgggagcaattcagcaaagagaagggaagtatccaaacactgctcagcctgtttcagacctttcaccagcttgatttgcacagccaaaaacctgtcggccagagaggtgagcaacacagggcgcagagacctccatctgaagcggaggatgtgctaatcaagctgactagggttctggctaacattgccatacatcccggagtaggacccgtgttggccgcaaacccaggaattgttgggctgctcctgaccaccctggagtataaaagtctcgacgactgcgaagagttggtgatcaacgctaccgccacgataaacaatctgtcctactaccaggtgaaaaattcgatcatccaagacaaaaaactttacattgcggagctactgctaaagcttctggtctcaaataacatggacggcatcctggaagccgtccgtgtcttcggaaacctgagtcaggatcacgacgtttgtgatttcattgtccagaataatgtccatcgatttatgatggcactgctggacgcacaacatcaggacatttgcttttctgcctgtggcgtcctactcaacctcacagttgataaggacaaaagggtgatcctaaaggagggaggcggtatcaaaaaactggtcgattgcctcagggatttaggccctaccgattggcagcttgcctgcttagtgtgtaagacattatggaacttctctgaaaacatcaccaatgcatctagctgctttggcaatgaagacaccaacactttgctgcttttgttatccagcttcttggatgaagagctcgccctggacggtagcttcgatcctgacttaaagaactatcataagctgcactgggagaccgaattcaaaccagtcgcacagcagctgctaaacagaattcaacgacaccacaccttcctggaacctctgccaatcccttcattttag

SEQ ID NO: 53136 - DNA, 2619 bp, Artificial Sequence
  Description of Artificial Sequence: Synthetic coding sequence
atgggaaagaagatcaaaaaggaagtcgaacctcctcctaaggatgttttcgatccactgatgattgagagcaagaaggccgctacagtcgttcttatgctgaatagcccagaagaggaaatcctagctaaggcttgcgaggccatatacaagtttgcactgaaaggcgaagagaacaagacgactctccttgagctaggtgcagtggagcccttgactaaactcctgactcacgaagataagatcgtgcgacgcaacgccactatgatttttggcattctggcatctaacaacgacgtcaagaagcttctgagagaacttgatgtgatgaacagtgtcatcgcccagctggcccctgaagaagaggtcgtgatacacgagttcgcaagcctgtgtctcgctaatatgagcgcagagtacacttcaaaggtccaaatctttgagcacggcggactcgaaccactgatacgcctcctctctagcccagacccggatgtgaaaaaaaatagcatggaatgtatttataatttggtgcaagacttccagtgcagagctaaactccaggaattgaacgcaatccctcctattctggaccttctcaagagcgagtaccctgtgatccagctgttggctcttaaaactttgggagtgatcgccaacgacaaggagagtaggactatgctccgcgacaatcaggggctcgatcatctcataaagatactggagactaaagagctgaacgatctgcacatcgaggccttggccgtaatagctaattgtctggaggatatggacacgatggtgcagatccaacaaaccggaggactgaaaaagcttctctccttcgccgagaattccactataccagacatccagaaaaatgcagcaaaagcgatcacaaaagctgcctacgatccagagaaccgaaaactgtttcacgaacaggaggtggaaaagtgtctggtggctttactgggctccgagaacgatgggacaaagattgcagccagtcaagcaattagcgcaatgtgtgaaaactctgggtcgaaggatttcttcaacaatcaggggatcccacaactgatccagcttcttaagtctgacaacgaagaggtcagagaggcagcggcactagcgttagcaaaccttactacctgtaaccctgcaaacgctaatgccgctgctgaggcagacgggattgacccactgattaatctgctctcttctaagcgggacggtgcaattgccaatgctgccaccgtcctgaccaacatggcaatgcaagaaccactgcggctgaacatacagaatcatgatattatgcatgcaattatctcccctcttcgttcggccaatacggtggtgcagagcaaggccgctcttgcggttaccgcgacagcctgtgatgtagaagctaggactgagctgcgtaacagtgggggtttggaaccattggtcgagctgctaaggagtaagaatgacgaggtgcgtaaacatgccagctgggctgtgatggtctgtgctggcgacgagctgacagccaacgagctctgtagactcggtgcacttgacattctggaggaggtgaacgtgagcggaacacgaaagaataaattcagcgaggctgcttataacaagctcctaaacaacaatctgtctttaaaatattctcagaccggatacttgagctccagcaatatcatcaatgacggcttctatgactatgggagaatcaatcccggaacaaaactgctgcctctgaaggagctctgccttcaggaaccgagcgacctgagggcagtactgctgatcaactctaagtcatatgtgtctcccccttcatctatggaggataaaagtgacgtcggatacggacggtccataagtagctctagtagcctgagaagaagttcaaaggagaaaaacaaaaagaattcttaccatttctccgccggttttgggtcccctattgaagacaaatctgagcctgcctcgggtagaaataccgtacttagcaagagtgctaccaaggagaaaggatggaggaagagcaaaggaaagaaggaggaggaaaaagtgaaggaggaggaggaagtgatggtggttccaaagttcgtgggagaggggagctcagataaagaatggtgccccccaagtgatccagattttagcatgtacgtgtacgaggtcaccaagtctatcttacctattacgaacattaaagaacaaatcgaggacctggccaagtatgtagcagagaagatgggtggcaaaattccaaaggaaaagctgcctgatttctcgtgggagctgcatattagtgagctgaaatttcagctcaagtcaaatgtaattcctattggacatgtgaagaagggcattttttaccacagggccctactcttcaaagccctggcagatagaatcggaatcggatgttctttggtacgcggtgagtatggtcgagcgtggaacgaggtaatgttacaaaacgattcaagaaagggtgtgattgggggactgcccgctcccgagatgtacgtgatcgacctcatgtttcacccgggagggctgatgaagctgcgctccagagaagccgacttataccgctttatctag

SEQ ID NO: 53137 - DNA, 1830 bp, Artificial Sequence
  Description of Artificial Sequence: Synthetic coding sequence
atggataccatggtgcagatccagcagacggggggtctaaagaagcttctgagtttcgcggaaaatagtaccatacccgacatccagaagaatgcggctaaggctatcaccaaggccgcatacgatccggagaaccggaagttgtttcacgagcaggaagttgagaaatgcctggtggcccttctgggctcagaaaatgatggaaccaaaatagccgcttctcaggccatctctgcgatgtgcgagaactcaggctccaaagactttttcaataatcagggcataccacagctcattcagctcctgaaaagtgacaatgaggaggtccgcgaagcagctgccttagccctagccaatctgactacctgtaaccctgctaatgcaaacgcagcagctgaggccgatggtatcgatccattaattaacctgctgtcctctaagagggatggagccattgccaatgcggcaactgtacttacgaatatggctatgcaggaaccactgcgccttaacattcaaaatcatgatattatgcacgccataatatctcctttacgctctgcaaacaccgttgtacaatccaaggccgctttggcggtaactgcaactgcttgcgacgtagaagccaggaccgagctccggaacagtggaggcctggagcctctcgtggagttgctccggtctaagaacgacgaggttcgtaaacatgccagctgggctgtgatggtgtgtgccggtgatgagctgactgcaaacgaattatgtcggctgggcgctctggacattttggaggaggtgaatgtgagcggcacccgaaaaaataaattttctgaagccgcatacaataaacttttaaacaataacctgtctctcaaatatagccagacaggctatctttcatcttcaaatattatcaacgatgggttctacgattacggaagaatcaatcccggaacgaaactcctgcccctgaaagagctgtgcctgcaggaaccttctgacctcagagcagtcctcctcataaactccaaatcatacgttagtccacctagcagcatggaagataagtccgacgtgggctacggcagatccatctcttccagctcaagcttgcgcagatccagcaaagagaagaataagaaaaactcttaccacttctcggcaggctttggcagtcccatagaagataagagcgagcctgcaagcggcaggaacaccgtgctctccaaaagcgccactaaggaaaaaggctggcggaagtctaaggggaaaaaagaggaggagaaggtgaaggaagaagaggaagtgatggtggtaccaaagtttgtgggggaggggtcctctgataaggagtggtgtcctccgtccgaccccgacttctctatgtatgtgtatgaggttacgaaatccattctgccgatcactaatatcaaggagcagatcgaagatctcgccaaatacgtggctgagaaaatgggcggaaaaattcctaaggaaaaactgcccgacttttcctgggaactgcatatcagcgaactcaaattccaactgaagtcgaacgtcattcctatcgggcacgtgaaaaaagggatattttatcacagagcgctgctatttaaagctctggctgatcggatcggtatcggctgtagtctggtgagaggcgagtacggcagagcttggaatgaggttatgctccaaaacgactcaagaaaaggcgtgattgggggactgccggctcctgagatgtatgtcatcgaccttatgttccacccaggaggtctcatgaagctccgctctcgcgaagctgatttgtacaggttcatttag

SEQ ID NO: 53138 - DNA, 2067 bp, Artificial Sequence
  Description of Artificial Sequence: Synthetic coding sequence
atgggcaagaagatcaaaaaagaagtggaaccccctccaaaggatgtgttcgatcccttgatgatagagagtaagaaggcagcaacggtggtgcttatgctgaatagcccagaggaggagatactggctaaggcttgtgaagccatctataagtttgccctcaaaggggaagaaaacaagaccactttgttagagctgggagcggtagaacccctgacaaaactccttacgcacgaggataaaatagtgagaagaaacgctaccatgattttcggcatcctggcctctaacaatgacgttaagaagctcctgcgggaactggatgtaatgaatagcgtgatcgcacagcttgcgccagaggaggaggttgtgattcatgagtttgcttccctatgtttggccaatatgtccgcggagtataccagtaaagtccagatttttgagcacggaggcctcgagcctctgattcgtttattaagtagtcccgaccctgacgtgaagaaaaattcaatggagtgtatctacaacctggtccaggattttcagtgtcgcgctaaattgcaagaattgaatgctattcctccaatccttgacctgctgaagtccgaataccctgtcattcagctgctcgccctaaagaccctgggtgtgatagccaacgacaaagaatcacggacgatgttgagagacaaccagggccttgatcatttgatcaagatcctggaaactaaagagctcaatgacctgcacatcgaggcattggctgtgatcgccaattgtctggaagatatggataccatggtgcagatccagcagaccggaggtcttaaaaagctactgtccttcgccgagaactcaaccatcccagacatccagaaaaacgctgctaaagcgattacaaaagcagcatatgatccagaaaaccggaagttattccacgagcaggaagtcgaaaaatgtctagtggcgctcctgggaagtgagaatgacggcactaaaatagctgcctcccaagctatcagcgctatgtgcgaaaatagtgggagcaaggattttttcaataatcagggcattccacagctgattcagctcttgaaatcagataatgaggaggtgagagaggcagccgcactcgccctggctaatctcacaacctgcaacccagccaacgccaatgccgctgcagaagctgatggtatagacccccttattaacttattgtcctccaaaagggatggagccatcgctaacgctgctacagtcctgaccaatatggctatgcaagagccactcagattgaacattcaaaatcatgacattatgcatgctatcatctctccacttcgatctgcaaacacagtggtgcagtccaaagccgcattggccgtcactgccactgcttgcgatgtggaagcgcgtacggagcttaggaatagtggaggcctggaaccgttagttgaactcttgcgatcaaaaaatgacgaggtgcgaaagcacgcgagctgggctgtgatggtctgcgccggagacgagttgactgccaatgagctatgcaggctgggagcactggacattctcgaagaggtgaatgtttcaggcacccggaaaaacaaattctcggaggcggcatataataagctcctgaacaacaacctttcgcttaagtactcacaaaccgggtaccttagttccagcaacatcattaacgacgggttttacgactatggccgaatcaaccccggtacaaaactgctgcccctgaaagagctgtgcttgcaggaacctagtgacctccgcgctgttcttcttatcaactccaaatcttacgtgtcacctccgtcctcaatggaagacaaaagcgacgttgggtatggcaggtcaataagctcctccagctcgcttcgccgaagctccaaagagaaaaacaagaaaaacagttaccacttttccgccggatttggctcccctatagaagacaaaagtgaacccgcaagcgggagaaatactgtactgtctaaatctgctacaaaagagaaggggtggagctccctgcccacaagccggtag

SEQ ID NO: 53139 - DNA, 2598 bp, Artificial Sequence
  Description of Artificial Sequence: Synthetic coding sequence
atggggaagaaaattaagaaagaggtggagccaccccctaaggatgtatttgaccccctgatgattgaatccaagaaggcagcaactgtcgttctcatgctcaatagtcccgaagaagagattctggcgaaagcatgcgaggccatctataagttcgctttgaagggtgaagagaacaagactactttactggaattaggagccgttgagccgttgacaaagttgcttacacacgaggacaagatcgtgcgtcggaacgcaaccatgattttcggtatcctggcctctaataacgacgtgaaaaaacttttgcgcgagttggacgttatgaatagtgttatcgcacagctggctcctgaagaagaggttgtgatacacgagttcgcatccctgtgtctggccaatatgtctgcagagtataccagcaaagtgcaaattttcgaacatggagggcttgaacctctgattcggctgctcagttctccggaccctgacgttaagaagaactctatggagtgtatatataacctcgttcaggactttcaatgtcgagcaaagcttcaagagctcaacgccattcccccaattcttgatctccttaaatctgaatatccggttatccaactgctggccctgaaaaccctgggggtgatcgccaacgataaggagtcacgaaccatgttgagggataaccaaggcctggaccaccttataaagattcttgaaacaaaggagctgaatgatttacatatcgaagccctggcggttattgctaattgtctggaggatatggacaccatggtgcagatccagcagactggagggcttaagaaacttctgtcattcgccgagaactctacaatccctgatatacagaagaatgcggctaaagctatcacaaaagccgcatacgacccagagaatcgaaagctctttcacgagcaggaggtagaaaagtgcctggtggcactgttaggatccgagaacgacggcaccaagattgcggcttcacaggcaatcagcgccatgtgcgaaaactcagggagtaaggacttcttcaacaaccagggtatcccacagcttattcagcttctgaagtcagacaatgaagaggtccgagaagctgccgcactggccctggcaaatctgactacttgcaaccccgctaacgctaacgcggctgcagaggcggatggcatcgaccctctaataaacctgttgagtagcaaaagagacggcgctattgccaacgctgccaccgtgttaactaatatggctatgcaggagccgctgcgcctcaacattcagaaccacgatatcatgcacgctattattagtcctctgagaagcgccaacacggtagtacagtctaaagccgctctagccgtcacagcaaccgcatgtgatgttgaggcgagaactgagctgagaaactccggtggcctggagccacttgtcgaactgctcaggagtaaaaacgatgaagtgcggaaacacgcaagttgggcagtgatggtatgcgcaggcgacgagctgacagctaacgagctgtgcagactgggtgcactggacatattagaggaggtgaatgtttccggcacccgtaagaacaagttcagcgaggcggcatacaacaagctgctgaataataatctttcactcaagtattcacagacaggatacttgtcctcttctaatattatcaacgacggcttctatgattatggtcgaatcaatccaggtacaaaactgctgcctctcaaagagctgtgtctgcaggagcccagtgatctgcgagcggtcctgctaattaactctaaaagctacgttagcccaccgtcttccatggaagacaagtctgatgtaggctatggaaggagcatctccagctccagttccctgcgcaggtcttcaaaggaaaagaataatgcgggattcggcagccctattgaagataagagcgaacccgcttcaggtcgtaatacggttctgtccaaatcagcgacaaaggagaagggatggcgaaagagcaaggggaaaaaggaggaagagaaggttaaagaggaggaggaggtgatggtggtccccaagtttgtcggcgagggatcctccgacaaagagtggtgccctccaagtgaccctgacttcagcatgtatgtgtatgaggtgacgaagtcgatccttcctatcaccaatattaaggaacagatcgaagatcttgccaaatacgtagccgaaaaaatggggggaaaaatacccaaagaaaagttgccagatttcagctgggagttacatatctccgaactgaagtttcagctaaagagcaatgtgatcccgattggtcatgtgaagaaaggcattttttatcaccgcgcactgctctttaaagcattggcagatcgaatcggaatcggctgcagcctggttcgcggtgagtacggaagagcttggaacgaggtgatgctgcagaatgatagccgcaagggcgtcatcgggggtcttcctgcccctgagatgtacgtgatagacctaatgtttcaccctggaggactgatgaagctgcgcagcagagaggcagacctgtaccggttcatttag

SEQ ID NO: 53140 - DNA, 1059 bp, Artificial Sequence
  Description of Artificial Sequence: Synthetic coding sequence
atgaaggaaaatagcattgcccttaacatcctcggcaagattacccgggatgacgacccagagagtgagatcaaaatgaagatcgctatgctcctgaaacagttagacctgcacctcctgaatcattctttgaaacacatttctctggaaatcagtctgtcacctatgacagtgaagaaggatattgagctcctaaaacggttttccgggaaagggaaccagaccgtgttagaatctatagagtatacttccgattatgagttctccaatgggtgcagggcacccccttggaggcagattcggggtgaaatatgttacgtcctcgtaaagccacacgatggcgaaactctttgtatcacatgtagtgccggaggtgtgttcctcaacggaggaaagactgacgatgagggcgatgtcaactatgagcgcaaaggctctatttacaaaaacctggtaacctttctaagggagaagtccccgaagttttcagaaaatatgagtaagcttggcatatcttttagtgaggatcagcagaaagagaaggaccaactaggtaaagctcctaagaaagaagaggcagctgccctcaggaaagatattagcggaagcgacaaaaggtcactggaaaaaaatcagattaacttctggcggaatcagatgacgaagcgctgggagcccagcctgaattggaaaactactgtcaactataagggtaaggggtccgctaaagagattcaggaggataagcatactggaaaactcgagaagccgagacctagtgtgtcacacgggcgtgctcagctgcttcgtaagtctgccgagaaaatcgaggagacagtctcggatagctcttctgaatctgaagaggacgaggagccgcctgatcatagacaggaagcatccgctgatctccctagcgaatactggcagatccagaaactggtcaagtacctgaagcagaaagagacaagccaaaacgggagaaataaacgctggatacggaagcaaaatactcgggtaatccgctccatgatctttgacgtcggcaaaacttcatag

SEQ ID NO: 53141 - DNA, 3135 bp, Artificial Sequence
  Description of Artificial Sequence: Synthetic coding sequence
atgggcgttgccctaaggaaactgacccagtggactgcagccggacacgggaccggaatcctagagattaccccgcttaacgaagcgatcctcaaggagataatagtgtttgtcgagtccttcatctacaaacatccccaggaggcaaagttcgttttcgtggaaccgctcgagtggaatacaagcctggctcccagtgctttcgaaagtggatacgtggtatcggaaaccaccgtgaagagcgaagaggtggacaagaatggccagccattgctgtttctgtctgttcctcagattaaaatccggtcgttcggacagctaagccgactcctgctgattgcaaaaacaggaaagcttaaggaagcccaggcctgcgtggaagcaaacagagacccgatcgttaaaatcctgggtagcgactataacaccatgaaagagaattcaatcgctctgaatatccttggaaaaattactcgggatgatgatccggaatcagaaatcaaaatgaagatcgctatgttactgaaacaactagacttgcacctcctaaatcactctctgaagcacatttccctagaaatctctctctcaccaatgaccgtcaaaaaagacatcgagctcttgaaaaggttctccgggaagggtaaccagaccgttttggaaagcatcgaatatacatctgactacgagttctcaaatggctgccgcgctcccccttggcggcagatccgtggcgagatatgctacgtgctggttaagccccatgatggcgaaactctttgtattacttgctccgctgggggtgttttccttaacgggggaaagacggatgacgaaggtgatgttaactatgagcggaaggggagcatttacaaaaaccttgtgacctttctgcgcgaaaaaagtccgaaattctcagagaatatgtccaagctcgggatttccttcagtgaggaccagcagaaggaaaaggaccagctgggcaaggctccaaaaaaggaggaagctgctgcactccggaaagatatcagtggctctgacaagagaagcctagagaagaaccaaatcaatttctggcggaatcagatgactaaacggtgggagcccagtctcaactggaagacgacagtgaactataaaggtaaaggctctgctaaagaaatccaggaggataagcacactgggaagctggagaagcccagacccagtgtctctcacggtagagctcagctcctaagaaaatccgcagaaaaaatcgaggaaactgtgtccgatagctccagtgagagcgaagaagatgaggaaccacctgaccaccgccaggaggcgtcggctgatctcccctcagagtattggcagatccaaaaactggtgaagtatctgaagggtgggaatcagacggcaaccgtgatagccctgtgcagcatgcgtgacttttcactggcccaggagacatgccagctcgctataagagatgtcggcggattagaagtacttataaatcttctggaaacagacgaggtgaagtgtaaaatcggttccctgaaaatcctcaaggaaatctcccataatccgcagattcggcaaaacattgtggacctgggcggtctgccaatcatggtaaacatccttgactcaccacataaaagtttaaaatgtctggctgctgagactattgccaacgtggctaaattcaaacgtgctcggagagtcgtgagacagcatggtggcataaccaagttagtggccctgctggattgcgcacatgatagtaccaagccagctcagtcctctctgtatgaggcccgagatgtggaagtggctaggtgcggagcgctggccctatggagttgctccaagtctcacacaaacaaagaggcaatcaggaaggcgggagggattcccctacttgcacggctcctgaagacatctcatgaaaatatgctgatacccgtggtcggtaccctgcaagagtgcgctagtgaagagaattacagggctgccattaaggccgagaggatcatcgagaatctggttaagaacctgaattcagaaaatgagcagcttcaagagcactgtgccatggccatatatcagtgcgccgaggacaaggagaccagggatctggtccggttgcacggcggtctcaaacccttggcttcccttctaaacaataccgacaataaggagcgtctcgcagctgtcactggagctatctggaagtgcagtatttccaaggaaaacgtcaccaagttcagggaatataaggccatcgaaaccttagtgggcttactaacagaccagcccgaagaggtgctggtgaacgtggtgggcgcactcggtgaatgttgtcaggagagggaaaatcgagtaattgtgcgcaagtgcggcggaattcagcctctggttaatctcctggttgggataaatcaggcgttgttggttaatgtgacgaaggcagtgggggcttgcgcagtggagccggaatccatgatgataattgatcgcctcgacggcgtacggttgctctggtccttgctgaaaaatcctcatcccgatgtgaaagccagtgccgcatgggccctctgtccctgcattaaaaacgccaaagacgctggcgagatggttaggtccttcgtcggcggactagaattgattgtcaacctactcaaatctgataataaagaggtcctggcttcagtgtgtgccgcaatcacaaatattgccaaggaccaagagaaccttgcagtgatcaccgaccatggagtggtgcctttgctgtcgaaattggctaatactaataacaacaaactgcggcatcacctcgcagaggccatctctaggtgttgcatgtgggggaggaatcgcgtagcatttggtgagcataaagcagtagctccactggtgcggtacttgaagtccaacgatactaacgtccatagggccactgcacaggccctctaccagctgtcagaagatgctgataactgcatcactatgcacgaaaatggagctgtgaagttgctgcttgacatggtcggttctcctgaccaggaccttcaggaggccgctgccggttgtatttctaatatccgcagactcgccctcgctacagagaaggctcgctacacgtag

SEQ ID NO: 53142 - DNA, 1170 bp, Artificial Sequence
  Description of Artificial Sequence: Synthetic coding sequence
ctgagccgcctgctgcttatcgctaaaacaggtaaattaaaggaagcacaggcgtgcgtggaggccaaccgggatcccatagtgaaaatcttgggcagcgactataacactatgaaggagaacagtattgctctgaatatcctcgggaaaattactagagatgacgatcccgaaagtgagatcaagatgaagatcgcaatgttattgaagcagctggacctgcacctcctgaatcacagcctcaagcatatcagtctcgagatcagtctgagccccatgacagtgaaaaaagatattgagctgttgaaaaggttttcaggcaaaggtaatcagactgttctggaatcaatcgagtatacaagtgactatgaattctccaatggatgcagagcgcctccttggaggcaaatcagaggcgaaatctgctatgtgctggttaagcctcatgacggagaaacactgtgtataacatgctcagccggtggcgtttttcttaatggtgggaagactgacgatgagggcgatgtcaactatgaacgcaagggtagtatctacaagaacctcgtcaccttcctgcgcgaaaaatcccccaagtttagtgagaacatgtccaagctaggaatctcattctctgaggatcagcaaaaagaaaaggaccaactggggaaggcaccgaaaaaggaggaggctgctgcgctgcgaaaagacatttcgggtagcgacaagagaagcctcgaaaagaaccagatcaacttttggcgaaaccaaatgactaagaggtgggagcctagcttaaactggaagacaacagttaactacaaaggcaagggatcagctaaagaaatccaagaagataaacatacaggcaagctggagaaacctcggcctagcgtgagccacggcagggctcagctgttgagaaagtccgctgaaaagatagaggagaccgtgtctgactcctcctccgaatctgaagaggatgaagaacctccagatcataggcaagaggcttccgcagacctgccaagcgaatattggcagatccagaaactagttaaatatttgaagcagaaggagacaagtcaaaacggccgaaacaagcgttggattcggaaacaaaacactagagttatccgttctatgatcttcgacgttgggaaaacctcttag

SEQ ID NO: 53143 - DNA, 621 bp, Artificial Sequence
  Description of Artificial Sequence: Synthetic coding sequence
atgtcaaagttgggaatttcgttctcggaagatcaacaaaaagaaaaggaccagctcggcaaagcccctaaaaaagaggaggccgcagcactgagaaaggacatttccgggtccgataagaggagtttagagaagaatcagattaacttctggaggaatcagatgacaaaaagatgggagccgagcctgaattggaagacaacagtcaattataagggtaaaggctcggccaaagagatccaggaggataaacatactggcaaactagaaaagccgagaccatcagtgtctcacggacgagcacagctcctgcgaaagtcagccgaaaaaatagaggagacagtctccgacagctcctctgaatccgaagaagatgaggagcctccagaccatcggcaggaagcatcagcggacttaccgagtgagtactggcagatccagaagctggttaagtacctcaaggggggtaatcagaccgccaccgtgatcgctttatgctccatgagagacttcagtttagcacaggaaacttgtcagctggccatcagagacgtgggcggactcgaagtgttgatcatttgtctaaagcccatgaagtccaacgtgcggttggtacattag

SEQ ID NO: 53144 - DNA, 2118 bp, Artificial Sequence
  Description of Artificial Sequence: Synthetic coding sequence
atgtccaaattagggatctccttttctgaagatcaacagaaggagaaagatcagctggggaaggcccctaaaaaagaagaggccgctgcgcttcgaaaggacatctccgggtcggataagcgaagtctggaaaaaaaccaaatcaatttctggcgaaatcaaatgactaaacgctgggagcctagcctgaattggaagacaactgtgaactacaaaggaaagggaagcgctaaggaaattcaggaggataagcatacggggaaactagaaaagccacggcctagcgtttcccacggcagagctcagcttctcaggaagtccgccgagaaaatcgaggagacagtaagtgactcctcctctgagtcagaggaggacgaagagcccccagatcaccgccaggaagcctctgccgatctcccttccgaatattggcaaatccagaaactggtcaagtatctaaaagggggaaatcagaccgccacggttatcgctctgtgtagcatgagggacttcagcctggctcaagagacttgccagctcgccatcagggatgtgggtggactggaggtgctcattaatctactcgagacagacgaagtcaagtgcaaaatcggatctcttaagatcctgaaagagatatctcataaccctcagattcggcagaacatagtggacttgggtggtctacccattatggtgaatatcctcgattctccgcacaagtctctgaagtgcctggccgcagagacaattgcgaatgtggccaaatttaaacgggcaaggagggtcgtgcgtcaacacggagggatcacaaagctcgtagccctgctggactgtgcccacgactcaacaaagcctgcacagagctcattatacgaagccagagatgttgaagtggctagatgcggcgcactggcgttgtggagctgcagcaaatcccataccaacaaagaggccatcagaaaagctggaggtatacccctgctagctcgcctactgaaaacttcgcatgaaaacatgttaatacccgtagtggggaccctgcaagaatgcgcatccgaagagaattatagagctgccatcaaagccgagcggatcattgaaaatcttgttaaaaacttaaattctgaaaacgaacaactgcaagagcactgtgctatggctatttaccagtgtgctgaggacaaagagactagggatttagtgcggcttcacggcggactcaagcccttggcaagtctactgaacaatactgataacaaggaaaggctggccgcagtcacaggtgccatctggaagtgcagcatttcgaaggaaaacgtaactaagttccgggagtataaggctatcgaaaccctggtaggcctgttgaccgaccagcctgaagaggtgctggtgaatgttgtaggagcacttggcgaatgttgccaggagcgggagaatcgggtcattgtgagaaagtgtggcggaattcagccacttgtgaatctcctggtgggtattaatcaggcacttctcgtgaacgtaaccaaagcggtgggagcttgcgctgtggagccagagagcatgatgattatagaccgattggacggagtgcgtctcttatggagtctactgaagaacccccaccctgacgttaaagctagtgcagcctgggcactctgtccctgtatcaaaaacgcgaaagatgccggtgagatggtcagaagtttcgtaggagggcttgagctgattgttaatcttctgaagagtgacaataaagaagtgcttgcgagtgtgtgtgcagctataacaaacatagccaaggatcaagagaatctcgctgttatcacggaccacggagtcgtgcctctcctgagtaagctggccaacaccaacaataacaaactgagacaccatctggccgaggccatatctaggtgttgcatgtggggaaggaatcgggtggcttttggagagcacaaagctgtggcacccctggtgagataccttaaatctaatgatactaatgtgcaccgagctactgctcaggccctctatcagctgtcagaggacgccgacaactgcatcaccatgcatgagaatggggctgtcaaaaagaacatcttcatttcatag

SEQ ID NO: 53145 - DNA, 1839 bp, Artificial Sequence
  Description of Artificial Sequence: Synthetic coding sequence
atgagggacttcagcctggctcaggagacctgtcaactggccatccgggatgtgggcggactcgaggtgctcatcaacctgttggaaaccgatgaggttaagtgcaagatcggatccctgaagattctaaaggagatttcccacaatccccagatccggcagaacatcgtagatctcgggggactccccatcatggttaacattctcgacagtccccacaagagtctgaaatgcctcgctgccgaaacaattgctaatgtcgcaaagtttaaaagggcacgacgggtagtgcgtcaacacggtggtatcacaaagctcgtggccctcctggactgtgctcacgattcaacgaaaccagcccaatcatccctgtatgaggcacgggatgtggaagtggccagatgtggggctttagcactctggagttgcagtaaatcacatacgaacaaagaggccataaggaaagctggcggtatccctctgttggcccgacttttgaagacctcacatgaaaatatgttaatcccagtggtggggactctccaggaatgcgcatcggaagagaattatagagccgcaatcaaggcagagcggataatcgagaacctggtgaagaacctaaactcagaaaacgagcaattgcaggagcactgtgctatggcaatttaccagtgcgccgaggataaggaaactagggatcttgtgaggctccacggaggactcaagcctctagcctccttgctgaataatacagacaataaagagcgactcgctgccgtcaccggagccatttggaagtgctcaatctccaaggagaacgtaaccaagttcagggagtacaaggcgattgaaacactcgtgggactgctgacagaccagcctgaagaggtcttggtgaatgtcgtgggagctctgggggaatgctgtcaggaaagggagaatagagtcatcgtgcgcaaatgcggcggaatccagcccctggttaatctcctcgtgggcatcaaccaggccctcttggtgaatgtgacaaaagccgtcggtgcgtgtgctgtggagcccgagtctatgatgataattgatagacttgacggagttaggctgctgtggtccctgcttaagaatccccacccagatgtcaaggccagcgccgcatgggcactgtgcccttgtatcaaaaatgctaaggacgccggtgagatggtaaggtcatttgtcggaggcttggagttgatcgtgaatttactcaagagcgataataaggaggtgctggcaagcgtgtgtgccgcaatcacaaacatagctaaggaccaggaaaatctggcggttatcacagatcacggggtcgttcccttactctccaaattagccaataccaataacaataagctgcgccaccacctggctgaagctatatcccgctgctgtatgtggggccgaaatcgggtggcctttggcgaacataaggctgtggctcccctggtgcgatacctgaaatctaatgacaccaatgttcatagagctactgcccaagccttgtatcagctgagcgaagatgctgacaactgcattaccatgcacgagaatggcgctgtaaagaccgagtctcgccacgtcgctcgccttgagtgtagcgacaatgatcttgggagcttgcagcctccacctccaggtttcaagagattctcctgtctgtctctactgtcgtcatgggactactcgttttactggatttggttgggccctctcactcggatttcgcgaaaattgcagttagtggtgtacccaatctcagccggttggctgcttctgcagcggaggcaggacactctggagatctag

SEQ ID NO: 53146 - DNA, 2808 bp, Artificial Sequence
  Description of Artificial Sequence: Synthetic coding sequence
atggcggctgccaagccaacactcactgattcattgtctttctgtctggcacagctcgccgcagctgccggtgaggctctgggcggtgagaaggatcccgctacgaacgagacacctctgtcccgggctctactggctctgcgcacccgccatatcaaggcagccggtggaatcgaaagatttcgagccagaggtggtctgcggcctctgctggcgctccttcggagagctgctgctgcaggttctgccccttcccaggcgggacccggaagtgccccatccagcgctgcatccggggcttcctcgcccgctcctgctagcggccctgccccatcagccgttagcagctctagcccaactccaccagtgagactgcggaagacattggacctcgccctgtcaattcttgcggactgctgtaccgagggcgcatgccgaacagaagtccgaagactggggggaatactccctctggttactattctacagtgtatgaaaaccgactctatccaaaaccgcaccgctcgggctcttgggaatctagctatggagccagagtcatgtggggatatacactgcgctggggcagtgcccctccttgtggagagtctcacagcgtgccaagattcgcaatgtctgcagagtgtggtgcgggcattgcgaaacctggccgattccccccagcacagacttgcactggcccagcagggtgccgtcaggccactcgcggagctgctcgccaccgcccctgatgcagcattgacacttgccctggtgcgggcattgctggagctgagccgtggatgcagcagagcatgtgctgagcagttatccctggggggaggtctcggtcctctggtgtcactggcctcccacccgaagcgagctgtgcgtgagggcaccatactgattctcgctaacctctgtgcacaaggcctcatccgacctgctcttggaaatgccggaggcgttgaggtactggtggatgaacttcggcaacgccgagatccaaatggcgcaagcccaaccagccagcagccactcgttcgcgcagtatgtctcctgtgcagggaggcaatcaatagggccaggcttagggacgcgggaggcctggatctgctgatgggcctcctgagagatccccgtgcatcagcgtggcatccaaggatcgtcgccgctctggtcggcttcctgtacgacacgggcgctcttgggagactacaggcactggggctagtgcctcttttagccggacaactatgcggcgaagcaggagaagaagaggaagagggccgtgaggccgctagttgggacttcccagaagagagaactcccgaacgcgctcagggaggtagcttccggtcactgagaagctggctgattagcgaagggtatgccactggtcccgacgatatcagtcctgattggtccccagagcagtgcccccctgagcccatggaacctgccagcccagcgcctacccctacaagcctgcgcgctccaagaacacagcgaacaccgggacgctctccagccgcagccatcgaggaaccctggggtcgcgaaggcccagctttgttgcttttgagtcgatttagtcaggcaccagacccctccggcgctctcgtaactggacctgctctctatgggctgctgacatacgtcacgggagccccaggacctccatcaccccgagcgcttcggattttatccaggctgacttgtaaccccgcttgcctcgaggctttcgtgaggagctatggagcggcattgctaagggcctggctggtactgggggtggccccagacgattggcctgccccaagagcccgtccaaccctccattccagacaccgcgagctaggtgaacgcctgctgcagaatctgacagttcaggcagagtccccattcggagttggcgcactaacacatcttttgttgagcggctcccctgaagatagagttgcctgtgccctgactttgccatttatctgtcgcaaaccatctctgtggaggcgccttctccttgaacaagggggacttcgactgctcctcgcagccctgacacgtccagctccacatccgctttttctgtttttcgcagccgattccttaagctgtttgcaagatctggtgtcccccaccgtgtcaccggctgtaccccaggctgttcctatggacttggactcaccaagcccatgtctttatgagccactcctgggacctgccccagtccctgcgcctgaccttcactttctgctggattccggactgcagctgcctgcccagagggcggcatccgccactgctagtcctttcttccgcgcattactgagcggatcttttgcagaagcgcagatggacttggtccctctgcgaggtctctcacccggagcagcatggcccgtgctgcaccatctgcatggctgcagaggttgtggtgccgcattaggcccagtgcccccaccaggacagcctcttctggggagcgaggccgaagaggccttggaagcggctggtaggtttctgttgcccggactcgaggaggaattagaagaagcggtgggacgcattcatttaggcccacaaggagggccagaatccgtaggggaggtgttcaggctgggtagacctagactggccgctcattgcgccaggtggaccctgggatctgaacagtgccctagaaagagagggctggctctcgtggggttggtggaggcagccggagaggaagctgggcctctgactgaagctttactggcagttgtaatgggaatagaactgggcgcacgcgtcccagcctag

SEQ ID NO: 53147 - DNA, 3093 bp, Artificial Sequence
  Description of Artificial Sequence: Synthetic coding sequence
atggtcactctgggcgcaggagtgcgactgtttaccggagtgtaccctgtggtactcaaccaaatccgcgctacgagtgaagcttccgctataacgaggacaaccatgccagcacctgaactgacaagcacttctcgcgctgaagatacacgggacacaggcgtgcaactcagaaagcgcaagatcccccaggctagacactcccggaagcgacaaagaaccttcagttttagatcactgggtagtgcagcccgttcaggcgctgagagtgaggccagagccaaaatggccgcagccaaacctaccctcactgattctttgtccttttgtctagctcagttggcagctgccgctggagaggccctcggcggagagaaagacccggcaacgaacgagacacccttatccagagctctgctggcccttaggacccggcatattaaagccgctggtggtatagagaggttcagagctcggggagggctgagacctctgctggctctgcttcggagagccgcagcagcgggttccgctcccagtcaagcgggtccgggatccgcccctagttccgcagcttctggcgcttcgtccccagcccctgcttcaggaccagccccatccgctgtgtccagttcttcacccacccccccagtgcgcctccgcaagacattagatctcgcactgtccattctggccgactgttgcactgaaggggcttgccgaacagaggttaggcgcctcggaggaattcttcccctggtgactatcctgcagtgcatgaagacagactctatccagaacagaactgcccgagccctcggtaacctggcgatggaacctgagtcgtgcggagatatccattgcgccggtgctgtgcctttgttagtggagagcctcacagcatgccaggactctcagtgcttgcaatccgtggtacgtgcgctgcggaatctggccgatagcccccaacatagactggcactggctcagcaaggcgcagtacgccctttggcagagttgctcgctactgcacctgatgctgctctgacactcgctttggtacgggctcttctggaactgtcccgcggttgttcgcgcgcttgcgcagagcagctgtccttaggagggggactggggcctctggtgagcctggcctctcacccgaaacgcgcagtgcgcgagggcacaatcttgattttggctaatttgtgcgcgcaaggattaatccggcctgctctaggaaacgcaggtggggtcgaagttctggttgatgaattacggcagcgaagggaccccaacggtgcctctcccacctcacagcaacctctcgtccgggcagtgtgtcttctctgcagagaagctattaaccgcgctcggctccgcgatgctggcggtcttgacctgttaatgggacttctgagagaccccagggcctctgcctggcatcctaggatcgtcgctgctcttgtgggctttctgtacgacacaggggctttgggcagactgcaggctctgggactagtgccattactcgctgggcaattgtgcggggaagccggtgaggaagaggaggagggaagagaggcagccagttgggacttccccgaggaacgaacacccgagcgcgctcaggggggatcgtttaggagcctgcggtcttggttaatttccgaaggatatgccaccgggcctgacgatatcagccccgactggtctcctgagcagtgtccccctgagcccatggagccggcttctccagccccaactccgacttcactgcgcgctcctcggacacagcgcacccccggaaggtctccagcagctgctattgaagaaccatgggggcgagagggccctgcactcctgctgctcagccgcttctcccaggcgccagatccgtccggggcactggtgacaggacctgcactttacggcctgctgacttacgtcaccggtgctcctgggccaccttcccctcgggctctgcgtattctgagcaggcttacctgtaacccggcatgtctcgaggcattcgtcagatcgtacggtgctgcactcctgagagcttggttagtactgggagtcgctcccgatgattggcctgccccacgggctcggccaactcttcactcgcgacaccgagagctcggtgagaggcttctgcagaatctgaccgtccaggccgaaagtcctttcggcgtcggagctcttacacatctcctgctgtctggatcacccgaggacagagtcgcctgcgcacttacccttcccttcatctgtcggaagcccagcttatggcggaggttactgttggagcaggggggtcttcgtcttctcctggccgctcttacacggccagctccccacccactgttcctgttttttgcagccgatagcctatcatgcctccaagacttagtctcgccaactgtgtcccctgccgtaccacaggcagtgcctatggacctggattctccaagtccctgcctttacgagcccctacttggccctgcccctgtccccgcacccgatctgcactttttattagattcagggcttcaactgcccgcacagagggcagctagtgccacagcttccccattcttccgagccctgctttccggctctttcgccgaggctcagatggacctggtgccgctgagaggactcagcccaggtgccgcatggccagtgctgcatcatcttcatggatgtagggggtgtggcgctgcactgggccctgtaccgcctccaggccagccattattggggagcgaggcagaggaggcccttgaagcagccggtaggttcctgttgccaggcctcgaagaggagctggaggaggccgtggggcgtattcatctaggccctcagggtggcccagagtcggtgggcgaagtattccggttaggcagaccacgacttgccgctcattgtgcccgttggactttggggagcgaacagtgcccaagaaaaaggggcctagctctggtggggctggtggaggctgcaggggaggaggctgggccactgactgaagcattactggccgtagtgatgggaattgagttgggggcaagagtgccagcctag

SEQ ID NO: 53148 - DNA, 1740 bp, Artificial Sequence
  Description of Artificial Sequence: Synthetic coding sequence
atgaaaactgattccatccagaatcgcaccgcacgcgcactgggtaatctggctatggagccagagtcgtgcggggatatccactgtgccggtgccgtgcccctgttagtagaatctctgaccgcgtgtcaggattcccagtgtctccagagcgtagccttgggcttagtgcctctcctggctggacagctatgtggcgaagcgggtgaagaggaggaagaaggccgtgaggcggcatcatgggattttcccgaagagaggacacccgagagagcccaaggcggtagttttaggtctctccgatcctggttaatcagcgaggggtatgcgaccggcccagatgatatttcgcccgactggagccccgaacagtgccccccagagccaatggagcccgcatcccccgcacctacacccacttcgctcagagcccctagaacccagaggacccccggtcgcagtcccgctgcggcaatcgaagagccctggggcagagaaggcccagccctactgcttctttcccggttcagtcaagctcctgatccaagcggcgctctggtgacaggacctgctctctatggtctgctcacatatgtgaccggggcacccggaccaccaagtccaagggcgttgaggatcctaagtcgcctgacttgcaatcctgcttgcctggaggcctttgtacgatcctacggcgctgctttactgcgcgcttggttggtattaggggttgctcctgacgattggcctgcaccccgagctaggccaaccttgcattcccgccatagagaactcggcgagcgactgcttcagaatctcacagtccaggcagagtctcccttcggggtgggagccttaacgcacctcctgctgtccgggtcccctgaagatagggtcgcctgcgcccttaccctgccattcatctgccggaaaccgtccctatggagacggctactgcttgaacaggggggactcagacttctgctggccgcactgaccagaccagctccccaccctctgtttctgttcttcgccgctgactctctctcctgtctccaggacttggtgtcacccacagtcagccccgctgttccacaggccgtgcctatggacctggatagcccgagcccatgtttatacgagccgctgctgggaccagcccctgtgcccgctccagaccttcacttcttgcttgactccggtctccaactccccgctcagagggctgcatccgctaccgcgtctccgttctttcgcgctctactgtccgggtcttttgccgaggcccagatggacctggttcccttgaggggtctgtcccccggagctgcttggccggtcctgcaccacctgcacggctgcagaggatgtggtgccgcactgggtcctgtgccccctccaggccaaccattgctcggctctgaagctgaggaagccctggaggcggcaggtcggttcctcctgcctgggctggaggaggagctggaggaggctgttggacggatccatctgggtccccagggaggcccagagagtgttggcgaagtgttccgcctagggaggcctcgcctcgccgctcattgcgccagatggactctgggtagcgaacaatgcccgcgaaagagagggctcgcactcgtaggcctagtggaagcggcaggagaagaggctggtcccctgaccgaagctctcctggctgtggttatgggcatagagctgggagcgagggtacctgcctag

SEQ ID NO: 53149 - DNA, 2178 bp, Artificial Sequence
  Description of Artificial Sequence: Synthetic coding sequence
atggccgcagctaagccaactctgaccgatagcctttcgttttgtttggcgcagctagccgctgccgctggagaagcactgggcggtgagaaggacccggcaaccaatgagacccccctcagccgagcgctgctggcccttagaacccgccatataaaggccgcaggaggaattgagcgctttagggcgcgaggcggactcaggccacttctcgcgctcctccgccgtgccgctgcggctggatcggcgcctagtcaggctgggccaggaagtgcgcctagttccgcagccagtggtgcctcttctcccgctcctgcatctggacccgctccatcagctgtttccagctcatcacccactcccccagtgcggctcaggaaaacccttgatctcgctctctccattctggctgactgttgtactgaaggggcttgcagaactgaggtcaggaggctaggaggtatcctcccactcgtgacaatccttcagtgcatgaagacagactcaattcaaaatcgtacagcaagagcactgggcaatctggcgatggagccagagagctgcggggatattcactgtgctggggctgtccctctactggtcgagtcccttaccgcatgccaggacagccagtgcttacaatccgtggtcagagccctaaggaacttagctgacagtcctcagcacagactggctcttgcgcaacaaggtgctgtgcggcctctggccgagctgctggcaaccgcaccagatgcagccctaaccctcgcgcttgtgagggctttgcttgagcttagtcgaggatgtagccgggcatgcgctgaacaattatcactcggagggggtcttggaccacttgtttcactggcttcccaccctaagcgcgcagtgcgagaaggtacaatactgatcttggctaacttatgcgcccaggggctaatccgccctgcattggggaatgccggaggagtagaggtgctcgtcgacgaattacggcagcggagggaccccaacggcgcatcccccacctcccaacaacccctggtgagagcagtgtgccttctgtgcagagaggccattaaccgggcaagactgcgggacgccggtggtttggatctgctgatggggctgctgagggaccccagggcctcagcttggcacccaaggatagtcgcagcactggtgggcttcctttatgataccggagccctcggtagactgcaggcactgggcctggtgcccctcctcgcaggccagttatgtggcgaggcaggcgaggaggaagaagagggaagagaagcagcctcttgggattttcccgaggaacgaacgcctgaacgagcccaagggggatcattccgaagcctgcgatcctggctcatctctgagggctacgccacaggcccagatgacatcagcccagattggagtcccgagcaatgcccccctgaaccaatggagcccgcttctccagcccctacccctacctcattaagagctcccaggacgcagagaacacctggcaggtccccagcagcagccatcgaagaaccctgggggcgagagggccctgcacttctgctcctctcaagattctcgcaggctccggatccctctggtgccctggtgaccggcccagctctctatggcctgcttacgtacgttacaggggctcccggaccccctagcccacgggctctcagaatcctttcccgactgacctgtaatccagcctgtctcgaggccttcgtgcggagctatggtgctgctctgttgagggcttggctcgtgttaggcgtggccccagatgactggccagcccctcgcgcacgtcctaccctgcattcacggcacagagaattgggcgagtttccttatcccccagtgtcccttcccccttgcgagtcaccctcgtcccctatggcctcaatgggccctgagccacatctgcccacacatctctcctctcctgctaggccaccagataatctatctcccgagtggggcggagagcagggggtccctgtgcccccatgggctcatagacaatcctccgctgttagctctgccctggcactcggaccaaggtaccccaactctaggtgcagcccagcccctaggatctgggctgggctctgttttttccccggatctgccattggatcagctctaagttag

SEQ ID NO: 53150 - DNA, 2904 bp, Artificial Sequence
  Description of Artificial Sequence: Synthetic coding sequence
atgcaccgcccacacgtgccaggatgcgctgcgatcaagttccgctctcttggttcagctgccaggtccggtgctgaaagcgaggctagagctaaaatggcagctgccaaaccaacactgacagacagcctgtcgttttgtctggcccagctcgcagcagccgctggcgaagctctcgggggagagaaggacccagcgacaaacgaaactcctctgagcagagcactcctggcactccggacccgccacattaaagcagctggcggaatcgagaggttccgcgcacgagggggattgaggccactgctggcactgcttcggcgagcagccgcagccggatcagcgccttctcaagctggcccagggtctgccccttcctctgcagctagcggagccagcagccctgctcctgcatctggcccagctccctccgctgtgagctcttctagtccgaccccccctgttcgacttaggaaaaccttggatctcgccctatccatcctagcagattgttgtacagaaggcgcttgtaggacggaggtgaggcggttgggcggtattctgccactggttactattctgcagtgcatgaagaccgattctattcaaaataggactgccagggcgctcggaaatttggccatggagcccgagtcctgtggtgatatacactgcgccggtgctgttcctctgctggtggaatcccttacagcctgccaggactcccagtgtctacagagtgtggtccgggctctaaggaacctagccgatagtcctcaacacagacttgctctggcccagcagggtgcagtgcggccattagctgaacttctggccacggcaccagatgccgctctcaccctggccctggtaagggcgctcctcgagctgtccagaggttgttctagggcctgcgccgagcagctgtccctcggcggaggactgggaccacttgtgagtcttgcctcacaccccaaaagagccgttagggagggcaccattctgatcttagctaacctgtgcgctcagggtttgattaggcccgctctgggcaacgcagggggagttgaagtgcttgtggatgagctgcggcagaggagagatcccaacggggcaagcccaacatctcagcaacctctggtccgggcagtgtgcttgttgtgccgcgaagccattaaccgcgctaggctgagagatgcgggtggactggacctcttaatgggattgctgagggacccccgtgcctccgcgtggcacccccgaattgtggctgcactggtgggatttctctatgacacaggtgcactcgggaggctgcaggctctcgggctggtccctctgttggcagggcagttatgcggagaggctggcgaggaagaggaggaaggcagggaggcagcttcttgggactttcctgaggagcgaacacccgaaagagctcaaggcggtagtttccgatcgctcagatcctggctgatttccgaaggatatgccaccggcccagatgacatcagcccagactggagccctgaacagtgccccccagagccgatggagccagcaagtcccgcacctactccgacttcgctgcgcgcacctaggacacagcggacccctggcaggagcccagcagcagccatcgaggagccctggggtcgagagggtccagctcttctcctcttatccagattctcacaggccccagatcctagtggtgcactggtgaccggcccagctttgtacggtctgctcacctacgtcaccggcgcacccggtcctcccagcccaagagcccttcggattctgtccagattgacttgcaaccccgcatgtctggaagcgtttgttcgctcttacggagcggctctcctgagagcctggctcgtgctcggggtcgcacctgatgactggcccgctccccgtgcccgtccaacattacacagtaggcatagggagctgggagagcggctgctacagaatctgacagtacaagctgaaagtcctttcggcgtcggcgctttaacgcacttgttgctaagtggtagtccagaagacagggtcgcatgcgctctcactctcccatttatatgcagaaagccgtcactctggagacggctgctgctggagcaggggggacttcggttgctgcttgcagcgctgacacggccagcacctcacccgttgttcctgttttttgctgctgattcactcagctgcctccaggaccttgtttctccgaccgtgtcacccgctgtgccccaggcagtaccaatggacctcgactccccaagtccctgcctgtatgagcccctgctcggcccagcacccgttccagctcccgacttgcactttctccttgattctggcctgcagttgcccgcacagagggcggcttccgctacagcatccccattttttagagctctgctctcgggcagtttcgccgaggcccaaatggacttggtaccccttcgaggactgtctcccggagccgcatggcctgtgctgcaccacctgcacggctgcagggggtgcggcgcagcactgggtcccgtgcccccaccaggccagccccttctgggaagtgaggcagaggaggccctggaggccgcagggcgtttcctgctacctggcttggaagaggaactggaagaggcagtgggacggatacatttaggcccacaggggggtcctgagagtgtcggcgaggtgtttaggttaggtcggcctaggctcgctgcacactgcgcccgatggacactcggatccgagcaatgtccgcgaaaaaggggactggcactggtgggcctcgttgaggctgctggtgaggaggctggacccctgacagaggctctgttagccgtggttatgggtatagagctcggcgctagggtacctgcatag

SEQ ID NO: 53151 - DNA, 1431 bp, Artificial Sequence
  Description of Artificial Sequence: Synthetic coding sequence
atggtgtccaaaagaatcgcacaggaaacatttgacgccgcagtgagagaaaacatcgaggagtttgcaatgggccctgaagaagctgtgaaagaggccgtggagcagttcgaatctcagggagtggatctcagcaatatagttaagacagcgcctaaagtaagcgccgatggctcgcaagagcctacacacgacattctgcagatgctcagcgacttgcaggagagtgtagcatcctctaggccacaggaagtcagcgcataccttacacggttctgcgatcagtgcaagcaggacaaagcctgtaggttcctcgcggctcagaagggtgcatatcccatcatttttaccgcatggaagctcgcgacggctggagaccaaggtctgctgcttcagtccctgaacgcactgtccgtcctcacagacggccagccagacctgcttgatgctcagggcctgcagctcctggtggccaccctgacacagaacgccgacgaagctgaccttacatgctctggtatacggtgtgtgagacacgcttgccttaagcacgagcagaacaggcaggacctagtaaaggctggagtgcttcctctcctcaccggtgctatcacccatcacggacatcacacggacgtggttagggaagcctgctgggctcttcgcgtaatgactttcgatgacgacatcagggtccccttcggtcacgcccacaatcacgctaagatgatcgtgcaggagaacaagggactcaaagtgctaatagaggccactaaggccttcctagataatccgggtattctgagcgagctatgtggtacattaagtcggctcgccattaggaatgaattttgccaggaagtggtggacttaggcggactgagtatcttggtgtcactgttggcagattgcaacgatcaccagatgcgtgatcagagcggcgttcaggaactggtgaaacaggtactgtccacactgcgcgctatcgccggtaacgacgacgtgaaagatgcaatagttcgggcaggcggaactgagtctatcgttgccgctatgactcagcaccttacttctccacaggtgtgtgaacagtcttgtgcggcactgtgcttccttgccctcaggaaacctgataacagccggattatcgtcgagggcggtggcgcagtggctgctctgcaggcaatgaaagcccatccgcagaaggcaggagtacagaaacaggcgtgtatgctcattcgtaatctggtcgcccatgggcaggcattctccaaaccaatactcgatctcggcgcagaggcccttatcatgcaggcgcgtagcgcgcatcgcgactgcgaagatgtggctaaagcggcactacgggatctcggatgccacgtcgaacttagggaactctggacaggtcagcgaggcaatttggccccttag

SEQ ID NO: 53152 - DNA, 1395 bp, Artificial Sequence
  Description of Artificial Sequence: Synthetic coding sequence
atgacctcctgccgatgtagtgtaacaagtcgctctctatggccagccttagcccctaggcgctgccagcatacctcgccggcttcagcgcagtgtaagcaggataaggcatgccgctttctggccgcacagaagggggcatacccgatcatcttcacagcctggaaactggcaactgccggagaccaagggctccttctgcaatctttaaacgcgctatccgttctaacggatggccagcctgatctcttagacgcgcagggacttcagctgctcgtggctaccctcacacagaacgccgatgaggcagacctgacctgttcaggcatccgttgtgtgaggcatgcctgcctcaagcacgagcagaatcgccaggacctggtcaaggcaggtgttctgcctttactgaccggggctattacccaccacgggcaccatactgatgtggtacgcgaggcctgctgggcactccgggttatgacatttgatgacgacataagggttccgttcgggcacgcacataaccacgctaaaatgatcgtgcaagagaataaaggacttaaggtgctgatcgaagccactaaggctttcctcgacaacccaggcatactttccgaactctgcggaaccttaagccggctggcgatccgtaacgaattttgccaagaagtggttgatctggggggtctctccatccttgtgagtctgctagcggactgcaacgaccatcagatgagagaccagagcggtgttcaggagttggtcaagcaggtcctctctacattaagagcaatcgccggaaacgacgacgtgaaggatgcaattgttagagctggaggcactgagtcgatcgttgccgcaatgacccagcatctcacttcacctcaggtttgcgagcagtcttgtgccgctctttgctttctggcccttcgaaagccggacaatagccgcatcattgtagaaggcggaggtgccgtcgccgctctgcaggcaatgaaggcgcatccccaaaaagcaggcgtgcagaaacaagcctgcatgctgattcggaacctggtggctcaccgcccatcaaggagcccttcctggacatggggcctgcgccacagcagctgtcgccctgacttacctactgtgactgtgcggacatggccgaggcccccatgcggcacttgggtggtaatgagtagctccgaatcctgtgggcaagccagaggtgcaacatggagacatgacccgagaccttctctcgttactcttggggaaagctgcgatagcggcatgggcgtcgacccatgcccaccactttctcctatctcttcagtccccttcactatgcgatctgttttctggcaagcactaggaaaaggtagcggggaaggaggcgctttgtag

SEQ ID NO: 53153 - DNA, 1431 bp, Artificial Sequence
  Description of Artificial Sequence: Synthetic coding sequence
atggtctcaaagcggattgcacaggagacgttcgatgcggctgtgagggagaatatcgaagagttcgctatggggccagaggaggccgtaaaagaagccgtggagcagtttgaaagtcaaggagtggatctgtctaacattgtgaaaaccgccccaaaagtctctgccgacgggagccaagagccaacccacgacattctgcaaatgctatccgacctgcaggaatctgtagctagttcacggcctcaggaggtaagcgcgtatctgaccaggttttgtgaccagtgcaaacaggataaggcgtgccgattcctcgccgcacagaagggagcctaccctataattttcaccgcgtggaaactggcaacagccggtgaccagggtttgcttctgcaatccctgaatgctttgagcgtgttgacagacgggcagccagacttactggacgcacaaggactccagctactggtcgcaactctcacccaaaatgcggatgaggccgacctaacttgtagcggtatcaggtgcgtccggcatgcttgcctcaagcatgaacagaatcgtcaggatctggtcaaagcaggcgttctgcccctcttaactggggctattactcaccatggccaccacacagatgttgtgcgcgaggcctgttgggctctcagggttatgacatttgacgatgacatcagggttccctttgggcacgcccacaatcatgctaagatgatcgttcaagagaataagggcctcaaagtgttgatcgaagccaccaaggcatttctggacaaccctggaatcctcagcgagctctgtggtaccttgagccggcttgcaattcgcaatgaattctgtcaggaggttgtcgatctgggcggtctttcaatcctcgttagcttgctggcagattgcaacgatcatcagatgagagaccagtcgggcgttcaggagctagtgaaacaggtgctgtcgactctacgggcaatcgcaggaaacgacgatgtcaaagatgctatcgtgcgggcaggaggcaccgagtccatcgttgcagctatgacccaacacctgacaagcccccaagtgtgtgaacagagttgtgctgcattatgctttcttgccttaagaaagcccgacaattcacggattatcgtggaaggaggcggagccgttgctgcgctccaggcaatgaaggcccacccgcagaaagcaggtgttcagaagcaggcctgcatgctgattcgaaacttagttgctcacggacaggcatttagtaaacctattctggacctgggcgcagaagcgctgattatgcaggcacgctccgcccacagggactgtgaggatgttgctaaagctgcactgcgtgatctagggtgtcacgtggagttaagggagctctggaccggacagcgcggaaacctcgcgccatag

SEQ ID NO: 53154 - DNA, 1506 bp, Artificial Sequence
  Description of Artificial Sequence: Synthetic coding sequence
atgagtgaacggtgctgttcccggtattcatccggcgcatcaatcgggtgtacccctacttccactcaggcaaaaatggttagcaagagaatagcgcaagaaacattcgacgcagccgtgagagagaatatcgaagaattcgcaatgggtcccgaggaagcggttaaggaagcagtcgaacagttcgaaagtcagggagtggacctgagcaatatagtcaagaccgctcctaaagttagcgccgatggctcgcaggagcctacccacgatatcctgcagatgctcagcgacctgcaggagtccgttgcaagctccaggccacaagaagtgagcgcttatctcactcggttttgtgatcagtgcaagcaggataaggcctgccgttttttagcggctcagaaaggtgcgtaccctatcatctttacagcctggaaactggcgacagctggagatcagggcttgctccttcagagcctgaacgctctgtcagtgctgactgacggacaacccgacctgctggacgcccagggactgcaactactggtggcgacactgacccagaacgccgacgaggctgatttaacctgtagcggcattaggtgcgttcggcacgcctgtttgaagcacgaacagaatcggcaagatctggtcaaggctggggtcttgccattgttgacaggtgctattactcaccacgggcaccacacagacgtcgtccgggaggcttgttgggctctccgggtcatgaccttcgatgatgatatccgcgtgccctttgggcatgcacacaaccatgctaagatgattgtccaggagaataaggggctgaaagtacttatcgaggccaccaaagctttcctggataatcctggaatccttagtgaactgtgcggtactctctcaaggcttgcaatacgaaacgagttttgtcaggaggtggtagatctgggaggactgagcatcctggttagtctgctcgccgactgcaatgatcaccagatgagggatcagtcgggcgtgcaggagcttgtgaagcaggtgctgagtaccctgcgggctatagctggcaatgacgatgtcaaagatgccatcgttcgcgcagggggaaccgagagcatcgttgccgctatgacacaacatctgacaagtcctcaggtgtgtgagcagtcctgcgcagctctttgcttcctcgcattgagaaaacctgacaattcccggattattgtggaggggggtggcgcagttgccgcattgcaagcaatgaaggcacacccacagaaggcaggagtacagaaacaagcatgcatgttgattaggaatctggtggctcatgggcaggctttcagcaaacccatcctcgatttgggtgctgaagccctaatcatgcaggccagatcagcccatcgtgattgcgaagacgtcgccaaggccgctttacgggatttgggttgccatgtggaacttagggagctgtggaccggccagaggggcaacttggccccttag

SEQ ID NO: 53155 - DNA, 1506 bp, Artificial Sequence
  Description of Artificial Sequence: Synthetic coding sequence
atgtctgagcgctgctgctcaaggtacagctctggggcatcaatcgggtgtacccccacttccactcaggcaaagatggtgagtaaaagaatcgcacaggagacctttgacgccgctgtgagagaaaacatagaagagttcgccatgggcccagaggaagccgtaaaggaggctgtagaacagttcgagtcccagggcgtcgatttgtccaacatagtgaagacagccccaaaagtgtctgccgacgggtcacaggaacccacccacgatatcctgcagatgctgagtgatctgcaggaatctgtggcctcatcgcgcccacaggaagtgagtgcttatctgacccggttttgcgaccagtgtaaacaggacaaggcttgtaggtttttggctgcacagaagggtgcctacccgatcatttttacggcctggaagctcgctactgcaggcgatcagggcctgctgctccagagcctcaacgctctgagcgtgttgacagatggacagcccgacctgctggacgctcaggggcttcagcttttagtcgcgacacttactcagaacgcggacgaagctgaccttacatgcagcggcatccggtgtgtccgacatgcctgcttaaagcatgaacagaaccgacaggacctggtgaaagctggggtgctgccacttctgactggggctattactcaccacggacaccacactgacgtcgtcagggaagcctgttgggccttgagggtgatgaccttcgatgatgatatccgcgtgcccttcggccatgcccataatcacgcgaaaatgatcgtgcaggaaaacaagggcctgaaagtactgatagaggcaactaaggccttcttagacaatcccggtatcctgtcagaattgtgtggcaccctttcaagactggcaatcaggaatgagttttgtcaggaggtggtcgatcttggaggattgtctatcctcgtctcccttttagctgattgtaatgaccatcaaatgagggaccagtcaggggtacaggaactggtgaaacaggtgctcagtacactgcgagccatcgccggaaatgatgacgttaaggatgctatcgtgcgagcagggggtaccgaatctattgtggccgctatgacacagcacctcacttcaccacaagtctgcgaacaaagttgcgccgctctgtgcttccttgccttaagaaaacctgacaactccagaattatcgtggaaggaggcggagccgtggctgccctccaggcaatgaaggcccaccctcaaaaggctggtgtgcaaaagcaggcatgcatgttgatccggaatctggttgctcatggtcaggccttcagcaagcccattctggatctgggtgccgaggctcttattatgcaggcgaggtcggctcaccgcgattgcgaagatgtggctaaggcagccctgcgggatcttgggtgccacgtcgagctgcgcgaactctggaccggacagagggggaacctggccccatag

SEQ ID NO: 53156 - DNA, 213 bp, Artificial Sequence
  Description of Artificial Sequence: Synthetic coding sequence
atggtgagtaaacgaatcgcccaggaaacatttgatgcggctgtcagagaaaacatagaagaattcgccatggggccagaggaagccgtcaaggaagccgtagaacagttcgagagccaaggcgttgatctctctaatattgtcaagaccgcccctaaagtgtctgcagacggctcacaggagccgacacacgatatcctgcaaatgttgtag

SEQ ID NO: 53157 - DNA, 774 bp, Artificial Sequence
  Description of Artificial Sequence: Synthetic coding sequence
atggtgtcaaaacgcatagcccaagagactttcgacgccgctgtcagagagaatatagaagagtttgccatggggcctgaggaggccgtgaaggaggcagtggagcaattcgagtcccagggcgtcgacctgtcaaacatcgttaaaaccgcaccaaaagtgtccgcggacggctctcaggagcccacacatgatatcctgcagatgctttccgacctgcaggagagcgttgcttccagccgacctcaagaagtgtccgcatatctgacccggttctgcgatcagtgtaaacaagataaggcctgtcggtttttggccgcacaaaagggggcatacccaatcatcttcaccgcctggaagctagcaacagctggggaccagggactcctcctgcagtctctgaatgcacttagcgtcctgacagacggtcagccagacctcctggacgcacaggggctacaactgctggttgctacacttacccagaatgccgacgaggctgacctaacatgttcaggtattcgatgcgtaagacatgcatgtctgaaacatgaacagaacagacaagatctggtgaaggctggcgttctgccactgcttacaggtgcaattactcaccacgggcaccatacagatgtcgttcgtgaggcctgctgggccctgagagtgatgaccttcgacgatgatattcgggtaccctttggtcacgcccacaaccatgctaaaatgattgtccaggagaataaagggctgaaggtgcttatcgaagcctag

SEQ ID NO: 53158 - DNA, 312 bp, Artificial Sequence
  Description of Artificial Sequence: Synthetic coding sequence
atggtgagcaagcgcattgcccaggaaacattcgacgccgctgtgcgcgaaaacatcgaagagtttgctatgggacctgaggaagccgttaaagaggctgtggaacaatttgagagccaaggggtggatcttagtaacatcgtgaagaccgcccctaaggtgtctgcggacggcagccaagaacccactcacgacatccttcagatgctgtccgatcttcaggagagtgtggcttcatcacggccacaggaggtgagtgcataccttactcggttttgtgaccaatgcaaacaggataaagcttgcagatag

SEQ ID NO: 53159 - DNA, 246 bp, Artificial Sequence
  Description of Artificial Sequence: Synthetic coding sequence
tgaaaggcccatccccagaaagctggagttcagaaacaagcatgcatgctgattcgaaacctggttgcccacgggcaggcattctccaagcccattcttgatctgggagccgaggccctgattatgcaagctagatctgcacatagggactgcgaagacgtggccaaggccgctctccgtgacctgggctgccacgttgagctgagagaactctggactgggcagcgcggtaatctggcgccatag

SEQ ID NO: 53160 - DNA, 93 bp, Artificial Sequence
  Description of Artificial Sequence: Synthetic coding sequence
atggtgtccaaacgaatcgcgcaggaaacgtttgacgccgctgtgcgggagaatatagaagagtttgccatgggtcctgaggaagccgtatag

SEQ ID NO: 53161 - DNA, 486 bp, Artificial Sequence
  Description of Artificial Sequence: Synthetic coding sequence
atggtttcaaagcgaattgctcaagaaacgtttgatgccgctgtccgggagaacattgaggaattcgctatgggacccgaggaggctgtcaaggaagccgtagaacaatttgagtcacagggagttgatttgtccaatatcgtgaagactgcccctaaagtctccgctgacggctcccaagaaccaacacatgatattctccagatgttgtccgatctgcaggaatcagtggcatctagtcgaccccaggaggtaagtgcttacttgacccggttctgtgaccagtgcaaacaggataaagcatgccggtttctcgctgcacaaaaaggagcataccctattatttttactgcgtggaaacttgccactgccggtgatcagggacttctgcttcagtccttaaacgctctgagtgtcctcacagacggccagcccgatttactcgatgcccaaggcctccaactgctggttgccacgctgacatag

SEQ ID NO: 53162 - DNA, 492 bp, Artificial Sequence
  Description of Artificial Sequence: Synthetic coding sequence
atgtctgagaggtgttgtagtagatatagctctggagcctccatagggtgtacaccgacttctactcaagccaagatggtgagcaaacggatagctcaagaaacgtttgatgccgctgttcgggaaaatatcgaggagtttgccatggggccagaggaagccgtgaaggaggctgtagagcagtttgagagccagggagtggacctatccaacattgtgaagactgccccaaaggtgtccgctgacggaagccaggaacctacgcacgacattctccagatgttgtcggatctgcaagaaagcgttgcatcctcccgaccgcaagaggtgtccgcctacttgactaggttctgtgatcagtgtaagcaggacaaagcttgccgcttcctcgctgcccagaagggggcttatcccattatttttacagcttggaagttagcaacagccggtgaccagggcttacttctgcaatccctgaacgcactctcctag

SEQ ID NO: 53163 - DNA, 780 bp, Artificial Sequence
  Description of Artificial Sequence: Synthetic coding sequence
atggtgtcaaaacgaattgcccaggaaacgttcgatgccgctgtgcgggagaatatcgaggaattcgctatggggccagaggaggcggtcaaggaagccgtggaacagttcgaatctcagggcgttgacctatccaacattgtgaagacagcgccaaaagtgtccgctgacggttcccaagagcccactcacgacatcttgcagatgctatccgacctccaggagtctgtggcatctagcaggccccaggaagttagtgcttacctgaccaggttctgcgaccagtgcaaacaggacaaggcctgccgttttctggctgcacagaaaggagcttatccaatcatcttcacagcgtggaaactggccaccgcgggtgatcaagggctgctgctgcagtcccttaacgccctcagtgtgctgaccgatgggcaacctgaccttctcgacgcccaggggctgcagctcctagtggctactttgacccaaaacgccgatgaggcagatctgacatgcagtggcattcgttgcgtccgccacgcatgtttgaagcacgagcagaaccgtcaggacttagtgaaagcaggcgttctgcctctcctaacaggcgctattacccaccacggacaccacacggacgttgtgagagaagcctgctgggcactgagagttatgacttttgatgacgacatacgggtgccctttggtcatgcacacaaccacgctaagatgattgtccaggaaaataaggggctaaaggtacttattgaggctacaaagtag

SEQ ID NO: 53164 - DNA, 597 bp, Artificial Sequence
  Description of Artificial Sequence: Synthetic coding sequence
atggctcaaaaacctaaggtggatccccacgtggggagactgggttatcttcaggcattggtcaccgagtttcaagaaacccagtcccaggatgcgaaggaacaggtcctggccaatctggccaatttcgcgtacgacccgagcaactatgaatacctcaggcaattacaggtattggatttgttcctggatagtcttagcgaggagaatgagacactggtggaatttgctattgggggtttgtgcaatctttgccccgacagagccaacaaggagcatatcctccacgccggtggagttcccctgattataaattgcctgtcctctccaaacgaggagacagtgttgtcagctataactaccctgatgcacctttctccgcctgggaggagctttttacctgaactcactgccactccggtcgtgcagtgtatgctgcgctttagccttagcgctagcgcgcgtttaaggaatcttgctcagatattcctcgaagatttctgtagccccagacaggttgcagaggccagaagtcggcaggcacactctgctctagggatcccgttgcctcggtctgtggcaccaaggcagcggtag

SEQ ID NO: 53165 - DNA, 1158 bp, Artificial Sequence
  Description of Artificial Sequence: Synthetic coding sequence
atggaagtgactgcatcctcacggcattatgtggacagactgttcgaccccgatccacagaaagtgctccagggcgtaatcgacatgaaaaatgcagtgattggcaacaataaacaaaaggcaaacctgattgtcctgggcgctgttccccgacttctctatttgctgcagcaggagacgtcctcaaccgaactgaaaactgaatgcgccgttgtgctgggatcccttgccatgggaactgagaataacgtcaaatctctgctcgattgtcatatcataccggcactgctgcaaggcctcctgtcacccgacctcaagtttattgaggcttgcctgagatgtctaaggacaatcttcacttcacccgtcacccctgaagagttgctgtataccgatgctactgtcattccccatttaatggccctgctgtcccgctctcggtacacgcaagagtatatctgccaaatttttagtcactgctgtaagggaccggatcatcagaccatcctcttcaatcacggcgctgtgcaaaacatcgctcatctcctgacttctctaagctacaaagtgagaatgcaggcgctgaaatgtttcagtgtcttggcattcgagaacccccaggtgtccatgacactggtcaacgtactcgtagatggtgagctcctcccgcagatattcgtcaagatgcttcagagagataagcccatcgagatgcaattgaccagcgccaagtgtttgacttatatgtgcagagcaggggcaatccgcacagacgataattgtattgtcttgaaaactctcccctgcctcgtccggatgtgctctaaggagagactgctggaagagcgcgtagagggagccgagaccctcgcctatctgatcgaaccagatgttgagctccagagaattgctagcataaccgaccacctcattgccatgctggccgattattttaagtaccctagctcagtctcagctataacagatatcaagcgactggaccacgacctgaaacacgcccacgagctgcggcaagctgcgttcaaactgtacgcaagtctgggcgctaatgacgaggatattcggaagaaggtaagtctgggcgagggacggccacctgtcctgacagcctccagacaaggagtgactagcacctag

SEQ ID NO: 53166 - DNA, 1992 bp, Artificial Sequence
  Description of Artificial Sequence: Synthetic coding sequence
atgagtgttctgagtgaggtgaccgcgagctctagacattacgtggaccgattgttcgatcctgaccctcagaaggtcctgcagggcgtgatcgatatgaagaacgccgtgatcgggaataataagcagaaggccaatttgatcgttcttggcgctgtgccccgtctgctctatctcctgcaacaagagacttctagtaccgagctgaagacagagtgtgccgtggttctggggtccctggccatgggaaccgaaaacaacgttaagtccctgttggattgccatattatccctgctctgctgcaaggccttctaagtcccgacctgaaattcatcgaggcctgtctccgatgcctccgcacaatctttacctctccagtgacgcctgaagagctgctttacacagatgctactgtgatcccccatctgatggccctcctgtcccgctctagatacacccaggagtatatatgtcagatcttctcccattgctgtaaggggcctgaccaccagacaatccttttcaatcacggcgcagtgcagaacatcgcccacctgctgacgtcactgtcctacaaagtgcggatgcaagcccttaagtgcttttccgtgttggccttcgagaaccctcaggtttccatgacacttgtcaacgtgcttgtggacggagaacttttgccacaaatctttgtaaaaatgctgcagagagataaaccgattgaaatgcagttgacaagtgccaaatgtctaacctatatgtgtagagccggtgcgatccggactgacgacaattgcattgtgcttaagaccctcccctgccttgtgcgaatgtgctcaaaagagaggcttctggaggagagagtagagggggctgagacactggcctatctgatcgagcccgacgttgagctgcagcgaatcgcttccatcaccgaccacctaatagcaatgctcgcagactactttaaatatccttcaagcgtcagtgctatcaccgatattaagcggttggatcacgacctgaaacacgctcacgagcttcggcaagcggctttcaaactatatgctagccttggagctaacgatgaggatatcagaaaaaagattatcgaaactgagaacatgatggacagaattgtaactggactgtccgagtcaagtgtgaaagtccggcttgcagctgtgcgctgtctacatagcctgtcccgatccgtgcagcagctacggacctcatttcaggaccacgctgtgtggaaaccactcatgaaggtattgcaaaacgcaccggatgagattctagtggtggcttcttcaatgctctgtaatctgctgctggagttcagtccgtctaaagaaccgatccttgaatctggcgctgttgaactgctttgcggtctgacccaaagcgagaaccctgctctgagggtgaacggtatctgggctttgatgaatatggcgttccaggccgagcagaaaataaaggcggatatactccggagcttgtccactgaacagttgttccgactgttgagcgattcagacctcaatgtgttgatgaagacccttgggctccttcgaaaccttctttccacaaggccacacattgataaaatcatgtcgacccatggcaaacagattatgcaggcggttacgcttatactggaaggagaacacaacatcgaggtgaaggagcaaacgctgtgcatcctcgcaaacattgcggacggcaccaccgccaaggacctgattatgacgaatgacgatattctacagaaaatcaagtattacatgggtcattcccacgtgaaactccagttagcagctatgttctgcatctccaatctgatttggaatgaagaggagggatcacaggagagacaagacaagcttcgggatatgggcatcgtagacatccttcacaaactatctcagtcgcccgacagtaacctgtgcgataaagctaagatggccctacagcaatacttggcttag

SEQ ID NO: 53167 - DNA, 597 bp, Artificial Sequence
  Description of Artificial Sequence: Synthetic coding sequence
atggcctgccttctggagactcccattcggatgagtgttctgtcagaggtgaccgcctcaagccgccactacgtggatcgactgtttgaccccgatccacaaaaagtactgcagggggttattgatatgaagaacgccgtgattgggaacaataaacaaaaggccaatctgatcgtgctcggagctgtacccagactgctatacctgctccagcaggaaaccagcagcactgaactgaagacagagtgcgcagtggtcctcggctcgctggcaatgggcacagagaacaatgtcaagagccttctggattgtcatatcatcccagcgttattgcagggactgctgagtcccgacttgaagtttatcgaggcgtgcctgaggtgcctgagaaccattttcacctcccccgtgacaccagaggagctcctgtacaccgacgcaacagtgatcccccatctgatggctctgctaagccggtctagatatactcaggaatatatctgccaaatcttctcacactgctgcaagggcccagaccatcaaaccatactcttcaatcatggagccgttcaaaacattgctcacctgttaacgtag

SEQ ID NO: 53168 - DNA, 393 bp, Artificial Sequence
  Description of Artificial Sequence: Synthetic coding sequence
atgaagaacgcggttatcggaaacaataagcagaaggctaatttgatcgtgctgggggctgtgcctaggctgttatacctcttacagcaggaaacctcaagtaccgaattaaaaactgaatgcgccgtcgtgctgggtagcctcgcaatgggtacagagaacaacgtgaaatcactgttagattgccacattatacctgccttgttgcaaggcttgctcagcccagatctgaaatttatcgaagcgtgccttagatgcctgagaaccatatttacctctccagttaccccagaggaactgttatacacagatgcgacagtcattcctcacctcatggcactgcttagccggtctcggtacactcaagagtatatctgtcaaattttcagctag

SEQ ID NO: 53169 - DNA, 81 bp, Artificial Sequence
  Description of Artificial Sequence: Synthetic coding sequence
atggaagtcacggcgtcctccaggcactacgtggatcgcttatttgaccctgatcctcagaaggtactgcaaggagtatag

SEQ ID NO: 53170 - DNA, 2022 bp, Artificial Sequence
  Description of Artificial Sequence: Synthetic coding sequence
atggcctgtctattggaaacccctattaggatgagtgtgctatcagaagtgactgcttcatccaggcattacgtcgacaggctattcgaccctgacccgcagaaggtgctgcagggagtgatagatatgaagaatgctgttattgggaacaacaagcaaaaagccaatctgatagtcctgggcgctgttccacggctcttgtatctgctccagcaggagacttcttcaacagaacttaagaccgaatgtgccgtggtgttgggatccttagccatgggaaccgagaacaacgttaaatcactgctggattgtcacattatccctgcactgcttcagggcctgctatcgccagatcttaaatttatcgaagcttgcttgcggtgtctgcggacaatctttacttctccggtcacgcctgaagagctcctgtacacagatgctaccgtgatcccccatctgatggctctcctttcccgatccagatatacccaggagtatatttgccaaattttttctcactgctgtaagggccctgatcaccaaaccatcctcttcaaccatggagctgtccagaatatcgctcacttgctaacatctctctcttacaaggtgcgcatgcaggctcttaagtgtttttccgtcctagcattcgagaatccacaggtgagtatgactctagtaaacgtccttgtggatggcgagctactccctcagatttttgtaaagatgctgcagcgggacaaacccatagagatgcaactgacctcggccaaatgtttaacttacatgtgccgtgcgggtgctatccggactgacgacaattgcatcgtgctgaaaacccttccgtgcctcgtcagaatgtgtagtaaggagcggttgctggaggaacgcgtcgaaggcgctgaaacgctggcttatttgatcgaacctgatgtggagctccagcggattgccagtatcacggaccacttaatcgccatgctcgctgactattttaaatatccgagtagcgtgagtgccatcacagatatcaagcgcttggatcacgatctaaaacatgctcacgagttgagacaagcagcattcaagttgtatgccagcctgggtgccaacgacgaggacatacgcaaaaagatcattgagaccgagaacatgatggatagaattgtcaccggtctgagcgagagctcagttaaagttcggttagccgcagtccgctgcttgcacagcttgtccagaagcgtgcagcagctaaggaccagctttcaggatcacgcagtctggaagccactcatgaaggtcctccagaacgccccagatgagattttagtggtggccagcagtatgctctgtaacctcttgctggaattctctccttcaaaagagccaatcctagagtctggcgcagtggaactcctgtgcgggctgacccagtctgagaaccccgcattgcgcgtcaatggcatttgggctttaatgaatatggcctttcaggccgaacagaaaatcaaggcagacatcctgaggagcttgtcaaccgagcagttatttcgattgctgagcgactctgatctgaacgtactcatgaaaaccctgggactcctgcgcaacctgttgtcgaccagaccccacattgacaagataatgtcaactcacgggaagcagataatgcaggctgttaccttgatccttgagggggagcacaatatcgaggtgaaagagcagactctgtgcattctggccaacatcgccgatggcaccacagcaaaggacctgataatgacaaacgatgacattctccaaaagattaagtactatatggggcacagccacgtaaagctgcagcttgctgcaatgttctgcatttctaacctgatatggaatgaggaggaaggatcccaagaaagacaagataaacttcgggatatgggaattgtcgacatactgcataaactctcacagtctcctgattctaacctgtgtgataaggcgaaaatggccttacagcaatatctcgcctag

SEQ ID NO: 53171 - DNA, 1158 bp, Artificial Sequence
  Description of Artificial Sequence: Synthetic coding sequence
atggaagttacagcaagttcgcgccattatgtggatagactgttcgatcctgatcctcaaaaagtgcttcaaggagtaatcgatatgaagaatgctgtgataggcaataataagcagaaggccaacctgatcgtcttgggagcagtgcctaggcttctgtacttgctccagcaggaaacctcttccaccgaactcaagaccgaatgcgcagtcgttctaggctctttggccatgggcacagagaataacgttaaaagcctgctcgattgtcacattataccagcgctcttgcagggcctcctctcacctgaccttaaattcatcgaagcttgtcttagatgcctaagaaccatcttcacttccccagtcactcctgaggagctgctgtatactgacgccacagtgattccgcacttgatggcgctgttatcaagaagccggtatacacaagagtatatttgccagatcttctcacattgttgcaagggcccagatcaccaaacaattctgttcaaccacggcgcagtgcaaaatattgcgcatctcttgactagccttagctacaaggtgcgcatgcaagctttaaagtgctttagcgttctagcgttcgagaatcctcaggtgtcgatgacactggtcaacgttctggtcgatggggaattactaccgcagatctttgtcaaaatgctccagcgcgacaagcctatagagatgcagctgacgtctgccaaatgccttacgtatatgtgtcgggcaggagctattaggactgatgataattgcatcgtgctaaagaccctcccctgtctggtgcgcatgtgttccaaggagaggctcctggaggaacgggtggaaggggcagagacgcttgcatacctgattgagcccgatgttgaattacagcggatcgcaagtattacagatcacctgatcgccatgctagcagactattttaagtacccttcgagtgtttcggccattactgacattaaacgactggaccatgatcttaagcatgcccacgagcttaggcaggcagccttcaagctttacgcctccctcggtgctaatgacgaagacatcagaaaaaaagtcagtctgggcgagggaaggccccctgtcctgaccgctagccgccaaggggttacttccacatag

SEQ ID NO: 53172 - DNA, 1980 bp, Artificial Sequence
  Description of Artificial Sequence: Synthetic coding sequence
atggaagtgacggcatcttcccgccactatgtggatcggctcttcgaccccgatcctcaaaaggtactgcaaggggttatcgacatgaaaaacgcggttattggcaataacaaacagaaggccaacctgatcgtccttggagccgtgccgcgattactgtacctgcttcagcaggagacaagctccacagaactgaaaacagaatgcgcagtggtcctgggcagtctcgccatgggcacagaaaataatgttaaatctttactggactgtcatatcataccagccctgctgcagggcctcctgtctcccgacctcaagttcatcgaagcctgcctgagatgtctccgaaccatttttactagccccgttacccctgaggaacttttatataccgacgctaccgtgatcccgcatcttatggcactgctttcaagatcccgctatacgcaagaatacatctgtcagatcttttcccattgttgtaagggcccagatcaccagaccatcctgtttaatcatggtgcagtgcagaatatcgcccacctcctgacttccctgtcttacaaggtcaggatgcaggcactgaagtgtttttcagtactagcatttgaaaatcctcaagtgagcatgacactggtgaacgtgcttgtggacggcgaactactccctcagatttttgtcaagatgcttcaacgagataaacccattgaaatgcagctgacctctgcaaagtgcctgacatacatgtgtcgagccggagcaatcaggactgacgacaactgcattgttttgaagaccctcccatgcctggtgcggatgtgctcaaaggaacgcttgttggaagagcgcgtggaaggagcagaaacactcgcatacctgatcgaacctgacgtcgagcttcagcgcattgcatcaattacagatcatttgattgcaatgctggccgactacttcaagtatccctcttctgtttctgccatcactgacatcaaaaggctagaccatgatctcaagcacgctcatgaactgcgtcaggcagcattcaagctgtacgcaagtctgggggcaaatgatgaggatatccgaaagaaaattatcgaaaccgaaaatatgatggatcgcattgtgaccgggctttctgagtcctctgtcaaggtgaggctggccgctgtacggtgtttgcactctctgtctagatcggttcaacagctgagaacatccttccaggaccacgcagtgtggaagcccctcatgaaggtcctccagaatgcaccagacgaaattctcgttgttgcttctagcatgttgtgtaacctccttttagaattctccccgtctaaagaaccaatcctggagtcaggggcagttgaactgctgtgcggactgacccagagtgaaaatccggcactccgggtaaacgggatctgggccctgatgaacatggccttccaggctgaacagaaaatcaaggctgacatcttaagaagtctttccaccgagcagttgtttcggctcctgagcgattcggacctgaacgtgcttatgaagaccctcggactgcttcgcaacctcctgtccacacgcccacatattgataagataatgagcacccatggtaaacagatcatgcaggctgtgaccctgattctggaaggcgagcataacatagaggtgaaggaacagacactatgtatactggctaatatagcggatggcactacagcgaaagaccttatcatgacaaacgatgatatactgcagaaaatcaagtactatatgggccatagtcacgtaaagttgcagctggccgctatgttttgtatcagcaatttgatttggaatgaggaagaagggtcccaggagagacaggataagcttagggacatgggaatcgtagatattctgcataagctcagccagagcccggactcaaatctgtgcgacaaggccaaaatggcactgcagcaatacttagcctag

SEQ ID NO: 53173 - DNA, 1896 bp, Artificial Sequence
  Description of Artificial Sequence: Synthetic coding sequence
atgaaaaacgcagtgatcgggaacaacaaacagaaagcaaacttaatcgtgttaggtgccgtgccacgcttgctctacctcctgcaacaggaaacatcgtctacagagctcaagactgagtgcgccgtggtgctgggctctttggcgatgggaactgaaaataacgtgaagagcttactcgactgtcacataattccggctttgctgcaaggtctgctctcaccagacttaaagtttatagaggcatgcctaaggtgcctgcgtacaattttcacatctcccgtcacccctgaggagctgctgtataccgacgccacggttattccacacttaatggccctgttgtctcggagtagatatactcaggagtacatctgtcaaatctttagtcattgctgcaagggaccagatcatcagacgattctgtttaaccacggagccgtgcagaatattgcccacttgctgaccagcctcagctacaaagtgagaatgcaggccttgaaatgcttttccgtgctggcatttgagaacccccaggtatccatgaccctggtgaatgttttagtcgatggcgaactactgccccagatcttcgtcaaaatgttgcaacgcgacaagcccatcgaaatgcagctgacctccgctaagtgcctgacatacatgtgcagagcgggagcaataagaaccgatgacaattgcatagtgctcaaaactctcccttgtttggtcagaatgtgcagtaaggaaaggctgttagaagaacgggtggagggcgctgagacactggcctacctgatagagccagatgtggaactgcagagaattgcatcaataaccgaccatttgatcgctatgctcgcagattacttcaagtacccttcatccgtgtccgcaattacagatatcaagcgccttgaccacgatttgaagcacgctcacgagctaaggcaggcagcttttaagctttacgccagcctgggggctaatgacgaggacatcaggaaaaaaatcatcgagaccgaaaacatgatggatagaatcgtcactgggctcagcgagagctctgtcaaggtgcgcctggcggctgtgaggtgtttacattctctgtctcgttcagtgcagcagctgaggacaagttttcaggatcatgccgtttggaagccattaatgaaagtgctgcaaaatgccccagacgagattctggttgtggcttctagcatgttatgtaacctcctcctggaattcagtccctccaaggagcccatcttggagtccggcgcagttgaattactatgtggtcttactcagagcgagaaccccgctctgcgggttaacggaatatgggccttgatgaatatggccttccaggctgagcagaagataaaagcggatattctaagatccctgagtactgaacagctgtttaggctcctctcggattccgatctgaacgtactgatgaaaactctcgggctcttgcggaatctgcttagtacacggcctcatatcgacaaaatcatgtccactcacggcaaacagataatgcaagccgtgaccctcatcctggaaggagaacacaacatagaggttaaagagcagactctctgcatccttgccaatattgccgatggaacaacggcaaaagatttgattatgacaaacgacgacatcttgcagaaaattaagtactatatgggacatagtcacgtgaagctacagctcgctgctatgttctgcatctctaaccttatctggaacgaggaggaaggatctcaagagcgccaggacaagctccgggacatgggcattgtcgacatcctccacaaactgagccagtcccccgatagcaacttgtgcgataaggcaaaaatggcccttcagcagtacctcgcctag

SEQ ID NO: 53174 - DNA, 1929 bp, Artificial Sequence
  Description of Artificial Sequence: Synthetic coding sequence
atggcctgcctactggagacgccaatcagaatgtctgtgctctccgaagtcaccgccagttcccgccattatgtggatagactgtttgaccctgacccccagaaagtactacagggcgtcattgatatgaaaaacgcagtaatcggcaataataagcagaaagctaacttgattgtgttgggggcagtccccaggctgctttatctgctacagcaggagacctcctcaaccgaattgaagacagaatgtgccgtagtgttgggaagtctggcgatgggaactgaaaataacgtgaaaagtctgctggactgccatattattccggcattgcttcagggcctcctgagccccgaccttaagttcatagaagcctgcctcaggtgcctgcggacgatcttcactagtccagtgacaccggaggaactgttatacacggggcctgaccaccagaccatcctctttaaccacggagccgtgcagaatatcgcacaccttcttacatccctgtcttacaaagtcagaatgcaggcactgaagtgcttcagtgtcctggcattcgagaatccccaagtgtcgatgacactggtgaatgtgctcgtggacggcgagttgcttccacagatctttgtcaaaatgctgcaaagagataaaccgattgagatgcagctaacgtctgctaaatgcctcacatacatgtgcagggctggcgcaatccgcacagatgacaattgtatcgtgctaaaaaccctgccctgtctggtacggatgtgttcaaaagagaggctactggaggaacgcgtggagggggcagagacccttgcctacctcatcgaaccagatgtcgaactccagagaattgcctccataactgaccacctgatagcaatgctggctgactactttaagtatccctcttccgtctccgccataacagacatcaaaagactcgatcacgaccttaagcacgcccacgagctccgacaggctgctttcaagttatacgctagcttgggtgctaacgacgaggacatcaggaaaaagatcattgaaacagagaatatgatggatagaatagtaacaggcctgtcagaaagttcagtgaaagtgagactcgcagccgtgaggtgcctgcattcgctctcccggtctgtgcagcagttaaggacatctttccaggaccatgctgtgtggaagccactgatgaaagtccttcagaacgcaccagatgagatccttgttgtggccagctccatgctctgcaacctgctgctcgaattttctccttccaaggaacccattctcgagtcgggcgcagtcgagctgctttgcggtctgacccagagtgaaaacccggctctccgcgtgaatggcatttgggcactcatgaatatggcatttcaggccgaacagaagatcaaggctgacattcttcgttcattaagcaccgaacagctctttcggctgttgtccgacagcgacttgaacgtgctgatgaaaactctcggtctgctgaggaacctccttagtacacggcctcacatcgataaaatcatgtcaacacacggcaagcagataatgcaggcagtgacgctgatcttggagggtgaacataatattgaagtcaaagagcagactctgtgcattctggctaacattgccgacggcacgaccgccaaggacctcatcatgacaaacgacgatatattgcagaaaataaagtattacatggggcactctcacgtcaagctgcagctggctgcaatgttctgtatttctaatctcatttggaatgaggaggaggggtcgcaagagcgacaggataagcttcgggacatgggcatcgtggacattctccacaaattatctcagtcaccagactctaacctctgtgataaggcgaaaatggctctgcagcagtatcttgcctag

SEQ ID NO: 53175 - DNA, 1593 bp, Artificial Sequence
  Description of Artificial Sequence: Synthetic coding sequence
tatcaagatgccactgtgattccccaccttatggctctgctatcacggtcccgctacacccaggagtacatctgccagatcttctcacattgctgtaaaggacccgaccaccagaccatcctgtttaatcacggtgctgtgcaaaacatagcacacctgcttacctcactatcttataaggtgcggatgcaagcacttaagtgcttctccgttcttgcattcgagaaccctcaggtaagcatgacgctggtgaacgtactagttgacggagagcttcttcctcagatcttcgtgaaaatgttgcaacgcgataaaccgatcgagatgcagctcacaagcgccaaatgccttacctatatgtgtcgagccggtgctatcaggaccgatgacaactgtatcgttctcaagactctgccatgcctcgtgagaatgtgttccaaggagcgcctactggaggaaagggttgaaggggcagagaccttggcctacctaatagagcctgatgtcgagctccagaggatcgccagtatcactgatcacctgattgccatgttggcagactactttaagtatccctccagcgtgtcggcaatcacagacatcaagcgtcttgatcacgatctgaagcacgctcacgaactccgccaggctgcatttaagctgtatgcctctctaggcgcaaatgatgaggatatcagaaagaaaattatcgagaccgagaacatgatggacaggattgtgactgggctgtccgaatcttccgtcaaggtgcggcttgctgctgtgcgatgtctgcattccctgtcacgcagtgtccagcaactgaggactagctttcaagatcacgccgtgtggaagccactcatgaaggtattacagaacgctccagatgagattcttgttgtggcaagctccatgctgtgtaacctgctgctggagttcagtccctccaaagaacctatcctcgaatccggcgctgtggagctgctgtgtggactgacacagagcgagaacccagcactgcgggttaatggaatctgggcgctgatgaatatggcttttcaggcggagcagaaaatcaaggctgatatattacgatctctcagtaccgaacagttgttccggctcctgagcgattcagatctgaatgtcttgatgaagaccctgggcctcctccggaacctgctcagtactagaccgcacatcgataaaatcatgagtacacacggcaagcagattatgcaagcggtgaccttgatccttgagggtgagcataatattgaagttaaagagcaaacactgtgtatcctggccaatattgcagatgggacaaccgcaaaggatcttatcatgactaacgacgacatcctccagaagatcaagtattacatggggcactcccacgtcaagttgcaactggcagctatgttctgtatatccaatctcatatggaatgaagaggagggatctcaagagcggcaggataagttgcgggacatgggaatagttgacattttgcacaagctatctcagagccccgattccaatctttgcgataaagcaaaaatggccctgcagcagtacctggcctag

SEQ ID NO: 53176 - DNA, 1998 bp, Artificial Sequence
  Description of Artificial Sequence: Synthetic coding sequence
atgggtgatatccttgctcatgagtctgagctcctcggacttgtaaaggaatacttagactttgccgaattcgaagatacactgaaaacgttttcgaaggagtgtaaaataaaagggaaaccgctgtgcaaaaccgttggaggatccttccgagacagcaaaagcctgactattcaaaaagatctcgtggctgcattcgacaacggggaccagaaagtgttttttgacctgtgggaggagcacattagttctagcatcagggatggagattcatttgcccagaaactggagttttacctccatattcattttgctatttacctgctaaagtattcagtgggccgaccagataaggaggagttggatgagaagatttcatacttcaagacctatctggaaacaaagggcgcagccttgagtcagacaacagagtttctgccattttacgcgcttccatttgtccccaacccaatggtacatccctcattcaaagagctgttccaggacagttggacacccgaattgaaactcaagctgatcaagtttctggctctcatatctaaggcatccaatacaccaaagctgctgactatttacaaggagaacggacaaagcaacaaggaaattctgcaacagctccaccagcaactggtagaagccgaaaggcgctccgtgacatacctcaagcgctataataagatccaggcggactatcacaacctcataggcgttactgctgagcttgttgactcccttgaggcgaccgtctcagggaagatgataacccccgagtatctgcagtccgtctgcgtaagactgttctccaatcaaatgaggcagagcctggcacactcagtggattttacgaggcccggtaccgcttctactatgcttagggcctcactagccccagtcaaactcaaagatgtcccgttactgccgagtctagactatgagaagctgaaaaaagatttgatcctcggcagcgaccggctgaaggcctttctgctccaagctctgcggtggagactaactacaagccatcccggagaacagcgcgagaccgtgctccaagcctacatcagtaatgacctcctggactgctactctcacaaccagagatctgtgctacaactgctccactccaccagcgacgttgtaagacagtacatggctcggctgatcaatgcctttgcctctttggccgagggtagactgtacctggcacagaacacaaaggtcctccagatgctggaaggtagactgaaggaggaagacaaggatattatcacgcgcgagaacgtccttggggcactacagaagttctcgctccgtcgtccacttcaaactgccatgatacaggatggtctgatcttttggcttgtagatgtgctgaaggacccagattgcctttcagactatacgcttgaatactcagtggccctgttaatgaacctgtgtttgcggagtaccggcaagaacatgtgtgcgaaagtcgccggtctggttcttaaggtgctcagcgacctcctggggcatgagaatcacgaaatccagccatatgtgaatggtgctctgtacagtatcctgagtgtgccttcaatccgtgaggaggctagggcaatgggtatggaagatatcctgcgctgttttatcaaagaaggcaatgcggagatgattcgccagatcgagtttatcatcaaacagctgaatagtgaggagctgcccgacggagtcctggagtccgatgacgacgaagacgaggatgacgaagaagaccacgatattatggaggcagacttagataaggacgaattgattcagccacagcttggagaactgtccggcgaaaaactgctgaccacagagtacctggggattatgacaaacactggaaaaacccggaggaaagggcttgctaacgtgcaatggagcggagatgagccactccaacggcctgtgacccccggaggacaccgcaacggatacccggtgtag

SEQ ID NO: 53177 - DNA, 2451 bp, Artificial Sequence
  Description of Artificial Sequence: Synthetic coding sequence
atgggcgacatcttagctcacgaaagcgaactgctaggcttggtaaaagagtacctggacttcgcagagttcgaggacactctcaagaccttctccaaagaatgcaaaatcaagggaaaaccactctgtaagaccgtcggcggatcatttcgagacagtaaatctctgactatccagaaggacctggtggcagcgttcgataatggtgaccagaaggtcttttttgatctgtgggaggagcacattagctccagtatccgcgacggtgatagcttcgcacagaagctggaattctatctccacatccattttgcgatttatttactgaaatattcagtggggagacccgataaggaagaattagacgagaagatttcttacttcaagacatacctagaaacaaagggtgcagccctgtcccaaacaactgagtttctacccttctacgcactgccattcgtgcctaatccgatggtgcatccgagctttaaagaactgttccaggactcttggacaccggagctgaaactgaaactcatcaagttcttggcccttatcagcaaagcgtctaacaccccaaagctgctgactatctacaaggagaacgggcaatcgaataaggaaatcttgcagcagctgcatcagcagttagtcgaagcagagcggcgtagcgtaacttatctaaagcggtacaacaagattcaggccgactatcacaacttgataggcgtcaccgcagaactggtggacagtctagaggccactgtctcggggaagatgatcactcccgaatacctgcagtcagtttgcgtcaggctgttcagcaaccagatgcggcaaagccttgctcattccgttgatttcactcgacccggaaccgcgagcactatgctccgagcaagcttagcccctgtgaagttaaaggacgtcccattgttgccatctttagactatgaaaagctgaaaaaagacttgatcttgggctctgacaggctgaaggcttttttattgcaggccctccgctggcggctgacaacgtcgcacccgggtgaacaaagggagacggttctacaggcatatattagcaatgacctgcttgactgctatagccataatcagagaagtgtgctgcagttgttgcactccacatcggacgtcgtgagacagtatatggcacggctgatcaacgctttcgcaagcttggccgagggacgactttacctggcccaaaataccaaagtcctccagatgctcgaagggagactgaaggaggaagacaaagatattattacacgggaaaacgttttgggcgctctgcagaaattttctttaagacgaccgctgcagacggccatgattcaagatggtctgatcttctggttggtcgacgttttgaaggatcccgactgcctctctgactacactctggagtattcagtggccctgcttatgaatctttgcctccgctcaacgggcaaaaatatgtgcgcaaaagtagctggactggtactgaaagtgctcagtgatctcctcggacatgagaaccacgaaatccagccttacgtcaacggggcattatactccatcctgtccgtgcccagcattcgtgaagaagccagagcaatggggatggaggatattctgagatgctttatcaaggaaggtaatgccgagatgatccggcaaatcgagttcatcatcaaacagctgaacagcgaggaactaccagacggagtcttggagtcagatgatgatgaggacgaggacgacgaggaagatcatgatatcatggaagcagatctggataaagacgaactgatacaaccgcaactgggcgagctgtctggcgagaaactgctgacaacagaatatttaggcattatgaccaacacgggtaagacacgcagaaagggactggccaatgtacagtggtctggggacgaaccccttcagagaccggttacgccaggtggccaccggaatggttatccagtggtggaagatcaacacacaccgcctcagacggcacagcatgctaggaacggacatccacaggccctgcctgctgctcacgaagcggtttatcgagaagggaagccttccacccctgagtcttgtgtctcatctagctcagcgatcattgccaaacctggggaatggctgccaagaggccgacaggaggaacccaggcccgctccaacgcccagacagccacgcgaagccccacaggacccgggtaatggcgtgaccacaagggagtgcgccagtgcattcacttgcaagcctcgggctccatgtacaccagagatgctggactggaatcctcctaaggcaaaagcaagcgttctggctccattgttcagcagctgcgggccacagcaggcctcccgccctggtagcacagccagctccacaaggggtctgccctcaaaagaaacccaccctaagtag

SEQ ID NO: 53178 - DNA, 501 bp, Artificial Sequence
  Description of Artificial Sequence: Synthetic coding sequence
atgggggatattctcgcccacgaaagcgagctgctggggctagtcaaagagtatctggatttcgctgaatttgaggacaccctgaaaaccttttcaaaggagtgcaagattaaaggcaagccactgtgtaagacagtgggtggaagctttcgcgatagtaaatcactaacgatacagaaagatctggtagcagcattcgataatggcgaccaaaaagtgttcttcgacctgtgggaggagcacatttcctcaagcattcgagatggtgattcattcgcccaaaaattagagttctacctgcacatccacttcgctatttatctgctgaaatacagtgtgggtcgaccagataaggaagagctggacgaaaaaattagctactttaagacataccttgagacaaaaggtgccgctctgagccagaccactgagtttctgcctttttacgccctgccattcgtccctaacccaatggtgcatccttccttcaaagaactctag

SEQ ID NO: 53179 - DNA, 1140 bp, Artificial Sequence
  Description of Artificial Sequence: Synthetic coding sequence
atgggttacgcacgaaaggtgggatgggtaacggccggacttgtgatcggtgcaggcgcatgttattgtatttatcggctgacaagaggcaggaaacaaaataaagaaaagatggcagagggcggtagtggagatgtggatgatgccggtgactgttcgggggctagatacaacgactggtccgacgacgacgatgacagcaatgagtctaagtcgatcgtgtggtatcctccttgggcacggataggcactgaagccggaacccgcgcacgggctagagctcgcgcaagagccactagagctcgcagggctgttcagaaacgggcatcacccaactctgatgacacagtgctgtctccacaggaactccagaaggttctgtgcctggttgagatgtccgagaagccttatattctcgaagccgctcttattgctttagggaacaacgcagcatacgcctttaatcgcgatattattcgggatctaggtggcctacccatcgtggccaagattctgaacaccagggatcctattgttaaagagaaggcccttattgttctcaataatctcagcgtcaatgctgaaaatcagcgacggttaaaagtgtacatgaatcaggtgtgtgacgacactataacctctaggttgaattcgagcgtgcaacttgccggacttcgtttgctcaccaatatgactgtgacaaatgaataccagcacatgctggcaaacagtatctcagatttcttccggctattttctgcagggaacgaggagacaaaactacaggtactgaagctactgctcaatctggctgagaacccggctatgacacgtgagttgctccgggcacaggtcccatcgtcactcgggagcctgttcaataagaaagaaaacaaagaggtgatactgaagctgctggtaatcttcgagaacatcaacgataattttaaatgggaggaaaatgagcccacacagaaccagtttggcgaaggaagcctttttttcttcctgaaggaatttcaggtgtgtgctgacaaggtgctcggcatcgagtctcaccatgattttctcgttaaagttaaggtaggaaagttcatggccaagcttgcagagcacatgttcccaaagtcacaagagtag

SEQ ID NO: 53180 - DNA, 1140 bp, Artificial Sequence
  Description of Artificial Sequence: Synthetic coding sequence
atgggctatgccagaaaagtgggatgggttaccgccggtcttgtgatcggtgccggtgcctgctattgcatttaccgcctcactagggggcgtaagcaaaataaagagaagatggctgaggggggaagtggagacgtagacgacgctggagattgcagcggcgcacggtacaatgattggtctgacgatgacgacgacagtaacgagagcaagtccatcgtatggtatcccccttgggctcggattggtactgaggccggtacacgggctcgcgcaagagcccgagcaagagcaacccgggctcgtcgggctgtccagaaacgcgcttcgccaaattctgatgacaccgttctgtcacctcaggaactccagaaggttctctgcctagtagagatgtccgagaaaccgtatattctggaagcagccttgattgctctggggaataatgccgcatacgcgttcaacagagatattattcgagaccttgggggtctgccaatagttgcaaagattctgaacactagagatcccattgttaaggaaaaagctctgattgttcttaacaacttgagtgtaaatgctgagaatcaaaggagactcaaagtgtatatgaaccaggtgtgcgacgacaccatcacctcccgtcttaactcctcagtccaacttgctggactccggctcctgaccaatatgactgtaactaatgagtatcagcacatgctggctaactccataagtgattttttccggttgtttagcgcaggcaacgaggagaccaagctccaagttctcaagcttcttctgaatcttgcagaaaacccggcaatgacccgtgagcttttgagggcccaggttccctcttcactggggtcgttgtttaacaaaaaggagaataaggaggtcatcctcaagcttcttgtgatattcgagaacatcaacgataattttaaatgggaggaaaacgagcccacacagaaccagttcggcgaaggcagcctgttcttcttccttaaagagttccaagtgtgcgcagacaaagttctgggcattgagtctcaccacgattttttagtgaaggttaaagtaggaaagttcatggcaaaactagctgaacatatgttcccaaaatcccaggaatag

SEQ ID NO: 53181 - DNA, 6872 bp, Artificial Sequence
  Description of Artificial Sequence: Synthetic coding sequence
atgggacggatccaggaggtcgggtgggtaactgccggtctggttatttgggcaggtacatgctactatatctataagtttacgaagggcagagctcagagcgtgaggaccctggccaggaatggtagcacagtgaaaatggaaaccgtcgtgggagtgcagtctcaaacacttgctataaatgaggcagagatcaaaacaaaaccccaagtggaaattggggcagagactggagcacgatccggccctcgagcggaggtggaaacaaaagctacagccattgctatccaccgggcaaacagccaggccaaggcgatggttggcgctgagcctgagacacagagcgagtctaaggtcgtggccggaactctcgttatgactgaggctgtcacactcactgaggtgaaggcaaaagcaagagaagtagccatgaaagaggctgttacacaaaccgacgctgaggctggcaaaatcgtgaagaaggaggccgtaacccagactaaggccaaggcatgggcattggtggctaaaacggaagcaaagcgagaggccatgactcagaccaaagcggagacccatatactggctgagaaagagacggagatcaatagagtcatggtgacccaatctgaaactctggctgtcccacgagaggtagctaaaatgggtgccaccaataaaacggggatcgtcgacgaaacgaagacgagggccttagaggagaccgtatctgtggcaaagactcagtcagaggccaggcccggtgccacggtggacgccagggggaaccccaacggcatgagccgagaggtggccggagttgacatgaagagctgtgcccaaagccaggccgtgaccaaaattcagggcgatgatatgcccggaactggcgtggaagacatgggcaactgtaagactatgtcccgcgcagagagcggcgcagacactcgggcaagcgcacagcctcagatttttgcaaagactcaaactgaggccatccctggcgctaagatcgacgctggcggtaacacaaacgcaatgtgtaaggtgggcgcaggggctgatgtgagggcctgtatccagccgcaaaccgtggctaaaaagcaggcagaagtgactagcggggctcgcgtggatgggaggggcaataccaatgttatttcgaaagctattactggggctgacatgcgcgctgcagcccagccccaggccgtagcttcaacccacgcagaggcgatgagcgatgcaaaagtgaagaaccggggaaaccctaatgcaatgaccaaagctggagcaaaggccaacctgcgcgctaatagtcaggtggaagccctgcccgacgccagagataagagcagagggaatcccaacgtgatggccaaggttggcgacggcaccgacatgctgagctgtacccaacctcaattggtcgcaagcgtccaggcagatacactcagcgacggaaagattaaggttcgcggaaatgtgaataccatgcccaaggagggcgcaggcgtcgacatgaaagcgcagggaatggcccagagccaaggcgaggcgctacccaataccagggggaaggctcggggaaaggccaaggctaaatgtaagactggtcccggaatggatatgaagacttgcacacagccccaggctggggtcaagacccctgcggaagctctcttggactcgagagtggacggaagaggcaaccccaatgcaactagtaaagctggcactaaggctgaccagcgggtgtgcggacaacctctggttgttgccaacccgcaaggcgaagccctgccgggtgccaagaataaggtcaagggcaacccccatactgtattgaaagttggcgctggcgaaggcacaacagatagtgcacagcccgaagcagtggtgtcattccagggagaagcactactcggcaccaaaaacaaggtgaaaggaaatcctaacgttgttcttaaagccgaagtcggggagggcgcaatgggcacagcccagttgcagatcatggcgtcaagcaaaggagaagccctcttggattctaagaacaaggtaaagggaaactcaaatgccgtctccaaggccggagcgggaaccgataccacaggctccgtacagccacagattgtcgctaactcacagggcgaagtgttgccaggggctaagaataaaattcgaggaaaccctactaccgtccccaatagtggagtgggcccttatactacagactcggcacgcctgcaagcagttgctaactcgcaaggagaagtgctgcctggcgcaaagaacaaagtgaaggcaaacctgaacgctgtttccaaagccgaggctgggatgggagccacaggtagcgtgcaacctcaggccgtcgcaaattcacactgcgaaaccctgcctggagctaagaacaaggttaggggaaactggaatgctgtgtctaaggctggggctggaatggacactcggggatctgctcaaccacaggcagtagctaacagccagggggaggtgcttccgggagcaaaaaataaagtcaaaggaaatcccaacgtggttagtaaagcaggagccagagaggacactgtgggatcaacgcagcctcaggtgttagcatcctcccagagagagactctgcccggagctaggaacaaagtcaaaggtaattccaatgtagtgtctaaggccggagctcgcgaggataccatgggctcagcgcagccacaggtggtggctaattcgcagcgtgaaaccctgccaggggctagaaacaaagtcaaggggaatagcaatgccatctcgaaagctgaggcgggagccggaatcatgggcagcgtgcaagtgcaagtagtggcttctttccagggcgaggtgctgcccggagccaaaaacaaggtgcggggaaacagcaatgccgtccccaaagctgaggctggggctgatacggttgggtctgcccaaccccaggcagtggctaatagtcagtccgaaacgctcttgggtgcgcgtaacaaagtgaaaggcaatacaattgccgtgcccaaggccggaactggcgctggaactcgccatagcgcacagccccaaatcgtcgctggaagccaaggcgagactctccctggcgcacgggacaaatccatgtcaacctctgaagctgaggccacagctgaagatgaggcctacgccaaacccgaagcagaggctatgcccaccagcgaatccgaaggaggaagtggcacccaagcctgtaggaaaacccagccgaacattcacgattattattggaacggtattggggtggaggactggattgctgccgaacgatggatcaagttccgcttccagaccatggacggagattgggaaaacagtgtcagttgggccgacgacgagaacgaagcctctatcgggagttggtcaggcgctagcgataaagcaggcattatcagatcatgggcggtggcttgcgatgagacgtccgttaaatcctgggctggagctcgcgctgagaatgtcgtgggcatcggtacctgggccagggctggcgaacaagccagcgggggactgtgggcgggaggacagaccagtgaggggacgtgggcaggcgataaggcttctggcggtgcctggaccggcgctgagaatcaggcctcaggaggcagctgggccctggccggaaaccaggccatcggtgagctgtgggctgcagggcaggccagcgatggatcctggcctgggggtcaagctagcggagtgtcttgggttggcgaggaggctattggcggatcttggaccggcgctgaaaatcaggcgtctgaagggagctgggcaggcgcaggcgcagggaatatgtcatccgtatcatattgggcaggggttgtcgatcaggccggaggaggttcttgggccggaaccagtgaccagtccggcggtggcagtaagccacgtttcgaggatcaggcgagcggcgaaggcagttgggcaggcgctggcggtcaagcctccggcggttctatgctgggaccggaagaccagtcatctggtagaagctgggctgataccgctgaccaagccagtggcggttcacggctaggccacgtcgatcagtctagcgggggtgcctgggccggaaccctggaccagagcggaggcggatcgaaacctaggtttgagaaccagactactgaagagggctcgtgggctggggcagggggacaggccggtggaggcagtaaagtcggaccggaagaccagtcttctggacggagctgggccaattcaggggatcagattagtggaggctttctggtcggtatcgtagaccaggccaacgggggttcatggacaggagctgggcaccccgcatctgtcggccctaaacctatttttgaagatcaggtctcaggcagaggctcgtgggccgatgcaagggagcaggttgtcggggattctagactcggcctcagagaccagtcgagcggagattcctgggccgatactggggatcaggcctctggatggttctgtgtgtgccccggaagtcagacaaacggaggtagttggggcggagcaagcgggcaggacgttggcggatccagaccgggtcctactaatcagtcaagcgccggatcatgggactcaccgggaagccaggtaagcggctcatgttggaccggggctggagccgtcgatcaggccggtgggtgctccaaacctggattcgaggatcaagctattgggggagggttttggccaggggcaggtgatcagacaggcggtggatcaagacccggatctgaagaccaatctagcggtataggcagctggggagtcgccggaggacaagttctaggcggagccagacccggtcccgcagatcagagcagcggtggatcctgggctggcactgggaaccagtcctctggcaggtcttggatcgggcctggggaccaggcagttgactgctctaagccggagttcgaggaccaggcctgcggcggtggttcatgggcaggtgctggctctcaggcaagcggtgaaagctgggctggaagcaggccagggaatgaagcaatcggcggtagcagaatggggtctgaagatcaagctacaggcggatcttgggcgcgaagcgaggaccaggcctcaggtcgatttcaggtgtccttcgaggtggaagccaatgaggggttttggttcgggccaggcgctgaggcggttatcggatcctggtgttggaccgaagaaaaggcggacatcgtgtcaagacccgatgataaagatgaggcaaccaccgcttctcgcagcggtgctggtgaggaagctatgatttgcagtcgtatagaagctgaaaataaagccagctccggctcttggattaggagcgaagaggtggcctatatgggaagctgcgtcggcgcagaggccggtgccggagcagaagctggggcaggggctgaggctggcgcaggggcaggtgcagaggccggtgctgaagccggtgcaggcgctggggctggcccagggacagaaagtggcgctggaatatggtcttgggacggcgacgccacaacagtggagtcccgactgggcgctggagaagaggcaggcgtggagagttggactctcgctaggaacgtgggggaagatgagctgtccagagagtcctctcctgacattgaggaaattagcttacgatcactgttctgggcagagagcgagaactccaataccttccgcagcaagagcgggaaggacgcttcgtttgagtctggcgcaggagataacacttccatcaaggataagtttgaggccgctggaggcgtggatatcgggagttggttttgtgccggaaatgaaaatacttcagaggataaatccgccccaaaggctaaagccaagaagagcagcgagagtcgtggtatttacccttacatggtccctggcgctggtatgggctcttgggacggtgcgatgatttggagtgagaccaaatttgctcatcagtcggaggcaagctttccagtagaagacgaatctagaaagcagacccgcactggagaaaagacacgcccttggtcatgcagatgcaaacacgaagcaaacatggatcctagggaccttgagaagctgatatgcatgattgagatgaccgaggaccccagcgtgcatgagatcgcaaataatgcactgtacaattccgccgattattcttactcacacgaggtcgtgcggaacgtggggggtattagcgtaatcgaatccctgcttaacaatccttatccaagcgtgcgccagaaagccctcaatgcactgaacaacatctccgtcgccgctgaaaatcatagaaaagtcaaaacatatctcaaccaagtttgtgaggatactgtgacatatcctcttaattccaacgtacaattggccggtctgcgccttatcaggcatttgaccatcacctctgagtatcaacacatggttacaaattatataagtgagtttttgcgcctgttaaccgtggggtccggagaaaccaaggaccatgttctgggcatgcttctcaacttcagcaagaaccctagcatgacaaaggatttgctgattgctaacgctcctacctccctcataaacatttttagcaagaaagagaccaaagagaatatactcaatgccctgagcctgttcgaaaacattaactatcactttaagcggcgagccaaggcctttacacaggataagttcagcaagaacagtctctattttttgtttcagaggccaaaggcttgcgcaaaaaaactcagagccttggcggctgagtgcaacgacccagaggtgaaggaacgtgtcgaactgcttattagcaaattgta

SEQ ID NO: 53182 - DNA, 903 bp, Artificial Sequence
  Description of Artificial Sequence: Synthetic coding sequence
atgggcagagcaagagaggtgggatggatggctgcagggctgatgatcggagcaggcgcttgctattgcgtctacaagctgactattggcagagacgattcagagaagctggaggaagagggagaagaagaatgggatgacgatcaagaattggacgaggaagagccagacatctggtttgatttcgaaaccatggctagaccctggaccgaagatggcgactggacagaaccaggcgctccgggtggcaccgaagaccggccttcaggaggcggaaaagccaatcgcgcacaccccatcaagcagagaccattcccctatgagcataagaatacgtggtcagcccaaaattgtaaaaatggctcctgtgtcctcgatctctcaaagtgtttattcattcagggcaagcttttgtttgccgaacctaaggacgccggtttcccttttagtcaggatatcaactctcatctcgcctccttatccatggcacggaacacttcccccacaccagatcccacggttcgggaagcactctgcgcacccgataatttgaatgccagtatcgaaagccagggccaaatcaaaatgtatataaacgaggtttgcagagagacggtgtctcgctgctgtaactcttttctgcagcaagccggtctcaatttactgattagcatgacagtaatcaacaatatgctggcaaagtccgcatctgatttaaagttccctctgatatctgaggggagcggttgcgcgaaggtgcaggtcctcaagccactgatggggctctccgaaaaaccagttctcgcaggggagttggtgggtgcacagatgctgttcagctttatgtccctgtttattcggaacggaaatcgggagattttgctcgagacccctgccccatag

SEQ ID NO: 53183 - DNA, 903 bp, Artificial Sequence
  Description of Artificial Sequence: Synthetic coding sequence
atgggcagagcccgtgaagtgggatggatggctgctgggcttatgattggcgcaggagcctgctattgcgtttataagctgaccattggcagggatgactcggaaaagctggaggaggagggggaagaggagtgggatgacgaccaggagctggacgaggaggaaccagatatctggtttgactttgaaaccatggctcgcccatggacggaagacggtgactggaccgagcccggagctccagggggtaccgaagaccgtccaagtgggggtggcaaggccaatagagcgcatcctatcaagcagcgcccatttccatacgagcacaaaaacacttggtccgcacagaactgtaagaatgggtcttgcgtactggacctgtcgaagtgcctgttcatccaagggaaactgctgttcgctgagcctaaggatgctggtttcccattcagccaagacatcaactctcacctggcatcgttatccatggccagaaacacttcaccaacacctgatcctacggtgcgggaggccctatgcgctcctgacaacctgaacgcttctattgaaagtcagggccaaatcaagatgtatataaacgaggtttgccgggaaaccgtaagtaggtgctgtaactcattcctgcagcaggccggactgaacctgctcatctccatgacggtgataaacaatatgctggcaaaaagcgcctcggatttgaaattccctcttattagcgaggggtcggggtgtgctaaggttcaggtactgaagccactcatgggcctcagtgagaagccagtgctcgcaggggagctagtcggtgcccagatgttgttcagtttcatgagcttgtttatccgaaacgggaatcgcgaaattctgctggagacccctgccccatag

SEQ ID NO: 53184 - DNA, 903 bp, Artificial Sequence
  Description of Artificial Sequence: Synthetic coding sequence
atggggagggccagagaggttggctggatggcagcaggtttgatgatcggcgcaggtgcatgctattgtgtatacaagctgaccatcggcagggatgactccgagaaactggaagaggaaggtgaagaagagtgggacgatgatcaagaactggatgaggaggagccagatatttggtttgatttcgaaacaatggctagaccatggacagaagacggcgactggactgagcctggagcaccagggggaacggaagacagaccctcaggcggagggaaggccaatcgcgctcatcccatcaagcagagaccattcccctatgagcataagaacacgtggagtgcacaaaattgtaaaaatggatcatgcgtgctggacctatcaaaatgtttattcatacagggtaagcttttattcgccgagccaaaggatgcgggatttcccttcagccaggatatcaactcacatttggcttctctatcgatggcgagaaacacaagtcctacccccgatcctaccgttcgggaagcgctatgcgccccagataatctcaatgcgagcattgagtctcagggccagattaaaatgtacattaacgaagtgtgtagagaaacggtgagcaggtgttgcaactcattcttacagcaggctggactgaatctcttaatttccatgactgtaattaataatatgctcgctaaatccgccagcgacctgaagtttccacttatttcagaaggaagtggctgtgctaaggtccaagttctgaaacctctgatggggctcagcgaaaaacctgtcctggccggagagttagtgggggcacagatgttattcagctttatgagtttgttcattcgcaacggcaatcgagagattcttctggaaactcctgcaccttag

SEQ ID NO: 53185 - DNA, 1677 bp, Artificial Sequence
  Description of Artificial Sequence: Synthetic coding sequence
atggtggattccgggaccgaggctagggcacgaggaaaggcggaggccggactgcaagacggcattagcggaccagcaacagcgagggtaaatgggaagactcaggccgaggctgtggctgaagcggaactcaagactgagtccgtgacacaggccaaggcgggtgacggggctatgacgcgtacacacactgtcacctatagagaggcgatggccgtgacacgcgaagtgattaaagtggaggacacaacaaagacccgggttatggtagaaaccaagactaagccccttgctgagaggtccattgttcctcagaccaagagcaaggcaatgccaatgtcaagagtttctactgtgaccaaaagcgaagttaaagtggttgccgtcatcgaggcaaatatcagaagctacgccaaatcccacgataaagcaaatacggggtcacggcctgatcgaagggaagagactagcatagggatgaaaagttcagacgaagacgaggaaaatatttgcagctggttctggaccggggaggagccttccgtcggctcttggttctggcctgaggaggaaactagtctgcaggtctacaagccacttcctaaaatccaggagaaacctaaaccaacacacaaacccacactcacaatcaagcagaaggtgattgcgtggtcccgagccagatacatcgtcctggtccctgtggaaggaggcgagcagtccctgccgcctgagggcaattggaccctcgtggaaaccctgattgagaccccattaggcatacggccacttacaaagatcccgccttatcatggcccatattatcaaactttagccgagatcaagaagcagattagacagcgcgaaaaatatggacccaacccaaaggcttgtcactgcaaatctcgcggattttcactggaaccgaaagagtttgataaactggttgcgttactcaagctgacaaaagatccctttatccacgaaattgcaacaatgatcatgggcatttcccctgcctacccattcacccaggacatcatccacgatgtgggtatcaccgttatgatagaaaaccttgtcaacaatccaaatgtgaaagagcatccaggagctctgagcatggtggatgattcatccgagagcagcgaagagccaaagtccggggaatcatacattcaccaggtctgtaaaggtataatcagctgcccattaaactcccctgttcagctcgctggcttgaagctgctgggccacctgtccataaagtttgaagatcattacgtgatcacctcctatattcctgacttcctcactttacttaataaaggctccgtgaagaccaaattttatgtactcaaagtttttagttgtctctccaagaaccacgccaacactagggagctaatctctgccaaggtgctgtcctcgttggtggccccttttaacaagaacgaatctaaagcaaacatcttaaatattatcgaaatcttcgagaacatcaattttcagttcaagaccaaagcgaaactcttcaccaaggaaaaatttaccaagtcagaattgatatcgatcttccaggaggcgaagcagtttggacagaaactgcaggatctcgccgaacactccgacccagaggtccgggataaggtcattcggctgatactaaagctgtag

SEQ ID NO: 53186 - DNA, 1677 bp, Artificial Sequence
  Description of Artificial Sequence: Synthetic coding sequence
atggttgattctggcacagaggcccgtgcgagagggaaagcagaggccggtttgcaagatggtatctctgggcctgccacagccagagtaaacggcaagactcaggccgaagctgttgcggaagctgagttaaaaacagagtcagtgacacaggcaaaggcaggagatggggctatgaccaggactcacaccgtaacttaccgtgaggcgatggctgttactagggaagtgatcaaagtggaggatactacaaaaacccgtgtgatggtggaaactaaaacaaagcctcttgcggaacgcagtattgtgcctcagaccaaaagcaaagcaatgcccatgtctcgagtctccactgtgacaaagtctgaagtgaaggtggttgcggtcatagaagcaaatatacgatcctatgccaagagtcatgataaggctaacacaggctctaggcctgatcgacgggaggagacttctatcggcatgaagagtagcgacgaggatgaagagaatatttgcagctggttctggactggagaagagccgtccgtggggagctggttttggcctgaagaggagacttctctccaggtctacaagccactgccaaagatccaggaaaaaccgaaacccacgcacaaaccaaccctgacgattaagcagaaggtaatagcatggtcaagagcccgatacatcgtgttggtgccggttgaggggggagagcaatctctcccccctgaagggaattggacattagtggagacgcttattgaaacaccccttggaatccgccctctgaccaagataccgccataccatgggccttattaccagacccttgctgaaatcaagaagcagatacgacagcgggaaaagtatgggcctaatcccaaggcatgtcactgtaagtccagaggttttagcctggaacctaaagagttcgacaaactggtggccctcctcaagcttactaaagatccatttattcatgagattgcgacaatgatcatgggcatctcaccggcataccctttcacacaagatatcattcatgacgtcggaataacagttatgatcgagaatttggttaacaaccccaacgtgaaggagcatccgggtgccctttccatggtcgatgacagctctgaatcttccgaagagcctaaaagcggcgagagctacatccatcaggtgtgcaaagggattatctcctgtccactaaactcccccgtccagctagcaggcttaaaattgctgggccatctatccataaaatttgaggaccattatgtcattacatcttacattcccgactttctcacgcttctcaataagggttccgtaaagacaaaattttatgtccttaaagtgttctcgtgcttgagcaagaatcacgcaaatacacgggagctgataagcgctaaggtgctgagctctctggtcgcgccttttaacaagaatgaatcaaaggccaacattctgaatattatcgaaatctttgaaaatatcaacttccaattcaaaaccaaagccaaactgtttacaaaggaaaaatttacaaagagcgagcttatttcgatatttcaggaagcgaaacagttcggccaaaagctgcaggaccttgctgaacatagtgatcccgaagtcagggataaggtcattagactgattcttaaactgtag

SEQ ID NO: 53187 - DNA, 1677 bp, Artificial Sequence
  Description of Artificial Sequence: Synthetic coding sequence
atggtggactccggaactgaagccagagcaaggggaaaggccgaagctggactgcaggatggcatcagcgggcctgcgacagcccgagtcaacggcaagacgcaggctgaagcggtggccgaagccgagctcaaaacggaaagtgtcacccaggctaaagccggtgacggcgctatgaccagaacacatactgtaacctacagggaggcaatggctgtgaccagagaggtgatcaaggtcgaagacactaccaagacgcgtgtcatggtcgagacaaaaaccaagcccctggcggagaggtctatcgtcccccagaccaagtctaaggcaatgccaatgtcaagagtgtccacagtcacaaaatcagaggtgaaggttgtggctgtgatagaagccaacattaggtcttatgccaaatctcacgacaaagctaacactggctcgagaccggacagaagagaggaaacttctatcggaatgaaaagctcagatgaggacgaggaaaatatttgttcgtggttctggaccggggaggagccatctgtgggcagctggttctggccggaagaagaaactagtctccaggtgtacaagcccttgcctaagatccaagagaaacccaaacccacccacaagccgacacttactattaagcagaaagtcatagcatggtcgcgtgcccgatacatcgttctggtcccagtcgaaggcggtgaacagtccttaccgccagagggaaactggacactggtggagacactgattgaaactcccctgggcattagacctctcaccaaaatccctccttatcatggtccgtattatcagacgctggcagagattaagaagcagatacgccagagggaaaaatatggccctaatcccaaggcatgccactgtaagtcccgagggttcagccttgagcccaaagaatttgataaacttgtcgctcttctcaagctgacaaaggaccccttcatccatgagatcgcaacgatgattatggggatctccccggcttacccattcacgcaggatatcattcacgacgtgggtataaccgtgatgattgagaacctcgtcaataatccgaacgtgaaggagcatccaggagcactgtcgatggtggatgattcttccgagtcatcggaggagcccaaatctggagagtcttacatacatcaggtgtgtaaaggtattatcagttgcccgctgaacagccctgtccagttagcaggcttaaaactgctggggcaccttagcattaaatttgaagatcactacgtcattacgtcttatatacccgacttcctgacgttgctgaacaaagggtctgtcaagacaaaattttacgtgttgaaagtgttctcctgtctgagcaagaaccacgcaaacactcgcgagttgatcagcgccaaagttctatcaagcctggtggcaccattcaataaaaacgagagcaaggccaatatcctgaatatcattgaaatcttcgaaaacattaacttccagttcaagacaaaggctaaactcttcactaaggagaagtttacaaagagcgagttgatcagcattttccaggaggccaaacagtttggccagaaactgcaggacttagcagaacattcggaccctgaggtgcgggacaaggttattaggttgatcctgaaattgtag

SEQ ID NO: 53188 - DNA, 1677 bp, Artificial Sequence
  Description of Artificial Sequence: Synthetic coding sequence
atggtggattcagggaccgaggcccgtgcacggggtaaggctgaagccggacttcaggatgggatctcaggtcctgcgaccgccagagtgaatggaaagacacaagctgaggcggttgcagaggccgagctcaaaacagaatccgtgactcaggctaaagcaggagatggcgctatgacccgcactcacactgtgacgtatcgggaagctatggccgtaactagggaggtgatcaaggtggaagataccactaagactcgggtgatggtggaaactaaaaccaagccactggctgaacgatccattgtgccccagacaaagagtaaagcaatgcccatgagcagggtaagcaccgtgaccaagtccgaggtgaaggtcgtagccgtaattgaggccaatatccggagttatgcaaaaagccacgacaaggctaacaccggctcgaggccagaccgtagagaggagacttctatcgggatgaagtcatccgacgaggatgaggagaacatctgctcatggttctggactggtgaggagccatccgttggctcctggttttggccagaagaagagacaagcctccaagtatataagcccctcccaaagatccaggagaaaccaaaacctacacacaaaccgacgttgacaataaaacagaaggttatagcctggagccgggctcgctacattgtgctcgtgcctgtggaaggtggcgaacagagcttaccccctgaaggcaattggactctggtggagactctgatagaaaccccgcttggcataaggcctctcactaaaattcccccttaccatggtccatactatcagaccctggccgagatcaaaaagcagattcgccagagggaaaaatatggtcctaatccaaaggcgtgtcattgcaagagccggggattttcccttgaacccaaggagtttgataaactcgtggcactgctgaagcttacaaaagacccattcatccatgagattgcaacaatgatcatggggatctctccagcctatccctttacgcaggatatcatacacgatgttggcatcacagtgatgatcgagaatcttgttaataaccccaatgtgaaggaacaccccggagctctgagcatggtggacgacagctctgagtccagcgaagagccaaagagtggggagtcgtacatccatcaggtctgcaagggtatcattagctgtccactgaatagccccgtacagcttgccggattgaagctgttggggcacctgtctatcaaattcgaggaccactatgtgataactagctacattcctgattttctgacacttctcaacaagggaagtgtcaaaactaagttctacgttcttaaagtgttttcatgtctgtctaaaaaccatgccaacacacgcgagcttattagtgcaaaagtccttagcagcctggtcgcgcctttcaataaaaatgagtccaaagccaacatactcaatattattgaaattttcgaaaacatcaactttcagttcaaaacgaaagctaaactctttaccaaagagaagttcactaaaagcgaactgatttcaattttccaggaggcaaaacagtttggccagaaactgcaagatctcgccgagcacagcgatccggaggtgcgtgacaaagtgataagattgatactgaagctatag

SEQ ID NO: 53189 - DNA, 1677 bp, Artificial Sequence
  Description of Artificial Sequence: Synthetic coding sequence
atggtggattctggtacagaagccagggctcgcggaaaggccgaggccggactccaggatggtatctcaggcccagctacagctcgggtgaatggcaaaactcaggcagaggcagtggcagaagctgaacttaaaaccgaatcagttactcaggccaaagctggtgatggcgcaatgacgcggactcataccgtaacatacagagaggctatggccgtaactcgggaagtcatcaaggtggaggataccaccaaaacacgcgttatggtggaaacaaaaacaaagcccctggctgaacgcagcatcgtgccacagaccaaaagcaaggccatgcctatgagccgggtctccactgtgaccaagagtgaagtgaaggtggtggctgtgatcgaggccaacattcggagttacgctaagtctcatgataaggctaatacgggctcaaggcctgatcggagagaggaaacgagtattggcatgaagtcctcagatgaggacgaggagaacatttgtagttggttctggaccggggaggaaccttcggtgggcagctggttctggccagaggaggagacctctctccaggtgtataagcccctgccgaagatccaagagaagcccaaacctacccataagcctactctgaccatcaagcagaaagtcatcgcatggtcaagggctcggtatatcgtcctggtgcctgttgagggcggagagcagtccctcccccctgaaggtaactggacacttgtggaaacgctgattgagacgccactgggtattcggccattgacgaagattcctccatatcacggtccatattaccagacgctggccgaaattaagaagcagatccgacaacgggaaaagtatggacccaaccctaaggcctgccactgcaaatctcggggattcagcctcgagcccaaagagttcgacaaattggtcgccttgctcaaactcacaaaagatccattcatccacgagatcgcaactatgattatgggtatttcacctgcgtaccctttcacacaagacattatccatgatgtgggaattacggtgatgattgagaatctggtgaataatccaaatgttaaagagcaccccggagccctgtccatggtggacgactcgtccgagagctcagaggaacctaagtctggcgaatcatacattcaccaggtctgcaaaggtattatctcttgtcccctaaattcaccagtgcagctggctggtctgaagctattgggccatctgtcaattaagttcgaagatcattatgtgatcacatcgtatattcctgacttcctcacgttactgaacaagggaagcgttaagacgaagttctacgtgttgaaggttttctcctgtttatcaaaaaaccacgccaacaccagggaattaatttccgcaaaggtgctctctagtctggtggcgcctttcaacaagaatgagtccaaagctaacatcctcaatataatcgaaatctttgaaaacatcaacttccaatttaagaccaaagccaagctgtttaccaaagaaaagttcactaaaagcgagctgatctcaatctttcaggaggcaaaacaatttggccagaaactccaggaccttgccgagcattcagacccagaggtgcgcgacaaagtgatcaggctgatattaaaactctag

SEQ ID NO: 53190 - DNA, 633 bp, Artificial Sequence
  Description of Artificial Sequence: Synthetic coding sequence
atgttcgaatcctttaacgtgcccggactttacatagcagtgcaggccgtcctggctctggcggctagctggaccagtcggcaagttggtgaacgcactctcactggcattgtgatcgattctggcgacggggtcacccatgtgattccggtggcagaagggtacgttataggtagttgtattaagcacattccgatagcagggagggacatcacctattttatccaacaacttctgagagagagagaggttggaattccccctgaacagagtctggagactgccaaggctataaaagagaaatactgctacatttgtcctgacattgttaaggagtttgctaaatacgacgttgatccgcaaaagtggattaagcagtataccggcatcaacgctatcaaccagaagaagtttgtgattgacgtaggctacgagcgattccttgggcctgagattttctttcacccagagtttgcaaacccagacagtatggaatctatcagcgatgttgtggacgaagtgatccagaactgtccgatcgacgttagaaggcccctctacaagatggaacagatcccattgagctacccccagggacatgggttccacccactgtcaccgccatttcattag

SEQ ID NO: 53191 - DNA, 156 bp, Artificial Sequence
  Description of Artificial Sequence: Synthetic coding sequence
atgtttgaaagttttaatgtgcctggactgtacatcgcagtgcaggccgtgctcgcactggccgcatcctggactagcagacaagtaggggaacggacacttactggcattgtaatcgactcgggcgatggcgtcacacatgtgattcctgtctag

SEQ ID NO: 53192 - DNA, 633 bp, Artificial Sequence
  Description of Artificial Sequence: Synthetic coding sequence
atgtttgagagtttcaacgtgccaggactttacatcgcggtacaggccgtacttgcattggccgcatcatggactagcaggcaggttggagagcggaccttgacaggcatagttatcgacagcggcgatggcgttactcacgtaattccagtggctgaggggtacgtaattggatcctgcatcaaacacatccccatcgctggcagggatattacatactttattcagcaactcctgcgcgagcgagaggtggggataccgccagagcaaagcctggaaactgcaaaagcaataaaggagaagtactgttacatctgtcccgacatcgtaaaggagtttgctaaatacgatgtcgatccccagaagtggataaagcagtatacaggcataaacgccatcaaccagaaaaagttcgttatcgacgtcggatacgaaaggtttcttggtcctgaaattttcttccatcccgagtttgccaacccagattctatggaatcaatctcagacgtggtggacgaggtgatacagaactgccccatagacgtaagacggcctctctataaaatggaacaaatcccactgtcctaccctcaaggtcacgggttccatcctctttctcctccctttcattag

SEQ ID NO: 53193 - DNA, 1878 bp, Artificial Sequence
  Description of Artificial Sequence: Synthetic coding sequence
atgactgctacccttcgcccatacctgagcgccgttagggccacccttcaagctgctctctgtttggagaactttagttcgcaggttgtggaaaggcacaacaaaccagaggtggaggtgaggtccagcaaggagctgttgttgcagccagttacaatctcacgcaatgagaaagaaaaagtcctcatcgaaggctcgattaacagtgtgcgtgtctccatcgccgtgaagcaggccgatgaaattgagaaaatcctttgtcacaaatttatgaggtttatgatgatgcgagctgagaattttttcatactgcgtagaaagccagtggaacaaaagaaaatttttacaatccaggggtgttatccagtgattcggtgcctgctgcgtagacggggttgggtcgaaaaaaaaatggtccaccgcagcgggccaacactgctgcctccccagaaagacttggacagttctgcgatgggggatagtgacactacagaggacgaagatgaggacgaagatgaggagtttcagccctcccagttgttcgacttcgacgatttgctgaagttcgacgacctggatgggacgcacgccctgatggttggtctgtgtcttaatctcagaaacctgccatggttcgatgaggtcgatgctaactccttctttcctcgttgctactgcctgggcgcagaagacgataaaaaggcattcattggcgacaagcagcccaagaaacaggagaagaaccccgtgctggtctcccccgagtttgtagatgaagcgctgtgcgcttgtgaagagtacctgtccaacttggcacatatggacattgacaaagacttggaggcacccctgtatttaacccccgagggctggtcactgttcctgcagagatattatcaagtagtacacgagggcgcagagctgaggcacctggacacgcaggtacagaggtgcgaggatatactgcagcagctgcaggcggtggtgccacagatcgacatggagggggatcggaatatttggatcgtaaaacctggtgctaaaagccgaggtaggggaatcatgtgcatggaccatttggaggaaatgctgaaattagttaacggaaaccccgtcgtgatgaaggacggtaagtgggtggtgcagaagtacatcgagaggccccttttgatctttggtacaaagttcgatttgaggcagtggtttctcgtgaccgactggaatccactgactgtatggttctatcgggacagctatatacggttcagcactcagcccttttccctcaaaaatcttgacaatagtgtgcatctgtgtaataacagcattcagaaacacctggagaattcttgccatcgccaccccctgctccccccagataacatgtggtcctcacagaggttccaggcccacctacaggagatgggggctccaaatgcttggagcaccattatagtgccaggaatgaaagatgccgtaatccatgctctgcagacctcccaagatacagtccagtgtcgcaaggcttcctttgaactttacggggcagacttcgtgtttggcgaggacttccaaccttggctgattgagatcaatgctagccctacaatggccccttctacggcagttactgcacggctttgcgcaggcgtccaggccgacacccttagagtagtcatcgaccggatgctggataggaactgtgatacaggcgcattcgaactcatctataaacaaccagtaactacctcccctgccagcacacctcgacccagctgtctcttgcccatgtacagcgatactcgggctcgcagttcagatgattcgaccgcatcttggtgggccctgcggccatgccggcctcaggccaggccatag

SEQ ID NO: 53194 - DNA, 1683 bp, Artificial Sequence
  Description of Artificial Sequence: Synthetic coding sequence
gcgggacccagagctgcatgctcagagcctaacccctgtactcaggttgttatgaattcgcatagctataacggctccgtgggacgccctctcggctcaggtcctggtgcccttggcagggatccaccagatcctgaggctggccacccacctcaacctcctcactcgcccggactgcaggtggtggtagctaaatctgaacccgctcgcccttcccccggtagcccccgaggccaaccacaagatcaggatgacgatgaggacgatgaggaagacgaggctgggagacagagagcctctgggaaacctagcaacgtcggacacagactcggccatcggcgagctctctttgagaagagaaaaaggctatcagattacgcattgatttttggcatgttcggaattgtggtgatggtaacagagactgagctcagttggggtgtatacaccaaggaaagcctgtattccttcgccctgaaatgccttatcagtctctcaactgccattctgttggggctggttgttctttatcacgcccgagagatccaactatttatggtcgacaatggggctgacgattggagaatagcaatgacatgcgagcgtgtgttcttgatcagcctcgaactggccgtgtgcgctatacatcctgtgccagggcactatcgtttcacttggaccgcacgactggctttcacctacgccccatccgtagctgaagccgacgtcgacgttctcctgtccattcctatgtttctgcgcctgtacctccttggaagggtgatgctgctgcactctaagatttttactgatgcatcatccagatcaatcggtgccctcaataaaattaccttcaacactaggttcgtgatgaagaccctgatgaccatctgccctggaactgttctgctggtgttctccattagctcttggattatcgccgcttggactgtccgtgtttgcgagaggtaccacgataagcaggaggtgactagtaacttcttgggagccatgtggctgatctctattacattcctgagtattggatacggcgacatggtgccccacacatactgtggtaagggtgtctgcctgcttactggcatcatgggtgccggatgtacggccctggtggtagctgtcgtggccaggaagctcgaactcaccaaagccgagaaacacgtacataatttcatgatggatacccagctgacaaagcgcgtcaagaacgctgccgctaatgtccttcgcgagacctggctgatttacaagcacacacgcttggtcaagaaacctgaccaggccagggttcgaaaacatcagcgcaagttcctacaggccatccaccacggcaggatgctacgcagtgtgaaaatcgagcagggaaagctcaacgaccaagcgaacacactgactgaccttgctaaaactcagaccgtaatgtatgatctggtcagcgagctgcatgcccagcatgaagaactggaggcaagattggccacccttgagtcccggctagatgctctgggcgcttctttacaggcactgcccggtctgattgcgcaggcaattcgccctccccctccaccgttgcccccaaggcctggcccaggaccacaggatcaggcggctcggtcttccccatgtcgctggacgcccgtggccccttccgactgtgggtag

SEQ ID NO: 53195 - DNA, 1209 bp, Artificial Sequence
  Description of Artificial Sequence: Synthetic coding sequence
atgagatcaggtggagtgcggtcttttgcacttgaactggccaggggtcctggcggtgcatacaggggtggggagaggctatgtggcagagtgctgctagaggcagcggctcccttgcgggtgcgagccctggaagttaaagcccgtggaggagctgccacacattggctcgaagggagatctgtaggcgtgaatgctgtctcgtctgattatgcagcagcagagacttatctgagacgaagacaattgttgctgcgagacacaggcgaaaccactactttgccacccggtcggcatgaattcctctttagctttcagctgcctcctaccctggtgactagctttgagggaaagcacggatctgtaagatactgtattaaggccaccctgcaccgtccctgggtgccagccaggcgggcaagaaaggtattcactgtcatagagccagtagatattaacaccccagcactcctggccccacaggccggagccagagaaaaagttgccagaagctggtactgtaacagagggctggtgtctttgtccgccaagatcgaccggaaaggatatactccaggagaggtgatcccagtatttgccgagatcgacaatgggagcacacgaccggtgctgcccagagctgccgtggtccaaacgcagaccttcatggccaggggtgcacgtaaacagaaaagggccgtggtggcttctcttgccggtgagccggtcggacccggtcagcgcgcactgtggcagggcagagcactgcgaatccctccagtgggaccatcaattcttcattgtcgggtgttgcatgttgactatgctttgaaagtttgcgtggacattccagggacaagcaagctcttgctagagctccccctcgtcattggcacaattcctctgcacccattcggctccagatcgtccagcgtgggatcacacgcatcattcctgctcgattggcggcttggagcccttccagagcgacccgaagcccctccagagtacagcgaagtggtagccgacactgaggaggccgctctcggacaatctcctttccctttgcctcaggacccagacatgagcctggagggccctttcttcgcatacattcaggagtttaggtaccgaccccctccgctgtactctgaggaggaccctaaccctctgttgggtgatatgcgccctagatgcatgacctgttag

SEQ ID NO: 53196 - DNA, 1257 bp, Artificial Sequence
  Description of Artificial Sequence: Synthetic coding sequence
atgggcggagaggccggatgtgcagcagctgtgggcgctgagggtcgcgtgaagtccctcggcctggtattcgaggacgagcgcaaaggctgttactcttccggtgagacggtcgccggtcacgttttactggaagcttccgagccggttgccttgcgtgccttgaggctggaggcccagggcagggcgactgcagcatgggggccaagcacatgtcctagggcaagcgcatctaccgccgctctcgccgttttcagcgaagttgaatacttgaatgttaggctgagtctgagggaaccacctgccggagagggaattattttgctccagcccggaaaacacgaattcccctttaggttccaactgccaagcgagcctctcgtgacttcgttcaccgggaagtatggctctatccagtattgtgttagagcagtgctggaacgtccaaaagtgcctgaccagtcagtgaaacgtgagctgcaggtggttagccatgttgacgtgaatactcccgcactgctgacccccgtgctgaagacccaggaaaagatggtcggttgttggttctttacgagtgggcctgtgagcctcagtgcaaaaatagaaagaaagggatactgcaatggggaggccatcccaatttacgccgagatcgaaaactgtagttcacggctgatcgtgccgaaagccgctattttccaaacgcagacatacctcgcgtccggcaaaacaaagacgattcggcacatggtggccaacgtgcgcggaaaccatatagcatcagggagcaccgatacctggaatggcaagaccctgaaaatcccccctgtgactccatctattctggattgctgtattatccgggttgattatagccttgccgtgtacatccatattcccggagccaagaagttaatgcttgagctgccactcgtgattggaactatcccctacaacggctttggtagccgcaattcttctatcgcatcccaattttctatggacatgtcctggctgaccctgacactccccgagcagccagaagccccacccaactacgccgacgtcgtaagcgaggaagaattctctcggcacattcctccctacccccaaccgcctaattgcgagggggaagtgtgctgtcccgtgttcgcctgtatacaggagtttagattccagcctcctcctctgtattctgaggtggacccccatcccagcgatgtggaagaatcacagcctgtgtctttcatcctctag

SEQ ID NO: 53197 - DNA, 996 bp, Artificial Sequence
  Description of Artificial Sequence: Synthetic coding sequence
atgcaaggcgaggccgacgccagaacgggatgcgctgaatggcagggagagggtattattctcctgcaacccggaaaacacgaatttccttttaggttccagttgccatccgaaccactggtcacctctttcaccggaaaatacggctctatccaatattgcgtgcgagctgtgctcgagaggcccaaggtgccggaccaatccgtgaagagggagcttcaagttgtgtcgcatgtggacgtcaatacacccgcactgttaacacccgtcctaaagacccaggagaagatggtcgggtgctggtttttcacatctggacctgtctcattatcggctaagatagagcgtaagggctattgcaatggcgaggccatacctatctacgctgaaatcgaaaattgttctagccgcctgattgtgccaaaggcagctatctttcagactcagacttacttagcttccggcaagaccaagaccattagacacatggtcgcaaacgtgagggggaatcatatcgcaagcggaagcaccgacacatggaacgggaaaacactgaagattccccctgtcactccctcaatcctggattgttgcatcatcagagtcgattacagcctggctgtatatatccacattcctggcgcaaagaaactgatgctcgagttgcctctggtgatcggtacaattccatacaatggctttgggagtcgcaactcatctatcgcatcccagttttccatggacatgtcgtggctgacgctcacgttgcctgaacagccagaggccccacccaactatgcagacgtggtgagtgaagaggaattcagcagacatattcctccatatcctcaaccacccaactgcgagggcgaagtctgttgccccgttttcgcgtgcattcaagaattcaggttccaaccaccccctctctacagcgaagtggatcctcacccaagcgacgttgaggaaagtcagccggtctccttcatcctgtag

SEQ ID NO: 53198 - DNA, 1029 bp, Artificial Sequence
  Description of Artificial Sequence: Synthetic coding sequence
atgggggatagggaggagtgcttgtccacaccccaaccacctatgtctgtggtcaaatctattgagctggtgcttccggaagataggatctatttagcagggtccagcatcaaaggacaagtgatcttgacactgaacagcacgctggtagacccaatcgtgaaggtggagctcgtgggcagaggatatgttgagtggtctgaggaggctggggcttcatgcgattatagccgaaacgtgatctgcaataacaaagccgactacgtccacaaaactaagacttttcctgtggaagataattggttgagcgctgggtctcacacctttgattttcactttaaccttcctcccagacttcctagtacgttcacctcgaaattcgggcacgtgttttactttgttcaggcctcctgtatggggagggaacacattttggctaagaaaagaatgtatctactggtgcagggcacctcaacctttcataaggagacccccttccagaacccattattcgtcgaagcggaggagaaggtctcttacaattgctgcagacaagggacggtgtgcttgcagatccagatggagaggaatacgtttacgccaggtgaaaaagtggtgttcaccaccgaaattaacaaccaaacatctaagtgcattaagaccgtggtgttcgccctgtatgcacatatccaatatgaaggtttcacacctagcgcagaacggcgatccaggctcgacagttctgagctgctccggcaggaggccaacacaccagttaccaggttcaacactacgaaagttgtcagcaccttcaacttgccactgctactttcagtgtcatcctctactcaagacggcgaaatcatgcatacaaggtacgagctcgtcacaaccgtccatcttccgtggtccctgacatccctgaaggccaaggtgccgataattataacaagtgcgagtgtagatagcgctatttgtcaactgtccgaagacggggtccttcctgtaaaccccgaccaccaaaattag

SEQ ID NO: 53199 - DNA, 843 bp, Artificial Sequence
  Description of Artificial Sequence: Synthetic coding sequence
atggagacacaccacggtatttgtagtcgtttatgcaaagaatctgattccgtggtgcttgcagttgggtatcggaaattgccaaaacacaaatttccagtgcccgtaagagattgcctggtggccactattcattttcttaagagcctggatgcttatggcgtggaccctgcgagggtggtcgtgtgcggggatagcttcgggggagcgatcgccgcagtcgtgtgtcagcaattggtcgaccgaccggatctgcctagaatccgcgcacagattctgatctatgctattttgcaggccttagatttacagaccccctcctttcagcagcgtaagaatattcccctactgacttggtccttcatctgctattgcttctttcagaacctggacttcagctcctcttggcaggaggtgatcatgaaaggcgcacacctgcctgcggaggtttgggaaaagtaccggaagtggctgggccctgagaatataccagagcgtttcaaagagagggggtatcaactcaaacctcatgaacccatgaacgaagccgcttatctggaggtgtctgtggtgctggatgtcatgtgttcacccctgatagctgaagacgatatcgttagccaactgcctgagacatgtattgtctcctgcgaatatgacgcgcttcgagataatagcctcctttacaaaaaaaggctggaggacttaggggttcctgtaacctggcaccacatggaagatgggttccatggcgtgctccgaacaatcgatatgagttttctgcatttcccttgttctatgcgcattctcagcgccttggtacagtttgttaaaggactatag

SEQ ID NO: 53200 - DNA, 1053 bp, Artificial Sequence
  Description of Artificial Sequence: Synthetic coding sequence
atgatcttcgagaaactgagaatatgttccatgccccagttcttttgcttcatgcaagatctgccccctctaaaatacgaccccgatgtggttgtgaccgattttcgatttggtaccattcctgtcaaactgtatcagtctaaagcctccacatgcacgttgaagcctggaatcgtctattaccacggaggtggaggagtcatggggagccttaagacccaccacggaatatgctcgcggctctgtaaggaatccgactctgtggttttagccgtagggtaccgcaagctacccaagcacaagttccctgtgccggttcgggattgtctggtggcaaccatccactttttaaagagcttggacgcctacggagtggacccagcacgcgtggtggtgtgcggtgattcttttggcggagccatagcagctgtggtctgccagcagcttgtggatcggcctgatttaccaagaatcagggcccagatcctgatctacgccatcctccaggccctggacctgcagaccccgtcgtttcaacagcgaaagaatatcccccttctgacatggtcatttatttgctattgtttctttcagaacctagactttagttcgtcatggcaggaggttataatgaaaggtgcccacttgcctgcagaagtatgggaaaagtaccgcaaatggctaggccctgaaaacatacctgaacggttcaaagagcgcggttaccagctgaaaccacacgaacccatgaatgaggctgcttacctcgaagtctcggtcgtgctggacgtgatgtgcagtcctctgattgcagaagacgatatcgtgtcccagctgcccgagacctgtatcgtatcttgcgaatatgatgctcttcgagacaatagtttgctgtacaagaaacggttagaggacttgggcgtgcccgtaacatggcatcatatggaggacggattccatggcgtgcttagaaccatcgacatgagtttcctccacttcccctgttccatgagaatcttaagcgcactcgtgcagttcgtgaagggcctgtag

SEQ ID NO: 53201 - DNA, 1578 bp, Artificial Sequence
  Description of Artificial Sequence: Synthetic coding sequence
atgggctggttgttccttaaggttctgcttgcaggtgtttccttctccggcttcctgtacccgttggtggatttctgcattagtgggaaaaccagggggcagaaacccaacttcgtaataattctcgccgacgacatgggctggggagacctcggggcaaactgggccgaaaccaaagataccgctaatttggataagatggctagcgaaggaatgcggtttgtagatttccacgctgccgctagcacatgtagtccgagtagagcgtcattgcttactgggaggcttgggctgcggaatggggttacccgcaacttcgcagtcacgtccgtgggtggtttgccgctgaatgagacgacacttgccgaagtcctacagcaggctggctatgtgactggcataattggaaagtggcatctcggacatcatgggagttaccatcccaatttccgaggtttcgactactactttggcatcccttatagtcacgacatgggctgcaccgataccccaggatacaaccacccgccatgccccgcatgtccccaaggagacggcccaagccgcaacttgcagcgagactgttacaccgatgttgcccttccgctgtacgaaaacttgaacattgtggaacagccagtcaacttaagcagcctcgcccagaaatatgcagagaaggccacgcagtttatccagcgcgcttccacaagcgggcgtccctttctgctatacgttgctcttgcccacatgcacgtgccactcccggtgacacagttgcccgctgcccctcggggacgttccctctacggcgctggtttatgggagatggattctctcgtcgggcagatcaaagacaaggtggaccacacagttaaggaaaatacattcttgtggttcacaggcgataacggcccttgggcccagaaatgcgagttggctgggtcagtgggcccatttaccggtttttggcagacccgtcagggagggagcccggcaaagcagactacctgggaaggtgggcatagagtgccagccctcgcctattggccgggacgcgttccggtgaatgtcaccagcacagctctactttctgtgctggacatcttcccaactgtcgtggcactggcccaggcgagcctgccccaggggcgacgcttcgacggagttgacgtcagtgaggttcttttcggcaggagccagccaggccaccgagtgttgttccacccaaactccggggcagccggtgaattcggggcactgcagaccgttaggttagagcgctacaaggctttctacatcactggcggagccagggcttgtgacggcagcacaggaccagaactccagcataagtttccactcatcttcaatttggaagatgatactgccgaggctgtgcctcttgagaggggaggcgctgagtatcaggccgtgttgcccgaggtgaggaaggttcttgcagacgttttgcaggatattgcaaatgacaacataagctctgcagattatacccaggacccgtctgttactccatgttgcaacccataccagattgcatgcagatgtcaggcggcatag

SEQ ID NO: 53202 - DNA, 1932 bp, Artificial Sequence
  Description of Artificial Sequence: Synthetic coding sequence
atgtgcggaatttgctgctccgtgaacttctcagctgaacattttagtcaagatctcaaggaagatctgctgtacaatctgaaacagcggggaccgaattcatctaagcagctgctgaaatccgacgtcaattaccagtgcctgttctcggcccacgttctacacctgaggggtgtcttaaccacccagcccgttgaggatgaaaggggaaacgtgtttctctggaacggagagatcttcagtggcattaaggttgaagcagaggaaaacgatactcagatcttgtttaattacctgtcctcatgtaaaaacgaatcagagatcctgtctctgttcagtgaagttcagggaccttggagttttatctattatcaggccagttcccactatttatggttcggtcgcgatttttttggcaggcggtccctcctgtggcatttttccaaccttggaaagtccttctgcctaagcagcgtgggcacacagacttccggtctggccaaccaatggcaggaggtccccgcttctggactattccgcattgatctcaagtctacagttatttctggctgtatcatccttcagctgtacccctggaaatacatctccagggaaaacatcatcgaggagaatgtaaacagcctgagccagatctccgcagacctgccggctttcgtttcagtggtggcaaacgaggcgaagctgtatctagagaagccagtcgtgcccttgaatatgatgctgcctcaggcagcattggaaactcactgcagcaatatttccaacgtgcctcctacccgggaaattcttcaagtgtttttgacagacgtgcatatgaaagaggtgattcagcagtttattgatgtgctgtccgtagccgttaaaaaacgcgttttgtgcctaccccgagacgagaacttaaccgccaatgaggtcctcaaaacgtgcgatcggaaggctaacgtggctattctgttcagtgggggaatcgacagcatggtgatagccacccttgctgataggcatattcctttagatgagcctatagacctgctcaacgtcgcatttatcgcagaagagaaaaccatgcctacgactttcaatcgcgagggcaacaagcagaagaacaagtgcgagatcccatccgaggagttcagcaaagacgttgccgcagcagctgcagacagcccaaacaaacacgtgagtgtgcctgataggattactgggagggctgggctcaaagaacttcaggcggtgtccccctcacggatttggaactttgttgagatcaacgtgtccatggaggagctgcaaaaactaaggcgaactaggatctgtcatttgatcagacctctggacaccgtccttgacgatagcatcggatgcgcagtttggttcgcctcccgcggaataggctggctggttgcccaggagggagtcaagtcctaccagtctaacgctaaagtggttctgactgggattggggcagacgaacaattggcaggatactctagacacagagttcgattccagtctcacggcctagagggtctgaacaaggagatcatgatggagttgggacggatatcttctcgaaacctggggagagacgaccgggtgatcggagaccacggcaaagaagcacggtttcctttcctggatgaaaacgtggtgagctttttgaactcccttccgatttgggagaaagccaatcttacattgccccgaggcattggcgagaagctgttacttcgactcgcagcggtcgaactgggcctcactgcatccgcccttctcccgaagcgtgcgatgcagttcggatctcgcatcgctaagatggagaagataaacgagaaagcatcggacaaatgcgggagactacagatcatgagtttagagaacttgtctatcgaaaaagagactaagctgtag

SEQ ID NO: 53203 - DNA, 1857 bp, Artificial Sequence
  Description of Artificial Sequence: Synthetic coding sequence
atgtgcggcatctgctgcagcgtgaacttttctgcggagcacttttcgcaggacttgaaggaagacctcctgtacaatctgaagcagcggggacccaattcctccaaacagctcctaaagtctgacgtgaattatcaatgcctattttccgcccatgtgctacatctacgcggagtactcacaactcagcccgtggaagacgagaggggtaacgtctttctctggaacggagagatattttctgggataaaagtagaggctgaagaaaacgatacccagatactgttcaattatttgagttcatgcaaaaatgagtccgagatcctgtctctcttttcggaagtccagggcccttggtctttcatctactaccaagcatcctcacactacctgtggtttggcagagattttttcggacgcagatcccttctgtggcacttctccaaccttgggaagagtttttgcctcagtagcgtcggcacccagacttccggcctcgctaatcagtggcaagaggtccctgcttctggtctgttccgtattgatctgaaaagtacagtgatttccggatgcatcatcctgcaactgtacccatggaaatacatctcccgggagaacattatcgaggaaaacgtgaatagcttgagtcagataagtgccgatctcccagcgtttgtgtctgtcgttgcaaatgaggcaaaactgtatctggagaaacctgtggtccccctgaatatgatgctcccccaagctgctcttgagactcactgttccaacatcagcaatgtgcctcctactcgggagatcctccaggtatttctgactgacgttcacatgaaagaggtgatccagcagttcatagatgttctgagcgtagctgtgaaaaagagagtcctgtgcctacccagggacgagaatctgactgcaaatgaagttcttaaaacttgcgatcgtaaggctaatgtggccatcctgttttccggcggaattgacagcatggtcatcgctacgctagcggaccggcacatcccgttggacgagcccatcgaccttctcaacgttgcctttattgctgaggaaaaaacaatgcccacaaccttcaatagggagggcaataaacagaaaaacaaatgtgagattccttctgaagaattttctaaggacgtggctgctgctgcagctgatagccccaataaacatgtttcagtgccagatcgcatcacaggcagggcaggccttaaagagttacaggccgtctccccaagtaggatctggaactttgtggagataaatgttagtatggaagagctgcaaaagttgagacgaacacgtatctgccacctgattcggccactggatacagtgctggatgacagtattggatgtgccgtatggttcgctagccgtggcatagggtggctggtcgcccaggagggcgtaaaatcttaccagagcaatgctaaggttgttctgaccgggatcggggcagacgaacagcttgctgggtactcgaggcacagggtgaggtttcagtctcacggtctggaggggctgaacaaagaaattatgatggaactgggcagaatttcaagtaggaatctagggcgagacgaccgggtaattggagatcatggcaaggaagctagattcccttttcttgatgaaaatgtggtgtctttccttaattctctgccgatatgggagaaggctaatcttacgctgcctagagggatcggtgagaagttactgttgcggctggctgccgttgaacttggccttacagcaagcgcattacttccgaaacgcgcaatgcaattcggtagccggatcgcgaagatggagaagattaacgagtag

SEQ ID NO: 53204 - DNA, 222 bp, Artificial Sequence
  Description of Artificial Sequence: Synthetic coding sequence
atgtgtggcatttgttgctcagtcaactttagcgctgaacacttctctcaggatttgaaagaagacctcctgtacaacctgaaacagagaggcccaaactctagcaagcagctactgaaatcggatgtcaactatcagtgcttatttagcgcccacgttctccacctgcgcggagtgctgaccacccagccggttgaggacgagcgcggaaatgtgttctag

SEQ ID NO: 53205 - DNA, 564 bp, Artificial Sequence
  Description of Artificial Sequence: Synthetic coding sequence
atggagagatccgctttcatggagttggacgcgggtagcaggttggttatgcacctgcgagaatggcccgctctgttagtgagcagcaccggctggacagagttcgagcagcttactctcgacggtcataatttgcctagcctggtttgcgttattaccgggtccgtcgatcttggggtttgtctccatatgtcttctagcggactggacttacccatgaaagtggttgacatgttcgggtgttgtttacctgtgtgcgccgtaaatttcaaatgcctccacgaactggtgaagcacgaggaaaacggcctggtgttcgaagattctgaggagttagccgctctccagatgttgtttagtaacttccctgaccccgctggaaagttaaaccagttctggaagaatctgcgggagtcccagcaacttcggtgggatgaatcttgggtgcagacagtactgcctctggtgatggatatccagctacttggtcagagactgaagccacgcgacccctgttgtccttccaggagtttctttagcgagagccaggggaaacctttctag

SEQ ID NO: 53206 - DNA, 537 bp, Artificial Sequence
  Description of Artificial Sequence: Synthetic coding sequence
atgggagatagggtaaagggctctaagtctagacgcccagatcttgtggtggaggtcgcccatcctaagatcatccatgagagtggagctcagattctgcgccatgcaaacctgctgtccctgcgagtcaccatggccacacacccagacggcttcaggctggaaggtcccctcgccgcagcccactctccgggtccctgtactgtcttatacgaagggccagtccgcggtctgtgcccctttgcgcctaggaattcaaataccatggccgctgctgcactagccgcacccagcctggggtttgacggcgtaatcggtgtactggtcgccgataccagtctgaccgatatgcacgtggtcgacgtggagctatctggccctaggggtcccaccgggaggtctttcgccgtgcacaccagaagggagaaccctgccgaaccaggggctgttaccgggagcgcgacggtgaccgctttctggcagagtctgttggcttgctgccagctgccctctcggcctggtatccatctatgctag

SEQ ID NO: 53207 - DNA, 852 bp, Artificial Sequence
  Description of Artificial Sequence: Synthetic coding sequence
atggcagatagaggtccgtggcgtgttggtgtggttgggtacggacggctgggccagtcattggtctctcgtctcctcgcccaggggcctgagctggggctggaactggtgtttgtctggaatcgcgatccgggacgaatggccggttcggttcctcctagtctgcagttgcagaacttggcagctctaggcgagagaaggcccgaccttgtagtcgaggtagcgcatcctaagatcatccatgagtctggcgctcaaatcctacgccacgctaatctgcttgtggggagccctagtgccctcagcgatcagactacagagagacaattgttagaggcctctcagcactgggaccacgcagtttttgtggcccgaggggcactttggggggctgaagatattaggagactggatgcagccggagggctccgctcgttaagagtgactatggcaacacaccctgatggattcagactggaggggcctctcgctgccgcacattctcctgggccttgcactgtactgtatgaaggacccgtacggggactgtgtcccttcgctccaaggaactctaataccatggctgcagctgcattggctgccccatcactaggtttcgacggagtcataggcgtgctagtcgccgatacttcgctcactgacatgcatgtggttgacgtggaactatcaggcccaagaggacctacagggagatcttttgcagtgcacacccgaagggagaaccctgctgaacctggcgctgttaccggaagcgcaacagtaacagcattctggcagtctttgctggcatgttgtcagctccctagccggccaggaatccacctatgttag

SEQ ID NO: 53208 - DNA, 1458 bp, Artificial Sequence
  Description of Artificial Sequence: Synthetic coding sequence
atgtcaggtcattccccaactaggggtgccatgcaggtggccatgaatgggaaggccaggaaggaggcagtccagactgccgcaaaggagctgctgaagttcgtgaatagatctccttccccgtttcacgcggtcgcggagtgtaggaatcggctgttgcaagccggattctcagaactgaaagaaacagaaaagtggaacattaaacctgaatccaaatacttcatgacacgcaacagctccactatcattgctttcgctgtcgggggacagtacgtccctggcaacggattttcattgataggggcacacactgactcaccttgcttaagggttaagagacggtctcgacgtagtcaggttggatttcagcaggtcggagtggaaacctacgggggtggtatctggtccacttggttcgatcgggatctgacgctcgcgggacgagtcatcgtcaagtgtcccactagcggcaggctagaacagcaactggtgcacgtcgaacggcctattcttagaatcccccacctggccattcatctgcagcggaatattaacgaaaacttcgggcctaacacggagatgcatcttgtacccattctggccactgctattcaggaggaactggagaaggggaccccagagcctggtccactaaacgcagtcgatgagcgtcatcatagcgtgctaatgagtttgctgtgtgcacacctagggctgtctcctaaggacatcgtcgaaatggaactttgtctggccgacactcagcctgtagtgcttggcggtgcatacgatgagtttattttcgccccaagactagacaatctgcatagttgcttctgtgccctgcaggcattaattgattcatgtgcgggtccaggcagcctggctactgagccccacgtgagaatggttacactgtatgacaatgaggaagtgggatcagagagcgctcagggagctcagtccctgctcaccgagctggtgcttcgtagaatcagcgcctcttgtcagcaccctaccgccttcgaagaagcgattcctaaatcgtttatgatttcggccgacatggcacacgctgtccatccgaattacctggataagcacgaagaaaaccatcgtcctctgttccataaagggccagtgattaaagtcaattccaaacagcggtatgcttctaatgcagtgagtgaagctctgatacgcgaggtagcgaataaagtgaaagtaccgctgcaggatctcatggtcagaaatgacaccccatgtggcactaccatcggccctatcctcgcatctaggctgggcctgcgtgtgctcgacctgggctccccgcaactcgcaatgcactctatacgcgagatggcctgcacaaccggggtacttcagactctcacgttatttaagggtttctttgagctgtttccgagcctgtcacacaacctcttggtcgattag

SEQ ID NO: 53209 - DNA, 1326 bp, Artificial Sequence
  Description of Artificial Sequence: Synthetic coding sequence
atgagcggccactcacctaccagaggcgcaatgcaagttgcaatgaatggtaaggcgcgaaaggaggcggtccagacagccgcaaaagagctcctgaaattcgtgaatcgatctcccagccctttccacgcagtggctgagtgccgcaataggctcctccaagctggcttcagtgaactcaaggagaccgaaaaatggaatataaaacctgaatcaaaatacttcatgacccgaaactcatccacaattatcgctttcgcggtgggcggacagtacgtgcccggaaacggcttctcgttaatcggcgcacataccgactctccctgtttaagagtgaagagacggagccggcgatcccaggtgggcttccaacaggtaggcgtggaaacttacggaggaggtatttggagcacatggtttgaccgcgatctgaccttagctggacgtgtgatcgtaaagtgcccaacctcaggcagactggagcagcagttagttcacgtcgagagacccatcttacgaataccacacctcgcaatccatcttcaacgtaacattaatgaaaattttggtccaaatacggagatgcatctggtgcccattttggctacggcgatccaagaagaattggagaagggtaccccagagccagggcctctgaacgcagtcgatgaacggcatcattctgtccttatgtctctcctctgcgcacacctgggactgagccctaaggatattgtggaaatggagctgtgccttgccgacacccagcctgtggtgctgggcggagcatacgacgaatttatattcgctcccagactcgacaacctacattcatgcttctgcgcattgcaagcgctcattgactcatgtgcaggaccaggctccctggcaacggaaccccacgtgcgaatggttactctctacgacaacgaggaagttgggtccgagagtgcccagggtgctcagtcactgctgactgagctggtcctgcgaagaattagcgcttcttgccaacacccgaccgcgttcgaagaagccattcctaagtcttttatgatctccgctgacatggcacatgcggtgcaccctaactatttggataaacacgaagaaaatcatagaccattgtttcataagggacctgtgattaaggttaactccaagcagaggtacgcctctaatgccgtgtctgaagccctgattcgagaagtcgccaataaaagccgttcaccctgcaggatcagctggagtggcatgacccctccagtcgagccaccactcgacttgtcatggctgctggggtggggatgcggatgttggatctag

SEQ ID NO: 53210 - DNA, 1137 bp, Artificial Sequence
  Description of Artificial Sequence: Synthetic coding sequence
ctctccctgagtcttagtctgagcctctttttggatgtgtctctcagcctgagcgtatccctgtccttcagtctcagtcatcccggttcaacatggttcgatcgcgacctgaccctcgcaggacgcgtgatcgtaaagtgccctactagtgggaggctcgaacagcaactagtacatgttgagaggcccatattgcgaattccgcatctagccattcacctgcagcgcaacattaacgagaatttcggaccgaacaccgaaatgcacctggtcccaatcctggccaccgccattcaggaggagttagagaaaggcactccggaaccagggcctttgaatgctgttgatgaacgacaccacagcgtgctgatgagcctgctgtgtgcacatctgggcctgtctcctaaggacatcgtggaaatggaattatgtcttgcagacactcaaccggtggtcctgggaggcgcatacgacgaatttattttcgccccacggctcgacaacttgcactcatgcttttgcgcattgcaggcactgatcgactcctgtgccggacccggatcactcgccactgaacctcacgttcggatggttaccctgtatgataacgaggaggtgggttcagagtcagcccagggcgctcagagccttctcaccgagctggtcctgaggcgtatatccgcgtcttgccaacatcctactgcattcgaggaggccattcctaagagctttatgatctccgccgatatggcccacgcagtccatcctaactatttggataaacacgaggagaatcataggcctctcttccacaaggggccagtgattaaggtgaactccaaacagcgatatgcctccaacgcagtgagcgaggcccttattcgggaggtggccaacaaagtcaaagtgccgttgcaggacctgatggtgaggaacgacacaccttgtggcacgaccattggtccgatacttgcatctaggctggggctgagggtgcttgatttagggtccccacagctggccatgcattcaattagggaaatggcctgcaccaccggggtgctgcaaacgctgactctcttcaagggctttttcgaactttttccttcgctttctcataatctgttggttgattag

SEQ ID NO: 53211 - DNA, 1296 bp, Artificial Sequence
  Description of Artificial Sequence: Synthetic coding sequence
atggagggtgtagggggactctggccctgggtccttgggctgctgtcactgcctggagtgatcctgggcgctccactggcatcctcatgcgccggagcctgtggcaccagtttcccagacggcctgaccccagaggggacacaggcatcaggtgataaggacataccggcaattaaccagggcttgatactcgaggagactccagaaagcagctttttaattgagggggatatcatccgtccatcaccctttcggttgcttagtgctacaagcaataaatggcctatgggcggatctggggtagtcgaagtacccttcttgctgtcctctaaatatgatgagccgtccaggcaggttatattagaggctttggcagagtttgaacggagtacctgcatccgttttgtgacctaccaggatcagagagactttatctctatcatacccatgtacgggtgtttctcttcggtaggcagaagcggaggcatgcaggtggtgagcctggctccgacctgcctccagaaagggagaggtatcgttctgcacgaactgatgcacgtactggggttctggcacgagcacacccgggctgaccgagatcggtatatccgagtcaattggaacgagatccttcctgggtttgaaattaattttatcaagtcccagtcgagcaacatgttaactccctatgattacagttcagtcatgcattatgggcgtctggcattttcaaggcgaggccttccaaccatcacacccctctgggctccctctgtccacatcgggcagagatggaacctttctgctagtgacatcaccagggtcctgaaactctacggatgtagcccttccggcccaagaccccgagggcgagggagccatgcgcacagtacaggcaggtcccccgcacctgcttcactgagcctgcagaggctgctcgaggccctgtctgccgagtcaaggtctcctgacccatctggctccagtgcaggcggacagcccgtcccagccggacccggagagtctccacacgggtgggaatcacccgcactgaaaaaattgtctgccgaggctagcgccagacagccacaaacgttggcaagttcccccagaagtcggcctggggctggtgctccaggggttgcccaggagcagagctggctggctggcgtttctacaaaacccacagtgccgtcctctgaagcgggaatccagcctgtacctgtgcaaggcagccccgctctgccaggcggttgtgttccacgcaatcacttcaagggaatgagcgaggactag

SEQ ID NO: 53212 - DNA, 2040 bp, Artificial Sequence
  Description of Artificial Sequence: Synthetic coding sequence
atgggaattcgcggtcttatgtcgtttgttgaggatcatagtaacgaatttttcacagatctcaaattacgtgacacaaagattgtcatagatgggtatgctctattccaccggctgtgcttcagctccaacctagaccttagatatggcggagactacgactcttttgcggacgtggtgcagaaattttttgagagcctgttcgcctgcaatatctgcccctacgttgttctggacgggggatgcgacatctctgacaagaaactcaccacattgaaggacagagccagagagaagatccagatggcccattcactgagcgtgggagggtctggctacgtctgccctctgcttatccgggaagtcttcatccaggttctcattaagctcagagtgtgttttgtccagtgcttcagcgaggctgatagggatatcatgactctcgctaaccattggaattgcccagttcttagctccgactcagacttctgcattttcgatcttaaaaccggattctgtccgctgaattctttccaatggcgtaatatgaataccataaagggtacacagaactatatccccgctaagtgcttcagcctggatgcattttgtcatcacttcagcaacatgaataaagcactattgcccctgtttgcagttctgtgcggaaatgatcatgtcaaccttccaatcatggagacattcctgagcaaggctcggttacccctcggggctacatcatccaaggggaggagacaccaccgtatactggggctgctaaattggctctctcatttcgcgaatcccacagaggcattggataatgtgctgaagtacttgccaaagaaagatcgggaaaacgtaaaggagttgctgtgctgctccatggaagagtaccaacagagtcaggttaaattacaggatttttttcaatgcgggacctatgtgtgtccagacgcactcaacttggggctgcccgagtgggtcctggtggccctggctaagggccagctctctccattcattagcgatgcccttgtgctgagacgcaccatattgccgactcaggtggagaacatgcaacaaccaaacgcccacagaatcagtcagcctatccggcagattatctacggtcttctcctcaacgcctcacctcatcttgacaaaacatcctggaacgccctgcctccccagcccctggctttttccgaagtggagcgcatcaataaaaatattcgaacttccattattgacgctgtcgaacttgctaaggatcattcagatctgagcaggctgaccgagctttcccttcgacgcaggcaaatgttgctccttgagaccctgaaagtgaagcagacgatccttgagcccatacctacttccttaaagctcccaatagcagtttcgtgctattggctccagcacaccgagactaaagctaagctgcatcaccttcagtccctgctgctgactatgctcgttgggccattgatcgctatcattaatagccctggtaaagaggaactccaagaagatggcgctaagatgttgtatgccgaatttcaaagagtaaaggcacagactagactgggtacacgcctggatctggataccgctcatattttttgtcagtggcagtcctgcctgcagatgggtatgtatctgaatcagttgctgtccaccccactgccggaaccagatcttacacggctctattctggcagccttgtacacggactgtgccagcaactccttgcctctacctcagtggagtcattactgtctatctgtcctgaagccaagcagctgtatgagtatctgttcaacgccacacgaagctacgccccagcggagattttcctacctaaaggcaggtcaaactccaaaaagaagcgtcaaaagaaacagaatacctcttgctctaagaacagaggacgcacaacagcgcataccaagtgttggtacgaaggcaacaatagattcgggctcttgatggtagaaaatctggaagagcactctgaggcaagcaatatagagtag

SEQ ID NO: 53213 - DNA, 1194 bp, Artificial Sequence
  Description of Artificial Sequence: Synthetic coding sequence
atgggaattcgcggactgatgtcatttgtggaagaccactctaatgaattctttacagacctgaagcttcgcgacacaaaaatagtgattgacggttatgccctgttccaccggttgtgcttctcttccaacctggatttacgttatggcggtgactacgactcatttgcagatgtggtgcagaagtttttcgaaagtttatttgcctgtaacatctgtccctatgttgtcctcgacggaggttgtgacatatcagataagaaacttacgactctcaaagaccgcgctagagaaaaaattcagatggcccacagtctgagcgtgggtggctcaggctacgtgtgcccgctgctcatcagggaagtgtttatacaggtgctgatcaagctgcgggtgtgttttgtccagtgtttctctgaggccgacagggatatcatgacactcgcaaaccattggaattgtcccgtcctgtcctccgactctgatttctgtatctttgacttaaagacagggttctgtcccctcaattcatttcagtggagaaatatgaacacgattaaaggtacccagaactacattcccgctaaatgcttctccctcgacgcattctgccaccactttagtaacatgaacaaagcactgctacccctcttcgctgtgttgtgtgggaatgatcatgtcaacctacctataatggaaacatttctgtctaaagcgagactgcctctgggtgcgaccagctcgaagggtcggagacaccaccggatcttagggctcttgaactggctgtcccattttgcaaaccctactgaggcattggataatgtcctgaaatatctgccgaagaaagatagggaaaacgtgaaagaacttttatgctgcagcatggaggagtaccagcagtcccaggtgaagctacaagatttctttcaatgtgggacctatgtctgtcctgacgcgctgaacctggggttgccagaatgggtcttagtcgccctggccaagggccagctatccccattcatttctgatgcgttggtacttcgtcgcacgattctgcctacccaggtcgagaacatgcagcctctggctttcagtgaagtggaaagaattaacaagaacattagaacctccatcctaacagcccacaatgcaagtggagccctggattgccataatcagcagccttggtag

SEQ ID NO: 53214 - DNA, 147 bp, Artificial Sequence
  Description of Artificial Sequence: Synthetic coding sequence
atggggatccggggtctgatgtcttttgtggaagatcactccaatgagtttttcacggatttaaaattgcgggacactaaaatcgtcattgatggttatgctttattccacagactgtgcttctcaagtaacctagacctgcgttag

SEQ ID NO: 53215 - DNA, 153 bp, Artificial Sequence
  Description of Artificial Sequence: Synthetic coding sequence
atgggcatcagaggcttaatgagctttgtggaagatcatagcaacgaattcttcacggatctgaaacttcgggacactaaaattgtcatagacggatatgccctgttccatcggctatgtttctcctcaaatctcgaccttcgttatggctag

SEQ ID NO: 53216 - DNA, 24 bp, Artificial Sequence
  Description of Artificial Sequence: Synthetic coding sequence
atgggaattcgcggtctgatgtag

SEQ ID NO: 53217 - DNA, 255 bp, Artificial Sequence
  Description of Artificial Sequence: Synthetic coding sequence
atggagcgtaaaaatgaccctttacctatcagtactgtgggtaccaggggtaaggggcctaaaagagacgagcagtataggataatgtggaatgagctggagaccctcgtccgcgcacacattaataactccgaaaaacaccaacgagtgcttgaatgtttgatggcctgcagaagcaagccacctgaagaagaagagcggaagaaagaggaagagcgcggaaagactaaaaggaccagccagagaaagcaatag

SEQ ID NO: 53218 - DNA, 2121 bp, Artificial Sequence
  Description of Artificial Sequence: Synthetic coding sequence
atgaagattttttccgaatctcacaaaaccgtatttgttgtcgaccattgtccttacatggccgagtcctgtcgtcagcatgttgaatttgatatgttagtaaagaataggactcagggaatcatacccctagcaccaatctcaaaatccctatggacttgttcagtcgaaagttcaatggaatactgtcggattatgtacgatatctttccatttaaaaaattggtcaacttcattgttagcgattcaggagcccatgtgctgaatagctggactcaggaggatcagaatctgcaggagcttatggctgctctagcagcagttggcccaccaaacccaagggctgatcccgagtgctgtagcatcctgcacggactggtggcggcagtggagaccctctgcaagataaccgagtaccaacatgaggctcgaaccttactgatggaaaatgccgagcgagtgggcaatagaggtaggatcatctgtatcacaaacgctaagagcgactcgcacgtcaggatgcttgaagattgcgtgcaggaaactatccacgagcataacaaactggctgcaaattccgaccacctcatgcagatccagaaatgtgagcttgtgttgatacacacttacccggtgggagaggacagtttggtttcagacaggtctaaaaaagaacttagtcctgttctcacatcggaagtgcactctgttcgtgccggaagacacctggccaccaagctcaacattctggtgcagcaacatttcgacttggcgagcaccacaattaccaacatccccatgaaggaagaacagcacgctaacaccagcgccaactacgatgtggagctgctgcatcataaagacgcacacgtggactttctgaagtctggggattcccatttaggcggtgggtcccgcgagggaagctttaaagaaactatcacactaaaatggtgcaccccaaggactaataatatcgagctccactactgcaccggcgcttacagaattagtcccgttgacgttaattctagaccctccagctgcctgacaaatttcctgttgaacggacgatccgtcctgctggagcagccgagaaagtccggatcaaaagtgatttcccacatgctgagttctcatggcggagaaatttttcttcacgtgctgagctcctcacggtctattctcgaagaccctccctccatcagtgagggctgcggaggtcgcgtgaccgattataggataacagacttcggtgagttcatgcgcgagaatcgactgacaccttttctggacccaaggtataaaatcgacggaagccttgaagttcctctggagcgggctaaggaccaactggagaagcacacaagatactggcccatgataatttctcagacgaccatctttaatatgcaggccgtggttcctctggctagtgttattgtgaaagagtctttaacagaggaggatgtgttaaattgtcagaaaaccatctacaatctggtggacatggaacgcaagaatgaccctctccccatcagcaccgtgggaacccggggtaaaggccctaaacgtgatgaacagtatcggatcatgtggaatgaactggagacactggtccgagctcacattaacaattcggagaaacaccagcgagtactggaatgcctgatggcttgtaggagtaaaccccctgaggaggaagaacggaaaaagcgcggaaggaaacgggaggacaaggaagataaaagcgagaaagccgtaaaggactacgaacaggagaaatcttggcaggatagtgaaagactgaagggtatccttgaaagaggcaaggaggagctcgcagaagcagagatcatcaaagattcaccagactcaccggaacccccaaataagaaaccactggttgagatggatgaaaccccccaggtggagaagtccaagggtcccgtctcgcttctgagcctctggtcgaaccggatcaatactgctaactctcggaagcaccaggagttcgccggaagactgaattctgtgaataatagggctgagctgtaccaacacctgaaagaggaaaacggcatggaaactacggagaacgggaaagcatcccgtcagtag

SEQ ID NO: 53219 - DNA, 882 bp, Artificial Sequence
  Description of Artificial Sequence: Synthetic coding sequence
atggtcgtacttttttattggaataatcatgagtcccaggtgctgaaatctctggtgatctgcctagtcgccatggaagagcggttcctgcatgtgctctcttcttccagaagcattcttgaggaccctccaagcattagtgagggctgcggaggacgggttactgactacagaatcacagtggtgcccctcgcttctgtaattgtcaaggaatcactcactgaagaggacgtactgaactgtcagaaaacaatttacaacctggtcgacatggaaaggaagaatgaccccctgccaattagtacagtaggcactcggggaaaagggccaaagcgagacgagcagtataggatcatgtggaacgagttggaaaccctggttcgcgcacacatcaacaatagcgagaagcaccagcgcgtgcttgagtgcctgatggcctgtcgcagcaaacccccagaggaggaggagagaaagaagcggggtagaaagagggaggataaggaggataaaagcgaaaaggccgtcaaggactacgagcaggagaagagctggcaagatagtgagaggcttaaaggaattttggagaggggtaaagaggaactggccgaagccgagataatcaaagatagtccggactcaccggaacctcccaacaagaaaccgctggtagagatggacgagacaccccaagtagaaaaatccaaaggtccagtatcactgctgtcactttggagtaaccgaatcaatactgccaactcacgcaagcaccaggagtttgcaggaaggctgaacagcgtaaataatcgggctgaactgtatcagcacctgaaggaggagaatggcatggaaaccaccgaaaatggtaaggcttctcgtcagtag

SEQ ID NO: 53220 - DNA, 492 bp, Artificial Sequence
  Description of Artificial Sequence: Synthetic coding sequence
atgaagatcttttccgaaagccacaagactgtctttgtggtggaccactgtccttacatggctgaatcctgccgtcagcatgtcgagtttgatatgctcgtcaaaaaccgaacacagggaatcattccgctggcgcctattagcaaatctctctggacttgcagcgtagagtcatccatggaatactgccgcatcatgtatgacattttccccttcaaaaagctcgtgaattttattgtgagcgacagcggcgctcacgtactgaactcctggacacaggaggatcaaaatctgcaagaactgatggctgcactcgccgcagttggtccaccaaatcccagagcggatcctgagtgctgttccatactgcacggtttggtagccgcagtggaaacgctatgtaagatcacagagtatcagcacgaagcgcgaacgctcctgatggagaacgccgagagagtgggaaatcgtgggcgaattatatgtatctag

SEQ ID NO: 53221 - DNA, 375 bp, Artificial Sequence
  Description of Artificial Sequence: Synthetic coding sequence
atggctgctctggctgctgtgggcccacccaatcctagggcagaccctgagtgctgcagcatcctccacggattggtagccgcagtggagacactgtgcaaaatcacggagtaccagcacgaagcgcgtacacttctaatggaaaacgccgaacgtgtcggaaatagggggagaattatctgtattactaacgctaagtccgattctcacgtgagaatgctggaagactgcgtgcaggagactattcatgagcataacaagttagctgctaatagtgatcacctcatgcaaattcagaagtgcgagttggtgttgatacacacctatcctgtcggcgaggacagtcttgttagcgacaggtccaagaaagagtag

SEQ ID NO: 53222 - DNA, 1818 bp, Artificial Sequence
  Description of Artificial Sequence: Synthetic coding sequence
atggctgcattggcggcagtggggccaccgaatccacgcgcagatcccgagtgttgcagcatactgcatggcttggtcgccgcagtggaaacactctgtaaaatcactgaatatcagcatgaggctcggacactgctcatggagaacgcagagcgtgtggggaatcgcggacgaataatctgtattacaaacgccaaatccgactctcacgtgcgcatgctggaggattgcgtgcaggaaacgattcatgagcataataaactggccgcaaatagtgatcacttaatgcagattcagaagtgcgagctcgttctgatacatacctatccggtaggcgaggactccctggtgtccgacaggtccaaaaaggaacttagtcctgttctgacatctgaggttcattctgttagggcaggaagacacctcgccactaagttaaatatcttagttcagcagcacttcgaccttgccagtaccactattaccaatatccctatgaaggaagaacagcatgcgaatactagcgcaaactatgacgttgaattactgcaccacaaggacgcccacgtagacttcctcaagagtggtgactcccacttggggggaggatcccgcgaaggctctttcaaggagacaattactctgaagtggtgtacaccacgcactaacaacattgagttgcactattgtacaggcgcttatagaatttctcccgtggacgtgaattcacgcccttctagctgtttaactaattttctgctgaacgggaggtctgtgctcttggaacagcctaggaagagcggtagcaaggtgatctcccacatgttgtcctctcatggaggtgagattttcttacacgtactctccagctctcgatccatccttgaggatcctcccagcataagtgagggatgcggaggacgggtgaccgattaccgcattaccgacttcggcgagtttatgagggaaaatcggttgaccccgttcctcgaccctagatataaaattgatggctctctggaggtgcccctcgagagggctaaagaccagctggagaagcatacccgatattggcccatgattatctctcagactacaatctttaacatgcaagcggttgtccctctagcatcagtgatcgttaaggaaagcctgactgaagaagatgttctgaactgtcagaaaacaatttataacttggtcgacatggaaaggaagaatgatccactgcctattagcacagtaggcacgaggggtaaaggacccaaaagggatgagcagtaccgtataatgtggaacgagctcgagacccttgttagggcgcacataaacaattccgaaaaacatcagcgcgtgctcgaatgtttgatggcatgtcggtctaagcctccagaggaagaagagcggaaaaaaagaggtcggaaaagggaagataaggaggataaaagcgagaaggcagtcaaagactatgagcaggagaagtcatggcaggactcggaacgtctgaagggcatcttggaaaggggcaaggaagagctggcagaagccgagataataaaggattctcccgacagtcctgaacctccaaacaaaaagcctctggtggaaatggatgagacccctcaggttgagaagtcaaaagggccagtcagtcttctgagtctctggagcaatagaatcaacaccgccaacagcaggaaacatcaggagttcgccggacggctgaattccgtgaataatagagccgagctataccagcacctcaaggaggaaaacggcatggaaaccacagaaaacgggaaagcctcaaggcaatag

SEQ ID NO: 53223 - DNA, 678 bp, Artificial Sequence
  Description of Artificial Sequence: Synthetic coding sequence
atgaaaatttttagtgagtcccataagactgtgttcgtggttgaccactgcccgtacatggcagaaagctgtagacagcacgtcgagttcgacatgctcgtgaagaaccgcacgcagggaataataccattggcaccaataagtaagtcattgtggacctgtagcgtcgagtcctcaatggaatactgcagaataatgtacgatatctttccttttaaaaagcttgttaacttcattgtttccgacagcggtgcccacgtcctcaactcctggacccaggaggatcaaaacctgcaagaacttatggctgctctggcggctgtgggacccccaaatcccagggccgatcccgagtgctgttccattctccacggcctggtcgctgcagttgagactctctgtaaaattaccgaataccaacacgaggcgaggacccttctgatggaaaatgctgagagagtcggcaatcgcggaagaatcatctgcatcaccaatgcaaaatcagatagccacgttagaatgctcgaggattgcgtccaggagactattcacgagcataataaactcgccgcaaactcggatcacttgatgcagattcagaaatgcgaactcgtgttgattcacacctaccctgtaggggaggattccctggtgagcgatagaagcaagaaggaatag

SEQ ID NO: 53224 - DNA, 4812 bp, Artificial Sequence
  Description of Artificial Sequence: Synthetic coding sequence
atgagggtaaagccacagggactggtcgtgacgagctccgctgtgtgcagctcgccggattatctcagagagcccaagtactaccctggcggtccccctaccccaagacctctattgccgacgcgacctccagctagtcccccagataaagccttctctactcatgcattttcagagaacccacggcctccgccaaggagagatccaagcaccagacggcctcctgtcttggctaagggcgacgacccgctgcccccacgggcagcgaggccagtaagccaggcaaggtgtcctactcccgttggcgacgggtcctcgtcccggaggtgttgggacaacgggagagtcaatctgcgcccagtcgtacagctcatcgatatcatgaaggacttaacccgcctgtctcaggacctgcagcacagcggcgtgcacttggattgcggcggtcttcggctatcaagacctccagccccacccccaggcgaccttcagtactctttttttagctctccttctttggctaatagtatcagaagccctgaagagcgtgccacaccacatgccaagagtgagaggccatcacaccctctgtacgaacctgaacccgaacctcgcgactcgccgcagccgggacagggacacagtccgggagccacagccgcagccaccggcttacctcccgagccagagcccgacagcaccgattattcagagctagcagacgccgatatactgtcagagttggcaagtttgacctgccccgaagcgcagctgttggaggcacaggccctggaacctcctagccccgaaccagaacctcaactcctggatcctcagcctcgcttcctcgacccccaggccctcgagcctctgggcgaggctctagaactccctccattacaaccactggctgatcccctgggcttgcccggtctcgctctgcaagccctagacacactcccagactctctggagtcgcagctgctagaccctcaggcactcgatcctttacctaagctactggatgtacctggtcggaggctcgagccacagcagcctctgggccattgcccccttgcagaacccctaaggctagacctatgtagccctcacgggccaccaggcccagagggtcacccaaagtatgcactgcgcagaactgacagaccgaaaatcttgtgtcgaaggcgcaaagccggacggggtcgcaaggcagatgcgggacccgaggggagactgctgcccctcccaatgcccaccggactggtcgccgcattggccgaacctccccctccgcctcctcctcccccacccgctttgcctgggcctggcccagtttcagtccctgagctcaagcctgaaagctcacaaacccccgtggtcagcacccgaaaaggaaaatgtcggggtgtgagaagaatggtcgtgaaaatggcgaagataccagtcagtctgggcagaagaaacaaaaccacttacaaagttagcagtctgtcctctagcttaagtgtggagggtaaagaacttggcctcagagtgtccgcggagcccacgcccctgcttaagatgaaaaacaacggtcggaatgtcgttgtggtcttcccccctggcgagatgcctatcattctcaagcggaagaggggcaggccgccaaaaaacttgctattaggcccaggcaagcctaaggagcctgccgtggttgcggctgaggctgctaccgtggccgctgcgaccatggccatgcctgaggtgaagaagaggagaagacgtaaacaaaaacttgcctccccccagccctcatacgccgcagacgccaatgacagcaaagccgaatactccgatgtgctcgctaaactcgccttcctaaacagacaaagccagtgtgctgggagatgctccccacctcggtgttggacaccctccgaacctgagtcagtgcaccaggcgcctgacacccagagtataagccattttctgcacagagtgcaagggttcaggcgccgaggaggtaaagcgggaggattcggcggtcgcggaggtggccatgctgccaagtctgctcggtgctcattcagtgatttttttgaggggatcggaaaaaaaaagaaagttgtggccgttgcagccgctggggtggggggacctggcctgaccgagttaggacacccgagaaaacgaggcaggggcgaagttgatgctgtaacagggaagcccaaacgcaaaagaagatctcgcaagaacgggaccttgttcccagagcaagtcccctctggccctgggttcggggaggccggagctgagtgggccggagataagggtggtggatgggcgccacatcacggacaccctggcggacaagctgggaggaactgtggattccagggcacagaagctcgagcattcgccagcacagggttggaatctggagctagtggacgcggatcatactactcaaccggagccccatctggtcaaaccgagctgtcgcaagagaggcaaaatctgttcacagggtactttcgctctctgctcgatagcgacgatagtagtgatctgctagatttcgcacttagtgccagcagacctgagagtaggaaagcaagcggcacatatgcgggaccccctaccagtgcactgccggctcaacgtgggttggccacgtttccttctcgcggtgccaaggccagccctgtggctgtaggcagtagtggtgctggagcagacccttcatttcagccggtgctatcagcccgacaaacattcccaccgggacgcgctgcgagttacgggctcactcccgctgcctctgattgtagggccgctgaaaccttccctaagttggtgcccccacctagtgccatggccagatcaccgaccactcaccctccagctaatacatatctgcctcagtatggagggtacggcgctggccaaagtgtgttcgcacccaccaaaccttttaccggacaagattgcgctaacagtaaggattgctcatttgcatacggatccgggaactcactgcctgcctcccctagctcagcacactccgcagggtatgctcccccaccgaccgggggaccctgcctcccgccttctaaagcttcctttttttcctcatcagaaggcgctcctttcagtgggagcgctcccaccccacttcgatgcgattcccgggcaagcacagtctcacccggaggctacatggtgccaaagggcactaccgcctctgccactagcgccgctagcgccgcttcttccagttctagcagttttcagccttcgcctgagaattgcagacagttcgccggagcctcccaatggccgtttcgtcagggttacggagggctcgattgggcctccgaagctttctctcagctatataacccttctttcgattgtcacgtaagtgagcccaacgtgattttggatatatctaactataccccgcagaaggtgaaacagcaaaccgctgtaagtgagacattctccgaatcctcctctgattccacccaattcaaccagcccgtcggcggaggtggtttcaggcgcgctaattccgaggcaagcagcagcgaagggcagagctccctctcgtccctggaaaaactgatgatggactggaatgaagcctcgtcagccccaggctacaactggaatcagagcgtgctctttcagtcttcttctaagccgggtcgcggtcgcaggaaaaaggtggacttgtttgaggcctcgcatctgggttttcccacatccgccagtgctgccgcatccggctaccctagcaagcggtccaccgggccacgacagcccagaggtggtcgcggaggtggcgcatgctctgccaaaaaggaacgcggaggcgcagccgctaaggcgaagttcatccccaagccccagccagttaaccctctgttccaggactctcctgacctgggccttgattattatagcggtgattcctctatgtcccctctgccctcacagtcgcgggcttttggagtgggagagagggatccctgtgacttcattggcccatactccatgaacccatcgacaccatctgacggcaccttcgggcaggggtttcactgcgacagcccgtccctgggcgcacccgaattagatgggaaacactttcctccattggctcatccaccaaccgtctttgatgcaggactgcagaaggcatactcccctacctgtagtcctaccctcggatttaaggaagagttgcgaccaccccctactaaattagcagcctgtgagccactgaagcacggcctgcagggtgcgagcttgggtcacgccgcagccgcacaggcacatctgagttgccgggacctcccgctaggtcaaccccactatgatagcccctcttgcaagggcaccgcttactggtatcctccaggttctgctgcccgttcacccccatatgagggcaaggtcggcacagggctgctcgctgattttttgggtagaacggaggccgcttgcttgtccgctccccatttggccagcccgcctgccacgcccaaagcggacaaagagcctctggagatggccagaccacccggacctccacgtggtcccgctgcagctgcagccggatacggatgcccacttctgtctgacctgaccctgagcccagtgcccagagactcactcttgcctctgcaagacacagcgtaccggtaccccggttttatgccacaggctcaccctggcctagggggaggtcctaagtccggctttttaggaccaatggctgagcctcaccctgaagacacctttaccgtgacttccctgtag

SEQ ID NO: 53225 - DNA, 4812 bp, Artificial Sequence
  Description of Artificial Sequence: Synthetic coding sequence
atgagagtcaagccccagggactggtggtcacttcatctgctgtatgtagctcccccgattacctccgggagcctaagtattatccaggcggtccccctaccccaaggcctctgctgccgacacgtccccctgcatcccctccagataaagccttttctactcacgccttttcggaaaatccgaggcctccaccaagacgcgacccatcgactcgcaggccacccgtgctggctaagggcgatgaccctctccccccaagggctgctcggcctgtctcccaggcacgttgtcctacacccgtcggagatgggtctagctcaaggaggtgttgggataatgggagggtgaacctgcgcccagttgtgcagctgatcgatattatgaaggacctgacacgcctatcccaagatctccagcacagtggggttcatttggactgcggaggccttagactgtcgcggcctcctgcccctcccccaggcgacctccagtatagcttcttcagcagcccatctcttgccaattctatccggtcacccgaggaaagggccacaccacacgctaaatctgagagacccagtcaccctctctacgaacctgagcctgaacctagagacagtcctcaaccgggacagggccactcacccggagcaactgctgctgctacgggattaccgccagaacctgagcccgattcaactgattactcagagctcgccgacgctgacatcctttctgagttagctagcctgacgtgtccagaggcccagctgctggaggcacaggcgttagagccaccatcccccgaaccggagccccagctgcttgatccccagccacgctttctggaccctcaggccctcgagccactgggcgaagcactcgaattgcccccactgcaaccactggctgaccctcttggactccccggacttgccttacaagcattggacacgctgccggacagcctcgagtcccagctgttggatcctcaggcacttgaccccctcccaaagctcctggatgtccccggaagaaggttggaaccacaacagcccctaggccactgtcctctcgctgagcctctgaggctggatttgtgcagcccccatggccctcctgggccagaaggacatccgaagtatgccttgaggcggactgatcggcctaaaatcctgtgtaggcggagaaaggcaggccgaggtcgaaaagcggatgccggacccgaggggagactcctccccctgcctatgcccacaggactggtggcagcactcgctgagccaccgcctccaccccctcctcctcctcctgccctgcccggacccggaccagtgagcgtgccagagttgaaacccgagtcctcccaaacacctgtggtttccactcggaaagggaagtgtcggggagtcagacgcatggtcgttaaaatggccaagatcccagtctcactgggacggaggaataaaaccacatacaaggtgagcagcctctcaagtagccttagcgtggagggcaaggagctgggcctccgagtttcagccgagcctactcccttgctgaagatgaagaataacgggagaaacgtagtcgtggtcttcccacccggagagatgcccattatacttaagcggaaacgagggagacctcccaagaacctgctcctgggccctgggaagcccaaggaacctgccgtggtggctgccgaagctgcaaccgtcgcggcagcaaccatggcaatgcctgaagtgaagaaaaggagacgcagaaagcagaaactggccagcccacaaccaagctacgcagcagatgccaacgacagcaaggccgagtactcagatgtgctagccaagctggcatttctcaatcggcaatcccagtgtgccggacggtgctcaccccctagatgctggacaccgtccgagccagaaagcgtacaccaggcgcctgacactcagtcaatcagtcactttctgcacagggtgcagggcttccggaggcgaggcggaaaggcgggagggttcggcggtagaggtggtggacatgctgctaagagcgctaggtgcagcttttctgacttctttgaggggatcgggaaaaagaagaaggtggtggcagtggcagccgctggcgttggaggcccaggattaactgaactagggcatcctcggaagcgaggaaggggtgaagtggatgccgtgacaggcaagcccaagagaaagagacggagtagaaagaatggcaccctcttccccgaacaggtcccgtcaggccctggattcggtgaggccggagccgagtgggccggagataagggcggtgggtgggcgcctcaccacggacatcctggtggccaggcagggaggaactgtggcttccaaggaaccgaggccagagctttcgctagtacaggcctagagtcaggtgcctcaggccgagggtcttattattcaacaggagcgccaagcgggcaaaccgagctctctcaggagcgacaaaacctgttcacagggtacttccggagccttctcgactctgacgatagcagcgacctcctggactttgcactgtcagctagccgccctgaaagtcggaaggctagcggaacatatgcgggtcccccaacatcagccctcccagcccagcggggactggctacattcccctcacggggtgctaaagcaagtcccgtggctgttggctcatctggagctggcgcagatcctagctttcagcctgtgctctcagctagacaaaccttcccacctggacgggcagcgtcctacgggctgacacctgccgcatccgactgtagggcggctgaaacatttcctaaactggttccacctccaagcgcaatggcacgctcaccaactactcaccctcccgcaaacacatacctcccccagtatggcggatacggcgctggccagagcgtgtttgctcccaccaagccctttacaggccaggattgcgcaaatagcaaagattgctcgttcgcctatgggtcagggaactcgctacctgcatccccctcctcagcccacagcgctggctacgcgcctcccccaaccggtggcccatgtctccccccatccaaagcatcattcttttcttcatctgagggcgctcccttctctggctccgcgccaacccctctgcgatgtgatagccgtgcatcaacggtgtcccccggaggttatatggtgccaaagggtaccactgcgtcggcgaccagcgctgccagcgcagcttcctcaagctctagttccttccagccctcacccgaaaactgcagacagttcgccggagccagccagtggccatttcggcagggctacggaggactcgactgggcttctgaagctttctctcagctctataatccttcctttgactgccacgtgtctgagcctaatgtaatcttggacatctccaactacacaccccagaaggtcaaacagcagactgccgtgagtgaaacgttcagcgagagctcatctgattctacccagtttaaccagcctgttggcggagggggattccgaagggccaactcagaggcttcatccagtgagggccaaagctcactaagcagtttggagaagctaatgatggattggaacgaagcctccagtgcacctggctacaactggaatcagtctgtgctgtttcagtcaagttctaagcctgggagggggagaaggaagaaggtggatttgtttgaggcatcacatctgggtttccccacaagcgcatccgccgctgccagtggatacccaagtaagcgctccacgggacccaggcagcctcgcggtggcagaggaggaggtgcctgcagcgctaagaaggagagaggaggagcggctgccaaggccaaatttatcccgaagccccagccggtgaaccctttattccaggattctcctgatctcgggcttgactactattcaggggatagctccatgtcccctttgccgtcccagtcaagggcttttggcgtcggcgagcgcgatccttgcgacttcatcggcccatattcaatgaacccttcgaccccaagtgatgggacctttggccaaggttttcattgcgattctccctctctgggtgccccagaactggacggaaaacacttccctccgttggcccacccacccacagtatttgatgcagggttgcaaaaggcctatagccctacctgttctcccacgctgggattcaaagaagaactgcggcctccccctacaaaattggccgcatgtgagcccctaaagcatggcctacagggcgcttccctggggcatgccgcagccgcacaggcccacctcagctgccgcgatttaccgttgggtcagccacactacgactcgccttcctgcaagggtacagcgtattggtatcctccagggtcggcggctaggtccccgccttacgaagggaaagtgggcactggtcttctggcagactttttgggaaggacagaggccgcttgtctgtcagctccacacctggcaagccctcccgcaacccctaaggcggataaagagcccctggagatggctagacccccaggacccccaagagggcctgccgcagcagctgccggatacgggtgtcctctgttgtccgacttgaccctcagccccgtgccaagagattcactcctgcccctccaagatactgcctataggtaccctggcttcatgccacaagcccacccaggcctcggagggggaccaaaaagtggcttcttaggacctatggccgaacctcatcctgaagataccttcactgtgacaagcttatag

SEQ ID NO: 53226 - DNA, 450 bp, Artificial Sequence
  Description of Artificial Sequence: Synthetic coding sequence
atgcgcgtcaaaccccagggactggtcgttacttcatccgccgtgtgtagctctcctgactacctgagagagcccaagtactatccaggcggtcctcctaccccgcgtcccctgttgccgactcgacctccagcctccccgcctgacaaagccttttccactcatgcgttttctgagaatcccagacctcctcccaggcgggacccttcaacgagaagacctcccgtgctggccaagggcgatgaccccctgcctccacgagcagcccgtcccgtttcccaagctaggtgcccaacacccgtcggggatggtagctcctctcgcagatgttgggacaatggcagggtgaacctacgcccagtggtccagctgatagacatcatgaaagatctgactcgcctctcccaggacttgcagcattcaggcgttcacttagactgcggaggttag

SEQ ID NO: 53227 - DNA, 1239 bp, Artificial Sequence
  Description of Artificial Sequence: Synthetic coding sequence
atggaagcactccaaaaacaacaggcagctcggctcgctcagggggtgggacccctggccccagcatgtcctctactgccaccccagccccctctgcccgaccataggaccctgcaggcccctgaaggtgccttggggaatgtgggcgcagaggaggaggaggacgccgaagaagatgaggaaaagcgcgaggaggccggagctgaagaagaggccgcagaagaatctcgccctggcgctcagggtccctccagtccatcctcccagcctcccggtctgcaccctcacgaatggacatatgaggagcaatttaagcaactttacgagctggacgcagatcccaagaggaaagaatttctagatgacctgttctcctttatgcagaagcgaggcacaccagtcaatagagtaccaatcatggctaaacaggtcctggatctctacgctctcttcaggcttgtcactgccaaaggaggcttggtcgaggtgatcaatagaaaagtgtggagggaggtgacgagaggcctgtctttgccaaccactattacaagcgccgcatttaccctgcgtacacagtatatgaagtacctctacccttacgagtgtgaaacccgcgctctgtcaagtcccggagagcttcaggccgcaatcgactccaatagacgcgaaggtagaaggcaagcgtacaccgcaactcccctgtttggtctcgccggtcccccaccaagaggtgcacaggacccggcattggggcctggtccagcgccacccgcaactcagtcttcccccggacccgctcaaggctcgacttctgggctccctgcacacgcatgtgcccagctgtcccccagccctattaagaaagaggaatccggtattcctaacccttgtctggcactccccgtaggcctcgcactgggaccaacaagagaaaagttggcccctgaagagccacctgagaagcgtgccgtcttgatgggacctatggatccacctcgcccatgcatgcccccatcattcctgcccaggggcaaagtgcctctgcgagaggaaagattagatggccctttaaatctggccggatcaggcatcagctcaataaatatggcactcgagatcaatggagttgtgtatacgggcgttctcttcgcgcgtcggcagccagtacccgcttcccaggggccaacaaatcccgcaccaccgccatcgaccggacctccctcaagcatattgccttag

SEQ ID NO: 53228 - DNA, 441 bp, Artificial Sequence
  Description of Artificial Sequence: Synthetic coding sequence
atgacgtctgagcgttcccggataccctgcctgtctgccgctgccgcagagggcaccggcaaaaaacagcaggaggggagagcgatggctacactggacaggaaggtcccaagtcctgaagcattcttgggcaagccctggtctagttggatcgacgcggcaaagctccactgcagtgataacgttgacctggaagaggccggtaaggaaggaggtaaatctagagaggtgatgcgtctgaacaaagaggacatgcatttatttggccactaccctgcacacgatgatttttatctggtggtatgcagtgcatgtaaccaggttgttaagcctcaggtgttccagagccactgtggcagaaaacaggataacaggaggaacgagggaatttctaggagcgggccagaaagctcccaggcaatcgagaaacaccaggtctag

SEQ ID NO: 53229 - DNA, 1602 bp, Artificial Sequence
  Description of Artificial Sequence: Synthetic coding sequence
atggatggggctgatgaatctgagaagttggactgccaattcagtacccaccaccctaggcctctggctttctgcagtttcggctcacgccttatgggtaggggttactatgtatttgatcgaaggtgggataggttcagatttgcgcttaattccatggtcgagaaacatctgaatagccagatgtggaagcacaggaacccttcacacagagcatctggaccttctccactatttagaacctgcctgactaacttactttcccttagtaatatcggcgctgcttgggtcagcactctggagtcagtggcaccccgttacccattgaacttggctgctcagacccctggacccggtgggccagagccaggcggtatggcagccgacggaggggtcgaggacattcggaagaagcgcaatggccaggactcgttctttttcaataaacacttgaccctgcatcaggaaccaccaacccagtactccctgtccgccagaaaaattcctcccgctgccgatagtcctcttcccagtccagctgctcacatcacgacccctgtaccagcatcagtgctgcagcctttctctaatccatccgcagtctacttgccaagtgctccaatctcatcacggttgacatccagttacatcatgaccagcgccatgctgagtaacgcggctttcgtgacgtctccagatccttctgcgctaatgagtcacaccaccgcattcccgcacgtggctgcaacactgtccattatggacagcaccttcaaggccccatctgcggtaagccctataccggctgtgatacccagtccttctcacaagcccagcaagaccaaaacctccaagagcagtaaggtgaaggacctgtctacaagatctgacgaatcccctagcaacaaaaagaggaagcctcagtccagcacgtcatccagctcctcatccagcagctcctctctacagactagcctgtcttccccactttcaggtcctcataaaaaaaattgcgttttaaatgccagcagcgctcttaactcctatcaagcagcccctccctacaattctctatccgtacacaactccaataatggcgtgtcccctctgagcgccaagctggaaccttccggtcgcacttccttgcccggagggcctgcagacatcgtaaggcaagtgggagccgtcggcggttctagtgactcgtgtccgctttctgtgccttcgttggccctgcatgctggcgacctgagcctcgcgtcccataacgcagtctccagcctgcctttgtccttcgacaagtctgagggtaaaaagcggaagaattcatcttcctccagcaaggcctgtaaaattacaaagatgccgggaatgaactctgttcacaagaaaaatccaccctcactgctggccccagtccccgatcccgtgaattcaacttcatctaggcaagttagagacctgttggccccacctagtccagcactgggaggacgcggttcatgggctgccccactgctgagccgcgcagccccaacaggcaatacttcacttatccccgttctcgtgtttccggagggatctttccatcccttgttgtag

SEQ ID NO: 53230 - DNA, 2586 bp, Artificial Sequence
  Description of Artificial Sequence: Synthetic coding sequence
atgacctcagagaggtccaggatcccttgcctctctgcagccgctgcagaagggaccggtaagaaacagcaggagggaagggccatggctaccttagataggaaggtgccttcccctgaggcgtttctcgggaaaccctggagctcctggattgacgcggctaaactacactgcagcgacaacgtcgacctggaggaggctggcaaagaagggggaaaatcacgagaggtgatgagattaaataaagaggatatgcatctctttggtcattacccggctcacgatgatttctatttagttgtctgcagcgcttgtaaccaggttgttaaaccacaggtgttccagtctcactgtgagagacgacacggatccatgtgtcggccatctccatcccctgtcagcccagcctctaatcctaggacatctctcgtacaggtaaaaacaaaggcgtgcctttctgggcaccattccgcctcgtccacttccaagcccttcaaaaccccaaaggataatctgttaacctccagctccaaacagcacacagtcttcccagcgaaaggctctagagataaaccctgtgtcccagttcctgtggtctcgctcgagaagattcctaacctggtcaaagccgatggagctaatgtgaaaatgaatagcaccacaaccaccgctgtgtctgccagctcgacatcgtccagcgcggtaagtacaccccctctcattaagccagtgctgatgtcgaagtctgtacctcccagtcctgaaaagattcttaacggaaagggtattttgcccactaccattgacaaaaagcatcaaaacggcaccaaaaacagcaacaaaccttatagaaggctcagcgagagagagttcgacccaaataaacattgtggcgtccttgatcccgagaccaagaaaccctgtacaagatccctgacttgcaagacccactctctgagccaccgccgtgcagtgcctgggagaaaaaagcaatttgaccttctgctcgccgagcataaggcgaaaagtagagagaaggaagtaaaagacaaggaacacttgctcacctcaaccagggagattctcccatcacaatctggccctgcacaagatagtctgctgggcagttctggctcttccggacctgagccgaaggtggcttcacctgctaaatccagaccaccaaacagcgtgcttcccaggccatcatctgcaaactctatatcctcgagtacctctagcaaccacagtggccatacccctgaacctcccctgccccctgtggggggagacctagccagtcgattgtcttccgatgagggcgagatggacggcgctgatgaatccgaaaagctagattgccagttcagtacccaccatcccaggcctctcgcattttgctcattcggctcccgcctaatgggacgtggatactatgtgtttgatcgcagatgggatagatttcgctttgctttaaactcaatggtggaaaagcatcttaacagccagatgtggaagaagattccccctgccgctgattctcctcttccctcaccagcagctcacattaccacgcctgtccctgcaagtgtgctgcaaccttttagcaaccctagtgctgtttacctcccttccgccccaatctcatctcggctgacctctagctacataatgaccagcgccatgctgagtaatgccgcatttgttacatccccagatccctccgctctgatgtctcatactacagctttcccgcacgtcgccgctaccctgtccatcatggacagcacattcaaagcacccagcgctgtcagccccatccctgctgttatcccatcaccatcacataagcctagcaaaacaaagacctcgaagagcagcaaggtgaaggacctatcgactcgttccgacgagtcccctagcaataaaaagaggaagcctcagtcctcaacttcctcatcctcctcatcaagttcatcaagtctgcagacttcactgagtagccccctctccggaccccataaaaaaaattgcgtcctaaacgcctctagtgccctgaattcttaccaggccgcacctccgtacaattccctttccgttcacaattcaaacaatggcgtctcaccactctctgccaaattggagccctccgggaggaccagtttgcccggagggcctgccgacatagtccgtcaggtgggagctgtgggaggttcttcagattcctgccctctctctgtgcctagcctggctcttcatgccggagatctctcacttgcttcgcacaatgcggtctcttctctcccactgtcatttgataaaagcgaaggcaagaagcgaaagaacagttctagcagtagcaaggcctgcaagataaccaagatgccgggaatgaactccgttcacaagaagaatccacctagccttctggccccagtcccagaccccgtgaattctactagctcaaggcaggtcggcaagaattcctccctggccctgagccagtcctctccctccagcattagtagccctgggcattctcgtcagaacacaaatcgcactggacggatccggaccctcccttag

SEQ ID NO: 53231 - DNA, 2217 bp, Artificial Sequence
  Description of Artificial Sequence: Synthetic coding sequence
atgtgccgcccaagccccagtcctgttagccctgcatctaatcccaggacttcgctcgtccaggtaaaaacgaaggcttgtcttagcggccatcattccgcttcgagtacaagcaagccatttaaaaccccaaaagataatctactgacatcgtctagcaaacagcacactgtgtttccagctaaagggagtcgagataagccttgcgtgccagttccggtggtgtcccttgagaagattccaaacctggtcaaggcggacggggcaaacgtgaaaatgaacagcaccaccaccacggctgtgagtgcgtccagcacgagcagttcagcagtgagcactccccctctgatcaagcccgtcctgatgtctaaaagcgtacctccgagccccgaaaaaatcctgaacggcaaaggaatcttgcccacaacaattgacaaaaagcatcagaatggcacaaagaattctaacaaaccctacaggaggctgagcgaacgcgaattcgaccctaacaagcactgtggcgtcttggaccctgaaaccaagaaaccttgcacacggtccctgacctgtaagactcacagcctgtcacaccgtcgcgctgttccgggtaggaaaaaacagtttgacctcctgctggctgagcacaaggctaaatcaagagagaaagaagtgaaggacaaagagcatctgttaaccagcactcgggagatcctcccgtctcagtccggacctgcccaggatagcttactgggaagctcaggctcctcgggacctgaacccaaagtggctagcccagctaagagcagacccccaaacagtgttctgcccaggccctcgagcgccaactccatttcttcctctacgagttcaaaccactccggccatacgcctgaaccccctctgccgcctgtgggaggcgacctggcatcccggctctctagtgacgaaggagaaatggatggagcagatgagtccgagaaactggattgccagttctctactcaccatccacgaccactggctttctgttcttttggatcacgtctaatgggcaggggctattacgtgtttgatcgcagatgggatcgctttcgctttgcccttaactctatggtcgaaaaacacttgaattctcagatgtggaagaagatccccccagcggctgacagccccctgccgtcccccgcagctcatatcacaactcctgtccccgcttcagtgttacagccgttctctaatccctccgctgtctatcttccaagtgccccaatttcgtcaagactgacaagctcttacataatgacatccgccatgctatctaatgcagcttttgtgacgtcccccgaccctagtgcgcttatgtcccacaccaccgcgttccctcacgttgccgctactctgagcattatggattccacattcaaggcaccttccgccgtgagtcccatccctgcggtcattccctcgcccagccacaaaccaagtaagactaaaacctccaagagttcaaaagttaaggacctttcaacaaggagtgacgagagtcctagtaacaagaagaggaagccacagtcgtccacaagctcgtcctctagcagtagctctagtagcctccagacctctcttagcagtccactgagtggacctcacaagaaaaactgcgtcctcaacgcctcttccgccctgaactcctatcaggcagccccaccatacaattcactgagcgtccacaatagtaacaatggggtgtcacccctcagtgctaagctggagccatctggcaggacctcactccccggtggccctgccgacatagttcggcaggtgggggctgtcggaggatcctcagattcttgtcccctcagtgtcccgtccctggccctgcatgccggagacctgagcctggctagtcacaatgcagtgagtagcctccctttaagcttcgacaagtcggaggggaagaagcggaagaatagctcctcgtcctctaaggcctgtaaaataacaaaaatgcccggaatgaattctgtccacaaaaagaatcctcctagtctgctggctccagtccctgatcccgtcaattcaacgtcctctcgtcaagtgggaaagaacagctcattggccctaagtcagtctagtccaagctctatcagctccccgggacattcccgccagaaaaacactaaccgcacaggaagaatcaggactctgccgtag

SEQ ID NO: 53232 - DNA, 1050 bp, Artificial Sequence
  Description of Artificial Sequence: Synthetic coding sequence
atgcccaggggtggaacccaggccagtagcgaggagtccgaggaggagggcacctcagatgacctgcatcccccacccgactgtcactacgcaacgagaccgcctagaccgcaggccttttgcactttcggatctagactggtgagcccaggatgttatgtattctcaaggcgcttggacagattttgttcagctctttcaagtatgctagaacgccatctcagcacccacatgtggaaaaagatcccccctgccgctgagccacccgcacacctggtaaatagcccactgagcgcacccctcagccccagcagtactgggacttgcccacggctgcctggaccaacactgaggccagcctgcccggcatcaatgccaccaacaaaggacaatctagtcccaagctatcccgctggctcaccctcggtggccgcagcctgcagtcaagctgagtgcatgggaggctcccaggctatcactagtccccttcccgcaaacaccccatccccctccttttccaagcttcctcctagcaaggcatccaagagcagtaaagggaaagacggagtggaggtcgaggccccttctcgcaagaggaaactctctccaggcccaacgactctgaagaggacatgtatcttagagcccaccggcaaaggcaaacccagcggttgccgtggactgagcgcgaaaacaaagaccgcactttccatgggactgaacggaacaatgggcccacgtgtgaagcgcgctggacccttggattgtcgaggatctccccatcagctgcctacgcccgtaaaggcctcccaattggaaaaccgcggagcagcagggcaccccgctaaggccctacccactaactgcctgtccgaggaggaagtggccaagaagcgaaagaacctggccacatattgtcgtccggtgaaagccaaacactgtcaggccggagcacccgcagatgtggcttgctctgtaagacgcaagaagccgggaccagcattagcatttgaggaaaaatgcagtacattgaaaagtaaagcgcactag

SEQ ID NO: 53233 - DNA, 2169 bp, Artificial Sequence
  Description of Artificial Sequence: Synthetic coding sequence
atggctgtgcgggaacgggcagcagccgctatggccgctctggagcggagagtcccaagtttagatgacttcgccggacagtcatggtccagctgggtggaacgggcagatctaccagccgcagatggagctgaactggaggagagctccaaaaataccaaaaaactagacgccatgaccctcatcaaggaagacatgtctatctttggccattgtcctgctcatgacgacttctacctggttgtgtgtaaccattgcagccaggtggttaaaccccaggcctttcagaaacactgcgagcgcaggcacggtccacttagcaagctgtatggtcgggctccgccacccccacccgcacccgctagttcacagaagtgtcatgttgtcaatggccagggccctgcgtgcagggcaccaggctctacgaaaacaagcagccgggaaaaaggacaggggtctagatcccgaggacaccagccaccagagaaaacccaaaaggataacttatgtcaaccaggcggattgaccaaggattcccccggtaagccaccgatggcccctccatccaaagaaccaccaggacgcgagaacattgaaattatcccgtccgagggtagttcccactgggcagaagggtctccacctgagaaggagccaagcggaacacgtctgccgccaaaaactcatcggaaaatggccagaaaggaatgcgatctgaatcggcagtgcggcgtgattaatccggaaaccaagaaaatctgcacacggctcctcacctgcaagatacattccgttcaccagaggcgcgaggtccaaggcagggcaaaagactttgatgtactggttgccgagctcaaggcaaactctcgaaaaggcgaatcaccaaaggagaaaagccctgggagaaaagagcaagttttggaaaggcctagtcaggagttacctagttcagtgcaggtcgttgccgctgttgctgcccctagttccacattctccgttagggccaagcaaacttacccatactgtgcccttccaagatcaagggcatcatctgaatctgaactcgacgatgaaggtccgtgcggtggtgacggggatcccggtctgttcccttttcctatgcccaggggaggtacacaggctagctctgaggagagcgaggaggaaggtacgtctgacgacctgcatccaccacccgattgccactacgctacccgcccaccgaggccccaggccttttgtacattcgggtcacggctcgttagcccaggctgttacgtgttcagtaggagactcgaccggttttgctctgccctgagttctatgctggagcgccacttgtccacccacatgtggaaaaagatcccccctgccgctgaacccccagctcaccttgtgaatagccccctctcagctccactgtcgccaagcagcactggaacatgcccgcgacttcctgggccaacccttaggcctgcctgccctgcatccatgccaccaacaaaagataacctagttccatcctatcctgccggaagtccctcagtagctgctgcctgctcccaggcggagtgtatgggcggaagtcaagccatcacatcccctctcccggctaatactccttcaccatctttcagcaagctgcccccaagtaaggcaagcaagagcagtaagggaaaggatggagtagaggtggaagccccatcccgcaaacggaagctgagtccaggcccaaccactctgaagcgaacctgcattttagaaccgacaggaaaaggtaagccctcgggttgccgtggattgtcagccaaaactaaaaccgctctgtcgatggggctgaacgggaccatgggtcctagagtcaagagagcgggaccactcgactgccgcggaagcccccaccagctacccacacccgtgaaggcatcccagctcgagaatcggggtgcagctggacaccctgcaaaggctctccccaccaactgcctgtctgaggaagaagtggccaagaagcggaagaacctggccacttattgtaggcctgtgaaagccaagcattgccaggccggagcgcctgccgatgtcgcctgctccgttcggagaaagaagcccggtcctgccctagcatttgaagaaaagtgcagcacacttaaaagcaaagcacactag

SEQ ID NO: 53234 - DNA, 1743 bp, Artificial Sequence
  Description of Artificial Sequence: Synthetic coding sequence
atggcggtgcgcgagagagccgcagccgcaatggccgcactggagcgcagggttccatctctggacgatttcgcaggacagtcctggtcctcctgggtcgagagagccgacttacccgctgccgacggggcagagctggaagagtccagcaaaaatacgaaaaaactggatgccatgacactaattaaggaggacatgagcattttcggccattgcccggcacacgatgacttctacctagtcgtctgtaatcattgttcacaggtggtgaaacctcaggctttccaaaagcactgtgaaagaaggcatgggccattgtcaaagctctatggacgagctccacccccacctcccgcacccgcttcgtcacagaaatgtcatgtagtgaatggccagggtcctgcctgtcgagctcccggtagtacgaagaccagcagtagagaaaaagggcagggaagtagatctcgcggtcatcagccccctgagaaaacccagaaggataatttgtgccagccgggaggattaaccaaagactctcccggtaaaccaccgatggcccctccctccaaggaaccgcctggaagggagaatatcgagatcataccatcggagggatccagtcactgggctgagggatcaccacctgaaaaggagccctcaggtacaaggctccccccaaaaactcaccggaagatggccagaaaggagtgcgacctcaatcgtcaatgtggagtgattaatccagagaccaaaaaaatctgcacccgcctcttgacgtgcaaaatccatagcgtacatcagcggagagaggtgcaaggacgtgccaaagatttcgatgtgttggttgctgagctcaaggctaattctagaaagggggaaagtcccaaggagaagtcacctggccgtaaggaacaagtgctagagcggccatcccaagagctgccttccagcgtacaagtcgtcgccgcagtggcagccccatcttcaactttctccgtgcgcgctaaacaaacctatccctattgcgccctgccgagatcacgtgccagtagtgaatctgaattagatgacgaggggccatgcggaggagacggggaccccggtctttttcctttccctatgccaaggggtggcactcaggctagttcagaggaatctgaagaggagggcacatccgacgatctacacccacctccagactgccactatgcaacaaggccaccgagaccgcaggcgttttgtacattcggatccagactcgtatccccaggttgttacgtgttctcacggcgattggaccgcttctgtagcgcattaagtagtatgctggagagacacctgtcaactcacatgtggaagaaaataccgccagctgctgagcccccagcccaccttgtaaatagcccattgtcagcacccctgtcaccttctagtaccgggacttgtcctcggcttccaggacccacgctgcggcctgcatgcccggcaagtatgcccccaacaaaggataacctagtgccctcttatcctgctggcagcccctctgttgctgcggcttgctcccaagctgagtgtatgggggagcccggataccacctgacaacagcctgtcaacatgctatcccagtgctgcaacaggctgctgcttttcaagggcagcaggtgatccagcggcagggcaggggaggaggcggtgggcctttctcaaaggccgaagtgatcccttggccctaccattcgtag

SEQ ID NO: 53235 - DNA, 294 bp, Artificial Sequence
  Description of Artificial Sequence: Synthetic coding sequence
atggaagagattagtttagccaaccttgacactaacaaactggaagcaattgcccaggaaatatatgtggacctcatcgaagacagctgcctaggcttctgctttgaagtgcatcgcgcagtgaaatgtggatacttctatcttgaatttgccgagaccggatcagtcaaagattttgggattcagcccgtcgaggacaaaggcgcatgtaggttaccattgtgctccttgccaggagagccagggaatggcccagaccagcaactccaaaggagtccccctgagttccagtag

SEQ ID NO: 53236 - DNA, 1860 bp, Artificial Sequence
  Description of Artificial Sequence: Synthetic coding sequence
atgctgcttgccagtgccgtggtcgtatgggagtggctcaacgaacatggacggtggcgtccatactcccctgctgtgtcccatcacatcgaagcggtcgtgagagctggtccgagagctggcggtagcgtcgtcctgggtcaggtggacagccgtctggcaccctatattattgacctccagtccatgaatcaatttaggcaggacacggggacactgcggcctgttagacggaattattacgatccttcgtctgctccgggaaagggagtagtctgggaatgggaaaacgacaatgggtcctggacaccctacgatatggaggtgggaatcacaattcagcatgcttatgaaaagcagcatccctggatcgacctgactagtatcggctttagctatgtcattgactttaataccatgggtcaaataaaccgccaaactcagagacaaagaagggtccggagaaggcttgatctcatctaccccatggtgactggtactctgccgaaggcacagtcatggcccgtgtcacccggacctgctacaagccctcccatgtctccttgcagttgcccacaatgtgttctcgtcatgtcagtaaaagctgccgtagtgaatggaagtactgggcctctccagctgcccgttacacgaaagaatatgccacccccaggagtcgtgaaactcccacctctgccaggctccggggctaaacccctggatagtacagggacaattaggggccctttgaaaaccgctccctcacaggtgataaggaggcaggccagcagcatgccgaccggtacaaccatgggaagccccgcttctcctcccggacctaactcaaaaaccggcagggttgcgttggctactctcaatcggaccaatctccaaaggctggccatagcccaaagcagagtgctgattgcctctggggtgcctacagtacctgtcaagaacctgaatgggtcgtctccagtgaaccccgctctggctggcattactggtatcctaatgtctgcggcaggcctgcctgtgtgtctcacccggccacctaaattagttttgcatcctccccctgtgagcaagagcgagatcaagagcattcctggagtgtcgaacaccagtagaaaaacgactaagaagcaggcaaaaaagggcaagactcccgaggaagtgttgaagaagtacctgcagaaagtgcgacacccccctgatgaagactgcacaatctgcatggagcgccttaccgctcctagtgggtataaagggcctcagcccacagtaaagccagatctggtgggcaaactgtctcgatgcggacatgtttatcatatttactgcctcgtggcaatgtacaataacggcaacaaggatggcagcctccagtgtccgacctgcaagacaatttacggagtgaagacggggactcagcctcccggaaagatggaataccatcttattccccactctctgccaggacaccctgactgcaagacgattcgtattatctatagcatccctccgggtatccagggacccgaacatcccaatccaggaaaatccttcagcgcacggggtttccctcgccactgctacctgcctgattccgagaaggggagaaaggtgctgaaactgcttctggttgcttgggatcggagactcatcttcgccatcggcacttccagcactactggcgagagcgatacagtcatatggaatgaagttcaccacaaaacagagtttgggtcgaatctaaccggccacggttatcctgatgcaaattacctcgacaatgtactcgctgagctggctgctcaaggcatcagtgaggatagcaccgcccaggagaaggattag

SEQ ID NO: 53237 - DNA, 996 bp, Artificial Sequence
  Description of Artificial Sequence: Synthetic coding sequence
atggccgtagccatggtgaagctctgcgaaagagcaggcctgcccctgctagcggctcctcttctccgctctctacttccacgtgctcctcagccagggcctgcccagcctagaagcgttcagggtcagaggtgccccgcacggcatccaccaggcaatcttgtttgtgagcgcggagccggtgtaaacggagttactgccggtgctgggggacggctgcgcggacttcatcgcggagggcgagccctagggtgctccgcccacagaccactgcatagcgctagggtccggccacctgcacacctggcggctccacctggcagttcggctagagggtgtcgtctgaccgagctcgggtacgcccttaatgagtggctgcaggacataaggaagaaccaactgcccggacttctggggggtgtgggaccgatgcatagtgtggtccagttgtttcagggattccgggatttactctggcttccaattgagcagtaccggaaagatggcagacttatgagggggctgcagcggggagcagcatcttttggctccagcacagcctccgccgctttagagctcagtaatcggctggtgcaagcaatacaggcaacagccgagacggtctatgacattctgtcacccgcagccccagttagccgttcattgcaggataagaggtctgcacggagactgcggcgtggacagcagcccgcagatttaagggagggggttgctaaagcttacgacacagtgcgagagggcattctggataccgcgcagacaatttgtgatgtcgcctcccgtggtcatgaacagaaggggcttacaggcgcagtcggcggagtgattcgtcagctgcctcctaccgtggtcaagccactcattttggctactgaagccacgtcctccctactcggaggcatgcgtaaccagatagtcccagacgcacacaaggaccacgccctgaagtggcggtctgattccgcccaggactag

SEQ ID NO: 53238 - DNA, 5816 bp, Artificial Sequence
  Description of Artificial Sequence: Synthetic coding sequence
atgagtagatggttatggccctggagcaactgcgtgaaggagcgggtttgccgttacctgttgcatcactatctgggtcacttcttccaggagcatctttctttagaccagctctccctggacctgtacaaggggtctgtggctctgagagatatccatctcgagatttggagtgtgaacgaggtgctggagtctatggagagcccactagagctggtggagggctttgtaggcagcattgaagtcgctgtcccttgggctgccctcttgacggaccactgtaccgttcgggtttccgggctccagctgactctacagcccaggaggggtccagcccctggggcagctgatagtcagtcatgggcctcctgtatgacaacttccctgcagcttgcacaggagtgcttacgagatgggctgcctgagccttcggagcctcctcaacccttggagggtcttgagatgtttgctcaaacaatcgaaacggttctgagaaggatcaaagtgaccttcctggacactgtcgtgcgcgtggaacatagccctggcgatggcgagcgcggtgtagctgttgaagtgcgcgtgcaacggctggagtattgcgacgaggctgttagggacccctctcaagcccctcctgttgatgtgcaccaaccaccggctttccttcacaagctactccagcttgccggtgttcggctccactacgaggagcttccagcccaagaggagccacccgagcccccactgcagatcggctcttgcagcggatatatggaattaatggtcaagctcaagcaaaacgaggccttcccagggccaaagctggaagtcgctggacagttagggagccttcatctcctcctcacaccgcgacaactgcagcagctgcaggagttgcttagtgccgtcagcctgacagatcacgaaggattagcagacaagcttaacaaaagcagacccttaggggctgaggacctctggctgattgaacaggaccttaatcagcagctccaggcaggggctgtcgctgaaccactgagtccagatcctctgaccaatccacttctgaacttggacaatacagatctgtttttttcaatggccggactcacaagtagtgtggcttcagccctatccgagctgagcttatctgacgtcgatctagcaagctccgtccgctccgatatggccagcagacgactctcagcccaggcacatccagctgggaaaatggcccctaatcctctactggatactatgaggccagacagcctactgaaaatgactctgggcggagttacgttgacattgcttcagacatcagccccatccagtggcccacccgatttagcaacccatttttttactgagttcgacgccacgaaagatgggccttttgggtctcgagatttccaccatctccgaccacgctttcagagggcttgcccttgctcacatgtcaggctcacaggtactgcagtgcagctctcgtgggaactgaggactgggtcgaggggaagaaggaccacttcaatggaggtgcactttggtcagctggaggtcctggagtgcttatggcctcgcggaacctctgagccagaatataccgagatccttacctttccaggcacactggggagccaggcatctgccaggccgtgtgcccacctcagacatacccaaatcttgaggcgcgttcccaagtccagaccacgcagatctgttgcttgccattgccatagtgagcttgcgctagacctggccaactttcaggccgacgtggagctaggcgcactggatcggcttgccgcactgttgcggttggccactgtcccagcggagccaccagccggattgctgaccgagccccttcccgctatggagcagcagacagtcttcagattaagcgcaccccgagccactctgcggctgcgcttcccaattgccgatttacgtcctgaaccagacccctgggcaggccaggccgtgcgagccgaacagttaagattggaactctcggagccccagttccgctctgaactgtcctcaggtccgggtcccccagttccgacacatctagagcttacttgctccgacttgcatggcatctacgaggatggcggtaagcctcccgttccctgtctccgggtaagtaaggcactggaccccaaaagcactgggcgtaagtacttcctgccgcaagttgtggtgacagtcaaccctcaatctagttccacccagtgggaagtagctcctgaaaaaggtgaagagttggagctgagtgtggagagcccctgcgaacttcgcgagccagaacctagcccattctcaagcaaacgtaccatgtatgagaccgaggagatggtgatcccaggcgatccagaggaaatgagaacattccagtccaggacactcgccctgagcaggtgctccctggaagtcatacttccttctgtgcacatctttctgccctccaaagaggtctatgaatctatctataaccgaatcaacaacgatctgttgatgtgggagcccgcagatctcttacctacccctgaccccgctgcccagccttccgggtttcccggacctagtggtttttggcatgatagctttaagatgtgcaagagcgcttttaagctggctaattgcttcgacttaactcccgactccgacagcgacgacgaagacgcgcacttcttttccgtgggtgcaagcgggggtccccaagccgcagccccagaggcacctagccttcatctgcagtccacattctcgaccctcgtaaccgttctcaaagggaggatcacggcactgtgcgagacaaaggacgagggcggtaagaggcttgaggctgtccacggagagctcgtgctggatatggagcatgggaccctattcagcgtgagccaatactgcggccaaccaggactaggatatttctgtctggaagccgagaaagccaccctctatcatagagctgcggtggacgactatccgctgccctctcacctggacttgccttcttttgctcccccagctcagctcgctccaactatttatccctccgaagaaggagtgactgagcgaggagcatcaggccgaaaaggacaggggagggggcctcacatgctctccacagcagtcagaattcatttggacccacataagaacgtgaaggagtttctagtgacactccgtctgcataaagccacccttagacactacatggcactcccagagcaaagttggcattcgcagcttcttgaatttttggacgtgctcgatgatcctgtgctgggctatttgcctcccaccgtgatcacaatcctgcacacccaccttttctcctgttctgtagattaccgccctttatatctgcctgtgcgagttctgatcaccgccgagacttttacgcttagttccaacatcattatggataccagcacgtttctactgcggttcattttggatgacagcgcgctctacctttccgataaatgtgaagttgaaacattggatctccgcagggactatgtatgcgtattggatgtagaccttcttgagttggttatcaagacttggaaggggagcaccgaagggaaactgtcccagccactgtttgagcttcggtgttctaataatgtggtgcacgttcactcttgcgctgactcttgtgccctcctcgtgaacttactgcagtatgttatgtccaccggggaccttcatccccctcccagacctccctccccaaccgaaatagctggccaaaaactgtctgagagtcctgcctccttaccctcctgcccacccgtggagaccgcgctgatcaatcagcgtgacctggccgacgcactgctcgacacagagaggagccttcgggaactggctcaaccatccggtggccacctgccccaggccagccccattagcgtctacttattcccaggtgagaggtcaggagccccacctccatcaccaccagtgggtggccctgccggaagcctgggcagctgctctgaggagaaggaagatgagcgggaggaggaaggcgacggagatacactcgactcagacgaattttgtattcttgatgcgcctggtctgggaattccccctcgagacggagagcccgtggtcactcagctccaccccggaccgatcgtcgtaagggacggctacttcagtagaccgattggcagtaccgacctcctccgcgctcctgcccacttccctgtaccatccacacgagtggttctcagagaagtctctctggtgtggcacctgtatggaggtagggactttgggccacatccaggccatcgggcaagaactggcctatccgggcctcgatctagtcctagccggtgctctggacctaatagaccccagaactcatggcgaacacaaggtgggagcggtagacaacatcatgtcctcatggaaatccagttatctaaagtgtcgttccagcatgaggtgtatcctgccgagcccgctacaggaccggcagccccatcccaggagctggaggaaaggccactatccagacaggtgtttatcgtgcaggaactcgaggttagggatcgcctcgcatccagtcagattaataagttcctttacttgcacacgagcgaaaggatgccccgacgggcacacagcaacatgttgactatcaaggctcttcatgtggccccaaccactaacctgggcggacctgaatgttgcttgcgagttagcctcatgcccttaaggctgaacgttgatcaggatgcacttttttttctgaaggatttctttacctcacttgtggccggtatcaatccagttgttcccggagaaaccagcgctgaggctaggcctgagacacgcgctcagccatcctcccctctggaggggcaggccgaaggagtggaaacaaccggatcccaggaagcccctggaggcggacacagtccttcccccccagaccagcagcctatttactttcgcgagttcaggtttacatcagaagtgcccatctggttggattaccatggcaaacacgtgacgatggatcaggtgggtacattcgccggactgcttatcggcctggcccaactgaactgctccgagctgaagcttaagcgtctgtgttgcagacacggcctgctgggagtagataaagtgctgggctacgcactcaacgaatggctgcaagatatcaggaaaaatcaattaccaggattactcggcggagtgggacccatgcattccgtagtacagctgttccaggggttccgcgacctattgtggttgcccatcgagcagtatagaaaagatggcaggctgatgcgtggacttcagcgtggcgctgcttcctttggatcaagcaccgcctccgctgccctggagctttcaaaccgcctggtccaggctattcaggcaacagccgagacagtttacgacattttaagtcccgcagccccagtcagccgcagcttacaagataagcgatccgctaggaggctccggagggggcagcagccagctgacctgcgagaaggagtggccaaagcctatgataccgtgagggagggaatactcgacacagcccagacaatttgcgacgtagccagccgtggccacgaacagaagggcctaactggggctgtgggcggtgttattcgccagctgcccccaacagttgtgaagcccctcattctcgccacagaagcaaccagctccctgttgggcggaatgaggaatcaaattgtccccgatgctcacaaggatcatgctttaaaatggaggtccgatagtgcccaagatta

SEQ ID NO: 53239 - DNA, 5822 bp, Artificial Sequence
  Description of Artificial Sequence: Synthetic coding sequence
atgagcaggtggctgtggccctggtccaattgtgtgaaagagcgcgtgtgtagatacctgctgcaccactatctgggccacttttttcaggagcatctgtcgcttgaccagttgtcgctcgatctttacaagggcagcgtcgccctgcgtgacatccacctggaaatctggagcgtcaacgaggtgctggaatctatggagtccccgctagaactggtggaaggctttgtgggcagcattgaggtcgccgtaccgtgggcagctctcttgactgaccattgtactgtgagggtgtcgggcctgcaattaacactccagcccagacgaggacctgcaccgggtgctgctgattcccagtcttgggcctcgtgtatgactacttccctccagctggctcaagaatgtctgagagacggcctgccggaaccgtcagagccaccgcagcctctggagggacttgaaatgtttgcgcaaacaatcgagactgttcttcgcagaattaaggtaaccttcctagatactgtagtaagagttgagcacagcccaggcgacggagagcgtggtgtcgctgttgaagtccgcgtgcagagactagaatactgcgacgaggctgtgagagatccttcacaggcaccccctgtggacgtgcatcagccacccgctttcctgcataagctactgcagctcgccggtgtccggctccattatgaagaactccctgctcaggaggaaccgccagaacctccactgcagatcggctcctgttccggttatatggagctcatggtaaagctgaagcagaacgaagcttttcctggcccaaagctggaggtggcagggcagctgggttccctgcacctgctgttgacacccaggcagctgcaacagttacaggaattattgtcagcagtgtctctcaccgatcacgaaggactggcagataaactcaataagagcaggccattgggagcggaggatctgtggcttatcgaacaagatctgaatcaacagctgcaggccggagccgttgccgagccactgtcacccgaccctctcacaaacccactgctgaacctggataacacagacctgttttttagcatggcagggcttacatcatccgtggcctcagccttatcagagctcagcctctctgatgtggatctcgcatccagtgtgcggagcgacatggcttcccggaggctgagtgctcaggcacaccccgctggaaagatggcgcctaaccccctgctagacaccatgcggcctgactcattgctcaagatgacgctcgggggtgtcaccctgaccctcctccagacctcagcgccatcttcgggcccaccagatctcgcaacccactttttcacggaattcgatgcaacaaaagacgggccttttgggtcgcgagactttcaccaccttcgaccacgctttcagagagcatgcccctgctcacacgttagactgacaggcaccgctgtgcagctatcatgggagctgcgtacaggctcacgaggcagacggaccaccagcatggaagtccatttcgggcagctggaggtcctggaatgtttatggcctcggggtacctcagagccggagtatactgagatcctgacttttccaggcaccctgggatcccaagcgtccgcaaggccctgcgctcaccttaggcacacgcaaatcctgcggcgtgtgcctaagtccaggcctcgcaggtcagtggcttgtcactgccattccgaactggccctggacctggccaatttccaagccgacgttgagctgggcgcattagaccggttagctgccctgctgaggctggctacggtcccagccgaaccacctgcaggcttgctaaccgagccactcccagccatggagcagcagacagtctttaggctgtccgccccacgtgcaacgctgagactgcgcttccctattgctgacctacggcctgagcccgatccatgggcgggacaagccgttcgcgctgaacaacttcgcctcgaattgagtgagccccaattccgttcagagctctcgtcagggccagggccacctgtgcccacacatctcgaattgacatgcagcgacctccatggcatttacgaggatggtggtaagcctcctgtgccatgcctacgggtctccaaggcccttgatcccaagtccaccgggagaaaatacttcctgccgcaagtggttgttactgtcaacccgcagagtagctctacacagtgggaggtggccccagaaaaaggcgaagagttggaactcagtgtcgagagtccctgtgaattaagggaaccagaaccatcaccattttcctctaaacgaaccatgtatgaaaccgaggagatggttattcccggagatcctgaagagatgcgcacatttcagtcccggaccctcgccttgagtcgctgttccctggaggtcatccttccctccgtgcacatctttcttcctagcaaagaggtctacgagtcaatatataatagaatcaacaatgacttacttatgtgggagcctgccgacttgcttcctacaccagacccggcagctcaaccgtctgggtttccaggcccatctggattttggcatgacagcttcaaaatgtgcaagtccgcctttaaactcgccaactgcttcgatttgaccccagatagcgattccgacgacgaggacgcccacttctttagtgtgggtgccagcggcggacctcaggctgctgcccctgaggccccatctctccaccttcagagcacattttctacattggtcaccgtgctgaaaggaagaattaccgctctgtgtgagaccaaagacgaggggggaaaaaggctggaagccgtccatggagagttggttctggacatggaacatggaaccctgtttagtgtcagtcagtattgcggccagcccggattgggctacttttgcctggaggcggaaaaggcaacactctaccacagggccgctgtcgatgattaccctcttcctagtcacttggacctgccttctttcgctccaccagcgcagctggccccaaccatctatcccagcgaggagggcgtgactgaaagaggagcttccgggaggaaaggacaaggtagagggccacacatgttatccaccgccgtgcgtattcacctcgaccctcacaagaacgtgaaagaatttctggttacactcaggcttcataaggctacactgaggcattacatggctctgcccgagcagtcatggcactctcaattgttggaattcttggatgtgctagacgacccagtgcttgggtatctacccccaacagttattaccattctacatactcacctgttctcatgtagtgtcgattatcggcctctgtacctgcctgtgcgagtgcttatcactgctgagacgtttactctatccagcaacataattatggacacttctactttcttattgagattcatattggacgactcagctttgtacttgagcgacaaatgcgaagtggagactctcgatttgagaagggattatgtttgcgtgctcgacgtggacctgcttgaactagtgataaaaacttggaagggaagtactgagggtaaactaagtcaacctctcttcgagctaagatgcagcaacaacgtagtccatgtgcattcatgtgctgactcctgtgccctcctggttaacctgctgcagtatgtgatgagcacaggggacctacaccctccaccacgacctccaagccctactgagattgcaggccagaaggtgcaattgagtgagtctccagccagccttccatcttgcccacccgtcgagacagccttgatcaatcagagagatctcgctgacgcgctcttagatacagaaaggtcattgagagaattggctcagccatctggaggccatctgccccaggcttccccaatttcagtgtacctcttccctggcgaaagatcaggtgctccgcctccttcacccccagtgggtggcccagcgggatcgctgggaagctgcagtgaagagaaggaagatgaaagagaagaggaaggtgatggcgataccctagatagtgatgagttctgcatcctagatgctccagggctggggatacctcctcgcgacggagagcctgtggttacacagctccacccgggacccatcgtggtccgcgacggatactttagtcgcccaattgggagcaccgacttactcagggccccagcccacttcccagtgcccagcactcgggtcgtcctccgcgaggtgtcgttggtttggcatctgtatggtggacgcgatttcgggccacatccaggccatcgagccagaaccggtctgagtggcccaagaagctcaccttcgcggtgtagcggcccaaaccgtcctcagaatagttggaggacccagggcggatccggcagacagcaccacgtgttgatggagatccagcttagtaaggtttccttccagcatgaggtgtacccggcagaacctgcaaccggccctgccgcaccaagtcaggagctggaagaaaggccgctgagtcgacaggtatttatcgtgcaggaactcgaggtgagggaccggctggcatcttctcagataaacaagttcctttacctgcacacatccgagcggatgcccagaagggctcactcgaatatgctgaccatcaaggccctgcacgttgcccctaccacgaacttaggcggaccagagtgctgtctgagagttagcctgatgccccttcgcctaaacgtggaccaagacgctctattttttctgaaggactttttcacaagcctggtggcgggaataaacccagtagtgccaggggagaccagcgccgaagctaggcccgagacacgggctcagcccagctcccctctagagggacaggccgagggggttgagaccaccgggtctcaggaggcacccggtggtgggcactctccctcccccccagatcagcagccaatctactttagagagttcaggttcactagtgaagtcccaatttggctcgattatcatggaaaacatgtgacaatggaccaggtgggcaccttcgccggtcttctgattggcctggctcaactgaactgcagtgagctcaaattaaagaggctgtgctgtagacatggtttgctcggagtggacaaggtgttgggttacgccttaaatgaatggctgcaagatatcagaaagaatcaattgcctgggttgctgggcggagtgggtcccatgcactcagtggtgcagctcttccagggatttagagacctgctttggctacccattgagcagtataggaaagatggcaggctaatgcgagggctccagcgcggtgctgcgtcctttggttccagtaccgcttccgcagccctcgagcttagcaatcgtttggtgcaagctatacaggccacagcagagaccgtgtacgacatactgagccccgcagctccggtgagccgctcacttcaggataaaaggagtgcaagaagactgcggaggggacagcagccggcagatcttcgcgagggggtggccaaggcctatgataccgttagagaggggatcctggataccgctcagactatatgtgatgtcgcaagcagagggcatgaacagaaaggtctgaccggcgctgtggggggagtgatccgccaattgcctccgaccgtggtcaaacctctcatccttgccactgaggccacatcctccctgcttggtggcatgagaaatcaaatcgtgcccgacgcccacaaggaccacgccctcaagtggaggtccgacagtgcacaggacta

SEQ ID NO: 53240 - DNA, 6236 bp, Artificial Sequence
  Description of Artificial Sequence: Synthetic coding sequence
atgccatggcctttttcggagtccatcaagaagcgcgcttgccgatacctgttacaacgttacctggggcacttcctacaagagaagctatctctagaacaactgagcctggatttgtaccaggggaccggcagcctcgcccaggtgccactcgacaaatggtgcttgaacgagattctggagagcgccgacgcacctctggaagtgactgaaggtttcattcaatccattagcctgtctgtaccctggggttccctcctgcaggacaattgcgcgctggaggtacgaggactggagatggtattccgtcccaggcctagacccgctacaggcagcgaaccaatgtattggagtagcttcatgacctccagcatgcagctagcaaaggaatgcctctctcagaaactcactgatgagcagggagaaggcagtcagccgtttgaaggcctggagaagtttgctgagacaatagagacggtcctgcggagggtgaaggtcacttttatcgataccgtgctccggatagagcacgtgccggaaaattccaagactggaactgcactggagattcgcatcgaaaggacagtgtactgtgacgagacagccgacgaaagcagtggcatcaacgtccaccagccaactgcgtttgcccacaaactgttgcagctctcaggagtgagcctgttctgggatgaattttccgcaagtgcaaagtcgtcacccgtgtgttctaccgcacctgtcgagactgagcccaaactctctccttcctggaacccaaaaatcatctatgaacctcacccccaactgacgcgcaatctgccagagatcgccccaagtgaccctgtgcagataggcagactcatcggccgtttggaactgagtttgacgttgaaacagaatgaagtgctgcctggggcaaagctcgacgttgacggacagatcgacagcatacatttattgctgtctcctagacaggtacatctgctgcttgatatgttagccgctattgcagggcctgaaaatagcagcaagattgggttggccaacaaagatcgcaagaaccgccctatgcagcaggaggatgaatatcgtatccaaatggaactcaataggtactatctgcgtaaggactctctgagcgtgggagtaagttcagagcagagcttctatgaaactgagaccgctcggacaccctctagcagagaagaggaagtgtttttctcaatggctgatatggacatgtctcacagcctgtcaagtctgcccccacttggcgaccctccgaacatggacctggagctgtctctcaccagcacatataccaacactcccgctggtagtccactgagcgctaccgtgttgcagcccacatggggagagttcttggatcaccataaggaacagcctgtccgtggttccaccttcccgtctaacctggtccaccctactccactgcagaaaactagcttgccatcccggtcggtctccgttgacgagtcacgcccagagctcatcttccggctggcagtcgggaccttttccataagtgtgctccatatcgaccctctctcccctcccgagacaagtcaaaacttgaatcccctgaccccaatggcggtcgctttctttacctgcattgagaagatagaccccgctcgctttagcactgaggactttaagagcttcagagccgtgttcgcagaagcctgctcgcatgaccacctgcgcttcatcggcacgggaatcaaggtcagctatgaacaaaggcagcgcagcgcgtcgaggtacttctccacagacatgagcatcggccaaatggaatttctggaatgcttgttcccaacagattttcactccgtgccaccccattataccgagttgctaacttttcactccaaagaagaaactgggagtcatagcccagtatgccttcagctgcattacaagcattcagagaaccgaggaccacaagggaaccaggctagattgtcctcagttccacacaaagccgaactgcagattaaactgaatccagtgtgctgtgaattagacatatctatagtcgaccgcctgaactctctgttgcaaccacagaaattagcaaccgtcgaaatgatggcttcacacatgtatacaagctataataagcatatttctttacataaggcatttactgaggtatttctggatgatagccatagtcctgcaaactgtcggatttcagtacaagtcgccacacccgctctgaatctgtcagtgcggttcccgattcccgatttgagatcggatcaggagagaggaccctggtttaaaaagagcctccagaaggaaattctctatttagctttcaccgatttggagtttaaaactgagtttatagggggttcaactccagaacagattaagcttgagctgacattcagggagcttatagggtccttccaagaggagaaaggggatcctagcattaagttcttccacgtatccagcggtgttgatggagataccacctctagtgacgattttgattggcccagaatcgttctcaagattaatccgcctgccatgcactcaattctagagcgaattgctgcagaagaggaagaggagaacgatgggcactaccaagaggaggaggaaggaggcgctcactctctgaaagacgtttgcgatctgcgtcggcctgcccctagtcctttctcgagtcgtagggtgatgtttgagaacgaacagatggtgatgcctggggaccctgttgaaatgaccgaattccaggataaggcgattagcaattcgcactatgttttggagcttaccctgccaaatatctacgtcaccctacccaacaagagcttctatgagaaattgtacaaccgtattttcaatgatctcctcctgtgggagcctactgccccttctcctgtggaaacatttgagaatatctcctacggaattgggctctccgtggcgagtcaactgattaacacatttaacaaggactctttcagtgctttcaaaagtgctgtccattacgacgaggaatccgggtccgaggaggaaaccctacagtatttttctacggttgaccccaactatcgctcaagaagaaagaagaagctggactcccagaacaagaacagccagagcttcctttctgtactgctcaatatcaaccacgggttaatagcagttttcacagacgtaaaacaggacaacggtgatctgttagagaataaacatggagaattctggctggagttcaattcaggaagcctcttctgcgtgactaaatatgagggatttgatgataaacactatatttgcttgcactcctcaagctttagcctctaccataaagggattgtcaatggagtcatcttgcccacagaaactcgtctgccaagttccacccggcctcactggttagagcccaccatctacagctccgaagaggacgggctcagtaaaaccagctcggatggggttggcggagactcactcaatatgctgtctgtggcagtgaaaatcctgtccgataagagcgagagtaatactaaggagttcctgatcgccgtgggcctcaagggcgcaactttacagcacaggatgctgcccagtggactcagttggcacgaacagatcctatactttcttaacatcgcagatgagccagtcctggggtacaacccgcctactagctttacaactttccacgtgcatctctggtcctgtgccctcgattaccgcccactctacttacctataagatcactgctgaccgttgagaccttctccgtgagcagttctgtagctctggacaaatcttcatccacattgcggatcatactcgatgaggctgccctgcatctgtctgataaatgcaacacggtgactataaacttatcaagggactacgtgcgggtcatggacatgggccttctggagttaacgatcaccgctgtcaaatcagactcagatggggagcagacggagcctagatttgagcttcattgctctagtgatgtcgtccacatccgcacctgctccgacagttgtgccgctctgatgaacctgatacagtatatcgcgtcttatggggatttacaaacacctaataaggcagacatgaaacccggtgccttccagcggaggtccaaggtggactcatccggcagaagctcttcccgagggccagtgcttccagaggccgaccagcagatgctgcgcgacttgatgtccgacgccatggaggaaatcgacatgcagcagggaacatcatcagttaaaccacaagcgaacggtgtgctggatgaaaaaagccagattcaggagccgtgctgtagcgacctgttcctatttcctgacgagtcaggcaatgtcagccaggaatccggaccaacatacgcctctttttcgcaccacttcatctcagacgccatgacaggcgtgcctaccgagaatgacgacttttgcattctgtttgcccctaaagccgctatgcaagaaaaggaagaggaacccgtgatcaagataatggtggatgatgccatagtgattcgagacaactatttctctctccctgtgaataaaaccgacacttcaaaggcacctcttcacttcccgatcccagtaattaggtatgttgtgaaggaagtgtccctcgtgtggcatctttatgggggtaaggacttcgggattgtccctccaacgagccctgcaaaatcctacatatccccccacagctcaccctctcataccccaaccagacatggaagaaatacagtgtgtggtgggaagggccgtaatcacgatttccttatggaaatccaactctcaaaggtgaagtttcagcacgaagtgtatcccccatgcaagccagactgcgactcatctcttagtgagcacccagtctctcgacaggtctttatagtacaggatctggagattcgggatcggctcgcaacatcccagatgaacaagtttctctatctgtactgtagcaaagagatgccaagaaaagcgcattccaatatgctcaccgtaaaggccttacatgtgtgccccgagagcgggagaagtcctcaggagtgttgcctcagggtgtcactcatgcccctgagactgaacatcgatcaggatgcgctgtttttcctgaaagacttcttcacatcactcagcgcagaggtagaactccaaatgactcctgatcccgaagtgaagaaaagccccggtgctgacgttacctgttctctcccgcgtcacttgagcacctctaaggagcccaacctcgttatcagcttcagtgggccaaaacagcccagccagaacgactcagccaacagcgtagaggtggtgaatgggatggaggagaagaatttttccgccgaagaagcaagttttcgtgatcaaccggtgttttttagagaattccgtttcacctctgaagtgccaattcgcctcgactaccatggaaaacacgtcagcatggaccagggcaccctggctggcatcctcattggactcgcgcagctaaactgcagcgaactgaagctgaagaggctcagctacagacatgggttgctgggggttgataagttattctcctatgccatcaccgagtggttaaatgacataaagaagaaccagctgccaggaatcttaggaggagtcggtcccatgcattctctcgtccagctggtgcaggggctgaaggatctggtgtggttgcccatcgagcagtatcggaaggacgggcgtatcgtgcgcggattccagcggggagcagcaagtttcggcacatccacggccatggcagccctggagctcaccaacagaatggtccagacaattcaagcagccgctgagactgcctatgacatggtatcccctggaaccttgagtatagagcccaaaaaaactaagaggttcccacaccaccgcctggcccaccaacctgttgacctgcgcgagggcgtcgccaaagcctacagcgtcgttaaagaaggcatcaccgacacagcccaaacaatctacgaaaccgcagcccgtgaacacgagagtagaggcgttaccggggctgtgggagaagtactgcggcaaattcccccagccgtggtaaaaccgctgatcgtggctacagaggcaacctctaatgtgttggggggaatgagaaaccagatacggcctgatgtccgacaggatgagagccaaaagtggcgccatggggatgatta

SEQ ID NO: 53241 - DNA, 2214 bp, Artificial Sequence
  Description of Artificial Sequence: Synthetic coding sequence
atggaagatgcaggagaagaccccacaacgtttgcagctcacagcctgccctcagatccaaggttacttgccactgtcacaaatgcatatctcggtactagagtcttccatgatactcttcatgtgagtggtgtgtataatggggcaggaggcgatacccatcgcgctatgctgccaagccctctcaacgttaggttggaggcccctgccggtatgggcgaacagctcacggagacgtttgccctcgataccaatacaggtagcttcctgcatacactcgaagggcctcgtttcagagcatcacagtgcatctacgcacataggacactgccccacgttcttgcattcagagtcagtattgcccgtttggctcccggaagcggacccatcaccctcctgctgaggtctgcctttagtccagagagccctgacctggacctacaccagggccctgattttcagggagccaggtacctatacggacacactctgacgccagaacaacccggtggcccacagcaagaggtgcatatgttgtggacacctgcacctccagacctgactctcggtgagggagaggaggccagaacatgggacttcctcaccgctgtgggcggttcccaggcggaggcacaggcgtgtttgaccgaagcccttcagctgcaggctcgcggtgccctgtatactgcccacgctcaggcctgggctcagctctgggttgaatgtggtctcgacgtcgttgggcctttacagctcagacaggctttgcggggatcactgtactaccttttgtccgcactgcctcagcctaaagcgcctgggtacatttgccacggtctgtccccaggtggtttgagcaacgggtcccgcgaagagtgttactggggacatgtgttttgggaccaggatctctggatgttcccatcgatactgatgttccaccctgaagctgccagggcgatcctagaatatcgtatcaggactttggacggcgctttagaaaacgcacaaaacctcggatatcagggcgcaaagttcgcctgggagagtgcggatagcgggctggaagtgtgtcctgaagacatctacggcgtccaggaggtgcacgtgaatggagccgtcgtgctcgcattcgagctgtactaccacacaacacaggatctacagctgtttagagaggcagggggttgggacgtcgtcagagcagtagccgaattttggtgttcgagagtcgagtggtcaccgagggaggagaagtatcaccttagaggcgtgatgagccccgatgagtaccacagtggggtcaataacagtgtttatactaacgtcctcgtgcaaaattctcttcggttcgccgcagccctggcccaggatctggggctgcctatccccagtcagtggttggctgtcgccgataaaataaaagttccctttgatgtcgaacagaatttccaccctgaattcgatggatacgaacctggggaagttgtgaaacaggcggatgttgtgctactggggtatccagttcctttcagtctctcccccgacgtgaggaggaagaatctcgagatctacgaggcagtgacctccccgcagggcccagcaatgacctggagtatgttcgccgtgggatggatggaactcaaggacgcagtgagagctcgtgggctcttagaccgctcctttgccaatatggcagagccatttaaagtgtggaccgagaacgcagacggcagtggagctgtgaattttctaacaggcatggggggatttctccaagctgttgtcttcggctgcaccggctttcgagtgactagagcgggagtgacattcgatcccgtgtgtctgagcggcattagtcgtgtgagtgtttcgggtattttttatcagggcaataagctcaattttagtttctccgaagacagcgtcactgttgaagtgactgcacgagctgggccatgggccccacatttggaggccgaactgtggcctagccaatctcgactaagcctgctccctggacataaggtgtccttccccagaagcgctgggcgtattcagatgagtcccccaaagctccctggatcatcctcttctgagttccccggacggactttcagcgatgtgcgtgacccactccagtcccctttgtgggttacattgggatcttcttcccccactgaatcactgactgttgacccagcctccgagtag

SEQ ID NO: 53242 - DNA, 804 bp, Artificial Sequence
  Description of Artificial Sequence: Synthetic coding sequence
atgagggttgcagcccttatttcaggagggaaagactcttgctataatatgatgcagtgtatcgcggcaggacaccagatcgtggccctggctaacctgcgaccagctgagaatcaggtggggtccgatgagctcgatagttacatgtatcagaccgttggacatcatgctatcgacctgtacgctgaagccatggcgcttccgctttatagaagaacgatccgcggacgcagtctggacacccggcaggtgtacacaaagtgcgaaggcgacgaggtcgaagacctgtatgagctgctcaagctggtcaaggagaaggaagaggtggaaggaatctcagtcggagccattctctcagactatcagcggattcgggtcgagaatgtatgcaaacgactcaatttgcaaccgttagcttacctttggcagcggaatcaggaagatctgctgcgcgaaatgatctcctctaacatacaggccatgatcatcaaagtcgctgcgttaggactggacccggataagcacctgggtaaaaccctggatcagatggaaccctacctgattgaattgtctaagaagtacggcgtgcatgtgtgtggtgaggggggagaatatgagacattcacgctggactgccccctcttcaagaagaaaatcatcgtggattcttccgaggtcgtaatacatagcgccgatgccttcgcacccgtagcgtacctcaggttcctggaactccacctcgaggacaaggtgtccagcgttccagataattatagaacgtctaattatatctataacttctag

SEQ ID NO: 53243 - DNA, 498 bp, Artificial Sequence
  Description of Artificial Sequence: Synthetic coding sequence
atgagggtggctgctttaatttcagggggaaaggactcatgttataacatgatgcagtgcattgctgccggtcaccagatagtggcgctcgctaacctgaggcctgcggagaatcaagtgggcagtgacgaactggatagttatatgtaccaaaccgttggccaccatgctatcgacctgtatgccgaggcaatggctctcccactctatcgacggacaatccggggaagaagtttggatacaaggcaagtgtacactaagtgtgagggtgatgaggtcgaggacctctatgagcttcttaagttagtgaagggcattacacggatgaccctgcttgccgagtatgatgccctgaacttgcaggattttcatatgcatctgaaagttggatcgcaggctattgtgtataggaccccaaacgagctgtgtactcatagcaagttcgataagcatacctttccacctttcattagcgaaatagctaaatgtgaggtctag

SEQ ID NO: 53244 - DNA, 3306 bp, Artificial Sequence
  Description of Artificial Sequence: Synthetic coding sequence
atgtctgcaaaggccattagtgagcaaacaggtaaagaactgctctataaatttatctgcaccacttccgctattcagaatcgattcaaatacgcaagggtcacacctgacacggattgggcgagactgctccaggaccatccttggctgctatctcagaatcttgttgtgaagccagaccagcttatcaagagacgcggaaagctaggccttgtcggcgtgaacttgaccctagacggagttaagagttggctgaaaccacgacttggccaggaggccacagtagggaaggccaccggcttcctgaagaactttctcatcgagcccttcgtcccacactcgcaagctgaagagttctacgtctgcatttacgcaacccgcgaaggagattatgttctgtttcaccatgaagggggagtcgacgttggtgatgttgatgcgaaagcccagaaactcctggtaggcgtagatgagaaactaaaccccgaggacatcaagaaacacctgcttgttcacgcccctgaagataagaaagaaatcctggcgtcttttatttccggcttatttaatttttatgaagatttatattttacctatctagaaattaacccactcgtagtaaccaaagatggcgtctatgtcctcgatctcgcggcaaaggtcgacgccactgcagactacatttgtaaagttaagtggggcgatatagaatttcctcctccttttggtcgcgaagcctaccctgaagaagcctacatcgccgatctcgatgctaagtccggtgcatcactgaagctgaccctgcttaatcctaagggtagaatctggacaatggtagcaggagggggagcttctgtggtgtactccgacaccatatgtgacctgggcggagtaaatgagcttgccaattacggcgagtactcaggagcaccaagcgagcagcagacgtatgactatgctaagacaattctgtcattgatgacgcgggaaaagcatcccgacggcaagatcctaattattggaggctctattgccaatttcaccaacgtggctgcgacgttcaaaggaatagtgagggccatccgtgattaccagggacctctgaaggagcacgaagttacaatatttgtgcgacgcggtgggccaaattatcaggagggtttgcgcgtcatgggcgaagtgggaaagactactggcatccccattcacgtctttggcacagagacccacatgaccgcaattgtggggatggcactgggccaccggcctatcccaaaccagccccctacagcagcccatacagccaatttcctgctgaatgctagcggatctacgtctacccctgcaccttcacggacggcatccttctcggagagcagggccgacgaggtggctccagcaaaaaaagctaaacctgctatgccccaggactcagtgccttcccctcgaagcctgcaggggaagtccacaaccctgttcagccgccacactaaggccatagtttggggcatgcagacacgcgcagtacagggaatgctggacttcgattacgtttgtagtcgcgatgaaccatctgtagccgcaatggtttatccattcactggcgatcacaagcagaaattttattggggacataaggaaatcttaataccagttttcaagaacatggccgatgctatgcgcaagcaccccgaggtggatgtgctgattaactttgccagcttacgcagtgcttatgacagtacaatggaaaccatgaactacgcacagataagaacaattgccatcatcgctgaaggaattcctgaggcactgacaagaaagctcatcaagaaagcagatcagaaaggggtcaccatcatcggacctgctactgtagggggaattaaacctggatgcttcaagatagggaataccggaggaatgttggacaacatcctggcatcgaaactatatcgtcctgggagtgtcgcatacgtcagcagatcgggtggaatgtctaatgaattaaataacatcatctcccgcaccacagacggcgtgtatgaaggcgtagctatcgggggagatcggtacccaggttccacatttatggaccatgtcctccggtaccaggacaccccaggagtgaagatgattgtggtactcggagagatcggcggaacagaggagtacaaaatctgtaggggaatcaaggaaggtagacttaccaaacccatcgtgtgctggtgcattggaacatgtgctaccatgttctcaagcgaggtgcaatttggacatgccggagcctgcgctaaccaggcgtcagagactgcagttgcgaagaatcaggctctgaaggaggctggcgtctttgttccgaggtcctttgacgaactgggcgagatcattcagtctgtctacgaggatctggtggctaacggcgtgattgtgcccgctcaggaagtccccccacccaccgtgccaatggactacagctgggcacgagaactcgggttgataagaaagccagcctcttttatgactagtatctgcgacgaaagggggcaggagctcatttacgctggaatgcccatcacagaagtcttcaaagaggaaatgggaattgggggtgtcttgggactgctctggtttcagaaaaggctacccaagtattcctgtcagtttatcgagatgtgtctcatggtgactgctgaccatggccctgctgtttctggggctcacaataccatcatctgcgcacgggcaggcaaagacttggtatcaagtctgacgagcggactgcttaccataggcgatcggtttggaggggctctggacgccgctgctaagatgtttagcaaggcattcgactccggaataattccgatggaatttgtgaacaagatgaaaaaagaaggcaagctcatcatggggatcggtcaccgtgttaagagcatcaataaccccgatatgcgcgttcagattctgaaagattatgtcaggcagcacttccctgcaaccccattactggactatgcgctggaagtggagaagatcactaccagtaagaagcccaatctgattttaaacgtggacggtcttatcggcgtcgcttttgttgatatgctgaggaactgtggaagtttcacgagggaggaggccgacgagtatatagatatcggcgctctgaacggcatcttcgtgctcgggagaagtatggggtttattgggcactacctggaccagaagcgccttaagcagggcctatacagacatccctgggatgacatcagttacgtgctgcctgagcatatgtccatgtag

SEQ ID NO: 53245 - DNA, 288 bp, Artificial Sequence
  Description of Artificial Sequence: Synthetic coding sequence
atggcgcatttcaaggacgacctgcagaccaacgtcgagatcatacccggagagtcagcgcctcgcaaagagagtcccaggcccccagccccacccagtagcgcagcaggggtcggagggtgctctaaccactccccaagtgtgcaggagtcacctctctctcctccagctctcgcccaattggggtctgcccagcagcctagcatgagaaccgagctcagtttctccgagaagaaggatacaatgattatctggcaaatcaccattaccgtgtggtgtcaacgctag

SEQ ID NO: 53246 - DNA, 288 bp, Artificial Sequence
  Description of Artificial Sequence: Synthetic coding sequence
atggcgcacttcaaggacgacctccagacaaacgttgagatcataccaggagagagcgcccctaggaaggagtcccctagaccacccgcaccacctagcagtgctgccggtgtggggggatgctctaaccactcgccatccgtacaggaatccccactatcacctcccgcactcgcccagctgggctccgcccagcagcctagtatgcggactgagctttcattctcagaaaagaaggataccatgatcatctggcagattacgatcacagtgtggtgccagagatag

SEQ ID NO: 53247 - DNA, 1173 bp, Artificial Sequence
  Description of Artificial Sequence: Synthetic coding sequence
atgcccccatctggactgagactcctacctctattactcccgttgctttggttactcgtattaacgcccggtagacccgcagccggactctctacctgcaagaccattgacatggaactggttaagcgaaaaaggatcgaagcgatcaggggacagattctgagcaaactacggcttgcaagtcccccatcccagggtgaagtgccccctggacctctgcccgaagctgtgctggctctttacaactcaacccgcgaccgcgtggctggcgagagtgccgaacctgagcccgagccagaagccgactattatgcaaaggaggtcacccgagtcctgatggtcgaaacacacaacgagatttatgacaagtttaaacaatcaactcattctatttacatgttttttaatacctcagaattaagagaggctgtccccgaacctgtcctactgtcaagggcggaactgagacttctgaggcttaagctgaaagtggaacagcacgtggaattgtatcaaaaatacagtaataactcctggcgctacttgagtaacagactgctggcacctagcgacagccccgagtggttgtccttcgacgtcactggagttgtgaggcagtggctttcacgaggcggtgagattgaaggctttcgtctctctgctcactgctcatgtgacagtcgggacaacaccctgcaggtggatataaacggctttacaaccggcagacgaggtgatttagcaacgattcacggcatgaatcgaccattcctgctcctgatggccacccctttggagagggcccaacatctgcagtccagcagacatcgtagagcattggatacaaattactgtttctcatcaaccgagaagaattgttgcgtgagacagttgtacattgatttccgaaaggatcttggctggaaatggatccatgagcccaagggataccacgcaaacttttgtctgggaccgtgcccatacatctggagccttgacacccagtatagcaaggttctcgccctgtacaaccagcataaccccggtgcttccgccgcaccctgctgcgtgcctcaggctcttgaaccactccccatcgtatactatgttggccgtaaacctaaagtggagcagttaagcaatatgatcgtgaggagctgtaaatgctcatag

SEQ ID NO: 53248 - DNA, 576 bp, Artificial Sequence
  Description of Artificial Sequence: Synthetic coding sequence
atgtgggacctcgtgctggaagatcgcagaatgaactcattaagacttgtggcgccaatgtggaatggcagaatacggggtatccaccggctcggtgctgccgtggctcccgaggggaaccagaagaaaaaaaggacgatcctgcagtttctaacaaactacttttatgatgtggaggccctcagagattatctcttgcagcgagagatgtacaaagtgcatgagaagaaccgctcatacacttggctggaaaaacagcacggcccttacggtgccggagcatttttcattctcaagcagggcggtgccgttaagttccgcgataaggagtggatccgccctgacaagtatggccacttctcccaggagttttggaatttctgtgaggtgcccgtcgaagcagtagacgcgggtgactgcgatatcaactatgaaggcctcgacaacttacgcacgagcgctggatggacatcgagaacctctctgccatgccctaccctggctagtttacgatactggtggcgacgttgctgcccgattgcgagactgtgggagtctacaggtctgcgggcatag

SEQ ID NO: 53249 - DNA, 792 bp, Artificial Sequence
  Description of Artificial Sequence: Synthetic coding sequence
atgtgggatctcgtgctcgaagatcgtcgcatgaacagcctgcgcttggttgcaccaatgtggaatggtcgcattcgcggaatccataggctcggagccgctgtagcacccgagggcaaccagaaaaaaaagaggaccatcttacagttcctgacaaactatttctacgatgtcgaagctctgagagactacctgctccaacgcgaaatgtacaaagttcatgaaaaaaatcggtcttatacctggctggaaaagcagcacggaccttatggagcaggcgctttttttatcttaaagcagggaggcgctgtgaaattcagagacaaggagtggattagacctgataaatacggacacttctcccaagagttctggaatttctgcgaggtcccagtcgaggccgtagacgcaggcgactgcgatattaactacgaaggcctagataatttactgagactaaaagaattgcaatctctgtccctgcagagatgttgtcacgtcgatgactggtgcttgtctaggctgtaccctctggcagattcgcttcaggagctgtccttagcaggttgtcccaggatttcagaacgtggcctcgcatgtctgcatcatctccagaacttacgtcgcctggatattagcgatttacctgccgtttccaacccagggttaacccagattctagtggaggagatgctgccgaattgtgaggtagtaggggtggattgggcagaggggctcaagagtgggccagaagagcaacccagggatactgcctctccagtgccggcatag

SEQ ID NO: 53250 - DNA, 693 bp, Artificial Sequence
  Description of Artificial Sequence: Synthetic coding sequence
atggccgctccctgggcatcattacgactcgtggctcccatgtggaacggacgcatccggggtattcatagattaggtgccgcagttgccccagagggcaatcagaaaaagaagcgaactatcctgcaattcctgactaactacttctacgatgtcgaagctctccgggactaccttctccagcgggaaatgtacaaggttcatgaaaagaaccgattcagagataaggaatggattcgaccagacaaatatggacacttttcacaggaattctggaacttctgcgaggtgcctgtggaggccgtggatgccggagattgtgacataaattatgaaggcttggataatcttctgaggctgaaagagttgcagtcgctgagcctacagcgctgttgccatgtcgacgattggtgtctctcacgtctgtatccgcttgccgatagtctgcaggagctgagtcttgcaggttgtccgaggatcagtgaacgcggactggcctgtctgcaccacttgcagaacttgcgtaggctcgacatctcagatcttccggcagtttccaaccccggtctgacacagatcctcgtcgaggaaatgctgcccaattgtgaagtagtgggagttgactgggccgagggcctcaagtccggacctgaggagcagcccagggataccgcctctccagttcccgcttag

SEQ ID NO: 53251 - DNA, 1002 bp, Artificial Sequence
  Description of Artificial Sequence: Synthetic coding sequence
atggagctagatatccactccgcacaagtgcctctaccggtggggagaggacgtcaccgagacgcgaccccagaaagtaagggttctcttcaggacctcgggtggagcgccgttgctcaaagccagctcacggccacttccacttcacctgcgcaggttattcccccaccacagcccaggtggagccggacccccggattcaagcgatgcttccgactgggactacataaagtgctcggatcacaatcactaagactagttgccccaatgtggaatggacgtatcaggggcatacatcgcctaggtgccgctgttgcccctgaaggaaatcagaaaaagaagaggacaatcttacagtttctgacaaactatttctacgatgttgaggccctcagagactatctgctgcagcgagagatgtataaggtacacgagaagaatcgtagctatacctggctggagaagcagcacgggccttatggggcaggagcattttttatacttaagcagggcggagctgtaaaattccgagataaggaatggatacggcctgataagtacggacattttagccaggagttctggaatttctgtgaagttcccgttgaagccgtggacgcaggggactgtgacattaactatgagggtttagataaccttctgagattaaaggaattgcagagcctcagcttacaacggtgttgtcatgtagatgactggtgcttgtcccggctgtatcctctagccgacagcttgcaggagctgtctctggccggatgtcctcggatctccgaaagaggactggcatgcctgcatcacttgcagaatctgaggcggctggatatctcagacctaccagccgtaagcaatcccggactgacccagatactggtggaggaaatgctgcctaattgtgaggtggtcggtgtggattgggctgaggggctgaagagtggcccagaggagcaacctcgcgataccgctagcccagttccggcttag

SEQ ID NO: 53252 - DNA, 693 bp, Artificial Sequence
  Description of Artificial Sequence: Synthetic coding sequence
atggcagccccatgggcgagcctgcgcttagtagcgccaatgtggaacggcaggatcagaggaattcatagactcggcgcagcagtcgcgccagaaggaaaccagaagaaaaagaggacaatcctgcagtttttgaccaattatttttacgatgttgaggccctacgcgactatctcttgcagcgtgaaatgtacaaagtccacgaaaaaaaccgctttcgggacaaggagtggatcagacctgacaagtacggccacttctcccaagagttttggaatttttgcgaagtgcctgtggaagccgtcgacgcaggcgactgtgatattaactatgagggcctcgacaatctgctgcgcttgaaagaactacagtctctgagccttcagcggtgttgccatgtggatgactggtgcttatcgcggctttaccccttagcggatagcctccaggagctctctttagctgggtgccctaggatctctgaaaggggactcgcctgtttacatcatcttcaaaatctccgcagactggatatatccgatctgcccgctgtatcaaatcccggactgacgcaaattttggttgaggagatgctccccaactgcgaggtggtaggcgttgactgggccgaaggcctgaagtctgggcctgaagaacagccccgagacacagcttctcctgtgccagcctag

SEQ ID NO: 53253 - DNA, 3663 bp, Artificial Sequence
  Description of Artificial Sequence: Synthetic coding sequence
atgggcgacatggcaaactcgtctattgagttccatcccaaacctcagcaacagcgggatgtgccccaggccggtggtttcggttgcactttagccgagctccgcacactgatggaactgcgaggcgctgaagctctgcagaagatagaggaggcatacggagatgtgtccggattgtgccggaggttaaaaacctccccgaccgagggtctcgctgataataccaacgacctggagaaaaggagacagatctacggccaaaacttcataccgccaaagcagcctaaaacattcctgcagctggtttgggaggcactgcaggatgtgaccctcattatcctggaagttgcagcgatcgtctctctgggcctgagcttctacgcaccgcctggagaagagagtgaagcatgtggtaatgtgtcaggcggtgccgaggacgagggtgaagccgaggcaggctggattgaaggcgctgctattctcctgagcgtgatatgtgtggttctagtcacagccttcaatgattggagtaaggagaaacagtttcgcggtttgcagtcccggatcgagcaggaacaaaagttcacagttatcagaaatggccagctgcttcaggttccagtggccgctctcgtcgtcggggacatcgcgcaggtgaagtacggagatctcctccccgctgacggcgttctcattcaagccaacgatcttaagatcgacgaaagctctttgacaggcgaatcagaccatgtcaggaagtctgccgataaagacccgatgctgctgtctgggactcatgttatggaagggtcgggaagaatggttgtgaccgccgtcggagtgaattctcaaactggcattatttttaccctcctgggggctggaggcgaggaagaagagaaaaaggacaaaaaaggcaaacagcaggatggcgcaatggaatcttcgcagaccaaggcaaagaaacaagacggtgctgtggccatggagatgcagcccttgaagtcagcagaagggggtgaaatggaggagagggagaagaaaaaagcaaacgcccctaaaaaggagaagtctgttctgcagggcaagctgacgaaattggcagtgcagatcggcaaagctgggctggtaatgtctgcaatcaccgttattattttggtgctgtactttgtcatcgaaaccttcgtggtggaggggagaacttggttggccgagtgcactcctgtttatgttcagtactttgtcaaattcttcataatcggggtgaccgttttggtggtggcggtgccagaggggcttccactggccgtgacaataagcctcgcgtacagcgtgaagaagatgatgaaggacaataatttagttcgccacctcgatgcttgtgagactatgggtaatgctacagccatttgcagcgacaaaactgggactctgactaccaaccgaatgacggtagtccagagttatctcggggatacccattataaggagatccctgcccctagcgccttaactcctaagatacttgatctcctggttcatgctatcagcataaattcagcatacacgactaagatcctgccacccgagaaagaaggcgcactaccacggcaggtcggaaataagacggagtgcgcgctactcggcttcgtgttggacttaaaacgggattttcagcccgtgcgggagcagatcccggaagataaactgtacaaagtgtacactttcaactccgtgcggaagtctatgtctactgtgatcagaatgcccgatggcggatttagactgttcagtaaaggagcgagcgaaattttgctcaagaaatgcacgaatatcctcaactcgaacggagaactgagagggtttcggccacgggatcgcgacgacatggtgagaaaaattatcgagccaatggcatgcgacggtctccgtaccatctgcattgcctacagagacttttccgcaggtcaggaaccggactgggataacgagaatgaggttgtgggagatctgacatgtatcgctgtcgttggaatagaagacccggttaggcccgaagttccagaggctatccggaaatgccagagggcaggcattacagttaggatggtcactggggacaacattaacacagcacgagctatagccgctaaatgtggtattattcagcctggcgaggacttcctctgtctggagggtaaagagtttaatagacggatccgtaatgagaaaggggagatcgaacaagagcggctcgataaggtctggccgaagctgcgtgtgcttgcacgatcgagtccaaccgataagcatactctggttaagggaatcatcgactcaacaactggggagcagagacaggttgtggctgtgactggcgatggtactaacgatgggccagccttaaaaaaggccgatgtgggatttgcaatgggcatcgctggcacagatgttgccaaagaggcttctgatatcattcttacggacgacaatttcacctccattgtgaaagctgtgatgtggggcagaaacgtctacgattccatttccaagttcctgcagttccagttgacagtgaatgtggtggctgtgatcgtcgcctttactggtgcctgcattacccaggattcccctctgaaagctgttcaaatgctttgggtgaatctgattatggatacattcgcatcactggccttggcgacggagcctcctacagaatccctactgctcagaaaaccttatgggcgtgacaagccgttgatcagcagaaccatgatgaagaacattctgggccacgcggtgtatcagctagccatcatcttcacgctactgtttgtcggtgaattgttctttgacatcgacagcggtcgcaacgctccactacattcgcccccttcagagcactacactataatcttcaacacctttgtcatgatgcaattgtttaacgaaatcaatgcccgaaaaatccacggcgagcgaaatgttttcgacggcatctttagcaatcccattttttgcactattgtgctcggtacgtttggaatccaaatagtcattgtgcaatttggtgggaaacctttttcttgttcaccgctgagcaccgaacagtggctctggtgcctctttgtgggggtcggagagctggtttgggggcaggtcattgctactattccgacatctcaactcaaatgcctgaaagaagccggtcacggccctggcaaagatgaaatgaccgacgaagaactagccgaaggggaggaggagatcgatcacgctgagagagaactgcgcaggggacagatactctggtttagaggtcttaaccgcatccaaacccagattcgagtcgtcaaagccttcagatcatccctgtatgaaggacttgaaaaacctgagtcaaagacctcaatacacaacttcatggctacgcctgaattcttaattaacgactacactcacaatatcccactgattgatgacactgacgttgacgaaaacgaagaaaggctgagggcaccccctcccccttctcccaaccagaacaacaacgcgattgactcaggcatttatctcactacccatgtcacgaaaagcgccacttcatccgtgttcagcagcagtcctgggagtcccttgcacagtgttgaaaccagcctctag

SEQ ID NO: 53254 - DNA, 4377 bp, Artificial Sequence
  Description of Artificial Sequence: Synthetic coding sequence
atggtgaatacgaggaagtcctcgcttcggctcctgggctcaaaaagccccggacccggtcctggcccaggcgctggtgcagagcccggagccaccggcggatcttcccactttatctcttcaaggacccggtcctcgaagactcgcgctgctagctgtcctgcggcaaaagccggaggaagcgggggagccggtgtcacactggacgaggccaggaaggtggaagttgacggctcactgtctgactcacacgtttctccccctgcaaaaaggaccttgaaacagcctgatagcgtttgcaaggacaagtccaaaagcaggtccacgggccagagggaggaatggaatctcagcaccgggcaggccaggctgacttcccagccgggtgccacactgccgaatggccattccgggctttcgcttaggtcccatccgcttcgaggcgagaaaaagggggacggagatctgtcttgtattaacggcgacatggaagtgaggaaaagctgtcgtagcagaaagaatagattcgagagcgtgaaccagtctctcctctttgatcagctggtcaacagcacagccgaggctgtgttacaggagatggacaatataaacatacgacagaacagaaggtctggcgaagtagaaaggctgagaatgtggaccgataccgagtttgagaatatggacatgtactccagggtgaagcgaaggcgcaaatccctgcgccgaaatagctacggaattcagaatcaccacgaagtctcaactgaaggtgaggaggaagaatctcaggaagaagacggagatatagaggtagaggaggccgagggcgaggagaacgataggccatacaatttgcgtcagcgtaaaaccgtcgaccggtatcaggcccctcctattgtgccagcacatcagaaaaaaagagagaacacactgtttgacatccaccgctccccagcacgaagatcccacatccgacggaagaaacatgccatccacagttctgacacaaccagctctgacgaggaacggtttgaacgccgtaagagcaagagcatggcccgagcacggaatcgttgcctgcctatgaacttcagagccgaagacctggcctctgggatcttgcgcgagagagtgaaagtaggtgcctctctggcagacgtagaccctatgaacattgataagagtgtcaggttcgatagcattggcggtttgtcacaccacatacacgcgctcaaggagatggtggtctttcccctgctctaccctgaaattttcgaaaagttcaaaattcagccaccaagaggctgcctgttttacgggccacccggtaccgggaagacgttagtcgcacgtgccctggccaacgaatgtagccagggagataaaaaggtagcttttttcatgaggaagggcgctgactgcctgtccaagtgggtgggtgagagcgagagacagctcaggctcctgttcgaccaggcatatcttatgagaccatctataattttttttgatgaaattgatggtctggcccctgttaggtcctctagacaggatcaaatccactcatccatcgtgtcgaccctcctcgcccttatggatgggctcgataaccggggtgagatagtggtcatcggagccacaaatcgccttgattctatcgaccccgcacttcggcgaccaggccgattcgaccgagagttcctttttaatctgcccgatcagaaggcaagaaagcacatcctacaaatccatacacgcgattggaacccaaagctgagtgatgcctttctgggggagctagctgaaaagtgcgttgggtactgtggagctgatattaaggcgctttgtaccgaggccgcacttattgcgcttcgaaggcgttaccctcagatctacgcctcttcccataagcttcagttggatgttagctccattgttctgtcagcacaggatttctatcacgctatgcagaatatcgtccccgcaagccagcgcgctgtgatgtcctcaggtcatgcactctcacccatcattcggcctcttttagagcgcagttttaacaacatcctcgctgtgctgcagaaggtgtttcctcatgctgagatatcccagtcagataagaaggaagatattgaaacacttatcctggaggattctgaggacgaaaacgccctcagcatcttcgagacaaactgccacagtggctcccccaagaagcagtcatctagtgcggctattcacaagccctatttgcatttcacaatgtctccgtatcaccagcccaccagctataggccaaggctgctgctgtcaggcgagaggggaagtgggcagaccagccaccttgccccagcgctactccacacacttgaaagatttagcgtgcaccgcctcgatctgcctgctctctacagtgttagtgccaaaactcctgaagagtcatgcgcccaaatttttagggaggcacgcagaaccgttcccagtattgtgtatatgccccacattggcgactggtgggaagctgtcagtgagaccgtccgggcaacatttctgacgctgctgcaggatatcccctcattcagccccatatttctgctcagcacctccgaaacaatgtactcagagttgcctgaagaggtgaaatgtattttcagaatccagtatgaggaggttctgtacatccagcggcctatcgaagaggataggagaaagtttttccaagaactcatcctgaatcaggcttccatggcacccccacggagaaagcacgccgcactctgcgccatggaggttctcccactggccctgccttcaccccctcgccagttgagtgagtcagagaaatcacggatggaggaccaggaggagaacaccctgagagaactcaggctgtttctgcgcgacgtgaccaagcgcttggcgactgacaagagatttaatatcttttccaaacccgtggatatcgaagaggtgtctgattaccttgaggtgataaaggagcctatggatctctcaactgtgataacgaaaattgataagcacaactatcttacagcaaaagattttctcaaggatatcgatcttatatgttccaacgcacttgagtataaccctgataaggatccgggagataagattatcaggcacagggcctgcacgctgaaagataccgcccacgcaatcattgcagctgagctcgaccctgagtttaacaaactctgtgaagaaatcaaggaagccagaattaagcgcggactctctgtgacatccgagcagataaatccccattcgacaggtgcgagaaaaactgagacccgggtggaagaggccttccgccataagcaaagaaatcctatggacgtatggcacaattctgccaacaagtgtgccttccgtgttcgcagaaagagccgtcggcgtagtcagtggggcaagggtattattaagaagcggaaggtgaacaatcttaaaaaggacgaagaggacaccaagttcgcagattatgaaaaccacactgaagaccgcaaactgcttgagaatggcgagttcgaagtctcaaccgactgtcatgaagagaacggcgaagaaactggggacttgtccatgacgaacgacgaaagctcctgcgacattatggacctggaccagggccagcgcttaaataatggcgctgggaccaaagagaacttcgcaagtacagaggaagagtcttccaatgaaagcctgctggtgaacagcagctcttcattgaacccagaacagacgtcccgcaaagagacatttctgaaaggcaactgcctgaatggagaggcttcaaccgattcgtttgaggggatccccgtactggagtgccagaatggcaagctggaggtggtctccttctgcgactcaggcgacaagtgctccagcgagcagaagatcctccttgaggatcaaagcaaggagaaacccgaaacaagcactgagaaccacggtgacgatctcgagaagcttgaagctctcgaatgttctaacaacgagaagctggagcctggctcagacgtagaagtgaaggatgccgagctggacaaggaaggagcatcaaaggtgaagaagtatcgtaaactgattctcgagcaggctaaaaccacatccctggagctcgttcccgaagagccaagcgagcccgttccacccctcatcgtggaccgcgagagactaaagaaattgctcgacctcttggtagacaagtccaataacctggcggtggaccagctggagcgcttatattcactgcttagccagtgtatataccgccatagaaaggactatgacaagtcacagcttgtcgaagagatggagcgcactgtgcatatgtttgaaaccttcctgtag

SEQ ID NO: 53255 - DNA, 639 bp, Artificial Sequence
  Description of Artificial Sequence: Synthetic coding sequence
atggaagtacggaaaagctgccggtcacgcaaaaacaggttcgaatctgtgaatcaatctctgttgttcgaccagctggtgaactccaccgcagaggctgtgctgcaggaaatggataacatcaacatcaggcagaaccggcgaagtggggaggtcgagcgtcttcgcatgtggaccgataccgagtttgagaacatggacatgtacagtcgagttaaacggaggcggaagtccttgcggcgaaacagctacggaattcagaaccaccacgaggtgtcaacggagggggaggaggaggctcgaacttcgaagctgctgcccttggaaaagattagcatcgaaagccaggaggaagatggtgatatagaggtggaggaggccgagggcgaagagaacgatcgtccttacaacctgcgccagaggaaaacagtggaccggtaccaggccccacctatcgtgcctgcacaccaaaagaagcgagaaaataccctgttcgacattcaccgcagcccagcgagacggagtcacatacggaggaaaaaacatgccattcatagctccgacacaacttcatcagatgaggagcgcttcgagcgcaggaagtccaaatccatggcccgagcacggaaccggaaatag

SEQ ID NO: 53256 - DNA, 1881 bp, Artificial Sequence
  Description of Artificial Sequence: Synthetic coding sequence
atgcctcatatcggggactggtgggaggcagtgtctgagactgttcgcgcaacatttctaacactgctacaggacattccgtcattctctcccatattcttgctgtctaccagcgaaactatgtatagtgagctcccagaagaagttaagtgcatctttcgtatccagtatgaggaagtactgtatatccagcggccaatagaagaggacagaagaaaattcttccaggagttaatcctgaaccaggcgtcaatggccccacccaggcggaaacacgctgccttgtgtgctatggaggtccttccattggccctcccatcaccacccaggcagctgagtgaaagcgagaaatcaagaatggaggatcaggaagaaaacaccttgagggaacttcggctgtttctgcgagacgttacaaagaggctggcaactgataagagatttaatatattttccaagcccgtggatattgaagaggtatcagattacctggaggtgatcaaagagcctatggatttgtcaacagtgatcactaagatcgataaacataattacctgacagctaaggattttctgaaggatatcgatctgatctgttcgaacgccttagagtacaatcccgacaaggatcccggagataaaatcatccgacatagagcctgcacacttaaggacactgcccatgccataatcgcggctgaactggatcccgagttcaataaactctgcgaggagatcaaggaagctaggatcaaaagaggactgtctgttaccagcgaacagatcaatccccactccaccggggcacgcaagacggagactcgcgtggaagaagctttcagacataagcagcgtaatcctatggacgtgtggcataatagcgctaataagtgcgctttccgggtgagacgcaagagtcggcgacgatcacagtggggtaagggaataattaaaaagagaaaggtgaacaatctaaagaaagacgaggaggatacaaagttcgcagattacgaaaatcataccgaggacaggaagctgctagagaacggggaattcgaggtgagcaccgactgtcatgaggaaaacggcgaggagacaggcgatttgtccatgacaaatgacgaaagcagttgtgatatcatggatttggaccaaggccaaaggctcaataacggggctggtaccaaggagaactttgcgtccacggaggaggagtccagcaacgagagcctattagtgaactcatcttcctccctgaatcctgaacagaccagtcggaaggaaacattccttaaggggaactgtctgaacggtgaagcaagcaccgactctttcgaaggaatccccgtgttagaatgccagaatgggaagctggaggtggttagcttctgcgacagcggggataagtgcagttccgaacaaaaaatactgctagaagaccagtctaaggaaaagccggaaacttcaacggagaaccatggagacgatttggaaaaacttgaggcattggagtgctctaacaatgaaaagctcgagcctggatccgacgtggaagtgaaagacgccgagctcgataaggaaggtgctagcaaggtgaagaaatatagaaagctgattttggaacaagcgaaaactacatccctagagctggtgcccgaagagcccagcgagcctgtaccccctcttatcgtcgatagggagaggctcaaaaagttgcttgacctcctagtggacaaatcgaataatctggccgtggaccagctcgaaagactatatagtcttctgagtcaatgtatctatcgccacaggaaggactatgacaaaagccagctggtcgaagaaatggagcgcacagttcatatgtttgagaccttcctatag

SEQ ID NO: 53257 - DNA, 1236 bp, Artificial Sequence
  Description of Artificial Sequence: Synthetic coding sequence
atgagcaaggatgctctaaatttagcccagatgcaggagcagaccctccagctggaacagcaatctaagctgaaacagctggtaaacgaagatctgcggaaacaggaggaatcggtgcaaaagcaccatcaaaccttcttggagtcaattcgggctgcaggtactctgttcggggaaggtttccgggctttcgtgactgaccgcgacaaagtgacagccacagttgctggtctgaccttgctagccgtaggcgtctattccgccaagaacgccaccgcagtgacaggccgttatattgaggccaggctggggaagccttctctggtccgcgaaacctcaagaattactgtgctcgaagctctgcgacaccctatccagcaggtgagccgcagacttctgtctagacctcaggacgtccttgaaggagtggtgttgagcccatccctggaagcacgcgttagagatatcgccatcatgacaaggaacattaagaaaaaccggggtctgtatagacatatattgctttacggcccaccaggtaccgggaagacactgttcgcaaagaaactcgctttgcacagcgggatggattacgccatcatgaccggtggtgatgtcgcccctatgggcagagagggagttaccgctatgcataagctcttcgattgggcaaatacatcgcgacgcggtctgctgctctttgttgatgaggcagatgcattcctccggaaacgcgctaccgagaaaatctcggaagacctgagagcaactctgaatgcatttctctacaggacgggccagcattcaaataaatttatgctcattttggcctcctgtcatccagaacagttcgactgggctattaatgcatgcatcgacgttatggtacacttcgatctgccagggcaggaagagagggccagactggtcagaatgtacctgaacgagtacgtcctgaagcctgccaccgaagggaagcggcgtctgaagctggcccagttcgattacggaaggaaatgtctggaaattgcaaggctaactgaaggaatgagctgcaggaagatcgcccagctggccgtgagttggcaggccacagcctacgcaagtaaagatggcgtgctaacggaagcaatgatggacgcatgcgttcaagacttcgtgcaacaacaccagcagatgatgcggtggctcaagggggaacgtccagggccagaggacgagcagccttcttcttag

SEQ ID NO: 53258 - DNA, 2112 bp, Artificial Sequence
  Description of Artificial Sequence: Synthetic coding sequence
atggcaacctgtgctgagatcttacggtcagagtttcccgagattgatggccaggtcttcgattacgtgaccggggtgctgcacagcgggagcgccgacttcgagtctgtcgacgacctggtggaagcagtgggcgagcttctacaggaggtgtcaggcgactccaaggatgacgctggaataagagccgtgtgccagcggatggctgagcctcagtctcagggcaattcacaggtcctgttagacgcacctatccaactgtccaaaattacagagaactacgactgtggcactaaactgccagggctgctgaagagagagcagtcaagcaccgtgaatgccaaaaagctggagaaggctgaagctcgcctaaaagctaagcaggagaaacggagcgagaaggatacgttgaagacctccaaccctttagtgcttgaagaagcaagcgcatcccaagctgggagcagaaaggagagccgcctggagagcagcggaaaaaataagagctatgacgttaggattgaaaacttcgacgtttcatttggcgacagggtcctacttgccggagcagacgttaatctcgcctgggggaggcgatatggactggtgggtcgtaatgggttaggcaagactaccctgctgaaaatgctggccactcgttccttgcgagtgcctgcacacatctccctgctccacgttgagcaagaagtggccggagacgatacccccgctcttcaaagcgtgctggaatccgattctgtgcgtgaggacctgcttcgcagggagagggagttgactgctcaaatagcagcaggtcgagccgagggatcagaggctgcagagctcgccgaaatctacgctaaactggaagaaattgaagctgacaaagcgcctgctcgggcttcagtaatactagccggtctcgggttcactcctaagatgcagcaacagcctaccagagaattctctggcggttggagaatgcgtctcgccctagctcgcgctctctttgccagacctgatctgctgctcctggacgagccaacaaacatgctcgacgtcagagcaatcctctggcttgagaattacctgcagacttggccatccaccatattagtggtctcccatgaccgcaatttcctcaatgccatcgccacagatataatccacctgcattcacagaggctggacgggtaccgcggtgattttgaaaccttcatcaaatccaaacaggaacggctgcttaatcaacaacgagaatacgaggcgcagcagcaatatcggcagcatatccaagtttttatagacaggttcagatacaatgcgaatagggcatcacaggtgcaatctaagctaaaaatgttagagaaattgcctgagctcaagcctgtggataaggagtccgaggtggtaatgaagttccccgatggcttcgaaaagttttccccaccaatcttgcagttggacgaggtcgacttttactatgatcccaaacatgtcattttctctcgattgagcgtctccgcggatctggagagtaggatctgcgttgtaggagaaaatggtgcaggcaaatctactatgctgaaactcctactgggggatctggccccagtgcgtggcattcgccacgcccacaggaacctcaagattgggtatttctcccagcaccatgtagagcagctcgacctcaacgtcagtgccgtcgaactgctggcacggaagtttccaggaagacctgaagaggagtaccgccaccagctagggaggtacggcatctcaggtgaactggccatgcgcccactggcctcgcttagcggaggccagaaatctcgtgtcgccttcgcccagatgactatgccgtgtcctaatttctatatcctggatgagcctacgaaccacctcgatatggaaactattgaggccttggggagagccctgaacaatttccgtggtggggttatcctggtgtcccacgacgaacgattcattcgactggtctgtagggagctttgggtttgcgaaggcggtggagtcactcgggttgagggcggtttcgaccaatatcgcgctctgctccaggagcaatttcgccgagagggatttctgtag

SEQ ID NO: 53259 - DNA, 2130 bp, Artificial Sequence
  Description of Artificial Sequence: Synthetic coding sequence
atggccacttgcgctgagatccttaggagcgaattcccagagattgatggccaggtgtttgattacgtgaccggtgtgttacactccgggtcggcagattttgaatccgtggatgatctcgtcgaagccgtaggagaattactccaggaagtttctggggattctaaggacgatgcaggaatacgagcagtatgccaaagaatgtacaatacactgcggctggctgaaccccagagtcagggcaattcccaggtactcctggatgcgcctatccagctctccaaaattactgagaactacgactgcggcacaaaactcccgggactacttaagagggagcagagctctactgtcaatgccaaaaagctcgagaaggccgaggcaagacttaaggctaaacaggagaaacggtcagagaaggacaccctaaaaacctccaaccctctggttctcgaggaagcctctgcatcccaggcagggtctcgcaaggaatcccgcttggagtcctcaggcaagaataaatcttatgacgtgcgcattgaaaattttgacgtctcttttggggacagggtcttgctggcaggagccgacgtaaacttggcatggggacgcaggtacggcctagtaggcagaaatggacttggcaaaacaacactcttaaaaatgctggctactcgctcactgcgtgtacctgcccatattagtctgcttcacgtggaacaggaagtcgccggagatgacacacccgcacttcaatctgtgttagaatccgactcagtccgcgaagatctcttgagaagggagcgggaattgaccgcccagatcgctgcaggacgtgcagagggctctgaggccgctgagttggcagagatttacgcaaagctagaggaaattgaggctgacaaggcaccagcacgggcttccgtgattctcgctgggctgggtttcactccgaaaatgcagcagcagccaacaagagagttctccggagggtggcgcatgcggttagccctggcgagagccttgttcgccaggcccgatttgcttctgttagatgagccgactaacatgctcgacgtgagggccatcttatggctggagaattacctgcagacctggccaagtaccatactcgtggtgagccacgatcgcaacttccttaatgctatcgcaaccgacattatccatttgcacagtcagcgtctcgacggatataggggggacttcgagacgttcatcaagagcaagcaggagagactcctcaaccagcagagagagtacgaggctcaacagcagtaccgccagcatattcaggtgtttatcgatcgcttcaggtataatgcgaacagagcctctcaagtgcaaagtaagctgaagatgctcgagaaactgccggagctgaaacccgtcgataaggagtccgaggtagttatgaagtttccagatggtttcgaaaagtttagtcctcctattctccaattggacgaggttgatttttactatgaccccaagcacgtgatcttctctcgactcagtgtgtccgccgacctcgaaagccgcatctgcgtagtgggcgagaatggagctggcaaaagtaccatgctgaaactgctgctcggggacctggctccggtgcgcggtatcaggcatgcacacaggaacctcaaaatcggttatttctcccagcaccatgtggaacagctcgacttgaatgtcagcgcagtcgagctgcttgctcggaagtttcccggtcgccctgaggaagaatataggcaccagttgggaaggtacggcatatctggagagctcgcaatgcgtccactagccagtctgtccgggggacagaaatctcgcgtagcatttgcacagatgaccatgccctgccccaatttctacattttggacgagccaacaaaccatctggacatggagacaatagaggctctcgggagagctcttaacaattttagaggaggcgttatacttgtgagccatgacgagcgatttattcggttagtgtgtcgggagctgtgggtttgcgaaggtgggggtgtgactcgagtagaggggggattcgaccagtatcgagctctgctgcaggagcagttcagaagagaggggtttctgtag

SEQ ID NO: 53260 - DNA, 3573 bp, Artificial Sequence
  Description of Artificial Sequence: Synthetic coding sequence
atgaaaacaagacagaacaaggattcgatgtccatgaggagcggacggaagaaagaggcccctggcccacgcgaagagctgagatcaaggggcagggccagcccaggaggcgtcagcacctcgtcctctgatggcaaagccgaaaaaagtcggcagaccgcgaagaaggcaagggtggaggaggcatcgacccctaaggtgaataagcagggcagatccgaagagattagcgaaagcgaaagcgaggaaacaaacgccccaaaaaaaacaaaaacagaacaggagctgcccagaccacagtccccctctgacctggattcgttggatggacgaagccttaatgatgacggctcgtcagatccacgcgacatcgaccaagacaaccgaagtacaagcccatcaatttactcccccggttctgtagagaatgacagtgattcaagctcaggcttatcccaggggccagctaggccttatcacccccctccccttttccctccctcaccccagccaccagattctactcctagacaacctgaggcttctttcgagccccatccttcagttactccgaccgggtatcacgcgcctatggaacctcccacttcaaggatgttccaggctcccccaggggctcccccacctcacccccagctctacccagggggtaccggtggagtactcagtggacccccaatggggccaaaagggggtggtgctgcatcttccgtcggcggtccaaacgggggtaagcagcatcccccaccgaccacccccatatccgtctccagttcaggcgcaagcggcgcaccgcctacgaaacctccgaccactccggtcgggggtggaaatctgccgagcgcacctcctcccgctaactttcctcacgtcaccccgaatttgccccctcctcccgcactgaggcccttaaacaatgcctccgcctcacctcccggtttaggcgctcagcctttaccgggtcatctaccatctccacatgcgatggggcaaggaatgggcggtctcccccctgggccagaaaaaggtcccaccctggcaccaagcccacacagtctaccacccgcaagctccagcgcaccagcccctcctatgcggttcccatatagttccagttcttccagttccgccgcagcctcaagcagcagcagttccagcagttcctcggcaagcccatttcccgcttctcaggcacttccctcttacccccattccttccctccacctaccagcctgagtgttagtaaccagccccctaaatacactcaaccttcccttcccagtcaggcagtctggagccagggcccaccacccccaccaccctacggaagactcctggctaattcaaacgcccaccccggaccgtttcctcctagcactggcgcacagagcaccgcccatccacctgttagcacccaccaccaccatcaccaacagcagcagcagcagcagcagcagcaacagcagcagcagcaacagcagcagcagcatcacggcaacagcggacctccgcctccaggagctttcccccacccactggaggggggaagtagccaccacgcccacccatatgccatgagtccaagtcttggttctttgaggccttaccccccaggccctgcccatttgcccccaccacactcacaggtctcctactctcaggccggacctaatgggcctccagtcagcagcagtagcaacagttctagctccactagccagggatcctatccgtgttcacatccttcaccttcgcaaggccctcagggggctccttaccccttcccaccagtgcccaccgttacgacgtcctcagctacactcagcacggttatagccacagtggcttcttcccccgcaggttataagacggcctccccacctgggcctcccccatacggcaaaagggccccttcacccggtgcctataagaccgcaacccctccagggtataaacccggtagccccccatcgtttcggaccgggacaccacccggatacaggggtacgagtccaccagccggtcccggtacctttaagccaggttctccgactgttggacccggacctcttcctccggcaggcccttccggccttccaagcctgccacccccacctgccgctcctgcgagtggcccacctctgagcgctacacaaattaaacaggagcctgctgaggagtatgaaacccctgagtcaccagtccctccagctcggagccccagcccaccgcctaaagtggtcgacgtgccctcacacgcttcccagtctgcaagatttaataaacatttagatcggggttttaatagctgcgcacggagtgatttgtacttcgtgccgctcgaggggtccaagcttgcaaaaaagagagccgatctggtggaaaaagtgcgccgagaggctgagcagagagcacgtgaagaaaaagaaagggagcgcgagagagagagggagaaggagagagaacgggagaaggaacgagagctggagcggagtgtcaagctggcacaggagggaagggcacccgttgagtgcccgagtctcggccctgtcccacaccgtcctccatttgagccgggaagtgcagttgccacagtgccgccatacctgggacctgacacaccagccctgcgaacattgtctgaatatgccaggccacacgtaatgtcacctggaaataggaaccaccccttctacgtgcccctgggtgcagtggatccaggactcctggggtacaatgttccagcgttgtactcatccgatccagccgctcgggagcgtgaacgcgaagccagggagagagacttgagggaccgcttgaaacccggtttcgaagttaagccaagtgaacttgagccccttcacggggtccccggacctgggcttgatccattcccccgtcacggaggcttagccctccagcccggaccccctggcctccaccccttccccttccacccatctctcggacccctcgagcgggagcgtctggccctggcagcgggtcctgctctcagaccagacatgtcgtacgcggagcgcctggcagcagagagacagcatgcggagcgggtggctgcacttggcaacgacccattagcccgactgcagatgttgaacgttactccccatcaccatcagcattcccacattcactctcatctgcacttacatcagcaggatgcaatacatgcggcaagtgcttccgtacatcccctcatagaccccttagcctccggctcccatcttacacggataccatatcctgccggtactcttcccaacccactactacctcacccactgcacgagaacgaagttctgcgtcatcagctgtttgcggcaccctatcgggacttgcctgcctccttgtctgctccaatgtcagccgcacaccaacttcaggcaatgcacgctcagagcgccgaactccagagactagctttagaacagcagcagtggctgcacgcccaccaccccctgcattccgtccccttaccagctcaggaagattactattcccacttgaagaaggagagtgataaacctttgtag

SEQ ID NO: 53261 - DNA, 3573 bp, Artificial Sequence
  Description of Artificial Sequence: Synthetic coding sequence
atgaagacaagacagaacaaggactcaatgagtatgcgttctgggagaaagaaagaggcccctggacctagggaggagctcaggagcagggggagagcatcccccggaggggtcagcacaagctcatctgatggaaaagccgagaaatctcgtcagacagccaagaaggcgagggtggaggaagcaagcacacctaaggttaacaagcaaggcaggagcgaggaaataagcgagagcgaatcggaagaaacaaatgctccaaagaagaccaagacggagcaggagcttcctcgaccgcaaagcccatctgatctggactcactggacggaagatctctcaatgacgacgggtcctcagacccccgtgacattgatcaagacaataggagcacaagtccctctatatactccccgggatctgttgagaatgatagcgactcatcctctggtctgtctcagggacctgcacgcccttatcatcctcctcccctcttcccaccttctccgcagccccctgacagtactccgcgacagccagaagcttccttcgaaccgcatccaagcgtgacacccactgggtaccacgcacccatggagcctccaacctcccgcatgttccaggcccctcccggtgcgccaccaccccacccacagctgtatccaggaggcacaggtggagtgctgagtgggcctcccatgggaccaaagggcggaggcgctgccagcagcgttggagggcctaacggcggaaaacagcatcccccacctacgacacctatatcagtctccagctccggggctagcggggcacctccaaccaagcctccaacaacgccagtgggcggaggaaacctgccgagcgccccaccgcctgctaactttccgcacgtcacgccaaacctacccccacctcctgctctccggccactcaacaatgcatctgccagccccccaggactaggagctcaaccccttccgggacacctgccaagccctcacgccatgggtcaggggatgggcggactgccccctggcccagaaaaaggtcctaccctggcaccttcaccccatagcctcccgcctgcaagtagcagtgcccctgcccctccaatgaggttcccttatagctcctcgagtagtagctcagctgccgctagctcctccagtagctctagctcaagctcggcctccccattccctgcttcacaggctcttcctagctacccacactcatttccccctcccacctcattgagtgtgtccaatcagcctccgaaatacacccagccgtccctgcctagccaagcagtgtggtcgcagggtcccccacctcccccaccttacgggaggctcttagcaaatagtaatgcccaccccggtccattcccgccatctaccggtgcccagtcaacagcgcaccctccggtgtctactcaccaccatcaccatcagcagcaacagcaacaacagcaacagcagcagcagcagcagcagcagcagcagcagcaccatgggaactcaggtcccccacctccaggagcatttcctcaccccttggaaggagggagctcgcatcatgcccatccttacgctatgtcgcccagcctaggcagcctgaggccttaccccccaggacctgcccacctgccccctcctcatagtcaggtgtcatatagtcaggccggaccgaatggtcctcccgtttcctccagctctaactcctcttcttccacctcacagggctcatacccatgctcccaccctagcccatcgcagggacctcagggagccccttatccttttcctcctgtaccgaccgtaacaacatcatctgctacattgagcacagtaatcgcgacagtggcctcctcccctgcgggatacaagacggcctctccccctggacctcctccttacggaaaacgtgcccctagccctggggcatacaagactgcaacacccccagggtacaagccaggcagtccaccatcatttagaactggaaccccacctggctaccgcggaaccagtcctcccgctgggcctggcactttcaaacctggctcaccaactgttgggcctggacctttgcccccagccggaccctccggtctgccttcactgcctcctcctcctgcagcaccagcgtccgggccaccactgtcagccacccaaataaagcaggagccagctgaggaatacgagacccccgagtcccccgtcccacccgctcgtagcccatcacctcccccaaaagtcgtcgacgttccttcacatgcctcccagtccgcacgttttaacaagcatcttgatagaggcttcaattcatgcgccaggtcagacctgtatttcgttcctctcgaggggagtaagttagccaagaagagagccgatctggtggaaaaggtgcgcagagaagctgagcagcgcgctcgtgaggaaaaagaacgggaaagagaacgagagagggagaaggaacgcgaacgggagaaggagagagagctggaaaggtctgtgaagttggctcaggaaggcagggcaccggtcgagtgcccatccctggggccagttccacaccggccacctttcgaaccgggaagcgctgtggctactgttccaccctaccttggcccagatacgcctgctcttagaaccctctcggaatacgccagacctcacgtgatgtcccccggaaaccgcaaccaccccttctacgtccccctcggggcagttgatcctggcctgctgggctataatgtccccgcattgtactcctccgaccctgccgctcgcgagagggagagggaggccagggagagggacctgagagaccggctgaaacctggcttcgaggttaaaccgtcagagctcgaacctctacacggagtcccgggtccgggtctggatccgtttccgaggcatggcggactggcactgcaaccaggtccacctggacttcacccctttccgttccatcctagtctggggcctctggagcgtgagcgcctggctctggccgcagggccagccctgagacccgatatgagctatgctgaacggctggcggcagaacggcagcacgccgagcgagtcgctgctctgggtaatgacccactcgccaggttgcagatgctcaatgttactccccatcaccatcagcacagccacattcactcccacctgcacttgcaccagcaggacgccattcatgccgctagcgccagcgtacatccgcttattgatccattggcaagcggctcccatctgaccagaatcccataccctgccggtacactcccaaatccactgcttcctcatccacttcatgaaaacgaagtacttcggcatcagctttttgctgctccctacagggatctgcccgcaagtctctcagccccaatgtctgcagctcatcaactgcaagccatgcacgctcaatctgccgaattgcagagactcgctttggaacagcaacagtggcttcatgcccaccaccctcttcattctgtgcctcttcctgcccaggaagactactactctcatttaaagaaagaaagcgataagcccttgtag

SEQ ID NO: 53262 - DNA, 3780 bp, Artificial Sequence
  Description of Artificial Sequence: Synthetic coding sequence
atggatggcccaacccggggacatggcctgagaaagaagcgtagatcacggtcccagagggaccgcgagcggaggtcgagagggggtctgggagcgggtgccgcaggcggaggtggcgctggcaggaccagggctttgtcccttgcctcatctagcggatcagataaagaggacaatggcaaacccccttcctccgcccctagcagaccgagacctcctaggagaaagcgtagagagagtacgagtgctgaagaggacataatcgatgggttcgccatgacatctttcgtcacttttgaagccttggagaaagacgtggctctcaagcctcaggagcgggtggagaaacggcaaactcctctaactaagaagaaaagagaggccctcacgaacggattgtctttccatagcaagaaatcacgtctaagccacccacaccactatagctccgacagagaaaacgatcggaacctatgtcagcatctgggaaaaagaaagaaaatgcccaaggctttacggcagctaaaacctggccagaacagctgcagggactctgactcagaaagcgcttccggcgagtcaaagggattccacaggtcttcgagtcgcgagcgcctcagtgattcgagcgcccctagttctctgggaaccggctacttttgtgacagtgactctgaccaggaagagaaggccagtgatgctagctccgagaaactctttaataccgttatcgttaataaggatcctgaactgggcgtgggcacactgcccgagcatgactctcaagatgcaggccctatcgtgcctaagatctcaggcctggagcgcagtcaggagaagtcccaggactgttgcaaggagccgatctttgagcccgtcgtgctcaaggatccttgcccacaggtggcccagcccattcctcagccgcagactgagccgcaacttagggcgcctagtccggaccccgacctggttcagcgcactgaagcacccccacaaccaccacccctgtctactcagcccccacaggggccaccagaggcacagttgcagccagcacctcagcctcaggtgcagcgtcctccacgcccacaatcccctactcagctgcttcaccagaacctgccccctgtccaggctcatccctcggctcaatctttatcgcagccactgtctgcttacaattccagcagcctttcactgaactctctgtcgagcagccgatcgagcacacctgctaagacccaaccagcccctccccatattagccatcacccgtctgcatcaccattcccactctccttgccaaaccacagccccctgcattcattcactcctaccctgcagccacctgcccattctcaccaccctaacatgtttgcgcctccaaccgctctgcccccacccccaccactcacctctggtagcttgcaggtagcgggtcatcccgcaggatctacatactcagagcaggatatcctccgtcaagagcttaacactcgatttctggcttcgcagtccgcagacagaggggctagcctgggccctccaccgtacctaagaaccgagttccatcagcatcagcatcagcaccagcacacccatcagcacacacatcagcacaccttcacgccttttcctcatgcgatccccccaactgcaatcatgccaaccccagcccctcccatgtttgacaagtaccccacaaaagtggatccgttctaccggcatagcctgttccatagctacccacccgctgtgtcaggcatccctccaatgattcccccaactgggccattcgggtccctgcaaggcgctttccagccaaagaccagtaaccctattgatgtcgccgcacgtccagggacagtcccacatactcttctgcagaaggacccaaggcttactgacccctttcgacccatgctgcgtaaaccagggaaatggtgtgccatgcacgttcacattgcatggcagatttatcatcatcagcagaaggtgaagaagcagatgcaatctgatcctcataagctggacttcggcctaaaacccgaatttctatcacgaccccctggaccatctttgttcggtgccatccatcatccccacgacctggctcggccaagtactctcttcagtgccgctggtgctgctcatccgaccggaactccattcggtcccccaccccatcatagcaactttctcaaccccgcagctcatttggaaccctttaaccggccatcaacattcaccggcctggccgcagttggtggcaatgcatttggaggactcggcaatccctccgtgactccaaactctatgtttggccataaagacggcccttccgtccagaattttagcaacccacacgagccgtggaacaggttgcaccggacacccccttcatttccaactcctccgccatggcttaagcctggcgagctcgagcggagcgcatcagcggctgcccacgatcgtgatagagatgtagacaagagagacagctccgtgagcaaagatgataaagagcgcgagtctgttgaaaagcgccattccagccacccatccccagccccagtactaccggtgaatgctcttgggcacaccaggtcaagcaccgagcagattcgggctcacctcaacactgaggcgagagaaaaggacaagccaaaagagcgggaaagggatcacagcgagtcccgaaaggaccttgctgctgacgagcacaaggccaaagaaggtcacctccccgaaaaggacggacacgggcatgaaggccgagccgcaggtgaagaggccaagcagctagcgcgagtcccttctccctatgtccggacccctgtggtggagtccgccaggcccaattccacctcaagtcgggaagcggagcccagaaagggtgagcctgcatatgagaatccaaagaaatccagtgaggtgaaagttaaagaagagcggaaggaagaccacgatctgccgccagaagcaccccaaacacatagagcctctgaaccgccacctcccaacagttcctcaagcgtccatcccggaccgttagcctcgatgccaatgaccgtgggcgttaccggtatacatccaatgaacagtatttccagcttggaccgcacgagaatgatgaccccgtttatgggcattagtccactccccggaggggagagatttccctatccttcattccactgggatcccataagagacccgcttcgggacccctatcgggagcttgatattcatcggcgtgatccgttgggtcgtgattttcttcttcggaacgatccactgcaccggttatctactcctagactgtacgaagccgatcggtcctttagggaccgggagccccatgactatagtcaccatcatcaccaccatcatcacccattgagtgtggatccgaggagagagcacgaacgcggaggtcacctcgacgaacgggagcggctgcacatgctgcgcgaggactacgagcacacccgtcttcattcggtacaccccgcttcactggatgggcacttacctcacccatccctcatcacaccaggtctgccctcaatgcattacccaagaatcagccctactgccggaaatcagaacgggctgctcaacaagactccgccaacagccgctcttagcgctcctccaccgcttatctccactctcggtggccgacctgtatctcccaggcgcaccaccccactgtcggccgagattagggagaggcccccttcacatactttaaaggatatcgaagccagatag

SEQ ID NO: 53263 - DNA, 801 bp, Artificial Sequence
  Description of Artificial Sequence: Synthetic coding sequence
atggacgggcctactcgagggcatggccttcgcaagaagcgcaggtctcgcagccagcgagatcgagagagaaggtcccgtggaggattaggagccggagcagccggagggggaggagcaggtcgtaccagagctctcagcctggcttcatcctcaggatctgataaggaagacaatgggaaaccgcctagctccgctccgtcccgccctcgcccaccccgtaggaaaaggagggaatccacttccgccgaggaggacatcatcgacgggtttgcaatgaccagctttgttacctttgaggccttggaaaaggacgttgcgctgaagcctcaagaacgcgtagaaaaaagacagactccccttacaaaaaagaaacgtgaagcattgactaacggtttaagtttccacagcaaaaaaagcaggctgtcgcacccacaccattattcatccgaccgggagaatgatcggaacctgtgtcaacatctgggtaagcgtaagaaaatgccaaaggccttaaggcagctcaaacccggtcagaatagttgtcgcgactctgattctgagagcgccagtggtgaatcgaagggatttcaccgatctagcagccgagaaagattatcggattccagcgcgccatccagcctgggcaccggatattttcggtctggcaagatgtgtctcggcgaggaggcctgtctcaagtcgggaaatgacatgaagcgagatgtctcgaacactagcagctgggcgagcaacagggagagttttttctccctggtgaagctgctgaagggcttttag

SEQ ID NO: 53264 - DNA, 3708 bp, Artificial Sequence
  Description of Artificial Sequence: Synthetic coding sequence
atggacggaccgacccggggtcacggactgcgcaaaaaaaggcgcagccgtagccagcgcgatcgtgaacgaagaagccgaggagggctcggggcaggggctgcaggcggagggggtgctggacgaacacgcgctctgagcctggcctcttctagcggcagtgataaagaggacaatggtaagccacccagtagcgcacccagtcgaccacgtccgcctcgacgcaagagaagagaaagtactagtgccgaggaagatatcatcgacggattcgcaatgacttccttcgtcaccttcgaggctctcgagaaagacgtggcgttgaagccccaggaaagggtcgagaagcggcaaacccccctcacaaagaagaagagggaggcattgaccaatgggcttagcttccattctaaaaaatcccgattgagtcacccgcatcactatagttctgatagggagaacgaccggaatttgtgccaacacctggggaaacggaaaaaaatgcctaaagcactgaggcagcttaaacctggacaaaatagctgtagagacagcgactccgaatcggccagcggtgagtctaaagggttccatagatcatctagtagggagcgtttgagtgactcttccgctccttccagcctgggcactgggtatttctgtgactccgactcggaccaagaggagaaggctagtgacgcaagtagtgaaaagcttttcaataccgtcatcgtcaacaaagaccccgaactgggagtcggcacccttcccgagcacgattctcaagacgcaggtcctatcgtgcccaagatcagcggtctggagaggtcgcaggaaaaaagtcaggattgttgcaaagagcctatcttcgaaccagtcgtccttaaggacccatgtccacaggttgctcagccaatccctcagccacagaccgagccacagcttcgcgcaccttccccagatcccgacctggtccagcggacagaggcccctcctcagccaccccctctgtcaacacagcccccacagggcccaccagaggctcagctccagcctgcccctcagccccaggtgcagcggcctcctaggccccagtcacccactcagctgttacaccagaacctccctccggtccaggcccacccgtcagctcagtcacttagtcagccgctgtccgcctacaacagcagtagcctcagtctgaacagtctgagctctagccgctctagcaccccagctaaaacccaacccgcaccaccacatatcagccaccatcccagcgcaagcccttttccgctgagtctcccaaatcattcccccctccattctttcactcccaccttgcagccacccgcacactcccatcatcccaacatgttcgcaccaccgactgctctgccacctccaccccctctgacctcgggaagcctacaagtggcaggtcatccagccggttcgacctactcggagcaagacatactccgacaggaattgaacacccgatttctggcttcgcagtctgccgaccggggagcatccctaggcccacccccttacctgagaacagagtttcaccagcaccagcaccagcaccagcacactcaccaacatacacaccagcatacgttcacgccctttccccacgcaatacctcccacggccatcatgcccactccagcacccccaatgtttgataaataccccacaaaggtcgacccattctataggcactcgttatttcactcctatcctccagcagtgtcaggcatccctcccatgatccctccgacaggaccttttggcagtctgcaaggggctttccagccgaagttgactgatccctttcgtcctatgctgcgcaaacccggaaaatggtgtgccatgcatgtgcatatcgcatggcagatttatcaccaccagcagaaagtgaagaaacagatgcagagcgacccacacaaacttgatttcgggcttaagccggagttcttgagccgcccacctggtccttctcttttcggggcaatccaccatcctcatgaccttgcacgcccatcgactctgttttctgccgcaggtgcagcccacccaacaggcactccctttggtcctcctccccatcattccaatttcttaaatcctgctgcccatcttgagccctttaatcggccttccactttcactgggctcgcagccgttgggggaaatgcctttgggggtttggggaacccgtctgtgacacctaattcgatgtttggacataaagatgggccatcggtccaaaatttctcaaatcctcatgagccctggaatagattgcatagaaccccaccaagctttcccacacccccaccgtggctcaagccgggagagctcgagagaagtgccagcgctgcagctcacgatcgagaccgtgatgtggataaaagggattcgtcggtgagcaaagatgataaggaacgtgagtcagtggagaaacgtcactcctcccatccgagccccgctcccgtccttcccgtcaacgccctgggccataccagatcttcaacggagcagattagagcgcatttgaacaccgaagccagagagaaggacaagcctaaggaaagggaacgagatcacagcgaatccagaaaagacctggccgcagacgagcataaggctaaggagggacatttgcctgaaaaggatggccacggccacgagggcagagccgctggagaggaggcaaagcagctggcgagggtacccagcccttacgtgcggacacccgtagtggagtcagcaagacccaattccacctcatcaagggaagccgagcctcggaagggggagcctgcttatgagaatcctaagaaaagctccgaggtgaaggtgaaagaagagcgaaaggaagatcacgacctgcctcccgaggcgcctcagactcatagggctagcgaacccccacccccaaatagcagctcttccgtacaccccggacccttggcgagtatgccaatgactgtaggtgtcaccggtattcaccctatgaacagcattagctctctcgaccgcacacgaatgatgacaccatttatgggtatctccccactgccgggaggcgagcgttttccttatccatctttccactgggatcccattagagaccctctaagagacccgtacagagagcttgatattcacaggcgagacccgttgggtcgtgatttcttgttaagaaatgatcctctgcatagactctccacaccaagactctacgaagccgacagatcattcagagaccgggagccccacgactattctcaccatcatcatcatcatcaccatccattgtccgtggaccctcgaagagaacacgaaaggggtggtcacctggatgagagggagcgattacacatgttaagggaagactatgagcacacaaggctccattcagttcatccagccagtctcgacggccatctgccccaccctagcttgataactcccggattgcccagcatgcactacccgcgaattagccccacggcaggaaatcagaacggtcttctgaataagaccccacctaccgccgctctctcggctccccctcctcttatttctacgctgggcggaaggccggtctcgccaagacgcaccacgcctctgtccgcagagatcagggaacggcctcctagtcacaccctgaaagacatagaagccagatag

SEQ ID NO: 53265 - DNA, 423 bp, Artificial Sequence
  Description of Artificial Sequence: Synthetic coding sequence
atggttactgccatggctctgagcaaatccaccaactctcataagaacgctaccgaggatctgtatgaggtggataagctgaaaaaagaatgctatgaatggataaatacctgcagctgcttgctgagtaatattaagggacgtaagatcactcttttaacctacgaggaaatcgaacgcttgctggaggaggaggcagtgaaagaattcattgaacccgaaatcgatgagagctttaaagaggacgaggaagagagtaaggaagataggaagctgcaggaggaaaataaggaaagagccgaggaacaaccaagcacttcaaccgagaaagaaaagttgatcagattcattggagaagacgagaacgttcacagcaagcctctctttgagacggacgtgctctcatcatggaagaatatatag

SEQ ID NO: 53266 - DNA, 2691 bp, Artificial Sequence
  Description of Artificial Sequence: Synthetic coding sequence
atggtggaccggagcaaacttctgcccactagcctccagaacgagttcattcccaaagaagtcttactctccctgacctacgcggcaaatgcaggcccttgtcctgaaaacctgcttcctccgaaaaagataaagaccccaaaaggcacacttccgcgtctagtggatcacgtttggcatcatccggtccggcgtaataagttcaagtacctgatagaccatcccgtctcgttaactggcgctggaagggacatttccttcctgtacgacgtgacttacgcgaagggacaaacacgcgagaaagccgtttgccccccacacctggcgaggtctctccagtcacacgacggagtgatcgtgcctcataagcctaagacgcttactgatactcttatcccagaggagttccatattgtgtcgtccacgggtgtgtcaggactagaatgctatgacgacaaatacaccacactcctgacggactccgaaaatcgcctgttgctgttccctagcatgaagcccaataagcgggttgaagtcgcccagctgaatgacgtgatggacacaatgcttgagcgcgcaggggttgagaaccaagagtatacgggcccaactaaaatgcataagctgctacatattctcaagaaagaacagactatctataatatgatctttcatgaactcatccggcaggtgtcagtagactgtgcagatcggggagagcttctcagcaaagtgcgcgagcggtacgtgcagatgctggaccagatcgctcgtcaaatgatagacttttataaggatctcgtgactcagcgggttatggaccagagaattctggaggagctgtacaactttaaacatgtgatagaggagctgactcgcgaactgtgtctggtgcgggctcatgacgtgaaactcactaaggagacggagaaagcccacaaggatttggcccaggcccttctgaatgctgaaaaaaatgccaagatcgtggaggagtatcacgatctgtatacactccagagggaaagaatggaaaatgacatgaaaaagcttgtggcggaacgggacatctggtcgtcagctacatatgaactcgcccttaaggtgatcgaacgaaacagagtcattctcgcacggaggctctacctgaacgaaaagggatggaacaaatacacgaaacattttatcatcctgttgagcaataaagatacggaagacttggccctcctccagaagctcacacaaaaatggcgaaacctagtcaacaaattaaagcaggaggtcgagcagatggaagagagtacaagtgagacgctcaagatcgtcaaggatgggttgatcaagtggcaggagtttttcaatgagaaagacattttgtccccaaataaagggaatatcttcaatagtgtgctactggatttcaagcaatggcaaaagattctcaatgaaaaaaaggaggaattcaccggcgacgtgttactgagcaagtatgataccctcaaaatcatcaagcaccttcaggaaaactgggccgacatcggcctcggcatcttcaaccggcataagagtctggaaggtgagatgcctagcgagaggcagtacatggaggagatcattaagaacattcagaaactgtacaaagaatacgagattcggattaatggcgacaatggatattccaagatcttgccctctctgatcagctctcttgatttttgttcttttaagcttgagaacctggagtttccagatacgcctttggaagagtggcaggaaattgatgagaagataaacgaaatgaagtctcatctcgatatcctgttaaatctgacaggaattgtgccacagcatatagacgtggatagtgtctctgtactacaggcctacatttttaacatgatccagcagtggctgttgaaaattggaaatgagataaataacggtaacatcgagctgcagcatcacatggatgagctgcacatttctatgattcagtggatggttaacttattaattctgatgatccctaactttactgaccaggattgtctgctgaaacttgaggaagagtcggccgagaagcatgatatcggggtggctagactggagctggatgccatcgaactgacacggaagttatatcaatattccagctatctgagcagctgttgcaagggcatggtcactgccatggccctgtccaaaagcaccaatagccataaaaacgccacggaggacctctatgaagtcgacaaattaaagcagccaagcaccagcaccgaaaaagagaaactgataagatttataggagaagatgaaaatgtccacagcaagcctctctttgagacagatgtgttgtctagttggcgcgagagcgctaaacagggaactcttgcccaaaaatacctggaggcgatggccgttattgagcacatgcaggagaagttattagaagtggagaatcgcgcaaggcaagccgaggagaagttcgaagatgcttacgaaaaactgcaccataccctgatcaagaacaaagacctagaggagcttgtgatgacttcccgcaaggaaagtaaggaggagaaggaaaatcaggatgaacgcgaagtgaaagaggaagaagagcagcaggaagaggaggaagttcggtctgctgagaactcgagcaagtcccctaaaaaggggcattag

SEQ ID NO: 53267 - DNA, 3039 bp, Artificial Sequence
  Description of Artificial Sequence: Synthetic coding sequence
atgtctctccctaagacccccagcactcccctaaacagcacttccacgtccgagagcaaaaaattgaaagtatctgtggcaaaagagggaacgcggggacttccggaactgaaagaaaagaagaacatggtggacagaagtaaactgctgccgaccagcctgcagaacgagttcataccaaaagaagtgctgctgtccttgacatacgcggctaacgcgggaccttgtccggaaaacttgctccccccaaaaaaaatcaagacccctaaagggactctccccaggctcgtggatcatgtctggcatcatcccgttaggcggaacaagttcaaatatctcatcgaccaccctgtttctcttactggcgcaggaagagatatttcctttttgtacgacgtcacgtacgcgaaagggcagactcgcgaaaaagctgtctgtcccccacacctcgccagatccttacaaagccatgacggcgtcatcgtgccccacaaaccgaaaacactcacagatacgttgattcctgaggagttccacatagtatccagcaccggagtgtctggtctggagtgctatgacgacaagtatacaacgctgctgaccgactcagagaaccgcctgctcctcttccctagcatgaagccaaataaaagagtcgaagtggcgcagctgaatgacgtgatggacactatgctggaaagggccggagtggaaaaccaggaatatactggcccaaccaaaatgcataaactactccacattctcaagaaggaacagactatatacaatatgatctttcacgagctgatcaggcaggtgtcggtcgattgcgcagatagaggagagcttttgtcaaaagtgagagaacgttacgttcagatgttggaccagattgcacggcagatgatcgacttttacaaggacctggtgacccaacgggtcatggaccaaaggattctggaggagctgtacaattttaagcacgtcatcgaggaactcacaagggagctctgcctggtcagggctcacgatgttaagctcaccaaagagactgaaaaggcccataaggacctagcgcaagcccttcttaatgctgaaaaaaatgcaaagatcgtggaggagtatcatgatttgtacacactgcagcgggagagaatggagaacgacatgaagaagctcgttgccgagcgggacatatggtcgtccgccacatatgagctcgctctcaaggtgatcgaacggaaccgagtgatcttggccagacgtctctacttgaatgaaaaaggatggaataagtacaccaagcattttatcatccttttgtccaacaaggatactgaggatctggctctgcttcaaaaactgacacagaagtggaggaatctggtgaacaaactcaagcaggaagtggaacaaatggaggaatccaccagtgagaccctgaagatagtcaaggacggactcatcaagtggcaggaattttttaacgaaaaggacatcctgtctccaaacaaggggaacatctttaacagcgtcttgctcgattttaaacagtggcagaaaatattaaacgagaagaaggaggaatttaccggagacgtcctgcttagcaaatatgatactctcaagatcatcaaacacctgcaggagaattgggccgatattggtttaggcattttcaacagacacaagagtcttgaaggggagatgccctcagagcgtcaatatatggaggaaatcattaaaaacatccagaagctgtataaggagtacgaaatccgcatcaacggggataatggctacagcaagatactgccctcactgattagcagtctggatttttgcagcttcaaattagaaaacctcgagttccccgacacacctctggaagagtggcaggagattgatgagaagataaacgagatgaagtcacatcttgatatcttgttaaacctcacgggcatcgttccgcagcacatcgatgtcgattcagtgtccgttctacaggcttacattttcaatatgatccagcagtggttgctgaaaataggtaatgagattaataacgggaacatcgagcttcagcaccacatggacgagctacacatctcaatgattcagtggatggttaacctgctgatactgatgatccccaatttcacagatcaggattgcctcttgaagctagaggaggagtccgccgaaaaacatgatattggggtggcaagattggagcttgacgctattgaactgaccagaaagttgtatcaatattcaagttacctgagctcctgctgcaaaggcatggttaccgccatggcccttagcaagtcaacgaacagccataagaacgctacagaagacttgtacgaggttgataagcttaaaaaagaatgctacgagtggatcaacacgtgctcctgccttctgtctaacatcaagggcaggaaaatcacacttctgacctacgaggagatcgagcggctgcttgaagaagaggccgttaaggagtttatagagcccgaaattgacgagtcctttaaggaggatgaagaagaatctaaggaagacaggaaattgcaagaggaaaataaagaacgagctgaagaacagccctccaccagtaccgagaaggagaaactgatcagattcataggagaagacgagaatgtccacagcaaacctctgttcgaaacagacgtgctaagctcatggagagaatccgcaaagcagggtacgttggcccagaagtatttggaggccatggccgtcattgaacacatgcaagagaagctgctagaggtggaaaaccgtgcccgacaggcggaggagaagtttgaggatgcctatgaaaagctgcaccacacccttatcaagaataaggatcttgaagagctggtgatgacatcacgcaaagagtcaaaggaggagaaggagaaccaggatgagcgggaagtgaaagaagaggaagaacaacaagaggaggaggaagtccgctctgccgagaattcctcaaagtccccaaagaaaggccattag

SEQ ID NO: 53268 - DNA, 1968 bp, Artificial Sequence
  Description of Artificial Sequence: Synthetic coding sequence
atgagcctccctaaaacccccagtacccctctgaacagcaccagcacttctgagtccaagaagttgaaggtgagcgtcgccaaagagggaaccagaggtctgcctgagctgaaggagaaaaagaatatggtcgacagaagcaagctgctcccgaccagtctacagaatgaatttattccaaaagaagtgctgttgagcctcacttacgcagcaaacgcaggaccttgccctgaaaatctgctacccccaaaaaagataaagactccaaaggggacgctcccacgtctagtggatcacgtgtggcaccatcctgtccgaagaaataagttcaagtacctgatcgatcaccccgtgtccttgaccggagctggcagggatatatcatttctctacgacgtcacttacgcaaagggccagacacgggaaaaggccgtgtgtccccctcacctggcccgaagtttacaatctcacgacggcgtgattgtcccacacaaacctaagaccctgaccgacaccctgattccagaagaattccacatcgtgtcctcaaccggcgttagcggcctagagtgctacgatgataaatacaccactctacttacagactcggaaaacaggcttctgctgttcccctcgatgaagccgaacaagcgggtggaagtggcacagctcaacgacgtgatggatacaatgctggagagagccggagtggaaaatcaagagtatactgggccaaccaaaatgcacaaactgcttcatattttaaagaaggagcagaccatttacaacatgatatttcatgaactcataaggcaggtttctgtcgactgcgctgacagaggggagctgctctccaaggtgcgtgaaagatatgtgcaaatgttggaccagattgctcggcaaatgatcgacttctataaagatctcgtgacccaacgtgtgatggaccagcgaatcctggaagaactgtacaacttcaaacatgtgattgaggaactcacacgggagctttgcctggtgcgtgctcacgatgtcaagctgacaaaggaaacagagaaggcacacaaggatcttgctcaggccttactgaatgccgaaaagaatgccaaaattgtcgaggaatatcatgatctttatacactgcagcgggagaggatggagaatgatatgaagaagcttgtcgcggaacgggacatctggtcctcagccacctacgaactggctctcaaggtcatcgagagaaaccgcgtgatcctggccaggagattatatctgaacgaaaaggggtggaataagtatacaaagcacttcataatacttctgagtaacaaggatacagaggacctagccctgttgcagaaacttacccagaaatggcgtaatctcgttaacaaactgaagcaagaggtggaacagatggaagaatccacatccgagacactgaagattgttaaagatgggctcattaagtggcaggagttcttcaatgaaaaggacatcctttctcccaataagggtaatatcttcaatagtgtcttattagatttcaagcagtggcagaagatattaaatgagaagaaagaagaatttacaggagatgtgctattgagtaagtacgatactctgaagatcataaagcacttgcaggaaaactgggcggacattgggcttggaatttttaaccggcacaagagcctcgaaggcgagatgccttcagagcggcaatacatggaagaaataattaaaaatatccagaaactttacaaagagtatgagatccgtattaacggtgataatgaaacagggtcccatagagttgctcaggcgggactgaaactactcggaagctcagatcaccctacttcagctcctcagagcgcagggatcagaggtattattcaccggacctggccatgggtgaacttttacatcgtctgcgaagtgacgccgaagttctttcaggtatag

SEQ ID NO: 53269 - DNA, 237 bp, Artificial Sequence
  Description of Artificial Sequence: Synthetic coding sequence
atgtctctgccaaaaacgccctccacccccctcaacagtacaagtactagcgagtcaaagaaactgaaggtctccgtggccaaggaggggacaaggggcttacctgagctaaaagaaaagaagaatatggtagacagatcaaagctgctcccgactagcctacaaaatgagtttatcccaaaggaagtacttctgtccttaacatacgctgcaaacgcgggtccttgtccagagtag

SEQ ID NO: 53270 - DNA, 378 bp, Artificial Sequence
  Description of Artificial Sequence: Synthetic coding sequence
atgtctctgcccaagactccgtccacgcctcttaattctaccagcacatctgaaagcaaaaagctgaaggtaagcgtggccaaagaggggactcggggtctacccgagcttaaggaaaaaaagaacatggttgatcggtccaagcttctgccaacctccttacagaacgagtttattccaaaagaagttctgctctcattaacctatgcagctaacgccggaccttgccccgagaacctgctgccccctaagaaaatcaaaactccaaaaggaaccttgccccgactcgtggaccacgtatggcaccacccggtgcggaggaacaaattcaaatatctaatcgaccaccctgttagcctcactggagccggtaggtag

SEQ ID NO: 53271 - DNA, 120 bp, Artificial Sequence
  Description of Artificial Sequence: Synthetic coding sequence
atggcggctggagcagtgtttcttgctctgagcgcacagttgttgcaggcaaggctgatgaaagaagagtcccccgtcgtgtcctggcgcttggagccggaggatggaacagcactgtag

SEQ ID NO: 53272 - DNA, 147 bp, Artificial Sequence
  Description of Artificial Sequence: Synthetic coding sequence
atggccgctggagcggtttttctggcgctctccgcccagctccttcaggctaggttgatgaaagaggtttcccctgtggtaagttggcgtcttgaacccgaggatgggacagcgttgagcggagtgagcctctgcaggcccggttag

SEQ ID NO: 53273 - DNA, 582 bp, Artificial Sequence
  Description of Artificial Sequence: Synthetic coding sequence
atgcccctcccgtgggattacccggaggccccttggagaaggctgcactcctcccccccacgcccttgtcccagagccctccagggcggaggaagacggggacctaaccctgatccgaggggctcgaaagggcttaagcagacagtgggtgctttgaatcccaacctgcacttgtggggcatatgctcttgccaattcctccttcgatctaaggggcgagatttcgtgcacagcgtgcaagaaacccattcccaattactgggatcatgggacccgtgggaagaaccagaagacgcagccccagtggccccatccgtccccgctagcggatacccagagttacccactcctagaagagaggtacagagcgaaagcgcccaggaacctggggcaagggatgtggaggctcagctcaggaggctccaggaagaacgaacttgtaaagtttgtctcgatcgtgctgtgtctattgttttcgtcccatgtggccatctcgtctgcgccgaatgtgctcctggcctccaactgtgtcccatctgtcgggcaccagtgagatcccgggtcagaacctttcttagctag

SEQ ID NO: 53274 - DNA, 7826 bp, Artificial Sequence
  Description of Artificial Sequence: Synthetic coding sequence
atggatggaagggacttcgcccctccaccacacctcctttccgagcggggatccctgggacaccgcagcgccgctgctgctgccagactggcccctgcaggcccagccgctcagcctcccgctcatttccagcccggaaaatacttcccgagcccactgccgatggccagccataccgggagcgcccgaaaaatgggaagctgtccggctccctcctttcttccaagcttcctggagcgacctctgtatccggctcccaccaaaacagtgagtgggccttctctccggccacctaccgccgcaatcaggagccccacacctgattgtgcccagaagtggagccagaacgctcatgaggccccaggctatccacgctttagtggctcactagcttcgacgtttcttccagtgtcacacttggatcaccacgggaattcgaacgttttatatgggcagcaccgtttctatggcacccagaaagataacttctatctgaggaacctccccccacaaccaacgctgctgcccgcaaatcataatttcccttctgtggcacgtgcagcccctgcacacccaatggggtcatgctcacgggatcgcgatcgtggagaagctggatcactccagaaaggaccgaaagatttcgaccggtttcttgtcggaaaggagctgggtcgggaaaaagcgggtaaggccgcagaaggtaaggaaagacccgctgccgaagaagacggcggtaaagaacggcataagctagtgctccctgtgccagcagacggacattgtcgggaaggtggccctgcaccacggggagcttgcgagggccgacctaaacatctgacttcttgtctgctaaacaccaaagtgctgaatggcgagatgggcagagccgctcttgcgtcctgcgctggcggtatgctggggagaccaggcactggcgtagttaccagcggccgttgtgccaaagaagccgcaggtccgcctgaacccggacccgctttttcagaatgtctggagcgacgccagatgttgcatcacaccgccagctatgcagggcctcctcccccactgtcaactgctgcagggtctttcccatgtctgcagctgcatggcggacccgacggcctgtgcccactccaggataaagcccctagggatttaaaagccagtggaccaacatttgttccgtctgtcggacaccttgcggataagggacgccctttccaggcagccgaggcttgcgccgtggctggggagggcaaagacagacacttggaggggactatggcacctgaccatgccgcaccttatggggtgtcttacgcccatctgaaggcagaaggcaagggcgaacgccgacctggtgggtttgaggcagcattgaacccacggcttaaaggattagattatttgagctccgcagggccagaagcatctttcccgggactgcccaaatcagggctggataaatccgggtacttcgagcttccaacctcatcccaggactgcgccagacctggccaccaggaccccctgggcggaaaggccccacaggcctgttgcacgctcgacaaaaccgtcggcaaagaagcgcctgctgggccacccggagctcaaaaagttgctcggattaggcatcagcagcacttgatggcagcagaagtggagcagggcggaattggcgctgaggcaaaacggaagtctctggaactggcctccttgggctacagcgggccacatcttcctccttggggcgtgcaggcaggacaggggactgctatggcgatatccgaggaaaggaaggcaggagcttacctggatccgtttgggtctgggctccagcaagcagctctgttacctcaggagcttcctgctccaccagacgaggtgagtgccatgaaaaatctgctcaaatacagttctcaggccctggtggtggggcaaaaggctcctcttgtgggcctggggggacttaaagcatcctgcatccagcaggaggccaagtttctctcgagtaagggtcccggtcagtctgaacgacctgactgtgccaggtcccgcgagcatgataccacccacggtgacggggaagtgaggcagccacccgtggggattgcagtagccctagctcgtcagaaggacacggtcagccgtagcgaagcggcatacgggactaacactgctagacagggacgggctgctcctgcatttaagggagggggagggccaagatccacacatgctcttgatcttgaggcagaggaggaacgaacgagactctgcgatgacagactcggtctggcatcgcgggagctgctgttgcaggacagcaaggatagggtggaatttgccaggatacatccaccatcttcttgtcctggcgatctggcaccacatttaatgatgcagtctggccagttggggggagatccagccccacacactcacccacaccctccctggttgcctcgtacacgatcgcctagcctgtggatgggtggacattcgtatggtctcggacatcctgcactgcatcagaacctcccaccaggatttccggcttcagtggctggcccagtacctagtgtgtttcccctgccgcaggacgccccaacccagctagttattctcccatctgaacctacaccgcatagtgcccctcacgccctcgcagatgtgatggaccaggccagtctgtggccgccaatgtacggcggaaggggtcctgcttcccacatgcaacaccccggacagctgccagtctatagtagacctcagttactgcgccagcaggagttgtatgcactccagcagcagagagctgctcaatttcagaggaaacctgaagatcaacatttagatctagaggagccggctcaggagaaagccccaaaatccacgcacaagcccgtcgcgctcacacccactgcaccaggagctcctagccctgctgccggaccaaccaagctgcccccttgctgtcatccaccagaccccaaacccccagccagctctcctactccacccccacggccatccgccccttgtaccctcaatgtgtgtccagcatcctcacctggacccggatccagagttcgctcggcagaagaaaaaaacggggaaggacagcaaagcaccgcggacatcattaccagcgaacctgatttacctcccggttacctgcgacctatggccggactgggcttctctctgcccagcgacgttcactcgagcaatcttgaggatcccgaaactatgcaaactactgctcccggagcccagccagagccaacgagaacatttcttcctggggaaccaccaccttgctcgcccagatccttggaagaaccgggactgctgtctggcgcaagagaggcaactcaggacctagccgctaccccatacccaaccgagcgcggaccacaggggaaagccgctgatccaagtcccctggaggggctacaggagctccagtgtgccgctctgcttgaggccggtggacctgaagcaaccgggcaggcacattcaactcagggcggagctagagaagagcggtcccgggaagagggagaacaaggtccatcctccggtgccagctctcaggtattagagcagcgagccggatctcccggagccctcgaggacgagggagagcagcccgctccagaggaggacgagctggaggaggatgaactgggccagcagtccatggaagattctgaggaggattgcggcggagcgccagacaattcccatccaccgagagccctcccagggttagatgcactggtagctgccacaattaatctgggagacctgcccagcgactctcctcctgacccgcagcctccagctgccagtggcccaccttccaccgtgcctctgccacacagctctggaatacacggcatcgccctcctaagcgagcttgctgatttggcaatccagaggcagcggtctgaaaggaccgtacctgaagaagaagaggatgtgctggctttcaatctccaacacctggccactttggcaaccgcctggtccttggtggaagctgccggactggattcgagcaccgctccggcacagcctcctaccgccaacccctgcagcggaccacgcctcacccctcggatgcagattttgcaaaggaaagacacatggacccccaagactaagccagtgtgcccactgaaggcggctatcgaccgcctagacacgcaggaagttggcatgagggtacgtctggccgagttgcagcggcgatacaaggagaaacagagggaactggcccgactccagaggaagcacgatcacgaaagagacgaaagcagtaggagccctgccagaagagggcctggacgacctaggaagcggaagcactcaagtagcctcccagcaccacgcccaaccggcccactccccagatctgacgggaaaaaggtcaaggcagtcaggacctccctaggcctgctatgcgccgagctgaggggaggtagtggtggagaaccagccaagaaacgcagcaagcttgagcggtcagtttatgcaggactgcaaactgcctctgttgagaaggcgcagtgcaaaaagagcagctgccaaggtggcttggcaccatctgtcgctcatagggtggcccagctgaaaccaaaggtgaagagcaagggacttcctaccggcctaagcagttttcagcagaaggaagccacaccgggaggaaggatacgagaaaagctgagccgcgctaaatccgcgaaggtctccggcgctaccaggcatccccagccaaagggccacggctcaagggagactcccagatgcccggcacagccgtccgttgccgcatcccaggaggccggatccggttacgactccgaggactgtgaggggctattaggaacagaggcaccgccacgtgaggcagggcttctgttgcacactggggcaagtgtcgcagtgctgggccctagcccctcctccgtggtcaaaatggaagccaatcagaaggccaaaaaaaagaaagaacgacaggggttactgggcgcttgtcgcctctcttctcccgaatccgaagtgaagatcaagaggagatctgtgaaagccaaggtgggaactactctagagcgcgcaccaggccagcggccacccggtgcactgggcaaaaaaaaagccaaaggcaaggcaaaggggagcctgagggctgagccgggtgcgacgccgagccgggacgccctgttcaacccttcaagggcctttgcctgtagggaggagggttcacagctagctagcgagcggctgaagcgtgccacccgtaaggggactgtcttgcagccagtgcttaggcgaaaaaacggcgcactgagcatcactctcgccactcgaaacgcaaaagctattctcggtaaagggaggaaactatctaaagttaagcacaaagctggcaaacagggtaaagggcgagccgtgtctaggttgctcgagtctttcgccgttgaagaagattttgaatttgatgacaattctagctttagcgaagaggaagaggacgaggaagaggaggaggaggactccgggcctctgagcgccgaacagtctgctgccttggccagatcctgtgccattcataaggaggacctcagagacgggttacccgtcctcattccaaaggaggactcactactgtatgctggttcagtacggaccctccaacccccagatatttattctattgtcatcgagggagagagaggcaaccggcagagaatctattccttagaacagttactgcaagaggctgttctagatgtcaggccccagagttctaggtaccttccacctggcacgagggtgtgcgcttattggtctcaaaagagtcggtgcctgtatcctggcaatgtcgtgagaggcgcatctggggacgaagatgaagacctcgatagcgtggtggtagaattcgatgacggagacacggggcatattgcagtcagtaacgtgcgcctcctccccccagatttcaaaattcaatgcacagagccttcccctgcccttctggttagcagctcttgccgtcggactaagaaggtctcatcggaggccccacccccttctgaggcggctacaccttccctttcccccaaggcccaggatgggcctgaggccttaaaaacccctggcaagaaatccatctccaaagacaaggcaggtaaggctgagctgttgacgtcgggcgcaaaaagtccaaccggagcatctgaccatttcctgggaagaaggggatctcctcttctctcgtggtcagctgtcgcacagacaaagcgcaaggccgtggctgccgctagtaaagggccaggcgtgctccagaatctgtttcagctcaacggaagcagcaagaagttgcgagcaagagaggccctcttcccagtgcattcagtggccacacccatcttcgggaatggcttcagagcagactctttcagctctctcgcctcgagttacgcccctttcgtggggggtaccgggcctgggctaccaaggggggctcataaacttctcagagcgaagaaggctgagagggtcgaagccgagaaaggcggtagacggagagctggcggtgaattcctggtgaaactcgaccacgaaggagtgactagcccgaaaaataaaacctgcaaggctctgctgatgggggataaggacttcagcccaaaacttggaaggcctttgccctctccatcatacgtgcatccagcactggtcgggaaggataagaagggtcgggctcctatcccccctctgccaatgggactggcattgcgcaaatatgctgggcaggctgagttcccccttccgtacgacagcgattgccatagtagcttttccgatgaggacgaagatggcccaggattggcggctggagtcccaagtcgatttctggccaggttgagcgtcagctctagctcctctgggtcgagcactagctcgagctcaggtagcgtcagtacatcatccctttgctctagcgataacgaggactcctcctatagctcggacgatgaggatcccgcacttctgctgcagacctgcctgacccaccccgtgccaactctcctggctcagccagaagccctacgctcgaaaggctcgggaccgcacgctcacgcccagcgctgctttctgtcccgcgctaccgtggcagggactggagcgggatccggcccttccagttctagcaagagcaagctgaaacggaaggaagctctgtcttttagcaaggcgaaagagcttagtcgtagacagcgccctccttccgtggagaaccgtccaaagattagcgcctttctgcctgccagacagctgtggaagtggtctggcaaccccacacagcgtcgcggaatgaaaggcaaggctcgcaaacttttctataaagccatcgttaggggtgaggagactctgcgcgttggcgattgcgcggtattcctgtccgcaggacgccctaatctgccttatattggcaggatcgagagcatgtgggagagttggggctctaatatggtggttaaagtaaaatggttttaccatccggaggagactaaactggggaagaggcagtgtgatgggaaaaacgctctttaccagtcatgccatgaggatgaaaatgacgtccagaccattagccacaaatgccaagtggttgccagggaacagtacgagcagatggcgagaagtcgcaagtgtcaggataggcaggacctctactacctggcaggtacctacgaccctaccacaggacgtctggtgaccgccgacggggtgcctatactgtgtta

SEQ ID NO: 53275 - DNA, 1260 bp, Artificial Sequence
  Description of Artificial Sequence: Synthetic coding sequence
atgaataaacaccaaaagcctgtcctaaccggccagcggttcaagacacgaaaacgcgatgaaaaagaaaaatttgaaccaacagttttcagagataccctcgtgcagggccttaatgaagctggcgatgacctagaagctgtcgctaaatttcttgattcaacagggtcacgattggattatcggagatacgccgacaccctgttcgacattctggtggccggttccatgttggcgccagggggaactaggatcgatgacggcgacaagacaaagatgactaatcactgcgtgttctcagcaaacgaggaccacgaaaccatcagaaactacgcccaagtattcaacaagctgattcggcgatataagtatctcgagaaagctttcgaggacgaaatgaaaaaacttctcctgttcctcaaggccttcagcgaaaccgaacagacaaaactggcaatgctctccggcatccttctgggaaacgggaccctgcctgccaccatactcacctcattatttaccgattccctagtgaaagaaggcattgccgctagtttcgcagtaaagttattcaaggcgtggatggcggaaaaggacgctaactccgtgacgtctagcttacgcaaggccaatctcgataagcgcctgctggaactgttcccagtaaataggcagagtgttgaccacttcgcgaagtacttcactgacgccggattaaaggaattaagcgacttcctgcgggtccagcagagcttagggacacgcaaggaactccagaaggaactacaggagcgcctctctcaggaatgtccaatcaaagaagtggtgctttacgtgaaggaggagatgaagcgcaatgatctccccgaaacagccgtgataggtctcctttggacctgcatcatgaatgcggtggaatggaataagaaggaagagttggtggcggaacaggctctgaagcatctgaaacagtatgctcccctgctggctgtgttcagcagtcagggacagtcagagctcatcttgctacagaaggtgcaggagtattgttatgacaacatccacttcatgaaagcctttcagaaaatcgtcgtgcttttttacaaggccgatgttctgtccgaggaagccatactaaaatggtataaggaagcccacgtggctaaggggaagagcgtctttctggatcaaatgaaaaaattcgtggagtggctccaaaatgccgaggaggagtcagaaagtgagggcgaagaaaactag

SEQ ID NO: 53276 - DNA, 1227 bp, Artificial Sequence
  Description of Artificial Sequence: Synthetic coding sequence
atgaataagcatcagaaaccagtgctaacggggcagaggttcaagactcgaaagagggatgagaaagagaaatttgagccaactgtgttcagggacacattggttcagggcctaaacgaggccggagacgatctagaggccgtcgcaaagtttttggattctacagggagtcgcctggattatcgcaggtatgctgatacgctatttgatattctggtcgccggaagcatgctcgctccagggggtacgcgcatcgacgatggcgacaaaaccaagatgaccaaccactgtgttttctcagccaatgaggaccacgagactatccggaactacgcccaagtctttaacaagctcataagaaggtataaatatttggaaaaggccttcgaagatgagatgaagaaattgcttctcttcctgaaggcattcagcgagactgaacagactaagcttgccatgctttctggaattctgttgggtaacggaactctgccagctacgatacttacgagccttttcactgattctctcgtgaaagaaggcattgctgcaagcttcgccgtaaagctgttcaaggcttggatggccgagaaggacgctaatagcgtgacttcctcgcttcgcaaagcgaacttggacaagagattgctcgaactctttcctgttaatcgacagtcagtcgatcacttcgccaagtacttcactgacgcaggtctcaaagagttgtctgatttcctacgggtccagcaaagtcttggcactagaaaagaattgcagaaggaactgcaggagcgcctaagtcaagagtgtcctatcaaagaagtcgtcctgtacgtgaaggaagaaatgaagcggaatgatctaccagagactgctgtgatcgggctgctctggacgtgtatcatgaacgccgtggagtggaataagaaagaagagttagtcgcggagcaggctctgaaacatctcaagcagtatgccccactgctggctgtttttagctcccaggggcagtccgaactgatattgctgcagaaggtgcaagagtactgctacgataacatacacttcatgaaggcgtttcaaaaaattgttgtcctcttctataaggccgacgttttatcagaagaagctatcctaaagtggtataaggaggcacacgtggccaaaggaaaatctgtgtttctcgatcagatgaagaagtttgttgagtggctccagaatgcatag

SEQ ID NO: 53277 - DNA, 492 bp, Artificial Sequence
  Description of Artificial Sequence: Synthetic coding sequence
atgaataaacatcagaagccggttttaaccgggcagcggttcaaaaccagaaagcgcgacgaaaaagaaaaatttgaacccacagtcttcagagatacactggtgcaggggctgaacgaggcaggagatgacctggaggccgtagcaaaatttctcgactcaactggctctaggctggactataggcgctacgctgacactctgtttgatatactggtcgccggttcaatgcttgctcctgggggaactagaatagacgacggagataagaccaaaatgacaaaccactgtgtcttctccgcaaatgaggatcacgaaaccatacggaattacgcccaggtgttcaataaactgatcagacgctacaagtaccttgaaaaagcattcgaggacgagatgaaaaagctcctcctgttcctgaaggcattctcagaaactgagcagacaaagttggccatgctgtccggaatactgctcgggaacggcacatag

SEQ ID NO: 53278 - DNA, 1260 bp, Artificial Sequence
  Description of Artificial Sequence: Synthetic coding sequence
atgaacaaacatcaaaaacccgtgttgacgggccaacggtttaagactagaaagagagatgaaaaagagaaatttgaaccgacggttttcagggacactctcgtccagggcctgaacgaagccggagatgatctggaggctgtggctaagtttctggattccaccggatcccgactcgactataggaggtacgccgacacactcttcgatatcctggttgccggatcaatgcttgcccctggcggaacaaggatagacgatggcgacaagactaaaatgacaaaccactgtgtcttcagcgccaacgaggaccacgagacaatacgcaactatgcacaggtctttaataagctcataaggaggtacaagtatctagaaaaagcattcgaggatgaaatgaaaaagcttctgctcttcctcaaggctttcagtgaaacagaacaaactaagctcgcgatgctttcaggtattctactggggaacggtaccctgcctgcaacgatcctcacatctttatttaccgacagtctggtgaaggaaggcattgccgctagttttgctgttaagctgttcaaggcatggatggcagagaaagatgcaaacagcgtcacatcctctcttaggaaggcaaacctggataaaaggctgctcgagttgtttcctgtgaatcggcaatctgtagaccactttgccaagtattttaccgacgccggactgaaagagttgtctgatttcctcagggtgcaacagtcgcttggcactcgcaaggaactccagaaagaactgcaggagcggttgtcacaagagtgccccattaaagaagtggtgctttatgtgaaggaagaaatgaagagaaatgacttgccagaaacagcagtgatcggactactctggacatgcatcatgaacgccgtcgagtggaacaaaaaggaagagctggtcgccgagcaagctctcaagcacttgaagcagtacgccccactgctggccgtctttagctcgcagggacaaagcgaactcatcttgctgcagaaggtgcaggagtactgctatgataacatccacttcatgaaggctttccagaagatcgtcgttcttttctataaggctgacgtgctgtctgaagaggccatcctcaaatggtataaggaagctcatgttgccaaaggaaagtccgtatttctggaccagatgaaaaagttcgtagagtggctgcaaaatgctgaggaggagagcgaatctgaaggggaggagaactag

SEQ ID NO: 53279 - DNA, 627 bp, Artificial Sequence
  Description of Artificial Sequence: Synthetic coding sequence
atgaataaacatcagaagccggtgctcactggacagagattcaaaacaaggaagagagatgaaaaagaaaaatttgagccaactgtgttccgtgataccctcgtgcagggtttgaacgaggccggagatgatttagaggccgtggccaagtttctggattccaccgggagtaggcttgactatcgaaggtacgccgacacactctttgacatacttgtggctgggagcatgctggcaccagggggaacacgcatcgacgacggagataagactaaaatgacaaatcattgtgtcttttcagccaacgaggaccatgagactattaggaattacgcacaggtttttaacaagctgatccgcagatataagtacctggaaaaagcctttgaggacgaaatgaaaaagcttctgctctttctcaaagcgttctccgagactgaacagacgaagctggccatgttgagtggcattctgctgggcaacgggaccttgcctgccacaatactcacgtcactcttcacggatagcctggtgaaggaaggtatcgccgcttcattcgccgtcaaattgtttaaggcttggatggccgagaaggacgcaaactctgtgaccagttccctgagatag

SEQ ID NO: 53280 - DNA, 825 bp, Artificial Sequence
  Description of Artificial Sequence: Synthetic coding sequence
atgaacaagcatcagaaaccagtgttaaccggccagcggtttaaaacgaggaaacgtgacgagaaggaaaagtttgaaccaacagtgttccgggacacccttgtccaggggctgaatgaggcgggtgatgatctcgaagctgtggcaaagttcctggactctactggatccaggctcgattatcgccgttacgctgataccctcttcgatattttggtggcagggtcaatgttggccccaggtggaacaagaatcgacgacggcgacaagactaagatgacaaaccactgtgtcttcagcgccaatgaagatcacgaaactatcaggaactacgcccaagtgtttaataagctgatccggcgatacaagtacctggaaaaggccttcgaagacgagatgaagaagctccttctgtttctgaaggcattctccgagaccgagcagactaaactcgccatgctgagcggaattctgctggggaatggtacgctcccagcaactatcctgacctcgttatttaccgatagcctggtcaaggaaggcatagccgctagtttcgccgtcaaactcttcaaggcatggatggctgagaaggatgcgaattcagtcacctcttctttacgcaaagctaatctggataaaagactgctcgagctgttcccagtcaatcgccaatccgtggatcatttcgcgaagtattttacagacgctggactcaaggagctgtcggattttttaagagtgcagcaatctttgggtacccggaaagaactacagaaagagttacaggaacgtctatcccaagaatgtccgatcaaagaatag

SEQ ID NO: 53281 - DNA, 486 bp, Artificial Sequence
  Description of Artificial Sequence: Synthetic coding sequence
atgaacaagcaccaaaaacccgtattgaccggacagaggtttaagactcgtaagagggacgagaaggaaaaattcgaaccgacagtgtttcgcgacaccctggtacagggtttgaacgaagctggcgatgatctggaagccgttgcgaaattcctggacagcacaggtagccgcctcgactatcgaaggtacgctgacactctattcgacatcctggtagccggtagcatgttggcacccggtggaaccaggatcgacgacggggacaagacgaagatgactaatcactgcgttttttccgctaacgaggatcatgagaccattcgcaactatgcccaggttttcaacaaactgattcgcagatataagtatctagaaaaagctttcgaagatgagatgaaaaaggccctgagaccgcacctgctctctagtttttctaagcacgggtggcagaagaagatgcctacactgttgcccaggctctag

SEQ ID NO: 53282 - DNA, 477 bp, Artificial Sequence
  Description of Artificial Sequence: Synthetic coding sequence
atgaaccaggagaagttggcaaagctgcaggcacaggtacgtatagggggaaagggcaccgcacgccgaaagaagaaagtggtgcaccgcactgctaccgctgacgataagaaactccagtcctccctaaagaaattagccgtaaataacatcgctggtatcgaagaggtcaacatgattaaggacgatgggaccgtcattcattttaataacccaaaggtacaggctagcttgagcgcgaacaccttcgccataaccggacatgctgaagctaagcctattacagagatgctcccgggtattcttagccaactgggcgcagatagcctcacttctcttcggaaattagccgaacagttccccagacaagtgttggactcaaaagcaccgaagccagaggacatcgacgaagaagacgacgatgtgcccgacctggtagaaaactttgatgaggcttctaagaatgaggctaactag

SEQ ID NO: 53283 - DNA, 303 bp, Artificial Sequence
  Description of Artificial Sequence: Synthetic coding sequence
atgatcaaggatgacggcactgtcatacattttaataacccaaaggtgcaagcatcactatctgccaacacctttgccattactggccacgcagaggctaagcccatcacagagatgctgcccggtattttaagccaattgggggctgattctttgacgtcccttcgtaaactcgcagaacagtttccgagacaagttctcgattccaaagcgccaaaaccagaagacatcgacgaggaagacgacgatgttcccgacttggtggagaattttgacgaggcctccaagaacgaagccaactag

SEQ ID NO: 53284 - DNA, 213 bp, Artificial Sequence
  Description of Artificial Sequence: Synthetic coding sequence
atggccgaggtgaagagcatgttccgcgaggtgctgcctaaacaaggaccactttttgtggaggacattatgactatggtgctgtgtaagcccaaattattgccccttaaatctttaactctggaaaagctggaaaagatgcaccaggctgctcagaatacaattcgacagcaagaaatggccgaaaaggatcaacggcaaatcacacactag

SEQ ID NO: 53285 - DNA, 213 bp, Artificial Sequence
  Description of Artificial Sequence: Synthetic coding sequence
atggctgaggtcaagagcatgtttcgcgaggtgttaccaaagcaggggccactatttgtggaggacataatgacaatggtcctctgtaagcccaaactcctcccactgaagtcactaacattggaaaagcttgagaagatgcaccaggctgcacagaataccatcaggcaacaggagatggccgagaaggaccagcgccaaatcacccattag

SEQ ID NO: 53286 - DNA, 279 bp, Artificial Sequence
  Description of Artificial Sequence: Synthetic coding sequence
atgctcaaggctgccgctaagagacctgaactgagcgggaaaaatacaatttccaacaactccgacatggccgaagtgaaaagcatgtttcgggaggtgttgccaaagcagggacctctgttcgtcgaagacatcatgactatggtgttgtgtaagccaaagcttctgcccctgaagagcctgactcttgaaaaacttgaaaagatgcaccaggctgctcaaaataccattcgtcagcaggagatggccgagaaagatcaaaggcaaattacacattag

SEQ ID NO: 53287 - DNA, 204 bp, Artificial Sequence
  Description of Artificial Sequence: Synthetic coding sequence
atgttgaaggcagccgctaaacggcctgaattaagcggcccactgttcgtggaagacattatgaccatggtgctgtgtaaacctaaacttctacccttaaagagcctcactctcgaaaagctggaaaagatgcatcaggccgcacagaataccatccgccagcaagaaatggccgaaaaagaccagaggcagataacacactag

SEQ ID NO: 53288 - DNA, 312 bp, Artificial Sequence
  Description of Artificial Sequence: Synthetic coding sequence
atgctgaaagccgcagccaagcggcctgagctgagcggccttctcaaatttaataattacggaattctttctgagtccccgttgactagccagagaacaacctggttgctgtaccagtcccctagtttcattcctggcttcgcttatccttccagatgtctcaaaacaatcggcggagtgtacaaacaggcacgaaagaaacactatatacagcagctccgctatggacggtctgaagtgaacgttcccggatctagttccaaggccagagccaccgtctgcggcaggtataacgacaacggcgcagtgtag

SEQ ID NO: 53289 - DNA, 879 bp, Artificial Sequence
  Description of Artificial Sequence: Synthetic coding sequence
atggctgtccccaccgagctggacggaggatccgtgaaggagacggcagcagaggaggagtctcgcgttttagctcctggcgctgcccctttcggcaacttccctcattattcccgctttcacccccctgagcagcgattgaggctgctcccccctgagcttctgagacaactgttccctgaatccccggagaacggcccaatcctgggactcgacgttggttgcaatagtggtgatttgtcagtggctctgtacaagcactttctgtccctgcccgacggggaaacttgctcggacgcgtcccgcgaattcaggctgctttgctgcgacatcgaccctgtactggtcaagcgggctgagaaggagtgtccctttcccgacgcactcacgtttataactctagacttcatgaatcagcggacgagaaaggtgctcctgtctagctttttaagccagttcggcaggagcgtgtttgatataggcttttgtatgtcaattacaatgtggatacaccttaaccacggggatcacggattgtgggaattcctggcccatctctcgtccctttgtcactacctgttagtggaaccgcagccttggaagtgttaccgggctgccgctagacggctgaggaagctggggcttcacgactttgatcacttccactcgctggcaataaggggggatatgcctaaccagatcgtccagattctgacacaggatcacggtatggagctcatttgttgctttgggaatacctcttgggaccgttctcttctgttatttcgggcaaaacaaacaatcgaaactcatcctatccctgagagcctgattgagaaaggaaaagagaaaaaccgtcttagctttcagaaacagtag

SEQ ID NO: 53290 - DNA, 741 bp, Artificial Sequence
  Description of Artificial Sequence: Synthetic coding sequence
atgtcccttcagtggacagcagtagcaacctttttgtatgcagaggtgtttgtcgtattactgctttgcatcccgtttatctctcccaagcgctggcaaaaaatattcaaatcccgcttggtggaattacttgtgagctatggcaacacatttttcgttgtactgatcgtgatcttagtgctcttagtaattgacgctgttcgagagatccggaagtacgacgatgtcactgaaaaggtaaacttgcagaataatcctggggcaatggagcactttcatatgaaattgtttcgcgcacaacgcaacctctacatcgccggtttttctctgctgctctcttttcttttgcgacggttagtgacactcatctcccagcaagcaactttactggcaagcaacgaggcctttaagaaacaagccgagtcagcaagtgaggctgctaaaaagtatatggaggagaatgaccagctgaaaaaaggcgcagccgtcgacggcggaaagctggatgtgggcaatgcagaggttaagctcgaggaggaaaatcgttccctgaaagctgacctccagaaactcaaggacgagctcgcttccaccaagcagaagctggaaaaggccgagaatcaagtgctcgcgatgcgcaagcagtctgaaggactgaccaaagaatatgacagactgctggaggaacacgccaagctgcaggctgccgtggacggtcctatggataaaaaggaagaatag

SEQ ID NO: 53291 - DNA, 741 bp, Artificial Sequence
  Description of Artificial Sequence: Synthetic coding sequence
atgtcactccagtggacagctgtggccacatttctgtacgctgaagtcttcgtcgttctactgctatgtattccattcattagtccaaaaaggtggcagaagattttcaaatcacggttggtggaacttctcgtctcgtacgggaacaccttctttgtggtgctcatcgttatcctagtgcttctggtcattgatgccgttcgagagattagaaagtatgatgacgtgactgaaaaggtcaacctgcagaataatcctggggcaatggagcacttccatatgaaactgtttagggctcagcgcaacctctatatcgcgggattttcattactgctttctttcttgctaaggcgacttgtgactctcatatcccagcaggcaactctgctggccagtaacgaagccttcaagaagcaagcagaatctgccagcgaggcagccaaaaaatacatggaggagaatgatcaactgaagaagggtgccgctgtggacgggggaaaactcgatgttggcaatgcagaggtaaagttggaagaagaaaaccgttcattgaaggcagatcttcaaaagctgaaggacgaactcgcatccactaaacaaaagctggaaaaggccgaaaaccaggtacttgctatgaggaagcaaagtgagggtctcaccaaagagtatgatcgcctcctggaagagcacgccaaacttcaagccgcagtggatggaccgatggataagaaggaagagtag

SEQ ID NO: 53292 - DNA, 636 bp, Artificial Sequence
  Description of Artificial Sequence: Synthetic coding sequence
atggctcaggcgaagattaatgccaaagctaacgaagggagattctgtaggtcaagcagtatggccgatcgatcaagtcgtttactggaaagtctcgatcagctggagctgcgtgtggaggcgttgcgggaagcagcgactgcggtagagcaggagaaggagattcttctggagatgattcattctattcagaattctcaggacatgcgccagatctctgacggggaacgggaggagcttaatttaaccgctaataggcttatgggtagaaccctgacagtcgaggttagtgtggaaacaatccggaatcctcagcagcaggagtcattgaaacacgcaaccaggattatagacgaggtggtgaataagttcttagacgaccttggtaacgcaaaatcacatcttatgagcttatatagcgcctgttcttcagaggttccacacggacctgtagatcagaagttccagtctattgtgataggatgtgccctagaggaccagaagaagatcaagcggagactggagaccctgttgcggaatatcgagaattccgacaaagcgatcaaattgctcgaacatagtaagggcgcagggtctaagaccctgcagcagaatgctgagtctagatttaattag

SEQ ID NO: 53293 - DNA, 327 bp, Artificial Sequence
  Description of Artificial Sequence: Synthetic coding sequence
atgccccacatgtgggtggaggcgctccgagaagccgcaacggcggtggagcaggaaaaagaaatcctcctggagatgattcactcaattcttaccgccaaccggttgatggggcgtacactcaccgttgaagtgtcagtggagaccataaggaaccctcaacagcaggaatcccttaagcacgcaacccgcataatcgatgaagtcgtaaacaaattcctggatgacctgggcaacgcaaaaagccaccttatgagcctctacagtgcttgctcatctgaggtaccccacggcccagtggaccaaaagttccaatctattgtgtag

SEQ ID NO: 53294 - DNA, 537 bp, Artificial Sequence
  Description of Artificial Sequence: Synthetic coding sequence
atgccccatatgtgggtcgaggccttgagggaggccgcaacagcagtggaacaggagaaggagatcctacttgaaatgattcattccatccagaattctcaagacatgaggcagattagcgatggcgaacgtgaggaactgaacctgaccgcgaaccgtctgatgggtcgcactttgacggtggaggtatcagtggagacaatcagaaacccacagcagcaggaaagtcttaagcacgccactcgcattatcgatgaagttgttaacaagtttcttgacgacttgggcaacgcgaagagccatctgatgtctctctattctgcttgctcctccgaagttccccatggcccagtcgaccaaaagttccagtcaatcgtgatcggctgcgctttagaagatcagaaaaaaattaaacggagattggaaacccttctcagaaacattgagaactctgacaaagcaataaagcttttagaacattctaagggtgcaggatctaaaacccttcagcagaatgcggaatcacggttcaattag

SEQ ID NO: 53295 - DNA, 1938 bp, Artificial Sequence
  Description of Artificial Sequence: Synthetic coding sequence
atgtccgaaagaacacaggaacaggacttcgtcatcatcactgtggacgactcagatgacaacaacgactgctctatagagatggtcgaggttagtgagaccgcagacaacagcaccaatgacatcgcagatgatagcacatacgttacggcagacaatcctaccgacgataccgcaacccagcctaattttcccggagggaatgatggacatcatagaccactccagatgtcctatggtagcggttctgtgacccaggccggtgtccagtggcacgatcatagcagtctccagccccagcccctcggactgaaacagttcttccatctctcccttccatcgtcttgggacgacaggcgaacccccccatgccctgtggctcatggagaccaaattgttagccaaatcaaccacccagttcacctgaggagatacagctacaatagcgaagaagttgatttcccgaaaaggggcaggttctacaccccagaggtacaaagtagtatttcacccccagccgaaaggcaagagactcacgcctgggcatccccggctgtgacatcactcgagagtgcagcctgccatgaactgcaggaagccgacctttccgagagtctgtcttacccgcgtattgtaagcagcagcagcctgcagcaatacgttgctcaggggggtagtttcccttgctttggaatgccctggaattttatctccgggggagcagaatccacaaacgctgtcataagtttcgctaatgcaacgaccgcagtgccaatggccgtgttgtcacggagggaaagcagtctggctaacaatcctggcgtggttaactactcagcactgcccgaaaatgaaaatgtggggccaggaagggctttgagtagcttctgctttcatccaaaccttgaatcaggaccgcaaatgtcttacggaacaatgtcatatagcacggagatgaaaaacaattgtgatcaagacgacgcctcagcctccgcctgtttgaccccggacttcgctctgttgcccctgaacatcttggttaaagtcgatactaacaccgaaaatagcgtgaacaccatgaaccggagcacactactggattccgactccggccaggactcctcatccagttccgtttgcatcccaccgaaatacggttatctgggagatcctaagcggaacgttcgcgtgctcaagattcacctcttggcagtccagaacatggctaagcccaagcaagccgcatgctacctggttcgaattctcttctctaaggagatcctcatcagtagcagcgtggacattcacctcaaggatagccagtccctggatcccaataagatggcggctctccgcgaatatctggcgactacgtttccgacatgtgacctgcacgaacatggaaaagattggcaggactgtatctctggcataaattcaatgatttactgtttatgcagtgaggggaagtccacaccaaaaacggtccgcaagaataagaagaggaccaaccgggtcgcctccgctagcgccgataggaatgaccagagaggcagggacggcggtgaagggtgcagctggatgtttcagcctatgaataactctaagatgagagagaagaggaacctgcagcctaattcgaatgctatccctgagggcatgcgtgaaccctccaccgataacccagaagagcctggagaagcctggtcatattttggcagaccttggagaaatattcggatgccctgtagtgtgcttactctggccaagactaaaagttgcgcaagcttgtcggctagatacctgattcagaagctgtttaccaaggatgtgctcgtacagtcaaacgtgtacggcaatctcaaacacggcctctgtgccctagacccaaataagatctccgctctgcgaggactgctgcacattgagtacgtatag

SEQ ID NO: 53296 - DNA, 2400 bp, Artificial Sequence
  Description of Artificial Sequence: Synthetic coding sequence
atgtccgagcgcacgcaggagcaggatttcgtgatcatcacagtggacgatagtgatgataacaacgactgttccatagaaatggtagaggttagcgaaactgcagacaacagtaccaacgatattgcagatgactctacatacgtaaccgccgacaatccaacagacgacacggccactcagccaaatttccccggaggtaatgatgggcaccacaggccgttgcagatgagttatggcagcggaagcgtgacacaagccggagtccagtggcatgatcactcatccttgcagcctcaacctctcggactcaaacagtttttccatttgtccctgccttcctcctgggatgatcgtcggactcccccttgccctgtggcccacggtgaccagatcgtgagccagattaatcatcccgttcacctccggagatattcgtataattctgaggaggtcgactttcccaaacgaggtcgcttctacactcctgaggttcaaagcagcatctccccccctgcagagcgtcaggagacccatgcgtgggcatctccagccgtcaccagtctggagtccgcagcatgccatgagctgcaggaggccgatctctctgaatcactgagttatcctagaatcgtcagttcctcgtccctacagcagtacgtggctcagggtggatcattcccctgctttgggatgccatggaatttcatttctggtggcgcagagtcaactaacgcagtgatttccttcgctaacgctacaacagcggtgcccatggcagtgttatctcggagagaaagttcattggcaaacaatccaggagttgtaaattactccgcgctgcccgagaatgagaatgttgggcctggcagagctctatctagtttttgtttccacccgaatctggagatgcccgagaggcctgctaatagcagtaagaactccaccgagaccgccaactatccaacactgatggggaactacaatggacagaacacagcttccttgtccgtgttcataccaccgtactttgcagagaaaatcattttgacagagatgccagggacaactgaaacaaacgtggagaacaactctcagaccgtgtactaccctgctctgtccggaaacaccagtgcaccatacccagcgtcaagctacctgcctatcacgtcaaattttgaatccggtccacagatgtcctacggaacaatgtcgtacagcaccgagatgaagaacaactgcgaccaagatgatgcttccgccagcgcatgtcttacccctgactttgcgctcctgccgcttaatatcttggtcaaggttgacaccaacactgagaatagcgtcaataccatgaatcggtccacactgttggattcagatagcggtcaggacagctcaagctcctctgtctgcattcctccaaagtatggctacttaggcgaccccaagaggaatgtccgagtactgaagattcatcttctcgctgtccagaatatggcaaagccaaaacaagcagcttgttatctcgttagaatcctattttccaaagaaatactcatttcctcaagtgtggatatccatttgaaggacagccagagcctggacccaaataagatggccgctctgagagaatacctggctacaacatttcccacctgcgacctacacgagcacgggaaggactggcaagattgcatctccggcatcaactcaatgatctattgcctttgtagtgaaggcaaatctacgcccaaaaccgtgagaaagaataaaaagcggactaatcgggtggcctccgcttccgctgaccggaatgatcagagaggacgggatgggggagaaggctgttcatggatgttccaacccatgaacaatagtaaaatgcgtgagaaacggaacctgcagcctaattccaatgccatccctgagggtatgcgggaaccttccacggacaatccagaggagccaggcgaagcttggtcctatttcggacgaccctggcggaacattagaatgccttgttcggtgctgacattagcgaaaacaaagtcctgtgccagcttgagcgccaggtatctcatccagaaacttttcacaaaggacgtgctggtgcaaagcaatgtttacgggaaccttaagcacggattatgtgctcttgatccaaataagatttctgctctgcgagagtttctccaggagaactacccaatctgtgacctctcggagaacggcagagactggaaaagttgtgttacttccattaactctggaattcgtagcctgagacacgacgttagacgagccgaagcacggagtcagtctttgcctgctgtgactccccctgaactcgaacaagagagcaaaccaggggatcccgatgctaccgatccctccacctag

SEQ ID NO: 53297 - DNA, 2487 bp, Artificial Sequence
  Description of Artificial Sequence: Synthetic coding sequence
atgaatagtactgaatttactgaggatgtagaagaggttctcaagtctatcactgtaaaagtggagactgaagcggaagacgccgctttagactgctctgttaattcacggaccagcgagaaacattcagtagactctgttctgacagcattgcaggactcctcaaagcggaagcagctggtgtcagacggactcttggatagtgtgcctggggttaagagacggaggctcattccagaagcactcttggctggtatgcggaacagagagaactcaagcccctgtcaaggtaacggagaacaggctggcagaggtcgatccctagggaacgtgtggcctggggaggaagaaccttgtaatgatgccaccacaccaagctacaaaaaaccgctgtacgggatctcacacaagatcatggagaagaaaaatcctccttctggggacttattgaacgtgtacgaactcttcgagaaggcgaacgcttccaattcccctagcagtctacgactcctgaacgaaccgcaaaaacgtgattgcggctcaaccggcgcaggtaccgacaatgaccccaatatctactttttgattcagaagatgttttacatgttgaacacactgacttccaatatgtcccagctgcactcgaaggttgaccttctgtctcttgaggtcagccgaattaagaaacaggtatcgccaaccgagatggtcgcaaagttccagcccccaccggaataccaactcaccgccgcagagctgaagcaaattgtggaccagtccctgtccggcggagatttggcctgcagattacttgtgcagctgtttcccgaactgtttagcgatgtcgacttttctcgagggtgttcggcctgcggcttcgctgccaagcgcaaactggagagtctgcacctccagctgattcgtaactatgtggaagtatattatccaagtgtgaaggacactgccgtgtggcaggccgaatgcctgccccagttgaacgattttttctcacgattctgggcccagagagagatggaggacagtcagccctcagggcaagtcgcgagctttttcgaggcagagcaggtggaccctggacattttctggacaataaggatcaggaggaagccctgtcattagaccgctctagcaccattgcatcagatcatgtggtggacacccaggacttgacagagtttctcgatgaggccagctcgcccggtgagttcgctgtctttctcctgcacaggttatttccggagctcttcgaccacaggaagttgggtgagcagtatagctgctatggggatggaggcaaacaggaactcgatccacagcgcctgcagatcatcaggaactatacggaaatatacttcccggatatgcaggaggaagaggcttggctccaacaatgcgcacagagaataaacgacgagcttgagggattaggactggacgctggatccgaaggtgatccacccagggacgattgttacgattcttcatctctaccagacgacattagtgttgtaaaggtggaggattctttcgaaggagagcgacctggacgtcgatcgaaaaagatctggctggtgcccatcgactttgataagctggagattccccagcccgactttgaagtacctggggcagattgcttgctgagtaaagagcaacttaggagcatttacgagtcaagtctgtcgataggtaactttgcaagtaggctgctcgttcacctgttccctgagttattcacgcacgagaatctaagaaagcaatataactgcagtgggtcactcggtaaaaaacaactcgacccttcacggattaagctaattcggcactatgtgcagctgctctacccaagggctaagaacgaccgggtctggacgctggaatttgtaggcaagctagacgagcgctgcagacgtcgtgatacagagcagcgaaggagttaccaacagcaaaggaaagtacacgtcccgggacccgagtgcagagatttgacctcgtatgccattaatccggaacgattccgggaggaattcgagggccctcccctacctcccgagcgctcctctaaagacttctgcaagatcccactagacgagctggtcgtcccatcccctgactttccggtgccttccccctatctgctctctgacaaggaggtcagagagatcgtacaacagtccctcagtgtgggaaattttgcagcacgccttctggtccgattatttccagagctatttactgctgaaaacctacgcctgcaatacaaccacagcggggcttgtaataaaaaacagttagaccccacacgacttcggctgatccgacactatgttgaggcggtttacccagtcgaaaaaatggaggaagtttggcactacgaatgcattccgtcaatcgacgaaaggtgtcggaggcccaatcgcaaaaaatgcgatatactgaaaaaggctaagaaagtggaaaagtag

SEQ ID NO: 53298 - DNA, 2487 bp, Artificial Sequence
  Description of Artificial Sequence: Synthetic coding sequence
atgaactcaaccgagtttactgaagacgtggaagaggtgcttaaatctataacagtgaaggtcgagacggaggccgaggatgccgcattagattgttccgttaatagtaggacgtctgaaaaacatagcgtcgactccgtcctcacagcgctccaggattccagcaagcgaaagcagctggtgtccgacggactcttggactcagtcccaggggtcaagcgtagaagactgatcccagaagccctcttagctggtatgcggaaccgcgagaactcttcaccttgccaggggaacggagaacaggccggtaggggacgatctctgggaaacgtctggcccggtgaggaagaaccatgtaatgacgccaccacaccctcatacaagaaacctctatacggcataagccacaagataatggaaaaaaaaaaccctccgtctggagatctgcttaatgtgtacgagctttttgaaaaagcaaacgcctctaactctccatcgagtttaagactcttaaacgaaccacagaagcgagattgcggcagcaccggggcagggactgataacgaccccaatatttactttctaatccagaaaatgttttacatgttgaacacactgacctctaacatgagtcagctccactcaaaggtggatttgctgagccttgaagtcagtcgcattaaaaagcaggtgtctcctaccgaaatggtcgcaaagtttcaaccaccgcctgagtatcagctaactgccgcagagctgaaacaaatcgttgaccaatccctttccgggggagacttggcctgtcgcctgctcgttcagctatttcctgagctgttttctgacgtggacttttcaagaggatgtagcgcctgcggttttgccgcaaaacgaaaattggaaagtcttcacttgcagctgatcagaaactatgtcgaagtctactatccttctgtgaaggataccgccgtgtggcaggctgaatgccttccacagctgaatgatttctttagccggttctgggcacagagggagatggaggattcacaaccatctggacaagtggcatcgttctttgaggccgaacaggttgaccctggacattttctcgacaataaggatcaggaggaggcattgtctctggaccggagtagcaccatcgccagcgaccacgtggtcgacacacaggatctgaccgagtttttagacgaagcgtcctcccctggagaattcgctgtattcctgctgcacagactctttccagaactctttgatcacaggaagctgggagaacaatactcctgttacggagatggaggtaaacaagagctggacccccagcggttacagatcatccgaaactacaccgagatctacttccctgatatgcaggaagaagaagcctggctccagcagtgtgcccaaaggatcaacgacgagcttgagggactgggattggacgcagggtcagaaggggaccccccaagggatgattgctacgatagcagtagtttgcctgacgatatctccgtggttaaggtggaggactccttcgaaggcgaacgccctgggaggcgctctaaaaaaatttggttagttcccatagatttcgataagctggagattccacagcctgattttgaggttccaggcgctgattgcttactttctaaggagcagttgcgaagtatatatgaatcatctctgagtatcggaaattttgcctccagactgctggtccacctgttccctgagctctttacccatgagaatttgcgtaaacaatataactgtagtggaagcttggggaagaagcagctggaccccagccgtattaagctcattcggcactatgtgcagctgctgtacccacgggctaagaatgacagagtttggaccctagagtttgttgggaagttggatgagagatgccgacgtcgagacaccgagcagcgcaggagttaccaacagcagcgcaaggttcacgtgcctggcccagaatgccgcgacctcacatcatacgcgattaatcctgagcgattcagggaggaatttgaggggcctccacttccccctgaacggagctcaaaagacttttgtaaaattcccctggatgagctggtcgtaccctcccccgactttcccgtcccctccccctacttattgtctgataaggaagtcagagaaattgtgcagcaatcactgtccgtgggcaactttgcagcaagattactagtacgcttgttcccagaactatttactgctgaaaatctcagactgcaatataatcattctggggcttgtaacaaaaagcagttagaccctacgaggctaagactcatcagacattacgtagaggccgtgtacccagtggaaaagatggaggaagtttggcattatgagtgcattccaagcattgacgagagatgccggagacctaacagaaaaaagtgcgatattcttaagaaggccaagaaggtggagaaatag

SEQ ID NO: 53299 - DNA, 1218 bp, Artificial Sequence
  Description of Artificial Sequence: Synthetic coding sequence
atgcaaccagcggaggagggcccttccgttcctaagatatacaagcagcgcagcccttatagcgttttaaaaaccttcccatctctcaacgtggtgtcagagagtaggatgatactggacgcctttgcgcaacagtgctctagggtcttgagtctgctcaactgtggaggtaaattactggactccaaccattctcagtctatgataagttgcgtcaagcaggaaggctcttcatataatgaaagacaagaacactgccatatcgggaagggagtacactctcaaactagcgacaacgtggatatcgagatgcagtacatgcagagaaagcagcagactagtgcattcttgagggtgttcactgattcactgcagaactacctcctcagtggtagctttcctacacctaatcctagctcagcatcggagtacggccatttggccgacgtggaccctttgtcaacatcccccgttcacaccctggggggatggacatcaccggctacgtcggaaagtcacggacaccctagttctagcacactacccgaagaagaggaagaagaagacgaggagggttattgcccccgatgtcaggaattggaacaggaggtgattagtctgcagcaggaaaacgaggagctccggaggaagttagagtctattcccgttccttgtcagacagtgctggactatctgaagatggtcctgcagcatcacaatcagcttcttattccacaacctgcagatcagcccacagaagggtccaaacagttgctgaacaactatcctgtgtacattacttctaaacagtgggacgaggcagtgaacagcagcaagaaagatggaaggcgtctgctccggtatttaatcaggtttgtgtttacgaccgacgagctaaagtactcctgcgggctcggaaagagaaagcgttcggtccagagtggtgaaacgggccctgagcgcagaccactcgaccccgtcaaggtgacttgtctgagagaattcatccggatgcactgtacaagcaacccagactggtggatgcccagcgaggaacagattaataaagtcttctcggacgctgtaggccacgccagacaaggacgtgctgttgggaccttcctgcacaacggaggcagtttttacgagggaatcgaccatcaggctagccaggacgaagttttcaacaagtcaagccaggatggctccggtgattag

SEQ ID NO: 53300 - DNA, 1605 bp, Artificial Sequence
  Description of Artificial Sequence: Synthetic coding sequence
atggaagaggagatgcagcccgctgaggaaggaccaagtgtacctaaaatttataagcagcgttctccctactcagttcttaagacattccccagtaagagaccagccctggctaagcgctatgagcgccctacattagtcgagctgccgcatgtgcgcgcacccccaccacctccgccaccattcgcccctcatgccgcagtctctataagcagctctgagccaccccctcagcaattccaggcccaatcgagctatcctcctggtcccggaagggctgcagcagcggcatcaagttcaagcccctcttgtacccctgccacaagccaaggacacctgagaactcccgctcagcctcctcccgcttcaccagccgcttcatccagcagtagctttgcagcagtcgtgcggtacggaccaggagctgccgcagctgccggtactggcggtacaggtagtgacagtgcttctctcgagctctctgctgaaagtcgaatgattttagacgcattcgcacagcaatgctcacgggtgcttagcctcctgaattgcggcggaaagttactggattccaatcactcacaatctatgattagctgtgtgaaacaggagggcagcagttataacgagcgtcaggagcattgccatattggtaaaggcgtgcactcacaaacttcagacaatgtggacatcgagatgcagtatatgcagagaaaacaacagacttccgcttttctgcgcgtgttcaccgactccctgcagaactaccttctctctggcagcttccccactccaaacccctcctccgcttccgagtacggacaccttgctgatgtggatccactttccacaagcccagtgcacactttgggtggctggactagcccagccaccagcgagagtcacggacaccccagcagctccacacttcctgaggaagaggaggaagaggacgaggagggttactgcccacgatgccaggagctggagcaggaggtcatatcgttacagcaggaaaacgaggagctgagaagaaagctggaatccatccccgtgccctgccagactgttttggattatctgaagatggtgttgcagcatcacaatcagctactcataccgcagccagcagatcagcctaccgagggctcaaaacagctgttaaacaactacccagtgtatataaccagtaagcagtgggatgaagcggtgaatagctctaaaaaggacggaaggcgcctcttgcgctatctgataaggtttgtgtttaccactgacgaattgaagtattcctgcggcttggggaagcggaaacggagcgtgcagtcgggggaaactggcccagagcggcgacctctcgatccagtgaaagtgacatgtctcagagaattcatccgaatgcactgcaccagtaatccagattggtggatgcctagcgaggagcagattaataaagtcttcagtgatgcggtcggccacgctagacagggcagggctgtcggtaccttccttcacaatggaggcagcttctatgaaggtatcgaccaccaggctagccaggatgaagtattcaataaatcctcacaggacgggagtggagactag

SEQ ID NO: 53301 - DNA, 1314 bp, Artificial Sequence
  Description of Artificial Sequence: Synthetic coding sequence
atgcagccggctgaagagggcccatccgtgccaaaaatatataagcagcgctcgccgtactcagtgctgaagaccttccccagcaagagacccgctctcgctaagcggtatgagaggccgaccctggtcgagctcccccacgtgagagcccctccccctccaccaccaccgttcgccccacacgctgctgtcagcatttctagcagtgagccccctccccaacagtttcaagcgcagtctagttatccacctggccctggcagggcagcggcagctgcatcctcttcatcaccttcctgcaccccggcaacttcacaagggcatcttcgtacacctgcacagccaccacctgcatccccagcagcttcttcttcgtctagtttcgcagctgtggttaggtacgggccaggcgcagcagctgcagccggtaccggtggaactggcagcgattcagcctctctagaacttagcgcagagtcaagaatgatcttggacgcctttgcacagcagtgctccagagttctgtccctgctgaattgcggaggcaagcttctggattcaaaccactcacagtcaatgatctcttgcgtgaagcaggaaggtagttcgtacaatgagaggcaagaacactgccatatcggaaagggggtgcactctcagacctcggataatgtggatatcgaaatgcagtacatgcagagaaagcagcagacctctgcatttctccgcgtgtttacggactcccttcagaattacctcctgtctggttcatttcctactccgaacccttcttccgcgtccgagtacgggcacctggccgatgtggatcccctgagtaccagcccggtacacactttgggaggctggacctcccccgcaacttccgaatcccacggccatcccagctcttcaactctccctgaggaagaagaggaggaagatgaggagggctactgccctagatgtcaggagctggagcaggaggtgatttctctgcaacaggaaaatgaggagctccggaggaaactggaatccattcctgtgccctgtcagacggtgctagattacctgaagatggttctccagcaccataaccagttgcttatcccccagcccgcagaccagcctactgaaggctctaaacagcttctcaataactatcccgtctacattactagtaagcagtgggacgaggccgtcaattcatccaagaaggatgggcgtcgactgctgcgttacctcattagatttgtctttaccacagatgagctgaaatactcttgtggcctcggcaagaggaaaagaattcattag

SEQ ID NO: 53302 - DNA, 570 bp, Artificial Sequence
  Description of Artificial Sequence: Synthetic coding sequence
atgcagaaaatcgttcagaccgatgagatcaccaatacacaggcctttcgcaagggaaagagaaagcgtacggagaccatggatagcgagaatgccaacagcgacatggacaaggggcagcgcgatccatatagcggaaatgcctttctccctggggagtcgagcagtgaagatgaggagccgctggccgagttgtcaaaagaggaactgtgtgctaaaattaagtctctcaaggaaaagttgacgaatacacgaaaagagaatagcagactgcgacagagtctggttatgcttcaggtgttgcctcaggcggtcacacagtttgaggaactcgtcggcatggctgaagccctcctgaagggtgggggtaccatgtcaactagcgcttcaaccttgtggcgggcaaccaacaattcttctcctgattcttttgcatccacatgttccaattcgaattctaatagctcaagccctgttagtctcaagcccgaggaagaacatcagactgatgagaagcagttccaaatcgagaaatggcaaaatccccttttgcaggggaccaagctctag

SEQ ID NO: 53303 - DNA, 390 bp, Artificial Sequence
  Description of Artificial Sequence: Synthetic coding sequence
atgcagaagattgtccagaccgacgagattaccaacactcaggcattcaggaaaggcaagcggaagcgcacggagacaatggattcggagaatgccaattccgacatggacaaaggacaaagggacccttatagcggaaatgctttccttcctggcgagtccagttcggaggacgaagaaccattggccgaactgtctaaggaagagctgtgtgccaagatcaaaagtctgaaggagaaattaacaaacacaaggaaagagaactccaggctgaggcagtccttggtgatgctgcaaggcaacaaacttgacatcacaacggagaaaacaattctgcacggcggaatgaagacgcttaatgtggtgactacaagttcgcacccagtctag

SEQ ID NO: 53304 - DNA, 840 bp, Artificial Sequence
  Description of Artificial Sequence: Synthetic coding sequence
atgcagaagatcgtccagactgacgaaatcaccaacacacaggcattcagaaaagggaaacgtaagcgtaccgagaccatggactcagaaaacgctaattcagatatggacaaaggtcaacgggatccctactccggaaacgcattcttacccggagaatcatctagcgaggacgaggagcccttggccgaactgagcaaggaggagctgtgtgcaaaaatcaagtccttgaaggagaaacttacgaacacaagaaaggagaatagcagactgcgccagagtctggtcatgttgcaggtcttgccacaggccgtgacacaatttgaagagttagtgggcatggctgaggctcttttaaagggtggtggaaccatgagcacaagcgccagcactctgtggagggctaccaataactcaagcccagacagcttcgcgtctacatgtagcaatagcaactctaatagttcatcacccgtgagtctgaaacctgaagaagagcaccagacggacgagaagcagttccagatcgaaaaatggcagatcgcgcgatgtaataaaagtaagccccagaaatttataaacgacttgatgcaggtgctgtacactaatgaatacatggccacccattccctgactggagcgaaaagcagtaccagccgggataaagcagtgaaaccggctatgaaccagaacgaggtgcaggagattattggagtcacaaaacagctgttccccaatacagacgatgttagcatccgcagaatgatcggtcaaaagcttaataactgcaccaaaaaaccaaacctttctaagaaccttaattcacaggatatcaagtag

SEQ ID NO: 53305 - DNA, 321 bp, Artificial Sequence
  Description of Artificial Sequence: Synthetic coding sequence
atgcagaagattgtgcagactgacgaaatcactaacacgcaagctttccgaaagggcaagcggaaaaggaccgagaccatggactcggagaatgcaaattctgacatggataagggtcaacgggatccctacagcggcaatgcctttctccctggagaatcctcctccgaggatgaggagccgctggccgagttgtcaaaagaagagttatgtgcaaagatcaaatccttaaaggagaagctcaccaacactcgaaaagagaatagcaggctccgacaatcgttagtgatgcttcaggcctggtcaagagaattaccatag

SEQ ID NO: 53306 - DNA, 390 bp, Artificial Sequence
  Description of Artificial Sequence: Synthetic coding sequence
atgcagaagattgtacaaactgacgaaattaccaacacccaggcttttaggaaaggaaaaaggaagagaacagagactatggacagcgagaatgctaacagtgatatggacaagggtcagcgtgacccttactcaggaaacgcttttctgcccggagagtcctcatcagaggacgaggaaccactggcggaactctctaaggaggagctttgcgccaagattaagagcctgaaggaaaagctcaccaacaccagaaaggagaactcaagattgagacagtctctcgtcatgttacagggcaacaaactcgacatcactactgagaagacaatccttcacggtggcatgaagacgcttaacgtggtgaccacatcctcacatcccgtctag

SEQ ID NO: 53307 - DNA, 546 bp, Artificial Sequence
  Description of Artificial Sequence: Synthetic coding sequence
atgctcctgccacaagccgtgacacaatttgaagagctcgtaggcatggccgaggctctcctgaagggaggcggaaccatgtccacgtcggctagcacactgtggcgagcaaccaataacagcagcccggacagctttgcatcgacatgtagtaactcaaactctaactcctcctcacctgtaagcctgaaacccgaagaagaacaccaaaccgatgaaaaacagttccaaatcgagaaatggcagattgcaaggtgcaacaaaagtaagccccagaagtttatcaatgatctaatgcaagttctgtatacaaatgaatacatggcaacacactctcttacaggcgctaagtcaagcacctcccgtgataaggcagtcaaaccagcgatgaaccagaatgaggtccaggaaatcattggcgtgacaaaacagttgtttcccaacactgacgatgtgtcgattcgacgaatgatcggacagaagttgaacaactgcactaaaaagccgaacctgagcaaaaacctgaattctcaggatattaagtag

SEQ ID NO: 53308 - DNA, 1407 bp, Artificial Sequence
  Description of Artificial Sequence: Synthetic coding sequence
atggaaatcaagaagcagattaccggaatgcggcgattactgaatgatagcactggcaggatttaccagcgtgtgggcaaggagggtgagaagctgaaggaagagccacaggacctcgacttggtgtggccccctaggctcaactcctccgcagaggcccctcagagcttgcacccctcctctcgcggagtgtggaatgaactgcccccacagagtggacagttcagtgggcagtatggcactcgctcccggacattccagagccagccccacccaacaaccagctctaacggagagttaccagttgttaacagcagtgctggaagcaactgctgtacgtgtaactgccaatctacccttcaagccatcctacaagagttgaagaccatgcgtaaactaatgcagatccaggctgttggcacacagaatcggcagcagccacccatctctttgatttgcagccaacggaccgccgttagcagaaagcggaataagaaaaagaaagtgccaccaaaaaccgtggagccactcaccgtaaaacagaagcccagtggctctgaaatggagaagaaatcggtggtggccagcgagcttagcgccctccaggccgcagagcatacctcaccagaagagtctcgagtccttggttttgggattgtgctcgagtccccgtccagcgacccagaagtccagttagccgaaggattcgatgtgtttatgcctaagtctcagttagatagcatcttgtctaactatacccgctctggctcgctgttattccgtaagcttgtctgtgcatttttcgacgataaaaccctcgccaatagtctgccaaacggcaaacggaaaagagggctgaatgataaccgcaaggggttggatcaaaatatcgtgggtgccatcaaagtcttcacggagaaatactgcactgccaatcatgtggataagttgcccggacccagggattgggtgcagattttgcaggaccaaattaaactcgcaaggcgcagactgaaacgaggctctgccgaaatcgctgattctgacgagcgcctcgacggaattgctctcccgccaacaggggcatgcggaggaccatgtaccgtgcttccgggtgggtcggcagcagttactctggtcctgcagagctcaccccagacaatgtcacaagaaaagggacaaatggcggaaccctgggaggaacagcacctggtcctgcttaacaacctgacccgcgaccgcgctgagacaggggcactgagtcagacctctcaggacttcaagcaccattccttcctcatcacccaggtgtccgcgacccttcaccaccagaggggtatcaggaacttcccaactccaggctccgcaaagtctctcactctgcacatttcttgtttgtcgttgtag

SEQ ID NO: 53309 - DNA, 1125 bp, Artificial Sequence
  Description of Artificial Sequence: Synthetic coding sequence
atggagattaaaaaacaaatcactggcatgcggagattgctcaacgactcaaccggaagaatataccagcgtgtcgggaaagagggcgagaagttgaaggaggaacctcaagacctggatcttgtgtggcctcctagactaaatagctccgctgaggcaccacaaagccttcacccttcgagtcgaggagtgtggaacgaacttcccccacagtccgggcagtttagcggccagtacggtaccagaagccgcacattccagagccagccacacccgaccacatcgagcaacggcatggtggtgaataaacactccgaggggagccacggaggcgagttgccggtggtgaactcaagcgcaggtagtaattgctgcacatgcaattgccagtccacattgcaggcaatcctccaagagcttaagaccatgagaaagctgatgcagatacaggctgtcggcacacagaatcgtcaacaacctcccatctctttgatttgttctcagaggaccgcggtttcccgtaagagaaataaaaaaaagaaggtcccaccaaagacagtggagccactaactgtcaaacagaagcctagtggatccgagatggagaagaagtctgtcgtggccagtgaactgagcgctctgcaggctgctgagcacacctcccccgaagaaagccgcgtactcggctttggcatagtgctggagtccccctcaagcgatccagaggtccagctcgccgagggtttcgatgtctttatgccaaagagccaacttgattcaattctgtcaaactatacacgctctggcagcttgttattcaggaagctggtgtgtgctttcttcgacgataagacacttgcaaactccctgcctaacggaaaacgaaaacgcggtctgaacgacaaccgtaagggtctggaccagaatatagtcggggctattaaagtgtttacagagaagtactgcaccgcaaaccacgttgacaagctgccgggaccgcgtgactgggtgcagatcctccaggaccagattaagctagcgagacgtagattgaagagaggaagtgagatcgccgattcggacgagcgtctcgatgggattgcactaccaccaacagtggtgtag

SEQ ID NO: 53310 - DNA, 1281 bp, Artificial Sequence
  Description of Artificial Sequence: Synthetic coding sequence
atggagttttcagagcgcaaaagatcgcgcaagtctcagagcttcaagctggtgagccgcgactatcaccacgaagtgtacaagatacccgagttcagcaatgacgtcaatggcgaggctaaggagacacagcctattttcctcggcgacgaaagtatggagatcaaaaaacaaataaccggaatgcgcaggctgctcaacgactccactggccgtatttatcagcgagtgggcaaagaaggcgaaaaactcaaagaagaaccgcaggatctggacctggtgtggccgccacgactgaacagtagcgctgaggccccacaaagtctgcatccaagtagtcgcggagtttggaacgagctccccccacaatccggccagttttccggccagtacggcacccgcagtagaacgtttcaaagtcagcctcatccaacaacttcctccaacgggatggttgtgaacaaacatagcgagggatcgcacggcggtgagttacctgtggttaactcttccgctggctccaattgctgcacctgcaactgccagagcaccctccaagcaatcctgcaggagctgaagaccatgcggaagttgatgcaaattcaggcagtgggtacacagaaccgtcagcagccccctatcagccttatctgcagccagagaactgccgtgtcccgaaagcgcaataaaaaaaaaaaagtgccgccaaagaccgtggaacctctgactgttaagcaaaaaccttcgggtagcgaaatggagaaaaagagcgtggtcgcatctgagctctcagctctacaggcggcagagcacacatctcctgaggagtcaagggtattgggatttgggatcgtcttggaatctccgtcatctgacccagaggtgcagcttgccgaaggattcgatgtattcatgccgaagtctcagttggattccatcttgagcaactacacccggtcaggtagccttctctttcgaaagctggtatgtgcttttttcgacgataaaaccctcgctaattccctgccaaatggaaagcgaaaacgcggtctgaacgataataggaaaggtctggaccagaatatcgtaggggctatcaaggtcttcactgaaaagtactgtacagctaatcacgtggataaactaccagggccacgcgactgggtgcagattcttcaagaccaaatcaaactcgcacgccgacgcttaaaaagaggctcggagatcgccgactcagacgagcgactagacggaatcgctctgccccctacagtggtttag

SEQ ID NO: 53311 - DNA, 1560 bp, Artificial Sequence
  Description of Artificial Sequence: Synthetic coding sequence
atggagttttccgagcggaagcgcagtaggaagagccaaagcttcaagctggttagccgcgattatcaccacgaggtgtataagataccggaatttagtaatgacgtgaatggtgaggccaaggagacccagccaatatttctgggcgatgagtcaatggagattaagaaacagatcaccggaatgagaaggctgttaaacgacagcaccggccgaatttaccagcgcgtaggcaaggaaggagaaaagctcaaggaggaacctcaagacctcgatctggtatggccaccacggctcaacagttcggcggaggcccctcaatcgctgcacccctcaagccggggagtgtggaacgaattgccaccccagagtggccagttcagtgggcagtacggcacgcggtctcggacatttcagtcccagcctcacccaacaactagctctaacggcgagctgccagtggtgaacagctccgctggcagtaactgctgcacctgcaattgtcagagcaccctgcaggcaattttgcaggaactcaaaactatgcggaagctaatgcagatacaggctgtgggtactcaaaacaggcagcagccgcctatttcactgatttgtagccagagaaccgccgtaagcagaaagaggaacaagaaaaagaaggttcctcccaagacggtggagcctctgactgtgaaacaaaaaccatcaggatccgagatggaaaagaagagcgtggtggcatcagagttaagcgcactacaggctgccgaacacactagcccagaagaatcacgggtgttagggttcggcatcgtcctggaatccccaagtagcgatcctgaagtccaactggcggaagggttcgacgtgttcatgcccaagtctcagctggatagtatcctgtccaactatacccgttccgggagtctacttttccggaagctggtctgtgcattctttgacgacaagacgcttgctaacagcttaccgaacggcaaaaggaagcgtggtctcaacgataaccgcaaaggtctggatcaaaacatagtgggagctattaaggtgtttacagagaagtactgtacagcaaatcatgttgataaattgcctggccctcgagactgggttcagatattgcaagatcaaattaagctcgctcggaggagacttaagaggggctctgagatcgccgattcggatgagaggcttgacggaattgcactgccaccgactggagcatgtggtggtccttgcaccgtgctgccgggagggtcagctgctgtgacactcgtcctccagagctctcctcagacgatgagtcaggagaagggccaaatggcagagccgtgggaagaacagcaccttgtgctgctgaacaacctcacaagagatagggctgagaccggagccctatctcaaacctcacaagatttcaaacaccatagcttcctcattactcaggtaagcgcaaccctccatcatcagcgtgggattcgtaatttcccaacaccagggagcgcaaagagtcttaccctacacatctcttgtctgagcttgtag

SEQ ID NO: 53312 - DNA, 354 bp, Artificial Sequence
  Description of Artificial Sequence: Synthetic coding sequence
ctggatagcatattgtcgaactacacaaggagcggctcattgctgttccgaaaattggtttgcgcattcttcgatgataaaaccttggccaactcgctgcctaacggcaagaggaagcgcggtctcaacgataaccggaagggactggatcagaatatcgtcggggcaataaaagtattcacagaaaagtattgtacagcaaatcatgtcgataaattacccggtcctcgggattgggtccagattctccaggaccaaatcaagctcgcccgacggcgtctgaagagaggcagcgaaatcgccgatagcgatgaaagacttgatggcatagcgcttccgccaacgggcaaatag

SEQ ID NO: 53313 - DNA, 3069 bp, Artificial Sequence
  Description of Artificial Sequence: Synthetic coding sequence
atgcctgatttccaacctggcgataccacagtccgactggacaaaaggatgtcgctcacggccatatatgacaaacgcagggaaactgattactcagacaaggggtacaacctggccttcgtttcccaagatgaacaggagaactccagttttaccatcttatacgaggaaccactgcaggaagaggacaagtacgcttccgccgaggctcggcagactcaatccgtgctcttccatgatacatccgccgattccatgcccgtgcttgcttgcgagaggtcagaatctagaacagatttagtgcatcacttcgagaagggaacgaagctgggggagacgtttgactcagacagttcagaaatgtttctgtccgtggaggctaaacgctacaagatttatccgctcgctctgtctccgatttatgaggacgacagctcccaagaggacatacttagcagcgaagtgagccctggacaccacggcccaagaaaaagccgggacagtgaaaaccagtctagcagcgtgctgagtctgcttcagagtgtcagtgaaagattgaaaatgaattttgacgaagacgaccgggaggccgctgacgaggaggaagaggaagaagaggctgccgtcttgcacaagggggatctgcgggcaggttccggtgaacgcgtgacctttcagctgcctgatccaagtatcaccttttacccagatgaccaagaatctgtgggtatctcaaaaaattcgtatgtcatgccaaatgagcccaccacatctaatctgcaagtgggactgtggcccgaaaaaacctctttcctccagaagtctgacctgacgtccaaactccattccagcctgaaaagcgcttatcaccaatatctgcagacttctcaatcccacagttctgagaagggcgctcgattcggtggaatctttcaggagcccgtgtccaagtacttccgtgtgcaggattctccaggcagactgtcaccattcatcgaaaacgtggataagcagacactgcggtgtaatccacgaccagggaaaatggtgatttatgacctccacgaaagcacctacaagcaggaggtgtactgcaatataccagatgcaacaagctggagctttcccaacggcgtgctgatcaaggtggtgcgtggctgctggatcctctatgaaaaaccgcatttccgcggtcaaaaatgcgtgctggaggagggtgagaaggtgctgaatagggactggattttgcagaaccgaagacacccacagagaaattttatcctgggtagccttaagagggtgctcaaagactgctcaattcccgagattgaactgtttccacagtcagacccggcttgttgtcccgtgtatatccagcgggctgttccaaatcttgaggagctcaatatcagtaagtctgtgtcattcactgttaagtctggggtttggctggcttaccctgacattaacttcaaaggccaggcaacggtcctggaagaagatcatggattgttcgagattagcactgccgagatgaaatcgcttcatcctctccagatgggtggtcttaaagtagaaatgccaatgaacctgaaagtgatcatctacgagaagccccactttcatgggcaagcgaaggagttcagcgagcacatcgattcagttccaaactttctgaagaataacggagactttcaccggattggctccataagagtaataggaggcgtttgggtcgcctacgaaaaggagcattttaaaggtcaacagtttctgcttgaggagggcgacttcgaggattcaaatgcttgcggggctctgtctagccccattctcagttttaggtacctgcaggcaaacttcatagaatcgtctgtcactctgtttgagagtgacctggaaagtggcaagtttatagatatcactaatcaggaaatcagtgatctggaagaaataggtttcggctcaaagactagatccatccacgttaagtctggcgtctgggttgcgtatcagcaaaaattcttctgcggcgagcagtatattctggaaaaggggaaatataagtgctttttcgactggggcggatctaataacatcatcatgagtatcaggcccatacaactagaacccctggggatcaacgagccaccgcacttgctgaaggccttctccaaaccgggttttcagggcgagtgtatcgacttcacagaggagacaagcgatctcacctcactgatgccttgctccttcaaggttcttcgaggatgttggcttctgtactatcaggaagatatgtttgtcaaccattgcgtgctggaggaaggactttacgccgatctgacctcatgcggctgtcctgctagcaaggttaagagcctcaaaccgatcgactacgtgtttgaggagccctccatctccctattcgctctcgagcactgtgagggtcgagagctccatcttgaagaagccgtgaattcggttctaaacaaggatctgcacttctatacgcaaagcgtctgggtgaagagtggtttatggatagcatatgaagggtcaaacttcctgggccgacagatcctgcttcggcctaacgagattcccaactggacagctttctccagatggaagaccatcggctctctccgccctatgaaacaaccagccgtctacatccggatcaagaatcgcgctcagggtgaatatctgaccgtcactgggagcctggctgatacacgggcaacttccgtttgcatctccccctattccgggaagaacacacagatttggtactactgcagaggcttgttcaagagcaaagcttccgatacctgcctcgacgttatcgggggtagagatactccaggcgcaaaggtggcactctggactgaacatggacaatttagacagaaatggcggcttaacaaaaatggaactatttcatcctatctttctgatcagctggtgctggacgttaagggcggaaactactgtgataaaacccacgtgattgtgaatcagcccctggaaggcgaagaaacacaaaaatgggatatagaaatcctctag

SEQ ID NO: 53314 - DNA, 690 bp, Artificial Sequence
  Description of Artificial Sequence: Synthetic coding sequence
atgaacgaaaagaagaaggtatttgaggaaccctctatctccttattcgcattagaacactgtgaggggagagagcttcacctcgaagaggcggtgaacagcgtactgaacaaggatctacacttttatacccagagcgtgtgggttaaaagtggattatggatagcatatgagggctctaattttctggggcgtcagatcctgttgcggccaaatgaaatccccaattggaccgctttcagtcggtggaagacgattgggagtctgagaccaatgaaacagccagccgtgtacattagaattaagaatagggcgcagggcgaatacttgactgtgacaggatctctggctgataccagagccacaagcgtgtgtatcagtccctacagcggcaagaatactcaaatttggtattactgcagagggctgttcaagtccaaggcatccgacacatgccttgacgtgatcggcggacgggacactcccggagccaaagtcgccctgtggaccgagcacgggcagttccggcagaaatggaggttgaataaaaatggaaccatttccagttatctgagcgatcaattagttctagacgtcaaaggcggaaattactgtgacaaaacccatgtcattgtgaaccagcccttggagggggaagagacacaaaaatgggatatagagatcctctag

SEQ ID NO: 53315 - DNA, 396 bp, Artificial Sequence
  Description of Artificial Sequence: Synthetic coding sequence
atgaataagaaaaaggtgttcgaagagcctagtatctcactgttcgccttggaacattgtgaaggacgggaactgcacctggaggaggccgtgaattccgtgttaaataaggacctgcatttctatacccagtctgtgtgggtgaagtctgggttgtggatcgcttacgagggtagtaattttctggggagacagatactcctccggcctaacgagatccctaattggacggctttctcacgctggaagaccataggctccctgagacctatgaagcaaccagctgtgtacatcagaatcaagaaccgggcacagggggaatatcttactgttacaggttctctcgctgatactagggctacctccgtatgcatctccccctatagcggcaaatag

SEQ ID NO: 53316 - DNA, 9156 bp, Artificial Sequence
  Description of Artificial Sequence: Synthetic coding sequence
atggccacgaatccccagccacagcctcctcccccagcacctccgcctcccccaccacagccccaacctcagcctccacccccaccccctggaccaggtgcaggtcccggagcgggtggagcgggaggggctggagccggtgccggtgatccccagcttgtagctatgatcgttaatcacctcaaaagccaagggcttttcgaccagttccgaagagattgccttgccgatgttgatactaagcctgcttaccagaacctgagacagcgcgtcgacaattttgtggcaaatcatcttgcaactcatacctggtccccccacctgaacaagaatcaacttcggaacaatatcagacagcaggtgctgaaaagtgggatgctcgaatcaggcatagatcgtattatctcacaggttgtggatccaaaaattaaccacacttttcggccacaggttgagaaagcagtccacgagtttcttgccacgttgaaccataaggaggaagggtccggaaatacggcgccagatgacgagaagccagatacgtctctgataacgcaaggagttcccacccccggaccttcagctaacgtggcaaacgatgcaatgtctattctggagaccattacctccctgaaccaagaggcatcagcagcccgagcatccaccgaaacctcaaacgccaaaacatctgaacgagcgtctaagaaactgcctagccaacccacaaccgacacatccaccgacaaagaaagaacttctgaagatatggccgacaaggaaaagtcaaccgcggatagcggcggagagggtctcgagacggctcccaaatctgaagaatttagcgaccttccctgccccgtggaggagatcaagaattatactaaggagcacaataatcttatcctcctcaacaaggatgtgcagcaggagtctagcgagcagaaaaataagagcactgacaagggagagaagaaaccagattcaaacgagaagggggagcgcaagaaggaaaagaaggagaagactgagaagaagtttgatcactcaaagaagtctgaagacacccagaaagtgaaggatgagaagcaggcaaaagagaaggaggttgaaagtctgaagctgccgagtgagaagaattccaacaaggcgaaaaccgtggaaggtactaaagaggatttctcccttattgactcagatgtggatggactgaccgatatcacagtcagtagtgttcatactagtgacctgtcaagcttcgaagaagatacagaggaggaggttgttacaagtgacagcatggaagagggggaaatcaccagcgatgatgaagagaagaacaagcagaacaaaaccaaaacacaaacttcagactcatccgagggcaagactaaaagtgtgcgacacgcgtatgtgcacaaaccttacctttactcaaagtattattccgactcagacgacgaactcaccgtagaacagcggagacagagcatcgccaaggagaaagaagagcggttactacgacgccagatcaatagggaaaagcttgaagaaaaaagaaaacagaaggccgagaaaacaaagtcatcaaaaactaaaggacagggcaggtcttccgtggacctggaagagagctcaacaaaatcccttgaacccaaagcggctcgcattaaggaggtgttaaaggaacgcaaggtgctggagaagaaggtggctctgtcgaagaaacgaaagaaagatagccggaatgtggaggaaaattccaaaaagaaacagcagtatgaggaagattctaaggagacgttgaaaaccagtgaacactgcgagaaagaaaagatctcatctagcaaggaactgaagcacgtgcacgcaaagagcgagccctctaagcctgctcggaggctgtctgaatccctgcacgtggtggatgaaaacaagaacgagtccaagcttgaacgggagcacaagcgaagaactagcacacctgttatcatggagggcgtccaagaggagaccgatacaagggatgtgaagcggcaagtggaacggtcagagatatgtacagaggagcctcagaaacagaagtctactctcaagaatgaaaaacacctgaagaaggacgacagtgaaacaccccacctgaagtccctgctgaaaaaggaagtcaaatcttccaaggaaaaaccagaaagagaaaaaaccccaagtgaggacaaactgagcgtgaagcataaatataaaggggattgtatgcacaagactggggatgagacagagctccattcttccgagaaaggattgaaagttgaagagaacattcaaaagcagtctcaacagacaaagctgagctccgatgataaaaccgagcgcaagtcaaaacaccgaaatgagagaaaactgagcgtgttaggcaaggacgggaaaccggtatctgaatacataattaagaccgatgagaatgtcagaaaggaaaacaataagaaggaacgacgactttccgccgaaaagacaaaggctgaacataagagtaggagatctagcgacagcaaaatccaaaaggacagcctcgggtccaagcagcacggcattacgctacagcgcaggagcgaatcctattccgaggataagtgtgatatggactcaaccaacatggattccaacctgaaaccggaggaagtggtgcacaaggagaagcggcgaaccaaaagtttgcttgaggaaaaactggtgctgaagagcaaaagcaagacacaggggaaacaggtcaaagttgtggaaaccgagctccaagagggggctaccaagcaagcaaccacccctaagcccgataaagagaagaatactgaggaaaacgactccgaaaaacagaggaagtcaaaagtcgaagacaagccttttgaggaaaccggtgtcgaacctgtgctggagactgcctcaagctctgcccattccacacaaaaagattcgtcccaccgggcaaaacttccactggccaaagaaaagtataagtcagataaggactcaacgtccaccaggttggaaaggaagctgagcgacggacacaagtccaggtccctgaaacattcctcaaaagacattaaaaagaaggatgaaaacaagagcgacgataaggacggcaaggaggttgactctagccacgaaaaagcaaggggtaactcctccttaatggagaagaaactgagtagaaggctctgcgagaatcggcgaggtagtctcagccaggagatggctaaaggggaggagaaactggctgccaacactctgtccaccccgagtggctctagcctgcagcggcctaaaaagtctggagatatgaccttgattccagaacaggagcctatggagattgattctgagcccggtgtggagaacgtcttcgaagtttccaaaacccaggacaaccgcaataataattcccagcaggatatcgactctgagaacatgaagcagaaaacctcagccacagttcagaaggatgaactcaggacatgtacagcagattcgaaagccacggcaccggcatataaacccggtcgtgggacaggagtcaactctaacagcgaaaaacacgctgatcataggtcgacgcttaccaaaaaaatgcacatccagtcagctgtttctaagatgaatcctggcgagaaagaaccgatccatagaggcacaacagaagtgaacattgatagtgagaccgtgcaccgaatgctcctgagtgccccttccgagaatgaccgggtgcagaagaacctgaagaacacagctgcagaagagcacgtcgctcagggtgatgctactctggaacactcgaccaatctcgattctagcccctctttgagctctgtgaccgtcgtgcctttacgagaatcgtacgatcccgatgtgatccccctgttcgataagcggacagtcctcgaggggagcacagcatccacttcgcccgcagaccattcagctttgcctaaccagtccctgaccgtgagagagtcagaagttttgaagaccagcgactctaaagaggggggtgaaggatttactgttgacacccccgcaaaggctagcattacaagtaaacggcacataccggaggcacaccaggctactctcctggatggcaagcagggcaaagtgatcatgccactggggagcaagctgacaggggtgatcgtcgagaacgagaacatcactaaagaggggggtttggtcgacatggccaagaaggagaacgatctgaatgcggagcctaatctgaaacagaccattaaggccacagtggagaacggtaagaaggacggtattgcagtggatcacgtggtcggacttaatacagagaaatacgcagagaccgtgaagctgaaacacaaacggtcacccggtaaagtcaaggatatctcaatagacgtggagcgacgaaacgagaatagtgaggtcgacacctctgcagggtccgggtctgccccttctgtgcttcaccagcggaatggtcagaccgaagacgtagcaacaggcccacgcagggccgagaaaacttccgtggctacctctaccgaaggcaaagataaagatgtcactcttagtccagttaaagccggaccagctacaactacttcaagtgaaacacgccagtcagaagtcgctctcccctgcacaagtatagaggctgacgagggcctaatcattggcacacactcccgaaataaccccctccacgtcggcgctgaggcttccgagtgcactgtgttcgccgctgccgaggaaggtggcgctgtcgtgactgaggggtttgccgaatccgaaaccttcctgacgagtactaaagagggtgagagtggagagtgcgctgtggccgagtctgaggaccgcgcagccgacttgctcgcggtgcatgcggtgaagatcgaagcaaatgtgaatagcgtagttactgaggagaaagacgatgcagttacttccgccggttcagaggaaaagtgtgacggctctctgagtagggactctgagatcgtggaaggaaccataacctttatatccgaggtggagagtgatggggctgtcacatccgcgggaactgaaatacgtgctggctccatatcttctgaagaagtcgatggctctcaggggaatatgatgcgcatggggccaaagaaggagacagaggggaccgttacatgcactggagccgagggcaggagcgataactttgttatttgttcggttaccggggcaggcccacgggaggagagaatggtgaccggagcaggagtcgtactcggcgataacgatgctcctccgggtacatctgcttcccaagaaggcgacggatccgtcaacgacggcacagaaggagaatcagccgtaacatcaacaggtataaccgaggacggcgaaggacctgcttcctgcactgggtccgaggattcctcagaaggattcgctatttcaagtgaatcagaagagaatggagaatccgctatggatagcaccgtggcgaaggaggggacaaacgtaccgctcgttgcagccggtccctgtgatgacgagggcattgtcacttctacaggtgccaaagaggaggatgaagaaggagaagatgtggtgacgagcaccggcagaggaaacgagattggacatgcctcaacatgtacaggactgggtgaagaaagtgagggcgtgttgatctgtgagtcagctgagggggatagtcaaataggaaccgttgtcgagcacgtagaggctgaagccggtgccgcaatcatgaacgctaacgaaaataacgttgattccatgtctggtaccgagaaagggtcaaaggatactgacatttgttcatctgccaagggcattgtggagagtagcgttacctctgctgtaagcggaaaagatgaggtgacccctgtccctggtggctgcgagggcccaatgacctcggccgctagtgatcagtctgactctcaactggaaaaggtggaagacaccacaatcagtaccggtctggtgggtggatcttatgatgttctcgtgtccggggaggttccagagtgtgaagtcgcgcacacttccccttcagagaaggaagacgaggatatcatcacatctgtagagaacgaggaatgcgatggcctgatggccaccaccgcctcaggggatatcacaaatcagaacagtttggcgggtggcaagaatcagggaaaggttcttattatcagcacaagtacaaccaatgactacacaccgcaagtcagcgctattaccgatgtggagggtggactatcagacgctttacggacggaagagaatatggaaggtaccagagtgactaccgaagagttcgaagcgcctatgccttctgccgtgtcaggtgatgactctcaactcacagcttcacgctcagaggagaaagatgaatgtgccatgataagcacatctattggcgaggagttcgaactgcccatcagtagcgctacaacgataaagtgtgctgagagtttgcagccagttgctgctgcagtggaagagcgcgcaacaggccctgtgttgatctcaaccgctgacttcgagggacccatgccatccgccccacccgaggccgaaagtccactggcctccacttcaaaagaagaaaaggatgaatgcgccttgattagcaccagcatcgccgaggagtgcgaggcctcagtgtccggcgtggtggtggaaagtgaaaacgaacgggctgggacggttatggaggagaaagacgggagcgggatcattagcacttcatctgtagaggactgcgaggggccagtcagctcggccgtcccacaggaggagggggatccgagcgtaacgccagctgaggagatgggagataccgccatgatctcaacatcaaccagcgaaggctgtgaggccgtgatgattggggcagtacttcaagatgaggacaggttaaccatcactagggttgaagacctgtccgatgccgctataatttcgacgtctacagccgagtgtatgcccatctctgcctctatcgaccggcacgaagaaaaccagctcacagctgataaccccgagggaaatggggacctcagcgctacagaggtttctaagcacaaggtccctatgccaagcctgatcgctgagaataactgtcgctgccctggacccgtcagaggcggtaaggagcccggaccagtgctcgctgtgtctacggaggaaggccataacggtccttcagtgcacaagccaagtgcgggacaaggacatccgtccgctgtgtgtgctgaaaaagaggaaaagcacggtaaagagtgtcctgagatcgggccttttgccggtcggggtcagaaggagtcgacactgcatctaattaacgccgaagaaaaaaatgtgttattgaacagcctgcagaaggaagataagagtcctgagacaggcactgctggtgggtcctccactgcatcctactctgccggacgtggactggaggggaatgccaattcccccgctcacctccgcggacccgagcaaacttccggacagacagccaaggatccgtctgtgtcaatacgatatctggcggctgtgaataccggcgctatcaaagcggacgacatgcctccagtccaggggaccgtcgcggagcacagctttcttcccgctgagcagcaggggagcgaagataacctgaaaacgagcaccaccaagtgcatcaccggccaggaatccaaaatcgctccttctcacactatgatcccaccagccacttatagcgtcgccctcctcgcgccaaagtgtgagcaggatctcacaattaagaacgattacagcgggaagtggacagaccaagcatcagccgagaaaacgggcgacgacaacagcacccgcaaatccttccctgaagagggggatataatggttaccgtttcctctgaggaaaatgtgtgtgacatcggtaatgaggaaagtccactcaatgtgctcggcggactaaaactcaaagccaatctgaagatggaagcgtacgtccccagcgaggaagaaaaaaacggagagatcctagcgcctcctgaatcactctgtggtgggaaaccctcgggcattgctgaattgcagcgagagcctttgcttgtgaatgagagtctgaatgtggaaaacagcgggtttagaactaacgaagaaattcacagtgagagctataataagggcgagatctcctccgggcgaaaggataatgccgaagcgatttctggccactccgtagaggccgacccaaaagaggtcgaagaggaggaacgacatatgccaaagcgcaagcgtaaacagcactaccttagcagcgaggacgagcccgatgacaatcctgatgtattggactctcgcatagagaccgcccagcggcaatgccccgagacggagcctcacgataccaaagaagagaattctcgtgacctggaggagttgccaaagaccagcagcgaaactaatagcacaacatctcgggtaatggaggaaaaagacgaatactccagctccgagaccaccggggagaaacctgagcaaaacgatgacgatacaataaagagtcaggaggaagatcagcctatcatcatcaagagaaagcgtggaaggccacgcaaataccctgtcgaaaccaccctaaaaatgaaagacgactctaagacagatactggaattgtgaccgtggagcagtcaccctcttccagtaagctcaaggtgatgcagacagatgaatctaataaagagaccgctaatctacaagaacggagcatcagcaacgacgatggcgaagagaagatcgtaacctccgtaagaagaaggggaagaaagcccaagcggagcctgacagtatccgacgatgcagaaagctctgagcctgagcgtaagagacagaagtccgtgtccgatcctgtggaagataaaaaagaacaggagagcgacgaagaagaggaggaggaggaggaggatgaaccttcaggcgctaccacccggtctacaacccgctccgaagcccagcgaagtaagacccaactttcccctagtataaagcggaaaagggaggtgtcccctcccggagccaggactcgcggtcaacagagggtggaggaggctccagtgaagaaagccaagagataa

SEQ ID NO: 53317 - DNA, 519 bp, Artificial Sequence
  Description of Artificial Sequence: Synthetic coding sequence
atggccgatggcggaggtggtggctcagggggagcgggtcctgctagtaccagagctagtgggggaggagggcctataaacccggcttcactgcccccaggggacccccagctgatcgcaatcattgtgggacaacttaagtcaaggggcctgttcgactcgtttagaagggactgtaaggccgatgttgacactaagcctgcttaccagaatttgtctcagaaagctgacaatttcgtgagtactcatctggataaacaagaatggaatccccctgccaacgataatcagctgcatgatgggctccggcagagtgtcgttcaaagtggtcgctccgaagcaggagttgaccgtatctctagccaggtggttgaccctaagctgaaccacatttttaggccccagatcgagcagatcatccacgaatttctcgttgctcagaaggaggcagccgttcccgctctcccaccagagccggagggacaggacccgcctgccccttctcaggatacttcctag

SEQ ID NO: 53318 - DNA, 414 bp, Artificial Sequence
  Description of Artificial Sequence: Synthetic coding sequence
atgctctccgggcgtttggtcctgggcctggtcagtatggcaggacgcgtctgcctttgccagggctcagctggaagcggcgcaatcggtcccgtggaagcagccataaggacgaaactggaagaggcgctctcacccgaggtgctggagctcagaaacgagagcggcggacacgccgtaccgcctgggtctgaaacccatttcagggttgctgtcgtgtctagtagatttgagggcctttccccacttcaacgacacaggttagtgcatgctgcactagcagaagagctggggggtcccgtgcacgccctggctattcaagccaggacacccgcacagtggagagaaaatagccagctggacacgtcccccccatgcctggggggaaacaaaaaaaccttgggaacgccttag

SEQ ID NO: 53319 - DNA, 459 bp, Artificial Sequence
  Description of Artificial Sequence: Synthetic coding sequence
atggcaagtgctaaaagtctggaccggtggaaggcacgcctgctcgagggtgggtccaccgccctcacctacgcccttgtgcgcgctgaagtgagcttcccggcagaagttgcccctgtacggcagcaggggtctgtggccggagcccgagcaggcgtagtgtctctgcttggatgcagaagttcctggacggccgctatggaactgagtgcagaatacctccgggagaaattgcagagggatcttgaggccgagcatgtcgaggtcgaggataccacacttaacaggtgcagttgctcctttagggtgctggtggtcagcgccaagttcgagggcaagcccttgctacagcggcatagactagtgaacgcttgtcttgcagaagaactgcctcatattcacgcttttgagcagaaaacactgacccccgaccagtgggccagagagcggcagaaatag

SEQ ID NO: 53320 - DNA, 1593 bp, Artificial Sequence
  Description of Artificial Sequence: Synthetic coding sequence
atgacctcaagcctgcagaggccttggcgcgttccctggctgccttggactattctcctcgtgagcaccgccgctgccagccaaaaccaggagcgcctttgcgctttcaaggatccataccagcaagatctgggcattggagaaagcagaatttcgcatgaaaacggaactattctgtgctccaaaggctccacctgttacggcttgtgggaaaaatccaagggtgacatcaacctggtaaaacaggggtgttggtcccatatcggagatccccaggagtgtcattacgaagagtgcgtggtgacaacgactcccccttctatccagaacgggacttatcgattttgctgctgttcaaccgacttgtgcaacgtgaatttcacagagaatttcccccctccagataccacacctctcagcccccctcactcatttaaccgggacgagaccattattattgcactcgcgagtgtctcagtgttagccgtactgatcgtggccctttgctttggttatcgcatgttaaccggggataggaagcagggcctccattccatgaatatgatggaggccgcagcatcagagcctagtctcgatctggacaacctgaaactcttggaactgataggacgtggaagatacggtgcagtatacaagggcagtctggacgagcgtccggttgcagtcaaggtgttttcttttgccaatagacagaatttcattaacgagaagaatatctacagggtcccactcatggagcacgataacattgccagattcatcgtcggagacgagcgcgtaacagctgacggccgtatggagtatttgctggtcatggaatattacccaaacgggagtctatgcaagtatctatctttgcacacgagcgattgggtgtcaagctgtcgcctggcacacagcgtgacacgcggactagcatacctccatactgagctgccccgtggagaccactacaaaccagcaatttcgcacagggacctcaatagccgcaacgtgctggttaagaatgatggaacttgcgtgatttctgatttcgggctatctatgcggctcaccggaaatagactcgtaaggccaggagaggaggataatgcggcaatttctgaagtgggaacaattaggtatatggcgcctgaggtgctcgagggagccgtgaatctgagggactgtgagtcggccctgaagcaggtcgatatgtatgccttgggcttgatatattgggaaattttcatgcgctgcacagatttgtttcccggagagtccgtccccgagtatcagatggcgttccaaaccgaggtagggaaccatccaacattcgaagacatgcaggtcctggtgtctagagaaaaacaacggcctaagtttcctgaggcttggaaggagaacagcctggccgtcagatcactgaaggaaaccattgaagactgctgggatcaggacgcagaagccagactgacagcccaatgcgccgaggagagaatggccgagttgatgatgatatgggagcgcaacaagtccgtctcaccaactgtgaaccctatgtccaccgcgatgcagaacgagagacgctag

SEQ ID NO: 53321 - DNA, 1470 bp, Artificial Sequence
  Description of Artificial Sequence: Synthetic coding sequence
atgaataaacttagccctgtgctcctgtttctaaaccagcagaattaccagatcgataaagatgtggaggacaaaaggcagaaggcaatagaagagttcttcacaaaagatgttatagttcccagcccttggaccgaccacgagggcaagcagttgagccaatgccacagcagcaagtgcacgaacataaactccgactccccagtaggaaagaagttaaccatccactccgaaaagtcagatgccgcatgtcaaaccctgttgagcctccccgttgattttaacctggaaaacattctaggggactacttccgcgctgatgaatttgccgaccagtctcctggcaacctgtctagctcttccctgaggcgtaaactgtttctcgatggaaatggaagcatatccgactctcttccctcagcttccccgggatcaccccatagcggagtgcaaaccagcctggagatgttctattcaattgatctttctcctgttaagtgtcggtcgcctcttcagacaccatcatcaggtcagttttccagtagcccgattcaggcatccgccaagaagtattccctcggttcaatcacgagtccatcaccaatctcttcaccgactttctctccaatcgagttccagattggcgagaccccgttgagcgaacagaggaagtttaccgtgcattcaccggatgcttctagcggtaccaattcgaacggcatcaccaacccttgcatcagatccccctacattgacgggtgtagtcccatcaagaattggagtcccatgcggttgcagatgtattctggtggaacacagtaccggacttcagtaatccagatccccttcacccttgagacccagggtgaggatgaggaagataaggaaaacataccttcaacggacgtgagttctcccgctatggacgccgcaggcatacacctcagacagttcagcaatgaagcttctacacacgggacgcaccttgttgtgaccgcgatgagtgttactcagaatcagagttctgctagcgagaaggaacttgctctactacaggatgtggagcgtgagaaggataacaacacagtggatatggtggatcctattgagatcgctgatgaaactacatggattaaagaaccagtcgacaatggatctctccctatgacagatttcgtgtctggtatagccttctcaatcgaaaactctcacatgtgtatgagcccgctcgccgagtcctccgtgattccatgcgagtccagcaatatccagatggattccggctacaatactcagaactgcggaagcaatatcatggacacagtcggcgctgagagttactgcaaggagtcagatgcacaaacatgcgaggttgaatcaaaatcgcaggccttcaacatgaagcaagaccacaccactcagagatgctggatgaaaactgcttctcccttccagtgcagctccccttag

SEQ ID NO: 53322 - DNA, 1680 bp, Artificial Sequence
  Description of Artificial Sequence: Synthetic coding sequence
atgggggacgtgaaggagagtaagatgcagattaccccagaaacgccgggtcggataccggtcctcaacccttttgaaagcccatcagactatagtaatctgcatgaacagaccctggcttcaccctcagtgttcaaaagcactaagctgccgacgcccggaaaatttcgctggtcaatcgatcaactggccgtgatcaaccctgtggagatcgacccagaggacattcacagacaagctctctacctgagccactccaggatcgataaggatgtggaggataaaagacagaaagccatcgaagagttcttcacaaaagatgtgattgtgccaagcccctggactgaccacgaggggaagcagctgtcccaatgccatagctcgaaatgtaccaacattaatagtgacagccctgtgggtaagaaattaacgatccactctgaaaaatccgatgcagcttgccagaccctgctttcccttcccgtggactttaacctggaaaacattctaggagattacttccgcgcagatgagttcgctgatcagagccctgggaatctgtctagcagctctctgcgccgaaagctgtttctagacgggaatggatccatcagcgactccctacctagcgctagtcccggatctcctcatagcggtgtacagaccagcctggaaatgttttattcaattgacctgtctcctgtgaagtgccgctctccactgcagacgccctcaagcggccagttctcgagcagccctattcaagcaagcgctaagaaatactcacttggctcaataaccagtccgtcccccattagctctcctacctttagccccatcgagttccagatcggagaaacacccctctccgaacagcggaagtttactgtgcatagtcccgatgccagtagtggcaccaattctaacggtatcaccaatccttgcattagatctccatatattgacggatgtagtccaatcaagaactggtctcccatgagactgcagatgtactctggaggcacccaataccggaccagcgtgattcaaatcccctttacactggagacccaaggcgaggatgaagaagacaaggagaacataccgagtacagacgtttcgagtccagctatggatgccgcaggtatccacctccgtcagttttctaacgaagcctccacccatggaacacatttagtcgtaactgctatgtctgtcacccagaaccagagctctgccagcgaaaaggaactcgctctcctgcaggatgtggaacgtgagaaggacaacaacaccgtagatatggtggatcctattgagattgccgatgagacgacgtggatcaaagagcccgtcgacaatggctctctcccaatgaccgactttgtgtcaggcattgcattttctattgagaattcccacatgtgtatgtcaccactcgcagagtcatctgtgatcccatgcgaatcctccaacatacagatggatagtgggtataatacgcagaactgtggcagcaatattatggatactgtgggtgctgagtcctactgcaaggaatctgatgcgcagacctgcgaggtcgaatcaaagtctcaggcatttaacatgaagcaggatcataccacacagagatgctggatgaaaaccgcctctcccttccagtgcagcagcccatag

SEQ ID NO: 53323 - DNA, 2007 bp, Artificial Sequence
  Description of Artificial Sequence: Synthetic coding sequence
atgacttctactggaaaagacggcggagcccaacatgcccagtatgtcggtccctaccgattggaaaagaccctggggaaaggccagaccggactcgtaaaactaggggttcactgcgtgacttgtcagaaggtggccatcaaaatcgtcaaccgagagaaactgagcgagagcgtcctcatgaaagttgagcgcgagatagccattctgaagctgattgaacacccccatgtcctgaaactccacgacgtgtacgagaacaagaaatatctgtacctcgttttggagcacgtgtccggaggagaactttttgattatcttgttaagaagggcagactaaccccgaaagaggctcgaaagttctttcgtcagattatttccgctctcgatttctgccatagtcacagcatatgtcatagggatctgaagccagaaaacctccttttagatgagaagaacaatatacggattgcagactttggcatggcatccctgcaggtgggcgatagcttgctggaaacatcctgcgggagtccgcactacgcgtgtccagaagtcatccgtggagagaagtacgacggcaggaaggcagatgtctggtcatgtggcgtcatattgtttgctctcctggttggcgctttaccatttgacgatgataacctcaggcagctactagagaaggtgaagcgcggtgtgtttcacatgccacacttcattcccccagactgccaaagtctgctgcgaggaatgattgaggtagacgccgctagacgcctaacgctcgaacatattcagaagcatatttggtacataggcggaaaaaacgagccagagcccgagcaacccattcctcgaaaggtccagatcagatcgctgccatccctggaggacattgaccccgatgtgttagacagcatgcactcactgggctgcttcagggacagaaataaacttcttcaggacctcctctctgaggaggaaaatcaggagaaaatgatttattttctcctactcgacaggaaggaaagatatcccagtcaagaagatgaagacctgccccctaggaatgaaatagaccctccacgcaagagggtagatagtccgatgcttaaccgacatggcaaaaggcgacctgaacggaagagcatggaagtcctttctgtgactgatggcggaagtcccgtgccagccaggcgcgctatcgaaatggctcagcatggacagcggtctcgttccatctctggcgcatccagtggcttatctaccagcccgttatcatcccctagagttacacctcatccctctccaagaggatctcccctgcccactccaaaaggaacaccagtacacacccccaaggagtccccagcgggaactcctaaccccactccaccttcctccccatctgttggcggtgtcccgtggcgcgctcgcttgaactcgatcaagaactcctttttgggctctcctaggtttcaccgccgaaaactgcaggtgcctactcccgaggaaatgagcaacctaacccctgagagctctccagagctggcaaagaaatcctggttcggtaattttatctcgttagagaaagaggagcagatcttcgtggtcatcaaggacaaacctctctcaagtattaaggccgacatcgtacacgccttcctgtccatcccgtctctttcccattctgttatctcccagacatcttttcgtgccgagtacaaggcaaccgggggtcctgcggtcttccaaaaacccgttaagtttcaggtggacattacttatacagaagggggagaggcccagaaggagaacgggatctattctgtcaccttcacactgctttctgggccatccaggcgtttcaagagggtcgttgaaactattcaggcccagctccttagcactcacgatcctcccgcagctcagcatctgtccgatactacaaactgcatggagatgatgactgggagactgtcaaagtgtgggatcattcccaaatcttag

SEQ ID NO: 53324 - DNA, 2091 bp, Artificial Sequence
  Description of Artificial Sequence: Synthetic coding sequence
atgacatcaaccggtaaggatggaggcgcacagcatgctcaatatgtgggcccttaccgcctcgaaaagacactgggcaagggacagaccggcctggtaaaattgggtgtgcactgtgtgacatgtcagaaagtagccatcaagatcgttaaccgggaaaagctgtctgagtccgtccttatgaaggtggaaagggaaattgcgatccttaagctgattgagcacccgcatgtcttgaagctccatgacgtttacgagaacaagaagtatctctacctcgtgctcgagcatgtctctggaggcgagctgttcgactaccttgtgaaaaaaggacgcctgaccccaaaggaagcacgcaaattctttcgtcaaattatctcagcgctggatttttgtcactcccattcaatttgccacagagacttgaaacccgaaaatctactgttggacgagaaaaataatatcagaatcgccgacttcgggatggcctctctgcaggtgggagactccctactggagacttcttgtggatcaccccattacgcctgtccagaggtgatccggggtgaaaagtacgatgggagaaaggctgacgtttggagctgcggcgtcatcctttttgccctccttgtcggcgctctaccgttcgacgatgataatctgcgtcagttactggagaaggtcaaacgaggagtttttcatatgccccacttcattcctccggattgccagtcgctgctgcgagggatgatagaggtggacgccgctaggaggcttacactggagcacatccagaaacacatttggtatatcggtgggaagaacgagcctgagccagaacagcctataccacgcaaggtacagatccgaagtctcccctccctggaagatattgatccggatgtcctggattctatgcacagcctcgggtgctttcgcgaccggaataagctgctccaggacctcttaagcgaggaggagaaccaagaaaagatgatctactttctgctgcttgatagaaaggaaagatatccgtcacaggaggatgaggacctgcctcccaggaacgagatcgaccctcccaggaaacgggtcgactcccccatgctcaacagacacggcaaaagaaggccagagcggaaaagcatggaggtgctgagtgtaaccgacgggggaagccctgtgcctgctcgccgtgccattgaaatggcccagcatggccagtcaaaagctatgttcagtaaatcactggatattgcagaggcacatccgcagttttctaaggaagatagaagcaggagtatttccggtgcctcatctggcctctccacttcaccactgtccagtcctcgtgtcacaccccacccatcccctcgtggcagccccctcccgacaccaaaaggaacgcccgtgcacactcctaaggaaagcccagctggtacgcctaatcccaccccaccctcctccccttccgttggcggtgtcccttggcgggctcgtctaaactccatcaagaattcatttctgggatctccccgatttcacagacgcaaactccaagtgcccaccccggaagagatgtccaatttgacccctgaaagcagccccgagctcgctaagaagtcctggtttggcaactttatatcccttgagaaggaagaacaaatttttgtcgtgatcaaagataaacctttgtccagtatcaaggcggacatcgtccacgcatttctgtcaattccttcgctcagtcactccgtgatctctcagactagcttcagagccgaatacaaggctaccggaggccctgccgtgtttcaaaagccagtgaaatttcaggtcgacattacgtacacagaggggggagaggctcagaaagagaacggaatttactccgtgacctttactcttctgagcggcccttcccgcagatttaagagggtggtagagacaatacaggcccagctgctgagcacacacgatccacccgcagcacagcacttgagtgagcctcccccaccagcccctggactgtcctggggtgccggactgaagggacagaaggtcgctaccagctacgagagttccctctag

SEQ ID NO: 53325 - DNA, 2301 bp, Artificial Sequence
  Description of Artificial Sequence: Synthetic coding sequence
atgagccccgaaggccatccctcaaggtgggccagaccacgtcggccttgtatctgtcccagctctctgtgctcgcccagagaaccacgctctggcccagctgtagggagaggaggtgcagcgcaccacagagtgcctgccggacataccccgggtccccaactgctccagcctcatcttcatttgccccagggtcagacctggctctgtctccagccaagccctgcagggctggtaaagcttggtgtccactgcgttacctgccaaaaagtcgctatcaagattgtgaaccgggagaaactctccgagagcgtgctgatgaaggtagaacgggagatagccatactgaaattaatcgagcacccgcatgtgctgaaactgcatgatgtgtacgaaaataagaaatacctttatttagtgctggaacacgtatcaggcggtgaattgttcgactacttagtgaaaaagggaagattgactcctaaggaggctaggaagttctttcgacagattatctcggcattggatttctgtcacagccattcaatatgccacagagaccttaagccagagaaccttctgcttgacgagaaaaataacattcggatcgccgacttcggcatggcctctcttcaagtgggtgactccttattggagacatcctgtggtagtcctcactacgcttgccctgaggttattaggggcgaaaaatacgacggacgaaaggctgatgtgtggtcatgcggagtgatcttgttcgctctcttggtgggcgctctgcctttcgacgatgacaatctccgacagctcctagaaaaggtgaaacgaggcgtgttccacatgccccatttcattcctcctgattgccagagcctgcttcggggaatgattgaagtggacgccgctagacggcttactctcgagcatatccaaaaacatatctggtatattggcggaaaaaatgagccagagcccgaacagcccattcccaggaaagtgcaaatccgttcccttcccagcctggaagacatcgatccagacgtcctggacagtatgcactccctcgggtgcttccgcgacaggaataagcttttacaggaccttctcagcgaagaagagaaccaggagaagatgatttatttcttactgctggatcgcaaagagcgatatccctcgcaggaagacgaggatctgccgccacgaaacgaaatcgacccacctagaaagcgggtcgacagtccaatgctgaatagacatggaaagcgccgacccgagcgcaagtccatggaggtcctgtcagtgaccgacgggggatccccagtccctgccagacgggcaatcgaaatggcccagcacgggcagaggagccgctcaatcagcggtgctagctctggcctctccacctctcctctgagttcgccacgagtcacacctcatccgagcccaaggggcagcccactgcccacccccaaagggaccccagtgcacactcctaaagagagcccagcagggacccctaatccgactcccccttcttctcctagcgtaggaggggtgccctggcgagccagactgaattccattaaaaatagtttcttggggagtcccaggtttcaccgaagaaagttgcaggttccgaccccggaagagatgtctaatctcacacctgagagctcacccgagctcgcaaagaagtcttggtttggcaattttatcagcctggaaaaggaagaacagatctttgtcgtgattaaggataagcccctgtcttccatcaaagccgatattgttcatgcatttctgtcaattccttcactgtcccactctgtgattagccagacctcctttcgcgcagagtataaggccactggaggccctgctgtgttccagaagcctgtgaaatttcaggttgacatcacttacaccgaaggcggagaagctcagaaggagaacgggatttacagcgtgacttttacccttctatctggcccttcccgccgattcaagcgcgttgtagaaaccatccaggcgcagctcctaagtactcatgaccctccagccgctcaacacctttctgataccacaaattgcatggagatgatgaccgggcgtttgtccaagtgcgacgaaaagaacggccaggcagcccaggcaccatccacccctgccaaacgatcagcgcatggcccactgggagactctgccgctgccggaccgggtccaggtggagatgctgagtaccctactggaaaggataccgcaaagatggggcctccgaccgctcgtcgggagcaaccatag

SEQ ID NO: 53326 - DNA, 2091 bp, Artificial Sequence
  Description of Artificial Sequence: Synthetic coding sequence
atgacatctactgggaaggacgggggtgcccaacatgcccagtatgtcgggccatatcgactagagaaaacactaggcaaaggtcagacaggcctagtgaaactcggagtgcactgcgtgacctgccaaaaagtcgctataaagattgtcaacagagagaaactcagcgaatccgtactgatgaaggtggaacgggagatcgcaatcctgaagctgattgagcatccacacgttctgaaactgcacgatgtgtacgaaaataaaaagtacttgtatctggttctagagcatgtttctggaggcgagcttttcgattatcttgtgaaaaagggaaggctgaccccaaaagaggcccgaaagtttttccgccagattatctcggcactcgacttctgccactctcatagcatatgtcaccgggacctgaagcccgagaatctgctgctggatgagaaaaacaacattcgcatagcagacttcggcatggcctcgctgcaggttggagatagcctgctagaaacatcatgcgggagtccccattacgcatgccctgaagtcatccgaggagaaaagtacgacggacgtaaggccgatgtctggtcctgtggcgtgatcttgttcgctctcttggtaggagcacttccctttgacgatgacaatctccgtcagctgctagaaaaagttaagagaggcgtctttcacatgccgcattttattccgcctgattgccagagtctgctaaggggtatgattgaagtggacgccgctagacgcctcacactggagcacattcagaaacacatctggtacatcggtggaaagaatgagcccgaacctgagcaaccaatcccgaggaaggtgcaaatccgttcactgccttccttggaggatatcgatcctgacgttttagactcaatgcatagcctcggctgctttcgagaccggaataagctgttgcaggatctccttagcgaggaggagaaccaagaaaagatgatttacttcctactcctggatcgcaaagagagatacccaagccaggaggacgaggacttacccccacgcaatgagatcgacccaccgcgtaagcgggttgacagccctatgctaaacagacatggtaaacgtcggccagagcggaaatcaatggaagtcctgtctgtgactgacgggggatcacctgtacctgcgagacgcgctatcgagatggcccaacacggccagtccaaggccatgttttctaaatcactcgatatagccgaggcgcacccccagtttagtaaggaggaccgaagtcgcagcatttctggcgcttcttccggactgtccacaagtcccctgagttcaccaagggtcacaccacacccgagcccgaggggatcacccctgccaactcctaaaggcacgcctgttcacacacccaaggaaagtcctgcaggcacacccaacccaacgcctccgtcttcacccagcgtaggtggcgtgccctggcgagctcgactgaactccataaaaaacagctttctgggatcacctcgtttccaccggcgaaaactgcaggtcccaacccccgaggaaatgagtaaccttacacctgaaagcagccccgagttagccaagaaaagttggttcggcaacttcatctccctcgagaaagaggagcagatttttgttgtaataaaggacaagcctttgtcatccattaaagccgacattgtgcatgccttcctctcaatcccttcgctaagccattctgttatatcacagacctcttttcgggctgaatataaggcgaccggaggtccagctgtgtttcagaagccagtgaagtttcaggttgatattacatacacagagggaggcgaggctcagaaggagaatggaatatactctgtcacgtttaccttgttaagcggaccatctagaaggtttaagcgtgtcgttgaaaccattcaggcccagctgctgtccactcatgatccccctgctgcgcagcacctctccgagccacccccaccagcaccaggtttatcttggggtgccggtctaaagggtcagaaggtagccacctcttatgaaagttccctgtag

SEQ ID NO: 53327 - DNA, 2211 bp, Artificial Sequence
  Description of Artificial Sequence: Synthetic coding sequence
atgaccagcacgggcaaagacggcggtgcacaacatgcccagtacgtcggaccatacagactggagaagacattggggaagggccagactgggctggtcaaacttggagtgcattgcgttacctgccagaaggtagccattaagatcgttaatcgcgagaagctgtccgagtctgttcttatgaaggtggaacgcgaaattgcaatcctgaagttgattgagcacccacacgtgctaaagcttcacgacgtttatgaaaataagaagtatctatatctggtgcttgaacatgtatccgggggtgaactttttgattacttagtgaagaagggaagactgactcctaaggaagctaggaagttctttcgccaaataatctctgccctggatttctgtcattcccattctatttgtcacagggatctcaagcctgaaaacctgctgctcgacgaaaaaaacaatatccggatcgctgactttggaatggctagcctacaagtgggtgactctctccttgagaccagttgcggtagccctcactacgcctgtcccgaagttatccgtggcgagaagtatgacggccgaaaagctgatgtctggagctgcggcgtgatcctattcgccttgctagtgggagctctgccattcgacgatgacaatttgcggcaactgctcgaaaaggttaaacggggtgttttccatatgccacatttcatccctcccgactgccagtccttattaagaggcatgatcgaagtcgacgctgcaaggagactgacactggagcatattcagaaacacatctggtatatcgggggtaaaaacgagccggaacccgagcaacccatccctcgaaaggtgcagattaggtcattaccaagtctggaggacatagatccggacgtgttggattctatgcactctctgggttgctttcgggatagaaataaacttctgcaagacctccttagcgaggaggagaaccaggagaaaatgatatatttcctccttctcgaccgcaaggaacgatatccctcccaggaagacgaagacctgccccctcggaatgaaatcgacccgccacggaagcgtgtagactcccctatgctgaaccgtcatggcaagcggcgacccgaacgtaagtcaatggaagtgctttccgttacagatgggggaagccccgtacctgcccgtcgcgcaatcgagatggcgcagcacggacagcgttcccggtccatctctggagcctcaagtggactgtcaacaagtccactgagtagcccgagagttactccacacccctctccccgaggcagcccgctgccaactccaaagggtacgccagtgcacactcctaaagaaagtccagccggtacacctaacccgaccccaccttcttcaccctctgtggggggagtgccctggcgtgcgaggctgaattcgatcaaaaatagtttcctgggaagccccaggttccaccggagaaagttacaggtcccaacacccgaggaaatgtccaatctgacccctgagtcttcccccgagctggctaagaagtcatggtttggtaatttcatcagtctcgagaaggaggagcagatctttgtcgtcattaaagacaaaccgctgagttccatcaaggccgacattgtgcacgcatttctgagcatccccagcctttcccacagcgttataagccagacttcattcagagcggagtacaaagccactggaggccctgccgttttccagaaaccggtgaagttccaggtggatataacatacacggagggtggagaagcacagaaagaaaatggaatatactccgttacctttaccctcctgtccgggccatcccggagattcaagagggttgtggagacaatccaggcccagctgctaagtacccacgacccccctgctgcccagcatctgtccgatacaacaaattgcatggaaatgatgaccgggaggcttagcaagtgtggaagcccgctttctaattttttcgacgtgattaaacagctgtttagtgatgaaaaaaacggccaggcggctcaagcaccaagtacccctgctaagaggtccgcgcatgggccactgggcgacagtgcggcagcaggtccaggccctggcggagatgctgagtatcccacagggaaggatactgcaaaaatgggaccacctacagccagacgggaacaaccatag

SEQ ID NO: 53328 - DNA, 2025 bp, Artificial Sequence
  Description of Artificial Sequence: Synthetic coding sequence
atgacttctaccggtaaagacggcggagcccagcatgcccagtacgtcgggccatatcggctggagaagacactcgggaaaggtcagactggcctcgtgaagcttggagtgcactgtgtcacgtgtcagaaggtggcaatcaagatagtgaatcgggagaagttaagcgagtcagtgctaatgaaagttgaaagagaaatagccattctaaaactgattgaacacccacacgtcctgaaattgcatgacgtatatgaaaataaaaaatacctctacttggtgctggagcatgtgtctggaggagagcttttcgattacctcgttaagaaaggacgtctcactcccaaggaagctagaaaattcttcagacagattatctccgccttggatttctgtcactcccactccatttgtcatagagatctcaaacccgaaaacctgctgctggatgaaaagaataacattcgcatagctgactttggcatggccagtctgcaagtaggcgatagtttactggagacaagttgtggctccccacattacgcctgccctgaagttatcaggggcgagaaatacgacgggaggaaggcggatgtctggtcctgtggcgtcatactattcgccttgcttgtcggggcactccctttcgacgatgacaatttgcgccaactgctggagaaggtcaagcgcggagttttccacatgccgcattttatacctcctgactgccagtccctactgcggggtatgatagaggttgacgcggctcgtagactcacgctcgagcacatccagaaacacatttggtatattgggggaaaaaacgaacccgagcccgagcaacccatcccacgcaaagtccagatccgttctctgcccagtctggaagacatagatccagacgtgctggatagcatgcattccttgggatgcttcagagacaggaacaagctcctgcaggatttattgagcgaggaggagaaccaggagaagatgatctactttttgctactcgaccggaaagagaggtacccgtctcaagaggatgaggatctacctccacgcaatgagattgacccccctcgaaagcgagtagatagcccgatgcttaacagacacgggaagcggaggcccgaaagaaaatcaatggaggtgttatctgtgaccgatggagggtctcctgtacccgctcgcagagcaatcgaaatggcccagcacggccagcgaagtcgatctatctccggcgcttccagcggacttagcacctccccactgtcttcgccacgcgtaactccacatcctagcccacgcggaagtcctctcccaactcccaagggcactcctgtacacacacccaaggaaagcccagctggtaccccaaatccaactcccccaagtagccccagcgtcgggggagtgccctggagggccaggttaaattcaattaagaattcttttctcggcagcccaaggtttcataggcgaaagctccaggtgccgacgcccgaggaaatgtcaaatctgactcccgagagttcacctgagttggccaagaaatcatggtttggtaattttattagtttggagaaggaggaacagatcttcgtcgttattaaggataagcctctctcttcaattaaggccgacattgtgcacgccttcctgtccattccaagtctgagccacagtgttatttcacagacaagctttcgcgctgagtacaaagccaccggagggcctgccgtctttcagaaacccgtgaagttccaggtggacatcacatatacggagggtggcgaagctcagaaagagaatggaatctattcagtcacctttactctgttgagtggcccttctcgccgatttaagcgcgtcgtggagacaatccaggctcagttactctccactcatgatccacctgccgctcagcacctctcagagccgcctccacctgcaccgggattgtcctggggggcaggactgaaaggtcaaaaggtagccacttcatacgagtccagtttatag

SEQ ID NO: 53329 - DNA, 1110 bp, Artificial Sequence
  Description of Artificial Sequence: Synthetic coding sequence
atgcacagtctcggttgctttagggacaggaacaaactgctacaagatcttctctccgaagaggagaaccaagaaaaaatgatctattttctgctcctggatcgtaaagaacgctacccgtcccaggaagatgaagacctgcctcccaggaacgaaattgatccacctcggaaacgggtcgatagtccgatgctcaatcgacacgggaaaagacgcccagaacgcaagagtatggaggtgctatccgttactgacgggggatcccccgtccctgctcgtcgggcaattgagatggcacagcatggtcagcgcagtcgcagcattagcggcgcaagttccggcctgtctacttcacctctaagcagtccgagagttactccacacccctccccaagaggctcgccactgccaacaccaaaagggactccagtgcacacaccaaaagaatcacccgcaggcactcctaatcccactcccccttcatcaccttctgttggcggagtgccatggagggccaggctgaactctatcaagaactctttcttaggatcccctcggttccaccgcaggaagctccaggtccccacaccagaggagatgtccaacctgacccccgagtcatctcccgagctcgctaaaaagtcctggttcggtaattttatttcactggaaaaagaggagcagatttttgtggtaataaaggacaagcccctttcctccatcaaggctgacattgtgcacgccttcttgagtattccatcacttagccactccgtgatcagccagacgagctttagagccgagtacaaagctaccggcggacccgctgtatttcagaagcccgtaaaatttcaagtagatatcacttacacagagggcggtgaagctcagaaggagaatggtatctacagcgtgacctttactcttttaagcggtccctcccgaaggttcaagagggtcgttgaaacgattcaagcacaactgctgagcacccacgatccacccgcagcacagcatctgtccgagccacctccaccagctccaggactctcctggggcgcaggtctgaagggccagaaagtcgcaacctcctatgagtccagcttatag

SEQ ID NO: 53330 - DNA, 336 bp, Artificial Sequence
  Description of Artificial Sequence: Synthetic coding sequence
atggaaaacgttcccaaagaaaacaaggtggtcgaaaaagcgcctgttcagaacgaagcgccagcactggggggaggggaataccaggaacccggagggaatgtgaaaggcgtgtgggccccaccggcacccggttttggcgaggatgtgccaaacaggctggtggacaacattgatatgatcgacggggatggggacgatatggaacggtttatggaagaaatgagagagctgcggagaaaaatccgggaactgcagttaaggtactcactgaggattcttataggggacccgccacaccatgaccaccatgatgagttttgcctgatgccctag

SEQ ID NO: 53331 - DNA, 336 bp, Artificial Sequence
  Description of Artificial Sequence: Synthetic coding sequence
atggagaatgtgcctaaggaaaataaagtcgtggagaaggccccagttcagaacgaggccccagccttgggtggaggtgaataccaggaacccggaggtaatgtcaaaggtgtgtgggcccctcctgccccaggcttcggggaggatgtacccaacagactggtcgacaacattgacatgattgacggtgatggcgatgatatggagcgattcatggaagaaatgcgtgagctgcggcgtaaaatccgggaactccagctccgatacagcttgaggatactgatcggcgacccgccacaccacgaccaccatgatgagttttgcctcatgccctag

SEQ ID NO: 53332 - DNA, 2478 bp, Artificial Sequence
  Description of Artificial Sequence: Synthetic coding sequence
atggctgcaggcaaattcgcatctctgcccaggaacatgccagtgaaccaccagttcccacttgcctcttctatggacctcctgtctagccgctcgcctctggccgagcaccgacccgacgcttaccaggatgtgtcgatccacggcactctgcccagaaagaagaaggggcctcctcctatcaggagctgcgacgacttcagccatatggggacacttccccattccaagtcaccgaggcagaacagtcccgtcacccaggacggtatccaagagtctccgtggcaggatcgacacggcgagacttttacattcagggacccccacctgttggatcccaccgtggagtacgtgaaattttccaaagagaggcatatcatggatcgcactcccgagaagctcaagaaggaactggaggaggaactgttactgtccagtgaagacctgcgcagccacgcgtggtaccatggtaggattccacggcaagtgtctgagaacttagtccagagggacggtgatttcctggttcgggattccctgagcagccccggaaatttcgtgctgacttgtcagtggaagaatttagctcaacattttaagatcaaccgtaccgtcttacggctgtccgaggcctacagtcgcgttcagtatcagttcgagatggagtcattcgatagcattccaggactcgtccggtgttacgtcgggaatcggcgtccaatctctcaacagtcgggagctattatatttcagcctatcaacagaacagtgccgctgcggtgcctagaagaacactatgggacgagccctggacaggctagggaaggcagtctcacaaaaggtagaccggacgtggccaagcgacttagcttaaccatgggaggcgtgcaggcaagggagcagaatcttcccagaggaaatctactccgcaataaagaaaagtctgggagccagccagcatgtctcgaccatatgcaggaccgacgggcattatctctgaaagctcatcagagcgagtcttacttaccgattggctgcaagctgcctccccagagtagcggcgtggataccagcccctgccctaactctcctgtgttccgcacgggctctgaacctgcactcagcccggctgtcgtgcgccgagttagctccgatgccagagctggcgaagctcttcggggaagcgatagccaactctgtcccaagcccccacccaagccttgtaaggttcccttcttaaaagtgccctcaagcccctctgcttggttgaacagcgaggccaactactgtgaactcaatccggcatttgctactgggtgcggaagaggagcaaagcttcctagctgcgcccagggcagccataccgaattgctcactgcgaagcagaatgaggctcccggaccccgaaattctggagtcaattatctgattctggacgacgatgaccgagaaagaccctgggaacctgccgctgcacaaatggagaaagggcaatgggataagggtgagttcgtgacacccctgctagaaacggtgagctcttttagaccaaatgaattcgaatccaagttcctgcctcctgagaacaagccgctggagactgctatgttgaagagggccaaagagctctttacaaataatgacccaaaagtgattgcacagcatgtcctgagtatggattgccgggtggccaggatcttgggagtgagtgaggaaatgagaagaaatatgggtgtgtcatcgggcctggagctcattactctgcctcatggccaccagcttcgcctggacattatcgagagacataacactatggccatcggcatagccgtggatatactggggtgtactggcaccttagaggaccgggcagccacacttagtaaaatcatccaagttgccgtagaactgaaagacagcatgggggatttgtactccttctccgcactgatgaaagccctggagatgccacagatcacccggctagaaaaaacttggactgccctgcggcaccagtatacccaaacagctatcctctatgagaagcagctgaagccctttagtaagctcctgcacgagggacgggagtcgacctgtgtccctcccaataatgtgtctgtgccgctgctgatgcccctggtaactctcatggaacggcaggctgtgacatttgagggtacagacatgtgggaaaagaatgatcagagctgcgagattatgctcaatcacctggctacagcacgcttcatggctgaagctgccgactcctatcgcatgaatgcggagagaatcctggctggattccagccagacgaggagatgaatgagatttgtaagactgagttccaaatgaggctgctatggggctcaaaaggggctcaggtgaaccagacagagcgctatgagaaattcaatcaaattctcaccgcactgtctcgaaagctggaaccgccacccgtcaagcaagccgagctctag

SEQ ID NO: 53333 - DNA, 2478 bp, Artificial Sequence
  Description of Artificial Sequence: Synthetic coding sequence
atggcagccggtaagtttgcatccctccctcgaaacatgccagttaatcaccaatttccactcgcctcgagcatggatcttctctcatctcgctcccccctcgcggagcataggcctgatgcctaccaggatgtatctatacatgggaccctgcctagaaagaaaaaaggccctcctcctattagatcatgcgatgatttttctcacatggggactttgccccattctaagtcaccccgacaaaactcccccgtgacccaggatggaatacaggagtccccatggcaggaccgccatggggaaactttcacattccgagacccccacctcttggaccctaccgtggagtacgtgaagttttcaaaggaaagacatatcatggaccgaaccccagagaagttaaagaaagagctggaggaggagctcctcttgtcatctgaggatctccggagtcacgcttggtaccatggtcgcatacctcgtcaggtctccgagaacctggtccaaagagacggtgatttcctggttcgcgatagtctatcttcccccggaaactttgtcctcacatgccagtggaaaaatcttgcacagcatttcaagattaatcgcaccgtgttgaggctttccgaggcctattcacgcgtgcaatatcaattcgaaatggaatccttcgactctatccccggtctcgtacgatgctacgttggtaaccgtaggcctatcagccagcaatccggtgcaataatctttcagcctatcaataggactgtgcccctcagatgtctggaggagcattatgggacgtccccgggtcaggcccgagaggggagtttgactaaggggcgtcccgatgtggcaaaacgcttgtctttaacgatgggaggagtacaagctcgggagcagaatctccccagaggtaatttattaaggaacaaagaaaaaagcgggtcacagcctgcctgcctggatcacatgcaggatcgcagggcgctttcgttgaaagcacaccagagcgaaagctacctccccatcggctgtaagttgcctccccagagctctggcgtggacacatctccatgtccaaatagccccgtcttcaggaccggatccgagcccgctctcagccctgccgttgttaggagggtaagctcagatgcccgtgcgggtgaggccttgcgcggtagcgactcccagctatgtcctaaacctccgccaaaaccgtgcaaggtacccttcttaaaggtcccgagctcaccatccgcatggctaaattctgaggcaaattactgtgagctgaacccagctttcgctacaggctgtgggcgaggggctaagttaccatcctgcgcacaggggagtcacaccgagttgctgacagcgaagcagaatgaggcgccagggcctagaaatagcggagtgaattatctcatactggatgacgacgatagggagcgcccttgggaacccgctgctgctcaaatggaaaagggacaatgggacaaaggagagttcgttacacccctcctcgaaactgttagttcctttcgcccaaacgaattcgagagcaaattcctgccacctgagaacaagccgctcgaaaccgccatgctgaagcgggcaaaggagctttttaccaacaacgatccgaaggtcattgcccagcacgttctcagcatggactgccgggtcgcacgtatcttgggagtttccgaagagatgaggcgcaacatgggtgtcagcagcgggctggagcttataaccctgccgcacggacaccagctcagactggacattattgaacgccacaacaccatggctattggaatagccgttgatattctggggtgtacaggaaccctagaggaccgggctgccacactgtcaaagatcatccaggtggccgtcgagctgaaggacagcatgggcgacttatacagtttttctgccttgatgaaagctctggagatgccccagattacaaggctagaaaagacttggacagccttaaggcatcagtatacacaaactgcaattttgtatgagaaacagcttaagcccttctccaaacttctgcacgagggtcgagagagcacctgtgtgccacccaataacgtcagtgtcccactgctcatgccgctcgtcactctgatggagaggcaagcggttacattcgaggggaccgacatgtgggagaagaacgaccagtcatgcgagattatgttgaaccatttagcaacagccagatttatggctgaggcagccgatagttataggatgaacgctgagcggatcctggccggttttcagccagacgaagagatgaacgaaatttgcaagaccgagttccagatgcgtttgctttggggaagcaaaggcgcacaggtgaaccagacagagaggtacgaaaagttcaaccagatcttgacagctctctcgcgaaagctggaacccccacctgtaaagcaggctgaactgtag

SEQ ID NO: 53334 - DNA, 2478 bp, Artificial Sequence
  Description of Artificial Sequence: Synthetic coding sequence
atggctgctggcaaattcgcctctctgccacgaaatatgcccgttaaccatcaattcccacttgctagtagtatggacctgctcagtagccgatcgccactagctgagcaccgcccagatgcttatcaggatgtctcaatccacgggacactgcctcgtaaaaaaaaaggccctcccccaattaggagctgtgatgactttagccacatggggacactgcctcattctaagtcaccacgtcaaaactcaccagtgacgcaggacggcatccaggagagcccatggcaggacaggcacggggaaacctttaccttccgcgatcctcaccttctggatcctactgtggaatacgtgaagttttctaaggagaggcacatcatggatcggaccccagaaaaactgaaaaaggaactggaagaggagttgttactgtcgtccgaagacctccgaagtcatgcctggtaccacgggaggatcccacgccaggtgtccgagaatttggtccagcgtgatggagatttcctggttagggactcactgtcttcacctggcaattttgtcttgacctgccagtggaaaaatctagcgcagcactttaagatcaacagaaccgtgttgagattatctgaagcatactcccgggtccagtatcagtttgagatggaatcctttgattccatccccggtctcgtgagatgttacgttggcaacaggcgccctattagccagcagagcggagctattatcttccagcctattaatcgcaccgtgccactccgttgcctggaagagcattacggcaccagtccaggccaggctagagaaggatctctgacaaagggccgaccggatgtcgccaaacgcctgtccctgacgatgggaggggtacaggctagagagcagaacttgccccgaggaaacttgctgagaaacaaggagaaatcagggtcccagcctgcttgcctggaccatatgcaagatcgaagagcccttagcctgaaggctcatcagtccgagagctacctaccgatcggttgcaagctccctcctcagtcgtcaggagtggacaccagtccttgccctaattccccagtgtttaggaccggcagtgaaccagctctcagccccgctgtagtacgcagagtctcatctgatgcccgtgcaggcgaggcgctgaggggatccgatagtcagctttgtccaaaaccaccacctaagccttgtaaggtgccttttctgaaggtgcctagctctccatctgcatggctgaattctgaagctaattactgcgagttaaaccctgcgttcgccacagggtgcggcagaggtgcaaagctgccttcctgcgctcagggatcccatactgagctcttaacggctaagcagaatgaagctcccggaccccgtaacagcggcgtcaactacttgattcttgacgatgacgatcgggagagaccatgggagccagcagctgcgcaaatggagaaaggacagtgggataaaggagaattcgtgacccccctgctggaaaccgtgagctcattcagaccgaacgagtttgaaagcaaatttctgcccccagagaacaagcctctggagaccgcgatgctgaagcgagcgaaagaactgttcaccaataatgatccaaaagtgattgctcagcacgttctgtcaatggactgcagggtagctaggatcctcggagtgtctgaggagatgaggaggaatatgggcgtctcctctgggctggagctcatcacactaccccacggacaccagttgagattagacatcattgagcggcacaacacaatggcgattgggatagctgtggacattttaggatgcactgggacactcgaagacagggcagcaaccctctcgaaaatcattcaagttgctgtggaactcaaggatagcatgggcgatctttattccttttcagcgttgatgaaggctctcgagatgccacagattacgagattggaaaaaacctggaccgcattgcgtcaccagtacacacagaccgctattctatatgaaaaacaattgaagcccttctccaaactgttgcacgagggccgagagtctacctgtgtgccacccaacaacgtcagtgtgcccctcctgatgccgctggtgaccctgatggaaagacaggccgtgactttcgaagggacggacatgtgggagaagaacgaccagtcctgcgagatcatgctaaatcacctggccactgcacgattcatggccgaggcagccgattcctatagaatgaatgctgaaaggatcctggccggattccagcccgacgaggagatgaatgaaatatgtaagactgaatttcagatgcgcctgctctggggctctaagggcgcacaggtgaatcaaaccgaaaggtatgagaaattcaaccagatccttaccgctctgagtagaaagctggagcctcccccagtgaaacaggccgagctgtag

SEQ ID NO: 53335 - DNA, 2205 bp, Artificial Sequence
  Description of Artificial Sequence: Synthetic coding sequence
atgcctaaagaatgttctgctttccatgcgctgagcgcagctctgtgctgcttctaccaccggaagagcttcattggcgtaaaattctcaaaagagcggcatataatggatcggactcccgaaaagctcaagaaagaactggaagaagaattactgctcagctccgaagacctgcgatctcatgcatggtatcacggcaggatccctcgacaggtgagtgagaacctggtacagagggacggtgacttccttgttcgcgactccctctccagcccaggaaacttcgtcctgacctgtcaatggaagaaccttgcacagcattttaagatcaaccgcaccgtgctgcgcctttccgaggcctattctcgcgttcagtatcagttcgaaatggagtctttcgacagtatcccaggccttgtgcgttgttacgtcggtaaccggcgtcctatcagccagcaatccggcgcaattattttccaacctattaacaggaccgtgccattgcgctgcctcgaggaacattatggaacatcaccgggacaggcccgagaaggtagcctgacaaagggacggcctgatgtagcaaaaaggctatcgctgacaatgggcggagtacaagctcgcgaacaaaatcttccaagggggaacttactacgtaataaagagaagagtggttctcaacccgcttgccttgatcatatgcaggatcggagggctctgtctttgaaggcacaccagagcgagtcatatctccccatcggttgcaaactgcccccacaaagcagtggcgtggatacaagcccatgccccaacagtcctgttttcagaacgggaagcgagcccgcattgtcacctgcggtcgtacggagggtttcaagtgatgccagggcaggagaggctttgaggggtagcgattctcagctgtgtccaaaaccacctccaaagccctgcaaagtgcccttcttgaaagtaccgtcgtcacccagcgcctggttgaattctgaggccaactattgcgaactgaaccccgcttttgctaccggttgtggccgtggcgctaagctgccaagttgcgctcagggatcacatacagaattattgactgcaaagcagaacgaggcaccaggtccacgcaactcaggcgtgaattacctgatactcgacgacgacgatagagaacgcccttgggagcctgccgctgcacagatggaaaaaggacagtgggataaaggcgaattcgttacacctctgctggagaccgtgtcctctttccgtcccaatgagttcgagagcaaattcctgccaccagaaaacaagcctctagagactgccatgctcaagcgcgctaaagaactctttaccaataatgacccaaaggtcatcgctcaacacgtgctgtcaatggactgccgagtggccaggatactaggagtgtcagaagagatgagacggaacatgggtgtgagcagcggacttgaactgatcacgctgccacatggccaccagctgaggcttgatatcattgaacgccacaatactatggccatcggaatcgctgtcgatatcctggggtgcactgggactttggaagaccgcgcagcaacgctgagcaagatcatccaggtcgctgttgagctcaaagatagtatgggcgatctgtacagcttttctgcccttatgaaggcactggagatgccacagatcaccaggctggaaaagacctggactgccctaagacaccagtatacacagactgccattctatacgagaagcagctcaagcctttttcaaaactgttgcacgagggcagggagtccacttgcgtccctcccaacaatgtttcggtacctttacttatgcctcttgtgaccctgatggagcgtcaggcagtcacctttgagggaaccgatatgtgggagaaaaacgaccagtcctgcgagataatgctaaatcatcttgcaacagcccgatttatggctgaagccgctgactcgtaccgtatgaacgccgagaggatcttagcaggctttcagccagatgaggagatgaatgagatatgcaaaactgaattccaaatgagattgctatggggcagcaagggagcccaggtcaaccaaacagaaaggtatgagaaattcaatcagattcttacagccctgagccgcaaactcgaaccccctcctgtgaagcaggccgagctgtag

SEQ ID NO: 53336 - DNA, 1506 bp, Artificial Sequence
  Description of Artificial Sequence: Synthetic coding sequence
atgcaagaccgtagggcactgtccctcaaggctcatcagtctgagtcctacctccctatcgggtgtaaactacccccacaatccagcggggtcgacacgtctccctgcccaaattcacccgtgttccggaccggatcagagcctgctctttcgcccgctgttgttcgtagggtgagtagcgacgcccgtgccggtgaggccctgaggggctctgactctcagctttgtccaaagccccctccaaagccttgtaaagtcccttttcttaaagtgccttcctcaccatccgcatggctgaattcagaggccaattactgcgaacttaacccggcttttgcaactggctgcggtagaggtgcgaaactgcctagctgtgcccaggggtctcatactgagctgctgacggcaaagcagaatgaagctcccggaccacgtaacagcggtgtgaattatctgatccttgacgacgacgatcgcgaacggccttgggagcctgccgctgctcagatggagaagggccagtgggataagggagagttcgtgacgccgcttttggagaccgtttcaagtttccgacctaatgaattcgagagcaagttcctgcctcccgagaataagcctttggagacggccatgcttaagcgcgcaaaagagctgttcacaaataatgatccaaaggtcattgcacaacatgtcctgagcatggattgtagagtggccagaatcctaggcgtgtctgaggagatgcgacggaatatgggcgtcagctctggacttgaactcatcacgcttccccatgggcaccagctgagattggacattatcgagcgccataataccatggcgattggaatagccgttgacatcttaggctgcaccggcacgctcgaggatcgcgcagctacacttagcaaaatcattcaggtagccgtggagttaaaggacagcatgggcgacctgtacagttttagtgctctgatgaaagctcttgagatgccgcagatcacacgactggaaaaaacttggacagcacttcggcatcaatatacgcaaacagctatcctctacgaaaaacaattgaagcccttctccaagctgctccacgagggcagagagagtacctgtgtgccccctaataatgtctcagtacccctgctgatgcccctggtcactctgatggaaaggcaggcggtaaccttcgagggaacagacatgtgggaaaagaacgaccagagctgtgagattatgctgaatcatctggccactgccagatttatggcggaggccgctgacagctaccgaatgaatgccgaaagaatccttgccggattccagcccgacgaggaaatgaacgaaatatgtaaaaccgagttccagatgcggcttctatggggttcgaaaggggctcaggtcaaccagactgaaagatatgagaagttcaatcagatattgacggccctcagtagaaagctggagccaccaccggttaaacaggcagagttgtag

SEQ ID NO: 53337 - DNA, 4452 bp, Artificial Sequence
  Description of Artificial Sequence: Synthetic coding sequence
atggcccctcttctcggccgaaagccctttccacttgtaaagccactgcctggagaagagccactgtttactattccccacactcaggaggctttccgcacaagagaagaatacgaggcacggttagagagatattctgagaggatctggacctgtaagtcaaccgggagctctcagctaacgcacaaagaggcctgggaggaggaacaggaggtagcagagctcctgaaagaagagtttccggcttggtatgagaagctggtgctcgagatggtacaccacaacacagcctctctggagaaactcgtcgacaccgcatggttagagatcatgaccaaatatgcggtgggtgaggaatgcgattttgaagttgggaaggagaagatgctcaaagtgaaaatcgttaaaatccacccactagagaaagtcgacgaggaggcaacggagaagaagtctgacggtgcttgcgatagccccagcagtgataaagagaattcatcgcagatcgctcaggaccaccagaagaaagaaacggtggtgaaggaggacgagggacgaagagaaagtatcaatgatcgcgctcggcgttctcccaggaagctaccaacaagcctcaaaaagggtgagcggaaatgggctccccctaagtttctcccccataagtacgatgtgaagctccagaatgaggacaagataatttccaatgtgcctgctgattcccttatccgaaccgaacgtccccctaacaaagagatcgttcggtactttattagacacaatgcattaagggcgggaaccggagagaacgccccatgggttgtggaagatgaacttgtcaaaaagtatagtctgccgagtaaattctccgactttctcttggacccatataagtacatgacgctaaacccaagcacaaagagaaagaacaccggctcccccgacaggaaaccaagcaagaagtccaagactgacaacagttcactgagtagccccttgaatcctaaactttggtgccacgtgcatctcaagaagagcctgtcaggctcgccactgaaggtgaaaaattcgaaaaattctaagagtcccgaggagcacttggaggaaatgatgaagatgatgtcccctaataagctacatactaactttcacatacctaaaaagggacctccagccaagaaacccggaaaacattctgataagcccctgaaagcgaaaggacggtcaaagggaatcctcaacggacagaaatctactgggaatagcaagagcccaaagaagggcctcaaaacgcctaagaccaagatgaaacagatgacccttcttgatatggcaaaggggacccaaaagatgacacgtgcacctagaaattcaggtgggacgcctcgcacatcaagtaagccccacaaacatctcccacctgctgctctgcacctgattgcttactacaaagaaaataaggatcgggaagacaagcggagtgccctgagctgtgtgatctcaaagacagccaggctgttatctagtgaggaccgtgctagattaccagaagagttgcggtctctcgtgcaaaagaggtacgagttgctagagcacaaaaagcggtgggccagcatgtcagaggagcagcgaaaggaatatctgaagaagaagcgcgaggagttgaagaagaagttaaaggagaaggccaaggagaggcgcgagaaagagatgctagaacgcctcgaaaagcagaaacggtatgaagaccaggagttgacgggtaaaaacctgccggcattcagactcgtcgacacgccggaaggtctgccaaacaccctctttggcgatgttgcaatggtagtggagttccttagttgctactccggacttctcctccctgacgcacagtacccaatcactgccgtgtccctcatggaggctctgtctgccgacaaagggggttttctatatctaaatcgggtgctcgtgatcctactccagacgctcctccaagacgaaattgccgaagactacggggagctgggcatgaaactctcggagatccctcttactctgcattcagtttctgagcttgtgagactttgcctacgcaggagcgacgttcaggaagagagcgagggctcggacactgatgataataaggactctgccgctttcgaagataatgaggtacaagacgaattcctggagaagctagagacatcagagttcttcgagctgacttctgaagaaaaattacagatccttacggccttgtgtcaccggattttgatgacctattcagttcaggaccacatggaaactcgtcagcagatgtccgctgagctatggaaggaaagactcgcagttctgaaggaggagaacgacaagaaaagggctgagaaacaaaagaggaaggagatggaagccaagaacaaggaaaacggaaaggtggagaatggcctcggaaaaacggaccgcaagaaggaaattgtcaaatttgagcctcaggttgatacagaggctgaagacatgattagcgctgttaaatccagacgcctgctggccattcaggcaaagaaagagagagaaatccaggagcgcgagatgaaagtgaagcttgagcggcaggccgaggaggaaaggatccgcaaacataaggccgctgccgagaaagctttccaggagggaatcgcaaaggccaagttagtgatgcgacggacacctattgggactgaccgtaaccacaataggtactggctgttcagtgatgaggttccgggattatttatcgaaaagggctgggtccacgactcaatcgattacaggttcaaccatcactgtaaggatcacacagtgtctggagatgaggactactgccctcgatcaaagaaagccaacttgggtaagaacgcaagcatgaatacacagcacggaaccgccacagaggttgctgtggagactactacacccaaacagggacagaacctatggtttctgtgcgattcccagaaagaattggatgagctgctgaattgcctgcacccacaaggtataagggagtctcagttgaaggaacggctggagaaaaggtatcaggacattatccacagtatacacttggccagaaagccaaacctcggcctcaagtcttgcgatgggaaccaggaactgctaaatttcctgcgatctgacctaatcgaagtagccaccaggctacagaagggagggctaggctacgtagaggaaaccagcgagttcgaggctagagtcatctccctagaaaaacttaaggacttcggtgaatgcgtgattgccttgcaggctagcgtcattaaaaagtttcttcaggggtttatggccccaaaacagaagagaagaaagctgcaatctgaagattccgccaaaaccgaagaagtggatgaagagaaaaaaatggtggaggaggctaaggtcgcttcggccctggagaagtggaagacagctatccgcgaagctcagacattctcacgaatgcatgttttgctagggatgctcgacgcatgcattaagtgggatatgtccgctgaaaacgccaggtgtaaggtgtgtcggaagaaaggcgaagacgataagctgatattgtgtgacgaatgcaacaaagctttccatctcttctgcctgcgtccagcactctatgaggtgccagacggggagtggcagtgccctgcctgtcaacccgcaactgccagacggaactctcgtggtagaaactataccgaggaaagcgcttctgaagatagcgaagacgacgagtcagatgaggaggaggaggaagaggaggaagaagaggaagaggaagactatgaggtggccggtttgcgattaaggccccgtaagaccatccggggaaaacacagcgtaattccacctgctgccaggtctggcaggaggcctggcaagaaacctcattcgacaaggcgttctcagccgaaagctcccccagttgacgatgccgaggttgatgagttagtgttgcagacaaagagaagctcacgtcggcagtctttggagctgcaaaagtgtgaagaaatactgcataaaattgtcaaatatagattcagctggccttttagagagcccgtcaccagggatgaggccgaagattactatgatgttatcacgcatcctatggatttccagactgtgcagaacaagtgcagctgcggttcatacaggagtgtacaggagtttctcacagatatgaaacaagttttcaccaatgccgaagtgtataattgtagggggtcccacgtgctgagctgcatggtgaagacagaacagtgcctggtcgccctactccataaacacctcccaggccatccgtatgtgaggcggaaacgcaaaaaattccctgatagactggcggaagatgagggggattcggaacctgaagccgttggacaatcgcgcggacggcgtcagaagaaatag

SEQ ID NO: 53338 - DNA, 1506 bp, Artificial Sequence
  Description of Artificial Sequence: Synthetic coding sequence
atgaaaggctaccagagcctcgtgttcaatttcttcttcctcaaactaagtgccgaaaacgagagcacacctattcagcagcttctagagcatttcctgcgccagctgcaacggaaggatccacatggctttttcgccttccctgtgaccgacgccatagcccctggctactccatgattatcaaacaccctatggacttcggtacgatgaaagacaaaatcgttgccaacgaatataagtccgtgacagagtttaaggctgattttaagctgatgtgcgacaatgcaatgacctataaccgacccgataccgtctattacaagctggcaaagaagatcctccacgctggcttcaagatgatgagcaaggagcgattactggccctcaagcgatccatgtcttttatgcaggacatggatttcagccagcaagccgctcttctaggaaatgaggataccgctgtggaagagcccgtgcctgaggtggtccctgtccaggtggagactgccaagaagtctaagaagccatctcgagaggtgatctcttgtatgttcgaacccgagggtaacgcctgttcgctgacagattccacagccgaggagcacgtcctcgcgctggtcgaacatgcggctgatgaggcccgagatagaataaatagatttctgccagggggaaaaatgggctatcttaaacgaaacggcgatggctctcttttgtattctgtggtgaatactgccgaacctgatgccgatgaagaggaaactcatcccgtagatctctcctccttatcatccaaactacttcccggattcaccacccttggttttaaagatgagaggagaaacaaggtcacgttcttgagcagtgctacaacagcgctctcgatgcaaaacaactcggtgttcggagacctcaaatcagatgaaatggagcttttatattccgcatatggagacgagaccggcgtgcagtgcgccctcagccttcaggagtttgtgaaggatgccggatcatactctaaaaaagtggtcgacgacctgctcgaccagatcactggaggagatcacagcagaactttgttccagttgaaacaacgccgaaatgtcccgatgaagcctcctgatgaggcgaaagtgggcgatacattaggagatagctcatcaagtgtcttggagtttatgtcaatgaagtcctacccggacgtgagcgtggatattagtatgctcagcagcctgggaaaggtgaagaaggaattggaccctgatgacagccacttaaacctggacgagactactaagctgctgcaggatcttcacgaggctcaggcggagaggggagggtcccgccctagctcaaacctgtctagtctgtccaatgcttctgagcgagatcaacaccatctgggatccccctctagactttctgttggtgagcagccagatgttacccatgatccatacgagttcctacaatctcccgaacctgctgcctcggccaagacctag

SEQ ID NO: 53339 - DNA, 561 bp, Artificial Sequence
  Description of Artificial Sequence: Synthetic coding sequence
gctgtttgcagcctgcggctgccatcgagccccgacaagagaagcagagcgatgcaagttaccctgatcctggctgaagaagagacacacccagtggatctctcatctctgtcctccaagttgttgcctgggtttaccactctggggtttaaggacgagcgtaggaacaaagtgacctttctgtcctctgccaccaccgcactgtccatgcagaacaactccgtgtttggagacctcaaatcagatgagatggagctcctttatagtgcctatggcgacgaaaccggcgtccagtgcgccttatcgctgcaggagttcgtgaaggacgccggaagctattctaagaaagtagttgacgacctattggaccaaattaccggtggcgaccactctcggaccctgtttcagttgaaacaaaggaggaacgttcccatgaaaccgccagatgaggctaaggttggggacacactcggggattcatcatcaagtgtcttggagtttatgtctatgaagtcctatccagatgtttccgtagacattagtatgcttagcagcctgtag

SEQ ID NO: 53340 - DNA, 1446 bp, Artificial Sequence
  Description of Artificial Sequence: Synthetic coding sequence
atgaagggataccagagtctggtatttaactttttttttctcaaactctctgccgagaacgagagcactccgattcagcaactgttggagcactttttgagacaactgcagagaaaggatccccacggatttttcgccttcccagtgacagacgctatcgccccagggtatagtatgattattaagcatccgatggactttggaaccatgaaagacaagattgtggcaaacgaatacaaatccgtcacggaatttaaagccgatttcaaactcatgtgcgataacgccatgacttataaccggcctgacaccgtctactacaagctggctaaaaagattttgcatgcgggattcaagatgatgtccaaacaggcggctttgttggggaatgaggataccgccgtagaggaacctgttcctgaagtggtgcccgtacaggtggagactgctaaaaagtccaagaagcctagccgcgaggtcattagctgcatgttcgaacctgagggaaacgcttgctctctaaccgactcgaccgcggaggaacatgtgctggccctggtcgagcatgcggcagatgaggctcgggaccgaatcaatagattcctgcccggtggtaagatgggatacttgaaacgaaatggagacgggtcgctactttattccgtagttaatactgccgaacctgatgccgatgaggaagagacacaccctgtggatctgtctagtttgtcctctaaacttctgcctggttttaccactctgggcttcaaagatgaaagacgaaataaggtgacttttctgagcagcgcaactaccgccctgtccatgcagaataattccgtgttcggggaccttaaatcagacgagatggaactgctttattcagcctatggcgatgaaaccggcgtgcagtgtgctctgtcccttcaggagtttgtcaaggacgcgggaagctacagtaaaaaagtggtggacgatctgttggaccagattaccggcggagatcactcccgcacactcttccagctgaaacagcgtagaaatgtccccatgaaaccaccagacgaggccaaggtaggggatacactcggtgactcgtctagttctgtattggagttcatgtctatgaagtcgtatcctgatgtgtctgtggacatcagcatgctttccagcctcggtaaagttaagaaagagcttgaccccgacgacagccacttaaacctggacgaaaccaccaagctcctgcaagacctccacgaggcgcaagcagagagagggggatcgaggccgagctcaaacctaagttctctgtccaatgcctctgagcgtgaccagcaccacctggggagcccaagccgtctcagcgtaggtgagcagcccgatgtaactcacgacccttacgagtttctgcagagccctgagcctgctgctagtgcaaagacctag

SEQ ID NO: 53341 - DNA, 645 bp, Artificial Sequence
  Description of Artificial Sequence: Synthetic coding sequence
atgaaaggctatcaatctctggtcttcaacttcttcttcttgaagttgagcgcagagaacgagtccaccccaatccagcagctgctagagcactttctcaggcaactgcagaggaaggatccgcatggtttcttcgccttcccggtgaccgacgccattgcacccggatactcaatgataatcaagcatcctatggattttggcaccatgaaagataagattgtagcaaacgaatacaagagcgtgaccgaatttaaggccgatttcaagctcatgtgcgataacgctatgacctataacagacctgataccgtgtactacaaactggccaaaaaaattctgcatgctggtttcaagatgatgtctaaacaggccgcactgctcgggaacgaggatacggccgtggaagagccggtccctgaagttgtgcctgttcaagtggagacggccaagaagagcaaaaaaccttccagggaagtaataagttgtatgttcgaacctgagggtaacgcgtgttccttgactgatagcacagcagaggagcatgtgctggcactagtggaacatgcagcagacgaagctagagatcgtatcaatcggttcctgccgggagggaaaagaaggcggccaaccaggtggacttag

SEQ ID NO: 53342 - DNA, 1794 bp, Artificial Sequence
  Description of Artificial Sequence: Synthetic coding sequence
atgggaaaaaaacacaagaagcataaagcggaatggcggtcctcctatgaagattatgcggacaagcctctggaaaaacccttgaaacttgtcctgaaggtgggtggctcagaagtgaccgaactcagcgggagtgggcacgattcgagctattacgatgatcgaagcgatcatgaacgggagcgacataaggagaaaaaaaaaaagaagaagaaaaaatcagaaaaggaaaagcatttagacgatgaagaacgtagaaaaagaaaggaggaaaaaaaacgcaagcgggaacgggagcactgcgacactgagggtgaggcggacgatttcgacccaggtaagaaggttgaggtggagccccctcctgataggccagtacgggcatgcaggacccagccggcagagaatgagtccacacctatccagcaactgctggagcatttcctgagacagctccagcgaaaggatccccacggattcttcgcatttcctgtgaccgatgctatcgcgcctggatactcgatgattatcaagcatcctatggatttcggaaccatgaaagataaaatcgtagctaatgagtataagagtgtcaccgagtttaaggcagatttcaaactcatgtgtgacaatgctatgacttataataggcccgatacagtgtattataaactcgccaagaaaatcctccacgcaggctttaagatgatgtctaagcaggcagctttgctggggaatgaggacacagctgttgaggaaccggtccctgaagtggtgccggtgcaggtggagaccgcaaagaaatcaaagaagccaagtcgggaagtcatctcctgtatgttcgaaccagaaggaaatgcttgctccctgaccgacagcactgccgaagaacatgtgcttgccctagtagaacacgccgcagatgaggcccgagatcggataaacaggtttctgcccggaggaaaaatgggatacttaaaacgcaatggcgatggatccttgctctacagcgttgtgaatacagccgagcccgatgctgacgaggaggagacacaccctgtggacctaagctccttgtcatcaaaactgttgcctggatttaccacactcgggttcaaagatgagagacgcaacaaagtgacattcctctccagtgccacgactgctctgtctatgcagaacaatagcgtttttggagacctcaagtctgacgagatggagcttctctatagtgcttacggcgatgaaacgggagtgcaatgtgcactgtccctgcaagagtttgtgaaagatgcaggcagctatagtaagaaggtagtcgatgacctgctggaccagattactgggggtgaccacagtagaaccctgttccagctgaaacagagaagaaatgttccaatgaaaccccctgatgaagccaaagtgggagacactctgggggattcctccagttccgtgttggaattcatgagcatgaagtcttatccagacgtgtctgttgacatctcaatgctgagctcgttggggaaagtgaaaaaagagctggatccggacgattcacatttgaacttggacgaaactaccaagctcctgcaagatttgcacgaggcccaagcggaaaggggtggctctaggccatcctcaaaccttagcagtctgagtaacgcatctgaacgcgatcagcatcacttgggctcaccaagtagacttagcgttggagagcagcccgacgtgactcatgacccatatgagttcttacagagtcccgaaccagcagccagtgctaagacgtag

SEQ ID NO: 53343 - DNA, 1635 bp, Artificial Sequence
  Description of Artificial Sequence: Synthetic coding sequence
atgatgactggccagaccatgtcagagcggggaaccaaaaagcgcaagcgcaggcgaagacgatccccacggagacgttctatctggacaatgcgaaaggagggttctgaaagaaaacggcgaagcggttccgagcggggatcaacagtgacaaggcgggagaggttaaccaccctgatcttgggtaggcgttggaggtggagtaggcctcagattgggcagtccgagagagcgggacattcacagccgaagatgcgtgcccatctgttctctaactcatggaacacttccagcgcctcatttagggaccctcacggcttctttgccttccctgtgacagacgctattgctcccggatatagtatgatcataaaacacccaatggacttcggtactatgaaagacaaaatcgtggccaatgaatacaaatccgtcacagagtttaaagcagacttcaagctgatgtgcgacaatgcaatgacatacaatcgacctgataccgtgtattacaagctggctaagaagattctccacgccggttttaagatgatgtcaaagcaagcagcactgttagggaacgaggatacggctgtcgaggaacccgtgccagaggtggtccccgtgcaggtggagacagccaaaaagtccaaaaagcctagcagggaagtaatctcctgtatgttcgagccagagggtaatgcctgctcacttacagactccacggccgaagaacacgtccttgctctggtcgagcatgctgctgatgaggctagagatcgtattaaccgttttttaccaggaggcaaaatgggataccttaagagaaatggcgatggctcactactctatagcgtggtgaacactgcagagcctgatgccgatgaggaggagacccacccagtagatctgagctcccttagctctaaattattgccaggatttaccactctgggttttaaagatgagcgcaggaacaaagtgacatttctgtcatcagccactaccgccttatctatgcagaataacagcgtgtttggggatctgaaaagtgacgagatggagctgctctactcagcatacggggatgagactggggtacagtgtgcactctctctgcaagaattcgtgaaggatgcaggctcgtactctaaaaaagtcgtggatgacctgctggaccaaatcaccgggggagatcacagcaggaccctctttcaactgaagcagcggagaaacgtgccaatgaaacccccagatgaggcaaaagtcggagacaccttaggggattccagctcctcggtgcttgaatttatgtcaatgaagtcatacccggacgtgtcggtggatatctccatgctctcctcccttggaaaggttaaaaaggaactggacccagacgattctcacctgaatctcgacgaaactactaagttgcttcaggaccttcacgaagcccaagctgagagggggggaagtaggccttcatccaacctgtcctcactgagtaatgcctcagaaagagaccagcatcacctcggaagcccgagccgactttccgttggagagcagcctgacgtcacgcacgatccttatgaattcttgcaatcacccgagcctgccgcatctgcaaagacatag

SEQ ID NO: 53344 - DNA, 438 bp, Artificial Sequence
  Description of Artificial Sequence: Synthetic coding sequence
atgcttggatggatccagccatccaggcaaccccaactgcgtgctgcgcctcctacacgtacaccaagcgctaaaagatgtatactgtgtaactttcttcccggatgttggcttgtcggggacgtagctgggagtcggcagccaagcgcgccacagactctaagacagcgccagcatacgcggccaccaccgcaggagcggggttccggtcgcaggtccccactgcgggaggctcgtcgggctaacccccacttcaaatctttccccgtgttggaagcccgtggactgccttgcggggctcgcagaaccggcccaaggcggcctgttagagaaatgacactgccaagcgacccagagcgagcaactttacctaatccccgactgggcgcacctgccgtgccgcgaagggggcctcgctcgcacggcggtcgcaggtag

SEQ ID NO: 53345 - DNA, 522 bp, Artificial Sequence
  Description of Artificial Sequence: Synthetic coding sequence
atggccgaaggagaggatgtagggtggtggcgctcttggctgcagcaaagctatcaggcagtgaaggaaaaatctagtgaagcacttgagttcatgaaacgcgatttgacagaattcacacaagtcgtgcagcacgatacagcctgcactatagccgctacagcttctgtggttaaggagaagctggccaccgagggcagttcgggggctaccgagaaaatgaagaaggggctgtctgacttcctcggcgtgatctcagacacattcgcccctagtcctgataagactattgattgcgacgttataacgcttatgggaactcctagtgggacggcggagccatacgacggcacgaaagcgagactatatagcctgcagtctgaccccgcaacatattgcaacgaacctgacggtcctccagagctgttcgacgcctgccagcccgaactgtgggctcagatcctggtggccccatgctggcctagttgggcctctgcccatacctgggagggcgctctttag

SEQ ID NO: 53346 - DNA, 1425 bp, Artificial Sequence
  Description of Artificial Sequence: Synthetic coding sequence
atggccgagggcgaggatgttggatggtggagatcatggttgcagcaatcgtatcaggccgtcaaagagaaaagtagcgaagctctagaattcatgaagagagatctgactgaatttactcaggtggtacagcatgatactgcctgtacaatagctgctaccgcatcagttgttaaggagaaacttgcgattgcagcgtgttcccgcggtgcctgcttcttgtgccctttctccatccagacagaagggagtagcggagcaactgagaagatgaagaaaggcctttccgacttcctgggtgtgatctcagacaccttcgctcccagccctgataagacaatagactgtgatgttatcactttgatgggaactccttccggaaccgcagagccctacgacgggaccaaggcccgactatatagcttgcagtcagatccagctacttattgcaatgagcctgacgggccacctgagctctttgatgcttggctgtcacagttttgtctcgaagagaagaagggagaaatcagcgagttactggtgggatcccccagtattcgggctctctacacaaagatggtcccagcggctgtttcccattcagaattctggcataggtatttctacaaggtccatcagttggaacaagagcaggcgaggcgcgacgcgttgaaacaaagggctgagcaatcaatctccgaagaacccggttgggaggaggaggaggaggaactgatgggaatctcacccatatccccaaaagaagctaaagtgccagtagcaaagatttcgacattcccagagggggaacccggaccacagtccccatgcgaggaaaacctggtaacatctgttgagccacccgcagaagtgaccccctctgagtcctctgaatcgatatcacttgtgacccaaatagccaaccccgcaaccgcacctgaagctagagtactgcccaaagacctgagccaaaagctgttggaagctagtctagaggagcagggtctcgcagttgacgtcggcgaaaccggccctagtccccctattcacagcaagccactgacccctgccggacacaccggaggtcccgagcccaggccccctgccagagttgaaacgctgcgggaggaagctcctaccgacctacgagtcttcgagctgaactccgactccggaaaatcaacacccagcaataacggcaaaaaggggtcttccacagacatatccgaggattgggagaaagatttcgacttagatatgaccgaggaggaggtccagatggctctgagtaaggtggacgcctctggggaagtgtccggaccaggaggatctgaaggaagcgagccaaacgggcctggctgtgaatcctctcctcagccagcacagctgtcaccacaggaggggccttgtagctgtctccgatag

SEQ ID NO: 53347 - DNA, 1110 bp, Artificial Sequence
  Description of Artificial Sequence: Synthetic coding sequence
atggctgagggcgaggatgtggggtggtggagatcctggttacagcagtcatatcaggccgtgaaagagaagagttctgaagcgctagagttcatgaaacgagatctcaccgaatttacccaggtcgtgcagcatgacaccgcatgtaccatcgccgcaacggcaagtgttgtaaaagaaaagttagcaaccgaggggtccagcggcgctaccgaaaagatgaagaaaggcttgagcgactttctgggggtgatttcagatactttcgccccatcgccagacaagacaatcgactgcgatgtcatcacactgatgggcaccccctccggcactgctgaaccatacgacggaaccaaggctcgtctctacagcctacaaagtgacccggcaacttattgtaacgagcccgacggcccaccggaactcttcgatgccctcaagcagcgggctgaacagtccatatcagaggaacctggctgggaggaagaagaggaggagctgatgggaatctctcccattagcccgaaagaagccaaagtccctgtggccaagatctcaacatttcctgaaggcgagcctggaccgcagagcccatgcgaagagaatctggtgacctccgtcgaacccccagctgaagtgacccccagcgagtcatcagagagcatctcactggttacgcagatcgctaatcctgccacggcccctgaggcacgcgtgctgcccaaagatctgagtcagaagctgcttgaggcctccctggaagagcaaggtttagctgtcgatgtgggtgagacagggccttccccacctatccacagcaaacctcttaccccggcagggcacactggcggacccgaaccccgtccccctgccagggttgagacactgagggaagaggcccctacagacctgcgcgtatttgaacttaatagcgatagcggaaagagcactcccagtaataatggtaagaaaggatcaagcacggacatctcagaggactgggagaaggacttcgacctggacatgacagaggaggaagtgcagatggcactctcaaaggtggacgcatccggtgagctagaggatgtggagtgggaagactgggagtag

SEQ ID NO: 53348 - DNA, 1125 bp, Artificial Sequence
  Description of Artificial Sequence: Synthetic coding sequence
atggccgagggcgaagacgttggatggtggaggagttggcttcagcagagctaccaggccgttaaggaaaagtctagtgaggcattggaattcatgaagagggacctgacggaatttacacaggttgttcaacacgatacagcctgtactattgcagcaacagcctcagtcgtaaaggagaaacttgcagccaggctgtatagcctgcagagcgacccagcaacctactgcaacgagcccgacggaccccctgaattattcgatgcttggctgagccagttctgcctggaagagaagaagggggagattagtgaactattggtcggcagcccgtctattcgagcactttatactaagatggtacccgctgccgtgtctcattccgaattttggcaccggtatttctataaagttcaccaactggagcaggagcaggccaggcgagacgctctcaaacagagggcggaacagagtatcagtgaggagcccggttgggaagaagaggaagaagagcttatgggtattagccccatctcgcccaaagaagccaaagtccccgtggctaagatttcaacattcccggagggagaaccaggtccacagtccccatgtgaggaaaacctcgtgacttcagtggagcctcctgccgaggtgaccccctctgagtcctccgagtccatatcactggtcacccagatcgccaatccagctacagcccctgaagctagagtgttgcctaaagatctatcccagaagctgctggaagcatcactggaggagcaggggctggccgtcgatgttggcgaaacaggacccagtccaccaatacattccaagcccctgaccccagccggacacacaggaggccctgagccaagacctccagctagggtggagacattgagagaggaagccccaaccgacctccgcgtgtttgagctcaatagtgactctggcaagagtacgcctagcaacaacggtaagaaaggctcaagtacagatatttcagaggattgggaaaaagatttcgacctggatatgaccgaggaagaggtacagatggccctgtctaaggtggatgcaagcggtgaactagaggacgttgaatgggaggactgggagtag

SEQ ID NO: 53349 - DNA, 1344 bp, Artificial Sequence
  Description of Artificial Sequence: Synthetic coding sequence
atggccgagggcgaggacgtcggatggtggaggagctggttgcaacagtcataccaggcagtcaaggaaaagtcctccgaggcactggagtttatgaaacgcgacttgactgaattcacccaggtggtccagcacgatactgcctgtactatagcagcaaccgcaagcgtggtcaaggaaaagctggcaatagctgcctgctcacgcggagcctgcttcctgtgccctttctccatacagactgaagggtcgtcaggggcaacagagaaaatgaaaaaagggctgtccgacttcctaggcgtcatttctgacaccttcgcccctagtcctgacaagaccattgactgtgatgtgatcactctcatgggcacaccctccggcaccgccgagccttatgatggcacgaaagcccgtctgtatagcctccaatcagacccggcaacttactgtaacgagcctgatggaccacccgaattatttgacgcctggctgagccagttttgcttggaagagaaaaaaggtgaaattagcgagctactggtgggatcacctagcatcagagcgctgtacaccaaaatggtgcctgctgccgtatcacactctgagttttggcataggtatttctacaaggtgcaccagttggagcaggaacaggcacggagggacgcccttaagcagcgtgccgagcaatccatcagcgaggaacctggttgggaagaggaagaggaggagcttatgggaatttcaccgatctccccaaaggaagccaaagtgcctgtggctaaaattagtacttttcccgagggagaaccaggccctcaatctccctgcgaggaaaatttggtcaccagcgtggaaccacctgccgaggtgactccttcagaaagctcagaatcaatcagtttggtcacacagatcgctaaccccgctaccgctcccgaggccagagttctcccgaaggacctatctcagaagctacttgaagcctctctggaagagcagggccttgccgtagatgtgggagaaaccggaccttccccccctattcatagcaagccactgacaccagctggtcacaccggcggacctgagcccaggccgccagctcgagttgaaacccttcgtgaggaagccccaaccgacctcagggtttttgagctgaatagcgacagcgggaagtcaacgccaagtaataatggcaagaagggcagctctaccgatatttccgaggactgggagaaggatttcgatctggacatgacagaggaggaagtgcagatggctctgagtaaagtggacgcctccggggaactcgaagatgtcgaatgggaagattgggagtag

SEQ ID NO: 53350 - DNA, 1269 bp, Artificial Sequence
  Description of Artificial Sequence: Synthetic coding sequence
atggcagaaggtgaggacgtcggctggtggaggtcctggctgcagcagtcctatcaagccgtgaaggaaaaaagcagtgaggccctcgaattcatgaagagggatctcacagagttcactcaggtcgtccagcacgacactgcctgtacaatagcggcaacagctagcgtcgtcaaggaaaagctcgcgacagaaggcagctccggtgctactgagaagatgaaaaaaggtttgagtgattttctgggggtaatctcggacactttcgctccttcccccgacaagactattgattgcgacgtgatcacgctcatgggcaccccgtccgggaccgccgagccctacgacggcactaaggccaggctctactcccttcagagcgaccccgcaacatactgtaacgagccagacggacctcctgaactgttcgacgcatggctgtcacagttttgcctggaagagaagaaaggcgaaatctcagagttgctagtggggagcccctccatccgggctctatacacaaaaatggttcccgcagcggtttcgcactctgaattttggcacaggtatttttacaaggtgcatcagctcgaacaggagcaggcaagaagagacgcactgaagcagcgtgccgaacagagtatctcagaagagccaggttgggaagaagaggaggaggaactgatgggtatctctcctatcagtccgaaggaggccaaggtgccagtcgctaagatctctacttttcccgaaggggagcctgggccacagtctccctgtgaagagaacctagtgacctccgtcgagcctcctgcagaagtcacacctagtgagtcatcagagagcattagtctagtgacccagattgctaatccggctactgcccctgaggctcgagtgttgccaaaagacctgagccagaagctgttagaggcctccctagaggagcaaggattagccgtcgatgtgggcgaaactggcccaagtcctccaattcattctaaaccgctcaccccagccggacatacaggcggaccggagccgaggcctccggctagggtcgagactttgcgggaggaggctcccacggatctgcgcgtcttcgaattgaattctgattctggaaagagtaccccttccaacaacggaaaaaaagagacaagatctcaatttaccgtcgattttttatggaagatttcggttaccctcctggaaccactgggccaatctgcaagtccactgttctctaacctccctttcccacgatag

SEQ ID NO: 53351 - DNA, 1293 bp, Artificial Sequence
  Description of Artificial Sequence: Synthetic coding sequence
atggccgaaggtgaagacgttggctggtggcggagttggctccagcaatcttatcaggcagtaaaggagaagtctagcgaagccttagaattcatgaaacgggatttaactgagttcacgcaggtggtccagcatgacaccgcctgcacaatcgccgctacagcgagtgtcgttaaggagaaactggccactgagggttcttctggcgctaccgagaagatgaaaaagggcctgagtgatttccttggagttattagcgatacgttcgcgcctagccccgataagaccatagactgtgatgtaatcacattaatggggacaccttctggaacggctgagccatatgatgggaccaaggcacgcttgtattctctacaaagcgatcccgcaacgtattgtaacgagccagacggacctccggaactatttgacgcgtggctgagccaattctgtctggaggagaagaagggggagatctctgagctgctcgttggtagccctagtattagggcactctacaccaagatggtgccagccgcagtgagccacagcgaattttggcatcggtacttctataaagttcaccaactggaacaggaacaggctagacgggacgcgctgaaacagcgggctgagcagagcatctccgaggaaccagggtgggaggaagaagaagaagagctcatggggatcagccctatcagtcccaaagaagctaaagtgccagtcgcgaagatctctacattcccagaaggggagccaggccctcaaagcccatgcgaggaaaaccttgtgacttcagtggagcccccagctgaagtgacccccagtgagtcctcagaaagcatctcattggtgacccagatcgcgaacccagcaactgccccagaagccagggtgctacctaaagatcttagtcagaagctcctcgaggcttccttggaagagcagggacttgctgttgacgtgggcgaaacagggcctagtcctcccattcactccaaacctctcacccccgctggtcacacagggggtcccgagccacgccctccagcccgtgtggagacactgcgagaggaggcccctacggatttgcgagtgttcgagttgaacagcgatagcggcaagtcgaccccatctaacaatggaaagaaaggcagctcgacagacatttctgaagattgggaaaaggacttcgacctcgacatgacagaagaggaggtgcaaatggctctttctaaagtagatgcctctggcgagctggaagacgtagaatgggaggattgggaatag

SEQ ID NO: 53352 - DNA, 1008 bp, Artificial Sequence
  Description of Artificial Sequence: Synthetic coding sequence
atggccgagggcgaggatgttgggtggtggagatcgtggttgcagcagtcttaccaggcagtcaaagagaaagccaggttatacagcctccaaagcgatccagctacttactgcaacgagccagacggcccaccagagctattcgatgcctggttgtcgcagttctgtctcgaggaaaaaaagggagagatctcagagctgctggttgggtccccttccatcagggccctgtacactaagatggtaccagccgcagtgtcccactcagagttttggcaccggtatttttataaggttcatcagcttgagcaggagcaggcgcgaagagacgcgttaaaacaaagagctgagcagtcaatttcagaggagccgggatgggaagaagaggaagaggaactgatgggcatttcccctatcagcccaaaagaagctaaagttcctgttgccaagatctccacttttcctgagggcgaaccagggcctcagagtccctgtgaagagaatctggttaccagtgtcgaacctcctgctgaggtcactcccagcgaatcttccgaatccattagtcttgtcactcagatagccaatcccgcaacagctcctgaggcgagggtgctgccaaaagatctaagtcagaagcttttagaggcatcgttggaggaacagggactggcagttgacgtcggcgaaactgggccttcaccaccaatacattccaagccactcacaccggctggtcatacagggggtccggagccacgcccaccagctcgcgtggaaacccttagggaggaggctccaacagatttgcgggtgtttgagctgaacagcgattctggtaaatctaccccaagcaacaatggaaaaaagggatcctcaactgatatcagcgaagattgggagaaagatttcgacttggatatgactgaggaagaagtacagatggctctgagtaaagtggatgccagcggagaattagaggacgtggagtgggaagattgggagtag

SEQ ID NO: 53353 - DNA, 1158 bp, Artificial Sequence
  Description of Artificial Sequence: Synthetic coding sequence
atggcttctttaggacccgcagctgccggagagcaggctagtggtgctgaggccgaacccggtccagccggtccaccaccgcctccgtctccgagcagcctgggcccactgctgccgctgcagcgagaaccactctacaattggcaagccaccaaagccagcttgaaagaaaggttcgcctttctgtttaactcagaactgctgagcgacgttcggtttgtgctgggcaagggcagaggggcagccgctgctggaggcccacagagaattccagcacacaggtttgtgctcgctgccggtagcgccgtctttgatgctatgttcaacggtggcatggccacaacttccgccgagatcgaactccccgatgttgagccggcagcgtttttagcactcctgagatttctgtatagtgatgaagttcagattgggcctgaaaccgtgatgaccaccctgtacaccgctaaaaagtacgctgttcctgctctggaagctcactgcgtagagttcctcacaaaacacttgcgtgctgataatgccttcatgctgctcacccaggcacggctgtttgatgagccgcagctggcctccctttgcctggacactatcgacaagtccaccatggatgccatctccgcagaaggatttactgatatcgacattgacacgctatgcgcagtgctcgagcgagacaccctcagcatccgagaatcccggttgtttggcgctgtcgtcaggtgggctgaggcagagtgtcagcggcagcagctccctgtcaccttcggtaacaagcaaaaagtcctgggaaaggctctgagcctgataagattccccttaatgaccattgaggagtttgctgcgggacctgcgcaaagcggtatcctgagtgacagagaggtcgtcaaccttttcctgcactttacagtgaaccctaagccaagggtcgagtatattgacaggccacggtgttgccttaggggtaaggaatgttgcattaatcgctttcagcaggtggaaagccggtggggctatagtggtacttcagacagaatccggtccctgaatatgcggaaatccaagccgtgggaccgtatgatcccggcactggttgtgatggggcagctgacacactccggcagttgttcacgaaatccctag

SEQ ID NO: 53354 - DNA, 1521 bp, Artificial Sequence
  Description of Artificial Sequence: Synthetic coding sequence
atgatcatgagtaatacgcataaagccagattagaaagacgcgtcacggggagcaccaacagatggagacttccgaagcagccgttttctggggatctgcttagcctatcccagatgtgcaaggctctgtctattgattttgaggaagcgctccgcaatccagatcgcctctgcatttcacaaatccagaagttcttctttgagaatttcaaaaacaaagatatccagagtggcgaggccgacgtcatactcgagtgtctgggcttcaagtgggagctccaccagccgcagctgtttcagtcggaaacactggctaaactctacctgaaagccctggcgcaaggtaccacccatcccctgagggagctcgaggagctgcttcgtgcgcagtccccgaagaagactaaggaaaaatctcccgctaagcgaattatcataagtttaaagattaatgacccactggtgacaaaggtcgccttcgctacagccctcaagaacttgtatatgtccgaggtggagatcaatctggaggatttgctgggtgtgctcgcttccgcacatatcctgcaatttagtggactgttccagcggtgcgtggacgtgatgattgctagactaaagccgagcaccattaaaaagttctatgaggcagggtgtaaatataaagaggaacaactgaccacagggtgcgagaaatggcttgagatgaatctagtccctcttgggggtactcagatccatctgcacaagattccgcaggacctgcttcataaggttctcaagtccccaagattgtttactttttctgagttccatctcctcaagactatgcttctctgggtgttccttcaactgaactataaaatccaggctatccccacgtacgagactgtgatgacgttttttaagtcctttcctgagaattgttgctttctggaccgggacattggtaggtcactccgcccactattcctctgtcttcggctgcacggaattaccaaaggcaaagatctggaagtgttgcgccatctcaatttttttcccgaatcttggctggaccaggttaccgtgaaccattaccacgccttggagaacggaggagacatggtgcatcttaaggacctcaatacgcaggccgtgaggtttggcctgctattcaaccaggagaataccacctattcgaagactatcgccctctatggattcttttttaaaatcaagggactcaagcatgataccacatcttacagcttctatatgcagcgcatcaaacacacggacctcgaatctccttctgcagtctacgaacataaccatgtgtccttaagggcagctaggctggtgaaatacgagataagggctgaagccctggtcgatgggaaatggcaagaatttcggaccaatcagattaaacaaaaatttggactaacaacgtcctcttgtaagagccacaccttgaaaatacagacagttggaattccgatctatgtatccttcgctttcatcttccccgcatcgtag

SEQ ID NO: 53355 - DNA, 1524 bp, Artificial Sequence
  Description of Artificial Sequence: Synthetic coding sequence
atgatcatgagtaacacccagcacaaggccagacttgaacgcagagtgactggctcaaccaaccggtggagactccctaaacaacctttttccggtgatctcctctctctgtcgcagatgtgcaaggccctatctatagatttcgaagaggccctccggaacccagaccgtctctgcatcagccaaattcagaagtttttctttgagaacttcaaaaataaggatattcagagcggagaggcagacgtgattctggaatgcctgggcttcaaatgggagctccaccagcctcagctatttcagtcagagactctggctaaattgtatttgaaggctctggcgcagggtaccacacacccccttcgcgagctggaggaattactgagagcccagagccccaaaaagaccaaagagaagagtcccgcaaagagaattatcatcagcttgaagatcaacgatcctcttgtgacgaaagtggctttcgccaccgccctgaaaaacctctacatgtccgaagtggaaatcaatctggaggacttgttgggcgtcctggcttccgcgcacatccttcagttctccggactgttccaaagatgcgtcgacgtgatgatagcccgactgaaacccagcaccatcaagaagttctacgaggctggatgtaagtacaaagaagaacagttgaccacgggctgcgagaagtggctggaaatgaacttagtgccactagggggaacacagattcacctccacaagattccgcaggacctcctgcataaagtgttgaagagtccgcgactgtttaccttcagtgagttccatctgctcaaaaccatgctgctgtgggtcttcctccagcttaactacaaaattcaggcaataccgacctacgagacagtgatgaccttttttaagagtttccccgagaactgctgttttcttgatcgggacattgggagatcactacgacctctgttcctttgtttgagattgcacggcataactaaaggcaaggatttggaggtccttcggcacttgaacttttttcccgagtcatggctcgaccaagtgaccgttaaccactatcacgccctggagaatggaggagatatggttcatctcaaagatctaaacactcaggcagtccggtttgggctgctgtttaatcaggaaaacactacctacagcaaaacgatcgccctttacgggtttttcttcaaaattaaagggctgaagcacgacactacatcatacagtttttacatgcagagaattaagcacacggacctggagtcgccatcggcagtttatgagcacaaccatgtgtctctcagagccgctagattggtgaaatatgagatcagggcggaagctttagtcgatgggaagtggcaggaattccgcacgaaccaaatcaagcaaaaatttggactcaccacttctagttgcaagtcgcatacgctcaagatacagacggtaggcattcctatatatgtgagtttcgcatttatattcccagctagttag

SEQ ID NO: 53356 - DNA, 2139 bp, Artificial Sequence
  Description of Artificial Sequence: Synthetic coding sequence
atgtgctccccagcatctccaaaaattctgtatcgaaacccccgttttctgcgcctggcattcctgcagctgcaccatcaacaacaaagcgatgtcttttgtgacgtactgttgcaagcggagggcgaggcggtccctgcgcactgctgtattttgtcagcctgcagccccttctttacagaaagactggaaagggagaggcccgctcaagggggaaaggtggttctcgaactgggaggactgaagatttcgactcttcgaaaactggtggactttctctacacgtcagagatggaagtgtctcaggaggaagcccaggatgtactgtcagctgccagacagctgcgggtttctgagcttgagtctctgcagctggagggagggaagcttgtgaaagccccacagggacggagactcaaccgagaatgtctccaacctacatccgcagccccaatcagcgcacgtgtggtcacacctagccaccaccctcacactcccctgcccacaaaccagacgccatgtccactgggtgccattcgcttaaaaagcctgggcaaggaggagggccctcaggaaaataaccgacagaatgccgacaatctcagcggaactctgctgctcaaacggaaagccagagcctgccctacgccccaagagaagaactcttccccctcttctcactctcaggaaccaagagaaaataagaacgacacggcactggacccaaccgtgctgagccctccatcactctatccatctgtcgataaacacctgctccctcggaagattaggctctccagaagtaaaccgtctccaggaatatgcacgtctaagccctcgtctattctgagcggatcctctagcgtgccagcaaccccaggtcgtcggctgtggcgccaaaggagcgtaaataaagagacacccgaggacaaacctaaaccaggacgggcaagccctttgcagagcacccccaacccttcaggactgggcaaaacgggcggttcccgcaaaagaagcccggaagtccgcgcacccaactccgattctgcagaggaaggacaggtggggagggtgaagcttcggaaaattgtaaatgggacctgctgggaagtcgttcaggagacccctttgaaaaatactcaggacagtcctcagattcccgatccgggtggcgactttcaggaaccttccggaacacagccattcagtagtaacgagcaagagatgtcgcccaccaggacagagctatgccaggattcaccaatgtgcaccaaactgcaggacattcttgttagtgctagccatagccctgaccacccggtggttaagagtgagtttgagtcatctcccgaactagtcgagaaggagcccatgctggccatcgattgtcgggagccttatgccttcgatactgcgctgctggagcagccctgcgaagcagaagagtaccgtattacctccgccgcagctacatccgaactggaggagatcttggatttcatgctgtgtggtagtgacatagagccccctatcggatctttggagtcaccgggtgcagagggttgtcggacccctacctatcatttgactgagactggaaagaattggattgagggggaggagtggtgtcttcccgatatggagctgtggccaagggagctgaccgaactggaaaaggagcccgctggcgagaacaggggacctactgaactattgtcaccactggtcatgccgtctgaggtgagcgaggtactcagtgtagggggtagatggacaccagacctcgaaataaccagtagtcagccactcgatggccaagaagataaacttctacatgtgtcctccctcgacacacctcaacgttcttatggagacctctcacccccatgttcaaactgggtcgagaccggcctggaagtgagcttgactacggacgagctactctatccttcaccgaaagcaggcaaagaggtgagcggacactctgagttgctgggaagcctccccgcatcttcagaggaggaggagattgatgtggtggattggacagccgagggacgcttggtgcctacaaccgtcccttcggtatggcctgatccttcaagcgagtctgagaccgaggtcgatattctgacttag

SEQ ID NO: 53357 - DNA, 2139 bp, Artificial Sequence
  Description of Artificial Sequence: Synthetic coding sequence
atgtgttcaccggcttctcccaagatcctctaccggaaccctcgatttttacgcctggctttcctccaactgcaccatcagcagcaatcagacgtcttttgcgacgtgctgctgcaggcagagggcgaagctgtgcccgcacattgctgtattttatctgcatgctcgccgtttttcacagagaggctcgagcgggagaggccagcgcaaggcggtaaggtggtgctggagcttggcggactgaagattagtaccctgcgcaaactcgtggactttctttacacatcagagatggaagtctcccaggaagaggcccaggacgtgctttccgctgccaggcaactgagggtatcagagctcgaatccctgcagttggaaggcggaaagctggtgaaagccccacagggaagacgcctaaaccgagaatgtctccaaccaaccagcgcggctcctatctccgcgagagttgttactccttcacaccacccacacactcctttaccgactaaccagacaccttgccccttaggggctatcagactgaaatcactgggaaaagaggagggtcctcaggagaacaacagacaaaatgctgacaatttgtctgggactttgttactgaagcggaaagccagagcttgtcctactccccaggaaaagaactcctctccatcttcacatagtcaggagcctcgggagaacaagaacgacaccgctctggatcctactgtgctctccccgccatctctgtacccatctgtggacaaacacctgctgccacggaagatcaggctcagcaggtcaaagccttcgcccggtatctgtacaagcaaaccatcctctatactttcagggagttcctccgtgcccgctacacccggtagacggctgtggcgccagcgcagcgtaaataaggaaacaccagaggataaaccaaagccagggagagctagcccactgcaaagcactcctaaccctagtggactgggtaagacaggcggtagcagaaagaggtcccccgaagtccgcgctccaaattccgactccgccgaggaaggccaggtgggtcgcgtcaagctcaggaaaatagtgaatgggacttgttgggaggtggtgcaggagacacccctcaaaaacacccaggacagcccgcagattccggaccctggaggggactttcaggagcctagcggcacccagccattctcatctaacgagcaggagatgagtccgactaggactgaactgtgtcaggattctccaatgtgtacgaaactgcaggatattctggtcagcgcttcacactcgcccgatcatcccgtcgtgaagagcgagttcgaaagctcccctgaactggtggaaaaggagcctatgctggccatcgactgccgtgagccgtacgcttttgataccgcccttctggagcagccttgcgaagccgaggaataccgaatcacatcggcagctgcaacatctgagctggaagaaattctggatttcatgctgtgcggcagtgatatcgagccgccaatcggaagcctggagtcacctggagcagaaggatgtcgcacaccaacctaccatttgaccgagacaggcaaaaattggattgagggcgaggaatggtgtctgcccgacatggagttgtggcccagggagttaaccgaattggagaaggaacctgccggtgagaataggggtccaaccgagctcctgtcccctctggtgatgccgagcgaagtctccgaggtgttatccgtcggcggaagatggactcccgatttggagattacttccagtcagccattagacggccaggaagacaaactactgcacgtgagctcactggataccccccagagatcctacggcgatttgtctcccccttgtagcaattgggttgagacaggccttgaggtgtcacttacaacagacgagctactgtatccttccccaaaggcgggaaaagaggtgtccgggcacagcgagctactggggagtctgccagcttcatctgaggaagaagaaatcgatgtggtggactggacagccgagggccgtctcgttccaaccactgtgccttccgtgtggccagacccatctagtgaatcagagactgaggtggacattctgacgtag

SEQ ID NO: 53358 - DNA, 270 bp, Artificial Sequence
  Description of Artificial Sequence: Synthetic coding sequence
atgtgttccccggcatcaccaaaaatcctgtataggaaccccaggtttctgaggcttgcgttcctgcagctccaccaccagcagcagtctgatgtcttttgtgacgtcttgctccaggcagaaggcgaagcagtgcccgcacactgctgcatcctgagtgcatgctccccctttttcactgagcgcctcgaacgggagcgcccagctcaaggtgggaaggtggtgttggagctcggaggcttaaaaattagtacgctcaggaagctttag

SEQ ID NO: 53359 - DNA, 876 bp, Artificial Sequence
  Description of Artificial Sequence: Synthetic coding sequence
atggaaccgttaggcctggtggtgcacgggaaagccgagcctttctccgctgccctgagaagtctggttaataaccccagatatagcgacgtgtgtttcgttgttgggcaagagaggcaggaagtctttgcacaccggtgcctcttggcttgtcgttgcaacttctttcagcgcctgctgggtactgagcctggccctggcgtcccaagtcctgtcgtgttaagcacggtgccaacggaggccttcctggcagtgctcgaattcctgtataccaactctgtcaagctgtacaggcacagtgtgttggaggtcctgacggcagcagtcgagtacggactggaggagctacgcgagctttgcctccaatttgtcgtaaaggttcttgatgtcgatctggtctgtgaagccctgcaggtagcagtcacctttggactgggccagctgcaggagaggtgcgtggcttttattgaagcccacagccaagaggccctgcggacaaggggtttcttggagttgtcagcggcagctctgctgcccctcttgaggagcgataaactatgtgtcgatgaggctgagttagtgagagcagccaggagttgggcacgggttggggctgcggtcctcgaacggcctgttgcagaggtcgcagcccctgtggtgaaggagctcagactggctttgttggctcccgctgaactgtccgccctggaagaacagaatcgtcaggagccactgattcctgtggagcaaatagtggaagcatggaagtgtcatgcgctgaggaggggggatgaggccagaggcgcaccttgcagacggcgaagagggactttgccacgggagcaccatcgattcctggatttgtcctttaaatag

SEQ ID NO: 53360 - DNA, 489 bp, Artificial Sequence
  Description of Artificial Sequence: Synthetic coding sequence
atggaacctttaggactggtggtacacggcaaggccgaaccgttcagtgcggctctccgctcactagtgaataacccacggtattctgacgtgtgttttgtggtaggccaggagcgccaagaagtattcgcgcacagatgtctgctggcctgcagatgtaatttcttccaaagactgcttgggaccgaaccaggacctggcgtgccatctcctgtcgtcttatcaacagtacccaccgaggcattccttgcagttttggagttcctctacacaaattcagtcaagttataccgccatagtgtgctggaagttctgaccgctgccgtggaatacgggcttgaggaactccgcgaattatgccttcagttcgtggttaaagtactcgatgtggacctagtgtgcgaggcgctccaacacttttggcgtccccgtcgagccgatcaggaggttcgtcgctcaagaccatcctggttgacccgctggccatag

SEQ ID NO: 53361 - DNA, 1386 bp, Artificial Sequence
  Description of Artificial Sequence: Synthetic coding sequence
atggctgctgatatctttccccgaaagaagccggcaaacagctcttctacgtcagtgcagcagtaccaccaacagaatcttagtaataacaacctgatcccggctccaaattggcagggattatatccaaccattcgagaacgaaacgcaatgatgtttaataacgatctgatggctgacgtgcacttcgttgttgggcctcccggaggcacacagcggctgcccggacacaagtacgtgttggcagtcggaagctcagtctttcatgccatgttttatggcgagctagcggaagataaagacgaaatacgtattcctgacgttgagcccgctgcttttctcgccatgctgaaatatatctattgcgacgagatcgacctggccgcagataccgtgctggccaccctgtatgcagctaagaagtatatagtgccccatctcgcaagagcgtgtgtgaatttcctagagacttccctgagcgcgaagaacgcgtgtgttctattgagccagtcctgcttgtttgaagagccagacctcacccagcgatgctgggaagttatcgatgcgcaggccgagttagctctgaaaagtgagggcttttgcgacatcgactttcaaactctcgaatcaatcctgcgcagagaaacgctgaacgccaaggagatagtagttttcgaggccgctttgaactgggccgaggtggaatgccaaaggcaggacttggctctgagcattgaaaacaagcggaaggtgcttgggaaagcactgtacctcatccgcatcccgactatggcactggatgactttgccaacggggcagctcaatccggagtcctcaccctgaatgaaaccaatgacatctttctgtggtacacagccgctaagaagccagagttgcagtttgtaagcaaggcacgcaaagggctcgtcccacagcgatgccataggtttcagtcttgcgcctacaggagtaaccagtggaggtataggggtagatgcgacagcattcagttcgctgtggacaagagggtgtttatcgcagggttcggcctgtatggtagctcatgtggctcagcggagtactcagccaaaatcgagttaaagaggcagggggttgtgctaggccagaatctgtcaaaatatttttctgatggctcatctaacactttccccgtctggtttgagtatcctgtgcagatcgagccggatactttctatacggccagtgtgatcctggatggcaacgagcttagctatttcggtcaggaggggatgacagaggtgcagtgtggaaaagtgactgtccaattccagtgttctagcgattccaccaacggtacgggcgtacaggggggtcagatccctgagcttatattctacgcatag

SEQ ID NO: 53362 - DNA, 1569 bp, Artificial Sequence
  Description of Artificial Sequence: Synthetic coding sequence
atggttgacgacaaggagaaaaatatgaagtgtctcactttttttctaatgctccccgaaactgtgaagaaccggtccaagaagtcctcaaagaaggctaacaccagtagtagctcttccaacagttctaagttgcctcccgtctgttatgaaatcatcactctcaagacgaaaaaaaagaagatggcggcagatattttcccgcgaaaaaaaccagcaaattcatcaagcacctccgtgcaacagtaccatcagcagaacctgtccaataacaaccttattcctgccccaaactggcaggggctctaccccacgatcagggagagaaacgccatgatgttcaataatgacttgatggcggatgtacacttcgtggtggggcctcccggtggaacgcagcgcctgccgggtcacaagtacgtcctagccgttggcagttcggtgttccatgctatgttttacggtgagctggccgaggacaaggacgaaattcgcattcctgatgtagagccagcagcatttcttgctatgctcaagtacatttattgcgatgaaatcgacctggccgctgacacggtgttggcaacactttacgccgctaagaagtatatagttcctcatttggctcgcgcatgcgtcaacttcctggagaccagcctctcagccaagaacgcgtgtgtcctgctgagtcaaagctgtctgttcgaagagcccgatctgacacagaggtgttgggaggtgattgacgcgcaggccgaactagctttaaaatcggagggcttctgcgacatcgactttcagacccttgagtctattttgagacgggagacgctcaacgcaaaggagatcgtcgtgttcgaggcggctcttaattgggctgaagtcgagtgtcagagacaagatctagccctcagtatcgagaacaagcgtaaagtgctcggaaaagccctttacctcatcaggataccaaccatggccctagacgacttcgccaacggggctgcccagtcaggtgtgctgactctgaacgagacaaacgacatctttttatggtatactgccgcaaagaaacctgagctacaatttgtaagtaaagcaagaaaggggctggttccccagcgatgccacagattccaaagttgcgcctaccgtagcaatcagtggagatatcgaggtcgttgtgattccatacagttcgcagtggacaagcgcgtgtttatcgctggcttcggcctgtatgggtcctcatgcggctcagcagagtactcagccaagattgagctcaagagacagggggtagtgctggggcagaacctgtcaaaatattttagtgatggcagcagcaatacatttcccgtttggttcgagtatcccgtgcaaatagaaccagatactttctatactgcctccgtcattctggatggcaatgagttatcatactttgggcaggagggtatgacagaggtacagtgtgggaaggtgaccgtgcagttccagtgcagctccgactcgactaacggtaccggagtgcaaggcggacagatccccgagctgattttttacgcgtag

SEQ ID NO: 53363 - DNA, 1386 bp, Artificial Sequence
  Description of Artificial Sequence: Synthetic coding sequence
atggcggcagacatttttccgaggaagaaacctgctaattcctcctcgacttccgtccaacagtatcaccaacagaacctgagcaacaacaatctcattcctgcacctaattggcaggggctgtaccctactatcagggagagaaatgcaatgatgttcaacaatgacctgatggctgatgtgcactttgtggtcggccctcctggcggaactcagcgcctccccggtcataagtacgttctggccgtagggtcatccgtgtttcatgccatgttttatggagagctcgctgaagataaagacgaaataagaatacccgatgttgagcccgctgcttttcttgcgatgctcaaatatatttattgcgacgagatcgatttagccgctgatactgtcctcgcgacactgtacgccgcaaaaaaatatatcgtccctcatctggccagagcctgtgtgaacttccttgaaacttctttgtctgcgaaaaacgcatgtgttttgttgtcccagtcctgcttattcgaagagcccgacctgacacagagatgctgggaggtcattgatgcccaagcagagctcgcccttaagtcagagggattttgcgatatcgacttccagacgctcgaaagtatcctaaggagggagacactcaatgccaaggagatcgtcgttttcgaggctgctcttaactgggcggaggtagagtgccaacgccaggatcttgccttgagcatcgagaacaagcgaaaggtgctcgggaaggccctctacctcattaggatccccaccatggctctggacgactttgctaatggagccgctcagtccggggtgcttaccttgaacgagaccaatgacattttcctgtggtacactgccgctaagaagcccgagctccagttcgtcagcaaagcaagaaagggcttagtgccccagagatgtcatcgatttcagtcttgtgcttaccggtccaatcagtggaggtacagaggcaggtgtgattcaatacagtttgccgtcgataagcgcgtgtttatagccggattcgggttgtatggctctagctgtggcagcgctgaatattccgccaagatcgaactgaaaagacagggggtcgtgctgggtcagaacctcagcaaatacttttccgacggcagttcgaacacttttcctgtctggtttgaatatcctgtccagatagaaccagacacattctacaccgcgagtgtgattttagacgggaacgagctctcatattttggacaagaaggtatgacggaggtgcagtgcgggaaggtgacggttcagttccagtgcagttccgactctactaatggaacgggagtacaggggggacaaattccagagttaatattctacgcgtag

SEQ ID NO: 53364 - DNA, 1569 bp, Artificial Sequence
  Description of Artificial Sequence: Synthetic coding sequence
atggtggatgataaagaaaagaatatgaagtgtctgacctttttcctgatgctgcctgaaactgtcaagaataggtcaaagaagagttcaaagaaggctaacacctcttcctcaagctcgaatagttctaagctccccccagtgtgctatgaaataatcaccttaaagacgaaaaaaaagaagatggccgctgacatattcccaaggaagaaaccagcaaattctagtagcacctcagtgcagcaataccaccagcagaatcttagtaataacaacctgatccccgctcctaattggcaggggctctaccctaccatacgcgagaggaacgccatgatgtttaataacgacctcatggcagacgtccattttgtcgtgggtcctccagggggtactcaacggctccccggacacaagtatgtactggcagtgggctcgtccgtttttcacgctatgttctatggagaactagccgaggataaggatgagattaggatcccggacgtggaacccgctgctttcctggctatgctgaaatatatctactgtgatgagattgacctggcagcagatactgtcctggcaaccctgtatgcggctaagaaatatatcgtgccacatctcgctcgtgcatgcgtgaactttctggagaccagtctgtctgcaaagaacgcttgtgtgctgctctcacagtcatgccttttcgaggagcctgacctgactcaaaggtgttgggaagtgatcgacgcgcaggctgagctagccctaaagagtgaaggattctgcgacatagacttccagaccctcgagtcaattctacgtcgagagaccctgaacgctaaggaaatcgtggttttcgaagctgcgcttaattgggcagaggttgaatgtcagcgacaggacttagccttgtcaatcgaaaataagagaaaggtgctggggaaagcattataccttattcgaatcccaaccatggccctggacgatttcgccaacggagcagctcagtcgggggtgctcacattaaatgagacaaatgatatatttctctggtatacagccgctaagaaacccgaactgcagttcgtgtccaaagcaagaaagggcttagtcccccaacgatgccaccggtttcagtcctgcgcctaccgtagtaaccagtggcgctacagaggccgatgtgattccatccagttcgccgttgataaacgggtttttatagctggttttgggctctatggaagtagctgtggaagcgccgaatattcagcaaagatagagctcaaacgacagggtgttgtgctgggacagaatctctccaaatatttttctgacggaagcagtaacaccttcccagtgtggtttgaatatccagttcaaatcgaacctgatacattttatacggctagtgtgattctggacggcaacgagttgagctatttcggccaggaaggaatgacagaagtacagtgcgggaaggtcaccgtacaatttcagtgttccagcgacagtacaaatgggaccggggtgcaaggtggccagatccccgagctgatcttttacgcttag

SEQ ID NO: 53365 - DNA, 411 bp, Artificial Sequence
  Description of Artificial Sequence: Synthetic coding sequence
atggccgcagatatctttccaagaaagaagccagccaatagctctagtacaagtgttcagcagtatcaccagcagaacctgagtaacaacaaccttatcccggctccgaattggcaggggctctatccaacgattcgggagagaaacgctatgatgttcaacaacgatctgatggccgatgtgcacttcgtggtgggaccgcctggtggcacacaacgcctgcctggccacaagtatgtattagcggttggcagttctgtttttcacgccatgttttacggagaattagcagaggataaggacgaaatacgtatcccagatgtggaacccgctgcctttctcgctatgctgaaatatatctactgcgatgaaattgatctggcagcagacactgtactggcaacgctgtag

SEQ ID NO: 53366 - DNA, 9 bp, Artificial Sequence
  Description of Artificial Sequence: Synthetic coding sequence
atggcttag

SEQ ID NO: 53367 - DNA, 1860 bp, Artificial Sequence
  Description of Artificial Sequence: Synthetic coding sequence
atggccgcagccccacctctctccaaggcagagtacctcaagaggtacctgagcggtgcggatgcgggagtggatcgcggttccgagtctggtcgtaagaggaggaaaaaacggcctaagcccggtggagcaggtggcaagggaatgagaatcgtggatgatgatgtgagctggactgccatctccaccactaagttggaaaaagaggaagaggaagacgacggagacctgcccgttgtggcagaatttgtggacgagagacccgaggaagtgaagcagatggaggccttccgctccagcgcaaagtggaagctgctcgggggacacaatgaagacctcccaagtaacagacatttcagacatgacacgccagactccagccccagacgggtcagacatgggacgcctgacccaagccctcgtaaggatagacatgatactccagacccatctccaaggagggctcgtcacgacactcctgacccttctcccttgaggggagcgcgtcatgattctgacacgtctcctcctagacggatcagacatgactctagcgatacgtcaccccctaggcgggctaggcatgactcccctgatccttctcctcccaggagaccgcagcataacagttctggagctagtccgagaagagtgcggcacgattcccctgacccaagccctccaaggcgggcaaggcacggctccagtgatatatcttcccccagacgcgtccataacaattctccagacacgtcccgccgaactttgggtagcagtgatacccaacaacttaggagggccagacacgactcacctgacctcgcccctaatgtgacatactccctgccgagaactaaatcaggaaaagcacccgagcgagcctccagcaaaacatctccccactggaaggagagcggagcaagccaccttagtttccccaaaaactctaagtacgagtatgacccagatatctctccccctaggaaaaaacaggctaagagtcacttcggggataaaaaacagctggactccaagggagattgtcagaaagcaacagattcagacctgtcatcgccaagacacaagcaatctcccggacatcaggattcagattctgatctgagtccccctcgcaataggccccgacaccgctctagcgatagtgatttgagtcccccacggagaaggcaacgaacaaaaagttccgacagcgacctgtccccaccacggagaagccagccccctgggaagaaagctgcccacatgtatagcggcgcaaagacgggcctggtgctcaccgatattcagcgagagcaacaggagcttaaagagcaagaccaggagacgatggcattcgaggccgaatttcagtacgcagaaactgtctttcgagataagtcaggccgtaagaggaaccttaagttggagcgcctggaacaaagaagaaaagccgaaaaggactccgaaagggatgagctgtacgctcagtggggtaaagggttggcacagagtcgccagcaacagcagaatgtcgaagatgctatgaaggagatgcagaaacctctggcgagatatatcgacgatgaggacctggacaggatgctgagggaacaagagcgcgaaggcgacccaatggccaacttcatcaagaagaacaaggcaaaggaaaacaagaataaaaaggtccggccaagatacagcggtccagctcctccacccaataggttcaatatatggcccggttaccgatgggacggtgttgatcgaagcaatggctttgaacagaagcggtttgcacgcttggcatctaaaaaagccgtcgaggaactggcttacaaatggtcggttgaagacatgtag

SEQ ID NO: 53368 - DNA, 1458 bp, Artificial Sequence
  Description of Artificial Sequence: Synthetic coding sequence
atggccgcagccccaccattgtctaaagctgagtacttaaagcggtacctctctggagctgacgctggtgtggaccgtggctctgaatctggcaggaagcgcagaaagaagagaccaaagcctggaggggctggtggaaagggaatgagaattgttgatgatgacgtctcctggacagcgataagtactactaagctggagaaagaggaggaagaagacgatggagatctgccagtggtcgccgagttcgtcgacgaaagaccggaggaagtcaagcagatggaagcatttcggtctagcgctaaatggaagttactggggggacataacgaggacctgcccagcaatcgacattttagacatgacactccagatagctccccgcgtagggtgcgacatggcactccggatccatcacccagaaaggatcggcacgataccccagacccttctcccaggagggccaggcacgacacgcctgaccctagtcccctccggggtgccaggcacgatagcgatactagccctcctcgtagaatcagacacgacagtagcgatacctcaccccctcgtcgcgcacgtcatgacagtcccgatccatcaccaccgcgtaggccacagcataactccagcggggactgccagaaagccaccgactcggatctcagcagccctagacataagcagagccccggacaccaggattccgactctgacctgagtcctccaaggaataggccgcgacaccgtagttcggacagtgacttatccccccctaggaggaggcagcgaaccaaaagtagcgactccgacctgagcccccctaggaggtcccagccaccgggtaagaaggctgcccacatgtactcaggagccaagacaggcttagtgctcacagacatccagcgcgagcagcaggagttaaaggaacaggaccaggagaccatggccttcgaggccgaattccagtatgcagagaccgtgttccgggacaagtctggacgaaagagaaatctcaagctagaacgcttagagcaaagacggaaagctgagaaggatagcgaacgcgacgaactctatgctcaatggggcaagggtctggcccaatctcgccagcaacaacagaacgtggaggacgccatgaaggaaatgcagaagccactcgccaggtatattgatgatgaggatttagatcgtatgctgcgggaacaagaaagagaaggtgatcccatggccaacttcataaagaaaaacaaggcaaaagaaaacaaaaacaagaaagtgcggcctagatatagcggccctgctcctccccctaaccggttcaatatttggccaggttaccgatgggatggcgtggatcggtctaatggttttgaacagaagcggtttgccagactcgccagcaagaaagccgtggaagaactggcgtacaagtggagcgtagaggacatgtag

SEQ ID NO: 53369 - DNA, 600 bp, Artificial Sequence
  Description of Artificial Sequence: Synthetic coding sequence
gctcctggcagactcgcctcccggccacctccccctcccgcaagacgatggcgccttgcagccccacgctacagtagtgcctctggcccaagcggtcccgctgctcgtctctgtgcagagacacagggcgaggctcctagaggccctagggccgtcggcggatctggaggcgctggcgagcccaggtggtcgcggggacccgcacagagagagcgactgctggggtgctcatgttgtttcccgtcatttttcacagggacctgcagctttcggaccagttggagtgcttttacgctggagttgacctctagcatccctgcacccctgcccccaccccctgctgcactctcgttgagccagcagcagggcaagtcccggagaaaagaggcttctactcccttaacaccggctgaagccccagcttacagcagggcgaggccaaggcggcagggctcaccgtctgcaggaccggaagcccctttggcgaccgatgagcctcccccacagcgacggtctggcatacgaggtggatccgcaaacattcgttccctgcagccttcttccctaagaccgtcagcccatcggggatcggctctgtag

SEQ ID NO: 53370 - DNA, 1185 bp, Artificial Sequence
  Description of Artificial Sequence: Synthetic coding sequence
atgtcaagaatataccatgatggggctctgagaaacaaagctgtgcaatccgtccgcctgccaggggcttgggatcccgctgctcatcaaggtggaaatggagtacttttagagggagaactcatcgatgtgagccggcattctatcttagatactcacggcaggaaagaaaggtactatgtgctgtacatccgcccttctcacattcaccgcagaaagtttgacgccaagggaaacgaaatcgaacccaacttctccgcgaccaggaaagtgaatacaggattcctaatgtcctcctacaaagtggaggccaagggggatactgatcgtctgactcctgaggccctcaagggcctggtgaacaaaccagagctgctggcactcacggagagcttgacccctgaccatactgtggccttctggatgcctgagagcgagatggaggttatggaactcgaactcggcgctggcgttcggcttaagacccgaggagatggcccttttcttgattccctggcaaagctcgaggcgggtacggtaactaagtgcaacttcaccggcgacgggaaaacaggcgcatcttggaccgacaacatcatggcacagaagtgcagcaaaggcgcagccgctgagatcagggaacagggagatggcgcagaggatgaggaatggccagaggagattcagcagcaaatcgtgcgagagacatttcatctggtgttgaagagggatgacaatatctgcaacttcctggaagggggatccctgatcggcggatccgactacaaactcatctaccggcattacgcaacgttgtacttcgttttctgtgtggattcctcagagtccgagctcggaatccttgacctcatccaggttttcgtagaaaccctcgacaagtgctttgagaatgtctgtgagctcgacttgatttttcacatggataaagtgcattacattttacaggaagttgtgatgggaggcatggtgttagagaccaatatgaacgaaatcgtagcgcagatcgaggcccagaacagactcgaaaagagcgagggagggttgagcgccgctcctgctcgagcagtttctgccgtgaaaaacattaacctccctgagatcccccgtaatatcaacataggagaccttaatatcaaagtcccaaacctatctcagttcgtatag

SEQ ID NO: 53371 - DNA, 1176 bp, Artificial Sequence
  Description of Artificial Sequence: Synthetic coding sequence
atggccggatccatggttacccctctgctgtataggcggaaacttcgtcccggagaacgcaagatgcggccagaagtgggtagggaacctgccgcactccagcccagacaacgtccaagatcagaccaccagttgcacagatccccttttactgtgccaccgaggaccccggcttgtaggtctcctggtccgtctccccctattgccgtagccctggaagtgaagccccaactcgaggatgcagtaggtaagctggcagccgaggccgtggccgtgcgagtattccccctggccgtggatgacctcgagagtgacgtcttggtcggaaggccccgagtcgaagcccaggacggagagatcctcgttgtcggtgctggccttcaggaggtccttggcaggggcgcacttgtcgacgaagtgggcgtggaggacgtcgaattggtttccttacacgatctggggagatgggtggtaaaggtcgtggttagactggtggtgcttgttccgctggaggcccgagttcatgccgtggaagaagctcggctggcctggccagtgctcgtggggcctcaggtaggactggccggagagtggcacctgcacgcagaacttagactagtgctggcccacgcattattaggaccgcctgaggaggacgtgttaggagctctagccggagtgtcccgagatcttgagctcctggctcgcgagctgcaggctctccaggtccttatccgcttccaacacgtgcgtgtgcagtggcagctcgtcagacgggaacagccccgagctgtcccagctggagtagtggtggtccaggccctgctggaccaggtcttgctgcatgaacatcgtctagcgctggccctcgcccttactgtgcctgttgcagttgccttatgtaggggcagggccgtacacctaggcctgagaggcgcagcccttcgcggaggccctggaagggggggtcgacgggtgctgaggctccaggccgctgcaggcggactcggactcctgctggaggacggggagcagcgattggcccttcatgctttgctgcttctgcaattcgttcagttgctgcctcagcacgtactagtcgcattgactcaacccagcgcgcatagggcaagggccatgtgggcaagaagctgttgcaggagactctcccagtag

SEQ ID NO: 53372 - DNA, 1062 bp, Artificial Sequence
  Description of Artificial Sequence: Synthetic coding sequence
atgtggctcctggagaaggctggttataaggtgggggcagccgaaccagctgcccgttgggccccatctggacttttctctaaacgtcgagcgccaggccctcccacgagcgcctgtcccaacgtgttgactccagacaggatccctcaatttttcattccgccacgcctcccagatcctggcggtgcagttcccgctgccagaagacatgttgccggacggggtctgcccgcaacctgcagtctaccacacctggcaggcagggaaggttgggcatttttaccggagtctcctcacaccagacgccgagaatcactgttccatgggcctccacctgcgccagccggaggccttcctgccgctcaatcccgcttacatgttagcgctccggacctcagactttgtcgggcaccagacagtgatacagcctcctcaccggactcttccccttttggaagccctcggcctggactgggaagaaggagggtcagcagaccccattccctttcgcccgagaaggcatctagcgctgatacaagccctcattccccccgtagggctggccctcccaccccacccttgtttcacctcgattttttatgttgtcagctgagaccgacccgggaaagcgtgctcagacttggccctcgaggtggacagctgcggttatccacagagtaccaggccggtcctgggaggctgagactaagactggtcagcgcagaaggcttacctaggcccagaagcaggcctggcagtggtggaggtgggtgttgcgtcgttctgagactgcggccacgcgttcgccctcgcgaacagcagtcacgggtagtgaagtgctcagcaaaccctatttttaacgaagactttttttttgatgggctgggaccacctgaccttgctgccagaagccttcgggctaaggtgttagataggggggcaggccttcgtagggacgttctgctgggcgaatgtgagacaccacttattgcattgctgccccctctgggagggggactggggcctggaagttctctagccccaacccacttatcactgtag

SEQ ID NO: 53373 - DNA, 2124 bp, Artificial Sequence
  Description of Artificial Sequence: Synthetic coding sequence
atggatcctggatgggggcagagggatgtgggctgggctgcccttctcattctgtttgccgcatcactgctcaccgtgttcgcctggctcctacagtatgccaggggcctgtggctcgccagagcccgaggcgatcgaggaccagggccagctcttgctggggaaccagccggtagcttacgtgaactcggcgtgtggaggtcgctactgcgcttgcgcgcaacccgagccggagctgcagaagagccaggcgtgagaggactgctggcctctctttttgctttcaagagttttagagaaaattggcagcgggcttgggtccgggcacttaatgaacaagcttgtcgaaatggctcctctatccagatcgctttcgaagaagtgccccagctgccaccaagggcctctatcagtcacgtgacatgcgtggaccagtctgagcacacgatggttctgcggtgccagctttccgccgaagaagtgcgctttcccgtgtcggtgacacagcagtccccagcagccgtgagtatggaaacctatcacgtgaccctcaccctccctcctacacaactcgaggtcaacttagaagagattccaggtgagggcctgctcatctcgtgggccttcacagaccgacctgacctttccctgacagtcctccctaagttgcaggcccgtgaaaggggcgaggaacaggtcgagctctctactattgaagaattgatcaaggatgccatcgtttccacgcagccggcaatgatggtaaacttacgtgcctgctctgctccagggggtcttgtgcctagcgagaaacccccaatgatgccgcaggcacagccagcaattccaagacccaaccggctattcttgagacagctgagagcgtctcacctagggaacgagctagagggaaccgaggaactgtgttgcgtggccgaactggacaacccgatgcagcagaagtggaccaaaccagccagagctggctcagaagtggaatggaccgaagatcttgccctcgaccttggcccacaaagtagggagctgaccctgaaggttcttcgcagcagcagctgcggcgacacagagcttcttggtcaagcaacactcccagttgggagcccttcccgccctctgtccaggaggcaactgtgtcccctcaccccaggccctggcaaggcgctcggtcctgctgctacgatggcggtcgaattgcattatgaagagggctcccccagaaacctggggacgccgacttcttcaacaccgaggccgtctatcacacctaccaaaaagatcgaattagacaggactatcatgcctgatggaactatcgttacaacagtcacgactgtgcagagtaggcctcgcatagatggtaagctggactcaccatctagaagtcccagtaaggtggaggtgaccgaaaagaccacaaccgtgttgtctgaatccagtggcccaagcaatacttctcactctagttcacctggcgactcgcacctgtccaatgggctcgacccggtggcagagaccgccatccgtcagttgaccgagcctagcggtagagtcgcaaaaaaaactccaaccaagaggtctaccctgattataagcggcgtgtccaaggttccaattgcccaggacgaattagctctatcactagggtatgctgcttctctggaagcaagcgtgcaagacgacgctgggacctctggcggaccttccagccccccaagtgacccccctgctatgtcacctggtcccctggacgctctctcttccccaacctccgtccaagaagcagacgaaaccacacgctccgatatctccgagagaccatcagtagatgacatcgaatcagaaacaggaagcacaggggcactggaaactcgttctctgaaggatcacaaagttagcttcctgagatctggaacaaaactgatttttcggagacgcccacggcaaaaggaagctgggctgtcacaatcccacgacgatctgtcgaacgcgactgctactccctccgtgaggaagaaggccggatcctttagtcgcaggttaatcaagcgcttctctttcaagtctaaacctaaagccaacggcaatccaagcccgcagctgtag

SEQ ID NO: 53374 - DNA, 840 bp, Artificial Sequence
  Description of Artificial Sequence: Synthetic coding sequence
atgataaaccaactcacgggcactatacaagtcgcccagcgaatcgatagggatgccggtgaactaagacagaatcctacaatctcattagaggtgctcgtgaaagacagaccatacggcggtcaggaaaacaggatccagataaccttcatagtcgaagatgtcaatgataaccctgcgacttgccagaaatttactttcagcattatggtaccagagagaacggccaagggaactttgctgctcgacctcaacaagttttgtttcgacgatgatagtgaggcacctaataacaggtttaacttcactatgccgtcgggcgtcggttccggcagcagatttctgcaggacccagccggttcaggcaagattgtcctgatcggcgacctggactatgaaaatccctcaaatttggcggctggcaacaagtacacagtgataatccaggtgcaggatgtggcaccaccctactataagtccaagtataatgtctatgtttacatcttgacgtcacccgaaaatgagttcccgctaatcttcgaccggccttcctatgtgtttgatgtaagcgaacgccgtccagcccaagggcatctgtcgggccctgaggagaagcgcttactgtccatttgcatggtgagagcagtatgtcatcacttcggccttcacatagcgtctggctccccgagagtgccaggccgacccatcggtcagtcccacccacaaactctgcctcttcaggattgggaggaacaggggacaagcgtaagagaaatcccgaacgaagattgcagggaacgcagacgcggtggaaactatcccgacgagcactatctttag

SEQ ID NO: 53375 - DNA, 957 bp, Artificial Sequence
  Description of Artificial Sequence: Synthetic coding sequence
tacaccgtgctagaggagctgtctcccggaaccattgttgcgaatattactgctgaggatcctgacgacgagggatttcctagtcacctcctgtatagtattacaaccgtgtctaagtacttcatgataaatcagctgactggaacgatccaggtggcccaacggatcgatagagatgccggtgaacttcgccagaacccgacaatctccctggaggttctggtgaaggacagaccatatggaggtcaagagaatagaatccagattactttcatagttgaggatgtgaatgacaaccccgctacgtgccagaagttcaccttcagtatcatggttccggagcggactgctaaaggaaccctgctgttggacttaaacaaattttgcttcgatgatgatagcgaagcccctaacaataggttcaactttaccatgccgagcggcgtaggaagtggctcccgcttcctccaggatcctgctgggtctgggaagattgtgcttatcggggacttggattatgagaatccatcgaacctagccgcaggaaacaaatacactgtgattattcaggtgcaggatgtggcccctccatattataagaataatgtctacgtctacattctcacttctcctgaaaacgagtttcccttaattttcgatagaccttcttacgtctttgatgtgagcgagcggaggccagcacagggccatctctcagggccagaagaaaaaaggctgctgagtatttgtatggttagagcggtttgtcaccattttggactgcatatcgcaagtgggtcgcctagagttcctggccgtcccatcggccagagccacccccagacccttcctttgcaggactgggaagaacagggtactagtgataaagagcgaaggaatgaagattgtagagaacggagacgagggggaaactatcccgacgaacactatctgtag

SEQ ID NO: 53376 - DNA, 450 bp, Artificial Sequence
  Description of Artificial Sequence: Synthetic coding sequence
atgcaggaggcaataattctgctggctttgttgggcgctatgtctggaggcgaggccttacatttgattctgctgccagctacaggtaacgtagctgaaaacagtcccccagggaccagtgtgcacaaattcagcgttaagttgagcgcctccctttctcccgtaatacctggattccctcaaatagtcaacagcaacccgctgacagaagcattcagagtgaactggctaagcgggacatatttcgaggtagtcacgacggggatggagcagctggacttcgagaccggccctaatatttttgaccttcagatctatgtgaaggatgaggtgggcgtgaccgacttgcaagtcttaacagttcaggtgaccgatgttaacgagccaccacagtttcagggcaacttagcagaagccagacacgaatgcactcagagttggcggaactag

SEQ ID NO: 53377 - DNA, 2658 bp, Artificial Sequence
  Description of Artificial Sequence: Synthetic coding sequence
atgcaggaagctatcatcctcctggctctgctgggcgctatgtcaggtggtgaggctctccacctcatactgctgcccgctacaggaaacgtcgccgagaattctcccccaggcacttcagtgcacaaattctctgttaagctgagcgccagtctgtcgcctgtgattcctgggtttccccaaattgtgaactccaatccgcttaccgaggccttccgcgtgaactggttaagcggcacatatttcgaagtagtgacaacaggcatggaacagctcgatttcgagaccggccctaacatattcgatctccaaatctacgttaaggacgaagtgggagtgactgatttacaggtactcactgtgcaggtcacagacgtgaacgagccaccacagtttcaaggaaacctggctgaaggtcttcacctgtacattgtggagagggccaaccccggatttatttaccaagtggaagcgtttgatcccgaagacacttctcggaatatcccgctgtcatacttcctgatctctccaccgaaatccttccggatgtctgctaatgggactctttttagcactacagagctcgattttgaagctggacataggtcctttcatttaattgtggaggttagggatagcggcggtcttaaagcctcgactgaactgcaggtcaacattgtgaatctcaatgacgaggtgcctagatttaccagtcctacccgggtgtacaccgttcttgaggaactgtcccctggcaccattgtcgccaacatcacagccgaggatccggacgacgagggctttcctagccatcttctgtactctatcactaccgtgtcaaaatactttatgattaatcaactcactgggactattcaggtggctcagagaatcgatcgcgatgcaggggagttgcggcagaatcccacaatctcactggaggtgttggtgaaggacaggccctacggcggacaggagaaccggatacagatcacattcattgtggaagatgtgaacgacaaccccgcaacatgccaaaagttcacgttttctatcatggtgcctgaacggactgccaagggaaccctcctcctcgatttgaataagttctgctttgacgatgacagcgaggcgcctaataacaggtttaattttacaatgcccagcggcgtaggcagtggatctaggttcttgcaagaccctgccggaagtgggaagatcgtgctgataggtgacttggactacgagaatccctcaaatctcgctgctggcaataagtacaccgtaatcatccaagtgcaggatgtcgcaccaccctactacaagaacaatgtttatgtatacatactaacgtctcccgagaacgaattccccttgatttttgatcggccttcatatgtgttcgacgtgtccgagcggaggcccgctcgaacgcgagtggggcaagtgcgggcaaccgataaagacctcccccagtcgagtctgctttacagcatttcaaccggaggtgcttccctgcagtatcccaatgtattttggattaatccaaaaacaggtgagctgcaactggtaaccaaggtcgactgtgagactaccccaatctatatacttcgcatacaagcaacaaacaatgaggatacctcatccgtcaccgtgacagttaatatcctggaagagaacgacgagaagcctatctgtactcctaattcttacttcctcgccctgccagttgaccttaaagtgggtaccaatatacagaatttcaaactgacttgcacagatctcgattcaagtcccagaagcttcagatactcaatcggtcctggtaacgtcaataaccactttacgttcagccctaacgcaggctccaatgtgacacgcctgctgctcacgagccgttttgattacgcgggaggcttcgacaagatttgggactacaagctcctggtttacgttaccgacgataatctgatgtctgatagaaagaaagctgaggctctggtcgagaccggtaccgtcacactctccatcaaggtgatcccacaccctaccaccataattaccacaacccctagacccagagtgacctaccaggttttgcgaaagaatgtctattctcccagcgcctggtacgtcccctttgttataacgctgggtagtattttgctgttggggctgctggtttatctcgtcgtcttattagcgaaagcaattcatcgccattgcccctgcaagaccggtaaaaacaaagagccgctcaagaaaaagacagaaaccaagactgccgaacgtgatgtggtcgtggagaccatccagatgaatacaatctttgacggagaggccatagacccagtgaccggggaaacatacgagtttaattcaaagacaggcgcacgcaaatggaaggaccccttgactcagatgcccaagtggaaggagagttcacaccagggtgcagccccacgcagggtgacagctggagaggggatgggctctctgcgaagcgctaattgggaagaggatgaactgagtggaaaggcatgggcagaggacgctggcctcgggtctagaaacgaggggggaaagctgggcaaccccaagaatcggaatcccgcttttatgaaccgcgcttacccaaagccccatcctgggaaatag

SEQ ID NO: 53378 - DNA, 945 bp, Artificial Sequence
  Description of Artificial Sequence: Synthetic coding sequence
atgtctgctgctgaagccggaggcgtgtttcacagggctcgtggcagaaccctggcagcttttcccgctgaaaaggagtctgaatggaagggccctttctatttcattctgggggctgacccacagttcggccttattaaggcctggtctacaggtgattgcgacaacggaggagatgaatgggaacaggaaatccgtctgactgagcaagcagtgcaagctatcaataagctgaatcccaagcctaagttctttgtcctctgtggcgatctcatccatgccatgccagggaaaccatggagaaccgaacaaacagaagatcttaagagagtcctgcgtgctgtggatcgggcaatccctctagtgttggtcagtggcaaccacgacattggcaacacccccaccgcagaaaccgtcgaggagttctgcagaacatggggggacgactatttctctttttgggtagggggagtcctgttcctggtgctcaatagccagttttacgaaaatccgagcaagtgtccctcgttgaagcaggcccaggaccagtggctggatgaacagctgagtattgctaggcagcgtcattgtcagcacgcaatcgtgttccaacatatccccctgttcctggagtctattgatgaagatgatgactactactttaatctttcgaaatcaacgcggaagaaactggcagataaatttatccatgccggtgtaaaggtagtgttctcaggtcactaccatagaaacgctggtggtacctatcagaacctcgacatggtggtttcttccgcaatcggttgccagctgggaagagacccccatggtctgagggtggtggttgttacggcagagaaaatcgtccatcgctactacagccttgacgaactctctgagaaaggcatagaagatgaccttatggatttgatcaagaaaaaatag

SEQ ID NO: 53379 - DNA, 519 bp, Artificial Sequence
  Description of Artificial Sequence: Synthetic coding sequence
atgtcagccgcagaagcaggaggcgtgttccacagagctcgcggtcgcactcttgcagcctttccagcagagaaagaatccgagtggaagggacccttctactttatcctcggtgcagatccgcaatttggcttaatcaaggcgtggtcgacgggggactgcgataatggcggagatgaatgggaacaggagattaggttaacagagcaagccgttcaggccattaacaagctcaatcctaagcctaaattctttgtgctgtgtggcgatttgattcacgcgatgccgggagtgaaagtggtgttctccgggcactaccatagaaatgctggaggcacttaccagaacctggatatggtggtaagttcggcgattggatgccagctgggcagagatcctcacggattgagggtggtagtggtcaccgccgaaaagatcgtccataggtattattcgcttgatgagctgagcgagaaggggatcgaggacgacctcatggacctgattaagaagaagtag

SEQ ID NO: 53380 - DNA, 426 bp, Artificial Sequence
  Description of Artificial Sequence: Synthetic coding sequence
atgggttttcagaaattttcccctttcttggctctgagcattttagtgttgctgcaggctggatccttgcatgctgctccttttagaagcgcactggaatccagccctgccgacccagctactctaagcgaggatgaggctcgactgttgctggcagccctcgtccaggattatgtgcagatgaaagccagcgaactggagcaggaacaagaacgagaagggtccagccttgatagtccaaggtcaaaaaggtgcggaaatctttctacttgtatgttaggaacgtatacacaggatttcaacaagtttcacacattcccgcagactgcgataggtgttggggcacctggaaagaagcgagatatgagctccgatctggagcgcgaccaccgccctcatgtcagtatgccacagaacgccaactag

SEQ ID NO: 53381 - DNA, 564 bp, Artificial Sequence
  Description of Artificial Sequence: Synthetic coding sequence
atgggaaataagcagactatctttacggaagagcagctggacaattaccaggactgtacgtttttcaataagaaagatatcttaaaactccattctagattctacgagcttgccccaaacctggtgcctatggattatagaaagagccctatcgtgcatgtcccgatgtctttgataatccaaatgccggaacttcgtgagaacccattcaaggaaagaattgttgccgctttctccgaagacggagaagggaacttaacgttcaacgacttcgttgatatgttttcagtgttgtgcgaatcagctccacgagagctgaaggcaaactatgcctttaagatttatgacttcaacacagacaactttatatgtaaggaggacctggagctcactctggctaggctgactaaatctgagctcgacgaggaggaagtggttttggtttgtgacaaagtgatcgaggaggccgatttagatggagatggaaagctgggattcgcggacttcgaagacatgatcgcaaaagcgcctgactttctgagcacattccacatccgaatctag

SEQ ID NO: 53382 - DNA, 564 bp, Artificial Sequence
  Description of Artificial Sequence: Synthetic coding sequence
atgggcaacaagcaaacagtgtttactcacgaacagctggaggcttaccaggactgcacctttttcacacgcaaggagatcatgaggctgttctacagataccaggatctggcaccccaacttgtgcctctggactatactacttgtcccgatgtcaaggtaccatatgagctgatcggcagtatgcccgagctgaaggataatccattcaggcagcggattgcccaagtatttagtgaggacggggacggtcacatgactctcgacaacttcctggatatgttctcggttatgagcgagatggcacctagagatctgaaggcgtattatgcatttaagatttatgactttaataacgacgattacatatgtgcctgggatcttgagcaaactgtcactaagttgacccggggtggcctctcagccgaggaggtatctctggtgtgtgaaaaagtattagatgaggccgacggggaccacgacggcaggctctccctggaggacttccaaaacatgatacttcgcgctcccgacttcttgtcaacgttccacattcgaatatag

SEQ ID NO: 53383 - DNA, 417 bp, Artificial Sequence
  Description of Artificial Sequence: Synthetic coding sequence
atggggaataagcagaccgtcttcacacatgagcagcttgaagcctatcaggataacccatttaggcagcgtattgcgcaggtgttttcggaggatggggacggacacatgaccttagacaactttctcgatatgttttccgtcatgtccgaaatggcacccagagatctcaaagcctactatgcatttaagatctatgactttaacaatgacgattacatctgcgcctgggacttagaacagactgtgaccaaactgacacgcggtggactcagcgcagaagaagtttccctggtctgcgaaaaggtgctagacgaagcagacggggatcacgacggacgtctttcactcgaggactttcagaacatgattttgagggctccagacttcctgagcacgtttcacattcgcatttag

SEQ ID NO: 53384 - DNA, 93 bp, Artificial Sequence
  Description of Artificial Sequence: Synthetic coding sequence
atggggaataagcagacagtattcactcatgagcaattagaggcatatcaggactgcacttttttcacaagaaaggagatcatgagattctag

SEQ ID NO: 53385 - DNA, 558 bp, Artificial Sequence
  Description of Artificial Sequence: Synthetic coding sequence
atgggccagtgtctccgctatcaaatgcactgggaggatcttgaagagtaccaggcactgacatttcttacacgaaatgagatactctgtatccatgacacattcctaaaactgtgtcccccaggtaagtattacaaagaggctacactgaccatggatcaggtgtcctcattacccgctctgagagtaaacccgtttagggaccgcatttgcagggtcttttcccataagggaatgttcagcttcgaagacgtcctcggaatggcctccgtgtttagtgaacaggcttgcccctcactcaagatcgaatacgctttcaggatatacgactttaacgagaatggattcatcgatgaagaggatttgcaaaggattatactcagattactaaatagcgatgacatgtccgaagatctactaatggacctgacgaatcatgttctgagtgagagcgacctggacaatgataatatgcttagcttctccgagtttgagcacgcaatggccaaatctcccgattttatgaactcattccgtatccacttttgggggtgttag

SEQ ID NO: 53386 - DNA, 450 bp, Artificial Sequence
  Description of Artificial Sequence: Synthetic coding sequence
atggctgcagagcacctgttgccaggccctcccccatccctagctgattttcgcttggaggcaggcggaaagggtacggagagaggttcaggttctagcaaacctaccggctcatccagggggcctcgcatggctaaatttctcagccaggatcagattaacgacggcaatggggagttagacttcagcacttttctcactattatgcacatgcagataaaacaggaggacccgaaaaaagagattctgctggccatgctcatggtggataaagaaaaaaaagggtacgttatggcctctgatctcaggtcaaagttaactagccttggcgagaaactcactcacaaagaagtcgacgacttgttcagagaggctgatatcgaaccaaatggcaaggtcaagtatgacgagtttatccacaaaatcactctgcctggtagggattattag

SEQ ID NO: 53387 - DNA, 591 bp, Artificial Sequence
  Description of Artificial Sequence: Synthetic coding sequence
atggccgcagaacatcttttaccaggtccgcctccttcactcgctgattttagattagaagccggaggcaagggcaccgagagaggcagcggaagctccaagcctacagggtcatcccggggtcctcggatggccaagtttttatcccaggaccagattaacgagtataaggaatgcttctctctttacgataaacagcagcgaggaaagatcaaggccactgatctgatggttgcgatgcggtgtctgggtgcaagccccacccccggagaggtgcagaggcacctccaaacccacggcattgacggcaacggtgaactggactttagtaccttcctgactataatgcacatgcagatcaagcaggaagatcctaaaaaggagattctcctcgccatgctgatggttgataaagagaagaaaggatacgtcatggcctcagatctgagatccaaacttactagcttgggggagaaacttacacataaggaggttgatgatctgtttcgcgaagcagatattgagcctaacggaaaggtcaagtacgacgagttcatccataagataaccctccccggacgggattactag

SEQ ID NO: 53388 - DNA, 363 bp, Artificial Sequence
  Description of Artificial Sequence: Synthetic coding sequence
atggtggcaatgagatgtctgggcgcaagcccaaccccaggagaggtccagcgccacctgcagactcacgggattgacggaaacggggagctggatttcagcactttcctgaccatcatgcacatgcaaatcaaacaggaagatcctaagaaggaaatccttctcgccatgcttatggtggataaggagaaaaaggggtacgttatggctagtgatcttagaagcaagctgacatcacttggtgagaaacttacccataaggaggtcgatgacctgtttcgggaagcagacatagaacctaacgggaaggtcaagtacgacgaatttatccataaaattacgttacctggccgagattactag

SEQ ID NO: 53389 - DNA, 441 bp, Artificial Sequence
  Description of Artificial Sequence: Synthetic coding sequence
atggccggagagctgaccccagaagaggaagcgcaatacaagaaggcatttagcgccgttgataccgatgggaatggaactataaacgcccaggaactgggcgctgctctgaaagctaccggaaagaaccttagcgaggcacagctgcgaaagctgatatcagaggttgactcagatggtgatggagaaatttccttccaggaatttctgactgccgctaaaaaggcgagggcaggtctggaggatctgcaagtggcattccgcgcattcgatcaggatggcgacgggcatattactgtcgatgaacttcgcagggctatggcgggactgggccagcccctcccccaggaagagctcgatgccatgattagggaggccgatgtcgaccaagacggaagggtgaattatgaagaatttgctagaatgctggcccaggagtag

SEQ ID NO: 53390 - DNA, 2010 bp, Artificial Sequence
  Description of Artificial Sequence: Synthetic coding sequence
atggcctactaccaggagcctagtgtcgagacctccattattaaattcaaagatcaagacttcaccacactgcgggaccattgtcttagcatgggacgaactttcaaggacgaaactttcccagcagccgactcaagcatcgggcagaaactcctccaagagaagcgattgagcaacgtgatttggaagcgccctcaggatctccccggtggtccaccacacttcatcctggatgatatttctaggtttgatatccaacagggtggagccgcagactgttggttcctggccgcactgggtagcctaactcagaacccccagtaccgtcaaaagatcctaatggtccaaagtttctcgcatcagtatgctgggatcttcagattccgtttctggcaatgtggtcaatgggtcgaggtggtaatcgacgacaggttgccagtccagggcgacaagtgtctgttcgtaaggcctaggcaccagaatcaggagttctggccatgcttattggagaaggcgtatgccaagctgttgggttcttatagcgacttgcactatgggttcctcgaagacgccttggttgacctgactggcggagtgataactaatatacatctgcatagtagtccagtcgacttagtgaaagctgtcaaaacggccacaaaggcaggttcgctgatcacttgcgcaaccccgagtggacctactgacacagcacaggctatggagaacgggttggtgagccttcatgcctacaccgtcaccggagccgaacagatccagtaccgcagggggtgggaggaaatcatatcactgtggaacccctggggatggggtgaagcagaatggaggggacggtggtccgatggatctcaagaatgggaagagacatgcgaccctcgtaagagccagttgcataagaaacgagaggatggtgagttctggatgagctgtcaggactttcagcagaaatttatcgcaatgtttatatgttccgaaattcctataaccctcgatcacggcaataccctgcatgagggatggagccagatcatgttccgtaaacaggtgatcctgggcaataccgccggaggccctagaaatgatgcgcagtttaatttctcggtgcaggaacctatggaaggcactaatgtcgtagtatgcgtgactgtggctgtaacaccttccaatctgaaagcagaagacgccaagttccccttggactttcaagtgatcctggccggaagccagcggtttagagaaaagttcccacctgtcttcttttcttcttttagaaataccgttcagagttctaataataagttccgcaggaattttaccatgacttaccacctgagtcccggaaactatgtggtggtcgcacagacaagacgaaaaagcgctgagttcctgctgaggattttcctgaagatgcctgactctgatagacacttgtcctctcacttcaatctgcgaatgaaggggagccctagcgaacatgggtcccagcagtccatctttaacagatacgcacagcagaggctggacatcgatgcaacacagctccaaggcttgcttaaccaagagctgctgaccggacctcctggagatatgttctcacttgatgaatgtaggtcccttgttgctctgatggagctcaaagtcaatgggagattggatcaggaagaattcgcgagactttggaagcgactagtgcattaccagcatgtcttccaaaaggtccagacctcacctggtgtgctgctgagctccgatctttggaaagctattgagaacaccgactttcttcgcggaatatttatcagcagagagttgctacacctcgtgaccctccgctactctgattctgtaggtagggtgtctttcccttccctagtgtgctttctgatgcgcctggaagccatggccaaaacatttcggaacctgtctaaagatggaaaagggctctatctcaccgagatggaatggatgtctcttgtcatgtacaactag

SEQ ID NO: 53391 - DNA, 2010 bp, Artificial Sequence
  Description of Artificial Sequence: Synthetic coding sequence
atggcttactaccaggagcccagcgtggagaccagtattattaaatttaaggatcaagatttcaccaccctgcgcgaccactgtctgtctatggggagaactttcaaagatgagacctttcccgctgcggactcatcgatcggccaaaagctgctgcaggaaaaaaggctgtcaaacgtgatctggaaaagacctcaggacctacctgggggacctccacatttcattttagacgatatttcaagattcgatatacaacagggtggagctgccgattgttggtttctcgccgctttaggtagtttgacacaaaacccacagtacagacagaaaatcctcatggtgcagtccttttctcaccagtatgctgggatttttcggttcaggttctggcagtgtggccagtgggtggaggtggtaatagatgatcgtctgcctgtccagggggacaaatgtttgttcgttcgccctcgccatcaaaatcaagagttttggccctgcctgcttgaaaaggcctacgcaaaattgcttgggtcctacagtgatcttcactacggtttcttggaggatgctctggtcgacctgaccggaggagtcatcaccaatattcacctgcacagtagcccggtggaccttgtgaaagcggtgaaaaccgctaccaaagccggaagtctgatcacctgtgccacgccctctggacccactgatactgcacaagcaatggaaaacggtctggtgagcctgcatgcctacaccgtgaccggagccgaacagatccaatatcgcagagggtgggaagagattatctccctgtggaacccctgggggtggggcgaggccgaatggagaggacgctggagcgacggctcacaggaatgggaagaaacctgtgacccgcgaaaatcccagctgcataaaaaaagagaggacggggagttctggatgtcctgtcaggatttccagcagaagtttattgccatgttcatctgctccgagataccaatcactctggatcacggcaacactctgcatgaaggttggtctcagataatgttcagaaagcaagttattctcggcaatactgccggaggaccaaggaatgatgcccagttcaattttagtgtgcaggagcccatggaagggaccaacgtggtggtgtgcgtgaccgtcgccgtgaccccaagtaacctgaaggctgaggatgctaaatttccactggactttcaggtgattctgacctcagttcaacgcttcagagagaaattccccccagtgtttttttcgtccttccgcaacaccgtccagtctagcaacaataaatttaggcgcaatttcaccatgacttaccacctgagccctggcaactatgtggttgtcgcgcagactcggcgaaaaagcgcagaattcctcctgaggatctttctaaagatgcccgacagcgacaggcacttatcctctcactttaatctgcgtatgaagggcagtccttctgaacatggatcccagcagtcgatattcaacaggtacgcccagcaacgactggacattgatgctactcagttacagggactgctgaatcaggaactcctgactggcccaccaggcgatatgttctcactggacgagtgtaggtcacttgttgctctgatggagctcaaagtgaacggacgtctggaccaggaggagtttgcgcgactctggaagcgactggtgcactatcaacacgtctttcaaaaagtgcaaacctcgcccggagtgttgctatcttccgacttgtggaaagctattgagaatactgattttctgagaggaatttttatctcgagagagctcctccacctggtcacgctgagatactctgacagcgttggcagagtatctttcccgtccctcgtctgttttctgatgcgactcgaagctatggcgaagacttttcgcaacctgagtaaagatgggaagggtctctatctgaccgaaatggagtggatgtctctcgttatgtataactag

SEQ ID NO: 53392 - DNA, 2055 bp, Artificial Sequence
  Description of Artificial Sequence: Synthetic coding sequence
atgtctctctggccgcctttccgctgtcggtggaagcttgcacccagatatagccgccgagccagccctcagcagcctcaacaggattttgaggccttacttgctgaatgcttgcggaacggctgtcttttcgaggatacgtccttccctgccaccctcagcagcattggatctggaagtttacttcagaagttgcccccaagacttcagtggaagagaccccctgagctccacagcaacccgcagttctatttcgctaaagccaaaagactggatctatgtcaaggcatcgttggagactgttggtttctggccgcactgcaggccctggccctccaccaggacattcttagccgggtcgtcccactcaatcagagtttcactgagaagtacgcagggatattcagattctggttttggcactacggcaactgggtgcctgtcgtcattgacgatagactgccagttaacgaagctggccaactagtcttcgtatccagtacctacaagaacctattttggggggcattactggagaaggcttacgcaaagttaagcgggtcatatgaagatttacagtctggacaggtctccgaagctctggtggacttcaccggcggtgtaaccatgacaatcaacctcgcagaagcgcacggaaacctgtgggacatcctgattgaggctacctacaaccggacactgatcggttgccagactcactccggcgaaaagatcctcgaaaacgggcttgtggaagggcacgcatacaccctgaccggaatccggaaggttacttgcaagcaccggcctgagtatctggtgaaacttaggaatccatgggggaaggtggaatggaaaggcgattggagcgacagctcttctaagtgggagctgcttagtcctaaggaaaaaatcctgctccttcgcaaggataatgacggcgagttctggatgaccctgcaggatttcaagacccatttcgtgctgctcgtgatttgcaagctcacccctgggctgttgtctcaggaagccgcacagaaatggacctatacaatgagggagggtaggtgggagaagcgctctaccgcaggcggtcagaggcagttgctgcaggatacgttctggaagaatccccagtttctcctttcagtgtggcgccctgaggagggtagacggtcgctgcggccttgctccgtcctggttagcctgttgcagaaaccacggcatcggtgtaggaaacgaaagcccctgctggctatcgggttctatctgtatcgcatgaacaagtaccacgatgaccagagaagactgcctcccgagtttttccaaagaaacaccccgctgtcgcagcccgacagatttctgaaagaaaaagaagtttctcaggaactctgcctggagcctggcacatacttgatagtcccttgcatactcgaagcccaccaaaagtcagagtttgtgctgcgggtcttcagcaggaagcacatcttttacgagatcggtagcaacagcggagtcgtcttctccaaggaaatcgaagatcaaaacgaaaggcaagacgaatttttcacgaagttttttgagaaacacccggaaataaatgccgtgcagctgcagaatcttctgaatcagatgacctggtccagtctcggaagtaggcaaccgtttttctcattggaggcatgccagggcattctcgccctgttagacctgaacgcttctggcactatgagcattcaggaatttcgcgatttgtggaagcagttaaagctgagtcagaaagtctttcacaaacaggaccggggatctggatacctgaactgggagcagctgcacgccgctatgagagaagcgggaatcatgctctctgacgatgtgtgccagcttatgctcattagatatggaggcccacgcctgcaaatggatttcgtaagctttatccatctaatgctgagagtggaaaacatggaggacgttttccaaaaccttactcaggacggaaaaggaatctatcttcaaaagccagaatggatgatgatggctctttactcgtag

SEQ ID NO: 53393 - DNA, 2055 bp, Artificial Sequence
  Description of Artificial Sequence: Synthetic coding sequence
atgtcactgtggcccccattcagatgtcgctggaaactggcaccgcgatattcacgaagagcctctccgcagcagccacagcaggacttcgaagctctgctggccgaatgtctgcggaatggttgtctgtttgaagacactagctttcctgcaacactttcctcgatcggaagcggcagccttctccaaaaactgcctccgcgactgcagtggaagcgaccgcctgagttgcactctaaccctcaattctacttcgccaaggctaaaagacttgatctgtgccagggtattgtgggtgattgctggttcctcgctgccctgcaggcattagccttgcatcaggacatcttgtctcgcgtggtgcccctcaatcagagttttacggaaaagtatgctgggatcttcagattctggttttggcactacgggaattgggtgcctgtagttatcgacgatcgattacctgttaacgaggccggacagctggtattcgtcagcagcacgtataaaaacctgttttggggagcactgctggagaaggcatatgccaaactgtcggggagctatgaagatctccagagtgggcaagtgtccgaggccttggtcgattttactggaggcgtgacgatgaccataaacctggccgaggcacacggcaatctatgggatattctcatcgaagccacctacaacagaacactgatagggtgccaaacccacagcggggaaaagattctggaaaacggcttagttgagggccacgcctacactttaacaggaatccgtaaagtgacatgcaaacaccgaccagaatatcttgtcaagctcagaaatccgtggggcaaggtggaatggaaaggtgattggtctgacagttccagcaagtgggaactcttaagccccaaagaaaaaattcttttgttaaggaaagataacgatggagaattctggatgacactccaggactttaagacacactttgtgctgttagtcatatgcaaactcacccctgggctgctctcacaggaggcggctcaaaaatggacatatacaatgagggagggtcggtgggaaaaaaggagcacagccggaggacaaaggcagttactgcaagatacattttggaagaaccctcagtttttgctctctgtgtggcgccctgaggaaggacgtcgctcccttaggccctgtagtgttctggtttcccttctgcagaaaccaagacacaggtgtcgaaagcgcaagccccttcttgctatcggtttttatctctacagagtggccaagtatcacgacgatcagaggaggcttccaccagagtttttccagagaaacacacctctgagccagccggatcgcttccttaaggagaaagaagtgagccaggaactttgcttagagcccggaacatatctcatcgtaccttgcatattggaagcacatcagaagtctgagtttgtcttgcgtgtcttctctagaaaacacatattctacgagatcggttctaacagcggagtagttttctccaaagagatcgaggaccagaacgagcggcaggatgagttctttacaaagttctttgaaaaacacccagaaattaacgcagtgcaactacaaaacttgctcaaccagatgacttggtcatctcttggtagtcgccagccattcttttctctagaggcctgtcaggggatcctcgccctgttggacctcaacgcctctggaacaatgtccatacaagagttcagggacctctggaaacagctgaagttgagccagaaagtgtttcacaagcaagacagggggtcgggctacctcaattgggagcaactgcatgccgctatgcgagaggccggaattatgctttcagatgatgtgtgccaactgatgctgataagatacggcggaccgagattgcaaatggacttcgtgtctttcatccacttaatgttaagggtggagaatatggaggacgtgtttcagaatctgactcaggatggcaaaggtatctaccttcagaagcccgagtggatgatgatggccctttattcctag

SEQ ID NO: 53394 - DNA, 2046 bp, Artificial Sequence
  Description of Artificial Sequence: Synthetic coding sequence
atggctgctcaggctgcgggagtctcccggcagcgagcagctactcagggacttggatctaatcagaacgctctgaagtacctgggtcaggattttaaaaccctaaggcagcagtgcctggacagtggagtgctctttaaggatccagaatttcccgcttgccccagtgccctgggctataaggatctaggcccaggttccccgcaaacccaggggattatctggaagaggccgaccgagctatgtccaagtccccaattcattgtaggcggtgccacaaggaccgacatatgtcagggtggccttggcgactgctggctactggccgctatcgcaagcctcaccctaaatgaggagttgctttatagggtggtgcccagggatcaggatttccaggagaattacgcaggtatcttccacttccaattctggcaatacggcgagtgggtggaggtcgtcatcgacgatcggctgcccaccaaaaatggacagttgctatttttgcacagcgaacagggaaatgagttttggagcgcccttttagagaaggcatacgccaagttaaatgggtgctacgaagcactggcaggcggttccactgtggagggattcgaggacttcaccggcggaatttcagagttctatgatcttaaaaaacccccagctaatctgtaccagattatccggaaagccttgtgtgccggatctctgcttggttgcagcattgatgtatcttcagcagctgaggcagaagccattacatcacagaagctggtgaagagccacgcttatagtgtcacaggagtcgaagaagtgaacttccagggtcaccctgaaaaattgatacgccttcgaaacccctggggtgaagtggaatggtccggcgcttggagcgacgatgcgtcccctgtcatatctccctccgcagagggttgccgggtcaagcataccacaatgcgcagtatgagccagatgtccctgagtgacttcgtccggcaatttagtcgactggagatctgcaatctgtcccccgactccttgtcgagtgaggaggtccacaagtggaacctcgttcttttcaatggccattggactcgaggctccaccgccggaggatgccaaaactacccagctacatattggactaacccacaattcaagatcaggcttgacgaggtggacgaagatcaggaagagtctattggcgaaccctgttgtacagtcttgctgggcctgatgcaaaagaatcggaggtggagaaagagaataggtcaggggatgctctccattgggtatgccgtgtatcaggtgctgttgtgttggtacaccttagacgtcctaggcttaaatatactggcttctcactgttctaccagcttcctgctgcttgaggaggccagcctgctattgtacattcctctgccagttgctttactgcggtttagagactcattcctgtggctgaatacacgcaggctacggcgaatctgccctcaagcatgccacgatgcgcttcccttttggcagagaccgagcagtgtgccccacccatggatggtgagcttagaggtgttctacagaggtggcagtttcccacacctgcagatgatcaggttcccattgccatttagtcggacggatataaagttcgacggtttcaatattaacacatgccgcgaaatgattagtctcttggactctaacgggacaggtaccctcggcgctgttgagttcaagacgctgtggctgaaaatacagaagtatcttgagatctactgggagacagattacaaccactcaggcacaatcgatgcgcacgagatgaggactgcccttcgtaaggcagggtttaccctcaatagccaggttcagcagaccatcgcacttcgctacgcatgctctaagttgggcattaattttgacagttttgttgcctgcatgatcaggctggaaacactgttcaagttattttctctgctggacgaagacaaagacggcatggtccagctctccctcgctgagtggctctgttgtgtcttggtttag

SEQ ID NO: 53395 - DNA, 1146 bp, Artificial Sequence
  Description of Artificial Sequence: Synthetic coding sequence
atggcggcacaggccgcaggcgtgagtaggcagcgtgcagccacccaagggctcggaagcaaccagaacgctttgaagtacctggggcaagattttaaaactttacgacagcagtgcctcgattcgggtgttctctttaaggatcccgagtttcccgcttgcccctccgctctcggctataaggacctgggacccggatccccccagactcagggaatcatctggaagcggcctacagagctctgtccatccccccagttcatagttgggggtgcaactcgcactgatatctgccagggcggacttggcgactgctggctgttagctgcaattgcttcgctgaccctgaacgaggagcttctctaccgggtggtgccccgtgaccaggattttcaagaaaattatgccggaatcttccatttccagttctggcaatacggagaatgggtcgaggtggtcatagacgacagactcccgacaaaaaacgggcagctgctattcctccatagtgagcaaggaaacgaattttggagtgcgcttttagagaaggcctatgcgaagctgaatggatgttacgaggccctggctgggggtagtactgtcgagggattcgaggacttcacagggggaattagcgaattttatgacttgaagaagccccctgccaacctgtatcagataatccgaaaggctttatgcgccggttctctccttggatgttccatcgacgttagcagtgcagccgaggccgaagcaatcacttctcagaaactcgtcaagtcccacgcttactctgttaccggagtggaggaggttaatttccagggccacccggaaaagttgatccgtcttcgaaacccgtggggcgaagtggaatggtctggggcatggtctgatgatgcacctgaatggaaccacatagatccacggagaaaagaggaactcgataaaaaggtggaggacggcgagttttggatgagcctttctgatttcgtcaggcagttcagtagattggaaatctgcaacctgagcccagacagtctgagctccgaggaagtccacaagtggaatcttgtgctctttaacggacactggaccagaggctctactgctggagggtgccagaactatcccggttcatcttag

SEQ ID NO: 53396 - DNA, 1314 bp, Artificial Sequence
  Description of Artificial Sequence: Synthetic coding sequence
atggctgcccaggccgctggcgtaagcaggcaacgcgcagccactcaaggactgggtagcaaccagaatgccctgaaatacctggggcaggacttcaaaaccctacgccaacagtgtctcgattcgggtgtattatttaaggacccggagttccctgcctgtccatcagcattgggttataaggatctgggaccgggatcgcctcagacacagggcatcatctggaaacgcccaaccgagctttgcccctcccctcaatttattgttggcggtgccacaaggacggacatctgccaaggcggactcggagactgttggcttctggccgcaatcgccagccttacactgaatgaggagctgctctacagggtagtccctcgggatcaggatttccaagagaactatgccggaatcttccacttccagttctggcagtatggcgagtgggtggaagtagtgattgacgataggttgccaactaagaatggccagctacttttcctgcacagcgagcagggtaacgagttctggagtgctctactggaaaaggcatacgctaagctcaatggctgctatgaagccctggccggtggatccacggtggagggtttcgaagactttaccggcggaatctctgagttttacgacctgaaaaaaccacccgcaaacctgtatcagatcattcgtaaggcgctgtgcgccggttcactgctgggatgctctatcgatgtgagctctgctgccgaggcagaggctatcacatcacagaaactggtgaagagccacgcgtactctgttacaggggtagaagaggtgaatttccagggccacccagagaaactgatccgcctgcggaatccctggggggaagtcgaatggtccggggcatggagcgacgacgcccctgagtggaaccacatagatcctaggagaaaagaagagttggacaagaaagtcgaggacggtgaattctggatgtcactgtccgatttcgtccgacagttctcaagacttgagatctgcaacctgagtccagatagtctgtcttccgaggaagtccacaagtggaaccttgtgctgtttaacgggcattggacaagagggagcaccgctgggggatgccaaaactacccagcaacatactggaccaacccccagttcaaaattcgcctggacgaagtggatgaggaccaggaagagagcatcggcgaaccatgctgtacggttctccttggattgatgcagaagaataggcgctggcggaaaaggatcggtcagggaatgctaagtatagggtatgccgtctaccagtag

SEQ ID NO: 53397 - DNA, 2151 bp, Artificial Sequence
  Description of Artificial Sequence: Synthetic coding sequence
atgtccggttctaaaaaaaagaaggtgacaaaggctgagcggttaaaacttcttcaggaggaagaagagcggcgtctgaaagaggaggaagaggcgagactgaaatatgaaaaggaggagatggaacggctcgaaatccagagaattgaaaaagagaagtggcaccgcctggaagcaaaggatctcgaaagacggaacgaggaactggaggagttatatctgctggagcggtgcttccccgaagctgagaagttaaagcaggaaacaaaacttctctcgcagtggaaacattacattcagtgcgatggctccccagacccgagcgttgcccaagagatgaacacattcatctcactgtggaaagagaagactaacgagacattcgaagaagttatcgaaaagagcaaggttgtgctgaacctcattgagaagctcaagttcatcttgctcgaaacccctccttgtgacttgcaggacaagaacatcatccagtaccaggagtccatcctgcagctgcaggagcttcttcatctcaagttcggagtggctactgagattctgctcaaacaggcatctaccctggctgatctggacagtggaaacatggaaaaggtgataaaagatgagaacgtgaccttgtacgtttgggcaaaccttaagaagaacccacgacatcgatctgtcaggttttccgaaacccagatagggttcgagattcctagaatcctggctacctctgacattgctgtccgcctgctgcatacacattatgatcacgtgtccgctttacatcctgtttctaccccatcaaaagagtatacctcagccgttacagaactggtgaaggacgatgtgaagaatgtcgaaaaggccatcagcaaagaggtcgaggaggaaagtaagcaacaagagaggggatctcatttaatccaggaagaagagatcaaggtggaggaagagcagggggatatcgaagtgaagatgtctagcgccgaggaagagtccgaggccatcaagtgcgaaagagaaatgaaggttctcagtgaaacagtttctgccgcacagcttttattggttgaaaacagttcagaaaaacctgacttttttgaagacaatgtcgttgatctgtgccaatttactaccctcggaggtgtttatcatctggacatccttgagctaccaccacaatgtaaacccgtgaagggttggatgattgtggagattcttaaagaaggtctgcaaaaatatacttacccccctgagacaaccgaggaattcgagaccgaaaacgccttccctccgatagaggtgacactcgaagtccatgagaatgtcatcttttttgaggaccctgtggtagtgcggtgggacgcagaggggaaacattggcggactgacggcatttccaacgtctcttataaaccaaaagagagactcgtgaccttttcactcgataccttcggtccggtaacacttatccaggacgctcatatcaacatgccatatcagtcctgggaactgagacctctcgacgttaataaggtcctgcttaccgtcacaactgtttttacagagattcagatacaaattaaggagaacctgtgcatgcttagtagcatcaagctgaaggataaaaaacatatcagtatccttgagggcacctggatgacacccatcccttttatcattgctctgaaggaagcaggccttaatattttccccacaaggcatagccacttttacgtgataatcaacaacaaggtcccactcgtcgaggtaaaggcctatagacaaatggcccttctgagttctgcgttcgcgttcggctggagtaagtggaatctgctttgtaattcaaccaaggtggtgtttaaggtcagagagcatcttaccgaagcctgtaccgagaaccctaactgggctctgcttatgtttagcggcgatcgcgcacagagattgaaaattaaggaggagtccgaggcattcagtgaggcattgaaggaagaaaccgagttccactcaaccctctatcacatggtgaaagactttgcgtctgaggaggccatggagaaagtcagaagcagcaactgtcagtttgtaaattctgtgtgccatatgctgctgtccaccagactgctctcatactcttag

SEQ ID NO: 53398 - DNA, 2073 bp, Artificial Sequence
  Description of Artificial Sequence: Synthetic coding sequence
atgcgccagactggaggaggcgctacaacagatagcgctagccccgtgcttaacaatgtgataaaatctcagtcttacttcacagcgaagagagtaggcctaggaaacaacagctatctgggcgtaggcagaccctctagccaacagtggctgagcctacctggtccgggaggtcagggacccaaggccaagaaatccggtagcaagaaaaagaaggtgacaaaagctgaacgtctcaagctactgcaggaggaagaggagaggcggctgaaggaggaggaggaggctaggctgaagtatgagaaggaggaaatggagcgactcgaaattcaaaggatcgaaaaggaaaagtggcaccgcttggaggccaaagacctggagagaagaaatgaagaactggaggagctgtacctcctggaaaggtgcttccccgaagccgagaagcttaagcaggaaactaagctgctgtctcaatggaagcactatatccagtgtgatggctctccagacccctctgtggctcaagaaatgaatacattcatttctctgtggaaagaaaaaactaatgaaacgttcgaggaagtgatcgagaagtccaaggtagtgctgaacctcattgagaaattgaaatttatccttctggaaactcccccttgtgacctacaggacaagaatatcatccaataccaagaatccattctccagctgcaagagttgttacatctgaaatttggagtggctaccgaaattctcctgaagcaggctagcaccctggcggacctggacagtgggaacatggagaaggtgataaaggatgaaaatgtgacattgtacgtgtgggccaatctgaagaagaacccgcgtcacaggagtgtccggttctcagaaacccagattggctttgaaataccccgtatcttagcaacctcggatatcgcagtgcgcctgcttcatacgcactatgaccacgtcagcgccctgcaccccgtttccactccaagcaaggaatacacgagcgccgtaactgaattggtgaaggacgatgtcaagaatgtggaaaaagccatcagcaaagaggtggaagaagagagcaaacagcaggaacgcggttcacacctgatccaggaggaagaaatcaaggtggaagaagagcagggagatattgaggtgaaaatgtcctctgctgaagaagaaagtgaagccatcaagtgtgagcgcgagatgaaggtcctcagcgagactgtgagcgcagctcagttgcttctggtcgagaatagtagcgagaagcccgatttttttgaggacaatgtggtggacctgtgtcagttcacaacgctagggggtgtctaccatctggatatcctagaactcccacctcaatgcaaacccgttaagggctggatgatcgtggaaattctgaaagaggggcttcaaaagtacacttatcccccagagactactgaagagtttgaaaccgagaacgccttcccccctattgaggtcacactggaggtgcacgagaatgtgatcttttttgaagatcccgtggtggttaggtgggatgccgaaggcaagcactggcgaactgacgggatctctaacgtctcttataaacctaaggaaagacttgtgaccttttctttagatacttttggtcctgtgacgctgatccaggatgctcatatcaacatgccataccagtcctgggaactccgacctctcgacgtgaacaaggttcttctgactgtgactaccgtgttcacagagatccagatccaaatcaaggagaatttgtgtatgctgtcttcgattaagttgaaggataagaaacatatttccatccttgaaggcacttggatgacccctataccgtttataatcgcccttaaggaggctgggttgaatatctttcctacacgccacagccatttctacgtgattataaataataaggtgccactggtggaagtgaaggcctatcgccagatggcactgctgtctagcgcgtttgccttcgggtggagtaaatggaatctcttatgcaactcaacaaaagtggtgtttaagtggtag

SEQ ID NO: 53399 - DNA, 1311 bp, Artificial Sequence
  Description of Artificial Sequence: Synthetic coding sequence
atggagcgtcttgaaatacaacgaatagagaaggagaagtggcatcggctcgaagccaaggatctcgaacgtagaaatgaagaattggaagagctctacttgctcgagcgatgcttccccgaagccgagaaactgaagcaggagaccaagctgctgtcccagtggaagcattatatccagtgcgacggttcaccagatccaagtgtagcccaggaaatgaatacttttatatccctatggaaggaatataccagcgcggtgacagagctcgtcaaagatgatgtcaagaacgtggaaaaagccatctctaaggaagtcgaggaggagagtaaacagcaggagaggggatcacacctgatccaagaagaggaaattaaagtggaagaagaacagggagatattgaggtgaaaatgtcttctgctgaagaggaatcagaggccattaaatgcgagcgcgagatgaaagtcctctctgagacagtgtcagcagctcagcttctcttggtggaaaactcctctgagaaaccagatttttttgaggacaacgtggtggatctgtgtcagttcacaacactcggaggtgtataccacctggacattcttgagctcccccctcagtgcaaacccgtgaaggggtggatgatagttgaaatattgaaagagggactccagaagtacacgtacccccctgaaaccaccgaggaattcgaaacagagaatgcattccctccaatcgaggtgacgttagaggtccatgaaaacgtaattttttttgaagacccggtcgttgtgcggtgggatgccgaaggtaagcattggagaaccgacggcattagcaatgtgtcctataaacccaaagagagattggtgaccttctccctggatacttttgggcctgttaccctgatacaagatgcacacattaatatgccctaccagtcttgggagctgcgccctcttgatgtaaataaagtgttgttgaccgtcaccaccgtgtttacagaaattcagatccagatcaaggagaatctttgcatgttgtcatctattaaacttaaagacaagaagcatataagtatccttgaggggacttggatgacacccattccgttcatcatcgctttgaaggaagctgggctgaatatatttccaactcgacattcccacttctacgtgataattaacaacaaagtgcccctggtggaggttaaggcttataggcagatggctcttttgtcatccgcatttgctttcggatggtctaaatggaatctgctctgtaatagtaccaaggtagtgttcaagtggtag

SEQ ID NO: 53400 - DNA, 2169 bp, Artificial Sequence
  Description of Artificial Sequence: Synthetic coding sequence
atgggcccaaaagcaaaaaaatctggctccaagaagaagaaggtaacaaaggctgagcggctcaagctcctgcaggaggaggaagaaaggagactaaaggaagaagaggaggcacggctcaaatacgagaaagaggagatggaacgcctggaaattcagcgtattgagaaagagaaatggcacagactggaggccaaggacttagagcggagaaatgaggagctggaagaactgtatctgctggagcgatgcttccccgaggccgaaaagctgaaacaggagacgaagctgctgtctcagtggaagcattacatccaatgcgacgggtcccctgacccatccgttgctcaggagatgaacacgttcatctcattgtggaaggaaaaaaccaacgagacttttgaggaggtaattgagaaatctaaagtcgtgctgaatctgatcgagaaactaaaattcatccttttagagactcccccatgtgatctccaggacaagaacatcatacaataccaggagagcatactgcagctgcaggagcttctccacctaaaattcggggtagccacagagattctcctgaagcaggctagtacattagctgatcttgactcaggaaatatggaaaaagttattaaggatgaaaatgtgacactgtacgtctgggctaacttgaagaaaaatccaaggcataggagtgtgcgctttagcgagacccagattggcttcgagatcccacgcattctcgccacaagcgacattgctgtcagactgctccatacacattacgaccatgtatcagcccttcacccggtttccactccgagtaaagagtatacgtctgcagtgacagaattggttaaagacgatgttaaaaacgttgaaaaggcaatatctaaagaggtggaggaggagagcaaacagcaggagagaggatcccaccttatccaggaagaagagatcaaggtcgaagaagagcagggagacatcgaggttaaaatgagctctgcagaagaggagagcgaggctataaagtgtgaaagagaaatgaaagtgttgtccgagactgtgtctgccgcacagctcctcctggtggagaacagctccgagaagcccgacttctttgaggacaatgtggtggatttatgccagtttacgaccctggggggagtttatcatctggatattttagaactgccaccacagtgcaaacccgttaagggatggatgattgtcgaaattctgaaagaaggcctgcagaagtacacttatcctcccgagaccacggaggaatttgagacggagaatgcctttccccctatagaggtcactctggaagtgcacgagaatgttatcttcttcgaggacccggtggtggtccgttgggacgctgaggggaagcactggcgaacagacggtatttcaaatgtctcgtataaaccaaaagaaaggctcgttacgttctccctggataccttcggtccggtaaccctcatccaggatgctcacatcaatatgccttatcagtcctgggaactgagaccgctcgacgtaaacaaggttctactcacagtgaccactgtgtttactgagattcaaattcagatcaaggagaatctgtgcatgctgagcagtatcaagctcaaggacaaaaagcacatcagcattctggaaggcacctggatgacaccgatccccttcataatcgcgttgaaggaggctggtctgaacattttcccaacgaggcatagccatttttacgtaatcatcaacaataaagttccattagtggaggtcaaggcgtacaggcaaatggctcttttgagcagcgccttcgcttttgggtggtcaaagtggaatctgctttgcaacagcacaaaagttgtctttaaggtacgggagcaccttactgaagcatgtaccgagaatccgaattgggccctgttgatgttcagcggtgatcgcgctcagcggctgaaaattaaagaggagtccgaagctttttccgaagctctcaaggaagagaccgaattccactccaccctataccacatggttaaagacttcgccagtgaggaagccatggaaaaggtgagatcctctaactgtcagttcgtcaattctgtttgccacatgctgctgagtactaggctgctgagttacagctag

SEQ ID NO: 53401 - DNA, 2031 bp, Artificial Sequence
  Description of Artificial Sequence: Synthetic coding sequence
atggaaaggctcgagatccagcgcatcgagaaagaaaagtggcatcgcctcgaggccaaggacttagaacggagaaatgaggaactcgaggagctttacctgctagagcgctgttttcctgaggctgagaagttgaagcaggaaacaaagctgttatcgcagtggaaacactatatccaatgtgatggctctccagacccctctgtcgcccaggagatgaacaccttcatttctttgtggaaagagaaaaccaatgagacatttgaagaggtcatcgagaaaagtaaagtcgtgctcaatttgatcgagaagcttaagtttattctccttgagacacccccttgcgacctgcaagataaaaacattatccagtaccaggaatccattctgcagctgcaagaattattacatttgaaattcggcgtggccactgaaatcctgctcaaacaggctagcactctggctgacctggactctgggaatatggagaaagtgataaaagacgaaaatgttaccctttatgtgtgggcaaatctgaagaagaaccctcgtcaccgctccgtgcgcttttcagagacacagatcggttttgaaatacctagaatcctggcaacctctgatattgcggtacgccttctgcatacccattacgatcacgtgtccgcactgcatcccgtgtcaactccttctaaagagtacaccagtgccgtaacagaactcgtaaaggatgatgttaagaatgtcgagaaagctataagtaaagaggttgaggaggaaagcaagcagcaggagcgcggaagccacctgatccaggaggaggaaatcaaagtcgaagaggaacagggcgatatcgaagtgaagatgtcctccgccgaggaagagagcgaagcaattaagtgcgagagagagatgaaggtgctgtccgagaccgtgtccgcagcccagctgttgcttgtagaaaattcgtccgagaaaccagatttttttgaagacaacgtggttgatctctgtcagttcaccactctgggcggagtgtatcacctcgacatccttgagttgccaccacaatgcaagccagtgaaagggtggatgatcgtggagatcctgaaagaaggcttgcagaaatacacatatcccccagagacaacagaagaatttgagaccgaaaatgccttcccccctatagaggttaccctggaagtgcatgaaaacgttatctttttcgaggatccggtggtggtacgatgggacgctgaaggtaagcactggaggaccgacggaatctctaacgtcagttacaaaccaaaagaacgtcttgtcaccttctccctggatacattcggacctgtgacattgatacaagacgcccacataaatatgccgtaccaaagctgggagcttcgcccattggatgtgaataaggtgcttttgacggtcacaacggtgttcaccgagatacaaatccagatcaaagagaatctttgcatgctcagcagcatcaaacttaaggacaagaagcacatctccatactggaggggacctggatgactccaattccttttatcatcgctctcaaagaggctggcctcaatatcttccccacacgccactctcatttttatgtgataataaataataaagtacccttggttgaggtgaaggcctacaggcagatggcgttattgtcatcggctttcgcttttggctggtctaagtggaacctgttgtgcaatagcactaaagtagtgtttaaagtacgcgagcatttaacagaggcctgtacagagaacccgaactgggccctcttaatgttcagcggcgacagggcccagcggctgaagatcaaagaagaatctgaggccttcagtgaggcgctgaaagaggagaccgagtttcactcaacactgtatcacatggttaaagatttcgctagcgaagaggccatggagaaggtaaggtccagtaactgccagttcgtgaattccgtatgtcacatgcttctgtctacccggttgctatcctatagttag

SEQ ID NO: 53402 - DNA, 1458 bp, Artificial Sequence
  Description of Artificial Sequence: Synthetic coding sequence
atgggcccaaaagcgaaaaagagcggatccaagaaaaagaaagttactaaagcggagcggctgaaactgctgcaagaggaagaggagaggcgactcaaagaggaggaagaggccaggctgaagtacgaaaaagaagagatggaacggctggagattcagcggatcgaaaaggagaaatggcatcggttggaggctaaagacttggagcgtagaaacgaagaacttgaagaattatacttactggaaaggtgctttcctgaagccgaaaagttgaaacaagagaccaagttactgagtcagtggaagcactatattcagtgtgatggaagcccagacccgtccgtggctcaggagatgaatacttttatctccctgtggaaagagaaaacgaacgaaacatttgaagaggtcatagaaaaatccaaagttgtcctaaacttgattgaaaaactgaagtttatactgctggagactcctccatgtgatctccaggacaagaatatcatacagtaccaggaaagtatcctccagttgcaggagctcttgcacctgaagttcggcgtagctacggaaatcctcctcaagcaggcttcaacgttggcagatcttgactccgggaacatggagaaagtgatcaaggacgagaacgtgacactctacgtttgggctaacctgaagaagaatcccaggcacaggagtgtccgctttagcgaaacacagatcggcttcgagattccaaggatcctggcaacaagcgacatagctgtcaggctgctgcacacccactatgaccacgttagcgctctccatcctgtgtccaccccctccaaagagtatactagcgccgtaaccgagctggtaaaagacgatgttaagaatgttgaaaaggcgatctctaaggaagtcgaagaggagagcaaacagcaggagaggggctcccacctgatccaggaagaagagatcaaagtggaggaagaacagggcgacatcgaagttaagatgtcaagtgccgaagaggagtccgaggctattaagtgcgaacgagagatgaaagtgctgagcgagaccgtgtccgcagcgcagctcctgctggtagaaaattcttccgagaagcctgatttcttcgaggacaacgtggtggacttgtgtcaattcaccacactcggaggagtctaccatctggacatcttagaactgccaccccagtgcaaaccagtcaaaggctggatgatagtggaaattctgaaagaaggtctgcagaaatacacttatcccccagagactaccgaggagtttgaaacggagaatgcctttcctcctatcgaggtaacgttggaagtgcacgagaatgtgattttttttgaggatcccgttgtagttcgatggatgttgaaggtaaacattggtgagctgatggccagcgctatgtatccaactaatcagaagaaagacctttag

SEQ ID NO: 53403 - DNA, 1545 bp, Artificial Sequence
  Description of Artificial Sequence: Synthetic coding sequence
atgaacacatttattagcttatggaaggaaaaaacgaatgagacttttgaagaagtgattgagaagtccaaagtagtcttgaatctgatagagaaattgaaattcattctactcgaaacccctccatgtgatctccaggacaagaacattattcaataccaggagtcaattctccagctccaagagctgctgcacctaaagttcggggtcgctaccgagatcctattgaaacaggccagcactcttgccgacttagacagcggaaacatggaaaaggtgattaaggatgaaaatgtgactctgtatgtgtgggccaatctaaaaaagaacccaagacacagatcagtgcggttcagtgagactcagattggcttcgaaataccaaggattctggcaacctctgatattgccgtcagactgttgcatacgcactacgatcatgtctcagctttacaccctgtgtctacaccctctaaggagtacacctccgctgtgaccgaattggtgaaggacgacgtcaagaacgtagagaaagccattagcaaggaagtggaggaggaaagcaaacagcaggaaagggggagccacttaattcaggaggaggaaatcaaggtggaggaggaacaaggcgatatcgaagtcaagatgagtagtgctgaagaagaatcagaagccattaaatgtgagagagaaatgaaggttttatcagagacagttagcgccgcacaactattactcgtggagaattccagcgagaagccggactttttcgaagataacgtggtcgacctatgtcagttcactaccctggggggagtctatcatttagacatcctggagcttcctccccaatgcaaacccgtaaaaggatggatgattgtggagattcttaaggaaggtctacagaagtacacttacccaccagagactaccgaggagtttgaaaccgagaacgcgtttccccctatcgaggttaccctggaagtgcacgaaaatgtgatctttttcgaagaccccgtcgtggtgaggtgggatgccgagggaaagcactggcgtactgatggcatttccaacgtctcatacaagcctaaagaaagactcgtaacgtttagtctagacacatttgggccagtcacactgattcaggacgcacatattaacatgccctatcagtcttgggaacttcggccattagacgtgaataaggtcctgctaaccgtgacaacagtgttcactgagatccagatccaaataaaggagaacctgtgcatgttatcatcaattaaacttaaagacaagaaacacattagtatcttagagggcacttggatgacacctattcctttcatcatcgctttgaaagaggcaggactgaacatcttcccaaccaggcactcccacttttatgtaatcatcaataataaggtgcctctggtggaggtgaaagcttacaggcagatggctctgctcagcagtgccttcgccttcggttggtccaaatggaatttactctgtaatagcacaaaagtggtcttcaagtggtag

SEQ ID NO: 53404 - DNA, 279 bp, Artificial Sequence
  Description of Artificial Sequence: Synthetic coding sequence
atggaaagactcgaaatccagcgcatcgaaaaggaaaagtggcaccggctggaagccaaagacttggagagacgaaatgaagaactggaagaactgtacctgttagagcgctgctttccggaagcagagaagctgaagcaggagacaaagctccttagtcagtggaaacactatattcaatgtgacgggagtcctgacccatctgtagcccaggagatgaatacatttatttcactttggaaggagaaaactaacgagactttcgaggaggtgatttag

SEQ ID NO: 53405 - DNA, 1974 bp, Artificial Sequence
  Description of Artificial Sequence: Synthetic coding sequence
atggacctggagcgacggaatgaagagctcgaggagctctatctcctcgagcgttgtttccctgaagctgagaagctgaaacaggagactaaactactatcccagtggaaacactacatacagtgtgacggctctcccgatccttctgtggcacaggagatgaacaccttcatctccctttggaaggagaagaccaacgagacgttcgaagaagtcattgaaaaatccaaggtcgtcctgaatctcatcgaaaagctaaagttcatcttgctcgagacacccccttgcgatttgcaggataagaacattatccaataccaggaatcaatcctccaactccaagagctcttgcatcttaaatttggtgtggcaaccgagatccttctgaaacaggcatctaccctggccgaccttgactcaggaaatatggaaaaggtaattaaggacgagaatgtgacactgtatgtgtgggctaacctaaagaagaacccccgtcatagaagtgttcgctttagcgagacccagataggttttgaaatcccccgtattttggcaacatcagatattgcagtgcgcctgctacacacacactacgaccatgtcagtgctcttcacccagttagtacaccctcgaaggagtatacatccgcggtgacagaactggtgaaggatgatgtgaagaatgtggaaaaggctatttcaaaagaggtggaggaggaatctaagcagcaggagcgcggaagtcacctcatccaggaagaggagattaaggttgaggaggagcaaggagacatcgaagtgaaaatgagcagcgctgaggaggaaagtgaagctatcaagtgcgagagagagatgaaggtgttatcagagacagtgtcggcggcacagctcctgctcgtggagaatagtagtgaaaaaccagatttcttcgaggacaacgtcgtggatctatgtcagtttaccactctaggaggtgtctatcaccttgacattctcgagctccccccacagtgtaaaccagtaaagggatggatgattgtagagattctcaaggagggactgcagaagtacacctacccacccgaaaccaccgaggaattcgagactgagaatgcatttcctccaatcgaggttacacttgaagtccacgagaatgtaatattctttgaagaccctgtggtcgtccggtgggacgcggaaggcaaacattggagaaccgatggaatttcaaatgtcagctacaaacccaaagaaaggctggttacctttagcctggataccttcggacccgtcacgctgatacaagacgcccatatcaatatgccttaccagagttgggagctcagacccctggatgttaacaaggttctgttgaccgttaccacggtgtttacagaaattcagatccaaataaaagaaaatctctgcatgctcagctccataaagctgaaggataagaaacatatctctatcctcgaggggacctggatgacacctataccctttatcatcgccctcaaggaggctggtttaaacatttttcctacaaggcatagccacttttatgtgatcatcaataataaggttcccctggtggaggtcaaggcctataggcagatggccctcctttcctctgctttcgctttcggttggtccaagtggaacttgctgtgcaattctaccaaagtcgtatttaaggtccgcgagcatctcacagaggcttgcacagagaaccccaactgggccctgttgatgttttccggtgatagagcgcagcgtctgaagatcaaggaggagagcgaagcattctctgaagctctgaaggaagagacagagttccactctactctttatcacatggtgaaagactttgcaagcgaggaagctatggaaaaggtaagaagctctaactgccagtttgtgaattccgtgtgccatatgctgctttccactaggctgctatcatacagctag

SEQ ID NO: 53406 - DNA, 411 bp, Artificial Sequence
  Description of Artificial Sequence: Synthetic coding sequence
atgatgcacactactagctatcgcaggctgagccctccccatctgacagatcaacctagcgcctacagccacactcaccggacttttagccattttagttgcggcagccagccagctgcccagagactgcatgtggagttgtggaacgctgatctgcagtccgagttcctctgtccctgcctgggtctgaccctttatttgacctgcaatcctcagttggggaagaggaaattctgttcccactccagtgaggacatgtctaaaatggtgagcaggagaaacgtgaaagactcccacgaggtgtccggcagcctgcaggccacactccaggttatttcttttagtttcccttttctactgcatacgtgctcccaccccctgtctcaccccacttccggtcaacgcagatag

SEQ ID NO: 53407 - DNA, 570 bp, Artificial Sequence
  Description of Artificial Sequence: Synthetic coding sequence
atgacagacaagacagagaaggtcgcagtggaccctgagacagtttttaaaagacctcgcgagtgtgattctcctagctaccagaagagacagcggatggcactcttggccaggaagcaaggggcaggcgactctctgattgccggttccgccatgtccaaagagaagaaattgatgacaggccacgccattcccccttcacagctggactcacaaatagatgacttcacgggcttcagcaaggataggatgatgcaaaaacctggtagcaacgcaccggtgggcggtaatgtcacctcatcattctctggcgatgacctggaatgtcgggagaccgctagttcgccaaagtcccagcgggagattaacgctgacataaaaaggaaactcgtgaaagagctacgctgcgtggggcagaagtacgagaaaatttttgaaatgctcgaaggagtccagggcccaactgccgtcagaaaacgttttttcgaaagcattataaaagaggctgctcgatgtatgcggagagactttgtgaagcacctaaagaagaagctgaaaagaatgatctag

SEQ ID NO: 53408 - DNA, 867 bp, Artificial Sequence
  Description of Artificial Sequence: Synthetic coding sequence
atgagcgctacaggagaccgccatcctacccagggagatcaggaagcccctgtgagtcaagaaggggcacaggcagaggctgcaggagctggtaaccaggaaggcggagactcgggtccagactcatccgacgtcgtcccagccgcagaggttgtcggagtcgccggtcctgttgagggcctgggggaggaggaaggggagcaggctgctggactggctgcggtgccaagaggcggttctgctgaggaggattctgacattggtcctgctaccgaggaggaggaggaggaggaaggaaacgaagccgctaattttgacctggcagtcgtggccagacggtatcccgcatccgggatccactttgtgctgttggacatggttcactcactgctccacagactttctcacaacgatcacattctgattgagaaccggcagctgtctagactcatggtgggcccacatgccgctgcacgtaacctgtggggtaacctcccccctctcctgttgccccaacgtcttggcgcaggggcagccgctcgagctggcgagggactaggactgatacaggaggcggctagcgtcccagagcctgctgtccccgctgacctggccgagatggcacgcgagccagccgaagaagctgccgaagaaaagctgagcgaggaggccaccgaagagcccgacgcagaggaacccgctacagaagaaccaactgcccaggaggcgaccgcacccgaagaggttacgaagtctcagccggaaaagtgggacgaggaagcccaggacgctgccggagaggaggagaaggaacaagagaaagagaaggatgccgaaaataaggtgaagaatagcaaggggacctag

SEQ ID NO: 53409 - DNA, 867 bp, Artificial Sequence
  Description of Artificial Sequence: Synthetic coding sequence
atgagtgccactggagacaggcacccgacccagggtgatcaggaagcacccgtgagtcaggagggcgctcaggccgaggccgcaggggctggaaaccaagaaggaggggatagcggacccgactctagtgatgtagtgcccgcagccgaagtcgtaggcgtggctgggccagtcgagggcctgggggaagaggagggggaacaggcggcaggattagccgcagtgccaagaggaggcagcgcagaggaggacagcgacataggacccgctacggaggaggaggaggaggaggaagggaatgaggcggcaaatttcgacctcgcagtcgtagcaagaagatatcccgcttctgggatacactttgtactcctggacatggtgcattcgctactgcatcgactttctcacaatgatcatatcctgatcgaaaacaggcaattgagtagactgatggtgggccctcatgcagcggctaggaatctgtgggggaatttgcccccactcctcctgcctcagaggctgggggctggagccgctgccagagcaggtgaagggttgggcctgattcaggaagccgcttctgtgcccgagccagctgtaccagcagatctagctgagatggctagagaacctgctgaggaggcagcggaagaaaagctcagcgaagaggcaaccgaggaaccagatgcggaagagcccgcaaccgaagagccaacggcccaggaggcgacagcccctgaggaagtaactaaatcccaacctgagaaatgggatgaggaggcacaggacgcggctggtgaggaggaaaaagaacaagagaaggaaaaagacgccgagaataaggtcaagaattctaaggggacctag

SEQ ID NO: 53410 - DNA, 495 bp, Artificial Sequence
  Description of Artificial Sequence: Synthetic coding sequence
atgggggacctgcctggtttggtgaggctctccattgccttgcgcatccagcccaatgacggacctgtcttctacaaggtagacggtcagcggtttggccagaatcgcactatcaaactactcaccggatcaagctacaaggtcgaagtgaaaatcaagccgagtacattgcaggtggaaaatattagcatcgggggagtcctggtcccactggagcttaagtccaaagagccggatggggatcgcgtagtgtacaccggcacttacgataccgagggggttacccctaccaaaagcggtgaaaggcaacctattcaaatcactatgccgttcactgacattggcacatttgagaccgtctggcaagtcaaattctataattatcacaagcgggaccactgtcagtggggatcgccgttcagcgtcatcgagtatgagtgcaagccaaatgagacccgctcactgatgtgggtcaacaaagagtcgtttctgtag

SEQ ID NO: 53411 - DNA, 387 bp, Artificial Sequence
  Description of Artificial Sequence: Synthetic coding sequence
atgggcgacttgcctggcttggtacggttgtctatcgccctccgcatacaaccaaatgatgggcctgtgttttacaaagttgacggccagagattcggccagaacagaacaatcaagctgctgaccggttcaagctataaggtggaggtgaaaattaagcccagcacgctccaggtggagaacatatccatcggaggggtgttggtccctttggagcttaaatctaaagaacccgatggtgaccgcgtagtgtacaccgggacatatgacaccgagggtgttacccctaccaaaagtggagaacgtcagcccatccagatcacaatgcctgagtgtctggagcagaggccccaagagatatctctgacatatgagtgtgaggaatag

SEQ ID NO: 53412 - DNA, 279 bp, Artificial Sequence
  Description of Artificial Sequence: Synthetic coding sequence
atgaacgactataagctggaggaggacccagttacaaaagagagaacattcaagaggttcgcgccacggaaaggagacaagatctatcaggaatttaagaagttatacttttatagtgatgcttatcggcctttgaagttcgcttgtgagaccattattgaagaatacgaagatgaaatttcatcgcttattgctcaagagactcactatctggctgataaattgtgctctgaaaaaagtgatctgtgcgagactagtgccaatcataccgaactgtag

SEQ ID NO: 53413 - DNA, 3141 bp, Artificial Sequence
  Description of Artificial Sequence: Synthetic coding sequence
atgcagaagccaagcggcctgaaaccgccaggaaggggcggaaaacactcctcccctatggggagaacatccaccggatccgcctccagctccgcagctgtggccgctagctccaaggagggtagccctttacacaagcagagctcaggccctagctcttcacctgccgctgccgcagctcctgaaaagcctggtcccaaggcagctgaggttggagacgactttctcggcgacttcgtggtcggtgaaagagtctgggttaatggcgtgaagcccggagtcgtgcagtatctgggtgagactcagttcgcacctggtcagtgggcaggtgtggtgctcgacgatccagtgggcaaaaatgatggggcagtgggaggcgtccggtacttcgaatgccctgccctgcaggggatctttacgagaccgtctaagctaaccagacagcccaccgctgagggaagtggttccgacgcacactctgtggaatctctcacagcccagaatctctcattgcacagcggcaccgccacgccgcctctcacgagccgcgtgattcccctgagggagagcgtactgaattcttctgtgaagacaggaaacgaatctgggagcaacctgtctgactctggtagcgtgaagagaggcgagaaagacttgaggctgggggacagggtgcttgtgggtggaacaaagaccggagtggtacgctatgtgggcgagactgacttcgcgaaaggggaatggtgcggagtcgaactggatgagcctctcggaaaaaatgatggcgcagtggctggcactaggtactttcagtgccccccaaagttcggccttttcgccccaatccataaagtcatccgtattgggtttccaagcacctcaccagctaaggcaaagaagacaaaaaggatggccatgggagtgagtgccttaacacacagcccatcaagcagctccatatcttcagtatcgtccgtcgcttcctccgtgggaggacgcccttctcgctctggcctcctgactgagacctcgagtcggtacgcacgtaaaatatctggaaccaccgccttacaagaggccttaaaggagaagcaacaacatatagaacagctgttggctgaacgagatctggaacgggctgaagttgccaaagcaacgagccatatttgcgaagtggaaaaggagatcgctttgctcaaggctcagcacgagcagtatgtcgccgaagctgaggagaaacttcaaagagctcgtctgcttgtggaaagtgtgcggaaggagaaagtggatttgagcaaccagttagaagaagaaaggcgcaaggtcgaggatctgcagttccgtgtggaagaagaatctattacaaaaggtgatctggaaactcaaacgcagttggaacacgcacgcataggagagctggagcaaagtctcctgctggagaaagctcaagccgagcgcctcttgagggagctagccgacaatcggctgacaacagtggccgaaaaaagtcgggtgttgcagctggaggaagagctgacacttagacggggagaaatcgaagagctgcaacaatgtcttttgcacagcggacctccccctcctgaccaccccgacgccgcagagatcctcagactgcgtgagaggttgctgagcgccagtaaagaacatcagagagagagcggagtgctgagggacaaatacgaaaaagctctgaaggcatatcaggcagaggtggataagctcagggccgctaacgagaagtatgcccaggaggtagccggactgaaggataaggtgcagcaggcgacctcagagaacatgggcctgatggataattggaagtctaagctggatagtctggcttccgatcaccagaaaagcctcgaagacttaaaagcgactcttaatagtggtcccggagcccaacagaaagagattggtgaattaaaagctgtcatggaggggataaaaatggagcaccagctggaactgggaaacctccaggccaagcacgacttggagaccgcgatgcatgtgaaggagaaggaggcactgcgcgagaagctccaggaggcccaagaggagctggcaggattgcaacgccactggagggcccagttggaggtgcaagcgagtcagcacaggctcgagctgcaggaggcacaagatcagagacgggacgcagagctcagggtgcatgaactcgagaagctggatgttgaatatcgaggtcaagctcaggctattgagttcctaaaggaacagatctccctggctgagaagaagatgcttgactatgaaaggctgcagagagcagaggctcagggaaagcaggaagtcgaaagtcttcgtgagaaactgttggtggcagagaatagactccaggcagttgaagctctgtgttcttcacagcacactcacatgatcgaatccaatgatatttcagaggaaactatccggaccaaggagaccgttgagggcctccaggataaactgaacaaacgtgataaggaagttaccgccttgactagccaaactgaaatgcttcgagcccaggtatctgccctggagagcaaatgcaaaagcggggaaaaaaaagttgacgctctgctgaaagagaagcgcaggctggaggctgagcttgaaaccgtttctcgcaaaacgcacgatgcttccggtcaactggtgctaatcagccaggaactgctccgtaaggaacgcagtctcaacgaactgcgggtgctgctccttgaagctaatcgacactcacccggaccagaacgcgacctttctcgagaggtccacaaagcggagtggaggattaaagagcagaagctgaaggacgacattcggggactaagagagaagctgactggtcttgacaaggagaaatcactgtcagatcagagacgctacagcctcatcgacagaagctcagccccagagcttctgagactgcaacatcagctgatgagcacggaagatgccctgcgggacgccctggatcaggcccagcaggtcgagaagctgatggaagcaatgaggagctgccctgacaaggctcaaaccatcggcaactcagggagcgctaacggcatccatcagcaagacaaggcgcagaagcaagaggataaacattag

SEQ ID NO: 53414 - DNA, 2118 bp, Artificial Sequence
  Description of Artificial Sequence: Synthetic coding sequence
atgacaatagaagatctccccgatttccctctcgagggaaacccgctttttggtaggtatcctttcatttttagcgcatccgatacaccagtaatattctccatctccgctgcccctatgccatcagactgcgagttcagctttttcgaccccaacgatgcgagctgtcaggagatactgtttgacccaaaaacaagtgtatctgaactctttgccatcctgcgacagtgggtgccacaggttcagcagaatatcgacattattggaaacgaaatcctgaaacgcggatgcaacgtaaatgatagggacggcctaaccgatatgacgctgctacactacacttgtaaatcaggggcacatggcatcggggatgtggaaacagccgtgaagtttgcgacacaacttatagacttgggcgcagatatttcgctgaggtcgagatggacgaatatgaatgccctgcactacgcagcgtactttgacgtgccggagcttattcgagtgatcctgaagacttccaaaccgaaggacgttgatgccacatgctctgattttaacttcggcactgctttgcacatagccgcttataacctgtgcgcaggcgcagtgaagtgccttctagagcaaggcgctaatccggcttttaggaatgataagggacagattccagccgacgtggttccggatccggtggacatgcccctggagatggccgacgccgctgccaccgccaaagaaatcaaacagatgctgctcgacgctgtgcctctgagctgcaacatatcgaaagctatgctcccgaactatgatcacgttacgggcaaggcgatgctgaccagcctcggcctcaagttaggtgatagggtggttattgctgggcaaaaggtgggtacgctcagattctgcggcactacggagttcgcgtccggccagtgggcaggtatagaactggatgagcccgagggaaagaacaacggctctgtaggtaaggtacagtactttaagtgcgcacctaagtatggaatattcgcacctctgagtaaaattagtaaagccaaggggcgacgaaaaaacattacacacacacctagcaccaaggctgcagtgcccctgatcagatcccagaagatagatgtagcccacgtgacttccaaggttaacaccggtctgatgactagcaagaaggattccgcaagcgagtcaactctgagcctgccacccggtgaagagctgaaaaccgtgaccgagaaggatgtggccctcctgggatctgtcagtagttgctcctcaaccagctcactggagcatcgccagtcttaccccaagaaacagaacgctatttcaagcaacaagaagactatgagcaagagtccttctctgagctctagagcctccgctggcctgaacagttccgccacttcaactgctaataatagcaggtgtgagggcgaactgcgattaggtgagcgcgtgctggtggtgggtcaacgtttgggaaccatccggttcttcgggaccacaaacttcgcacccggatactggtacggaatagaactagaaaaaccacacgggaagaatgatggtagtgttggcggtgtgcagtatttttcctgtagtcctaggtacggaatcttcgctcctccatcccgcgtccagagggtcaccgacagcttagacaccctatcagagatctcatctaataaacaaaaccacagctaccctggctttaggcgctcattcagcacaactagcgcaagtagtcagaaagagatcaatcgcaggaatgccttcagtaagtcaaaggctgctctgcgtcgtagttggtcctccacacccacagctggaggcattgaggggtccgtgaaacttcatgagggatcccaggtcctgctgacctcgtctaatgaaatgggcacagtgcgctacgttgggcctaccgacttcgcttcaggcatctggctaggactggagctgcgaagtgccaagggaaaaaatgatggatccgtgggagacaagcgctattttacctgcaagcccaaccacggagtgcttgtgaggcccagcagagtgacctatcgcggaattaacgggtccaagttagtggacgagaattgctag

SEQ ID NO: 53415 - DNA, 2172 bp, Artificial Sequence
  Description of Artificial Sequence: Synthetic coding sequence
aagatgacaattgaagacctccctgatttcccccttgaagggaaccctctgttcgggagatatcctttcattttctccgcatcagacacaccagtgatcttctctatatcagccgcaccaatgccctcagattgcgaatttagtttctttgatcccaatgacgccagttgccaagaaatcctctttgatccaaaaacatcagttagcgaattgttcgcaatactaaggcagtgggtgccgcaggtccagcagaatatcgatatcatcggcaatgagatcctgaaacgaggctgcaatgtgaatgacagagatggcctgaccgatatgaccctgttacattacacctgtaaatccggggcacatgggattggggacgttgaaacagcagttaagtttgccacccagttgattgacctaggggcagacatttcacttaggagcaggtggacgaatatgaatgctctccattatgccgcttactttgatgtgcccgagctgatccgcgtgatcctgaagactagcaagccaaaggacgtggacgctacttgcagtgactttaacttcggcaccgccctacacattgcagcatacaacctgtgcgccggagcagtgaaatgcttgctcgaacagggggctaatcctgccttccgcaacgataaggggcagatacccgcagatgttgtaccagatcctgttgatatgccccttgaaatggccgatgctgccgcaacggctaaggaaatcaagcagatgctcctggatgccgtccctctgtcatgcaatattagtaaggccatgttgccaaactacgatcatgtgacaggaaaagccatgctaacgtccctcgggctcaagctaggcgatcgcgttgtgatcgctggccaaaaagtgggcaccctgagattttgtggtactacagagttcgcctcaggtcaatgggcaggcatcgagctggacgaacctgaaggtaagaataacgggagtgttggcaaagtgcagtacttcaagtgcgcgcctaagtatgggatatttgcaccactttctaaaatctccaaggcaaaggggaggcgcaagaatattacacatacaccaagcactaaggctgcggtgccccttattcgaagccagaagattgacgtcgcacacgtcacctctaaagtaaacactggacttatgacatctaagaaggactcagcatccgaatctaccctgagtcttcctccaggcgaggagctcaaaacggtcaccgagaaagacgtagcgctgctggggtccgtgtcaagctgcagcagtacatcgagtttggaacaccggcagtcctatcctaaaaagcagaacgccattagctctaacaaaaagacaatgtctaaaagcccaagtttgtcttcgcgcgcttcagctgggatctacggctttttcaatcaggcatttttggtcttctttatattagtctgcctgttcgaatttctttcaaatatctattccaactcccgttgcgagggcgagttgaggctcggagaaagagtgctggtggtcggtcaaaggcttgggacgataaggttttttggcacaacaaattttgccccaggatactggtatgggattgagctggaaaaacctcatgggaagaacgacgggtctgtggggggagttcagtactttagttgttctccgaggtacggcatctttgcacctccgtcacgtgtgcagcgggtaactgactctctagatactctcagtgaaatcagtagcaataagcagaaccattcctaccccggttttcgaagatcattctctaccacatcagctagttcccaaaaggagattaataggaggaatgccttcagcaagtccaaggcggctttaaggaggagctggtcttccacccctactgcaggtggcattgagggctctgtgaaactgcatgaggggagccaggtcctattaacctctagcaacgagatgggaaccgtcagatacgtgggccctacagatttcgcatccgggatatggctgggactggaactcagaagcgcaaagggaaaaaacgatgggtcagttggggataagaggtacttcacttgtaagcccaaccatggagtgctggtcagacccagtagagtaacataccgcggaatcaacggatcaaaactggtcgacgagaactgctag

SEQ ID NO: 53416 - DNA, 2124 bp, Artificial Sequence
  Description of Artificial Sequence: Synthetic coding sequence
atgacgattgaagatctgcctgacttccccctggagggcaatccacttttcgggagatacccattcattttttctgcttcagacacgcctgttatttttagtattagtgccgcacccatgccttcagattgtgagttcagcttctttgatcctaatgacgccagttgccaggagatcctgttcgatccaaagacttctgtctccgagctcttcgcgatcttgcggcagtgggttccacaagtgcaacaaaatatcgatattatcggcaatgagatcctgaagcggggttgcaatgtaaatgacagagacggactcacagatatgacccttttacattacacttgtaagtccggggctcacgggatcggagacgtggaaacagcagtgaaatttgcgacccagctgattgacctgggcgctgacatatccctaagatccagatggaccaacatgaacgcgctgcattatgctgcttattttgatgtgcccgaactgatcagagtcattctgaagacctccaagcctaaggacgtcgacgcgacctgttccgattttaacttcggaacagccctgcacattgctgcttataatttatgtgccggtgcggttaagtgtctgctggagcagggagctaatcccgcatttcgtaatgacaaggggcagattccagcagacgtggttcccgaccccgtcgacatgccactggaaatggctgatgccgctgccacagctaaggagataaaacaaatgctgctggatgccgtgcccctctcatgtaacatatctaaagcaatgctgcccaattacgaccacgttacgggcaaagcaatgctcaccagcctcggactgaaacttggcgatagagtggtaatcgccggacagaaagtcgggacacttcgcttttgcggcactaccgaattcgcttcagggcaatgggcagggatcgagctagacgagccagagggaaaaaataacggttctgtgggaaaggtccagtactttaagtgtgctccaaaatatggaatttttgccccactctccaaaatctccaaagcaaaggggagaaggaaaaacatcacacataccccctcaacaaaagccgcagtgcctctgataaggtcccagaaaattgatgtggcacacgtgacgagcaaggtcaacacgggattaatgacaagcaaaaaagatagtgccagcgagagtacgctgtcccttcctcctggcgaggagctgaagactgtgactgagaaggatgtggctcttctgggctccgtgagcagttgttcctctacttccagtctggagcatagacaatcctatcctaaaaaacagaacgccatcagctcaaacaaaaagacaatgtctaaaagcccttctttatccagccgtgcttcagcaggccttaactcgtcagcgacaagcacagccaacaattcacgctgcgagggcgaactgaggttgggcgagagagtcctcgtggtaggccagcgattggggactatcaggttttttggcacgacaaacttcgcgcctgtgctcggatattggtacggcatcgaactggagaaaccccacggcaagaatgacgggtcggtgggtggggtgcagtacttctcgtgctcaccccgatacgggatcttcgccccaccatccagggtgcaacgcgtgactgactcccttgacacactgagcgaaattagtagtaataagcagaatcattcatacccaggcttccgacggagttttagtaccacctccgcctcatcccagaaggagatcaacagacgcaacgctttttctaagtctaaagctgccctgagaagaagctggtcgagtacccccaccgccggaggcatcgaagggagcgtgaagctccacgagggaagtcaggtgctcctaacctcatctaacgagatgggaacagttcgatacgtgggacctacagacttcgcatctgggatctggctcggcctggaactgcgcagcgctaagggtaaaaacgacggctccgttggggacaaaagatactttacttgtaaacctaatcatggagtgctggtccgtcccagcagagttacgtacagaggaataaatggttctaagctggtggatgagaattgttag

SEQ ID NO: 53417 - DNA, 2118 bp, Artificial Sequence
  Description of Artificial Sequence: Synthetic coding sequence
atgacgatagaggatctgccggatttcccacttgaggggaacccgctgttcggccgttatccatttattttctcggctagtgacaccccagtgatcttctcgatttcggcggcacctatgccctcggactgcgagttcagcttctttgacccgaacgacgccagttgtcaagaaatcttgttcgatcccaagacttccgtatctgagctgttcgcaattcttcgtcagtgggtcccccaagtgcaacaaaacatcgacatcattgggaacgagatactcaagcgaggttgtaatgtaaacgatagagacggccttactgacatgaccctgctgcactacacctgtaagagtggagcgcacggaattggcgacgtggaaaccgctgtgaagtttgcaacacagctcattgatttgggagctgacatctccctgcggtctcgctggactaacatgaatgccttacactatgccgcatatttcgacgtgcctgaactcatccgcgtgatcctaaaaacaagtaagcccaaagatgtcgatgcgacatgctccgattttaatttcggcaccgctctgcacatcgccgcatataatctctgcgctggcgctgtcaagtgcctcctcgaacagggagctaatcctgcgttcaggaacgataaagggcagattcccgcagatgtggtgcctgatccagtggacatgccactggagatggctgatgcggctgccactgcaaaagagattaagcagatgctcttagatgccgtgcccctgagctgtaatataagcaaggcaatgctgccaaattatgatcatgtgacggggaaggcaatgttgacatccctcgggttaaagctcggagacagagtggttatcgccggacagaaagttggcacccttcgattttgtgggactaccgaatttgcttctggtcagtgggccggtatcgagcttgatgagccagagggcaagaacaatggttcagtcggcaaggtgcaatattttaaatgcgccccaaagtatggaatttttgctcctctgtctaagataagtaaggcaaaagggagacggaaaaacattacccataccccaagcactaaggccgcagtgccgttgattcgctcacagaagatcgatgtcgcccatgttaccagtaaagtgaacaccggactcatgacaagcaagaaagatagcgcgtcagaaagcactctgagtctgcctccgggagaggaactcaaaactgtgactgaaaaggatgtggcccttctcgggtcagtgtcgtcctgcagctccacatcatccctagagcaccgacaaagttaccccaagaagcagaacgccatcagctcaaataaaaagacgatgtccaagagcccatccctctcctcccgcgctagtgctggcctgaattcgagcgccacttccaccgctaataacagtaggtgtgagggcgagttgcgcctgggagagagggttcttgtcgtgggacagagacttggaaccatacgctttttcggtaccactaacttcgcacctgggtattggtacggaattgagttagaaaagcctcacgggaagaacgacgggtccgtcggaggcgtgcaatacttctcctgttcaccccgatacggcattttcgctccaccctctcgtgtgcagagggttactgatagtcttgacactcttagcgagatttcttcaaacaaacagaaccattcctacccaggctttcgaagatcctttagtactacaagcgctagttcacagaaagagattaaccgaaggaacgccttctctaagagtaaggcagcactgcgaagaagctggtctagtaccccgaccgccggaggcatcgagggatccgtcaaactccacgagggctctcaggtcctcctgacatcatcaaatgagatgggcacggtcagatacgttggacccactgacttcgcttccggcatatggctcggcctggagctgcggtctgcaaagggaaaaaacgacgggtcggtgggagacaagaggtatttcacgtgtaagccgaaccacggcgtgctcgtgagaccaagcagagtgacctataggggcatcaacgggtcaaagcttgtggacgaaaactgctag

SEQ ID NO: 53418 - DNA, 645 bp, Artificial Sequence
  Description of Artificial Sequence: Synthetic coding sequence
atgacaatcgaagacctgccggattttccccttgaaggcaatcccctcttcggtcgctatccttttatctttagcgctagtgacacaccagtgatcttttccatcagcgccgcaccaatgccatccgattgtgagtttagtttctttgacccaaacgacgccagttgccaagaaattttattcgatcccaagacaagtgtaagcgaactgttcgctatattacgccaatgggtacctcaggtacagcagaacattgacatcatcggaaatgagatcctcaagcggggttgtaacgtgaacgatcgggacggactcacggacatgaccctgctgcactacacctgcaagagtggcgcacacggaatcggggatgtggagacagcggtcaaatttgcgacacaacttatagacctaggtgccgatattagcctcagatcaagatggaccaacatgaatgctctgcactatgctgcttacttcgatgtaccagagctcatcagggtgatcctgaagacatccaaaccaaaagacgtcgatgcgacttgttcagacttcaattttggtacggctctgcatatagctgcttacaacctgtgtgcgggagcagttaaatgcctcctcgagcagggtgcaaatcctgcatag

SEQ ID NO: 53419 - DNA, 1998 bp, Artificial Sequence
  Description of Artificial Sequence: Synthetic coding sequence
atgcagcgtcgaaaacagaaacagaaaaaccttaatgaaagtcattacctgtgcatgctgctgcagtcagagctgagcgagttctctttttttgatccaaacgacgctagttgtcaggagattttgttcgaccccaagactagtgtctctgaactgttcgccatcttgcgtcagtgggtgccccaggtccaacagaacatcgatataatcgggaacgagattctgaaaagggggtgcaatgtaaacgacagggacggattaacagatatgaccctgctccactatacatgtaagagcggtgcgcatgggataggcgacgtcgagacggccgtgaaattcgcgacacagttaatcgacctaggagctgacatctccctccgctctagatggaccaatatgaacgcactgcattacgctgcctactttgacgtgcctgagctcatccgggtgattttgaagactagcaaacccaaggatgtggacgcgacatgctccgattttaatttcgggaccgctcttcatatcgctgcctacaatttgtgcgctggcgctgtgaagtgcctcctggagcaaggagccaaccctgcgtttcgcaatgacaagggccagattcctgctgacgtggtaccggaccccgtggacatgcctctggaaatggctgacgcagctgcgacggctaaagaaataaagcagatgttacttgacgccgtcccactcagttgcaatatttccaaggccatgctccctaactacgatcacgttacgggcaaggcgatgctgacgtcactcggcctgaagttgggagatcgcgtggtgatcgctgggcagaaagtcgggaccctgcgattttgcgggacaacagaattcgctagcgggcagtgggccggtattgagctggatgaaccagaaggcaagaataacggaagcgtgggaaaggtccagtactttaaatgcgctccaaaatacggtatttttgctcccctatctaaaatttctaaagctaagggaaggcggaaaaatattacacatacaccttccaccaaggccgctgtccctctcatcagaagccagaagattgacgtggcccatgtcacatccaaggtgaacaccggtttgatgacatcaaagaaagactctgccagcgagagcaccctgtctctgcccccaggtgaagagctaaaaaccgtgacagagaaagacgttgcgctcttggggagcgtctcttccaataaaaagaccatgagtaagagcccctcactgtcctccagggcctcagcaggacttaacagtagtgccacgtctaccgctaataatagtcgctgcgaaggtgaactgaggctgggcgaacgtgtgctggtggtgggccagagactcggcactatcagattttttggcaccacaaattttgccccaggctactggtacgggatagagctggaaaagcctcatggaaagaacgacgggagcgtgggaggtgtgcagtactttagctgtagccccaggtacgggattttcgcacccccatctcgagtacaacgggttaccgattcgctagacaccttgagtgagatctcatctaacaaacaaaaccattcctatccagggtttcggaggagtttcagcactacatccgcatcatctcagaaagagatcaatcggagaaatgcattcagtaaatcaaaagcagcgctgaggcgctcctggagctctaccccaaccgccggaggtattgagggatcagttaaactgcatgaaggctcgcaagtgttattaaccagttccaatgaaatgggaactgtcaggtacgtcggaccaactgatttcgcttctggaatatggctaggccttgaattgagatctgccaaaggaaaaaatgatgggtctgtgggtgacaaacggtactttacatgtaagccaaatcatggcgtcctcgtccgtccttcacgggtgacctacagggggatcaacggctctaaactggtcgacgagaattgttag

SEQ ID NO: 53420 - DNA, 1173 bp, Artificial Sequence
  Description of Artificial Sequence: Synthetic coding sequence
atggtaaccagagcaggagctggaacggccgtggcaggtgcagtggtggtggctctcctcagcgctgcgctggccctgtacggcccacccctggatgctgtgttagagagagcctttagcctaaggaaagcacattctattaaggacatggagaacacattacagcttgtgagaaacatcattcctccactgtcctctacaaaacataaaggtcaggatggcaggatcggagtggtgggaggatgccaggagtacacaggcgcaccctacttcgctgcaatctcagcattgaaagtgggcgctgatttatcgcacgtattctgtgcctctgccgcagcacctgtcatcaaggcctactctcccgagcttattgtacatcccgtactcgacagtcctaatgctgtgcatgaggtggagaaatggctcccgaggttacacgcacttgtggttggaccaggccttggaagggacgacgcgcttctgcgcaatgttcagggaatacttgaagtgtccaaggcacgcgacattcccgtggtaattgatgcagacggactgtggcttgtggctcagcaaccggctctcatccatgggtatcggaaggccgtcctgacacctaatcacgtagagttcagtagattgtacgacgctgtactacggggaccaatggattcagatgattcgcatggcagtgtgcttcggctgtcccaagccctcggcaatgtaacagttgtgcagaagggtgaaagggacattctctcgaacggccagcaggtcctcgtgtgctcccaggaggggtcttcccgtagatgtggtggccagggggacctactgagcggttctctgggagtcctagtgcactgggccctgctagccggtccacagaaaacgaacgggggtatctccgaccttaagctcacgatctgggggcctgagatagaaactggcgtgaagacccgggctcagggctcctgcggacccaggactacaacgccgacctcgccccacttgctgttgagcccgagcccgcaggtccagccatcgcccggaggcagagtgtggaggctcttgtctcatcaggcagtacagcccccatctttacccgaggccagatcacttcaccaccacttacggcacgatcggaggggaggagggaggctgcagcaggccctgtag

SEQ ID NO: 53421 - DNA, 366 bp, Artificial Sequence
  Description of Artificial Sequence: Synthetic coding sequence
atggccctggggcctcgctgtggtgctatacgagcttgcagaagagtgctggaaagagcgttctcactgcggaaagcccacagcataaaggatatggagaatacactccagcttgtgcgcaacataatccctccattgtcaagcaccaagcacaaggggcaggacggcagaattggagtggtcggaggctgccaggatgactctcccaatgcagtccatgaggttgaaaagtggcttcccaggctccacgcactcgttgtcggccctggcctgggaagggatgacgccctgctgcgcaatgtccaggggattctggaagtgagcaaagctagggatatccctgtggttatcgacgctgtgtcctag

SEQ ID NO: 53422 - DNA, 714 bp, Artificial Sequence
  Description of Artificial Sequence: Synthetic coding sequence
atgcttcccgacggccctggatcctctctttgggggaacccgggtttgcagaccagtgattcacccaacgcagtgcacgaggtcgagaagtggctgcctcggttacatgcattggtagtaggacccggtctgggccgtgatgatgctctcctgcgaaatgtacagggaatacttgaggtcagcaaggccagagacattccggtggttatagatgccgacggcctgtggctggtagcgcagcaaccagctttaatccacggatataggaaagccgtacttacccccaaccatgtagagttttctcggctgtacgacgcagtgctccggggtccaatggattcagacgattcgcacgggagtgtcttgaggctcagccaggcccttggaaatgttaccgtggtgcaaaagggagaaagagacatactgtctaacggccagcaggtactcgtgtgctcccaggaggggtcttcccgtaggtgcggtgggcagggcgatctgttatcagggtctctgggagtattggtacattgggcgcttctggctggtccacagaagaccaatggttccagtcctctgctggtggctgctttcggcgcttgttcgctgactcggcagtgtaatcaccaggcctttcagaagcatggcagatctactactacctcagacatgatcgcagaggtcggcgcagctttttcaaaactttttgagacatag

SEQ ID NO: 53423 - DNA, 972 bp, Artificial Sequence
  Description of Artificial Sequence: Synthetic coding sequence
atggcactcggtcctcggtgcggcgcaattcgggcttgtcggcgagttctggagagagccttctcccttaggaaagcccattccataaaagatatggaaaacacgctgcagttagtgaggaatatcatacccccactgtcttcaacaaagcataagggacaggacgggagaattggagtggtcggcggatgtcaggagtacactggggctccctacttcgctgcgattagcgctttgaaagtgggagcagatctaagccatgttttctgtgcctcagcagcagcccctgtgatcaaggcatactcccccgagctgattgtacaccccgtcctggactcgcccaatgcagtgcacgaagttgagaagtggctgcctaggcttcacgcactggtggttggaccgggactgggcagagacgacgctctcctgcgaaatgttcaaggtatactggaggtctcaaaggccagagatattccagtcgtgattgatgccgatggactctggcttgttgcacaacagcccgctctgattcacggttatcggaaggctgtgctgaccccaaaccatgtagaattctccaggctctacgacgctgttcttaggggtcccatggactcagacgacagtcacggaagcgtcttgcggctgtcacaggctctggggaatgtgacagtggtgcagaaaggtgagagagatatcctctctaatggccagcaggtccttgtgtgcagtcaggaggggtcatctcggaggtgcggagggcagggcgatcttctctcgggctcacttggggttctagtgcattgggctctgctggccggaccgcagaagaccaatggaagcagccccctgctcgttgctgccttcggcgcatgcagcctcacccggcaatgcaatcatcaagctttccagaaacacggcgcttgtcaaatatttaacctctccataaattggctgcctctgcggatttag

SEQ ID NO: 53424 - DNA, 651 bp, Artificial Sequence
  Description of Artificial Sequence: Synthetic coding sequence
atggccgtcttcccagctacagcgcgaggccagctgggtatacgcaatgccgctcggtggccatgggtgttggccgtaggccaaagcggcctcgccgacgaaggtattcttgaggtaagcaaggctagggacattcctgtggtgatcgacgcggacggactatggctcgtggcccagcaaccagccttgattcatgggtaccggaaagctgtattgacccccaaccacgtcgaattcagccgactgtacgacgccgtcctgagggggcctatggacagcgacgacagtcacggatctgtcttaaggctgtcacaggcactgggaaacgtgaccgttgtccagaagggtgagcgggacatccttagcaatggccagcaagttctcgtttgctcacaggagggaagttccagacgctgcggaggccagggtgaccttctgagcggcagtcttggagtgcttgtgcattgggcactccttgccggtccccaaaagaccaacggatcaagcccactgcttgtggctgcgttcggcgcttgttctctgaccaggcaatgtaaccaccaggcttttcaaaagcatggccgatcgactactacgagcgacatgattgcagaggtcggggctgccttttccaagcttttcgagacatag

SEQ ID NO: 53425 - DNA, 789 bp, Artificial Sequence
  Description of Artificial Sequence: Synthetic coding sequence
atgagtcgactcagctgggggtaccgggagcacaatgggccaatccattggaaagaattcttcccaattgccgacggggatcaacagtcaccgatcgaaatcaagactaaagaggttaagtacgactcatctttgcgtcccttatcgattaagtatgacccctcttctgctaagatcattagcaatagtggccacagcttcaacgtggattttgacgacactgagaacaagagcgtgttgcgcggagggccacttaccggatcctatcgcttacgccaagtgcacctgcattggggttccgcagacgatcatggctcagagcatattgtggacggtgtctcttacgctgccgagctgcacgttgtgcactggaattcagataaatacccaagttttgtggaggccgcacatgagcccgatggccttgccgttctgggagtgtttttgcaaatcggcgagcccaacagccagctgcagaagattaccgacaccctggactctattaaggaaaaaggcaaacagactcggttcacaaacttcgacctgctgtcactgttacctcctagctgggattactggacataccctggtagcctgacggtgccaccactgcttgaaagcgtgacatggatcgtgttgaagcagcccataaacatatcctctcaacagttggctaaatttcggagtttgctgtgcactgccgaaggagaggctgcagcgttcctggtgtccaatcaccgaccccctcagccccttaagggcagaaaagttcgggcaagtttccattag

SEQ ID NO: 53426 - DNA, 1311 bp, Artificial Sequence
  Description of Artificial Sequence: Synthetic coding sequence
atgcagggaaccccaggcggtggcactcggcctggcccttccccagtagataggcgtacccttctggtcttttctttcatactggcggcagctttgggccagatgaatttcacaggagatcaggtcttgagggtgctcgccaaagatgagaaacaactgtcactgctcggcgacctggagggccttaagcctcagaaagtcgatttctggcgcggacctgctcggccttccctccccgtggatatgcgagtaccattctcagagctgaaagatatcaaagcctatctagagagtcatggtttggcgtattctatcatgattaaggacatccaggtgctcctagatgaggagcggcaggccatggctaaatctaggagattggaaaggtcaactaattcgttctcctacagctcctatcataccctggaggaaatttattcctggatcgacaacttcgtcatggagcactcagacatagtttccaaaatccagatagggaattctttcgagaaccaatcaatcctcgtcctcaaatttagcacgggtggtagtagacatcccgctatttggatcgatacagggattcactcccgagagtggattacccacgccacagggatatggaccgccaacaaaatcgttagcgattatggcaaagaccgcgtactgaccgacattctcaatgccatggatattttcatcgaacttgtgactaatcccgatggctttgcattcacacattccatgaatcggttgtggaggaaaaataagtctataagaccagggatattttgcataggtgtggatctaaacagaaattggaagtccggcttcggaggcaatggcagtaatagtaacccatgtagcgagacataccacggcccttccccccagtctgaaccagaagttgccgctatcgtcaattttatcacagctcacggcaacttcaaggcattaatttccattcacagctactctcagatgcttatgtacccctacggcaggctcctcgagccagtttcaaaccagcgagaactgtacgacctggctaaggatgctgtagaggctctgtataaggtgcacgggatcgaatacatctttggatctatatccaccaccctctacgtggctagtgggattacggttgactgggcatatgacagcggaatcaagtatgccttttctttcgagttgagagacactggacagtacggatttctgttaccggctactcaaataatccccaccgcccaagaaacgtggatggccctacgtactataatggagcatacactgaaccatccctactag

SEQ ID NO: 53427 - DNA, 1311 bp, Artificial Sequence
  Description of Artificial Sequence: Synthetic coding sequence
atgcaggggaccccaggcggaggtaccagacccggaccatcaccagtagatcggagaaccctgctggtattttctttcatcttggctgccgcactcggccaaatgaactttacaggcgatcaggtcctgagggtgcttgccaaggacgagaaacagctgtcattgctgggcgacttggagggtttgaagcctcaaaaggtggacttctggagggggccagcacgtcctagcttacccgtggatatgagggtgccgttctctgaactgaaggatattaaagcatacctagagagtcatggtctggcgtattccataatgatcaaagatatccaggttctgctggatgaagaacggcaggccatggccaagagcaggcgactggagcgctccactaatagcttcagctatagttcttatcacactctggaagaaatctatagttggatcgacaatttcgtcatggaacacagcgacattgtctccaaaatccagatcggcaactccttcgaaaatcagtcgatcttggtcctcaagttcagcacaggtgggtctcggcacccggcaatatggatcgatacaggaattcactctagggagtggattactcatgcaaccgggatctggacagctaacaaaattgtgagtgactatggcaaagaccgggtattgaccgatatactgaacgcgatggatattttcatcgagctcgttacaaatccagatgggttcgcctttactcacagcatgaacaggttgtggagaaaaaacaaatccataaggcctggtatcttctgtattggggtggacctcaaccgtaattggaagagtggctttggaggcaatggctctaattccaacccctgcagcgagacataccacggaccatcgccacagtctgagccagaggtagcagcaatagtcaacttcattaccgcacacggcaatttcaaagccctgatttctattcacagctacagtcagatgcttatgtatccctacggacggctcctggagcccgtctccaaccaacgggagctgtacgatctggccaaggatgccgtcgaggctctgtacaaagttcacggaatcgagtacatctttggctcgatctctacaacactttatgtggccagtggtatcaccgtggattgggcttacgactccggcatcaagtacgctttctcatttgaactgcgagatacaggtcagtacggttttctgctccccgctactcagatcatccctacagcgcaggagacatggatggctctacggaccatcatggagcacaccttgaaccacccctattag

SEQ ID NO: 53428 - DNA, 2196 bp, Artificial Sequence
  Description of Artificial Sequence: Synthetic coding sequence
atgtcccgcccaggaactgcgaccccggcactcgctcttgttctccttgctgtgaccctagctggagtcggagcccagggggcagcactcgaagaccccgattactatggtcaagagatttggagtagagaaccctactatgcccgacccgagccggaattggaaacgttctcccctcctctccctgccggaccgggtgaggagtgggagagacgccctcaggaacctcgccctcccaaacgggctacgaagcctaaaaaagcccctaaaagggaaaagagtgcccctgaacccccaccccctggcaagcacagtaataagaaggtgatgaggacaaaatcatctgagaaagccgcaaacgatgatcactccgtgagggttgccagggaggacgtaagagagtcctgtccaccacttggcctcgaaacgcttaagattacagactttcagctgcacgcctccacagtgaagcgttacggactcggagcccatcggggacggttgaacattcaggctggcatcaacgaaaatgacttttatgatggcgcttggtgcgctggaaggaatgacctgcaacagtggatcgaggttgatgctcgaagactgactcggttcaccggagtgattacacagggacgtaacagcttgtggctctcagactgggtgacatcttacaaagttatggtgagcaatgactcacacacttgggttaccgtgaaaaatggcagcggtgacatgatattcgagggcaatagcgagaaagaaatccctgttctaaacgagctgcccgttccgatggtggcccgatacatccgcataaatccccaatcctggttcgataacgggtctatttgtatgcgaatggaaatactcggttgtcccctacctgatcccaacaattactaccataggcggaacgagatgacaactactgacgacctcgactttaagcaccataactacaaggaaatgcgtcagcttatgaaggtggtaaatgagatgtgccccaatattacacgaatctataacatcgggaaatcgcaccaggggctcaagctgtatgcggtcgaaatctccgatcacccgggagagcacgaagtcggtgagcccgagttccattacatagccggtgcccacggtaacgaggtgcttgggcgagagttgttgctcctcctggtgcagttcgtatgtcaggaatacttagcgagaaacgccaggatcgtacacctcgtcgaggagactaggattcacgtgctgccatccctaaatccagacggttacgaaaaggcttatgaggggggtagtgagctgggaggatggtctctgggtaggtggacccacgatggtatcgacatcaataataattttcctgatctgaacacactgttatccgaaaacgcgacagtcgccgctgaaactcgagccgtgatcgcctggatggaaaagatccctttcgtcttaggagggaatcttcaggggggagaactggtcgtggcctacccttacgatctggtgcgctccccttggaagacccaggaacatacaccaacaccagacgatcacgtcttcaggtggttggcctacagttatgcctctacccaccggctcatgactgacgctcggcgtcgtgtttgccacacggaagattttcagaaggaggagggtactgtgaacggcgcatcctggcacaccgtagctggatccttaaatgacttctcatatctgcacaccaattgctttgagctatcaatctacgttggatgcgataaatacccacacgaaagtcagttgccggaggagtgggagaataaccgagagtctctcattgtcttcatggagcaagtccatcgcggaatcaaagggctggttcgggattctcacggcaagggtattcccaacgccatcatcagcgtggaggggatcaatcatgacataaggaccgcgaatgacggcgactactggagactgctgaaccccggagaatacgtggttaccgccaaggcagagggtttcacggccagtaccaagaactgtatggtgggttatgacatgggcgcaactagatgcgatttcactttgagtaaaacaaatatggccagaatcagagagattatggaaaagttcgggaagcagccagtgtccctcccagcaagacgccttaagctgcgaggacaaaaaaggaggcagagaggatag

SEQ ID NO: 53429 - DNA, 1770 bp, Artificial Sequence
  Description of Artificial Sequence: Synthetic coding sequence
ctcgaaatccaggccggaattaatgaaaatgacttttacgacggggcatggtgtgctgggagaaacgatctgcagcagtggatagaggtggatgcaaggaggctcacgcggttcaccggagtgattacacagggccgaaacagcttgtggctatccgattgggtcacaagctacaaggttatggtctcgaatgactcccacacttgggtcacagtgaaaaatggctctggggacatgatcttcgaaggcaactccgaaaaagagatcccggtgttgaatgaacttcccgtgccgatggtcgcaaggtatatacgaattaatccccaaagctggtttgacaacggctcaatatgcatgaggatggaaattctgggctgccccttgcctgacccaaacaattactatcaccgccgtaatgagatgactactaccgacgatctggacttcaaacaccataattacaaagagatgaggcagcttatgaaagtggtaaacgagatgtgtccgaacataaccagaatatacaacatcggcaaaagccaccagggccttaagctgtatgccgttgaaatctccgatcacccaggcgaacacgaggttggagagcctgagttccattatatagcaggagcccacggaaatgaggtgcttggccgagagctcctcctcctactcgtccagttcgtgtgccaggaatacctcgcccgtaacgcaaggatcgtccacctggttgaggaaacccggatccacgttctgcctagcttaaacccagacggttacgaaaaagcctatgaaggtggatccgagctggggggatggtccctgggcaggtggacacacgacggaattgatataaacaataactttccagaccttaataccttattgtgggaggcggaagatcgacagaacgtgccaagaaaggttcctaaccactacattgctatacccgagtggttcctgagtgagaatgccacagtggcggcagagacacgcgcagtgatagcatggatggaaaagatccccttcgtcttaggcggtaacctgcaaggaggtgagctcgtggtcgcctacccctacgatttggtccgttccccatggaaaactcaggagcacactccaacgccggatgaccacgttttcagatggctggcttatagttacgcctctacccatcggttgatgacggacgccaggcggagggtgtgccataccgaagacttccagaaagaggaaggcacagtgaatggagctagttggcataccgtggcaggctcgctgaacgatttctcctacctacataccaattgcttcgagctgtctatttatgtcgggtgtgacaaatatccccacgaatcccaactgcccgaggaatgggaaaataaccgggagagtcttatcgtgtttatggaacaggtgcaccgtgggattaaaggcctggtcagggatagccacggtaagggtattccaaacgctattatcagcgtagaaggcattaatcatgatattcgtaccgccaatgacggagattattggcgcctcctcaacccaggagagtatgttgtgaccgccaaggcagaaggcttcacagctagtacaaagaattgtatggtaggatatgacatgggagccacccggtgcgactttacgctgtccaaaacaaacatggctcggattcgggagatcatggagaaatttggaaagcagccagtatctctgccagcccgtcgcctaaaactccgcggacagaaacgcagacagagaggttag

SEQ ID NO: 53430 - DNA, 1464 bp, Artificial Sequence
  Description of Artificial Sequence: Synthetic coding sequence
atgagtgacctgttatcaatctattctgcacccgtggtcgtctcaaccgtgctccacatcacaattgtatttccaatccttcagattcggaagcttagactggggagggtgcataaactgcccagggtcttggaggttgggaacagcggaaccatgtctcgagcttacacattcttcttcctgcgctggaactccatggctcttaccggttattcatggctactgttaagtgctaccttcctcaatgtgggggctgagatctcaattactttggagcctgcccaaccatcagagggggacaatgttaccttagttgtacacgggctgtccggcgagctgttggcctatagttggtacgccggaccaactctatcggtgagctacctggttgcatcgtatatagttagcacaggagatgaaacccctggcccagcacatacaggtcgcgaagccgtgaggccggatggaagtctcgacatacaaggtattcttccgaggcattccgggacgtatatcttgcagactttcaacagacagttgcaaaccgaggtgggttacgggcatgtgcaggtgcatgaaattctcgcccagccaactgtgttggctaatagcaccgccctggtggagcgtcgtgacacgctgcgcttaatgtgcagcagcccatcacctactgcggaggtgcggtggttctttaatggcggtgcattacctgtggcactacggctggggctgtccccagatgggcgtgtgttagcccgtcacggcatcaggagggaagaagcaggggcttaccagtgtgaagtttggaatcctgtttcagtatcaagatcggaaccgataaatctcactgtgtactttggccctgagcgggtagccatactccaggattctactaccaggactgggtgcacgatcaaagtagacttcaacacgagcctgacactctggtgtgttagcaggtcttgccccgagccagagtacgtctggacctttaacgggcaggcgttgaaaaatggacaggatcatctcaacatttcaagcatgactgccgctcaggaaggaacttatacatgtatcgctaaaaacaccaaaacactcctctcaggcagcgcctcagtcgtggttaagttatccgccgctgcagtagccaccatgatcgtgcctgtacctaccaagcccacagaaggacaggatgtgacgttgacggtgcaagggtatcccaaagaccttttagtttacgcctggtacaggggacccgcttctgaaccgaatcggttactttctcaattgccctcgggaacctggatcgcaggcccagcccacacaggcagagaggtcgggtttcctaattgcagccttctcgtgcagaagctcaatcttacagacactggacgctatacccttaagacagtgaccgtgcaagggaagacagagaccttagaggtcgagctgcaagtcgcatag

SEQ ID NO: 53431 - DNA, 1278 bp, Artificial Sequence
  Description of Artificial Sequence: Synthetic coding sequence
atggccctcaccggctacagctggttactgctttccgcaacatttctgaacgtgggcgctgaaatcagcattactctggagcctgcccagccttccgaaggtgataatgtgacccttgtcgtccacggcctttcaggagagctcctggcatattcatggtacgctggtcctacactcagcgtcagctacctggtcgcgtcttacattgttagcacaggggatgaaacaccgggaccagcccacacagggcgagaagcagtccgcccagacggctccttagacatccagggcatcctccctcgacattccggaacgtacattctgcagactttcaatcggcagctgcagacagaagtgggatacggacacgtgcaagtgcacgagatattagcccaacctaccgtgctggccaactccacagccctcgtcgaacgcagagacactttacgcctgatgtgctcgtcaccatcccctacagctgaggttaggtggttcttcaacggcggagcactgcctgttgctctgcgtctcgggctttcaccagacggtcgcgtcctagccagacacgggatcaggagggaagaggctggcgcttatcagtgcgaggtctggaaccccgtgtcagtgagtagaagcgagccaatcaatctgactgtgtactttggtcccgaacgggtggctatccttcaggattccacaactagaaccggctgcacaatcaaagttgactttaacacctccctgaccctgtggtgtgtgagccgtagttgccccgaacctgagtatgtctggaccttcaacgggcaggccctgaaaaatggacaagaccacctgaacatcagcagtatgaccgccgctcaggaggggacgtatacctgtatagcgaaaaatacaaaaaccttactcagcgggagtgcttctgtagtagtgaaattatcggccgctgcggtggcaaccatgattgtgccagttccgaccaagcccactgaggggcaagacgtcactttaacagtccaggggtaccctaaggacctgctcgtttacgcttggtatagaggacctgctagtgaaccaaacaggctgctgagccagctgccttccggtacgtggattgccggacccgctcacaccgggagagaggtgggatttccaaattgttctctgctggtccagaagctgaatctgactgatacaggcaggtacactctgaagaccgttaccgttcagggcaaaaccgaaaccctggaggtcgaattacaggtggctcccctgggatag

SEQ ID NO: 53432 - DNA, 1092 bp, Artificial Sequence
  Description of Artificial Sequence: Synthetic coding sequence
atggacctgtctcgacctcgttggagcctttggcgcagggtgtttcttatggcttcactcctggcctgtggcatctgtcaggcatccggacagatttttatcacccagacactgggcatcaaaggctatcgcactgtggtggccctggataaggtgcctgaagatgtccaggaatactcgtggtactggggagccaacgattcagctggcaacatgatcataagtcataaaccaccctctgcccagcagcctgggccaatgtataccggacgtgagagagtgaatagggaagggtcattgctgattcggccaaccgcgcttaatgatacgggcaactacacagtgcgggtcgttgcgggaaatgaaacacaaagggcaaccggctggctggaagtactggaactgggcagcaatctgggcatcagcgtaaacgcctcaagcctggtcgaaaatatggactctgtggctgctgattgcctgacaaacgtaaccaatatcacatggtatgtcaatgacgtgccgactagctcaagtgacaggatgacaatcagccctgatggcaaaactctagtaattttgagagtctctcgatatgaccgcacaatccagtgtatgatagagagctttccagaaatctttcagcgcagtgaacggatttccctgacagttgcgtacggtccagattatgtcctgcttcgctccaaccctgatgattttaatggtattgttacagcggagattggctcgcaggtagagatggagtgcatttgctattctttcctggacctgaaataccattggattcacaacggttctctgctgaacttctcagacgccaaaatgaatttgtcctcactggcctgggaacagatgggcagatatcgatgcacagtggaaaatcccgttacacaactcataatgtacatggatgtacgtatccaggctcctcatgagtgcccactcccctccggcattctgccagtcgtgcaccgagactttagcatctcagggtctatggtgatgttccttatcatgctaaccgtgttgggcggagtctacatttgtggagtcctgattcatgcactcatttag

SEQ ID NO: 53433 - DNA, 1197 bp, Artificial Sequence
  Description of Artificial Sequence: Synthetic coding sequence
atggaggtatcaggttgtccaactcccgcaggccagtctgcaccatggggcggaaaagcggcattaaaggccggaaggcgcgatagacaaccgctttgccaagagacacaagtgctggagggagccgaagaagtggccgtcagcctggaaggaccacttctgctggaggaccctagacagcttatggacctcagtcgcccaagatggagcctttggcggagggtctttctcatggcctctctcttggcctgtggcatttgccaggcctccgggcagatctttatcacacagactctgggaattaaaggataccgcacagtagtcgctttagacaaggttcccgaggacgtccaggaatactcctggtactggggggctaacgattctgcaggcaatatgataattagtcacaaaccaccgtcggcccagcagcccggtccgatgtacacggggcgtgagcgtgtgaatcgggaaggctcattgcttatccgacccactgcactcaatgatacaggaaattacactgttagagtagtcgctgggaacgagacgcagcgtgccacagggtggctagaggtcctggaactcgggtccaacctgggtatttctgttaacgcatcatctctcgtcgaaaacatggactccgtcgccgcagactgcctcacaaacgtgacaaatatcacctggtacgtaaatgatgtaccaacctcttctagtgacaggatgaccatctcccctgacggaaaaaccttggttattcttcgggtgagtcggtatgataggaccatccaatgcatgattgagtccttccccgagatctttcagcgctccgaacgaatctccctcacagtggcttatggcccagactacgtgctgcttcggagtaatcctgatgactttaatggaatcgtgactgccgagattgggtctcaggtggaaatggagtgcatctgctattccttccttgatctgaagtaccactggattcataatggctcgcttctgaatttcagcgacgctaaaatgaacttgagctccttggcatgggaacagatgggcagatacaggtgtactgtggagaacccggttacacagcttattatgtacatggatgtgcgtatccaggccccacatgagtgtagctcctcaccgcctgggtcgtgctttgcacacctacctgctagtatgccttgctag

SEQ ID NO: 53434 - DNA, 705 bp, Artificial Sequence
  Description of Artificial Sequence: Synthetic coding sequence
atggagaagtgcaaaggcacctcgaggatggctgggacaacaagcgcagacgttaagatgagtagctctgaagaagtgtcttggataagctggttctgtggattgcgaggtaacgaatttttctgtgaagtagacgaggattacattcaggacaagttcaacctgacaggactcaatgaacaggtaccgcactacaggcaggccctagatatgatactcgatttggagccggatgaagaactagaggacaatcccaaccagagcgatttaatcgagcaagcagccgaaatgttgtatgggctcatccatgcacggtacatactgactaaccgcggaattgctcagatgcttgagaaatatcagcaaggggatttcggatactgcccaagagtttattgtgaaaatcagccgatgcttcccatcggcctgtctgatattccaggggaggcaatggtgaaactctactgtccaaagtgcatggatgtttacaccccaaaatctagtcgccaccaccatacagacggagcatacttcggaacaggcttcccccacatgctgtttatggtccaccccgaataccgtcccaaacgcccagctaatcagttcgtgccgcgactttacggatttaaaattcaccccatggcataccagctacaactgcaggcggctagtaactttaagtcaccagtgaagactatcagatag

SEQ ID NO: 53435 - DNA, 294 bp, Artificial Sequence
  Description of Artificial Sequence: Synthetic coding sequence
atggccgataaagtgttaaaagagaagcgcaagttattcattcatagcatgggagaaggaactattaacggcttgctagatgaacttctgcagacacgcgtgctcaaccaggaggaaatggaaaaagtcaagagggaaaacgctaccgtcatggacaagacaagagcactgatcgacagcgtaatcccaaaaggagcgcaggcatgccaaatttgcatcacctatatctgcgaggaggactcgtatcttgctgagaccctcgggctatctgcgggtccaatcccaggaaactag

SEQ ID NO: 53436 - DNA, 594 bp, Artificial Sequence
  Description of Artificial Sequence: Synthetic coding sequence
atggccgacaaggttctgaaagagaaaagaaagctgttcatccattctatgggcgagggcacgattaacggtttgctcgatgagcttctccagacccgagtgctgaaccaggaggaaatggaaaaggtgaagagggaaaacgccactgttatggacaagactcgcgcactgattgatagcgttattcccaaaggcgctcaagcgtgccagatttgcattacctatatttgtgaggaggactcatatttggcagaaaccctcggactttccgccgcactgcaggccgtccaggataatccagcaatgccaacctgtagtagtcccgaaggtcgcatcaaattgtgcttcttagaagatgctcaacgaatttggaagcagaaactacagcggtgccacgtgcagaacacaatcatcaagtggtcagagagatacacctccggaagcttcgagatgcagtggctcttcttgcggacaaactttattgagaggttttggcgtaacattctgctgctgccactccataagggctctctctaccccagaatcccgggtctcggcaaagagcttcaaaccgggactcacaagctgagttag

SEQ ID NO: 53437 - DNA, 294 bp, Artificial Sequence
  Description of Artificial Sequence: Synthetic coding sequence
atggcagacaaagtcttgaaggaaaagagaaaactgttcatacattcaatgggagaggggacaattaatgggttgctcgatgagctgctgcagacacgcgttcttaaccaggaagaaatggagaaagttaaacgggaaaacgcaacagttatggacaagactagagctttgatagattccgtgatccccaaaggggcacaagcttgtcagatatgcatcacatatatctgcgaggaagattcctatctggccgaaacactcggtctgagcgctggacccatccccggaaactag

SEQ ID NO: 53438 - DNA, 273 bp, Artificial Sequence
  Description of Artificial Sequence: Synthetic coding sequence
atggcagaccagctcctcagaaaaaagcgacgaatcttcattcactcggtcggggctggtaccattaacgctctcttggattgcctactggaagacgaagtgatttcccaggaggatatgaacaaagtgcgggacgagaatgacaccgtgatggataaagccagagtcttgatagacttagtaaccggtaagggtcccaagtcctgttgtaagttcataaagcacctgtgtgaggaagacccacagctggcatctaaaatgggactccattag

SEQ ID NO: 53439 - DNA, 672 bp, Artificial Sequence
  Description of Artificial Sequence: Synthetic coding sequence
atggcactgagtgtaccgctactctacagcctggtgcgcgcaatcagtgaggcaggcgctcctcctggatcggccggtcctctgctcttgcaaccccagcgtcaccgggcagcgggatgttttctcgggacatgtctcgatctgctggactcattcacactggtggagttgatgttggagggacgggttcctttgcctgcccatctgaggtaccttctgatagcagtgtattttctaacactggcaagccctgttctctggctttacgagctcaacgctgctgccgctgccgcagcatcttgggggcaggctagcgggcctggttcatgctcgcgactgctccgcctgcttggcggatgtctggtggatgtgcccctactggccctgcggtgcctcctggttgtttcgtaccaacagcccctgagcattttcatgttgaagaatttgttttttttgggctgcaggggtctcgaggcacttgaagggtgttgggataggggaaaccgggcttctccctctcgcgcacggggaggatacggagcccctcctagtgcccctcccccaccgccacctcccccacagggaggtagccaattagggcactgtatcagtgagaacgaaggaggtgctcatggctatgtgaacacattagccgtggcgagccagaattag

SEQ ID NO: 53440 - DNA, 1737 bp, Artificial Sequence
  Description of Artificial Sequence: Synthetic coding sequence
atgaggccagcgctgggacaccccagatcagtaagcagcgccagtggttcctttccccctccacctgcagccgctcgcctgcagcccctttttctgcgtggagggagcttccggggtcgacgaggctcaggcgattcttccacctccacttcaacatcgcgtggcggaggcggagggaggagaggcggtggcggaggctccccttcttcgagtacgggagctgagcgagaagatgatgacgagtccctgagtgtgtcaaagcccctggtacctaacgccgctctcctcggcccacctgcccaggtcggggcaccagctgggcctgctcccgtggcattctcttcaagcgctgcaaccagttcttcaacttccacacctactagcagctgctccatgactgcagccgactttggcggaggcgctgcagctggagctgtggggggtcccggttctcggtcagcagggggagccggaggtacaggaactggctcaggcgcaagctgctgcccctgttgctgctgctgtgggtgccccgacagaccgggtcggagggggagaaggcggggatgcgctccctccccacgctgtcgttggggctaccaggcactgtccgtagttctgctgctagcccaagggggattgttggatctatacttgatcgctgtgaccgacctgtattggtgctcttggatcgctaccgacctggtcgttgtcgtcggctgggcgattttcttcgccaagaactcccgagggcgtcggggtggcgcagcctccggtgcccacaatcaccaccttcaccaccatcacgcagcaccgccactccacttgcctgcacccagcgctgctaccgcaggggcaaaagcacggggagctcggggaggcgcaggcggagccggaggaggcctgggtgccgcagccgctgcaggggagtttgccttcgcttacctggcatggctgatctacagcatcgctttcacaccaaaagttgttctgatactgggtacctccatcctggacctgattgaactacgggcaccatttggaaccactgggtttagacttaccatggccctctcagtgcccctgctgtactctctcgtcagggctattagtgaagctggcgcaccaccgggttccgctggtcccctgctgcttcagccccagagacaccgagccgctgggtgctttctaggcacctgcttggacctattggactccttcaccctcgtggaactgatgttggaagggagggtaccactacctgcccacctccggtatctgctgattgcggtatattttctgactctggcttctccagtcctttggctgtacgagctcaatgctgctgcagcagcagcagcctcctggggacaagccagtggcccaggctcctgcagtcggttattgcgtttgctaggagggtgccttgtagacgtgcctctcctcgctcttaggtgtttgctggtagtcagctaccagcagcctctgtccatctttatgctcaagaatctattcttcctcgggtgcaggggactggaggccttggaggggtgctgggaccgagggaatcgcgcaagtccctctagggccagaggcggatatggggctccgccatcagcaccccctcccccacctcctcctcctcaaggcggaagccaactcgggcattgcatttcggaaaacgaagggggtgcccatgggtatgtcaacacattggccgtagccagccagaactag

SEQ ID NO: 53441 - DNA, 2262 bp, Artificial Sequence
  Description of Artificial Sequence: Synthetic coding sequence
atggcagataagcgcaagttacagggggaaatcgatagatgcttaaagaaggttagtgaaggggtagaacagtttgaggatatctggcagaaactccataacgctgcgaacgctaaccagaaggagaagtacgaagccgacctgaagaaagagatcaaaaaactccaacgccttagggaccagatcaagacttgggtcgcgtccaacgagatcaaggacaagcggcagctcattgataaccgaaagctaattgaaacccagatggagcgctttaaggtggttgaacgggaaacaaagactaaggcttattcaaaggagggtctgggcttggcccagaaggtggatcccgctcagaaagaaaaagaggaagtaggtcagtggctgacaaacaccattgatactctgaatatgcaggtcgatcagtttgagtccgaggtcgaatccctgtccgtgcagacccggaagaagaagggagataaggataaacaagatcgcattgagggtcttaagcgacatatcgaaaagcatcgctatcacgttcgtatgctggagacgattctcagaatgctggacaatgatagcattctcgtggacgctatccgaaaaatcaaagacgacgtggagtattatgtggacagttctcaggaccctgatttcgaagagaatgagtttctgtacgatgacctggacctagaggacatcccccaggctttggtggctacctctccgccaagtcatagccacatggaagatgaaatcttcaatcagtcaagcagtactccaaccagcacaacgtccagcagcccaataccccctagcccagccaactgcactaccgagaattctgaagatgacaaaaagcgcggacgatccacagacagcgaggtctcccaaagccccgcaaaaaacggttccaagcccgtgcattcgaaccaacacccccagtctcctgcagtcccaccaacgtacccttctggcccacctcccgctgcctcagccttatccaccacgccagggaataacggtgtcccagccccagctgctccaccttcggctctggggcctaaggcctctcctgcacccagccacaactcaggaaccccggctccttacgcgcaggccgtcgcaccacctgccccatccgggccttctaccacccagcccaggccaccaagcgtgcagccgtccggtgggggaggaggcggatccgggggtggcggttccagtagctcatcgaattctagcgccggtggcggagctgggaagcagaacggcgcaactagttatagtagcgtcgttgctgattcgcctgcggaggtcgcactgtcctccagtgggggaaacaatgcatcttctcaggcattgggtcctccaagcggccctcataaccctccccctagcacatccaaggagcccagcgccgctgcgccaactggcgcaggcggtgtcgctcccggttctgggaataatagtggaggaccaagtttattggtccctctcccagtgaatccaccctcaagccccactccatctttctccgacgccaaggccgctggggcattgctcaatggccctcctcaattctctaccgccccagaaattaaggctcctgagccgctctcctccctgaaatctatggctgaacgcgctgctatttctagcggaatagaagacccagtccccacactccatctaaccgagcgagatattattctgtcaagtacatcagccccacccgctagtgctcaacccccactgcaactgagcgaggtgaatatccccctctctctgggtgtgtgtcctttaggccctgtgcccctgactaaggagcaactttatcaacaggctatggaagaagccgcttggcatcatatgccccaccctagcgattcagagcgtatccgacagtacctgccacgcaacccttgccccactccgccatatcaccatcagatgccccctccgcatagcgataccgttgagttctaccagcgcctatctacagagacgctctttttcatcttctactatctggaaggaacaaaggcccagtacctggcagctaaggccctcaagaagcagagctggcggtttcacaccaaatacatgatgtggttccagcgacacgaagagccgaagacaattactgatgagtttgagcaggggacttatatttattttgattacgagaagtggggccagagaaaaaaggagggatttacctttgaatatcgctatctggaggatcgggaccttcaatag

SEQ ID NO: 53442 - DNA, 2262 bp, Artificial Sequence
  Description of Artificial Sequence: Synthetic coding sequence
atggcagacaagaggaagttgcagggcgagattgatagatgcctcaagaaggtgagcgagggtgttgaacaattcgaggatatctggcaaaaattacataatgccgcaaatgctaatcagaaagagaaatacgaagccgacctcaagaaggaaatcaagaaattacagagactgagagatcagataaagacttgggtagcttcaaatgagatcaaggataagcgccaactgatagacaacaggaaactgattgaaacacagatggagagattcaaagtagtcgagagggagacaaagactaaagcatactccaaagagggtctcggcctagcccaaaaagtcgacccagctcagaaggagaaagaggaggtgggacagtggctcacaaataccatcgataccctgaatatgcaggtcgaccagtttgagagcgaggtggagtccctaagtgtgcaaactcgcaaaaagaaaggggataaagacaagcaagatagaatagagggcctgaaacgtcatattgagaaacatcgataccatgtacggatgctggagactatcctgcggatgctggataacgattcgattctcgtggatgcaatccggaagattaaagacgacgtggagtattacgtcgattctagtcaggaccctgatttcgaggagaacgagttcctgtacgatgatttagacttggaagatatcccacaggcacttgtcgctaccagccctccatcccattctcatatggaggatgagattttcaatcagagcagctcgacgcccaccagcactacgagctcgtcgcctattccaccatcacccgctaactgtacgactgagaactcggaagatgacaagaaaaggggtcggtctactgacagcgaggtctcacagagtccggcaaagaacggaagtaagcccgtgcatagtaatcagcatccacagagtcctgccgtgccgcctacctatccatcgggtcctcccccagctgcaagtgcactcagcacaacccctggtaacaacggcgtgcccgctcctgccgctcccccttcggctttggggcctaaagcaagtccagcaccctcacataattctgggactcccgcaccctatgcgcaagctgtcgctccaccggctccatcaggtcctagcacaacccagcctcgacctccaagcgtgcaaccttccggcggaggcggagggggaagtggcggtggtggatcctcttcctcgtcaaattcttcagccggaggtggcgctggaaaacaaaatggggcaacctcatactcctccgtggtggccgattctcccgcagaggtggccctgagctctagtgggggaaacaatgccagtagccaagccctagggcctccatccggaccacataaccctcctccgtctacgtcgaaggaaccatccgccgcagcaccaaccggtgccggaggtgtagcacccggatcagggaacaattcgggagggccttccctcttggtaccgttgcccgtaaatccacccagttctcccacccctagtttcagcgatgccaaggcggctggggctctgctgaacgggccaccacagttttccacagcacccgagataaaggcccctgaaccgctgtcctcattaaagagcatggctgagagagccgcaattagtagcggaattgaggaccctgtccctaccctgcacctcactgagcgagatataattctatctagcacttctgctcccccagcctccgctcaacccccacttcaactctcggaggtgaacatcccgctgagcctgggagtgtgtcccctgggacctgtgcccctaaccaaggagcagctgtaccagcaagccatggaggaggccgcttggcatcatatgccacatcccagtgacagtgagagaatacggcagtacctgcccaggaacccatgtcccactcccccataccaccaccagatgcctcctccacacagcgacacggtcgagttctatcaaaggctctctacagagactctcttcttcatcttttattacctcgaaggcacaaaagctcagtacttggccgcaaaagcgctgaaaaagcagtcctggcgcttccataccaagtacatgatgtggtttcagcgccacgaggagcctaagaccatcaccgatgagtttgagcagggaacctatatctacttcgattacgaaaagtggggacaaaggaagaaggagggtttcacatttgagtatagatatttggaggatcgtgatctgcaatag

SEQ ID NO: 53443 - DNA, 2262 bp, Artificial Sequence
  Description of Artificial Sequence: Synthetic coding sequence
atggctgataaacgcaagttgcagggagagattgacaggtgcctcaagaaggtgagcgagggggtcgagcaatttgaggacatatggcagaaactacataatgctgcgaatgcaaaccagaaagagaaatacgaggcggatctgaaaaaggagattaagaagctccagcgcctgagggaccagattaagacctgggttgcaagcaatgagattaaggataaacggcaactcatcgataaccgaaaactaattgaaacccaaatggagaggtttaaggtggttgaacgggagactaaaacaaaagcctactcaaaggagggcttaggcttagcccagaaagtcgacccagcgcagaaggagaaggaggaggtgggccagtggttaaccaatacaatagacacgttgaacatgcaggtggatcagtttgagtcggaagtggaatctctatcagttcaaacaagaaaaaagaagggtgacaaggacaagcaggatcgaatcgaaggtctgaaacggcacatcgaaaagcatcgctatcacgtccgcatgctagaaacaatcttgcgcatgcttgataacgactccatactggtggatgcgatcagaaaaatcaaagacgacgtggaatactacgtggattccagccaggatcccgactttgaagaaaatgaattcctttacgacgacctcgatctggaggacattcctcaggcactagtggctacttccccccctagccactcccacatggaagatgagatctttaaccagtcgagcagtaccccaaccagtacgacctcctcatcccctatcccaccgtccccggctaactgtacaacagagaatagtgaagatgacaaaaagagaggtcggtctactgatagtgaggtctcccagagcccagcgaagaacggctctaagccagtgcattctaatcagcacccccagtcccctgccgtgcctcctacctatccaagtgggcctcccccagcagctagcgccctttctaccaccccagggaacaatggggttccagctccggctgcgccaccatcagctctgggcccaaaggcttctcccgctccgtctcataattctgggactcccgctccctatgcccaagcggtggccccaccagcacccagcggccctagtacaactcaaccacgccctccctccgtacagccgagtggcggaggcggaggcggaagtggaggaggcggaagttcttcctcatccaatagttctgctggcggaggagcaggcaagcaaaacggcgctaccagctacagttctgtggtggccgacagccccgctgaggttgctttaagcagtagtgggggaaataacgcatcaagtcaggcgctcggaccgccttccggcccacacaacccaccaccctccacctccaaggagccctctgctgccgcaccaacaggtgccggaggcgtcgcaccaggttccggaaacaatagtggcggaccatccttgcttgtccctttaccggtcaaccctccaagttctccaacaccaagctttagcgacgcgaaagccgcaggtgcactccttaacgggcctccacagttttcgacagcgccagagattaaagctccagagcccctcagttctttgaaatctatggctgaacgggcagctatatcctccggcatcgaagatcccgtgcctacactccacctgacggagcgcgacattattctgtcctcaactagcgcgccaccagcttcggcccagcctcctttacagctctcagaggtcaatatcccgctgtcactaggggtatgcccactcggccctgtcccactgacaaaagagcagctgtatcagcaagctatggaggaggccgcttggcaccacatgccccacccgtcagatagcgagagaatcaggcagtacttgccccgaaacccctgtcctacacccccttatcaccaccagatgcctcctccccactccgacacagtggagttctatcaaagactttcaaccgagacattattcttcatattctactaccttgagggaaccaaggcacagtatctggctgccaaagccctgaaaaaacagagttggcgatttcatacaaagtatatgatgtggtttcagcggcacgaggaacctaagaccatcactgacgagtttgagcaagggacctatatctattttgactacgaaaagtggggccaacgcaaaaaggagggtttcaccttcgaatatcggtacctcgaggacagagatcttcaatag

SEQ ID NO: 53444 - DNA, 2262 bp, Artificial Sequence
  Description of Artificial Sequence: Synthetic coding sequence
atggccgacaagcgaaaactgcaaggcgaaatagatagatgcctgaaaaaggtgtccgaaggggtagaacagttcgaggacatctggcagaaactccataacgccgctaatgctaatcagaaggagaagtacgaagccgatcttaagaaagaaataaaaaaattgcaacgactcagagaccagattaaaacttgggtcgcatccaacgagattaaggacaaacggcaactgatcgataacaggaaactaatcgagacacagatggagagattcaaagtggtcgagcgggaaaccaagactaaggcctacagcaaggaagggctaggcctcgcacagaaggtggaccccgctcagaaggaaaaggaggaagttgggcagtggctgacaaacactatcgatactcttaatatgcaggtagatcagttcgaatccgaagtcgagtcgctgtccgtccaaacacgcaaaaagaagggggacaaggacaagcaggatagaatcgagggactaaaaagacacattgaaaagcaccgataccatgttaggatgctggagacaattctgaggatgctggataacgactcaattctggtggatgcaattcgcaagataaaagatgatgtagaatattatgtcgacagtagccaggaccccgactttgaggagaatgaattcctgtatgacgatttagatctggaggacattccccaggctctcgtggccacctcgccaccaagccatagccacatggaagatgaaatctttaaccagagttcctctaccccaacctcaactacatcatcctctcctatacctccttcacccgctaattgcacaacagagaatagcgaggatgacaaaaaaagagggagaagcacggattcagaagtcagccagtcgccagcgaagaacggaagcaaacccgttcattcaaaccagcacccccagagtccagctgttccgcctacgtacccctctggaccaccccctgcagcatctgccctgagcaccacccccggtaataacggcgtgcctgcccctgcggcaccaccaagtgctctcggcccaaaggcctccccagcaccctcccacaatagcgggaccccagctccctacgcccaggccgtggcccctcccgctccgagtggacctagcactacccagcctaggccgcctagtgtgcagccatccggaggtgggggagggggatccggcggtgggggatctagctcctcctccaatagttccgcaggcggaggcgctggaaagcagaacggagccacttcgtacagtagtgtggttgcagacagcccagccgaagtggccctgtcatccagcggaggtaacaatgctagtagccaagcgctcggacctccctccgggcctcacaaccctcctccatcgacaagtaaggaaccttctgccgctgcaccaacaggcgctggaggggtcgcccctgggagcggtaacaacagcggcggaccttctctgctagtgccactgccagtgaatccaccaagctcccccactccatccttctctgacgcgaaagccgcaggagcactactgaacgggccaccacaattcagtaccgccccagagatcaaggccccagaacctctgtcatctctgaagagcatggctgagagggccgcaatttcctcggggatagaggaccctgtgcccaccctccacctgaccgagcgggatatcatcctttctagcacttccgccccacctgctagcgcccagccacccttgcaactctcagaggttaacattcccctttcgctgggagtgtgcccgctcgggcctgtccccctgaccaaggaacagctgtatcagcaggctatggaggaggcagcatggcaccatatgccccatccttcggactctgaaaggatccggcaatacctccctaggaatccttgccccacccccccatatcaccaccagatgccacctccccatagcgatactgtggaattttaccagcggttatcaaccgagactctattcttcatcttttattatttagagggcaccaaagcgcagtatctggcagcgaaggcgctcaagaaacagtcctggaggtttcatactaagtatatgatgtggttccagaggcacgaggaacctaagacaataacggatgaatttgagcagggcacatatatctatttcgactatgaaaaatggggccagcgaaaaaaggaaggattcacgtttgagtataggtacttagaagacagggacctgcaatag

SEQ ID NO: 53445 - DNA, 2262 bp, Artificial Sequence
  Description of Artificial Sequence: Synthetic coding sequence
atggctgacaagcggaagctgcagggagaaatcgaccgctgtctcaagaaagtttcagagggcgtcgaacaattcgaggatatctggcagaaactacataacgcggctaacgccaaccaaaaggagaagtacgaggccgatttaaagaaggagatcaagaagctacaaaggctgagagatcaaattaagacgtgggtggcctccaacgaaatcaaggacaaacgacaactgatcgataaccgcaagctgatagaaacacagatggagcgctttaaggttgtggaacgagagaccaagaccaaggcttatagcaaagaagggttaggcttggcacagaaggttgatcccgcacagaaagagaaggaggaagtgggccagtggctcacaaacaccattgataccttgaatatgcaagtggaccagttcgagtccgaagtggaatccctctctgtacaaacacgcaaaaaaaagggagataaggataaacaggatcgtattgaaggactgaagcggcacatcgagaagcaccgataccatgtccgaatgcttgaaacaattctgcgaatgctcgacaacgattccattctggtcgacgccataaggaagatcaaagatgatgtcgagtattatgtggatagctcccaggatcctgatttcgaggaaaacgagtttctgtatgacgatctggacctggaggacatcccacaggcccttgttgccacaagcccaccaagtcatagccacatggaagacgagatctttaaccagagctcttctacaccgacctccacaacgtcctcctcccccatacccccatctccagcaaactgtaccacagaaaatagcgaggacgacaaaaaacgtgggagaagcaccgactcggaagtctcccaaagtccagccaaaaacgggtctaagcccgttcacagcaaccaacaccctcagtctcccgcagtgcccccaacttaccccagtgggccacccccagccgctagtgccctgtcaactacccctgggaataatggcgttccagcgcctgccgcacccccatcagcgttgggtcctaaagctagtccagcgccatcacacaactcaggaacccccgctccttacgctcaagcggtcgctcccccagcaccgagtggaccatcaaccacacagccacgcccaccttccgtgcagccatctgggggaggcggtggaggcagtgggggtggcggaagctcttcttctagcaattcatccgccggaggtggcgcaggtaaacagaatggcgctacaagctactccagcgttgtggctgactcgcctgccgaggtggctttaagcagctctggcggaaacaacgcttctagtcaggcactcgggccaccgtccggaccccataatccgccaccctcaacctccaaggagccgtcagccgctgccccaactggtgctggaggtgttgcccctgggtctggaaacaattccgggggtccctctctgctagtgcctctgccagtgaacccacctagctcacctacaccctccttcagtgatgcaaaggcggctggtgctctgctgaacggccctccacagttctccactgccccagagatcaaagccccagaacccctgtcatcactgaagtctatggccgagcgggctgcgatttcttcaggcatcgaggacccagtgcccactcttcacctgactgagcgcgatatcatactgagcagtactagcgccccaccagccagcgcccagcccccattgcagctcagtgaagtgaatattcccttaagccttggtgtgtgtcctctagggcctgtgcctctgacaaaagaacagctgtatcaacaggccatggaagaagccgcttggcaccatatgccccacccctccgatagcgaacgtatccgccagtatctaccaaggaatccttgtccgacgccaccttatcatcaccagatgccacccccacactctgatactgtcgaattttaccagcggctcagtactgagacactgttctttatcttctattacctggaaggaaccaaagctcagtacctcgcagccaaggcactcaaaaaacagagctggaggtttcacacaaaatacatgatgtggtttcagcgccacgaggagcccaagactatcaccgacgaattcgagcagggaacatatatttatttcgactatgagaagtggggacagaggaagaaagagggattcacattcgaatacaggtacttagaagatagggacttacagtag

SEQ ID NO: 53446 - DNA, 2262 bp, Artificial Sequence
  Description of Artificial Sequence: Synthetic coding sequence
atggctgataagcgaaagctccagggagaaatcgaccgatgcttgaagaaagttagcgagggagtggagcagttcgaggacatctggcagaaactccacaatgcagctaacgcaaatcagaaggagaagtatgaagccgacttgaagaaggagatcaaaaagctgcagcgcctacgagaccagattaagacttgggtcgctagcaacgagataaaagacaaacggcagttgatagacaatagaaagcttatcgagacacagatggaacggttcaaagtggtggagcgagagactaaaacaaaggcttattccaaggagggcctggggctcgcccagaaagttgatccagcacaaaaagagaaggaggaggttgggcagtggctaaccaacactatcgacaccctgaacatgcaggtggatcagttcgagagcgaagttgaatcactatctgttcagactaggaagaaaaagggggacaaagacaaacaggacaggatcgagggcctgaaacgccatattgagaagcataggtatcacgtccgtatgcttgaaaccattctgcgaatgctcgataacgacagtatcctggtggacgcaatccgaaagatcaaagacgatgtggagtattatgtggactcctcgcaggaccctgattttgaggagaacgagtttttgtacgacgacctcgatctcgaggatatcccccaggcactggtcgcaacctcacctccttctcacagccacatggaggacgagatcttcaaccaaagttcttcaacccctactagtaccacttcaagcagcccaattcccccttctcccgcaaattgtactacagagaacagtgaagatgacaaaaaaaggggtcgctccacagacagcgaggtatcacagtctcctgcgaaaaacggaagtaagcccgttcacagcaaccagcatccccaatccccagcagtgccacctacctacccctccggcccacctccagccgcttctgccttgtcgacgacgcctggcaataacggcgtaccagcacccgctgctcctccatctgcgctcgggccaaaagcttcacccgcaccttcgcacaactcgggcacaccagccccatatgcgcaggctgtcgctccgcctgccccatcaggccctagtacaactcaacccaggccgccatctgtgcagccttccgggggaggaggcggaggctcaggaggcggtggttccagttcgtcaagcaacagctcggccggaggcggtgcaggtaagcaaaacggggcaacgagctacagctccgtcgtagctgacagcccggctgaggtcgcattgtcaagctccggtggaaacaacgcgagcagccaggcgttaggaccaccctcagggcctcacaacccacccccatctacaagcaaagagccgtccgctgccgctccaaccggcgctgggggagtggcccctggttctgggaacaactctggcggaccctccctccttgttccgcttcccgttaacccgccttccagcccaacaccaagcttttccgatgccaaagccgcaggagccctgctgaacggtccccctcagttttccaccgccccagaaatcaaagctcccgaaccgctatcctctcttaaatccatggccgagcgagctgccattagtagtgggatagaggacccagtgccgacactccatctgactgagagggacataatcctctcatctacctcagcccctcccgcaagcgcccagccacctcttcagctgtccgaggtcaatattcctctgtcattgggcgtatgccctttgggccctgtgccactcaccaaggaacaactgtatcagcaagcaatggaagaggcagcctggcatcatatgcctcaccccagcgatagcgaaaggatccgacagtacctgcctcggaacccttgtcccacacccccttatcaccaccagatgcccccaccacatagtgacacggtcgaattctatcagagactgtcaacagaaactttatttttcatattttactacttagaggggacaaaggcccagtacctggccgctaaagcccttaagaagcaatcctggcgcttccacactaagtacatgatgtggtttcagcggcacgaggagccgaagaccattaccgacgagtttgagcaggggacgtatatctactttgactacgagaagtggggacagcggaaaaaagaagggtttaccttcgagtacagatacctcgaggaccgcgacttgcagtag

SEQ ID NO: 53447 - DNA, 2262 bp, Artificial Sequence
  Description of Artificial Sequence: Synthetic coding sequence
atggctgataagagaaagttgcagggtgaaatcgataggtgtttgaagaaggtctctgagggggtcgagcaattcgaagacatttggcaaaagttgcacaatgcggctaacgccaatcaaaaggagaaatacgaagctgacctgaaaaaagagattaaaaagcttcaaagattacgtgaccaaatcaaaacgtgggtcgcctcaaacgagatcaaggacaagcggcaactgattgataatagaaaactaatagagacccagatggaacgcttcaaggttgttgagcgggaaactaaaacgaaagcatactccaaggagggcctgggtctggctcagaaggtggatcccgcacagaaggagaaagaggaggtgggacagtggctaacaaacactatagatacgctgaacatgcaggtggatcaattcgaatctgaagtcgagagcctgtcggtgcagacaagaaaaaagaagggcgacaaggacaagcaggacagaatagagggcttgaagcgacacattgagaagcacagataccacgttaggatgttggagaccattttgaggatgctggacaatgacagcattctagtcgacgctatcaggaaaatcaaggatgatgtagagtactacgtagattctagtcaggatcccgacttcgaagagaacgagtttctgtacgacgatctcgacttggaagacattccccaagcgctagtcgctactagccctcccagccacagccacatggaggatgagatcttcaaccaaagttccagtacacctacgtccaccactagctcaagccccattcccccttcgccagccaactgtactacggagaactccgaagatgataaaaaaagagggcgttccaccgactccgaggtgagccagtccccggctaagaacgggtctaagcccgtccactcaaaccagcaccctcaatctcccgcagtgcctcccacatatcccagcgggccacccccagccgcttctgctctaagcacgacccccggtaataacggggttccagcacctgctgctcccccaagtgctctgggtcccaaggcaagtcccgctccaagccacaatagtggcacccccgctccctatgcccaggcagtcgcaccccctgccccatccggcccatcgactacccagcctcgcccaccctcagttcagccctcaggaggaggtggaggtggtagcggcggaggaggaagtagcagctcatctaattcttctgccggaggcggtgcagggaagcagaatggagcaacttcctactccagcgtggtagctgatagtcccgcagaagtggccttgtcatccagcggcggaaacaatgcaagttctcaggctctcggacctccctctgggccacacaaccctcccccatccaccagcaaggaaccatctgcagccgcaccaacaggtgctggaggcgtagcgccagggtcaggaaataatagcggcggacccagcctcctagtaccactgccggttaaccctccttcgtctccaacaccttcgtttagcgacgctaaagcagctggggctctactcaacggccctccacagttttccacagccccagagattaaagcgcctgagccactgtcatcgctgaagagcatggctgagagagccgctatctcatccggcatcgaagacccggtacctacattacacctgactgaacgggatatcatcctctcctctacgagcgcacctcccgcatccgcacagcccccacttcagctgtcagaagttaacatccccctctccttaggcgtatgtccgttgggccctgtgcccttgacgaaagaacagctctatcagcaggctatggaagaggctgcatggcaccatatgccccacccatccgactccgagaggatacgccagtacttgcctagaaacccgtgtcccacacccccttatcaccatcagatgccaccccctcacagtgatacggtcgagttttatcaaaggttaagcactgagacactgttcttcatcttctactatttagaagggactaaggcgcaatacctagccgctaaggccttgaaaaagcagtcttggaggtttcataccaagtatatgatgtggttccaacgtcacgaggagcccaaaaccattacggacgagtttgaacaggggacatacatctattttgactatgagaagtggggccaaaggaaaaaagaaggattcactttcgagtacagatatctggaggaccgggacctgcagtag

SEQ ID NO: 53448 - DNA, 810 bp, Artificial Sequence
  Description of Artificial Sequence: Synthetic coding sequence
atggagcgcctggtgattcggatgcccttttcacacctgtcgacctattccctagtgtgggtgatggctgcggtcgtgctttgcacagcacaggttcaggtggtaacccaggatgagcgagagcagctttacacgcctgccagccttaagtgctccctgcagaacgcccaggaagcgttaatagtaacatggcagaaaaagaaggctgtctccccagagaatatggtcaccttttccgaaaatcatggtgtggtgatccagcctgcatataaggacaaaataaatatcactcagttgggtctgcagaattccacaattactttctggaatattacgttggaagacgaaggatgctatatgtgcttgttcaacaccttcgggtttgggaagattagcgggactgcttgtctgaccgtctatgttcaaccaatcgtgtccttgcactacaagtttagcgaggatcacttgaacatcacgtgcagcgcgactgcacggcctgctcccatggttttctggaaagtgccccgatccggcatagaaaattccaccgttaccctgagtcacccaaacggaacaacctccgtgacctcgatcctgcacataaaggacccaaagaaccaggtgggcaaggaagtcatctgtcaggtgttgcatctggggactgtgactgactttaagcaaaccgttaataaggggtactggttcagcgtcccccttctgttgtctatcgtctccttggttatattgctagtcctgatcagcatcttactttattggaaaaggcatcggaaccaagatagagaaccgtag

SEQ ID NO: 53449 - DNA, 885 bp, Artificial Sequence
  Description of Artificial Sequence: Synthetic coding sequence
atggagcgcttaaccctgacaagaactataggtggacctctgttaacggctactttgctgggcaagacaactattaacgattaccaagtgatcaggatgcccttttctcatctgtccacttatagcctagtctgggttatggcagctgttgtgctttgcacggcccaggtgcaagttgtgacacaggacgagagagagcaactgtacactccagcttcactgaaatgttcgctccagaacgcccaggaagccctgatagtcacttggcagaagaagaaggctgtaagccctgaaaacatggtgacattctctgaaaaccacggcgtggtcatacagccggcttacaaagataaaattaacatcacccagcttgggctgcagaattccactattaccttttggaatataacgctggaggacgaggggtgttacatgtgtttattcaatacgttcggctttgggaagatatccgggaccgcttgcttaacagtctatgtgcagccaattgtgtcacttcactacaaattcagcgaggatcacctgaatatcacctgcagtgctacagcgaggcctgcaccaatggtcttttggaaggtgcctagaagtggaatcgagaacagtacggtcactctcagccacccaaacgggacgacttcagtcacttcaatccttcatataaaggatcccaaaaaccaggttggaaaggaagtgatatgtcaggtcctgcatctgggaaccgtgacggatttcaagcagacagtgaataaaggatattggttctcagtgcccctgcttctatccatcgtctcgctggtgatcctgctcgtgctgataagcatcttgctctactggaaacgccaccggaatcaagatcgagagccttag

SEQ ID NO: 53450 - DNA, 1377 bp, Artificial Sequence
  Description of Artificial Sequence: Synthetic coding sequence
atgaatcgcggtgtcccattccggcacctccttctggttctgcagcttgccctcctgcccgcagctacacaggggaaaaaagtcgtgttggggaaaaagggagataccgtggagttaacctgcaccgcctcccagaaaaaaagcatccaattccattggaagaattctaaccagatcaagatccttgggaatcagggcagtttcttgactaagggcccttcgaagcttaatgatagggctgattctagaaggtccctatgggaccaaggcaacttccctcttattattaagaacctcaaaatagaggattcagacacatatatctgtgaagtagaagatcagaaggaggaggtccagttgctggtcttcggccttaccgcaaatagtgacacccacctgctgcagggccaatctctgacgttaaccctggagagtccgcctggctcttccccctccgtacagtgtcggagcccacgcggtaaaaatattcagggtggtaaaacattgtccgtctcccagttagaactgcaggattcaggcacatggacctgcaccgtgttgcagaaccagaagaaagtggagtttaaaatcgatatcgttgtactggccttccagaaagcctcctccattgtgtataaaaaggaaggggagcaagtggaattcagctttcctctggcatttacggttgaaaagctgaccgggagcggagagctgtggtggcaggccgaaagagcatctagttccaagtcgtggattaccttcgacttgaaaaacaaggaagttagcgtaaaacgagtgacacaggatcctaaactgcagatgggcaagaaactgccactacatctcactctgcctcaggccctgccccagtacgcaggctccggtaacctgaccctggctttagaggccaagacaggtaagctccaccaggaggtgaatctcgtggttatgagggccacacaactgcagaagaacctcacctgcgaggtctggggtccaacctcccccaagctcatgctttcccttaaactggagaacaaagaggcaaaagttagtaagcgtgagaaggcagtgtgggttctcaaccccgaggctggtatgtggcaatgtctcctgagcgatagcggtcaggttctcctggagagcaatattaaagtgttgcctacctggagtaccccagtgcagcccatggccctaattgtattgggcggtgtggcagggttgttactctttataggactgggcattttcttctgcgtgagatgtcgccaccggagacggcaggctgagaggatgagccagataaagcggcttcttagcgagaaaaaaacctgccagtgtccgcataggtttcagaaaacgtgtagtccgatctag

SEQ ID NO: 53451 - DNA, 789 bp, Artificial Sequence
  Description of Artificial Sequence: Synthetic coding sequence
atggtcgcttggaggtccgctttccttgtttgcctcgcatttagtctcgcgacgctggtacaaagaggcagcggggattttgatgattttaatctggaggatgccgtgaaagagacatctagcgttaagcagccctgggaccatactacaacaacaaccacaaaccgcccaggcaccactagggcccctgcaaaaccacctggatcaggtttagacctcgccgatgctctggatgaccaggacgatggccgtcgcaaacccggaattggcggacgggagaggtggaatcatgttaccaccaccacgaagcgtccagtgaccacaagagcacccgctaacaccctgggaaacgactttgatctggccgacgcattggacgatcgcaatgacagagacgacggcaggagaaaacccattgctggagggggtggtttttccgacaaagacctcgaggacatcgtaggtggaggagagtataagccagacaagggtaagggcgatggtcgctatgggagtaatgacgacccaggtagtgggatggtggcagagccaggcaccatcgctggcgtcgcatccgccctggccatggccctaatcggcgctgtctcttcctacatatcgtaccagcagaagaagttttgcttcagtattcaacagggacttaatgcggactatgttaaaggtgaaaatctggaggccgttgtgtgtgaagagccccaggtcaagtattctactctgcacacccagagtgccgagccaccccctccacccgagcccgcaaggatttag

SEQ ID NO: 53452 - DNA, 1437 bp, Artificial Sequence
  Description of Artificial Sequence: Synthetic coding sequence
atggcagctgcagccgctggtggggcaccaggtcccgctccaggccctgctgggcctcccccacctgccgcaccaacatccgcagcccgtgcaccaccacaggcactgaggcgtcggggagacagccggaggcgccaagcagcattattctttctcaataatatcagcctggatggacgaccaccttctttaggcccaggaggcgagaagccgccaccgccacccgctgaggctcgggaaccgcctgctcctccgcctcccgaaccgccaactggccttccagctaggactcccgctccacagggccttctgagtccaacgcaagtgcccacaggtttgggcttggatggccagagacagcgaaagcgggtcaccagccaaagatgttccctcgagttcctggaggacgcagtcggatgtgcgcctgcgcagagaaccaagcatacttccggcagccctcgacataagggtctgaagaagacccacttcattaagaacatgcgccaatatgatacgagaaatagcaggatagtgctcatatgtgctaaacgtagtctgtgcgcagcattctcggttctcccctacggtgaaggtttaaggatcagcgacttacgggtggattcgcagaagcagcggcatccatcgggcggagtatcagtaagcagtgagatggtcttcgagctagagggggtggagcttggggcagatggcaaggtagtctcctacgccaaatttctgtaccccaccaatgcattagtgactcacaagtctgacagtcatgggctgcttcctacaccacgaccttcagttcctagaactctgcctggctcccgtcacaaacccgctccaacaaaatcagcacccgcttctacggagctaggttcggatgtgggagacactttagagtacaacccaaatcttttggacgacccacagtggccctgcggaaaacacaaacgagtgttaatcttcgcaagctatatgacaaccgtgattgagtatgtgaagccttcagacttgaagaaagatatgaatgaaacgttcagggagaaattcccccacgtgaagcttacactaagcaaaataaggagcctgaaaagagaaatgaggtctctgagtgaagagtgttctctggaaccagtcacagtcgcaatggcatatgtctattttgagaagctggttctgcaggggaagctcagcaagcagaaccgtaaactttgcgcaggagcttgcgttctgctggccgcaaaaatttcctcagatctgagaaaaagcggggtcacccagcttatcgataagctggaagagaggttccggttcaatcgcagggatctgatcggttttgagttcaccgtgctggtggcattagagttggcgctctacttgccagagaatcaggtgctcccacactacaggaggctgacgcaacaattctag

SEQ ID NO: 53453 - DNA, 801 bp, Artificial Sequence
  Description of Artificial Sequence: Synthetic coding sequence
gatagggcccatctttgccaagctgtccccgttcgtggcctcctgggtccggctctctggggcaggcctgcagatcaggttgtcagctacgctaaattcctttacccaaccaatgcactcgtcacacataagagcgacagtcatgggttactccccacccctaggcccagtgtgcccaggacacttccaggttccaggcacaagccagcaccgacgaagtctgcccctgcaagcactgaactgggtagcgatgtgggggacaccttggagtataatccaaatttgttggacgacccccagtggccctgtggtaaacataagcgcgtgttgatatttgccagctatatgacaactgtgatcgaatacgtgaagcctagcgaccttaagaaggatatgaacgaaacatttagagaaaaatttcctcacgttaagctgacactttccaagattcgctcccttaagagggaaatgcgttctttaagcgaggaatgcagcttggagccagttacggtggcgatggcatacgtttacttcgaaaagctcgtactgcaaggaaagctgtctaaacagaatcggaagctctgtgccggtgcatgtgtcttgctggcagccaagataagtagcgatcttcggaagtcaggggtgactcagctgatcgacaagctcgaggaacggtttcgcttcaataggcgggacctcatcgggttcgaatttactgtattggtggcactagagctggcgctgtatttgcctgagaatcaagtgctgccacactaccgaaggctaacccagcaattttag

SEQ ID NO: 53454 - DNA, 777 bp, Artificial Sequence
  Description of Artificial Sequence: Synthetic coding sequence
tgacatcaggaacagcaggaccgagcccacctgtgtcaagccgtgccagtgcgcggactgctaggtccagccctgtggggacgtccggcagatcaggtggtcagctacgctaaatttctgtatcctactaacgccctggtgactcacaagtcagattctcacggactactgcccacccccaggccgtccgttccacgcactctcccgggaagtcggcataagcccgcaccaaccaaatctgctccagcgtcaacggagctggggtctgatgtcggtgatactctggaatataacccaaacttgctcgatgaccctcagtggccttgtgggaagcacaaaagggtcttgatctttgctagctacatgacaaccgttattgagtatgtgaagcccagcgacctcaagaaggatatgaacgagacattccgcgagaagttcccgcacgtgaaattaaccctgtccaaaattaggagcctaaagcgagagatgcggagtctttctgaggaatgctccctcgaaccagtgacggttgctatggcttacgtctacttcgagaagctggtgttacagggcaaactcagcaaacagaaccggaaactttgtgcaggagcctgtgttctgctcgctgccaagatcagtagcgatctgcgtaagtctggggttactcagctcatcgataagttagaagaacggtttcggttcaaccggcgtgacttgataggttttgagtttacggtcttagtggcgctggaactggccttgtacttgcccgagtag

SEQ ID NO: 53455 - DNA, 258 bp, Artificial Sequence
  Description of Artificial Sequence: Synthetic coding sequence
atggtggggggagaggccgctgccgcagtggaggaacttgtgagcggcgtgcgccaggcggctgattttgccgagcagttccgcagttatagtgaatccgaaaagcagtggaaagctcgcatggagttcatactgcggcacctacccgactacagggacccgcctgatggctccggccgactagatcagctgctgagtctttctatggtgtgggctaatcatttgttcttaggatgcagccctaggggtcccaaatag

SEQ ID NO: 53456 - DNA, 351 bp, Artificial Sequence
  Description of Artificial Sequence: Synthetic coding sequence
atggtcggcggagaggcagcagcggcagtggaggagctcgtctccggcgtccggcaggctgccgattttgctgagcaattccgatcatattcagaatcagaaaagcagtggaaggctagaatggagttcatcttgaggcatctgcctgactaccgggatccacctgacggcagcgggagactggaccaactgctatctctgtccatggtttgggcaaaccacctgttccttggatgttcttacaataaggatctactggataaggtcatggaaatggccgacggaatcgaggtagaggacttgccacagtttactactaggagtgagctcatgaagaaacaccaatcctag

SEQ ID NO: 53457 - DNA, 372 bp, Artificial Sequence
  Description of Artificial Sequence: Synthetic coding sequence
atgtcaagcggaggatcaccgggatgcctcagactggcggagggatgcccgaatcatcgggcatgggtgaggtggaataggcgccagccccattcggcctttttgatcgcttcccacctctttctcagtgtcctggtgtggttcaacagcttccagggcttggaattagaaagtgagaaccccagacacctcttatggaatgtgtgcctggtagtgctggtgtgtccaagtagctccctcgcttgtcgctttcaggtgtatcaaagaaccttctgctctgtggaatctcacagaacgaagagaaagatacttcagttatttgctaacattctgccctatctgtataagcagccctatacaaaaaagcactag

SEQ ID NO: 53458 - DNA, 396 bp, Artificial Sequence
  Description of Artificial Sequence: Synthetic coding sequence
atgggacccgctgcccgtcctcgtagatttgtgcccggaccccctggtgatgccacgacgttggagttatataccaaagtctgtctacctaggaagcgctggaggctgccactcggacggctggcgcgatctcctcgcctgcaggcccctcgcgtgcgcgctggttctagccactcgtgcaaggaagctgcgaaatacgtattccaaacctttcatgggagtaagcttagcgctagcattaagagatccggtgtgcgaggcaaatctattctggggatttcaatgcagatgaatggaccaggattccagctcagatccgggttccctcctctgagggccgagcttgcgccaagccatgcccgacctgaagcgagcggtcggtgtcctggtggctag

SEQ ID NO: 53459 - DNA, 438 bp, Artificial Sequence
  Description of Artificial Sequence: Synthetic coding sequence
atggggttgaagtctcacgtgctcccggctccaaactctcaaggacagggatcattgtgcatcttcgtatacgtgactagctatatggattatatacagctgcagggtaaagagaatttggattgttctgggctgaacaaacagaagatcgtctttccgcatagtatggattctggtgacggatggctcatggtcttggtacagcaactccatgaggggcgagggcacgtcctcgacccatttgccctaatcagtgtactagtgacttcatggtctcaggatggctgctgcatccccaagaaccatgtttgtgttcagggcagaaggggaggtggaaggggtcgtgcgaagctcgccggtcccgtcaccttctaccaaaaagtcaagccacgacagaagtctgtgagctgttctttaccactgcacatcttcacctag

SEQ ID NO: 53460 - DNA, 387 bp, Artificial Sequence
  Description of Artificial Sequence: Synthetic coding sequence
atgttacaggaagcactcaccgaggcaagcttcctgaaactggtcatcttcttcttctttttctcttttttgcgccgatcactcgcattgtccccccgactcgaatgttccggagccatcagtgcccactgcaatctaagactgttgggtagctcatattctctggcgagtgcctctcgagtcagtggtataacaggttcaaggcaccatgcacaactgttctttgtgtttctcgtagaaacaggttttcaccacattgggcaggctggtctggagctgctgaccagtggtgaccctccaactagtgcatcacagtctgtcggcataaccggagtttcccatagggcccagcagatgcgcatcatcttcattttcattaaactgtag

SEQ ID NO: 53461 - DNA, 597 bp, Artificial Sequence
  Description of Artificial Sequence: Synthetic coding sequence
atgaccctcaaagaacatgccgcattcaaacacttgttcaataaggcccatcttgcgcctccactgatccacttaaccctgagcggtcacagtacctgttttcgcgaacatcgcgtaggcggtaaagtgatcgaccagcagcaccccaaggctgaggagagttttctcgtgcagaacaagatggaaagccctatgtctacctttttttatagtcgtcacggtaacaatctgatcagcctgtccttcccacacatctcccccttcagtatcccgcagaacaggcactgtcatcatggcctgttctccatgtcatgctgggtgaggctccccgacggggtcgccgcaggtcagcgcggaagtagtctccctagacgcggagggagggccgaggcacccccaacgtcacggacaggacgtaggccagggggaggtgctccccacttccctgaccgggtcgccgcaggccgaaggggttccagtcttctgcgacgtggcggatgctgggcagagggcctgttgaccagtcaaaccggcagacctggacgcgatgcccctcaccttcccgatggcgtggctgccggacaacggtgtagttag

SEQ ID NO: 53462 - DNA, 450 bp, Artificial Sequence
  Description of Artificial Sequence: Synthetic coding sequence
atgcaggagattcatgagaaggtcctgaatgaggtagtcggggcaatgatgtatcatacctttagccttacgcgagaagatctcgagaactttaaggctttgcgtgtcatcgtccaggtgggatctggttatgacaatgttgctattaaggctgccggagaactggaaatagctgtctgctctatcccatctgcagctgtcgaagagacagccgattccacaaccggacatatattaaatctatactggggtaaccgcagcctgtatcaggctctacgggagggtaccagagtacagtcagtggaacagatcggggaagtcgcttccgtcaaggcaagaattagaggagaaatcttggggctgatcgggtttggacggacacagcaggaagtggccgtgagggctaaggcctttgcgggttgggatagagcggtccctggatgcgcatag

SEQ ID NO: 53463 - DNA, 381 bp, Artificial Sequence
  Description of Artificial Sequence: Synthetic coding sequence
atgggactacccgctcctagcctgcacgctacgagcacccttcgtcctgatcagttctctccacacaccaatcctagcctttctctgccctgtctcaagagctttcccgtgtccctgtggccctggggcagagcttctctgctttgccacttgtcccgtctgtttgtgtgtcatcgccctctcacacccaccagtcaagcccctaatatgttttcctgcgtctcatcctccctaacactggcggcaagcagtgcttggccggcttcacacttgcccattagtcacagcccctttctgcccccacatctcctacgctcccagctatcagttacctctagtcgggaacctcggctgtctttgcctctgcaactcggtcagtag

SEQ ID NO: 53464 - DNA, 1548 bp, Artificial Sequence
  Description of Artificial Sequence: Synthetic coding sequence
atggaatggaagctcgaaaggacggctcctaggcgtgtgcggaccgaagaagagatgctgtgggaatccatcatgagggttctgagtaaagacctgaaacaaaagagatcacaggactctgcaaacgtgctggattccgtcaatgctacatattcagatttcaagtccaactttgcaaagagactgtccgccgaagttcctgtggcatcctctccgatcactacccgatggcaacagtctcagacccgggctctgtccagcgatagcttcggagaggaacagagcacgacctatttgcccgaagcgtccggaagtgtgctgaaaaccccacctgaaaaagagaccctcacactcggaagccgcaaagaacaacttaagaccccatctaaagggatctccgagacgtcaaacagcgccctccatttctgcaaggcacctcatgcaatggaccgtgattggaaagaatctgtggcctcaaagggccaaaagtgcctaaaacagctgtttgtgactcagaacgttgtccagcaggctaacggcaagatgcaactgtgtgaacagagcgagtgtgtctggaaagggtgtaaagacggcgtgcgggacgagagttttcacctaaaatcctcaggggacattaacgatagtatactgcagcccgaggtcaaaattcacattaccgggctgagaaatgactactatcttaacatcttagactggagtttccagaacttagtggctattgcgcttggctccgccgtctacatttggaatggtgagaaccataatggtattgaaaacatagacctttcactcacatgtaactatatctcatctgtttcctggattaaggagggtacatgcctggcagtcgggacaagcgaaggcgaagtccagctgtgggacgtcgtgactaaaaagagactacgtaacatgctcggtcatctgtcagttgttggagctctaagttggaaccacttcatactcagttctggctccagattgggtagggtctaccaccatgatgtaagagtggcacagcatcatgtcgggacccttagacacaaacaggccgtgtgcgcgctcaaatggagtcctgacgggagactgctgtccagcggttgttcagacggcttactaactatctggccacatgaccccggagcgtcggcacagggacagcccctcaaagtgataactcagtccactgcggtgaaagccatggactggtgtccttggcagagcggcgttctggctatcgggggagggatgaaagatggcaggcttcatatcctggacattaacgctggcaaatccatccagaccccttccactaactcacaaatatgtagtctaatatggctgcctaagacgaaggagattgctactggccagggaacacccaaaaacgatgtgacagtttggacctgtcctaccgtttccaggtccggacaccggggaagagtcctgcacctgtccctctctccagatcagactagagtattcagcgccgctgcagacgggacagcgtcagtgtggaattgttactag

SEQ ID NO: 53465 - DNA, 1434 bp, Artificial Sequence
  Description of Artificial Sequence: Synthetic coding sequence
atggaatggaaattggagaggactgcccctcgcagggtgcggaccgaggaggagatgctttgggagtcaattatgagggtcctaagtaaagacctgaagcagaaacggtctcaggattcggctaatgtgctggattcagtaaacgccacgtactctgatttcaaaagtaactttgccaaacggctctcagctgaagtccccgtggcatcctcacccatcactacccggtggcagcagtcccagactcgcgcactgtcgagtgatagtttcggtgaagagcaatcaacaacgtacctgcccgaggcctcaggctccgtgctgaagactcctcctgaaaaggagacactgacccttggatcccgtaaggaacagctgaagactccaagcaaaggcatctccgaaacctccaactctgccctgcatttctgtaaggcaccacatgccatggaccgtgactggaaggagtccgtggcctcgaaaggacagaaatgcctgaagcagctgtttgttacgcaaaacgtggtgcagcaggccaacgggaaaatgcagctatgcgaacaaagcgagtgtgtgtggaagggctgtaaagacggggtgagagatgagtctttccatttgaagagctctggcgacatcaatgacagtatcctgcaacccgaggtaaaaattcacatcacagggctgaggaacgattattacttaaacatcctagattggagctttcagaatcttgttgctatagcactgggttccgctgtatacatatggaacggggagaaccataatgggattgaaaacattgatctgtccttgacatgtaactatatttctagcgtttcctggatcaaagaaggaacttgtctggctgttggcacttccgaaggcgaagtgcaactgtgggatgtggtaacaaaaaaacgtctccgcaacatgctgggccatctgtcagtagtgggggcactcagctggaatcactttattctctccagcggctctcggctcggcagggtctaccatcacgacgtacgggttgctcagcatcacgttggaaccctccggcataaacaggcagtctgcgctcttaaatggagtcccgacggaagactgttgagctcgggatgcagcgatggactgctgaccatctggccccacgatcctggcgcttccgctcagggccaacctctcaaagtcattacacagtctactgccgtgaagatctgctccctaatctggctgcccaagacgaaggaaattgccacggggcagggtaccccaaaaaatgatgtaaccgtgtggacttgtccgaccgttagccgctccggcggattctttggccacagaggtcgggtactgcatctgtccctgtcccccgaccagaccagagtgttcagcgctgccgctgacggcacagcctccgtgtggaattgctactag

SEQ ID NO: 53466 - DNA, 579 bp, Artificial Sequence
  Description of Artificial Sequence: Synthetic coding sequence
atggagtggaaactggagaggactgcccctagaagggtgcgtacggaagaagaaatgctgtgggtgttggattccgtgaacgctacctattccgactttaagtcaaattttgctaaaagattgagcgctgaagtacctgtggcgagctcccctattactaccaggtggcaacagtcccagacgcgtgcactttcttctgacagctttggggaggaacagagcacgacatatctgcccgaagccagtggaagcgtccttaaaactcctcccgagaaagagacgctgactctgggaagcaggaaggaacagctgaagacgcccagcaaagggatctctgagacgtccaacagtgccctgcacttctgcaaagcgccacacgcaatggatagggactggaaagagtccgtagcgtccaagggacagaaatgcctaaagcaactgtttgtaacccagaatgtagtgcagcaagccaatggcaagatgcagctgtgcgagcagtccgagtgcgtttggaaagaccacttcagcgggagcatgaaaaagcgctttgaacaggaagacgtaggaggtaaggattag

SEQ ID NO: 53467 - DNA, 1119 bp, Artificial Sequence
  Description of Artificial Sequence: Synthetic coding sequence
atggagtggaaactagaaaggacagccccacgtcgtgttagaacagaggaagagatgctgtgggagagtatcatgagagtcttatcgaaggatctgaaacaaaaacggtctcaggattcagctaacgtgctggactccgtcaacgctacctatagcgattttaaatccaattttgctaagcgcctcagcgctgaagtccctgtggcaagcagccctattacaacaaggtggcagcaatcccagaccagggccctgtcatccgattcattcggcgaagagcagtccacaacctatctgccagaggcttcagggagcgtcctcaagacaccacccgaaaaggagaccctgactttaggctccagaaaagaacagctgaaaaccccctctaaggggatctctgagacgtcaaacagcgcactgcacttttgcaaggcgcctcatgcgatggatcgcgactggaaagagtctgtcgccagcaaaggacagaagtgtcttaagcagctcttcgttactcagaacgtcgttcaacaggcaaatggcaagatgcagctttgcgaacagtccgagtgtgtatggaaagggtgcaaggacggcgttagagacgagtcttttcacctaaaatcgtcaggcgatatcaacgactcaatcctgcaacctgaagtgaagattcacatcacaggcctgagaaacgactattatctgaacatcctggactggagcttccagaatttggtggcaatcgccctcgggagtgctgtatacatatggaacggcgaaaatcataacgggatagaaaatatcgacctgtcgttgacctgcaattacattagctctgtatcctggatcaaggaaggaacctgcctggcagtgggaacctctgaaggcgaggtccagctctgggacgtagtgactaaaaaacgcctgagaaacatgctcgggcacctgtcagttgtgggcgcactcagctggaaccacttcatcctgtccagacttgagttttccggtgttatttccgctcactgcaacttgcacctgcccagctcatgggactaccgacgccctcccccatgcctcgtcggtcaggattggggagtgtttataatcacaatgttcggctag

SEQ ID NO: 53468 - DNA, 1560 bp, Artificial Sequence
  Description of Artificial Sequence: Synthetic coding sequence
atggagtggaagctcgaacggaccgcccctcgacgcgtgcgaaccgaggaggagatgctgtgggaatctataatgagggtgctgtctaaagacctgaaacagaagcgctcccaagacagtgccaacgtgttggattcagttaacgccacttacagcgattttaaatccaattttgccaagagattgtcagccgaggtgcccgtcgccagtagtcctattacaacccggtggcagcagagccaaacgcgagcactcagctccgattccttcggcgaggagcagtcgaccacttatctccctgaagccagtggttcagtactgaaaactccccctgaaaaagaaacactgactctcggtagccggaaggagcaactgaagaccccgtccaaggggatttctgagacatccaatagcgcgctgcacttctgcaaggcgcctcacgccatggaccgtgattggaaggaaagcgtggcctccaagggacaaaaatgtctaaagcagcttttcgttactcagaacgtggtgcagcaagcgaatgggaagatgcaactctgtgagcagagcgaatgtgtgtggaaggggtgtaaagacggagtccgagacgaatccttccaccttaagagttctggggatataaacgacagtatcctgcagcccgaggtgaaaattcatattacagggctccgcaatgattactacctgaatatcctggactggtcattccaaaatcttgtcgctattgcactggggtcggccgtatacatctggaatggcgagaatcataacggcattgagaacattgatctgtccctgacatgtaattatatctcaagcgtgtcttggatcaaagagggtacctgtcttgcggttggaacttctgagggcgaagtccaattatgggatgtagtcaccaaaaagaggctccgtaacatgctagggcacctatcggttgtaggggctctgagttggaaccactttatccttagctcgggctcccggctcggacgcgtctaccaccatgacgtgcgtgtggcgcagcaccatgtcggaacgctacgacataagcaggccgtgtgcgcccttaagtggagcccggacggacggcttctgtccagcggctgctcagatggccttctgaccatctggcctcatgaccccggagcgtctgcgcagggccaaccgctgaaggtaatcactcaaagcactgccgtgaaggctatggattggtgtccttggcagtccggcgtgttagccattggaggcggaatgaaggacggccgtctgcacattctcgatattaacgcgggaaagtctattcagacaccatccactaatagccagatctgcagtctcatctggctgcctaagacgaaggagattgcaactggacagggcaccccgaaaaacgacgttaccgtgtggacatgcccaacagtgtcacggagcggcggattctttggtcataggggacgggttcttcatcttagtctgtcaccagaccagacgcgcgtcttctcggcggcagctgacggcaccgcatctgtgtggaattgttattag

SEQ ID NO: 53469 - DNA, 807 bp, Artificial Sequence
  Description of Artificial Sequence: Synthetic coding sequence
atggggagcgcaaagtctgtgcctgtgacaccagcacggccaccaccccataataagcatctggccagggtagctgatccgagaagcccctcagcaggcatcctgagaacgcctatccaggtcgaatcttcaccgcagcccggtctcccagcaggcgaacagctggagggcctgaagcatgcacaggactccgatcctcggagcccgacgctcggaatcgctaggacaccaatgaagactagctctggtgatccgcctagcccactcgttaagcagctgagtgaggtcttcgaaactgaggattctaaaagcaacctgccacctgaaccagtcctacccccagaagccccacttagttctgaattggaccttcctctgggcactcagctgtctgtggaagagcagatgcccccttggaaccagacagagttccctagcaaacaagttttttctaaagaggaagccaggcaaccaaccgagacccccgtcgcttcccaaagttccgacaagccctccagagatcccgagactccacggagctcggggtctatgcggaacagatggaagcccaattcaagcaaagtcctggggagatcaccccttactattctccaagacgataactcccctggcaccttaaccctgcgccagggtaaacggccttcacccctgtccgagaatgtcagcgagctaaaggagggggctattttagggacaggcaggcttctgaagaccggcggaagggcctgggagcaaggccaggatcacgataaggaaaatcagcactttccactagtagagtcctag

SEQ ID NO: 53470 - DNA, 435 bp, Artificial Sequence
  Description of Artificial Sequence: Synthetic coding sequence
atggccttcacattcgccgcattctgttatatgctagccctgctgctcaccgcagctttgattttttttgcgatttggcatataatcgcattcgatgagctcaagacagactataagaaccccatcgatcaatgcaatacattaaaccctctggttttacccgagtatctgattcatgcctttttttgtgtgatgttcttgtgcgcagcagagtggctgacgctaggactcaatatgccactcctggcctaccacatctggaggtatatgtcaaggcctgtcatgtctggccctgggttatatgatcctaccacgattatgaatgcagacattctcgcctattgtcagaaagagggctggtgcaagttagcattttacctgctggccttcttctattacctatacggcatgatttacgtgctcgtcagtagttag

SEQ ID NO: 53471 - DNA, 225 bp, Artificial Sequence
  Description of Artificial Sequence: Synthetic coding sequence
atgaaattccaggaatgccacagtgaggtgatgaggcatgggcagaaaatttatccttctcaccaccgaatcgagatggccgtggaaattgcttctctcaaatgtcagcacagctccattaaccagagtcccaccaggaaaaatagcaacagtactaccggctggttactctgggacctgctaatgggcattggtaactcagggtccaatgtggtgctgacctag

SEQ ID NO: 53472 - DNA, 750 bp, Artificial Sequence
  Description of Artificial Sequence: Synthetic coding sequence
atgacaactgcagtggagcgtaaatacatcaacattcgcaagaggcttgaccagcttggatatcggcaaaccttgaccgtggagtgtctgcccctcgtggaaaagctcttttccgatctggtgcataccaccgaatctcttagacagagtaagctaagcgccgtcaaggctgagaaggaatcggccaacttcgactttgtgcttgaaccctacaaactcgaaaatgccagactgagtcgagaaaacaatgagttgtacctagaactcatgaagcttagagagcacagcgatcaacacgtgaaagaactgaaaacatccctgaaaaagtgcgccagagagaccgccgacctcaagttcctaaataatcagtatgcccataagctcaaattgctcgaaaaggagagtaaagccaaaaacgaaagaatacagcaattacaagagaaaaacttgcacgctgtggttcagacacccggtggcaaaaagcgctcaatcgcatttaggcgacagcggatgcaaatcgatgaacctgttccgcctagcgaggtgagtagttaccccgtcccccagccggacgacccctacatcgcagacttgctgcaggtggctgataatcgtatacaggagctgcagcaagaggtgcatcagctacaggagaaactggccatgatggagtctggcgtgagggattatagcaagcaagtgggctttctttttacctgcatagtggggattgaaatcggcatgctgtag

SEQ ID NO: 53473 - DNA, 165 bp, Artificial Sequence
  Description of Artificial Sequence: Synthetic coding sequence
atgagccttaggcggcacatcggcaaccctgagtacctgatgaagcgaatccctcaaaacccaaggtatcagcacattaaatctcgtctggacaccggagcctgtgtctaccttacttcttcccctgcgctccctgattgcgctatgaacggcctgtgtttttag

SEQ ID NO: 53474 - DNA, 411 bp, Artificial Sequence
  Description of Artificial Sequence: Synthetic coding sequence
atgctgtcatcatttaatgagtggttttggcaagatcgcttttggctacccccaaacgtgacttggactgagctcgaagacagagatgggagagtctacccccatccacaggacctgctggccgctctgccgctcgccttagtgctgctcgctatgcgcctcgctttcgaacgttttatcggcctgcccctgagtagatggctgggcgtgcgcgatcagacacgcaggcaggtgaaacctaatgccaccctggaaaaacactttctgacagagggacatcgacccaaggaaccccagctgtctctgttggctgcccagtgcggcttaaccttgcagcaaactcagagatggtttcgtcgacgcagaaatcaggatcgcccacaacttactaagaaattttgcgaagcgtag

SEQ ID NO: 53475 - DNA, 1398 bp, Artificial Sequence
  Description of Artificial Sequence: Synthetic coding sequence
atgagacgtgccgctggcatggaggatttctccgctgaggaggaggaaagttggtacgaccagcaggacctggagcaggacctgcacctggctgctgaactgggtaaaaccctactcgagcgaaacaaggagttggaaggatctctgcagcaaatgtactccacaaacgaagagcaggtgcaggaaatcgagtatttgacaaaacagttggacaccttacggcacgtcaatgagcagcatgcaaaagtgtacgagcagcttgacttgactgctcgtgacttagagttgacaaaccatcgcctagtcctggagagcaaagcagcacagcagaagatccacggcctgactgagacgattgagaggctgcaggcccaggtggaggaactccaggctcaggtggagcagctgcgcggtttggagcaactgcgggtactgagggagaagcgcgaaagacgaagaaccattcataccttcccgtgtcttaaggaattgtgtacatcacctagatgtaaagatgcttttcgtcttcactcaagcagcttggagttaggcccaaggcccttagaacaggagaacgagcgtttacagaccctggtgggggctctccggtcccaggtctcccaggagagacagagaaaggaaagagccgaacgtgagtacactgccgtattgcaggagtatagtgaattagaacggcagctttgtgagatggaagcttgtaggctgagggttcaggagctggaggctgagctgcttgaattacagcaaatgaagcaggccaagacctatctgctcggacctgacgaccacctggctgaagcgctgctggcgcctctaacccaagcacctgaagctgatgatccacagcccggtcggggagatgatctaggggctcaggacggtgtcagtagtcccgctgccagtcccggtcacgtggttaggaagtcttgctctgatacagccttgaatgccattgtggctaaggatcctgcctcccggcatgctggcaatctgacactccatgccaattcagtccgcaaaagaggcatgagcattctgcgggaggttgacgaacaataccacgctctgctcgagaagtacgaggagttattatctaagtgccgccagcatggtgcaggtgtgagacacgccggagttcaaacaagccgtccgattagccgcgacagtagctggcgcgacttgcgcggaggggaggaaggccagggtgaggtgaaggccggtgaaaaaagccttagccaacacgtcgaagctgttgataaaagactcgaacaatcccaacctgagtataaagcactctttaaagaaatcttctccaggatacagaaaaccaaagccgatatcaacgcgaccaaggtaaaaacccattcatctaagtag

SEQ ID NO: 53476 - DNA, 555 bp, Artificial Sequence
  Description of Artificial Sequence: Synthetic coding sequence
atgtgggtgttcggctatgggtcactgatttggaaggtggactttccataccaggataaacttgtgggatatatcaccaattactctcggagattctggcagggctctacagaccatcgtggagtgcctggcaagcccggaagagtcgtcaccctggttgaggaccctgctggttgtgtgtggggtgtggcctatcggctgcctgtcggaaaggaggaggaggtgaaggcctatcttgattttcgcgaaaagggcggttaccgtaccacgactgttattttctacccgaaggacccaacgactaagccattttccgtgctgctgtatatcggaacatgcgacaatccagactacttaggccctgctcctttagaggatatcgccgaacagatttttaacgcagccggaccatcggggaggaataccgaatacttgttcgagctggccaacagtatccggaacctggtgccggaagaggcagacgaacatcttttcgctctggagaagctggtcaaggagcgcctcgagggcaaacagaacctgaattgtatttag

SEQ ID NO: 53477 - DNA, 285 bp, Artificial Sequence
  Description of Artificial Sequence: Synthetic coding sequence
atgatgggcttatccctagccagtgcagttctgttggcctctctgctttcactgcacttagggacagccacgcgcggatctgacatttctaagacatgctgctttcaatattcacataaaccacttccatggacatgggtccggtcatatgagttcaccagtaacagctgctcccagagagcggtgatatttactacaaagcggggaaaaaaagtgtgtacccaccccaggaagaagtgggtgcagaaatatatttcattgcttaagacaccaaaacagctctag

SEQ ID NO: 53478 - DNA, 729 bp, Artificial Sequence
  Description of Artificial Sequence: Synthetic coding sequence
atgtgggcaagccgtgatcatctccctgagccagacttaggtgatgccgctccccctggcagccccagctccttttggacttccggcctgcccaggcaggagaggagtacttcgaggcagcgctccaggggctctccttctagtacctgtgtgccatacaaggtacacgccttggccacctttgagtgttcagccacttcccacgcctcaaggctgtggcaaaccctgcaacagttctgggccgaccatataagccgcccattttccccacgacgcccaccacttcgcaggatgccctcattgagcactttctatttacttgaccataacacacggcaagccgaacttggactcgcatatggagctccgtgcatgagacttagcaatcaggcctttgttttccggggtggcagatggactactgagagtcaactcgcaagaacccgatccccactcctgagccgaaccgcctggggctggaaagcacaggtgcagaggagcaaaagccaggttctgctggaggaaaacaattatttgaaactgcagcaggaactgctgattgacatgctcacggagactatggcacggatgcatctcctggaaaaacagaggaatcctgaggtcattcctacagccgcagcaagggcaggtcagaggaaaatgcggaagcgagctggggcatctgcaggcgtcctgatgatccagccctgtgcgctggacagccaatag

SEQ ID NO: 53479 - DNA, 237 bp, Artificial Sequence
  Description of Artificial Sequence: Synthetic coding sequence
atgtcagccaccactgcttgttggccagcctttacagtgctcggcgaagcacgcggtgaccaggtggattggagtaggctatacagggataccggtctcgtgaagatgtctcggaagcctcgggcttcatcacccttcagcaataaccatccaagcacaccgaagcgtttcccccgacaacctaaacgcgaaaaaggaccagtaaaagaagtaccaggcaccaagggttcgccatag

SEQ ID NO: 53480 - DNA, 222 bp, Artificial Sequence
  Description of Artificial Sequence: Synthetic coding sequence
atgtccgcgactaccgcgtgctggcctgccttcacggtgctaggtgaggccagaggcgaccaggtcgactggtctcgcctctaccgagacacgggactggtgaagatgagtagaaagccccgtgcgtctagccctttctccaacaatcatccctcaaccccgaaaaggcgaggaaggggtaaacatccgctcatccctggcccagaggccctgtctaaatag

SEQ ID NO: 53481 - DNA, 237 bp, Artificial Sequence
  Description of Artificial Sequence: Synthetic coding sequence
atgtcagcaacaactgcctgctggcccgctttcactgtgcttggtgaagccaggggcgaccaggttgactggtcccgcctttatagggatactggtctggtgaagatgtctcgtaagcctagggcgtccagcccgttttccaataatcatccgagcaccccgaagaggttcccaaggcaaccaaaacgggagaaggggccagtcaaggaagtacctggcactaagggaagcccttag

SEQ ID NO: 53482 - DNA, 333 bp, Artificial Sequence
  Description of Artificial Sequence: Synthetic coding sequence
atgtggatggggctgatccaactggtggagggcgtgaaacgcaaagaccagggctttttggagaaagagttttatcacaaaaccaacattaagatgaggtgcgagttccttgcctgttggcccgctttcaccgtgctgggggaagcgtggcgggaccaggtcgattggagccgactcctgagagacgcgggactggtgaagatgtctaggaagccaagggcttcaagcccactgtcaaacaaccaccctcctacccccaagcgattcccacggcaaccaggcagggagaaaggccctatcaaagaggtgcctggtaccaaaggatccccctag

SEQ ID NO: 53483 - DNA, 492 bp, Artificial Sequence
  Description of Artificial Sequence: Synthetic coding sequence
atgagtaagggactgctgttgctactgctcctgtctatgggcggtacctgggcatcaaaagaaccactgcgtccccgatgtaggcccataaatgcaaccctagccgtcgagaaagaaggctgcccagtttgcataacagtaaacaccaccatttgcgccggatactgcccaacaatgactcgagtactccagggcgtgctccccgctttaccgcaggtggtctgcaattatagagatgtgaggttcgaatccatacgcctgcccggttgtcccaggggggtcaacccagtggtctcttacgctgtcgctctaagttgtcaatgtgcactgtgtcgcagaagtactactgactgtgggggtcctaaggatcatcctctgacctgcgacgaccctagattccaggcctccagcagttcaaaagctcccccaccctccctgccatctcccagtaggctccctggcccatcagacacacccatcttgccccagtag

SEQ ID NO: 53484 - DNA, 417 bp, Artificial Sequence
  Description of Artificial Sequence: Synthetic coding sequence
atgagcaagggtctccttttgttgctgctgctgtcgatgggtgggacatgggccagcaaggagcctctgcgacctcgctgcagacctataaatgctacacttgcagttgagaaagaaggctgccccgtctgcattacggttaacacaactatatgtgctgggtattgtccgaccatgacacgggtactccagggggttctgcctgccttgccccaggtcgtctgtaactatagggatgtcaggttcgaaagtatccgtctccccggatgcccaagaggagtcaatcctgtggttagctatgctgtggctttgtcctgccagtgtgcactgtgtcggagatctacaacagactgtgggggaccaaaagatcaccctctgacatgcgatccccctctgcctgggcttctgttcctgtag

SEQ ID NO: 53485 - DNA, 492 bp, Artificial Sequence
  Description of Artificial Sequence: Synthetic coding sequence
atgtttcaaggcctgctgctgctccttttgctgagtatgggaggtacgtgggcaagccgagagatgctgcgtccaaggtgccggcctatcaacgctacactggctgttgaaaaagagggatgtcccgtgtgtattactgtcaacactactatctgcgctggttactgtccaaccatgacccgggtgctgcagggagtgctgccagccctcccccaggttgtgtgcaactatcgggatgtcagattcgagtctatccgcctccctgggtgcccaagaggagtcaatcccgtcgtctcttatgcagtcgccctctcatgccagtgcgccctctgcagacgcagcacaacggactgcggcggacctaaagaccatcccctgacatgtgacgatccacgcttccaggcctcttcttcatcaaaagcgcctcccccttccctccccagtccatctcggcttcccggaccttccgatacccctatcctgcctcagtag

SEQ ID NO: 53486 - DNA, 498 bp, Artificial Sequence
  Description of Artificial Sequence: Synthetic coding sequence
atggaaatgttccaggggctgctcctcctcttactactctctatgggagggacctgggctagccgtgagatgctacgccctaggtgccggccaatcaatgcgacccttgccgtggaaaaggagggttgtccggtgtgcataacagtaaatacaactatctgcgccggatattgtcccaccatgactagggtattacaaggtgtccttcccgcactaccccaggtggtctgtaactaccgggacgtgaggttcgagtctattagactgcccggatgtcccaggggagttaatcccgtggtcagctatgccgtggccttatcatgccagtgtgctctgtgcaggcgcagcacaactgactgcggcggtcccaaagaccaccctctcacttgcgacgatccgagatttcaggcttcttcctccagcaaggctccaccgccaagtctaccgagcccttcaaggctgcctggtcctagtgacactccgatcctgccacagtag

SEQ ID NO: 53487 - DNA, 189 bp, Artificial Sequence
  Description of Artificial Sequence: Synthetic coding sequence
atggcaagcaataaaaccaccctgcagaagatgggtaagaagcaaaacgggaaatcaaagaaagtggaggaggctgagcccgaagagttcgtagtggagaaggtactggatcggcgtgtcgtcaacggcaaggttgaatatttcttgaaatggaaaggatttacggacgctgataacacttgggaatag

SEQ ID NO: 53488 - DNA, 2082 bp, Artificial Sequence
  Description of Artificial Sequence: Synthetic coding sequence
atggaacgcgctggagctacctcacggggaggccaggctcctggttttctgctgcgtctccacacagaaggccgagcagaagctgctcgcgtgcaggaacaggaccttaggcagtggggtcttactgccagcgagctgcacaaacttctacagcccttcctcctgcggagggtgaaggccgaagtcgccacagagctcccgaaaaaaacagaagtagtgatctaccacggaatgtccgccctccagaaaaagtattacaaggccatcctcatgaaggatttggatgccttcgaaaacgaaaccgccaagaaagttaaactccagaacatactctctcagctgcgcaagtgcgtggatcatccctatttgttcgatggcgtggagccagagccattcgaggtgggagaccacctgaccgaagccagtggcaagctgcatctcctggataagctcctggctttcctctattctggagggcaccgggtcctgctgttcagccagatgacacagatgctggacattctccaggactacatggattacagggggtatagctacgaaagggtagatgggtctgtcagaggtgaggagcgtcatttggcaattaaaaactttggacagcaaccaatctttgtctttctgttgtccacgagagcaggtggggtaggaatgaacctgactgccgcagacacagttatatttgttgactcagatttcaaccctcaaaacgacttgcaagcggctgcaagagcgcatcgcatcggccagaataagtctgtaaaggtgattcggctaatagggcgagacacggtggaagaaattgtataccggaaagcagcttctaaattgcagctgactaacatgatcattgaaggcggacattttaccctcggggcacagaaaccggcagctgatgccgatctacagctgtcagaaatcctgaagtttggactggacaaattgctcgctagcgaaggctccacaatggacgagatcgatcttgagtcgatccttggcgaaacgaaagacggccagtgggtgagtgacgccttacctgctgcagagggaggctcccgcgatcaggaggagggcaaaaaccatatgtacctgtttgaaggcaaggactattctaaggagccaagcaaggaagacaggaagagttttgaacagctggtgaatctgcaaaagaccctgcttgaaaaggcttcccaggagggccgtagtctgagaaacaagggaagtgtactgatccctgggctcgtcgaaggatcgacaaaacgcaagcgagtactgagccccgaagaattagaggacagacaaaagaaaaggcaggaagctgcagccaaaagaaggagattgatcgaagagaaaaagcgtcagaaagaggaggcggagcataaaaaaaagatggcttggtgggagagtaataattaccaatcattctgcctgccttctgaggaaagcgagcctgaagacctggagaatggggaggagtcctcagccgaactcgactaccaggaccctgacgccaccagcctgaagtacgtgtccggcgacgtaacccacccccaggcaggcgcagaggatgctctgattgtgcactgtgtggacgactccgggcactggggacggggagggctgttcacagctctggaaaagagatctgctgaaccaaggaaaatctatgagctcgcaggaaagatgaaagacctcagcttgggtggagtactgcttttccccgtggacgacaaagagtcacgtaataaaggacaggatctccttgctcttatcgtagcccagcatagagatcgctcgaacgtgttgtccggcattaagatggccgctttggaggagggcctcaaaaaaatcttcctcgccgctaaaaaaaagaaagcatctgtgcacctccctcgtatcgggcacgcgactaagggtttcaactggtacggaacggagaggcttatcaggaagcacctagccgcacgcggaatccccacatacatctattattttcctcggagtaagagcgccgttttacatagtcagtccagctccagctctagtagacagcttgtgccatag

SEQ ID NO: 53489 - DNA, 1851 bp, Artificial Sequence
  Description of Artificial Sequence: Synthetic coding sequence
atgagtgcactgcagaaaaagtactataaggccattctgatgaaggacttggacgcgttcgaaaacgaaaccgccaagaaggttaagctacagaacatcctttctcaacttagaaagtgtgtggaccatccgtaccttttcgacggcgtcgagcccgaaccgtttgaggtgggagatcatctgactgaggcctcagggaagttacacttgttggataagttattagcctttttgtattctggcggtcatcgggtgctgctgttttcacagatgacacagatgctagacatactgcaggattacatggactatagagggtacagctatgaaagagttgatgggagtgtgcgtggggaggagcgacacctggccattaagaactttggccagcagcctatatttgtgtttctgctcagtacaagggccggaggggttggcatgaaccttacagctgccgacacagtgatttttgtggattcagatttcaaccctcagaacgacctgcaggctgccgcaagagcccatcgcatcggacagaataagtcagtgaaagtaatcagactgatcggacgggacaccgtggaagagatagtctatagaaaagcagcaagtaaactccaactcactaacatgatcatcgaaggcggtcattttacgctcggcgctcagaaaccagccgcagatgcagaccttcagctgtctgaaatcctaaaatttggcctggataagttactggccagcgaggggagtactatggacgaaatcgaccttgaaagcattttgggggaaaccaaggacggacagtgggtgtctgatgcattgccggcagccgagggtgggtcaagagatcaggaggagggcaagaatcacatgtacctttttgagggtaaagattacagtaaagaaccctctaaggaggacagaaagagcttcgaacagttggtaaatctgcaaaaaactctcttggaaaaagcatctcaggagggtcgctccttgaggaacaaaggtagcgtgctgattcctggacttgtcgaaggatcaaccaaaagaaaaagagtgctgtcacctgaggagctagaagaccgccagaagaagcgccaggaggctgccgctaaacggcgtcgcctgatcgaggagaaaaagcgtcagaaggaggaggctgaacacaagaaaaaaatggcatggtgggaatccaacaactaccagtccttttgtttgccttcagaggaatccgaacccgaagatttagagaatggagaggagtcgagcgcggagctcgattaccaggaccccgatgccaccagtctcaagtacgtgagtggagatgtcacccaccctcaagccggagccgaggatgctcttatcgtgcactgtgttgatgattccggccattggggccgtgggggactattcacggccctggaaaaacggagcgccgaacccaggaaaatctacgagctggcaggcaagatgaaagatctctcacttggtggagtcctcctgtttcctgtggacgataaggaatcaaggaataaaggccaggatttactcgctttgattgtggcccagcatcgggatcggtccaacgtcctgtctggtatcaagatggcggctctggaggagggcctgaagaaaatcttcctggccgctaagaagaaaaaggcctctgtgcacctgcctaggatcggccacgccacaaagggctttaactggtacggtacagagcgtttgatccggaaacatctggccgctcgaggaattcccacctacatttattattttcctcgctcgaaatcagccgtcttgcattcccagtcatcctcgagttcttctaggcagctggtcccgtag

SEQ ID NO: 53490 - DNA, 2694 bp, Artificial Sequence
  Description of Artificial Sequence: Synthetic coding sequence
atggagcgcgctggagccacaagtcgaggaggacaagcccctggcttcttgctgcgcctgcacacagagggcagagctgaagctgcacgcgtacaggaacaggacctgcgtcagtggggtttaactggcatacacctgaggtcttatcagcttgagggtgtgaactggctcgcccagagattccattgccagaacgggtgcatcctcggcgatgaaatgggcctaggaaagacttgccagacgattgcgctgttcatatatctagcaggcagactgaacgatgaaggtccatttctgattctgtgtccgctgtctgtcctgagcaactggaaagaggaaatgcagcgttttgctccgggtctgtcctgtgttacctatgctggcgataaagaggagcgggcatgcctgcagcaggacctcaaacaagagagccgttttcacgtgttattaaccacctatgaaatctgcttgaaagatgcctcgtttctaaaatcttttccctggagtgtgctagtggtggacgaagcccatcgtctcaaaaaccagtcatcacttctacataagactctgtccgaattctctgttgtgttctcccttctccttacaggtaccccaattcagaattccctgcaggagttgtatagcctcctgagtttcgtggaaccagatcttttttctaaagaggaagtgggagacttcatacagagataccaggacatagaaaaggagagtgaatccgcttctgagctccacaaactgctccagccgtttttgctgcgacgggtgaaagctgaagtggccacagagctgcccaagaaaaccgaggtggtgatttatcatggtatgtctgctttgcaaaaaaagtactacaaggccattcttatgaaggatctcgacgcattcgagaacgagacggcaaagaaggttaaattgcagaacatcctcagccagctgcgcaagtgcgtcgatcacccatacctattcgatggcgttgagcctgagccctttgaggtaggggatcacctgactgaggcatccggcaagctgcatttgctcgataagcttttagcctttctgtacagtggcggacatcgagtcctgctattcagtcaaatgacacagatgcttgatatattacaagactatatggactaccgtgggtactcttatgaaagggtggacggctctgtgcggggagaggaaaggcacctcgctattaaaaatttcgggcagcagccaatctttgtgtttttacttagcacgcgggcagggggagtaggcatgaatttgaccgctgccgataccgttatcttcgtagactctgacttcaacccacagaatgacctgcaagccgctgcacgagcccataggattggccagaataaatccgtcaaggtaatccgcctgatagggcgtgacactgtggaagaaatcgtttataggaaagctgcctcaaaactgcaattgacaaacatgattatagagggcggacacttcactctgggagcacaaaaacctgcagctgatgctgacctccaactgtccgaaattttgaagtttggtttagataagctgcttgcttccgaggggtccaccatggacgaaatcgatctggagtccattcttggcgagaccaaagatggccagtgggtgtcagatgccctgccggctgcggaggggggaagccgggatcaggaggaggggaagaatcacatgtatctgtttgaggggaaagactactcaaaagagccatctaaagaagatcgtaagtcctttgagcagctggtaaatctgcaaaagacactcctggaaaaagcgagtcaggaagggaggagcctccgcaacaaggggtcagtgttgattcctggactggtggagggctcgacaaagagaaaacgagtgctgagccccgaggagttggaggacagacagaagaagaggcaggaagctgcagctaaaaggaggcggctgattgaggagaaaaagagacagaaagaagaggcagagcacaagaagaaaatggcatggtgggagagcaacaattatcagtcgttctgtctgccgtcagaagagagtgaaccagaagatctggaaaacggagaggagtcatctgctgaattggactaccaggaccctgatgccacatctcttaaatatgtgtctggcgatgtgactcaccctcaagccggagccgaagatgcactaattgtgcactgcgtcgatgattctggccattggggtagaggtggtctgtttacagctctggaaaagcgatccgcggagcccagaaagatctatgagctggccggaaagatgaaagatctttcgctgggtggagtgcttttgttcccagtggatgacaaggagtcacgaaacaaggggcaggacttattggctctgatcgtagctcagcatagggaccggagtaacgtcctgtcaggcatcaagatggcagcgttagaggagggtctgaagaagatcttcctcgctgccaagaaaaaaaaggcgtctgttcatctgcccaggatcggccatgctaccaagggattcaattggtatggaacagagagattaatccggaaacacctggctgcccgagggatcccaacctacatctactatttcccccgtagtaagtcagccgtactgcatagtcagtcaagttcctcctcctctcgtcagttagtgccatag

SEQ ID NO: 53491 - DNA, 1983 bp, Artificial Sequence
  Description of Artificial Sequence: Synthetic coding sequence
atggaggcactcatggccaggggcgcactgactggtcctctgagggcactctgcctgctgggatgtttgctctcacacgctgcagctgcgccttcacccatcattaagtttcctggagacgtcgcacctaaaacagataaagaactggcagtgcagtatctaaatacattttatggatgtcctaaagaatcctgcaacctattcgtgctgaaggataccctgaagaagatgcagaaattttttggcctgcctcagaccggagacctggaccagaacactatcgaaaccatgcggaaaccaaggtgtggcaaccctgatgtggccaactataactttttccccagaaagccaaaatgggataagaatcagatcacatatagaattatcggctacactccagaccttgatcctgagactgtggacgacgccttcgctcgtgcatttcaggtctggtcggatgtgacacccctcagattttctcgtattcatgacggcgaggcagacatcatgatcaacttcggacgctgggaacatggcgatggttaccccttcgatggcaaggatggccttctcgcccatgccttcgcaccaggcacaggagtgggcggagactctcactttgacgacgacgagttgtggacactcggagaaggccaggtggtgagggtcaagtatgggaatgccgacggcgaatactgcaagttcccattcttgtttaacgggaaggaatataattcttgcacagacactgggaggtctgacggttttctctggtgctctactacttataatttcgaaaaggatggtaagtacggattctgtccccacgaagctctgtttacaatggggggaaatgctgaggggcagccctgtaagttccctttcagattccagggaacctcgtacgatagctgtaccactgaaggacgtaccgatgggtatcggtggtgtgggacgacagaggattacgaccgcgataagaaatacggcttctgccccgaaacagcgatgagcacagtcggcggtaattctgagggcgctccttgcgttttcccttttacatttctggggaacaagtatgaatcttgtacctctgccggaagaagtgatggtaagatgtggtgtgcaaccactgcgaattacgacgacgataggaagtgggggttttgtcctgatcagggttactcactcttcctggtcgctgcccacgagttcggccacgctatgggtctggagcacagtcaggacccaggcgctctcatggcaccaatctacacatacaccaaaaattttagactctctcaggatgacataaagggtatacaggaactgtacggagcctcgcccgacatcgatctgggcactggacccacaccaactctgggtcctgtgacgcccgaaatttgcaaacaggatatcgtgttcgatggcatagcccagatccggggagagatcttcttcttcaaggaccgtttcatctggaggacagtcacgcccagagacaagccaatgggacctctcctggtcgccactttctggccagaactgcccgaaaagatagacgcggtttacgaagcccctcaagaagaaaaggcagtgttctttgcaggtaatgaatactggatctactctgcatctactttggagaggggttatccaaagccccttactagcctgggcctccccccagatgtccagcgcgtcgatgctgccttcaactggtctaagaataaaaagacctatatattcgccggtgacaagttctggaggtacaatgaggtaaaaaaaaaaatggaccctggatttcctaagctgatcgctgatgcctggaacgcaattccagacaacttggacgccgtagttgatctgcagggcggtgggcattcctacttcttcaaaggggcttattacctaaagttggagaatcagagcctgaaaagcgtgaaatttggctctatcaaaagcgactggctgggctgttag

SEQ ID NO: 53492 - DNA, 8645 bp, Artificial Sequence
  Description of Artificial Sequence: Synthetic coding sequence
atgactgatcccatgatggatttctttgacgatgccaatctgtttggagagactctcgaagggctgtccgacgatgcgtttgtccagcccggacccgttagtttggttgatgaattgaaccttggtgctgaattcgaaccactccatattgactctctgaaccacgtccagggtaccccaacccatcagaaaatgacagacttcgaacagctgaaccaattcgattctatcaaattccaccatgtgaatcaatccttcgggagcccggcagaacacgtgcttagcccacactcacagtttaactgtagcccaatccatccccagaaccagccaaatggtctctttcccgacgtttctgacggaagccccatgtggggacatcagacagcaacaaccatctcaaatcagaacggcagtccttttcatcagcagggacattctcactccatgcatcagaataagagcttcgtggcccatcatgatttcgctctttttcaggcaaacgagcagcaaacccagtgcacttcattacgcagccagcagaatcgcaataatctcaatccgggtcagaattcactgtctcagtcaaagaatttcatgaatgtgagcgggccacacagggtgaacgtcaatcaccccccacagatgaccaacgcctcaaacagccagcaatcgattagcatgcagcagttttcccagacctctaatccaagcgcacacttccataaatgcagtagtcatcaggagggcaatttcaatgggccttcgccaaacatgacttcgtgcagtgtctccaatagtcagcagttcagcagtcattattcattctcatccaaccatatcagccctaactcactgttgcagagttccgccgtgctcgcttccaaccatactaaccaaaccctaagcgactttactggctctaattccttctcaccccaccgaggaatcaagcaggagagcactcagcatattttgaatcctaacacatcgctcaactccaataattttcagattctgcacagctcccatcctcagggtaattatagcaatagcaagctgtctcctgtgcacatgaattttcctgaccccgtggattctggcactcagatgggccacttcaacgaccatgtggaaaccaacggattttcatccctggaagaaaatctactccaccaggtggaatcacaaaccgaaccctttaccggcctggatcctgaggacttgctgcaggaaggccttttgcctcacttcgacgagtctacatttggtcaagataatagctcccacatactagaccatgatctagaccgccaattcacatcccatctcgtgacacgtcctagcgacatggcacagactcaactccagagccaggcaagatcgtggcactcttccttttctaatcatcagcatcttcacgatcgtaaccacctgtgcctgcagcggcagccaccgagctcaaaaaagtctgatggatctggaacgtatacgaaactgcagaacactcaggtccgcgtcatgtccgagaaaaaacaaagaaagaaagtggagtcagagtcaaaacaagagaaagctaatcggataatatctgaagcaattgctaaggctaaagagcggggagaacgaaatataccacgagttatgagccccgagaacttcccgactgctagcgtggaaggcaaggaggaaaagaaaggccgtcggatgaagtcaaagcctaaagataaggatagtaaaaaaaccaagacctgtagcaagcttaaagaaaaaacaaaaattgggaaactgatcattacgcttggcaagaaacagaagagaaagaacgagagttccgacgagatcagcgacgccgaacagatgccccagcatacacttaaagatcaagatagtcagaaacggaggtccaatcgccaaataaagcggaagaagtatgccgaggatattgagggcaagcagagcgaggaggaagtcaagggatctatgaagatcaagaaaaactcagccccactccccggtgaacaaccactgcaactgtttgtggagaacccctcagaggaagatgctgcaatcgtagataagatattatcaagccgaaccgttaaaaaggagatttcacctggggtgatgatcgataccgaagagttctttgttaagtataagaactattcctacctgcactgcgagtgggctaccgaagaacagctgctgaaggacaagagaatccagcagaagataaagcggtttaaactgagacaggcgcagcgcgcacacttctttgccgacatggaggaggagccatttaatcctgactatgtggaggttgaccgcgtcctggaagtttcgttctgtgaagacaaagatacgggcgagcccgtcatctactacctcgttaagtggtgcagcctcccctacgaggattcaacttgggaactcaaggaggatgttgacctggccaagatcgaggaattcgaacagctgcaggcttcccgcccagacactaggcggttggacaggccaccttcaaatatctggaagaagatcgaccaaagtcgcgactacaagaacgggaaccagctcagggagtatcaactagagggacttaactggctgctgtttaattggtataacaggagaaactgcattctggccgacgaaatggggctaggcaaaaccatccaaagcatcaccttcctgtacgagattttgctcactgggattcggggacccttcctgatcatcgctccgctgtctacaatcgctaattgggaacgggaattccgaacctggactgacattaacgtcgttgtgtaccatggcagtttgattagcagacagatgattcaacagtacgagatgtactttagggacagtcagggtagaatcattagaggcgcatacagattccaggcaatcataactaccttcgaaatgattcttggcggatgtggggagctgaacgctattgagtggaggtgcgtgatcattgatgaagctcacaggttaaagaataaaaactgtaagctcttagaagggctgaagcttatgaacttggagcacaaggtcctgctgactgggacgcccctgcagaacaccgtggaagagctgttttcactactgcacttccttgagcccctgcgctttccctcagagagcacattcatgcaggaattcggcgatctcaaaactgaggaacaggtccagaaactgcaggcaatccttaagcccatgatgttgagaagactgaaggaggacgtagagaagaaactggctcctaaagaagagactataatcgaagtggagctgaccaacattcaaaagaagtactatagggccatcttggagaagaatttctctttcctctccaaaggtgctggccagacaaatgtcccgaatttagtcaacaccatgatggaactgagaaagtgttgtaaccatccttatctgatcaagggagctgaggaaaagatcctcggcgagtttcgggatacatataacccggctgcaagtgacttccacttacaagccatgattcagtctgccggaaagttagtgctaattgacaagctattaccaaagatgaaggccggaggccacaaggttttgatcttcagccagatggtgcgatgcctggacatattagaggactacctcattcacaagcgctatctgtacgagagaattgacggacgagtgcgagggaatctgaggcaggccgctattgaccgcttttcaaaaccggattctgatagatttgttttcctcctgtgtacgcgtgcaggcggtctgggaattaatttgacagctgccgacacctgcatcatcttcgactcagattggaatccccagaacgatctgcaagcccaggcacgctgccaccgcattggccagaacaaggccgttaaggtgtacaggctggtaaccaggaacagctatgagcgggaaatgtttgacagggcttccttaaaattaggcctcgacaaggctgtgcttcaatctatgtcaggcagggaatcaaatgtcggcggaatacagcagctaagcaaaaaggaaatcgaagatttacttagacggggtgcctatggtgcaattatggaggaagaagacgaggggagcaaattttgtgaggaggacattgatcagatccttctgcggcgtactaagaccattacaatcgaatctgagggcaggggctccacatttgctaaagccagcttcgtagcgtcaggcaaccgcaccgacatcagcctcgatgatcccaacttctggcagaagtgggcgaagaaggccgaaatcgatatcgaggcaatttcgggacgtaattctctggtaatcgacaccccccgaatccggaagcagactagaccttttagtgcaactaaggatgaactggctgaactttcagaggcagagtctgaaggagatgagaagcctaagctgagacgtccatgtgaccgaagtaacggctatggccgaaccgagtgcttcagggtcgaaaaaaatcttctggtgtacgggtggggtcgttggcgcgaaatcctctcacacgggagattcaaacgtcagctgaatgaacatgatgtagagattatctgccgcgcattactggcatattgtctggtgcactaccggggtgacgaaaagataaagggctttatctgggatcttattaccccaacagaagacggacagacacgcgagttacagaaccatctgggtctgagcgcacccgtgcccagaggaaggaaaggcaaaaaggttaagactcagacgagcagctttgatattcagaaggccgagtggctgcggaaatataaccccgagcagctgctgcaagacgagggatataaaaaacatattaaacatcattgcaataaggtcctgctgcgggttcgcatgctctactatctgaaacaagaggtgatcggcaatgagtgtcagaaggtctttgatggcgtggatgcatccgacatcgacgtgtgggtcccagaaccggatcattctgaagttcctgccgagtggtgggattttgacgctgataagagccttctcatcggagtttttaaacacgggtacgaaaagtacaatactatccgagccgaccccgcactgtgtttccttgaaagagtcgggaaaccagacgagaaagcggtggccgctgagcagcgcgcaaacgattacatggacggtgacgtcgaggatcccgagtataagccagccccagccatattcaaggatgatatcgaggatgacgtgagcagccccggagaccttgtgatcgcggacggagacgggcaactaatggaaggggacaaagtctactggccgacccagagcgcgctgaccacccggctgaggaggctcatcacagcataccaaaggaccaacaagaataggcagatccagcagattcaaccaaccttctcggtgccaacttccgtcatgcagccaatatacgaagaagctacacttaatccaaagatggccgctaaaatcgagaggcagcagcgatggactcgcagagaggaagcagacttctaccgcgtcgtgtctaccttcggcgtagtgttcgaccctgatcgcggtcagtttgattggacgaagttcagggcgatggccagactccataagaagaccgacgattctctcgaaaagtacctgtatgccttcatgtccatgtgccgacgagtttgcaggcttccatcaaaggaggagcttgtggatcctaatatttttattcagccaattactgaggaacgggcatctcgaacactgtataggatcgaactactcagaaaggtgcgagagcaggctttaaggcatcctcagctctttgaacgactgaagctctgccacccgaacccggacttgccggtctggtgggaatgcggaccccatgacagggacctgttgatcggcgcagctaaacatggcgtcagccgcaccgactatcatatcctcagagacccagagttatcatttatggctgcccagaggaattattcacagtccaagatggcacattcccggacctccactcccctcttgcagcaataccaggttgccttgtccgccagccccctgacaagtctgccccgattgcttgatgctaagggaatcattctggaggaaatgaaagttaagtccgaaaacttgaaggaagagcctcagagctccgaagaagaatcgatgtcttcagtcgaaactagaactctgatcaagtcggagcccgtatctcccaagaatggggtgctcccacaggcgacaggtgaccaaaaatccggcggaaaatgcgagaccgatcgcagaatggttgcagccagaactgaaccactcacgcctaaccctgcctcaaaaaaaccaagagtacacaaacgcggtagtgagtcctccagcgattccgattctgattctgagcgctcttcatgctcgagccggagtagctcaagctccagctcttcttcatgtagtcatagtcgcagcgggtcttcaagcagttccagctcgagttgtagttcggcgtcgtccagttcttcttctagtaccagcagctcttcaagcagttcatcatctagttctgaggagtctgacagtgacgaagaggaggcgcaaaagagggagagtactactcacatgaaggcatacgacgaggagtcagttgccagcctgagcacaacacaagacgagactcaggattccttccagatgaacaatgggacaccagaatcagcctacatcctgcagggtggctacatgctggccgcatcttattggccaaaagaccgcgtaatgattaaccggctggattccatctgccaaacagtgctgaaggggaaatggccgtctgcgagaaggtcctacgatgcaaacacagttgcatcattttataccacaaagctgctggactcccctggtgctgccaccgagtattcggatccctctgtgcctacccccccaggcgctggagtcaaagaggaacacgaccagagtacccagatgtctaaggagggtggcttaaagctgactttccaaaagcaggggctggcacagaagcgaccctttgacggcgaagacggtgccttaggtcaacagcagtacctgacaaggctcagagaattgcaatcagccagcgagacctctcttgttaatttcccgaagtccatcccagtctcaggcacatctatacagccgacattgggagctaacggagttattctggataaccagccgatagttaaaaagagacgcggacgaagaaaaaacgtggagggtgtagatatttttttttttaaccgcaataaaccccctaaccatgtgagtctgggcctgacatcctctcaaatctccacgggaattaaccctgcactgtcttacacccaaccacagggaatcccagacactgaatctccagtccccgtgattaatcttaaagatggcaccagactggcaggggatgatgctcccaagaggaaggacctcgagaaatggctgaaagaacatccaggctacgttgaggatctgggtgctttcatcccgcgtatgcagttacatgaagggagacccaaacagaagcgacaccgatgtcgcaacccaaataagctggatgtcaatagtctgacaggggaggagcgagttcagctgattaaccgaaggaacgcccgaaaagtcggtggtgcatttgccccaccgttgaaggacctctgcagatttctaaaggaaaattctgaatatggcgttgccccagagtggggcgatgtggtgaaacagagcggatttctgcctgagagcatgtatgaacgcatactgaccggaccagtcgtaagagaagaggtctcccggcgtggtcgcaggccaaagagtggcattgctaaggcaacggcggctgccgctgctgcgtctgcaactagcgtcagcggtaaccctcttctggctaacggcctgttacccggtgtcgacctgactacactgcaggcactgcagcagaatctgcagaatctccagtcactccaggtcacagcaggtctgatggggatgcccacagggctgccaagtggcggtgaagcaaaaaatatggccgctatgtttcctatgctgctatctggaatggccggactccctaacttgctcggaatggggggtctactgaccaaaccaaccgagtctggcactgaagacaagaaggggagtgactccaaggagagtgaaggcaagactgaacgcaccgagtctcaaagcagtgaaaacgggggagaaaactcagtaagtagcagcccatccacgagctcgactgcagccctgaacaccgccgcagccgctaaccccctcgctctgaaccctctgctgctcagcaatattctttatcccggtatgctgctgaccccaggcctgaacctgcacattccgactttgtcacagtcaaatacgttcgatgttcaaaacaagaactctgatttgggaagctctaagagtgtggaggtgaaagaggaagactcccggatcaaggatcaagaggataagggcggaaccgaaccctcacccctgaacgaaaactccacggacgagggtagtgagaaagccgacgctagttcagggtctgacagcacgtcatcttctagcgaagactccgactccagcaatgaagatta

SEQ ID NO: 53493 - DNA, 8648 bp, Artificial Sequence
  Description of Artificial Sequence: Synthetic coding sequence
atgactgaccctatgatggacttcttcgacgacgccaacctgttcggagagacattggagggactcagcgatgacgctttcgttcaacccggacctgtaagtctcgtggacgagctcaacctcggtgctgagtttgagcccctgcatatcgacagccttaatcacgtacaaggtacaccaacgcaccagaaaatgactgattttgagcagctgaaccagtttgattcgataaagttccaccacgttaatcagtcatttggctcacctgcggagcatgtcctttccccccactctcagttcaattgtagccctatacatcctcagaaccagcctaacggcctctttcccgatgtgtccgacggatcccctatgtggggccatcagacggccacaacaataagcaaccagaatggcagtccattccaccagcagggtcacagtcactctatgcaccagaataagtcctttgtcgcgcaccacgatttcgccctcttccaggcaaacgaacagcagacccagtgtacatcactgcgtagtcagcagaatcggaacaacctgaatcctgggcaaaattcattgagtcagtctaaaaatttcatgaacgtttccggaccgcacagagtgaatgtgaatcaccccccacagatgaccaatgcaagcaatagccagcagtcgatctccatgcagcaattttcccagactagcaacccatccgcccattttcacaaatgcagttcgcatcaggaaggtaatttcaacggcccatccccaaatatgaccagctgtagcgtgagcaactctcagcaattctcctctcactacagcttttccagcaaccacatctcccctaactcccttctccagagtagcgccgtccttgcctcaaatcacaccaaccagacactctctgactttactggttccaactctttttcaccgcatcggggaatcaaacaggaaagtacacagcacattctcaacccgaacactagtcttaatagcaacaacttccagattctccattcttcgcacccccagggaaactacagcaacagtaagctgtctcccgttcatatgaactttcctgatcctgtggattctggtactcaaatgggacattttaacgaccatgtcgagactaacgggttctctagccttgaggagaatctgctccatcaggtagagtcacagaccgagcctttcacaggcctcgacccagaggacctgcttcaggagggattattgccacatttcgatgaatccacctttggtcaagataactccagtcatatccttgaccatgacctggatcggcaattcacctcgcatcttgtaacccgcccttccgatatggcacagacccagctacaatctcaggctcggagctggcacagttcattctcaaaccaccagcatctgcacgatagaaaccacctgtgcttacaaagacaaccaccctcatcgaagaagagcgacggttctggcacctacactaagcttcagaacactcaggtcagagtgatgtccgagaagaaacaaagaaagaaagtcgagtctgagagtaagcaggagaaggcgaatcgcattatcagcgaggctattgccaaagcaaaggaacgaggcgagcgcaacatccccagggtgatgtcccccgagaattttcctaccgcctccgtcgaaggcaaagaggagaagaaaggtaggcggatgaaatctaaacctaaggataaggacagcaagaaaaccaagacctgctcaaagctgaaggagaaaactaaaattggtaaactcataattactctcgggaaaaaacagaaaagaaagaacgaaagttccgatgagatatcggatgctgagcaaatgccccagcacaccctcaaggatcaagattcacaaaagcgtaggagtaacagacagattaaaagaaagaaatacgccgaagatattgaggggaagcaatccgaggaagaagtgaagggatcgatgaagataaagaaaaattctgccccactccctggagagcaacctttacaattatttgtggaaaatccctctgaagaggatgcagctatcgttgataagatcctgagctctaggacagtgaaaaaggaaatctccccaggcgtgatgattgataccgaggaattctttgtgaagtacaaaaattacagctacttacactgcgagtgggctactgaggagcagcttctaaaagacaagcgaatacagcagaagattaagcggttcaaactgagacaggctcagcgcgcacatttcttcgctgacatggaggaggagccctttaacccggactatgttgaggtcgatagggtcttggaagtttctttctgcgaggataaagacaccggagagccggtcatctattacctggtgaaatggtgctcactcccctacgaagattcaacctgggagcttaaagaggacgtcgacttggctaagattgaggaattcgaacagctccaagcatcaaggcccgatacgagacggctggatagaccacccagtaatatctggaagaagatagatcagtcgagagactacaagaatggcaatcagctgcgcgagtaccagctcgagggactgaattggctgctgtttaattggtataaccgtcggaactgtatcctggccgacgagatgggcctcggaaaaacgattcaaagtatcacattcttgtatgaaattctgctcacaggcattcggggaccctttctaataattgccccactgagcacaatcgccaattgggaacgagagttccgcacgtggacggatatcaacgttgtggtgtaccacggttcactcatatccaggcaaatgattcagcagtacgagatgtactttcgcgactcccaggggcgaataattcggggagcctaccgtttccaagctattattaccacattcgagatgatactgggcggttgcggcgagttgaatgcgatcgagtggcgatgcgttatcattgatgaagctcacagactgaagaacaaaaactgcaagctgctagaagggctcaaactgatgaatctggaacataaggtactgctgactgggactcctctacagaatacagtggaggaactcttcagtctactgcacttcttggagcctctccgcttcccctcggaatccacctttatgcaggaatttggggatctgaaaacagaggaacaggtccagaagcttcaggccatcctcaagccaatgatgctccgaaggctcaaggaggatgtggagaaaaaactggcacccaaagaagagaccattattgaggttgagctcactaacattcaaaagaagtattatcgcgcaatcctggaaaaaaattttagctttctgagtaaaggtgcaggacaaactaacgtgccaaacctggtgaatacaatgatggagctcagaaaatgttgcaatcacccatacctgatcaagggcgctgaagagaaaatcctcggggagttcagagacacgtacaaccctgctgctagcgacttccacctgcaagctatgatccagtccgcaggcaagctagtcttaatagacaaacttttacccaaaatgaaggccggtgggcataaagtactaatctttagccagatggtcagatgcctggacattcttgaagactatttaatccataaacgatacctgtacgagagaattgacggcagagttcgtgggaacctcaggcaagcagccatagacagattctccaagccggactcggaccgatttgttttcttattgtgtacacgcgcaggtgggttagggatcaacttgacagccgctgatacatgcatcatcttcgactcagactggaatccccagaacgatctccaggcacaggcccgatgccacagaattggccaaaataaggctgtcaaagtctacagactggtcacccgcaacagctatgaacgggaaatgttcgacagggccagcctgaagctgggactggataaagccgttctacaaagcatgtcaggcagagagagtaacgttggtggtatccagcaattgagtaagaaagaaattgaggatctgctgcgtaggggcgcatatggcgctatcatggaagaggaggatgagggatcaaaattctgtgaggaagatatcgatcaaatcttgttacgcagaacaaagaccattacaattgagtcagaaggtagaggctccacattcgctaaggcctcctttgtggcttctggaaacagaacagatatcagcctggatgatcccaacttttggcagaagtgggccaagaaggctgagatcgatatagaagccatctcgggtagaaattcgctggtcatcgatacacccaggatacggaagcaaactcgtccgttctccgcgacgaaggacgagctggctgagctgtctgaagccgaaagtgaaggcgacgaaaaacctaagttgcggcgaccgtgtgaccggagcaacggctacgggaggacggagtgtttccgggtagaaaagaaccttctcgtctacgggtgggggaggtggcgcgagatcctgagccatggccgattcaagaggcagctcaatgaacacgacgtcgaaattatctgtcgtgccctgttagcctattgcctggtgcactacagaggagacgaaaaaataaagggtttcatttgggacctcataactccaacagaagatgggcagacgagggaattgcagaatcatcttggactgtctgcaccagtgcccagaggcaggaaagggaagaaagtcaaaacccagacaagcagtttcgacatccagaaagccgagtggcttcgcaaatataatcctgaacagctcttacaggatgaaggatacaaaaagcacattaagcaccactgcaataaagtgcttcttagggtgcgtatgctgtattacctgaaacaagaggtcataggcaacgagtgccagaaagtgttcgacggcgtagacgcctccgatatagacgtctgggtgccggagcctgaccactctgaagtgccagcggaatggtgggatttcgatgccgacaaaagtctactgattggcgtatttaagcacggttacgaaaaatataacacgattagagccgacccagccctgtgtttcttggagcgcgtgggtaaacccgatgaaaaggccgttgccgctgagcaacgcgctaacgactatatggatggcgacgtggaagaccctgaatataagcccgctcccgctattttcaaagacgatattgaggatgacgtctcctcccccggagacctcgtgatcgccgatggcgatggtcagcttatggagggtgacaaagtttattggcctacccaaagcgcgctcaccacgcgtctgcggcgtcttatcacagcatatcagcggacgaacaaaaatcggcagatccagcaaattcagcctacattctctgtgcctacatccgtaatgcagcccatatacgaagaagccacactgaaccctaagatggcagcaaaaatcgagcgtcagcagagatggacgaggcgcgaggaagctgacttttaccgggtcgtctcaacattcggcgtggttttcgaccctgatcgcggacagttcgactggacaaagttccgcgctatggccaggctgcacaagaaaacggatgatagtctagagaaatacttatatgcatttatgtctatgtgtagaagagtgtgtcggctaccaagtaaagaggaactggtggatccgaatatctttattcagcccatcacagaagagcgtgccagtcgcacactgtatcgaattgaactgctgagaaaggtgagagaacaggccctgagacatcctcagctctttgaacgtctaaagctatgccaccctaatccagacttgccagtatggtgggagtgtggacctcacgaccgcgacctactcatcggggcagcaaagcacggggtttcgcgcaccgactatcatattcttcgcgacccagagttatctttcatggccgcacagcgcaattattctcagagcaagatggctcactctcgcacaagtacccccctactgcagcaataccaggttgcccttagtgcttcacctctgaccagtttaccgagattattggacgccaaaggcatcatcctggaggagatgaaggtgaaatccgagaacttaaaggaagagccacagagtagtgaagaagaatcaatgtcctcagttgagacccggacccttattaaatctgagcccgtatctcccaaaaacggggttttaccgcaggccacaggcgatcaaaaaagcggtggaaagtgcgaaaccgatcggcgtatggtggccgcacggaccgagcccctgacccctaacccagccagcaaaaagccacgggtgcacaagcgcggatctgagagctctagcgattccgactctgactcagagagatccagttgctcttcacgttcaagttcttcctcaagctcctcctcatgctctcatagtagatccggttcctcgagtagtagtagctcgagctgcagcagcgcatcttcttcatcatccagcagtacatcaagctcaagctcatccagttcatcatcctccgaagaaagtgattcagacgaggaggaggcccagaagagggccgagagtaccactcacatgaaagcttacgacgaggagtccgtggctagtctcagtactacccaggacgagactcaggacagtttccaaatgaacaacgggacccccgaaagtgcctacatcttgcaaggagggtatatgctcgcagcgagttactggcctaaagacagggtaatgattaaccgactggacagcatctgccaaacagtcttgaagggcaagtggcctagcgctcgacggagctatgacgccaacaccgtagctagtttctacacgaccaagctcctggactctcccggtgctgccactgaatacagcgatccctcagttcctactcctccgggagcgggagtcaaagaggagcatgatcagtccactcaaatgagcaaagagggtggactgaagctgacttttcagaaacagggcctggcccagaaacgcccttttgacggtgaggatggggctctcggacagcagcagtatctgacccgactcagagaattgcagagcgcttctgaaacatccctcgtgaatttccccaagtcgattcccgtttccgggaccagtatccagccgacgttaggtgccaacggagtgatcctggataatcagcctatagtcaaaaagcgcagagggagacggaagaacgtggagggtgttgatatctttttcttcaataggaacaagcctccaaaccatgtaagcctgggcttaaccagctcccagattagcacaggtatcaatcccgcactgagctacacacagcctcaaggcattcccgatactgaatcacctgtgcctgtgataaatctgaaggacgggaccaggctcgctggagacgacgctcccaaacgtaaggacctcgaaaagtggttgaaggaacatcccggttatgtggaagacttgggtgcatttatcccacgtatgcagctgcacgagggaaggcccaagcaaaaacggcatcgctgtcgcaaccccaataaactggatgtcaactccctaactggagaagaacgtgtgcaactaatcaatcggcgaaatgcaagaaaagtgggtggcgctttcgcccctccactcaaggacctgtgccgatttctcaaagaaaactccgaatatggtgtggcgcctgaatggggtgatgttgttaaacagtctggcttcctccccgagtctatgtatgaaaggatacttacgggacctgtcgtgagggaggaggtgtcgagacgcggaagacggcctaagtccgggattgcaaaagctactgctgcagcagcagccgcatctgccacctcggtcagcgggaatccgttactggccaatggattgctgcctggcgtagatttgaccacgctacaggcattgcagcagaatctgcagaacctccagagcttgcaagtgaccgctggcctcatgggaatgcctacaggcctgccttcagggggagaagccaaaaatatggctgcaatgtttcctatgcttctgagtggcatggccggactgccaaacctactgggaatgggagggttgctcactaagccaaccgagtccggcaccgaggataaaaaggggtccgattcgaaggaatccgaagggaaaactgagcgcaccgagtcccagtcctcggagaatgggggtgagaactccgtatcttcatcacctagcacctcaagcacggccgctctgaacactgccgcagccgctaacccactggcactgaaccctctgttactcagcaacatcctgtatcccggtatgctcctgactccaggcttaaaccttcatatcccaactttgtcccagtctaatacttttgatgttcagaataagaattcagacctggggagttccaagagcgtggaggtgaaagaggaagactcaaggataaaagaccaagaagacaaagggggaactgaaccttcacctctaaatgaaaattctacagatgagggcagcgagaaagccgacgccagtagcggaagtgacagcacttcatcaagcagtgaggactcagactcatctaacgaggacta

SEQ ID NO: 53494 - DNA, 2892 bp, Artificial Sequence
  Description of Artificial Sequence: Synthetic coding sequence
atgttgtactatcttaaacaggaggtcattggaaacgaatgccagaaagtgttcgacggggtagacgccagcgatatagacgtgtgggtccctgagcctgatcatagcgaggtcccagcggagtggtgggacttcgatgcagataagagtctgctgattggcgtgttcaagcacggctatgagaagtacaacaccattagagccgaccccgctctgtgctttttagagcgagtaggcaaacccgacgaaaaggccgtggcagccgagcagcgggcaaatgattacatggatggagatgttgaagaccccgagtataagccagctcccgctatctttaaggatgacatagaggacgacgtctcgagcccaggcgatttggttatcgcagacggggacggccagttaatggagggcgacaaggtgtactggccaacccaatctgctctgactactcgcttacgcagactgataaccgcctaccagaggacaaacaagaaccggcaaatccagcagatccagccgaccttcagcgtgccaacgagcgtaatgcagcccatttacgaggaagctacccttaatcccaagatggccgctaagattgagaggcaacagaggtggactcggcgtgaagaagctgatttctacagggtggtctcaacgttcggggtggtgtttgatccagatcgcggacagtttgattggaccaagttccgggcaatggctagacttcataaaaagaccgacgactctcttgaaaaatacctgtatgcattcatgagcatgtgtcgaagagtctgcaggttgccatctaaggaggagtccacaacccacatgaaagcttatgacgaagagtcagtcgcttcactgtcgactactcaggacgagacacaggactcttttcagatgaataatggcaccccggagagtgcatatattctgcagggcggatacatgctggctgcctcatattggcccaaggatagggttatgattaacagactggatagcatttgccaaaccgtgctaaaagggaagtggccgagcgccagaaggagttatgacgctaacacggttgctagtttttatacaaccaagctgcttgactccccaggggcagccactgaatactccgacccctccgtcccgactccacctggcgctggggttaaagaggagcacgatcagtcgacccagatgtccaaggtcaagaagcatgtcagggagaaagaattcacagtgaaaattaaagatgaggggggtcttaaactcacttttcagaagcaaggactcgcccagaagaggccattcgatggggaggatggggcacttggccagcagcagtacctcacccggctgagggagctgcagagcgcttctgagacttccttggttaacttccctaaatctatcccggtcagcggaacaagtatccaacctacactgggggctaacggggttattctggacaaccagcccatagtgaagaagaggcgcggtagaagaaaaaacgttgagggcgtggacatatttttctttaaccgaaataaacccccaaaccatgtgtctctgggactgaccagtagccaaatctctaccggcattaatccagctttaagctacacgcaaccccaggggatccctgacacagagtctccagttcccgtcattaaccttaaagacgggacccgccttgcaggtgacgacgcacccaaaagaaaagacctggaaaagtggctcaaagagcatcccggttacgttgaggacctaggcgcatttatcccccgaatgcagttgcacgaaggcaggcctaagcagaagcggcacaggtgcaggaacccaaataagttggatgtgaattccctgacaggggaggagcgggttcagctgataaatcgaaggaacgctcggaaggttgggggtgcctttgcccctcccttaaaggacttgtgtcgttttctcaaggaaaacagcgaatacggggtggctccggagtggggtgatgttgtcaagcagtcagggtttctgccagaaagcatgtatgagcggattctgacaggaccagttgtgcgcgaggaagtgagcagaagaggccgaaggccaaagtccgggattgcaaaagccacagccgcagccgctgctgccagcgcaacatctgtaagtggaaaccctctgttggcgaacgggcttctgccaggagtggatctgacaacacttcaagcattacaacaaaatcttcagaatttgcaatccctgcaggtcacagccggactgatgggaatgcccaccggattgccctctgggggagaagccaagaacatggccgctatgtttcctatgctgctcagcgggatggctggactccctaacctgttggggatgggcggactccttaccaagccaactgaatctgggactgaagataagaagggcagcgattccaaggaatctgaaggtaagacagagcgcacagagtctcagtctagtgaaaacggaggcgagaattccgtgtcctccagtccgtccacctcaagtaccgcggcactgaataccgccgctgccgctaaccctttggctctgaacccactgttgcttagcaatattttgtaccctggtatgctactgactccgggacttaatctgcacataccaactttgagccagtccaacacgttcgatgtccagaataagaactcggatctgggctcgagtaagagcgtagaagtcaaggaggaggatagtcgcattaaggaccaggaggataagggcggaacagagccctctccacttaacgagaactccacagatgaaggcagcgagaaagccgacgcctccagtggtagcgatagtacatcttccagctccgaggactcagatagttcaaacgaggactag

SEQ ID NO: 53495 - DNA, 8645 bp, Artificial Sequence
  Description of Artificial Sequence: Synthetic coding sequence
atgacagacccaatgatggacttcttcgacgatgccaatttgtttggcgagacattggaagggctgtccgacgacgcttttgttcaacctgggcctgtgtctctggttgatgagctgaacctgggcgcagaatttgagcccctgcatatcgactcattgaaccacgttcaggggacccctacgcatcagaagatgactgacttcgaacaattgaatcagtttgacagcatcaagttccatcacgtaaaccaatcgttcggatcccctgctgaacacgtgctgtcgccccacagccagttcaattgtagcccgatccatcctcagaatcaaccaaatgggttatttccggacgtgtccgacggctcacccatgtggggacaccaaacagctacaacgatttccaaccagaatggttctccattccaccagcaggggcatagtcacagcatgcatcagaataaatccttcgtcgctcaccacgactttgcactattccaggctaatgagcagcaaactcagtgcacctcactgcggagccagcagaacagaaataatctgaaccctggtcaaaatagcctgagccaatccaagaactttatgaatgtgtctggaccacaccgagtgaacgttaatcacccccctcaaatgaccaatgcttccaattcccagcagtccatcagcatgcagcagttctcacagaccagtaatccctcagctcatttccataaatgttcatcccatcaggaaggaaactttaacgggccttctcctaacatgacctcgtgttcagtgtctaacagtcagcaattctcctcccactattcctttagctctaaccatattagtcccaattctctcctccagtcatcggctgttctagcctctaatcatacaaatcagactttgtctgacttcaccggtagcaattcattttctccccatcgcggaattaaacaagagtctacacagcacattctgaaccccaatacatctcttaacagtaacaattttcaaatcctgcacagttcacacccccaggggaactacagtaactctaagctgagtccggtccacatgaattttcctgaccccgtcgattctggcactcagatgggtcactttaacgaccatgtcgaaaccaacgggttcagctcactggaggagaacctgctgcatcaggttgagtctcagacagagccatttactggcttggaccccgaggatctgctccaagaggggctcctgccccattttgacgaaagcacatttgggcaggacaattcctctcatatactcgatcacgatctggaccggcagttcacctcccatctggtgactcgcccatcagatatggcgcagacccagctgcaatcacaagccagaagctggcacagttccttttccaatcaccagcaccttcatgataggaatcacttgtgcctgcagaggcagcccccttccagtaaaaaaagtgacgggagcggcacctacacaaagctacagaatacccaggtgagagtgatgtctgagaaaaaacagagaaagaaagtcgagtccgagtcaaaacaggagaaggccaacagaattatatcagaggccatcgctaaggcgaaagagcgcggagagcggaatatcccgagagttatgtcgccagagaattttcccaccgcctcagtggaaggaaaggaggaaaaaaaaggtcggaggatgaaaagcaagccaaaggataaggattctaaaaagacaaagacatgctcaaagctgaaagaaaagaccaagataggtaagttgataattaccctgggaaagaagcagaagcggaaaaacgagagtagtgacgaaatctcagatgctgagcagatgccccagcacaccttaaaggaccaggatagtcaaaaacgccgaagtaatcggcaaatcaagcggaaaaaatacgcagaagatatagaaggtaaacaaagtgaagaggaagttaaggggtcgatgaagattaaaaagaactctgctccccttcccggtgagcagccgctccaattgttcgtggaaaatccttctgaggaggatgctgccatcgtggacaagattttgtcttctcgcaccgtcaaaaaggagatttctcccggagtgatgatagacactgaggaatttttcgtcaaatacaagaactactcttacctgcactgtgagtgggctacagaggagcaactgctgaaagataagcgaatccagcagaaaatcaagcgtttcaagcttcgtcaagcacagcgagctcacttcttcgccgacatggaggaggagcctttcaatcctgattacgtggaggtcgacagggttttagaggtatctttttgcgaggacaaggacacaggcgagcctgtgatctactatttagtgaagtggtgctcactgccatacgaggatagtacttgggaactcaaggaggacgtagacttagcgaaaatagaggagtttgagcagctccaagcctcccgcccagacacacggcgactggatcggcctccatcgaatatatggaagaagatagatcagagccgcgattacaagaatggcaaccagctcagggaatatcagctggagggactcaattggttgctgtttaattggtacaatcgcaggaactgcatcctggccgacgagatgggtctggggaagaccatccagtcgatcacctttctgtatgagattttgctgactggcatcaggggcccattcttgatcatagcacccctgtccacaatcgcgaattgggagagagagttccgcacatggacagacattaacgtcgtcgtctaccacgggagcctgatttctaggcagatgatccagcagtatgaaatgtacttccgggatagtcagggcagaatcatcagaggagcgtaccgttttcaggctattatcacgacctttgaaatgatcctgggcggatgcggagaactcaatgccattgagtggcggtgtgttatcattgatgaagcccataggctgaaaaacaaaaactgcaagctgcttgaggggcttaaactgatgaatctcgaacacaaggtacttttgacaggtaccccactgcagaatactgttgaagagctctttagcttattgcacttcttggagcctcttcgcttcccgtctgaatccacattcatgcaggaatttggagatctcaagacggaggagcaggtacagaagctgcaagcaattctaaagcctatgatgctgcggaggctgaaggaagacgtggagaagaagctcgcacccaaggaagagaccattatcgaggttgaactgaccaacatccagaagaaatattaccgtgccatattagagaagaatttttccttcctgagtaaaggtgcagggcagacaaacgtccccaacttagtaaacactatgatggaactaaggaaatgctgcaatcacccttacctgattaagggtgccgaggaaaagatattaggagaatttcgggatacgtacaaccctgctgcttccgattttcatttgcaggcaatgatccagtctgcgggaaaacttgtgctgatagataaactgctgcctaagatgaaagccggtggccataaagtgctgatcttttcgcagatggttcgatgtctggatatcctggaggactatctcattcacaaacgatatttatatgagcgaattgacgggagagtcagaggcaatctacggcaagcggcaatcgacagatttagcaaaccagacagcgacaggttcgtcttcctgttgtgcacacgggcaggcggattgggaattaatcttacggctgccgatacctgcattattttcgattccgactggaatccccagaacgacctccaggctcaggctagatgtcacaggatcggacaaaataaggcagtcaaagtctaccgattggttacgcgcaactcttacgagcgcgaaatgtttgaccgcgcttctttgaagcttggcctcgacaaagccgttctgcagagtatgtctgggagggagagtaacgtgggcggaatccagcagctctcaaagaaggagatagaagatctgttacgtcggggtgcctacggagcaattatggaagaggaggatgagggttctaaattttgtgaagaagatatcgatcaaatactgcttagaagaaccaaaaccatcaccattgagtccgagggacggggttccacattcgctaaagcttcatttgtggcatccggcaatcgaacagacatcagcttggatgacccgaacttttggcagaaatgggccaaaaaggctgaaatcgatatcgaggctatctccggccgaaatagtttagtcattgacacgcctagaattcgaaaacagacacgcccatttagtgccaccaaagacgagttggccgaactgtctgaggcggagtccgagggggatgagaagcctaagttaaggagaccttgcgatcgctcaaacgggtacggacgtacagaatgctttcgcgtggagaaaaacttacttgtttatggctgggggcgatggagggagatcctgagccacggacggtttaaacgccagctaaacgaacatgacgttgaaattatctgccgagccctgttggcttattgcttggtgcactatcgcggagacgagaaaatcaaaggtttcatctgggacctgattacccctacagaggacggccaaacaagagaattacagaaccacctgggtctctctgccccagtgcctagaggtaggaaaggaaagaaagtgaagacccaaacaagctccttcgacattcagaaggcagaatggttgcggaaatataaccccgagcagctccttcaggatgagggatataagaaacatataaaacaccattgcaataaggtccttctacgtgtgcgcatgctctattaccttaagcaggaagtgatcggcaatgagtgccagaaagtgttcgacggggtggatgctagcgacatcgatgtgtgggtgcctgaacccgaccacagtgaagtgccagccgaatggtgggactttgatgcagataaatctctactgataggcgttttcaaacatggctatgagaagtataacacaatcagggccgaccccgcactctgcttccttgagcgagtaggaaaacctgatgaaaaggctgtcgccgctgaacagcgggctaacgactatatggatggagacgtcgaagaccctgaatacaagcctgctcctgccatcttcaaagacgatattgaagacgatgtgagctcgcctggggatcttgttatcgccgacggcgatggtcagctgatggaaggggataaagtttattggccaacccagtccgctctgaccacacgcctccggaggctgattacagcttaccagcggacgaataagaatagacaaatccaacagatccagccaaccttttccgtacctacttcagtgatgcagcctatatacgaagaggccacgttgaaccccaagatggccgcaaagatcgagcgccaacagcgctggacacgccgagaggaggctgacttttacagggtcgttagcacattcggagtggtcttcgacccagacaggggacaatttgactggacaaaatttcgggcaatggccaggttgcataagaaaaccgacgattctttggagaagtatctctatgcctttatgtctatgtgtcgccgagtatgcaggctcccctctaaggaagagcttgtggaccccaatatcttcattcagcctattacagaggagagggccagcaggactctctacagaatcgaactgctgcggaaggtaagggagcaggccctcagacatccccagttgttcgagcgtctcaagttgtgccacccgaacccggatctgcctgtgtggtgggagtgcggcccacatgatcgggatctcctgattggcgctgcaaaacacggagtgtctcggacggactaccatatcctcagagatccagagctttctttcatggccgctcaacgtaattactcccagagtaaaatggcccattccaggacctccactccgctgctgcagcagtaccaggtggcactgtccgcaagtcctctcacctcactacctcgcttgctggacgcaaagggaattatcctggaggagatgaaggtgaagagcgagaatctgaaggaagaaccacagtcttccgaagaagagtctatgagcagtgtggaaacacggaccctgattaaatctgagccggttagtcccaaaaatggcgtgctgccacaagcgactggggatcagaaatcggggggtaagtgcgagactgataggagaatggtggcagcgagaaccgaacctttgacccctaaccccgcttccaagaaaccacgcgtgcataagcgaggtagtgagagcagctcagattccgactccgattccgaaaggtcgtcatgcagtagtaggagcagctcaagcagctcctcctcttcctgttcacactcacggtcagggtcgtcgagtagttcctcctcctcgtgttcaagcgcatctagctctagctccagttccacctccagcagcagttcttcttcatctagtagctcggaagagagtgactccgacgaagaggaggcacaaaagagagagtcgacaacccacatgaaggcctatgatgaggagtctgtcgcctcactttctaccacccaggacgaaacccaggatagtttccaaatgaacaatggcacaccagagtctgcgtatatcttacagggaggttatatgctcgccgcaagctactggcctaaagatcgcgtcatgatcaaccgcttagatagcatttgccagacagtcctcaaaggaaaatggccatccgctaggaggtcctacgacgcaaatacagttgcgtccttttatacaacgaaactgctcgacagccctggagcggctaccgaatacagtgaccctagcgttcctacacccccaggcgcaggggttaaggaggaacacgaccagtcgactcagatgagcaaggaaggagggcttaaactgacattccagaaacaggggctcgcccagaagcgcccttttgatggggaagacggggctctggggcagcagcagtatttaactagattgagggagctacagtctgcaagcgagacttccctggtcaatttcccaaagtcaatccccgtttctggcacgtcaatacagccaacgctgggagcaaacggggtgattctggataaccaacccatcgtaaaaaaaaggcgcggaagacggaagaatgtcgaaggggtggatatcttcttctttaaccggaataaacctcctaatcatgtgagtctgggccttaccagctctcagatttcaacgggcattaatcctgcgctgagctacactcagccccagggcattccagacacagaatccccggtaccagtgatcaatttaaaggatggtacaaggctcgcaggcgacgatgctccaaagaggaaggatcttgagaaatggctgaaggagcatcccggatatgtggaggatctgggtgcctttattcccagaatgcaacttcacgaaggtagacctaaacagaaacggcacagatgcaggaacccaaataagttggatgtgaattccctgactggcgaagagcgggtgcagctgattaacaggcggaacgctagaaaggtcgggggagcctttgctccacctttgaaggatctttgcaggtttctgaaggagaattcagaatacggcgttgcacctgagtggggggatgttgtcaaacagtccggtttcctgccagaaagcatgtatgagcgaattctaaccggccctgtagtgcgggaggaagtgtcacggagaggcaggcgccctaaaagcggcattgcaaaggcaacagcagcggcagcagcagcttcagcgaccagcgtaagtggcaaccccttgttagccaacggtttgctccccggtgtcgaccttaccacactgcaagctctccagcagaacctacagaacctgcagagcctccaggttacggctggactgatggggatgcctaccggcctgccaagcggaggagaagcgaagaatatggctgccatgtttccgatgctgctgtccggtatggcagggctgcccaatctgttgggcatgggagggctgctcacaaaaccaactgaatccggtactgaggacaaaaagggcagcgattctaaggagagcgagggcaagacagagcgaacagaatcgcaaagttcagaaaacggaggggaaaactctgtgtccagttccccatcaaccagcagcacagctgccctgaacaccgcagcggcagcaaatcccctcgccttaaaccctctgctgctgtccaacattctctatccaggaatgttgttaactccaggcctgaatctgcatattcccactctctcccaaagtaacacattcgatgtacagaacaaaaactctgatttgggaagctcgaaatcggtggaggtaaaggaagaggactccaggatcaaggatcaagaagacaaaggcggaaccgagccatcccctctgaacgagaactccaccgatgaaggcagcgaaaaagccgatgcctcctccggatccgacagcacctcttccagcagcgaggactcagactcgtctaatgaggatta

SEQ ID NO: 53496 - DNA, 444 bp, Artificial Sequence
  Description of Artificial Sequence: Synthetic coding sequence
atgacagccattaggcttcgggaattcatcgaacgtagaccagtgattccccctagcatcttcattgcacatcagggacgagatgtccaggggtactaccctggccagctagctcgtcttcacttcgaccattcagctaagcgggcacccagacccctgatcgacttgacgatcccccctaagacaaaatatcattatcaaccgcagctggaccagcagacacttatccgttacatttgcctgcgccgacatagtaagccggcagaaccctggtataaagaaacaacctaccggcgagactattctttgcccttctacgaaatcgactggaaccagaagttggctacagtcagtctcaaccccaggccactcaatagtttgcccgagctttattgttgtgaggaacgaagctcttttgagagaaatgccttcaaattgaagtag

SEQ ID NO: 53497 - DNA, 348 bp, Artificial Sequence
  Description of Artificial Sequence: Synthetic coding sequence
atgactgcgatccgacttagggaatttatcgagagacgccctgtcatcccaccttccatattcattgcccaccaaggcagagacgtgcagggctactatcctggccagctcgcccgactgcacttcgatcactccgccaagagagccccacgtcatagtaagcccgcagagccgtggtataaggaaacgacatacagaagagactacagtctgcccttttacgaaattgattggaaccaaaagttggctaccgtttctcttaacccgaggcctttgaactcactgcctgagttgtactgttgtgaagagcggtcatccttcgaacggaatgccttcaagctaaagtag

SEQ ID NO: 53498 - DNA, 552 bp, Artificial Sequence
  Description of Artificial Sequence: Synthetic coding sequence
atggaaaagcgggagcttaaggcgtcggtgccgaagtttgataagatcccctggctgagtgaagcaagcctggtgaacaagccattggtattgtcgctgccgcgacgttacccgcatacaagcgcaacgtttctgacctcgtctaagaagaacatgaatctgccgatcctgttccaagttccggacgttctgtcaaaagcccgacgtaaccaatgcgactcaatgctcctgaggaatcaacaactctgctccacctgccaggaaatgaaaatggtgcagccaagaactatgaagatccccgacgaccctaaggcaagctttgaaaactgcatgtcatataggatgtccttgcaccagcctaagttccagaccactccggaacctttccatgacgatattcccaccgaatctatccattaccggttgcccatactgggccctcgcacagctgtctttcatggactgctgactgaggcttacaaaacactcaaggagcgtcagagaagcagcttgccaagaaaagagccaattggcaagaccacccggcagtag

SEQ ID NO: 53499 - DNA, 1992 bp, Artificial Sequence
  Description of Artificial Sequence: Synthetic coding sequence
atgctgcaaatgcccaagcttaacgaaattccgcctggacgggctggcagacgagaggctagaggcgaaggacgttggcccggacagactggccctgaagccgcaagacttgaatggcgagcccaggggcaagcgggtggcgctcgcgcaccgtgggatagctggggcagtagccgtctgcctacccagcctggacccggatggtcaaggtgcccaccgtcactgttgtgcgctctgagctttcagaaaagcacaatggagtccaaagatgaggtgagcgacaccgatagcggcattatcttgcaatccggaccagattcgccagtgagtcccatgaaagaactgacccatgctgttcacaagcagcaaagggcccttgaggcacggctggaagcttgcctcgaagagctgcggagactatgtcttcgggaggccgaacttaccgggaccttacctgccgagtaccccctgaagcccggtgagaaggcacctaaagtgagaaggaggattggcgcagcctacaagctggacgattgggcccttcaccgtgaggaccctctgagctccctggaacgacaactggccttgcagctgcagatcaccgaggcagccaggagactttgcctggaggagaacctctcaagacaggcccgacgccaacgcaaacactccatgctccaagaggagaagaaacttcaggaactccaacggtgtctggttgaaaggcggagaaattctgagccccctcccgctgctgccctccccctggggagagagttgtctgccagcgatgatagctcactcagcgatggactcctcttagaggaagaagaaagccaggtccctaagccacctcctgagagcccagctccaccctcgcggcctctccccccacagactctggagggacttcaacctaccggccctgaggccggttctccggagagagccccagtacaaaactcgccgtggaaagagacttctctcgaccacccttatgagaagcctcggaaaagctcagagccttggagcgagagtagtagcccggctactacaccacaggatggtccatcggcatcctctctgtggttgctggaacccgcatcttaccacgttgtaccaatcagaggagtgcctggccaatggcagggcaggacaagcgccccagcaacacccgagatccaaggcagaagagggcagtcccaatccttacgggtggactcattcagagccggtccggaaggacgcggaaggtccgcatttccgcgacgtcgcccaacacactataccgtcacagtgcctgactcctgtttccccgctactaagccaccattgccccatgctgcctgccattcatgttcagaggatagcgggtcagatgtatcctccatatcacatccaacttcccctggcagctcatcccccgatatttcattcctgcagccgcttagtccacccaagactcacaggcatcgcggagcctgggtgccagcgggttctcgtgaactggtggcccatcatccaaaactgctgttgcctccagggtacttccccgcagggaggtatgtagtggtggccgaatccccgctgccaccaggagagtgggagctccgccgagctgcccctggacccgcatatgaggaggaaggaacccccctcaggtaccaaaggctggttccttccaggtcccgcatcgttcggaccccttctcttaaggacagccctgcagggaggggccttagtaaagcagcagtcagcgaagagctcaagtggtggcatgaacgcgcacgactccggagtacaaggccgcacagtttagatcggcagggggcattcagagtgaggagcctgcctttaggcagggagggattcggacgcgctctaggcccacgcgctcaggtgccaactgtctgcgtcctgcgaagaagccctgacggggcaccagttcaagtgtttgtacccgagaagggtgaaatcatttctcaggtctag

SEQ ID NO: 53500 - DNA, 1737 bp, Artificial Sequence
  Description of Artificial Sequence: Synthetic coding sequence
atggagtctaaggatgaagtgtccgatacagactccggaattatattacagagtggccctgatagcccggtctcgcccatgaaagaacttactcacgcagtccataagcaacaaagggcactggaagcgcgactggaagcttgtctggaggagctgcggcgtctctgcctgagggaagccgaattgacaggcaccttaccagcggaatacccgctgaaacccggagaaaaagcaccaaaggtgcggagaagaattggcgcagcatacaagttggacgattgggccttgcatagagaagatcccctgagctctttggagaggcagctggcattacagctccagattacggaagccgcacggcgtctctgtcttgaggagaacttatcgcggcaagctaggcgtcagaggaagcattcaatgctacaggaggaaaaaaaactacaggagctgcagcgctgcctcgtcgagcgcagaagaaattcagagccacctcccgcagctgccctaccgcttggacgggagttgagcgccagcgacgatagctcgctgtctgatgggttactcctcgaagaagaggagtcacaggtgcctaagcctcctcctgaatcccctgcccctccaagtagaccgttgccaccccagactctggagggactgcaaccgacaggtccagaggcaggctcacctgagagagcccctgtccagaacagcccgtggaaggaaacaagcctggatcacccttacgaaaagcctcgaaagagtagtgagccctggagcgagagttcctcccccgcaacaacgccacaggacggtcccagcgcttcatccctgtggctgctggaacctgcctcttatcatgtagtacccattcggggagtgccaggccaatggcaaggaaggacctctgcccctgcaaccccggagatccagggcaggaggggacaatctcaaagcctccgcgtggattcttttcgggctggaccggaagggaggggtcgcagcgcattcccacgaaggcgcccaacacattatacagtaaccgtgcctgactcatgcttccccgctacaaagccaccgctgcctcatgccgcttgtcacagctgctccgaggatagcgggagcgacgtcagtagtatttcccaccccacttctcctgggtcatccagtccggacatctccttcctgcagccgctgagtccgcctaagacgcacaggcacaggggagcgtgggtacctgcgggatccagagagttggtagcccatcacccaaagctcttgctgcccccaggctactttccagctggacgctatgtcgtggttgcagaaagtcccctgcccccaggtgaatgggagctgcgccgtgcagcccctgggccagcctacgaggaggaggggacacctcttcgctaccaaagacttgtgcctagtcgaagccgcatcgtgagaacacctagcctcaaggattctcccgctggaagaggcctgagcaaagccgcagtctcggaggaactgaagtggtggcacgaacgagctcgtctgagaagtacacggcctcactccctcgatcgccagggggctttcagggttcgctcactaccccttggaagggagggattcggacgtgctctgggaccccgagcccaggtgcccacagtgtgtgtgctgaggcgttcgcccgatggtgctccagttcaggtttttgtaccagagaagggggagataatctctcaggtctag

SEQ ID NO: 53501 - DNA, 372 bp, Artificial Sequence
  Description of Artificial Sequence: Synthetic coding sequence
atggagtctaaggacgaagtgtccgacactgacagcgggatcatactgcagagcggaccggactcccccgttagccccatgaaggaattgacacatgcagttcataaacagcaacgggcacttgaggccaggttggaagcatgcctggaggagttgcggcgattgtgcctcagggaggccgaattaacgggtaccctccccgcagagtacccacttaaaccaggtgagaaggctccaaaagtcagacgcaggataggagccgcttacaagctggacgattgggcattgcacagggaggatcctctttcttcccttgaacgccagttagctttacagctccagattacagaggccgcacgtcgtctgtgctag

SEQ ID NO: 53502 - DNA, 123 bp, Artificial Sequence
  Description of Artificial Sequence: Synthetic coding sequence
atggagtccaaggatgaagtgtcagacacggattctggtatcatccttcagtctgggccagattctccagttagccccatgaaggagctcacccacgccgtccacaaacagcagagggcatag

SEQ ID NO: 53503 - DNA, 612 bp, Artificial Sequence
  Description of Artificial Sequence: Synthetic coding sequence
atgacccaggaccgccctttgctggccgtgcaggaggccctgaagaaatgctttcctgtggtggaagagcagcagggcctctggcagtctgccctacgtgactgccagccgctgctgtcctccctctccaacttggccgagcaattacaggcggctcagaaccttcgattcgaggacgtgccagcccttagagcatttcccgacctgaaggagcgccttcgaagaaagcagctcgtggcaggtgacatcgtgctcgataagctgggagagagattggccatcctgctcaaggtgagagacatggtgtcatcacatgttgaacgggttttccagatatacgagcagcacgcggataccgtgggcatagacgccgtactgcaaccgtcagccgtgtcccctagtgtggccgacatgctggaatggctgcaagacatcgagcgacattaccgtaagtcctacctgaagcggaagtacctgctcagctctattcagtggggcgatttggccaatattcaggctcttccaaaagcctgggatcgcatctctaaagacgagcatcaagacctagtccaggacatcctgcttaacgtgtcatttttcctggaagagtag

SEQ ID NO: 53504 - DNA, 909 bp, Artificial Sequence
  Description of Artificial Sequence: Synthetic coding sequence
atggaacgtcacatggtgcgagggcagttatataagcactttgaccttgagagaaaaaatgctaagcaggctgaggcccgacttgatcagagactgcagaggcttaaagttatatgcctgtatcacgtcaagctgctaacctgggagcagcgccagttacagaaggagctgcagagactgcaacaggccgagaccatgaagaagaaattctctagttatctgggaaacgggtttcagaagcggcctgaagacgtcttggtcttctcaccacaggggaggcaaaaacaccgagcacctcaggctaaaaagatgagggctctggccacacgaatggcccaggacacttgtaaaagcaaatcacaggtcccaccaagccacgacgccggactaaaggacccaatgaagtcgaaaaaacaaccactttcgcagaacaaccgcacagcatgcttcatcaaagagcagcctcaggcccaggagaaagatagcgtcaacccctctaaagatgtggacccttcaaagggaatatcagtgccgtgtcagaatcaggaggtgtccacaaatacaattgagcaagggcctagcagcagccccgcatccgactccggcatggcttgcgccgatgagacaaggtccaaggacgtggctcttaagcctgatggaaatacaggtaaacaaattcctccaaagcatatggaatgtgctggctccttcgaaggcgagttcaccaaacccaccttcctggaacttttatcaaaagcacggaacgctcattaccttaggcaccgagtccccccagagtcagagcgactcttaagcatcggtgagatctttggacacggtgaatcttcaagtagccgagccggtaaagagtgcgagaatcgagtcccgagcaagttcctccctctttag

SEQ ID NO: 53505 - DNA, 708 bp, Artificial Sequence
  Description of Artificial Sequence: Synthetic coding sequence
atggtcaggggtcaactctacaaacactttgacctggagcggaaaaatgccaagcaggcggaggcccgactggaccaacgattacagagactgaaggtgatatgtctgtatcatgtaaaactcttgacctgggaacagagacagctacagaaagaactccagcgtctgcagcaggagacaatgaaaaagaagttttctagctacctgggaaatggatttcaaaagcggcctgaggacgtgctcgtattctctcctcaagggaggcaaaaacaccgcgcaccacaggccaagaagatgcgggctttggcaacaaggatggcccaggacacttgcaaatccaagtcccaagttcccccttcccatgatgccggtctgaaggatcctatgaagtcgaagaaacagcccctttcccagaacaaccgaaccgcttgctttattaaggaacagccccaggcacaagaaaaagattcagtgaaccccagcaaggacgtcgacccatcaaaaggaatttccgtgccgtgtcagaaccaggaggtttcaaccaatacgatcgaacagggacctatatctagcgcccaaccactcgcctttaatggagaaacaatactgtatagcgagcgcaatactaggaacctcctcccacctacactgagtagcatgaagcagagcaaccgcggaaggcaggctattagcgataggaccgactag

SEQ ID NO: 53506 - DNA, 786 bp, Artificial Sequence
  Description of Artificial Sequence: Synthetic coding sequence
atggagaacttttcccttctcagtatatcaggtccccctatctcatcgagcgcactgagtgcatttcccgatatcatgttcagcagagcgacaagcctacccgatattgccaagactgctgtgccgactgaggcaagctcaccagcccaggcgctcccaccacagtaccagtctataatcgtcaggcaaggaatccaaaatacagccttatcacccgattgttctctgggagacactcagcacggcgaaaagctacgtaggaattgcacgatttaccggccttggttttctccttactcctatttcgtgtgcgccgacaaagaatctcagttagaggcttatgactttcccgaagttcagcaggacgaagggaagtgggacaattgcctgtcagaggacatggccgaaaacatatgtagttcttcctcctctccggagaacacttgcccgcgtgaagctaccaagaagtcacgccatggactggactccatcacaagtcaggacatcctgatggcttccaggtggcaccccgcacaacagaacggctataaatgtgtggcctgctgtcgaatgtaccccaccttggattttctgaagagccacataaagaggggttttagggagggattctcttgcaaggtgtactaccgcaagctcaaggctttgtggagcaaagaacagaaagcacgacttggtgatcggctgtcttctggcagctgtcaggcctttaattcgccagctgagcacctgaggcagattggtggtgaggcatatctctgcttatag

SEQ ID NO: 53507 - DNA, 1527 bp, Artificial Sequence
  Description of Artificial Sequence: Synthetic coding sequence
atgaacgagaacaaagacaccgatagcaaaaagtccgaggagtatgaggacgacttcgagaaggacctggaatggctgattaacgagaacgaaaaatccgatgcgtccataatagaaatggcctgtgagaaggaggagaacattaaccaggatttaaaggaaaacgagaccgtcatggagcacacaaaacgacattccgatcccgataagagtcttcaggacgaagtgagcccacggaggaatgatatcatcagtgtgccgggaattcagcccctcgatccaatctctgactctgacagcgagaattctttccaggagtccaagctagaatcgcagaaagatctggaagaggaggaagatgaagaagtgcggagatacattatggaaaaaatcgtacaggccaataaactccttcagaaccaggaacctgtgaacgacaagcgagagaggaagcttaagtttaaggatcagcttgttgacctggaagtgccacccctggaagacaccaccactttcaagaactactttgagaatgagcggaatatgttcgggaaactgagtcaactctgcatatctaatgacttcggtcaggaagacgtgctgctttccctcacaaatggttcttgtgaggaaaataaagacagaacaattctggtggagcgcgacggaaagtttgaactcctaaacctacaagatatcgcctcccagggattcttacctccaataaataatgccaattctacggagaatgatccacaacagctgctccctagaagctctaattcaagcgtctccgggaccaagaaggaggactccacggcaaagatccacgctgtgacccactctagtaccggagaacccctggcctacattgcccagccacctttgaaccgcaagacctgcccctctagcgcagtaaacagcgacaggagcaaaggcaatggcaaaagcaatcacaggactcagtcagcccatatatcccccgttacgtcaacatattgcctatcacctcggcaaaaagaactgcagaagcagctggaggaaaaacgcgagaaacttaagcgtgaggaggaacgtcggaaaattgaagaggaaaaagaaaaaaagcgggagaatgatatcgtcttcaaggcttggctccaaaagaagagggagcaggtgctcgagatgaggcgaattcagcgcgcaaaagaaatcgaggatatgaatagcagagagaaccgggatccacagcaggcctttcgactttggctcaaaaaaaaacatgaagaacagatgaaggagcgacaaaccgaagagctccgaaaacaagaggaatgcctgttctttctgaaggggacggaggggagagagcgcgctttcaagcagtggctaagaagaaaaagaatggaaaaaatggcagagcagcaggcagtgagggaacggacacggcagctgaggcttgaagccaagcgtagcaaacagctgcagcatcatctttacatgtcggaggccaagccctttcgatttacggaccactacaactag

SEQ ID NO: 53508 - DNA, 1530 bp, Artificial Sequence
  Description of Artificial Sequence: Synthetic coding sequence
atgaacgaaaacaaagatacagactccaagaaatcagaggaatacgaggatgatttcgagaaggacctcgagtggctgattaatgagaatgagaagtctgatgcatccatcatagagatggcttgtgagaaggaggagaatataaatcaagatcttaaggagaacgaaaccgttatggagcacaccaaacgccactctgacccggacaagtccctccaggacgaggtaagtcctcggaggaatgatatcattagtgtcccgggaattcaaccactggatccaatctccgacagcgactcagaaaactcttttcaggagtccaaattggagtctcagaaggacctcgaggaggaggaagacgaggaggtgcgcagatacattatggaaaaaatagtgcaggctaacaaactgctgcaaaaccaggagcctgtgaatgataagagggagcgtaaattaaaattcaaggaccaacttgtagatctggaggttccccctcttgaggatactaccacctttaagaattatttcgagaacgagcgcaatatgttcggaaagctgagccagttatgcatcagtaatgactttggacaggaagatgtcctgctttctttgacaaacggatcttgcgaagaaaataaagataggacaatcctagtggagcgggacggcaagttcgagctgctcaatctgcaagatattgccagccaggggttcttgccaccaatcaataacgccaattccacagaaaacgacccccagcagttgctaccacggagcagcaacagcagcgtttctggcacaaagaaggaagattcaaccgccaaaatccatgcagtgactcattcatctacaggagagcctctcgcttacatagcccaaccaccgctaaacagaaaaacctgcccatcgtctgcagtgaatagtgaccgtagcaaggggaatggtaagtctaaccataggacacagtccgcgcacattagcccagtgacctctacctactgcctttccccacgacagaaagaactgcaaaagcagcttgaggaaaagcgagagaagctcaagcgtgaagaagagagaaggaagattgaggaggagaaggagaaaaagcgggagaacgacattgtatttaaagcttggctccagaaaaaaagagaacaggtgcttgagatgaggcggatacagcgagcaaaagaaatcgaggacatgaacagtcgccaggaaaatagggatccgcagcaggctttcaggctctggctaaagaagaaacatgaagagcagatgaaggaacgtcagacagaagaactgaggaagcaggaagagtgcctattcttcctgaaggggaccgagggacgagagcgcgcattcaagcagtggctgaggagaaaacgtatggaaaagatggccgaacagcaggcagttagagagagaacccggcaactgagactcgaagctaagcggtcaaagcagctccagcatcacctctatatgtccgaggccaagccattcagattcactgaccactataactag

SEQ ID NO: 53509 - DNA, 1071 bp, Artificial Sequence
  Description of Artificial Sequence: Synthetic coding sequence
atgaatgaaaacaaggacacagactccaagaaatctgaagaatatgaagacgacttcgaaaaagacctcgagtggcttatcaatgagaacgagaaatccgacgctagcataattgaaatggcttgtgagaaggaggagaacatcaatcaggacctgaaggagaacgaaaccgtcatggagcacaccaaacgtcattcagacccagacaaatctctccaggatgaggtgagtcccaggcggaatgacattatctctgtaccgggtatccagcctctggatcctatttctgatagcgactccgagaatagctttcaagagtccaaactggaatctcagaaggatctcgaggaggaggaggacgaggaagtccgcagatacatcatggagaagatcgtccaagccaataagcttttgcagaatcaggaaccggtgaatgataagagagagagaaaactcaagttcaaggaccagctggtcgaccttgaggtcccccctctggaggataccactaccttcaaaaactactttgagaatgaaagaaacatgtttggcaaattatcccagctatgtatcagcaatgacttcggacaggaagacgtcctcctgtcattaaccaacggtagctgcgaagagaataaggatagaactatcttggtggagcgcgatgggaagttcgaacttcttaatctgcaggatatcgctagccaaggcttcctacccccaatcaacaacgcgaacagcacagagaatgacccccagcagcttctgccgcgaagcagcaactcctctgtttcaggcacaaagaaagaggattctaccgcgaagattcatgcggtgactcattccagtactggagagcccctcgcctacattgcacagccccctctgaataggaagacatgcccctctagcgctgtgaattccgataggtcaaaagggaacgggaagagcaatcaccgcacccagtccgcacacattagtcctgtcaccagtacttattgtctgagccctcgacagaaggagcttcaaaagcagctggaagaaaagagggagaagcttaaacgggagtag

SEQ ID NO: 53510 - DNA, 1527 bp, Artificial Sequence
  Description of Artificial Sequence: Synthetic coding sequence
atgaatgagaataaagataccgattcaaaaaaaagtgaagaatacgaggacgatttcgagaaagatctggaatggcttattaacgagaacgaaaaaagcgacgcttctatcatcgagatggcctgtgagaaagaggaaaacatcaatcaggatctgaaggaaaacgaaactgtaatggagcataccaagagacactccgacccagacaagtcgctgcaggatgaggtgtcccctcgcaggaatgatatcatctccgttcctggcatccagccacttgatcccataagtgatagcgacagtgagaactcatttcaggagtcaaagctggagtcacagaaagatctcgaggaggaggaggatgaggaggtcaggcgctacatcatggaaaagatcgtccaggcaaacaagctgctccagaatcaggagcccgtgaatgacaaaagggagcgtaaactcaaatttaaagaccagctggtggaccttgaggtcccacccctggaggacacaacgaccttcaaaaattacttcgagaacgagagaaatatgtttgggaagctgagccagctttgcatttcaaacgatttcggccaggaagacgtgctactgagtttaaccaacggatcatgtgaggagaataaagataggactatcttagtagagagagatggaaaattcgagctgctcaatcttcaggatatagcctctcaaggctttctgcctccaattaataacgctaattctactgagaacgacccccaacagctgctacccagatcttcgaatagcagcgttagcggtactaagaaagaagattctaccgccaagattcacgccgtgacacattcttcaaccggagaaccactggcctatatcgcacagcctcctttgaatcgaaaaacctgccccagttccgctgtcaatagcgataggagcaaaggaaacggaaagtcgaaccaccgtacacagtcggcacacatctcacccgtcacaagtacatactgcctgtcccccagacagaaggagctgcaaaaacaactggaagaaaagagagagaaattgaagcgagaggaggagcgccgaaagatagaggaagagaaggagaaaaagcgagagaatgatattgtgttcaaagcatggctccagaaaaaacgggaacaagtactggaaatgaggagaatccagcgggctaaggagatagaggacatgaactcccgtgaaaatcgcgatcctcagcaagcctttcggctttggctgaagaaaaagcatgaggagcagatgaaagaaaggcaaaccgaagagctacggaagcaggaagaatgtttgttctttctgaagggtaccgagggccgagaacgcgcattcaagcagtggcttagacgcaaaagaatggaaaagatggcagaacaacaggcagtgagggaaagaactcgccaactgcgactggaggctaaaaggagtaagcagctccagcatcatctctatatgagcgaggccaagccctttcggtttacagaccattataactag

SEQ ID NO: 53511 - DNA, 429 bp, Artificial Sequence
  Description of Artificial Sequence: Synthetic coding sequence
atgacagtcggggcacgcttacgctctaaggcggagagctcgctattgagacggggaccacgagggcgaggccgaacggaaggcgatgaggaagcagccgctattctggagcacctggaatacgcagacgaggcagaggctgccgctgaaagcggcacaagcgctgccgacgaacggggtcctggtacccgcggtgcgagaagagtccatttcgccctgttaccagagagatacgagccactggaagaacctgctccatccgaacagccgagaaaaagatatagacgcaaactgaaaaaatacgggaaaaatgtcggtaaggtgataatcaaggggtgtaggtatgtcgtgattggcctgcagggcttcgctgctgcgtactcagccccttttgccgtcgccacaagcgtggtgagctttgtacggtag

SEQ ID NO: 53512 - DNA, 333 bp, Artificial Sequence
  Description of Artificial Sequence: Synthetic coding sequence
atggagtggggccctggtagtgattggtcgagaggcgaggccgcaggcgtggaccgtggcaaggctgggctgggcttgggaggaagacctccaccccagccaccaagagaggaaagggcccagcagctcctggacgccgttgagcaacgccagcggcagttgttggacacaatcgcagcttgcgaagagatgctgagacagcttggtaggcgaagaccggaacctgcaggcggtggtaacgtgtccgcaaagccaggcgctccgccacagcctgctgtgtctgccagagggggattccccaaggacgcgggagatggcgctgccgagccttag

SEQ ID NO: 53513 - DNA, 144 bp, Artificial Sequence
  Description of Artificial Sequence: Synthetic coding sequence
atgttgagacagcttggcagacgcagacccgaacccgcaggtgggggtaatgtttctgcgaagccaggtgcgcctcctcaacctgctgtcagcgccagggggggattccccaaagatgcaggagatggcgctgctgaaccctag

SEQ ID NO: 53514 - DNA, 480 bp, Artificial Sequence
  Description of Artificial Sequence: Synthetic coding sequence
atgggtccaggtctgcgtctcgtgacaggagtgcggggaggaccgtccgggagagaggaaggggcatggcccagggcttcagccggtcctgatcgcttgagtcttgctctctcccgcgcagggaggttgcctgcttggactgccggacgcagagggtggggaagcgctgggggtcaccctcattccagaccaggtcgcagtgcaccaagttcttgctggacccgctggtcaagcggctctgggtcatcgtggacgccctcacagcctgcacgcagatgctacggctcctgggccgcaggcgcaaggtcgcgccttgttgccggtacatcccaaccgaacctggaaagaccaccttctagactgagtcctccagaagcggcattccagcgaatgctggctatggagttgaggagcccagaccatccgagggccgagtatcctgacttttccccttcaccaggaccagtggccggtctgtag

SEQ ID NO: 53515 - DNA, 144 bp, Artificial Sequence
  Description of Artificial Sequence: Synthetic coding sequence
atgctacgccagctgggtagaagacggccagaacctgctggtggtggtaatgtgagtgccaagccgggtgcccctccacaaccggctgttagcgctaggggcggtttccccaaggatgcaggagatggggctgctgaaccatag

SEQ ID NO: 53516 - DNA, 483 bp, Artificial Sequence
  Description of Artificial Sequence: Synthetic coding sequence
atgggaaaaatcgcccttcaactcaaggccactcttgagaacatcaccaacctgcggcctgtcggagaagatttcagatggtatctgaaaatgaagtgtggcaattgcggtgaaatatccgacaaatggcagtatatcaggttaatggactcagtagccctcaagggaggtcggggatccgcttccatggtgcagaagtgtaaactgtgcgccagagagaactccattgaaattctgagctccacaatcaaaccctataatgctgaggacaacgagaattttaagaccattgtggagtttgaatgtagggggctggaaccagtggatttccagcctcaggctgggttcgcagctgaaggcgtcgaatctggcactgccttcagcgatatcaacctgcaggaaaaagactggacagattatgacgaaaaagctcaggagtcggtcggaatatacgaagtgacacatcaatttgtgaagtgctag

SEQ ID NO: 53517 - DNA, 414 bp, Artificial Sequence
  Description of Artificial Sequence: Synthetic coding sequence
atggggaaaatcgcattacagctcaaggcaaccctcgagaacataaccaacttgaggccggtcggtgaggatttcaggtggtatctgaaagactcagtggctcttaaagggggaaggggtagtgccagcatggtgcagaagtgcaagctgtgtgctagagagaatagcatcgagatcctgagcagcaccatcaagccgtacaacgctgaggataacgaaaactttaaaacaattgtcgagttcgaatgccgcggactggaacctgtagattttcagcctcttggtttactgttgaaggtctggagtcagggccagccatcagtgacactgatctgccgcaggaggaccggcttaacaatgatgaaacgcccacggtctctctgggagagcatgcgctcaccaactagcctatag

SEQ ID NO: 53518 - DNA, 624 bp, Artificial Sequence
  Description of Artificial Sequence: Synthetic coding sequence
atggatgatgacttaatgttagcccttaggctccaggaggaatggaacctgcaagaagccgagagggaccacgcgcaggaaagcctctccttagtcgacgcaagctgggaactcgtggatcctactccagatctgcaggcattattcgtgcaattcaatgatcagtttttctgggggcaactcgaagcagtggaggttaagtggtccgtccggatgaccctgtgcgcaggcatctgcagctacgaagggaaggggggtatgtgttcaatcagattgtctgaaccactgctgaagctgaggccacggaaggacctggtcgaggtttaccacacatttcacgatgaggtggacgaatatcgcagacactggtggcgatgtaatggaccatgccaacaccgcccaccctactacgggtacgttaaacgggctactaaccgggagccatccgcccacgactattggtgggccgagcaccagaaaacttgcgggggtacctacattaagatcaaggaacccgagaattactctaagaagggcaagggcaaggcgaagctgggaaaggaacctgtcctggcagctgaaaacaagggaactttcgtttacattctgttgatttttatgtag

SEQ ID NO: 53519 - DNA, 1470 bp, Artificial Sequence
  Description of Artificial Sequence: Synthetic coding sequence
atggatgatgacctgatgctcgccctgcggctgcaggaggagtggaacctccaggaggccgagagggatcatgcgcaggaaagcctaagcctcgtagatgcaagttgggaattggtcgaccctactccggacttgcaggctttgttcgtgcaattcaatgatcaatttttctgggggcaactcgaggctgtggaggtgaagtggtcggttcgaatgacactgtgcgctggcatttgtagttatgagggcaaggggggtatgtgtagcatcagactgagcgagccactgctcaagctgcggccaagaaaggaccttgttgagaccctgctccatgaaatgatccacgcttatctcttcgtgacgaataacgataaggaccgagaaggccatgggcctgagttttgcaaacacatgcaccggattaacagcctgaccggcgctaacataacagtgtatcataccttccatgatgaagtggacgagtatcgccgtcactggtggcgctgcaatggcccttgccagcaccgtcccccttactacggttacgtgaagcgcgctaccaatcgcgaaccctccgcgcacgactactggtgggccgaacaccagaagacctgcgggggaacctatattaagattaaagaacccgagaactactctaaaaagggtaaaggtaaggctaagttaggaaaggagcctgtgctggcggctgagaataaagataaaccaaatcgtggcgaggcccagttggtcattccattctctgggaaaggatatgtgcttggggagacctcaaatctgccgagcccgggtaaactgataacgtctcacgccatcaataaaactcaagaccttcttaatcagaaccactccgccaatgcggtgcgcccaaactcaaagattaaagtaaaattcgagcagaacggctccagcaagaactctcacctggtgtctcctgcagtgtccaactcccaccagaatgtccttagcaattattttccgagggtgagcttcgccaatcagaaagctttcagaggcgtgaacggaagccctagaatttccgtaaccgtgggaaatataccaaaaaacagcgtttcctcaagtagtcagcgaagggtgagcagtagtaagatttcgctgcggaacagctctaaagttaccgaaagcgcaagtgttatgccatctcaggatgttagtgggtccgaggacacctttccaaacaagagacctcgactggaggataagaccgtgtttgataacttcttcattaagaaggagcagatcaagtccagcggcaatgatccgaagtattcaacaacaacggcccaaaactccagcagcagctccagccagtcaaagatggtgaactgccctgtttgtcagaatgaagtgcttgagagccagatcaatgaacacttggactggtgcttagagggcgatagtataaaggtcaagagtgaggagagtctctag

SEQ ID NO: 53520 - DNA, 564 bp, Artificial Sequence
  Description of Artificial Sequence: Synthetic coding sequence
atgaagaaaaccctgcttcacgaaatgatccatgcctacttgttcgtgacaaacaacgacaaagacagagagggacatgggccagaattctgtaagcatatgcaccgaatcaatagtttgacaggcgctaacattactgtctaccataccttccacgacgaggtggatgaatataggcgccactggtggaggtgtaatggcccttgccagcaccgaccaccctactacggctatgtcaaacgagcaactaatcgagagccgtccgctcacgattactggtgggcggaacaccagaaaacctgtggagggacatacattaaaattaaggaacctgagaactattctaagaagggcaaagggaaagctaagctggggaaagagccagtcctagcagccgagaacaaagacaaaccaaacagaggcgaggcgcagctcgttatcccattttctggcaaaggatatgtgctcggggaaacatcaaatttgccgagccctggtaaactgatcacctctcatgccatcaacaagacccaggacttgctcaaccaaaatcactctgcctag

SEQ ID NO: 53521 - DNA, 753 bp, Artificial Sequence
  Description of Artificial Sequence: Synthetic coding sequence
atggatgacgatctcatgctggcccttagacttcaagaagagtggaatctgcaggaggcagaaagggatcatgcgcaggagtcgctgagcctggttgatgcgtcctgggagttggtcgatcctactccagatctgcaagccctgtttgtgcagtttaacgaccaatttttttggggccagctcgaggctgtggaggtcaagtggagtgtgaggatgacattatgtgccggaatttgtagttacgaggggaaaggaggtatgtgtagtattcgactgagtgagccactgctgaagttacggcctcgcaaagacttagttgaaaccctccttcacgagatgatccatgcctatctttttgtgacaaataacgataaggaccgggagggacacgggcctgaattttgcaaacacatgcatcggattaattccctaaccggggcaaacattacggtgtaccacactttccacgatgaagtggacgagtacagacgccattggtggagatgtaacgggccatgtcagcaccgcccaccttattatggctacgtgaaacgggcaaccaaccgcgaaccaagcgctcatgactactggtgggctgagcaccaaaagacctgcggcggtacgtatataaagatcaaggaaccagagaactactcaaagaaggggaagggtaaggcgaaactgggcaaagagcctgtcctggcagcagagaacaaaggcactttcgtttatattctactaatttttatgtag

SEQ ID NO: 53522 - DNA, 585 bp, Artificial Sequence
  Description of Artificial Sequence: Synthetic coding sequence
atggatgacgacttgatgcttgcgctcaggctccaagaagagtggaatctgcaagaggccgagcgagatcacgcacaggagtctctcagtctcgtggacgcatcttgggaactagtagacccgacgccggacctacaagccctgtttgtccagttcaatgaccagtttttctggggtcaactcgaggccgtagaggtgaagtggagcgtgaggatgaccctatgtgctggcatctgctcatatgagggaaaagggggaatgtgctccatccggctgtctgaacctttactcaagttgcgtccccgtaaggatctcgtagaagtctaccatactttccacgatgaagtggacgagtatagaaggcactggtggagatgcaacggcccatgccagcaccggccaccctattatggttacgtgaaacgggcaacgaaccgggaaccttctgcccatgactactggtgggctgagcatcagaagacctgcggagggacatatattaagatcaaagagccagaaaactataagaagaggcaacgaaagggcaagaccagaaaagggacttccatcggcagacgggagtag

SEQ ID NO: 53523 - DNA, 2472 bp, Artificial Sequence
  Description of Artificial Sequence: Synthetic coding sequence
atgtgggggtcacctgcgctagcatgggcggtgtggctggcctgtgtgcagcccaccgttttcccttggagcctcagctttaggagtgatacggataagcccagctcagcggctgaagtcctcactgaggccagctcttgctggactgacaccgtggagtgctttagcgattacatgacattgtggatcccgaggtcacatgtcgagggcctgcgtcgctggctggcccgtacactgcacttgcccggtacctggcgatcacccgatcaccttgattcatctttggctaaatgtggatacttcttacatctcgcatccgatggcgacttcctgttccgcgtacagtattctgcatgctttgtgcagaaggagaaagctaattataggttagaaattcggatattccagaagggcgtcatgggactcgaacggtcagatagatacattatgaaatgccccatgctacggtccagacttgggcaggagtccgtccactgcggtcccatgttcattcaggtctcacggccactacctctctggagggacaaccgtcagactccctggttgctgtcccttagaggcgaactggtggcttctttagaggatgcgagcctgatgggtctgtacgtagatatgaatgccactaccgtcacagtccagtcccctcgccagggtcttttacagcgttgggaagtgctcaacaccagtgctgaactactgccactctggctggtgtcaggccatcatgcctactctttggaagccgcatgtcctccagtatccttccagcccgagagcgaggtgctggtccacattcccaaacaacgattaggactcgtgaaacggggttcatacatagaagagacgctgtcattgagatttcttcgggttcatcaaagtaacattttcatggtcactgaaaataaggatttcgttgtggtgtctatccccgctgccggtgttctccaagtacagcgctgccaagaagtgggcggaacccctgggactcaggcgttctatcgagtcgatctcagcctggagtttgccgagatggccgctcccgtgctctggaccgtggagtccttctttcagtgcgtcgggagtggaaccgaaagcccagcctctacggccgctttgcgtactaccccatcccctcccagtcccggtcccgaaacacccccagctggcgtgccaccagccgcttcaagtcaggtttgggcggcaggccctgctgcacaggagtggctctcccgcgatctgctgcaccgccctagcgacgctctcgctaagaagggactagggcctttcttgcagaccgctaagcctgccagacgcggacagacaagtgcctccatcctgcctcgggtggtgcaggcccagcgcggaccccagccaccacccggagaagccggaataccgggacacccgacgcccccagctaccttgccgagcgaaccggtggagggcgtacaagcatcgccatggaggccccgtcctgttctgcctactcaccccgcactgactctgccagttagttcggatgcatcaagcccaagcccccctgcaccaaggccagagagaccagaaagtcttctggtgtccggaccttcagttacccttacagaaggactgggtactgtgaggcctgaacaagaccccgcaaaatctcccggttctcctcttctgttgcgcggtctcagctctggcgacgtggctgctcccgagcccatcatgggcgagccaggccaggcctcagaggagttccaaccactggcacggccttggagagccacactggcagccgaggagctggtttctcaccggtcacctggcgaaccccaggagacctgctcaggaacagaagttgagcgacccagacaaaccggcccagggctaccaagggagggcgctcggggacacatggacctgagcagctccgagcccagtcaagacatcgagggcccaggcttgtctatactgccagcccgagacgctaccttttctacaccatctgtcagacagcctgatccaagcgcctggctgtcatctggccctgagttgactgggatgcccagggtgagactcgcagctccactggccgtgctccccatggagcccttgcctcccgaaccggtacggccagccgctcttctcacacctgaggcgagctccgtgggcggaccagatcaggcccgatatctggaaagtgcaccaggatggccggtcggacaagaagagtggggggtcgcccacactagctctccgccttccacccaaacactcagtctgtgggcacccaccggtgtcctgttaccatctttggttgagctcgagtatccatttcaggccggtaggggagctagtctccagcaagaattaacagaacctactttagcattgagtgccgagagtcataggcccccagagctgcaggacagtgtcgagggtctctcagagcggccaagtagatag

SEQ ID NO: 53524 - DNA, 1971 bp, Artificial Sequence
  Description of Artificial Sequence: Synthetic coding sequence
atgaagtgccctatgttgagaagcaggctgggacaggagagcgtccattgcggaccgatgttcatccaggtctctagacctctgcccctgtggcgtgataacagacaaaccccctggcttctgtctctaagaggcgaactagtcgcctcgctggaggatgcatcacttatgggcctgtacgtcgatatgaatgccactaccgttaccgtgcagagcccacgccagggtctgctacagcgctgggaagtctccgggggtcagcaagccttgccaggtgtgtccttccagcccgaatctgaggtgctcgtgcacattccgaagcagcgcctgggactcgtgaaacgaggctcttatattgaggagaccctgagcctgcggtttttgagagtgcaccaatccaatatttttatggttactgaaaataaggactttgtagtggtttctattcccgctgcaggcgtgttgcaggtgcagaggtgtcaggaggttgggggtacgcccggaacccaagccttctatagggtggatctgtcactcgaattcgcagagatggcggcaccagtcctgtggaccgtggaaagctttttccagtgtgtgggtagcggaacagagagtcctgcatcaaccgccgcacttcggacaaccccgtcaccaccttcacccggtcctgaaacacctccagccggtgtgccgcctgccgcttctagtcaggtgtgggcagccggtccagcagctcaggagtggctgtctagggatctcttgcatagacccagtgacgctctggccaagaagggcctcggacctttcctccagaccgcaaaacctgctcgaaggggacagacgagcgcgtctattctccccagggttgtgcaggcccagcgcggaccccagcccccaccaggagaggccggaatcccagggcatcctaccccacccgctacccttccttccgagcccgtagagggcgtgcaggcgtcgccgtggcgccctaggccagttctgcccacgcatccagccctcaccttacccgtgtcctcagacgcatctagcccctctccccctgccccacgaccagagaggcctgagtccttgctggtgtcgggaccttccgtcactctgacagagggacttgggacggtgcgcccagaacaggatcccgcaaagtcacccggtagccctttgctgctgagggggctcagctctggggacgtcgctgcgcctgagcccattatgggggaacccggacaagcttctgaggaatttcagccactcgcaaggccctggagagctacccttgctgccgaggagctggtgtctcacagaagtcctggcgagccccaggaaacctgtagcggtactgaggttgagcggccacggcagacagggcctggactcccacgtgagggagcccgaggtcacatggatttgtcatctagtgagccttcccaggacattgagggcccaggtcttagcatcctgcctgcgcgagacgcaactttctctaccccttcggtgagacaaccggaccccagcgcctggcttagttctggccctgaactgaccggaatgccacgagtgcggctggcagctcccttggccgtgctgccaatggagcccttgccaccagagcccgtaagacccgctgccctgcttactcctgaagctagttctgtgggaggcccagatcaagctagatatctcgagtcagcccctggatggcccgtcgggcaggaggagtggggagtggcccacacatccagtccaccttctacacaaaccctgtccttgtgggctccgaccggtgttctgctcccgtctctggtcgagctcgaatacccatttcaggcgggtagaggtgcctcgctgcaacaagagctgacagaacccacgcttgccctatcagccgaatcacataggccacccgaactccaggacagcgtggaagggctgtccgagcgcccaagtcgctag

SEQ ID NO: 53525 - DNA, 1722 bp, Artificial Sequence
  Description of Artificial Sequence: Synthetic coding sequence
atgctgactcgaaatccaaagaccaagagttccctccagatcctgcaggacagtgtcaagtggcatcatatggctcacaaagtcaattccttactggacgcctactctggccttctctccaacgagtcaatgatcctggcagttaatagctcgtttgtcgatccacttctgcagttcgagtcacagctgaagatcatagagtcctctttcggcatgctcgtcgtgatgccatcactcgataaggtgaaggagatgggatcttcatatgagtacattgaagacatggagaatctgtatcataacattttgaacatttatgagaacatcttaacatcactggtgtcaaaggacctgtacaaactgcaaattctcaaggagatgctggtatggatgtcgaaggactcttcttatctccaggaaagaattatggtcataataaataaggtactaaggtttacagtcaccaaggttcggaagtacatcagcgtggacgctccgtgtttggggttgcttgccgcagaactttccctgctctgcagtcatgaagacccatccattgtgaaacaagcatccttaggaatgtgtcaccttctatatatcgccaggtgccaaaacgatataggaacaaacaagccaacgaacgggaagagtcatagcctacagttcccctcctctgacgtggaatttcttcctaaagagttccaacaggatgaaagcaagatcgcccaacgagtcggccagacacttttgccccctcttctgactgatttcgtccagtctctgctgatgaaactatccagcccggatgacaagattgctagtgacgctgcttccatactgatatttacgctcgagttccacgcagaaaaagttactatggtgtctaagatcgtggacgccatatataggcagctgtgcgataacaattgtatgaaggacgttatgctgcaagtgataaccctgctgacttgcacatcccccaaaaaggtaatctttcagctgatggattatcccgtcccagctgacgacacgctgattcagatgtggaaagcggcttgctcccaggcatcagtcgcgcctcacgtgctgaaaaccattctgttgatcctgaaaggcaaaccaggtgagatggaagacactgtaactgaaggcaagcgtttctctcttgatattaccaatctgatgcccctggccgcatgtcaggccctgtgtacctttcttccacttgggagttacaggaaagcagtggcccagtacttcccccagctactgaccaccctaatgttccaggttttctacaattccgagttgaagccaatcctgaaggatagggcgctgtatgcacaagacgccctgagagttcttctcaattgctcaggtctccagcaagtcgacatcacactgatgaaagaaaacttctgggatcagttgtccgaggacttgtgttactaccacggtgtctgtttcatcgcaaaaacactttcagaatacaatttcccccagttcccagagacactgtcatacttgtacaaactgagcgtcgaaggcccaaggcggtccgaggatactgtcattgttcttatcttcttaaccgaagtatcattcgtggactgcgaacagctgtgctcccattttttattcctccctaagtttaaatccaagtttcaatttctagtttccctcccgttgaacgttggctcttatcaggacttacggtcttag

SEQ ID NO: 53526 - DNA, 2586 bp, Artificial Sequence
  Description of Artificial Sequence: Synthetic coding sequence
atgctaaccagaaatcccaagacaaaatccagtttgcagattttgcaggactccgtgaaatggcaccacatggcacataaggtgaattctctactcgatgcctactccggtctgctgtccaatgagagcatgattctcgccgtgaactcttctttcgtggacccactgcttcagttcgagtcacaactgaaaattatagaatcctccttcggtatgctcgtggtgatgccttcccttgataaagtgaaggagatgggatcctcttacgaatatatcgaggacatggagaatctgtaccataacatcctaaacatctacgaaaatatcctgacatcgcttgtcagcaaggatttgtataagctgcaaatcttgaaggaaatgttggtctggatgtccaaggattcctcgtacctccaagaacgaatcatggtgatcattaataaagtgctccggttcacagtaacaaaagtaagaaagtatatctctgtagacgctccgtgcttaggtctgctggctgccgagctgtctctgctgtgctctcatgaggacccttccattgtgaagcaagcaagtctggggatgtgccatctgttgtatatcgctcggtgccagaacgacatcgggactaataagccaactaatggcaaaagccacagcctccaattcccctcttctgacgttgagtttcttccaaaggaattccagcaagatgagagcaagatcgcccagcgggttgggcaaaccttgctgccacccctgctgacagattttgttcagagtttgctgatgaagttatcttcccccgatgataaaattgccagcgacgctgcgtccattctaatctttacgctcgaattccacgccgagaaagtgaccatggtgtcaaagattgttgacgccatctatcggcaactctgcgataataactgcatgaaagatgttatgttgcaagtgataactcttttgacttgtacctcaccgaagaaggtcatctttcagttgatggattacccagtacctgctgacgatacactcatccagatgtggaaggcagcatgtagccaggcctctgtcgcacctcatgtcctgaagacaatcctgttaattctaaaaggaaagcccggagagatggaagataccgtgacggagggaaaaaggtttagcctggatatcaccaacttgatgccattagccgcatgtcaggcattatgcacgttcctgccgctggggtcgtataggaaggcagttgcccagtatttcccacagctgctgacaactttaatgttccaggtgttctataactccgagctaaaaccaatcctcaaggacagggctctctatgctcaggacgctcttagggttctcctgaactgtagcggcttgcaacaggttgacatcactctgatgaaggagaacttctgggatcagctatccgaggatttgtgctattaccatggggtgtgctttatcgctaaaacccttagcgagtacaatttcccacaattccccgagacactcagttacctttacaagctcagtgtggaaggcccacgtaggtccgaggacactgtaattgtactgatttttttgaccgagctcttaaacaacttttttaaagatcctttgcctgaggaatttctggtgctcttcattaactggattaacgattcgaaccccgttgtatcccgcttgatactgcatcgcattgtgcatatgtcaccaattatcaacaagacagagaatgttagttccatcttgattgccattctcgacgcatttctctccaaagatgataatgtggtcctgcaggcccttttgacactgaggagactcctgaatgagctcgacaaagtgacctacagcctgggcactcgtattgggagtagctattgcaccctgatggatcacatcaacggaggcatccgcagtatggcaatccgtcattttggccaactggtacgcgacatgagacagtacacttggatggtgaatgatgttgtgcttgaagggcttgtacccctcattcttttccttgaagacgatgacaaacgggtcgctgaggcctgcaagtacaccctgaagatatgtactagccagcttaaatggagcacctctcggttgctcaaggatgagaactacagctttgaaatggtagtgctgaacatctgcaacaacttgatcataagtcaccgaaattatattaccgacctgacctccgacactcttaggtttctgtggtcacctaggacctacttaaagagagccagcgttatcctgatcggatatctggccaaaagcggagggcatttgctgctgcgggatgagattgaggtgatgctggatgtgattgagcgcctgctccgggatgaagacccaatgatcaaacagttagcagagataacctatgatatttttaaaaagaaggcacacaaactcaccagcgctcccctgaagcagaacttccagaaattgctcaaactgttctacatcaagaaactgaaacctctctataactataactcccccaacgggcagatcgactcacccaccgattctaaggacgtgaagaatgacaaagcactctag

SEQ ID NO: 53527 - DNA, 564 bp, Artificial Sequence
  Description of Artificial Sequence: Synthetic coding sequence
tgaatgcccctcgctgcttgtcaggcactctgtacattcctccccctcggcagttatagaaaagctgtcgctcagtacttcccgcaattgctgactactctcatgttccaggtgttctacaacagcgagcttaagcccatactgaaggatagggcattatatgctcaggacgctctgagagtccttctgaactgcagcggcctgcagcaggtggatatcaccctcatgaaagaaaatttctgggatcagctctctgaggacttgtgctactaccacggagtatgcttcattgcgaagaccctatccgagtataattttccacagtttccagagaccttgagctacttgtacaagctgagtgtggaaggtcctcgtcgctctgaagatactgtgatcgtcttaattttcctgacagagttacttaacaatttctttaaagatcccttacctgaagagttcctagttctgttcatcaactggatcaacgattctaatcccgtggtgagtcgcctgatattacaccgcatagtgcacatgtcccctatcatcaataaggtggattag

SEQ ID NO: 53528 - DNA, 750 bp, Artificial Sequence
  Description of Artificial Sequence: Synthetic coding sequence
atgagggtggattcatctgccgatcctacaatgtcccaggaacagggcccagggtcgtccacgcctccgagctcgccaaccctgcttgacgccctgttgcagaatctgtacgatttcggtggaaccgaaggtgaaaccgaacagaaaaaaatcatcaaaaaaagggagaataaaaagagagatgtcatggcctcggccgctctagctgctgaacccagcccgttgcccggatctctgatccgtggccagcggaagtctgccagctctttttttaaagagttacgcgaagaaaggcactgtgctccctccgggaccccgaccggacccgagattttggcggctgctgtgccacctagttcactgaaaaacaacagggagcaggtcgaggttgtggagttccacagcaacaaaaaacggaaattgactccagatcataataagaacaccaagcaggctaatcctagcgttctggagcgggacgtggacacccaggagttcaacttggaaaaggctagacttgaggtacaccgattcggcattaccggctacgggaaaggaaaagaaagaatcttggagcaggaaagagctatcatgttgggcgctaaaccaccaaaaaaatcctacgtgaattacaaggtgctgcaggaacagataaaagaaaaaaaagccgctaaggaagaggaaaaacgcctggcgcaggagactgacatttttaaaaagaagaaacggaaaggacaagaggacaggtag

SEQ ID NO: 53529 - DNA, 792 bp, Artificial Sequence
  Description of Artificial Sequence: Synthetic coding sequence
atgtcacaggaacagggacctggttctagtacacctccttctagtcccaccttattggatgccctgctgcaaaacctctatgactttggcggtaccgaaggcgagaccgaacagaagaagattatcaagaaaagggaaaataaaaagagggatgtgatggcttccgctgcactcgcggctgaaccctctccactgccgggatcgctaataagagggcaaagaaaaagcgcatcatcattctttaaggagttgagggaagagagacactgtgcgccatcaggaactcctacaggccctgagatattagctgcagctgtaccgccttcatctctgaaaaacaaccgggagcaagtcgaagtcgtagagttccacagtaacaaaaaacggaaactcaccccagaccacaacaagaacacaaaggcacggctggaggttcacagatttgggattaccggatacggcaaaggcaaagagcgcatcttggagcaggagcgcgcaattatgctaggcgctaaacctcccaaaaagtcatacgtcaattacaaggtgctgcaggaacagatcaaagagaagaaagctgccaaagaagaggaaaagcggctcgcccaagagaccgatatattcaagaaaaagaagcggaagggccaggaagacaggaaaagcaagaagaaatctgctccctctattttaagtaacggccgaattggtcaggtcggcaaattcaaaaatggcacacttatcctcagtcccgtggatattaagaaaatcaactcttctagagtggccaagtag

SEQ ID NO: 53530 - DNA, 882 bp, Artificial Sequence
  Description of Artificial Sequence: Synthetic coding sequence
atgagagtggactcctccgccgaccctacaatgtctcaggagcagggtccaggctcctccaccccaccaagtagtccgactctgctcgacgctttgttgcaaaatctatacgacttcggcggtacagagggcgagactgagcagaagaaaatcattaaaaagagggagaataagaaaagggacgtaatggctagtgcagccctcgctgccgagccttcaccattgcccggtagtctgataaggggacagaggaagagcgcctcttccttcttcaaggagctgcgagaggagcggcattgcgccccatctggaactcctacaggacccgaaatcctggccgctgctgtacccccaagctcactcaaaaacaacagggagcaagttgaggttgtagaatttcacagcaacaagaagaggaagctgactcccgatcacaacaagaatactaagcaggcgaaccctagtgtgctggaaagggacgtggacactcaggaattcaatttggaaaaggcccgtctggaggtccatagatttggcatcacagggtatggcaaagggaaggaaagaatcctcgagcaggaaagagctatcatgctgggcgcaaaaccccctaaaaaaagctatgtcaactataaggtgctgcaggagcagatcaaagaaaaaaaggccgctaaagaagaagagaaaagactggctcaggaaacagacatatttaaaaaaaaaaaacgcaaaggtcaagaggatcggaagagcaaaaaaaaatccgcgccttccattctgtctaatgggagaattggacaggtgggcaaatttaaaaacgggacccttattttgagcccggtggacattaagaagatcaattcaagcagggtagccaaatag

SEQ ID NO: 53531 - DNA, 879 bp, Artificial Sequence
  Description of Artificial Sequence: Synthetic coding sequence
atgcgcgtggattcaagtgccgaccctacgatgtcgcaagaacagggcccaggatcttctacgcccccaagctcaccgaccctgctggatgcgttattacagaacctctacgacttcgggggtaccgaaggcgaaacagagcagaagaaaatcattaagaagagggagaacaagaaaagggacgtgatggcctcagccgcactggcagcagagccatctcccctacccggaagtttaatccgaggtcaaagaaaaagcgcctcaagctttttcaaggaactgagggaggaacgccactgtgcaccctcagggacccccaccggacctgaaatccttgccgctgccgttcctccttcaagtctgaagaataaccgagaacaggtggaggttgtcgagtttcattccaacaaaaaaagaaaactgactccggatcacaataagaacaccaaggccaacccttcagttttggagcgcgatgtagatacgcaagagttcaatctcgagaaggctcgcctggaggttcacaggttcgggattacagggtacggtaaagggaaagaacgaatcctcgagcaggaacgggcaattatgctgggagcgaagccacccaaaaaatcctatgtcaactacaaagtcttacaggaacagattaaggagaagaaagctgccaaagaggaggagaaaagattggctcaagagacagatatctttaagaagaagaaacgaaaggggcaagaagatcgcaagtcgaaaaagaaatccgctcccagtattttatccaatggcagaatcgggcaagtaggcaagttcaagaacgggactctgatactgtcgcccgtggatatcaaaaagattaactccagccgggtggctaaatag

SEQ ID NO: 53532 - DNA, 771 bp, Artificial Sequence
  Description of Artificial Sequence: Synthetic coding sequence
gggagcagtaccccgccaagctcccctaccctccttgacgcattactgcagaacttatatgattttggcggaaccgaaggggagactgaacaaaagaaaatcatcaaaaaacgggaaaacaagaagcgagatgtcatggctagtgctgcacttgccgctgagccaagtcctctgccaggcagtttgatccgcggtcagagaaagtccgcgagctccttttttaaagagctacgtgaagagcggcattgcgccccatcaggtacgcccactggacccgaaatactggctgcggcagtccctccaagcagtctgaagaataacagagaacaggttgaggtagtggaatttcattcaaacaaaaagcgtaagctgactcctgatcataacaagaacacaaaagccaggctggaagtacaccgcttcgggatcactggttacggtaagggaaaagaaagaatccttgaacaggaaagagccatcatgctaggtgcgaaacctcctaagaaatcatatgttaattataaggtgttgcaggaacagattaaagaaaagaaagctgcaaaagaggaagagaaacggctggcacaggagaccgatatctttaaaaaaaagaagcgcaaggggcaagaagacaggaagagtaaaaagaagagtgccccttcaatactgagcaacggcagaattggccaagttggcaagttcaaaaacggtacactgatcctgagccccgtggacatcaagaagattaattcctccagagttgcaaagtag

SEQ ID NO: 53533 - DNA, 438 bp, Artificial Sequence
  Description of Artificial Sequence: Synthetic coding sequence
tagcgcaggggggctggcgtgcgcagcggctgcgcaagcagagcctgttccggcgcacttggtggaagaggtccaggggagtctttattcgctcagtacccccgacgggctgagggccgtagagaaaagcagcaggtaacggagcagagaaacgggtggccgtcccaatcttggagctgctgttgctccacgtgctcgcctaacaagtgttcctacatcctgatgacccagtgtattggcagcagggagatggaattgagcgccgagtggcctggttgctcagtgaatatgaaagcaaccaagaccgctcgaggatctgagctgattctatcattaggatctttctccgggagagcgggacagcgccgtcgtccccctcctggccatcaggatggcagcgacacgcggggtctcagacgagttcaattagctctctag

SEQ ID NO: 53534 - DNA, 303 bp, Artificial Sequence
  Description of Artificial Sequence: Synthetic coding sequence
atgacccattctgggtggcagggaagcggcggagcaggcccaggtccacgggctcccgctagatcgagatgtcgacctggcctcccctccctgccatgcaggcccaatcctctggaagcaaggggatgcggatctgcactgcggccatgggatttggcagcacggacacctatcccctgtttttgtgaccactcttgggcgctgggaaagctactcggcccaaaacggcgagaaggtcgcaagggcagcgagagaaggcgccgagggcctgggggacaacagccacagccagctgaggagtag

SEQ ID NO: 53535 - DNA, 1074 bp, Artificial Sequence
  Description of Artificial Sequence: Synthetic coding sequence
atgagacgaactggtcctgaagaagaagcatgcggagtttggctggatgctgctgctctgaagaggcggaaggtgcagactcacttgatcaaacctggaacgaagatgctgacccttttaccaggagagcgcaaggctaacatctatttcacacagagaagggctccctctaccgggatccaccagcgaagtatcgcgtcgttcttcacgctgcaaccaggaaaaaccaatggctccgatcaaaaatccgtctcgtcacacactgagtctcagattaacaaagagtcaaagaaaaacgccacacagctggaccaccttatacccggtctggcacacgactgtatggcttcccctctcgccacgtcaactaccgcagacatccaggaagcgggtctctcaccccaatccctgcagacttctggtcatcaccgaatgaaaactcctttctctactgagcttagtttgttgcagcctgatacgcctgactgtgcgggagattcccacaccccattagcctttagcttcaccgaggatctcgagagctcatgcctcttggaccgcaaagaagaaaagggggattctgcgagaaaatgggagtggctgcatgaaagcaaaaaaaattatcagagtatggaaaaacacactaagctccccggagacaagtgttgccagcccttgggcaaaacaaaactcgagaggaaagtgtcggccaaagagaaccgccaggcaccagttttgcttcagacttatagagaaagttggaacggtgaaaatatagaatcggtgaagcagtctcggtcccccgtctccgtcttttcttgggataatgagaagaatgataaagacagctggtcacagctgttcaccgaagatagccagggccagcgagttattgcccacaacacgagggccccttttcaggatgttacaaacaactggaactgggatctggggccatttcctaactcgccatgggcccagtgtcaggaagatggccctacgcaaaatctgaaacctgacttattgtttactcaagacagcgagggaaatcaggtgatccgtcaccagttctag

SEQ ID NO: 53536 - DNA, 1116 bp, Artificial Sequence
  Description of Artificial Sequence: Synthetic coding sequence
atgagacggacaggtcctgaggaggaagcatgtggcgtgtggctggatgccgcagccctgaagaggaggaaagtgcaaactcacctaataaagccaggcactaagatgttaacattactgcccggagagcgcaaagccaatatttactttactcaacggagagccccatcaactggcattcaccaaaggtccatagcaagttttttcaccctgcagcccggaaagaccaatgggtccgaccaaaaaagcgtgagcagccatactgaatctcagataaacaaagaaagcaaaaaaaacgccacccaactggatcacctgatccccggtctggcccacgattgtatggctagccctctcgctacaagcaccacagccgatattcaggaagcagggctgtccccccagagtctccagacttccgggcatcatcgaatgaagacacctttctcgaccgaattatcacttctgcagcccgacaccccagattgcgcgggagacagccacactccattagcattttcctttacagaggatctcgaaagttcttgtttgttggaccgtaaagaggagaaaggagattctgccaggaaatgggaatggctgcatgagtccaaaaagaactaccaatcgatggagaagcatacgaagctcccaggagacaaatgttgtcagccacttggaaagacaaagttggagagaaaggtttcggccaaagagaatcgacaggcacctgttctgttgcagacatacagagagagctggaacggcgagaatatcgaatctgtgaagcagagccggtctcccgtgagcgtgttctcgtgggataatgaaaaaaatgataaagactcatggtctcagctgtttacggaggactcacaaggtcaaagagtgatcgcccataacactagagcaccctttcaggacgtcaccaacaattggaactgggacttggggccatttccaaattcaccttgggcacagtgtcaggaagatggtcccacacagaaccttaaacctgatctgctgttcacacaagatagtgaagtccaggccctggcttgtcagcaggactgctgtcgacggtccatcctgaaacggcagaaacacctccgatag

SEQ ID NO: 53537 - DNA, 297 bp, Artificial Sequence
  Description of Artificial Sequence: Synthetic coding sequence
atggcactcaaaacctctctgggctctgtgcagttcatggaacagttctgctggcctcatttacgttcattctgcgaaacatgcgtcggtagctggtccatccagatgagacagcatcaccaccagagtagtttccctggaagtctgcctcaggagacgaacttgactcttaaggtgtgcaagccgcaggcgcctcagaagctggaccccacgctctcttcctgctttttcattgaaagttgcggggcacaagtgccagtcgaaggatccaggcgggagacgagtataacagtgtag

SEQ ID NO: 53538 - DNA, 390 bp, Artificial Sequence
  Description of Artificial Sequence: Synthetic coding sequence
atgtggttatggcaggacatacagtgctgtcctgctcctccaagtgcccctccaagagcgctcgagccaggcagggcaccccctcccccaggtgagggtcttggagctggcattccttcactttcaccaccccagaaaaagccacagtccgtgggtatctgcgtgcgtcaaaaaggcagacagaaggcaggcctagaaaaggggaacaggaagaaggaacttcggcaagctaactgcccctcactgcgccctcaacgaaagggtgccgacacacgcaggttgcctagagagactcgcccaacaaagaagcggacagccgcagcacagccctttctgcagctctggaaccctgctccccacacaagcaacggaagaacaggagacctatag

SEQ ID NO: 53539 - DNA, 243 bp, Artificial Sequence
  Description of Artificial Sequence: Synthetic coding sequence
atggccgaaaaaattcttgaaaagctggatgtgctcgacaagcaggccgaaattattctcgcgagacgcaccaagatcaacaggctgcagagcgagggtcggaaaacaactatggccatccctttgaccttcgacttccaactggagttcgaggaagccctggccacgagtgcctcaaaagcgatcagcaagataaaggaggacaagagctgctccatcaccaagtcgaagataagtgagtag

SEQ ID NO: 53540 - DNA, 243 bp, Artificial Sequence
  Description of Artificial Sequence: Synthetic coding sequence
atggctgagaaaattctagaaaaacttgatgtcctggacaagcaggccgaaataatcctcgcgaggaggactaagattaacaggctccagtcagaaggtagaaagaccaccatggccatccccctgacatttgacttccagctggagttcgaggaggctctcgccacctctgcgtccaaggctataagcaaaatcaaagaggacaagtcttgtagcatcacaaaaagcaagatcagcaactag

SEQ ID NO: 53541 - DNA, 846 bp, Artificial Sequence
  Description of Artificial Sequence: Synthetic coding sequence
atggctgaaaagatcctggaaaagctagacgtgttagacaaacaggctgagatcattctggccaggaggactaagataaatcgtctgcagtcggagggcagaaaaaccacgatggcaattccgctcacttttgacttccagctggagttcgaggaggccttggccacctcggccagcaaagccattagcaagatcaaggaggacaaatcttgctccattactaagtcaaaaatgcacgtgtccttcaaatgcgaacccgaacctaggaagtcaaatttcgagaagtctaatttacgaccttttttcatccagacaaacgtcaagaacaaggagagtgagtctaccgaacccgtggaggaacacctgaagagcaggtcaattaggccttatctctacctcaaggacactacagagatggagaacgctggccctctgaatgtgctgtattctcaacatagacaggcttgcaggcggagtctcggatccaccgatttctcacccatgttcaatatacagtccaacgcacacaagaaagagaaggattctacactctttaccgcccagatcgaaaagaagcccaggaaacccttagactcggtgggactactggagggtgatcgtaacaagcgaaaaaaatcacctcaaatgaacgatttcaacatcaaagaaaacaaatccgttcggaattatcaactgtctaagtatcgatctgttcgcaagaagagcttacttcccttatgctttgaagacgagctgaaaaatccccatgctaagatcgtcaacgtgagccctaccaaaaccgtgacatctcatatggagcagaaggacaccaatccgattatatag

SEQ ID NO: 53542 - DNA, 1203 bp, Artificial Sequence
  Description of Artificial Sequence: Synthetic coding sequence
atggccgaaaaaatcctggagaagcttgatgtgctggataagcaggccgaaataatcttagccaggagaaccaaaatcaataggcttcagtcagaaggcaggaagaccacaatggcgatccccctcacatttgattttcagttggagtttgaggaggcactagcaacctccgctagtaaggccattagcaaaatcaaagaagacaagtcttgctctatcaccaagagcaaaatgcatgtgtctttcaaatgcgagccagagccccgaaagagcaacttcgaaaaaagtaacctgcggcctttcttcattcagacaaatgtaaagaataaagagtccgaatccacagcacagatcgagaagaagcctagaaagccgctcgactctgtcgggctgctggagggtgacagaaataagcggaagaagtccccgcaaatgaacgatttcaatattaaggagaataagtcagtgaggaactatcagctctctaagtacagatcggtgcggaaaaaatcccttctccctctgtgctttgaggacgagctgaaaaacccccatgcaaaaatcgttaatgtcagccccaccaagaccgtgacctcccacatggaacaaaaggacactaacccaatcatctttcacgacactgagtatgtacgcatgcttctgctgaccaagaacagattcagcagtcaccccctggaaaacgagaatatctaccctcacaaacgcacgaattttattctggaacggaattgcgagatccttaagtctatcatcggcaatcagagtataagcttgttcaaaccccagaagaccatgccgacggtgcaacgcaaggacatccagatccctatgagcttcaaggcaggtcatacaaccgtggacgacaagctgaagaagaagacaaacaagcaaaccctcgagaatcgctcgtggaatacactgtataacttttcacagaattttagcagtctcactaaacagttcgttggctacctagacaaggccgttatacacgaaatgtctgctcaaactgggaaatttgaaagaatgttcagcgccggtaaacctacctcaatccctaccagctccgcattacctgtcaagtgttattccaagccattcaagtatatatatgaacttaacaatgttacgccattggataatctactgaacctaagcaacgagatattaaatgcgagttag

SEQ ID NO: 53543 - DNA, 1203 bp, Artificial Sequence
  Description of Artificial Sequence: Synthetic coding sequence
atggccgaaaagatcctggagaagctggacgtgctcgataaacaggccgagattatcttggctcgcaggactaaaataaatagacttcagtccgaaggacggaagacaactatggcaatacccttaactttcgattttcagctcgagtttgaagaggccctggctaccagtgctagcaaggcaatctcaaaaatcaaagaggacaagtcgtgttctatcactaagagcaaaatgcatgtcagctttaagtgtgagcctgaacctagaaagagtaacttcgaaaagagtaatctcagacctttcttcattcagacgaacgtcaagaacaaagagtccgagtccacagctcagattgaaaagaaaccgagaaagcctctggacagcgttggtctgctggagggggatagaaacaaacggaagaagtcccctcaaatgaacgattttaatattaaggagaataaatccgttcggaactaccagttgagtaagtatcgtagtgtgaggaagaagtccttactgccgctgtgcttcgaggatgagcttaagaacccccatgcgaagattgtcaacgtatcccctaccaagacagtcacttctcatatggagcagaaggacacaaacccaattatcttccatgatacagagtacgttagaatgcttctgctgacaaaaaatagattttcctcacatcccttggagaacgagaatatatatccccacaaacgcacaaacttcattttagagcgaaactgtgagattttgaaaagtattatcgggaaccaaagtatttcccttttcaaaccccagaaaaccatgccaaccgtgcagcggaaagacatccaaatccctatgagttttaaggccggacatacaaccgtcgatgataagctgaagaaaaagaccaacaaacaaacattggaaaatagatcctggaacaccctgtacaatttttctcagaacttctctagcctaacaaagcaattcgttggttacttggataaggctgtgatccacgaaatgagcgcccagaccgggaagttcgagcgcatgttcagtgctgggaaacccaccagtatcccgacctcaagtgcactgcccgtaaaatgttactccaagccctttaaatatatttatgagttaaacaacgtgaccccactcgacaacctgctgaacctctccaatgagattctgaacgccagttag

SEQ ID NO: 53544 - DNA, 846 bp, Artificial Sequence
  Description of Artificial Sequence: Synthetic coding sequence
atggctgagaagatccttgagaagcttgacgtgctggataagcaggctgaaataatcctagcaagaagaaccaagatcaaccggctgcagtccgaaggacggaagaccaccatggcaattccattgacattcgatttccagctggagtttgaggaggcgttggccacctccgccagtaaagcaatcagtaaaatcaaagaagacaagagttgttccatcaccaagagtaagatgcacgtgagctttaagtgcgaacccgagcctcggaagtcaaattttgagaagtcaaacttacggccattttttattcagacaaacgttaaaaataaagaatccgagtctaccgaaccggtggaagagcatttgaagagcagatctatcaggccgtacctttatctaaaagacactacagagatggagaacgccggaccacttaatgtgctatactctcagcataggcaggcgtgccgtcgaagtctcggcagcacagacttctccccaatgttcaatatacaatcaaatgcccacaagaaggagaaggatagcacgctgtttacagctcaaattgagaagaaacctaggaagcctttggattcagtcggtctgctggaaggcgatcgcaataaaagaaaaaagagcccccaaatgaatgactttaacatcaaagaaaataagtccgtcaggaactaccaacttagtaagtacaggagcgtcaggaagaagtcgcttctcccactgtgttttgaggatgagcttaagaacccacacgccaaaattgtcaacgtaagtcctaccaagaccgtcacttcacacatggagcagaaggatacgaatcccatcatctag

SEQ ID NO: 53545 - DNA, 1203 bp, Artificial Sequence
  Description of Artificial Sequence: Synthetic coding sequence
atggctgaaaagattttggaaaagttagatgtgcttgataagcaggctgagatcatcctggctcgccgaacaaaaatcaatcgcctccagagcgagggaaggaagaccactatggcaatccccctgacattcgactttcagttagagttcgaggaggcgctggcgacttcagcttctaaagccatctcaaagatcaaggaagacaaaagttgtagtattaccaagtccaagatgcacgtgtcgtttaaatgcgaacctgaaccacgaaaaagtaactttgaaaagtccaatcttcggccattcttcatccagactaacgtgaagaataaggagtccgagagcaccgctcagatcgagaagaagcccaggaaacctctggattcggtcggcttacttgaaggggataggaacaagagaaaaaagtcgcctcagatgaatgattttaatatcaaggaaaataaatcagtaaggaactatcagttatccaaatacaggagtgtccgaaaaaaatctctgctgcctctctgcttcgaagacgaactcaagaatccacacgctaagattgtcaacgtgagtccaacaaagacggtgactagccacatggagcagaaggatacaaaccccatcatttttcacgatacagagtacgtccgtatgctgctactaacaaaaaatcgcttcagtagccaccctctggagaacgagaacatttacccacataaacgaactaattttattttggagaggaactgtgaaatattgaagagcatcattggcaaccaatctatctccctgtttaagccccagaagactatgcctactgtccagagaaaagacattcagatacccatgtcttttaaagctggccacacaaccgttgacgataaactcaaaaaaaagactaacaagcagacacttgagaacaggagttggaacacgctgtataacttttctcagaatttcagtagccttactaaacaattcgtcggatatctggacaaggctgttattcacgaaatgtccgctcagacaggcaagttcgagcggatgtttagtgcaggcaagccaacatcaataccaacatcttccgccttaccagtcaagtgctatagcaagccattcaaatacatctacgagcttaataacgtaacccccttggacaatcttctgaatcttagtaacgaaatcctcaacgcatcctag

SEQ ID NO: 53546 - DNA, 477 bp, Artificial Sequence
  Description of Artificial Sequence: Synthetic coding sequence
atgagacgctcactgagagctggcaagcgacgccaaacggccggaaaaagtaagagtccgcctaaagtaccgatcgtaattcaggacgattccttacccgcaggaccccctccacagatccggatccttaaacgcccaactagtaatggagtagtgtcctctccaaattcgacctcacgtccaactctgcccgtgaagtctctcgcacagagggaagccgaatatgccgaggctcggaagagaatactcggctctgcttctccagaggaagagcaggaaaagcccattctagatagaccgacacggatcagccagccggaagacagccgcctgcagacggcacagatcaatgctggtaagaaacgctgccgacgctgttgccgccacaggctcctaggtagacccccacgcgtggccttgccctggcagacagcagggcttgagcaaagggaaagaccggacttgctggccttatag

SEQ ID NO: 53547 - DNA, 459 bp, Artificial Sequence
  Description of Artificial Sequence: Synthetic coding sequence
atggaggatgaggaggttgcagagtcctgggaggaggcggctgacagtggagaaatcgatcggagattagaaaagaagttaaaaattactcagaaagaaagccggaagtcgaaatcaccccctaaagtccccatcgtgatccaggatgactctctgcccgctggccctccaccccagatccggatcctgaagcgcccaaccagcaatggcgtggtgtcaagccccaatagtactagcagacctacgctgcccgtgaagtctctcgcccagcgggaggctgagtatgccgaagcacggaaacgaatcctcggctctgccagccctgaggaggagcaagaaaagcccatcctggaccggcctacaagaatcagtcagcccgaagactcccgccagccgaacaacgttatcaggcagcctcttgggccagacggcagccagggatttaaacagcgccgatag

SEQ ID NO: 53548 - DNA, 402 bp, Artificial Sequence
  Description of Artificial Sequence: Synthetic coding sequence
atgcgtcgctccctgcgggctggaaaacgccgacaaaccgctggcaggaaaagcaaatcccccccaaaggtgccaatcgtcatccaagatgacagcctcccggctggcccaccaccccaaatcagaattctaaagcggccaacatctaatggagtagtttcaagtccaaacagcaccagtaggcccacactgcctgtcaagagtctcgcacagagggaagccgaatacgctgaggccagaaaacggatcctggggtcagcatcgccagaggaggagcaagagaaaccaatcctagatcgccctacgaggatcagtcagcccgaggatagtagacagcctaacaacgtgatcaggcagccacttggccctgacgggtcacaggggtttaagcagcgaagatag

SEQ ID NO: 53549 - DNA, 423 bp, Artificial Sequence
  Description of Artificial Sequence: Synthetic coding sequence
atggaagacgaggaggtagctgagtcctgggaagaggcagcggactctggcgagatagatcgccgtctggagaagaaactaaagatcacccaaaaggaaagccgaaagagtaaaagtccgccaaaggtacccatcgtcatacaagacgactctctccctgccggacctcctccccaaattaggattctgaagagaccaacatctaacggtgtggtgtcatcaccaaacagtacttctagaccgacgctgcccgtgaagtcgttagcccaaagagaggccgaatatgctgaagcacgcaagcgcatccttggatctgccagcccggaagaagaacaggagaagcccatcctggatagacctacacgaatctcacagcctgaagacagtcggcaacctaataatgtcattaggcaacgaaggtag

SEQ ID NO: 53550 - DNA, 480 bp, Artificial Sequence
  Description of Artificial Sequence: Synthetic coding sequence
atgtcttacgaggtggccactgctctcgagaaccgcagccataaggtgcggtacagcgacagtgtggagaatggttctattattttcagcctctccggagtggccttcctgctgatggacaccaaagagtgcctgctgtccactgaagagattttcctggcaaagattgagaaattcattaatatccaccagaatagcttccttgttctgtccgctgcgctccatggtccagaagagtggaagctcatgttcaggattcagcagcggttcttaggatgtaatctcaggatcttgcccgtgcacaatactgtgaatgctattaaccttatgtgcacaatagccaagactacatccaaaccgtacatcgactcaatatgttatcggatgatcactgctaaggcttatattattgaacagagccccgtatggaaaacactgcagaaaatcaagctcaactctgattccgtgaaccccaattag

SEQ ID NO: 53551 - DNA, 543 bp, Artificial Sequence
  Description of Artificial Sequence: Synthetic coding sequence
atggccgaaagtggcaaagaaaaaattaagtggactactaccataataatcagtagctcccttaagtcgtacgaagtggccaccgcccttgaaaatcgatcccacaaagtccgctattctgactccgtggagaacggaagcattatctttagcctgtctggtgttgctttcttattgatggatacaaaggaatgtttgctgtctacggaagagatttttcttgcaaagatcgaaaagtttatcaacattcatcagaactctttcctggttctcagtgctgcattgcacggaccggaggagtggaagcttatgttccggatacaacagcgcttcctcgggtgcaatcttcggatcctcccagtgcacaatacagtcaacgctatcaacttgatgtgcactatagccaaaaccacctccaagccatacatcgatagcatttgttaccggatgatcaccgccaaggcttacattattgagcaaagtcccgtctggaaaacactgcagaagatcaagttgaacagcgatagcgtcaatccaaattag

SEQ ID NO: 53552 - DNA, 813 bp, Artificial Sequence
  Description of Artificial Sequence: Synthetic coding sequence
atgcagggcaataacctccagcctcccagcccccgaccactggagtgttggagcctacaccgggaagccccacaacgaacagaggcatcaagaacacaccctagcccgttcctggccctgcccggatcacacaggacggccaatcaggcacaggtcgttccaggccttgtacaccaccctcaggaaaacacacagcgtcttcgaatcagggcgggattaagtccgttccccagggccagactggcagccattggtagcacccacggtcacaggtgggtccctggcatatgcctgcccagatgcctgtgcccagctagctgcgccctgcatgcttgtcctccgcattgcaacaacgcagaggcccactcctggctgcgtttgggtggacctttacagtcacgctctgtagaacaccagcagcacgcctgcggatggggctgggttacacatgctacttatggagagagaggtacaagtcaggccgcagaacgccagaggattgcacatactcgggctctgtcagtcggcaactgccctcgttcgcattttcagtgcgaattttcgagtataagtaagtggtccgaaggaacaggaacattcagcccaagaccccgagctgtgaaatctggggtagggggacagccaagtccacatattagaataacatggagaagctgcactaccctgacaagcaagccctgttcacgagctatcacccccgaatgtgtggtggggtggagccgccgtagtagacattggtactcagacatgcggaccggggaatgccaggggctgagccccattacacgatag

SEQ ID NO: 53553 - DNA, 333 bp, Artificial Sequence
  Description of Artificial Sequence: Synthetic coding sequence
atgacctacccccctcatagggcattctctaggagtgacgtcccctaccccctgctgagcagccctgtgcagtggccacttagtctggtggtcggagacacctcgacgcgctggccccagcagccctccgcgcttgaatccgattgccccggaccttcccacccatgcctcgctggccttctgggacctatgcaccccgttgacatccccctgtcaacagctcttcactccaaacaccagcgcagactcacccagtgtgtgcttatggtgcagagtccgagtaagcaacgcagtctctaccttttaaacaagaagatacctcacgatgcatag

SEQ ID NO: 53554 - DNA, 408 bp, Artificial Sequence
  Description of Artificial Sequence: Synthetic coding sequence
atggggaactacctgctgcgtaagctcagctgcttaggcgaaaatcagaaaaagccaaagaaaggaaaccctgacgaggagcggaagaggcaggaaatgaccacctttgagagaaaacttcaagaccaagataagaagtctcaggaagtttcctccaccagtaatcaggaaaatgagaacggtagcgggtccgaagaggtgtgttacacagtcattaaccacattccacaccagcgaagttcactctcgtccaatgacgatgggtacgagaacatcgacagcctgacaaggaaagtgcggcagttccgagagagaagtgaaacggagtatgcactactaagaacatcagttagccggccttgctcatgcacacacgagcacgactatgaggttgttttcccacactag

SEQ ID NO: 53555 - DNA, 348 bp, Artificial Sequence
  Description of Artificial Sequence: Synthetic coding sequence
atgggcaattaccttctacgcaagctgcgccaggaaatgaccactttcgagagaaagcttcaggaccaggataaaaaatctcaggaagtatctagcacgagtaaccaggaaaatgaaaatggcagtggctctgaggaggtttgctatactgtgattaatcacattccccatcaaagaagtagcttgtcctcaaacgacgatggctacgagaacatcgactctttgacacgaaaggtccgccaatttagggagcggagcgaaacagaatacgcactcctcagaacatctgtctcgcggccttgttcctgcactcacgaacatgactatgaggttgtctttcctcattag

SEQ ID NO: 53556 - DNA, 402 bp, Artificial Sequence
  Description of Artificial Sequence: Synthetic coding sequence
atggtgatgctggaggacagcaacagttcaaccggctgcggcgcacgcaattgtgtggaatgcttggtgttcttgtcagtgctgggctgccaaagtgagcggaagggacagatgagaacccaacaggctggtagatggttacgggctggcagagaagcatcttccgagacaaacccagagggaacactgattctggactttcagagcccagaactgccactagctgccagaggttggcaggaacacgagccagtggtcaggtgcaacgtcctccctcacgccttttcatcctggtgcttcggccagaactttcctaaatggagcgaaacacaagaactgagaaatagagtcaccgtgaagagatgggagatcatcagctgcgaaaattccggtgagagctag

SEQ ID NO: 53557 - DNA, 348 bp, Artificial Sequence
  Description of Artificial Sequence: Synthetic coding sequence
atgggcaactacctgctgcgaaagctccgccaggaaatgactacctttgagcgcaagctgcaagaccaagataaaaaatcccaggaagtttccagtacgtccaatcaggagaacgagaatggttcgggatcggaggaggtatgttatacggtaatcaatcatattccccatcagcggagcagtttgtcaagtaacgatgatggctacgaaaacatagatagtctgactcggaaagtccgacagttccgagagcgctcagaaaccgaatatgccctccttcggactagcgtgtcccgcccttgctcttgtacacacgagcacgattacgaagttgtgtttcctcattag

SEQ ID NO: 53558 - DNA, 243 bp, Artificial Sequence
  Description of Artificial Sequence: Synthetic coding sequence
atgggaaactatctgttgcggaagctcagttgtttgggagaaaaccagaagaaaccaaaaaagggtaatcccgacgaggaaagaaagagacaggagatgacaactttcgagcgaaagctgcaagaccaggataaaaaatcacaagaggtgtcttctacctccaaccaggaaaatgaaaatggctcagggagcgaagaagtttgctataccgtcatcaatcacattcctcatcagcggagttag

SEQ ID NO: 53559 - DNA, 348 bp, Artificial Sequence
  Description of Artificial Sequence: Synthetic coding sequence
atgggaaattatctgctgcgcaaactcagacaggagatgaccacctttgaacgcaagctccaggatcaggacaaaaaaagccaggaggtgtcgtcgacgtcaaaccaggaaaacgagaacggatccggaagtgaggaagtttgctacaccgtgatcaatcatatccctcaccagcgcagcagcctctcctcaaatgatgatggttacgagaatattgattctttgaccaggaaggttagacaatttagagaaaggtccgagaccgagtatgctttgctgcgtacctcagtctccagaccttgtagctgcacccacgaacacgactatgaagttgtgttcccccactag

SEQ ID NO: 53560 - DNA, 585 bp, Artificial Sequence
  Description of Artificial Sequence: Synthetic coding sequence
atgtttctcaccgcagtgaacccgcaacctttaagcactcctagctggcagatcgaaacaaaatattctacaaaggtcttaaccggcaactggatggaagagagaagaaaattcacccgagacacagataaaacacctcagtccatttatcgtaaggaatatatcccttttcctgatcacaggcccgatcaaatttcaagatggtacggtaaaaggaaggttgagggattgccatacaaacacctcataacccaccaccaggaaccgcctcaccggtacctcatctccacatacgacgatcattacaatagacacggttacaaccccggtctcccaccattaagaacctggaacgggcagaaattgctgtggctgcctgaaaaatcagactttcctttattggctcctccaacgaactatggtctgtacgaacagctgaaacagaggcagctgactcccaaggccggtttgaaacaaagtacatacaccagctcttacccccgtcccccactctgtgctatgagctggcgggagcatgctgtgccagtccctccacaccggcttcatccgtttccccatttttag

SEQ ID NO: 53561 - DNA, 471 bp, Artificial Sequence
  Description of Artificial Sequence: Synthetic coding sequence
atgtttctgacagctgtcaaccctcagcccctgtcgacacctagttggcaaattgaaactaagtattccaccaaagtacttaccggcaattggatggaggaaagacgtaagggactcccttataaacacctcattacacatcaccaagagccaccccaccgatatctgatctctacatatgacgaccattataatagacatggctacaaccccggattaccgccactacgcacatggaatggacagaaacttctgtggttgccggagaaaagtgatttccctcttttagccccacctacaaattatggtctatacgagcagcttaagcaacggcagctgacccccaaggccggactaaagcagtctacctacactagctcttatccgagacccccactctgcgccatgagctggcgtgagcacgctgtgccagtcccaccgcataggctacaccctttcccacacttctag

SEQ ID NO: 53562 - DNA, 4422 bp, Artificial Sequence
  Description of Artificial Sequence: Synthetic coding sequence
atgacaaggatgagttgcccttggggaagttaccagtgggagcccggtgcctgccccgctgcgcctcggggaatcgggggtggggatatggccggtggaatcccagatgtaaggggcctacaggaggccgcactcggggcaggccgatcccaggaggaggctcggctcgtcgaggaggcccagactcctgtgatgctgccgcaggattctggtcagcgcgttgaggaggtgcctggagatctgatggcaaaaagaatgtctctcatcttgcacgtccaaaagctgccatgggatcacgtcccatgtctccgcagaacacggcagaacctgtaccaggacgttgggggacatgcccacgggtctggtcttggcggagctaagcgcggagccgctagatccgcactcagacgtcccctccctccggctacatgtcgaccagcgggaatagtttccggaccaagtccgcgactggatagtaacccaacaggcgctcatctgatcaaacagacccggccactgaccgtggaatggactaaagacacacccgtccccgagcctatggaactgcggtccgacgcctctcacaaggaaaatgtgtcccccaaaccagcagctttgcctaaaccaggcaagcggctgaagcaacgacggttccgcagaagcctgggcattggactcagcgggcgacacgaccagtgggtccctggctgtcaagtggaacgcggtggccctgctgcgacgccatcacccggagccgttttggaccaggagccctgtagggttcagacgaatctagcctcccctggacctaggctcggcctggcactcaaggatacaacgggacagcttgtgaattcatctttctggcagcagtcaaacctacagtcgctggcacgacggagacaggggaaggcacgcgagttcgccatacagcagagcaatctatctatcaatgaaactagcagtccccacttatgccctgaacctggcggaagttcgggcccacataagcttccctgggggccactgctaagccaggagccactggcgagaccttcttcttgcctgcgacagagtggtttgccagcgccaggcaccccaagcggcgatttccgcccaaccgaagcgtttgctcctctcgacggtcacacccagccgggactgagatcctgggggggacttggctcttggagatcccggctggtaggggaacctctgactttggaggacttggccgtgccttcacagaatcaaactcaggctcctagcagggccgcagttcatcagctcctggctagcgtgcattgcctggcccaagaagctgctcgcctgcgatgtcaggcaccacaggagccgcctgcctggggggtgtcaccgaaacagaagggagaggaaggtgctccaagggagagggtgcacagggaggaggagcggacggcctttcacctgtctgataccgtgcccgctagctcagcatccaaaaacaaggctcagaatataactgcacctgaatctgaggccatttgttggcagcttctctcccggtgcttcagatcctggcggcatctagtcaagagacaacgcgagcctgccgcagctgctgtggcccttggaaggtggcagctcctcaggaaatgtctgcaggcactctggttgcgggaagcgcagctcgaggcagcctggggacagtatactaaagtgcttctggtaaggtcctttcgcgaagtgagcgggctgcaggtgggacccggaggccgtgtcaaacaatgccccggtagtctacgcgaagaagagatcgctcaacgtttgttgagtcaccctcggcagcggactgattcccgtcatgagcgtgtgcaaattcttcaggctttgcagttggctgtgttttttctgtggtgtcaacaaaagaagcgggctcgccaggaacgagagacattacgtaaagccacaagagctacacagcgaactggctctttccctcaggcttggcatagcaccgcagcgggagtggcttgggtggctcccctgagtccccagcatcagagggcttggctgtgccggtgcttcggcgcatggcagcagtttgttcagagagggagccgctaccgagaccacttggccgaccggaggacagggacactccggaagtgcttggaacagtgggtaaggatgaagcagctgagagagtccgacggggctaaagtgacccaattatctctttgccgacagaaggctgggcgagaagccgtctacacagctggcccaggggcatgtgggttgggagcagtaggtcaagcccagggacagcaggaacaaggccgtggaagtttgcaagatgcgtgttggaccctggcactgtgttgggccctgctgctctggaagatgcggctctttcagagacagtgggctaattcctttttccagggcctccagcaaaggatgcttcagcgctctttacggtggtggcacctgagggcattgggaccggacgctactagctcgtgtaccaagaccccaagcgccctcgagccgctgagcagctccacgcttcaggacagccttgaaaaagtgcctcgcgctccaacccttccggatactctccaaggaagcctgctctgggccgctggccagaggcagcagggccagtgcttactgctgtggcaggcccgagcacagcagttccaagggacagccagatggtaccagcataccaggcagaggcgaattttcctgtcctggagtcgctgggctacagcacagtgggcctggcgggagctggcctctcatcgtgcttgggatcgaacgtgtcgcgctgttcttggactgtggcggcagcgtctgctgcagagcaggctggtcgaatggtgggcccaggagcgagggtggaggctcgcgagagatgcactgtgccattggcatagttgttggcagggacagcagttcctgcatgagaaatgtcagacttgggtccaggttcacttgcaggggctgcaaaaagtcgtctttcggtcctggcagcaggccgcagcccaccaaaggtgcaccgtgacacgccctgaacagctgctcctgcagtcatacttccaggcttggtgtgaggtggtgagagacacaggtgtgttgcgcgcacaacatcaggccttccaggacggattaaggcgaagggcgttaggcgctgtcttcgctacttggagagaagcacaggaagtagccgctggtgcccaggaacagcgcgtagcccaggcatccctggcaaggtggcggagctgcgggcagcagggccaagaggacggtcagcaaaagaaggccagagcaccgcaggcattccccgcatggccggtggcccctggcatgcatcatgaagcccagcagcaggcgggagaaagcgcaggggctcaggccgcacagtgctggacatggtgttgggcgttgtgggtccatgagagctgtcgtggccaggtgtctagagcccacgcctcttggaagccgagagcctgggttctggaagcctctgtccagtcggccgtgaggggcggagtacaacgtgctattttaacccaacttcgccctgcggagttgcggaggtttctccgaacagttcagctgcgcgtgcgcctgggccttccaggagccggaaagacgcggagctgctggacccaagcaaccgagctggttccacccgctccgagtcttcagtgttccctggggggacggcgtaaacccaggggcactgcctgggcccagagatgtcgcgagcacagcctgtgcccggcttttcagctgtggccacagtggcccggacaatctagctgggtgccgggactgcccctgtggaccagggatcaagggcctcgtgctcactcctctcccgagcccagggcttgcaaagcccagagcaaggcccacaagaggaggctgcgcgctcgatcttgccgaattctcgaaaaacaggctcaggcccacggatctgctcttttgttagcactgaagggacatgacgcgctggggcatcaggaggaagtgccagccgcaccagtccctcgaggaaccgcctcgagagcagccggatttccagccggtcaggtacctggttccggtatggctgctctgggaggatgtccgcgaggacgcgctgccggtgctgatcccgctcagggcgttgcacctgaaatgggtctcgcggatgtggtggctgccgatcctgcaaccgcaagcgggtctgctgtcacagcagctggacggtgggcattcaagaagtggcatcagcggctggcggcacggagccccaggcgaggagctgcaagttcccctagaccttggtctaagccagggcctaaggggccagagagcggacaggaggctgcccgagcgcctcggggttggggattgggggcagagcatggggctcaactacagctgtag

SEQ ID NO: 53563 - DNA, 732 bp, Artificial Sequence
  Description of Artificial Sequence: Synthetic coding sequence
agaagtgatgcttctcacaaggaaaatgtgtcaccaaagccggcagcgcttccaaagcctgaacagaggcggttcagacggagcctgggcatcggcctttccgggagacatgatcaatgggtccccggttgccaggtggagcgcggaggccctgctgcaactccttcacccggagctgtgctcgatcaggaaccgtgcagggtccagacaaatctagcttctcccggacccagattgggactggctctcaaagacactacgggccagttagtcaactcgtctttctggcagcaatctaatctgcagtccctagctcgcagaagacaagggaaggctcgagaatttgcaatccagcagagtaatctttcaatcaatgagacctcctctcctcacctatgtccagaacccggtggcagctctggaccacataaactgccatggggcccactgttgtcacaggaaccactggcacgcccaagttcgtgtcttcggcagtccgggctgcctgccccagggaccccatccggagatttccggccaaccgaagcctttgcacctctagatggccacacccaacctgggcttaggtcctggggagggctggggagttggcgatcaaggctggtgggagagccactgactctggaggatctcgccgtccctagccagaaccagactcaggccccaagcagggcagcagtacatcaactgctcgctagcacacttgggtag

SEQ ID NO: 53564 - DNA, 2187 bp, Artificial Sequence
  Description of Artificial Sequence: Synthetic coding sequence
atggagggggagggagtccgtaattttaaggagctacgagccaaattccagaatctggatgcaccgccactccctggtcccattaagttcccagcaggcgtctctcctaagggcgacatagggggtacacagtccacccagatcttggccaacggcaagcctctaagctctaaccacaagcagagaacaccctactgctcctcgagtgaatcccagcccctccaacctcaaaagattaagttggcacagaaatccgagatcccaaaatgctctaactctcccggacctctcggcaagtctaccgtatgctcagccacatcctcccaaaaagcgtctttgcttctggaagtaacacagtccaacgtggagatcattaccaaagagaaagtgatggtggccaattccttccgtaataagctgtggaattgggaaaaggtgagttctcagaagtctgagatgtcatctgccctccttctggccaactacggatccaaagcaattcatctggaaggtcaaaaaggtatgggtctaactccagaggaaccccgaaagaagttagagaccaagggagcacaaactctgccatcacagaagcatgtggtcgctcctaaaatccttcacaatgtttctgaggacccttcatttgttattagccagcacatccgaaaatcctgggagaatccaccacctgagagatcccctgcttcttcgccttgccagcctatttatgaatgtgaattggcaagtcaggcacccgaaaaacagccagatgtgcggcaccaccatctgcccaaaacaaagcctcttccatctatcgactctctggggcctccacccccaaaaccgtcccgccctccgatcgtgaatctgcaggcttttcagcgtcaacccgcagccgtgccaaagactcagggagaggtcaccgttgaggaagggagcctgagccccgaaaggctgttcaatgccgagtttgaagaaccacacaactacgaagcaacaatctcttacttacgccactcagggaatagtatcaacctttgtacagctaaggagattgctgaccccacctacgaggtgggtattgaagaattacagaaaccaggcaaaaactttccctaccctgaacccagtgccaagcatgaagataagaaaatgaaggagaagcagccgtgcgagttgaagcctaaaaacacagagaaggagccgtattctaatcacgtctttaaagtggatgcttgcgagggaaccccagaaaaaatccagatgaccaacgtgcacacaggcaggcggaacatgcttgccggaaaacaagaggcaatgatcgacattattcagaccaacccttgtcccgagggaccaaaattggcaaggcacagccagggacactgcgggcatctggaggtgctggagagcaccaaggaaacccccgacctgggcgtgtctaaaacatcaagtatttccgaggagatctacgacgatgtggagtactcaagaaaagaagttccaaagttaaattattcatcttcccttgcctcaagttctgaagagaatagggagttgtatgaagatgtgtacaagaccaaaaacaattatcctaagatcgatctcgatggaaaggaggccctgaagcgcctccagcagttcttcaagaaggagaaagataggttcaaaataaagaagacgaagtccaaggagaatctctccgcattctcgattctcctgcctgacctcgagctcaaaagtcaagaggtcatcatttacgatgacgtcgacctgtccgaaaaagagtccaaggatgaggacaaactgaaaatgtggaaacccaagttcttaacaccaaaagaaaagaaggaaaagaacggcgcagaggagagcgagtctttttctccccgaaacttcttcaagacaaaaaaacaaaacctcgaaaaaaaccgcatgaagagggaggagaagttgtttcgggagaggttcaagtatgacaaggaaattatagtgatcaataccgccgtcgcttgcagtaataattcccgcaatggcatttttgatttgccaatcagcccgggtgaagagctggaggtgatcgatacgactgaacagaatttagttatctgtcgtaatagcaagggaaaatatggctacgtccttatagagcatctggatttcaaacatcaatcctggagcccatag

SEQ ID NO: 53565 - DNA, 2091 bp, Artificial Sequence
  Description of Artificial Sequence: Synthetic coding sequence
atgcccacccaggacggtcagctgagaagaccagcgaggccccctggcccaagagcctggatggaaccgagaggagggggtagctcccaattttccagctgcccgggacctgccagctcaggggaccagatgcaacggctgttgcaagggcctgccccacgcccacccggagagccaccgggtagtccaaaatcaccgggtcacagtactggaagccagcgaccaccagattcccctggcgctcctccgcgtagcccatccaggaaaaagcgacgggctgtgggcgcaaaaggtggcggtcataccggcgcttccgccagtgcacagacagggtcaccccttctgccagcagccagtccagagaccgcaaaactaatggccaaggcaggccaggaggaattggggcctgggccagccggtgctcctgaacccggacctcgctcaccggttcaagaggatcgcccaggtcccggattagggctctccaccccggtgcccgtgacagagcagggcacggaccagatacgcactccacgcagggctaaacttcacacagtaagcaccaccgtgtgggaggctcttcctgacgtaagtagagcaaaaagcgatatggccgtttctacacctgcttcagagcctcagccagaccgggatatggcagtgagcacacccgcttccgagcctcagagcgatagggacatggcagtaagcactccggcttcagagccccagccagatactgatatggctgtgagtacgcctgctagcgagcctcaaccagatcgcgatatggcggtctcaatccccgcatctaaaccccagagcgacacagccgtctccacaccagcttcagagccgcagtcaagcgtcgctcttagcaccccaattagcaaaccacaactggacacggatgtcgcagtgtctacccccgcttccaagcatggactcgacgtggcattgcccactgcgggacctgtagcaaagcttgaggttgccagcagcccccctgtttctgaagcagtgccacgaatgactgagtctagcggcttggtttctacacctgtgcccagagccgatgccgctgggctggcctggcccccaactagacgcgcaggccctgatgtcgttgagatggaagccgtagtgtccgagccttcagctggcgctccaggatgctgttctggtgctccagccctgggcctgactcaggtcccaaggaaaaagaaggttcggtttagcgtggcgggaccgtcaccgaataagccaggatccgggcaagcatctgcgagaccttcagccccacaaacagctaccggagcccacggtgggccaggagcttgggaggccgtggccgtcggccctcggcctcaccagccgaggattctgaagcacttgcccagacccccaccaagcgctgtcactcgggtggggccagggtctagctttgcagtaacattgccagaggcatatgaattctttttctgtgatactatcgaagagaacgaagaggccgaggctgctgctgctggccaggaccccgctggggttcagtggccagacatgtgcgagttcttcttccccgacgtgggagctcaaagatccaggcgacggggtagtccagaacccttgcccagagccgatccggtccccgcacccatccccggagacccggtaccgatctccataccggaagtgtatgagcacttcttttttggggaggatcggttagaaggagtccttggccctgccgttccactgccactgcaggccctcgaaccaccgaggtcagcttcagaaggtgccggtccaggtacccctttgaagcccgctgtggtcgaaagacttcacctcgcactcaggcgcgcaggagaactgcgaggaccagtacccagctttgcgttctcacagaacgacatgtgcctcgtctttgtcgccttcgcaacgtgggcagtccgcacgagcgatccacataccccggatgcctggaagacagcgttactcgcaaatgttgggacaatctcagccattcggtatttccgaagacaagtggggcagggacgcaggtcccacagcccttcgccgtcatcctag

SEQ ID NO: 53566 - DNA, 1197 bp, Artificial Sequence
  Description of Artificial Sequence: Synthetic coding sequence
atgcctcgcccagggcatcccaggccagcctcaggcccacccagactgggaccctgggagagacccactgaactttgtctcgagacctatgacaaaccacctcagccaccgccatctagaagaacaaggaggcctgacccaaaggatcccggacatcatggccctgaatccatcacctttatttcaggcagcgccgaacctgcacttgagagtcctacttgttgtctgctgtggaggccctgggtgtgggagtggtgccgtgcagcgttttgcttccggaggtgtcgggactgcctgcagcgctgtggcgcatgcgtgcgtggttgctccccgtgtctaagtacagaagacagcaccgagggaaccgcagaggcaaactgggccaaagagcacaacggtgttcccccatccccagaccgggcacctccttcacgaagagatgggcagaggcttaaaagcacaatgggaagcagctttagctaccctgacgtgaaactgaaaggcattcccgtgtatccctatccacgagcaacttctcccgctcccgacgcagactcttgctgcaaagaaccgcttgccgacccgccacctatgcgacactccttaccctcaacgttcgcctcttcaccgcgtggctccgaggaatattactcctttcatgaatccgacctcgacctgcccgagatgggctccggaagcatgagcagccgtgaaattgacgtcttgatctttaaaaaactgacagagctcttttccgtgcatcagatcgacgaactggctaaatgcacgtccgataccgtctttctcgaaaaaaccagcaagatctcagatctgatcagctcaatcacccaggactaccatctcgatgagcaggacgctgaggggaggcttgtccggggaattattcgaatctccacgagaaagtcccgggcacgaccccaaacaagtgagggcagatctacacgggctgcggctccaactgccgcagcaccagactcagggcacgagaccatggtgggatcagggttgtcccaagacgaactgactgtgcaaatatctcaggagacgaccgctgacgctattgctcgtaagctccgcccatatggggctcccggataccccgcttcccatgattcctccttccagggcacagatactgattcctccggcgcaccacttttacaggtgtattgctag

SEQ ID NO: 53567 - DNA, 624 bp, Artificial Sequence
  Description of Artificial Sequence: Synthetic coding sequence
atgccaagaccaggacacccaaggcctgccagcggaccacccaggttgggaccatgggaaagacccactgagctatgcctagagacttacgataagccccctcagcccccaccctccagacggactaggagacctgatcccaaagacccaggacaccacggtccagagtctatcactttcatctctggctctgctgaaccagcactagaatccccaacttgcttgctgcgtactcctcttaggggcctactcaaacctaccgggccacgatcaactatggaatgccctccagcgctgattgttcatcctccagccggaggtatggcctcaggaagtagccagccctgggctgcagcttctgccaccccaatgctttcctctaaggcttctctgtgtatccctacacgtgggccaccaccccagccccttatgagaacgcctgccgctcgtagccactggcctatccctcatccctgcgacactgcatgccccgctcctctccccgtcgtgctggtggctccgaggtccacaattctgagcatgagccgcacctggacatgccggaggtgggcagtggcaccctgtcgtgcagaaaagcttatgtgctcaagcagcagatcctag

SEQ ID NO: 53568 - DNA, 4593 bp, Artificial Sequence
  Description of Artificial Sequence: Synthetic coding sequence
atgtctcattcgcatccggcaggcttactggccgcatataactcgctaatggataaacatctcgccggatattttaataacacccggattcggagacatctcctgagatccggcctcattactagatcaggcagaattttgagcgaaaaagaatacaagctaaatatgatgaaaagggatcatcagaaatatatacgagaatgtttagcccaggccattttccataaggtccttgacatggagcgttaccatcaactagaaataaagaagaaactggagaccctcgccagaaaagaacggattcagagatttaaaggcgagcacacgcggcgttctgttgaaaacaatatgccaatactgagcccgcatcccccagtgggccctaaatctaacagaggtcatagtgtgctcgtagacgagggacatagcagccccctagcactcacggccccacgtccctacacggctccgggtaacatgcaaccccctattagactgcaaccgctcccctcaaacccagccgtggagaccgtccctaaagtgacttcaagatccaggtcaaagactagccttctggaaaacgaagccctctttcctattggaggcaagaaggccgtcatgaagtttcgtaatagcattggaaattctcagaggatgaactcctaccaacttcccaacattaactcatacatgatgccaatccctcctccattaccccctactggcaaaatcaccagggagaatcgttccgagacatggaggagacgacgatttaggcctacgacagctcccaacggactcgaacctctgctgacaaaagattcccgacgaatacataagacatctctgcatagtaacgccgcaatcacaatgatctacttagggaaaaatgtgcacttatccagcgacaaccccgattttcgggacgagatcaaggtgtaccagcaacactgtggcggagagaatctgtgtgtctataaagggaaacttctagagaaggagacattccagtttattagtaagcgacaccacggatttccattttctttgacgttctttttaaatggcatgcaggtgaataggctgagcagctgctgcgagtacaaacatagaaagggctccagactcggtgggaaacggggatattttgggtttgtttgtgttgaacgctcctctccttgctataaatgcatcatcgcaatgggattggataagaaaccgtctcttcccaaaagccgtaaggagaaaagcaccgaaaaaggggaggagttaaagaaagcagaagggaaagtgagaaaggagcgagaatacgttattcccaagagaaacgagattaaagagaataaaacttcagtgtcagccaaattctctgcgcaggagatcaaaacaggattgaaggaggtggtgactgctgttgaggaaatgaccagcaaaggaaaacccggtcaggaggtgctcgaggatgatcaagagaatacccttaaatatgagtacgaagaagacttcgaagtcgacgaggaaaagcagggagaaaagagcaatgaggaagggcaggcagacgttcaaatgaatgggataccacaatccccactcgacgacaagaaggacaatttggatcccgagaaggagagcgaaacgagcagtcagaaagctccagacgcgcgagacaacgtcaaggatgagaatgacggttgctcagaatctgaactggaggaggataaacaggacatgaagacggcctccagtacaagcagccgctctcatccgtacagctccgactcggaggatgaatccgctgtgggcgatcgcgaagctcacactgactcctccacagacgaatcggctcgcaggagttcttcccaggagctgtccgagaatgacaagccgagaaagagccacctgcccatcgaggagtccctagagatcgagatagaggaccaggagataaccaaggctgacgtggaaaccaagccgatgcctatagacgaaagtttcgagaacgtgttgaaggaagggactgagaaaggaactcaggaaattgccgaggggctctctgagaagagcggaaagcatgtgtctgccgaggagaaggaaaaagacaaaagtaagctgtgggaggaatcaacagctcaggtgaaggacaagaaagcaggcctccccggtctggaagagggcggtaaagacagcctcccgctggcctacgttctggccctgggtgcgcctaccatgaactttatggtggacgaaaccgcagccataaacagcaataaggagtcacagcagctcgtgcaaaaaacttatacccttgaaaaaaaagaggccatggaggaagatgaggcaccccagcacagagacgccgatatcgtgcaaggcaagggagaggcggctttatggggagaagccggagccgtgcatgaggccccactgagggcatggaagcctacggccgaacaacctgagctggccgaggaatttaccgagaagagggagatccctcctggaatcgagcgtggagccgaaggcgctgcggaggccgaaggcgtgcggaggctgggcgaaggtggttctgacccaatcggtcaggcggcagctaaggacgccgtcggactttccaaggatgaggccccagaaaagcaggcattaatgctgacggtccttgaaaccgacaaagcagcaagtgagggtgaacagggcctcgagaaggctgtattggctaatgaagccgctgcgctcaacctcgagcatctgcatgaggtggctgcactcagggaggcagccacctcagaggagggcgaagctgaggggggagtcgctgtgagtgacgtcggggaatccgaagaggaggcaagcatcgacctagaagatacagggcctatggaggacactgcatcgaaacgggaggatggatcagaagaggccatcctgggcggagaagagcccgcaaaggagagaaaagaagtgatgaggacagagaccagactgtcaccctttacaggcgaagccgaggcatccagaatgcaagtgtccgaaggaagcccagaagaagggtcactggccaaagaggcttttctttgtaaggaggatgttgaaggcgaagaaatggtgacagaggctgaggcaaatcgggaagacgatcggaaagaaattctgccaaaggagctggatcttgcacgagagcgacggaaggccgagagaccaaaaacttccttacggaaaaccgactctgagcgggaggaagtgaccagagccaacgcgcttaaggatgaagatgctttcaaggaggaacaaaagctaaaggctgaagagggtgaaacagaaacggaagtgcgagctgaggaggagaccaaggcaccccctaatgaaatggggtctgacgccgagaacgaggcacctgtggaggctagtgaactatctgacaatcccggtctacttggcgaggactcacttaaagagactgtggtcccaatcttcgaagccacaccaggcttcgaaaaatcattggagaatattactgcactgagaaaagaaggcggaggagaaagattgtctgaggcccgtgataccgaacataaagaccgtgaagagctctcatcccgtgaaaacagagctctcaaagaaggacaccgccaggacggagaaggagctctggcagcgcctgaagccgaacccgcaggaaaggttcaagccccagaaggactgatcccggcaactgggcaggccgaagagttggcagcaaaggatcatgatagttgtgccggtcttgagggacgcgcagagggccagggcggagtggatgtggtcctgcggacccaggaggccgtcgcagaggaggacccgatcatggccgaaaagtttcgcgaagaagctgtcgatgaggaccctgaggaggaagaagacaaggagtgtaccctggagactgaggcgatgcaggatagaaacagcgaaggggacggagacatggaaggcgagggaaacacccagaagaacgaggggatgggcggaggaagggttgtggccgtggaagtgctgcatgggggtggcgagactgccgaaactgctgcagaagagagggaagtcctggctggctccgaaactgctgaggaaaaaactattgccaataaagcctcttcctttagtgatgtggctgaggaggaaacttggcaccaacaggacgagctcgtgggcaagacggctgctgctggaaaggttgtcgtggaggagttggcgaggtctggggaagaagttcccgcagctgaagaaatgactgtgacatacacgacagaagcgggagttggtaccccgggagctcttgaacgtaagaccagtggactggggcaggagcaggaggaaggctccgaaggccaggaagcagccacaggaagcggcgacgggcgacaggagaccggcgctgcagaaaagtttcggttgggcctctcccgtgaaggcgaacgagagctgagccctgaaagtttgcaagccatggccacactgccagttaaaccagatttcacagagacacgcgaaaagcagcagcacatggtgcagggagaatccgagaccgccgatgtgagcccaaacaatgtgcaggtatag

SEQ ID NO: 53569 - DNA, 1602 bp, Artificial Sequence
  Description of Artificial Sequence: Synthetic coding sequence
atgttagcaaagggcaagaaagctgtaatgaaattcagaaattctattggcaatagccaacgtatgaactcctatcagctccccaacataaacagctatatgatgccaatcccgcctccgctgcctcctacgggcaagattacgagggagaacagatcggagacctggaggaggcgccgattccgtccgactaccgcccctaatggattggagcccctgttgacgaaggacagcagacgcatccacaaaacctccctccactccaatgccgctatcaccatgatctacttaggaaagaacgttcatttgagctccgacaatcctgatttcagagatgaaatcaaggtgtaccaacagcactgcgggggagaaaatctctgtgtgtataaaggcaagctcctcgagaaggagacttttcagtttatatcaaagaggcaccatgggttcccttttagcctgacctttttcttgaatggcatgcaagtgaaccgcctctcttcttgttgcgaatacaagcacaggaaagggtccagactcggcggaaagagaggctactttggatttgtctgcgtggaaagatcttccccttgttataaatgcatcatcgctatggggctggataaaaagccatccttgccgaagtccaggaaagagaagagcaccgagaagggcgaggaattgaagaaggctgaagggaaagtgcggaaggaacgcgagtacgtgattcccaagcggaacgagataaaggagaacaaaacatcagtgtctgctaagttctcagcgcaggaaataaagactggccttaaggaagtcgtgacggctgtggaggagatgacctccaaaggaaaaccaggccaggaggtgctggaagatgaccaggagaacacactgaaatacgaatatgaggaggatttcgaagtagatgaagagaagcaaggtgagaagagcaatgaggagggccaggcagatgttcaaatgaatggtattccgcagagccctttagacgataaaaaggacaacctggacccggaaaaagagagtgagacctcgtcacagaaggctcccgacgcccgagacaacgtgaaagacgagaatgacggttgttctgaatctgagctggaagaagataaacaggatatgaaaaccgccagctccacatctagcaggagccacccatatagctctgacagcgaggacgagtccgcggtgggggaccgagaagcccatacggacagctcaacagatgagagcgccagaaggagtagcagccaggagttgagcgaaaatgataagccacggaagtctcatttacccatcgaggagagcttggagatcgaaatcgaggatcaggaaatcactaaagcggatgtagaaacaaaacctatgcctatagatgagagctttgaaaacgttctgaaagagggtaccgaaaaaggcacccaggaaatcgctgaagggctttctgaaaaatcaggcaaacatgtctctgccgaggaaaaggaaaaagacaagtccaagctttgggaggagtctacggcccaggtaaaggacaagaaggccggacttccagggcttgaagagggaggaaagtacgggaggtag

SEQ ID NO: 53570 - DNA, 732 bp, Artificial Sequence
  Description of Artificial Sequence: Synthetic coding sequence
atgcgctcgagaaagctcactggggctgtcagatctagcgctagattaaaagcacgctcctgctcggccgctagactcgctagcgcacaggaagtagctggctcgacctcagcaaaaactgcctgcctcacttctagctctcacaaggcaaccgatacaagaacatccaaaaaatttaaatgtgataagggacatctcgtgaaaagtgagctgcagaaacttgtccccaagaatgacagtgcctcacttccgaaggtcacacctgaaactccctgcgagaacgagtttgccgagggatcagcacttttgcccggttccgaagctggagtctccgtgcagcagggggcagcgagccttccgctgggtggatgccgagtagtgagtgactccagactcgcaaaaacgagggacggattaagcgtgcctaagcactccgccggttccggagccgaggaatcaaacagcagctctactgtgcagaaacagaatgaacctggcttgcagaccgaggacgtgcagaagcccccattacagatggataattcagttttcctggatgatgactccaatcaacctatgcccgtgagcagattctttggcaatgtagagcttatgcaggatctcccccctgcatcctcctcctgtccatcgatgtctcgaagggagttccgaaagatgcatttccgagcaaaagatgacgatgacgatgatgatgatgacgctgagatgtag

SEQ ID NO: 53571 - DNA, 1245 bp, Artificial Sequence
  Description of Artificial Sequence: Synthetic coding sequence
atgagggaaagtcaagatgccgcaggtgcccacggctggaaccgggtggggtctacagccaccaagtggttcacaggagctcctttcggtgtgcagtcccacagattcgacattagcgcggtctaccccaactggaaaaagttcagcacattcacagaagccccatacagcaccagatatagtacccaggtttctcacatcggtccaggtacgtatagctccaaagaaacgtgtttcagcaagaagaaactaatgaaggaagtggatactggatgggcaaaagctcaggaagccacccggttaacccagcttccccatttccagtatcaagctattatgaaagagaagcgcctgaaggagcagaaactgggccctgggtcctataaccttaaggacttccttgaacagcttagagagaaaccttgcagtactcgcggtctgctatcttctggtgaagtccggttccggggactgactgggaattattacccaggaccaggcaattatggcgagaaagggaatccttatacaaagctggaagaaaacgcctggaacagaagccattctgaggggttgatgtgccggatgtctaacaaacctcatcccagaccctatcagggcagcgggctgggaccagggacctatttcttcaagtcagacctagagacctacgtcgcccgtagcgtaggaacacggggaccgtatgataccttttctggggataggagcaaaccccttccttatggtcactactccatgcaaaaaaaaaagcctcgtgagttgatgaacttcaaatcattcgtagaggagctgaacagccatcacaataaaaaacacggcgttttttccaagcttccacgcaatcccaagacacccacagagcgtatctattgggctaacttaagccagtgcccacgcacgctggcaacgtccgggcctagcttctggcttccgcaggaaaagaaatgcaaacccgtgaatcagcctccatttctgctgaccagtaagggctcaggcgcaaaagcttgtcaaatgattatgggtagctggaaccccgtgggcgtgggacgatacctcaatacttggcttatggaaacaaaggacagacggcagagatataggtcattgttcctcagcggaagtaaaagatacctgtctgacctggccagggatatgctgatgcagattcggctcttttgttggaagggcctggaggtaattaacttcggcctgtcccccatgtag

SEQ ID NO: 53572 - DNA, 1257 bp, Artificial Sequence
  Description of Artificial Sequence: Synthetic coding sequence
atgcgggagagtcaggacgccgcaggggcacacggctggaatcgcgtcggaagcactgccaccaaatggtttaccggcgcacccttcggcgtccagtcacaccgtttcgatatttccgccgtctacccaaattggaaaaaattttctacatttacggaagccccttactccacccgttactccacccaggtatcgcatatcggacctggtacgtactcctccaaagagacatgtttcagtaaaaagaagctgatgaaggaagtggatacaggctgggcaaaggcacaggaagcaacgcgcctaactcagcttccccattttcaatatcaagccatcatgaaagaaaagcgcctcaaagagcagaagctgggcccagggagctacaacctgaaggatttcctggaacagttacgtgagaaaccttgctcgacaagaggactactttccagcggagaagtgaggtttaggggattgaccgggaactattatcctggacccggaaattacggtgagaaagggaacccatacacaaagctcgaagagaacgcttggaaccggagccattctgagggacttatgtgccgcatgtcaaataaaccccaccctcgcccttatcagggatccggcctgggacctggaacttattttttcaaaagcgatctcgagacttacgtcgccagaagtgtgggcaccagaggtccctacgataccttctctggcgaccggagcaaacccctgccttacggacattactctatgcagaagaaaaagccgagggaactcatgaatttcaagtcgttcgtggaagagctgaatagtcaccacaacaagaaacacggtgtgttcagtaagctcccaaggaatcccaaaaccccaacagaacgtatttactgggctaatctttcccaatgtcccaggacgttagctacaagtggccctagcttttggctgccgcaggagaagaagtgcaagcctgtcaatcagccccctttcctgctcacgagcaaaggctcgggcgcaaaggcatgccagatgatcatgggctcatggaaccccgtcggagtggggaggtatctcaacacctggcttatggaaaccaaggaccgcagacaacggtataggtcgctatttctctccggatccaaaaggtatctgtctgatctagcaagagatatgctgatgcaggaaaggatcacaccctttaccaagggcaagtgtcccccaacagtcgactacaatagcgacccaaccccctag

SEQ ID NO: 53573 - DNA, 372 bp, Artificial Sequence
  Description of Artificial Sequence: Synthetic coding sequence
atgctgggcccaaatgcacaggtgactgtggttgtcgctcagcccggacccgaccatctcgatcatctgttgttggatacccagcactgccaacactcctcctgcggatccgccgcatgtacacagttgacctgggtgccgtgtcttggaggctcacacaaagcttctataaagatgtccgctcaggcggttgtgagcacagaagcaccttgggagcgtccctgtttccaggcacacctgggatgtctgcagaactctgtactgtgcagctgccgaatggagggtttctccctattcctggcgatgctgtgggggggagtgggcgaactcccctcagaccctagggggcatttgcagttcctcgccacctag

SEQ ID NO: 53574 - DNA, 372 bp, Artificial Sequence
  Description of Artificial Sequence: Synthetic coding sequence
atgcttgggccaaatgcacaggtgactgtcgtggtagcccagccaggtcctgaccatctggatcatttgctgttggacactcagcactgccagcattcatcttgcggctccgctgcctgcacacagctgacatgggttccctgcttggggggtagccacaaagcaagtatcaagatgtccgcccaggcagttgtttcaacggaagccccatgggaacgtccatgttttcaagcacacctgggatgccttcagaactctgtcctttgcagctgtaggatggaagggttttccctattcctagctatgctttgggggggagtgggcgagctgcccagcgacccccgagggcacctccagttccttgccacttag

SEQ ID NO: 53575 - DNA, 306 bp, Artificial Sequence
  Description of Artificial Sequence: Synthetic coding sequence
atgtccgtcgaaaagatgactaaagtggaagaatcattccagaaggccatgggccttaagaagactgtagacaggtggcggaactcacatacacattgcctctggcagatggcattgggtcagagacgcaatccttacgcaactctccggatgcaggatactatggttcaagagttggctttagctaagaagcagctgctgatggtgaggcaggcagctctgcatcagctttttgagaaggaacaccaacagtaccagcaggagctgaaccagatgggcaaggctttctacgtggagcggttctag

SEQ ID NO: 53576 - DNA, 534 bp, Artificial Sequence
  Description of Artificial Sequence: Synthetic coding sequence
atggcaacgaattattctgccaaccagtacgaaaaggcatttagcagtaaatacctgcagaactggagcccgaccaaaccaacaaaggaatctatcagttcccacgaggggtacacgcagatcatcgcaaacgaccgcggtcatcttctaccttctgtgcctcgaagtaaggcaaatccttggggatcttttatgggaacgtggcagatgccactgaagatacccccagctagagttacattgacctcgaggacgaccgccggtgctgcctcacttactaagtggatccagaaaaatcctgaccttctgaaggcctcaaatggcctttgtcccgagatcctagggaaaccccatgatcccgacagccagaagaagctgcgtaaaaagtcgatcacaaaaacagtgcagcaggcacggtcaccgaccatcattcctagtagtcccgcagccaatctgaacagccccgacgaactacagagcagccacccgagtgcgggtcacacgcccggtcctcagagacctgcaaagagctag

SEQ ID NO: 53577 - DNA, 510 bp, Artificial Sequence
  Description of Artificial Sequence: Synthetic coding sequence
atgccccctacaagagatccattccagcagccaacgctggacaatgatgatagctatctcggcgagttaagggccagcaaaaagctgccctataaaaaccctacgcacctggcccagcagcaggaaccctggagccgactgaatagcacccccacaatcaccagcatgagacgggatgcctactacttcgatccggagattcccaaagatgaccttgatttccgtctggcagccctttataatcaccacacaggaacattcaagaacaagtccgagattctgttgaaccagaagaccacacaggacacctataggactaaaatccagtttccaggcgagtttctgactcccccaacaccacccatcacattcctcgccaatattagacactggatcaatcccaagaaagaatctatccactcaatccagggcagcattgtgtcaccccatactgccgcaaccaacggagggtactcccggaaaaaggatggcggatttttcagtacctag

SEQ ID NO: 53578 - DNA, 474 bp, Artificial Sequence
  Description of Artificial Sequence: Synthetic coding sequence
atggagagatccccttccagaagaaggcgtttggaagaagctcctaaactaccgtacaagaaccctacacacctagctcagcaacaggagccttggagccgcttgaactctacccccactattacctccatgcgtagagacgcctactacttcgatccagagattcctaaggacgatctcgactttaggttggctgctttatataaccatcacacgggcacattcaaaaacaagtctgaaattttactgaatcagaaaacaactcaggacacctacagaactaaaattcaattccccggtgagttcctgactcccccaacaccccctatcacattccttgccaacatccgccattggatcaacccaaaaaaagaatcaatccatagcattcaggggagcattgtgtcacctcacacagcggcaaccaacggcggttacagtcgcaagaaagacgggggttttttctccacatag

SEQ ID NO: 53579 - DNA, 381 bp, Artificial Sequence
  Description of Artificial Sequence: Synthetic coding sequence
atgccaagcagcacactgacttgtaaaccattcgatctgaagcagagaagcagtcgacgcggtcctaaatctactgcctctgcgtcccctaggagctgcctaaagccctcttgcggaaagcaggtctgcctgctgttgagtgttaggcggagccaatccctagcccatcctgggagggacagcacgcgggtcctgagttatcagcaaacaagctccgatgccgtatcacagtataaacacactggaaaagtggaggaattgtatggacttagactgagctggctttcccaagctcagtttctcttagcgcaggacaagactgcatacgctgtaaaaagcgtggtgttaccagccagcaaccacaaaacaaagggacagtag

SEQ ID NO: 53580 - DNA, 216 bp, Artificial Sequence
  Description of Artificial Sequence: Synthetic coding sequence
atgcccagcagtaccctcacctgcaagcctttcgacctgaaacaaaggtctagccgcaggggaccaaagtccaccgcgtccgcctcaccccgaagctggattctctcacagaacccgaaagcgcagagttcccatgagaaaacatctggtaagccaaaatttcgggaggttttacagaatacgaaccaatactccagcaagttttcccggtcatag

SEQ ID NO: 53581 - DNA, 282 bp, Artificial Sequence
  Description of Artificial Sequence: Synthetic coding sequence
atgacaaataccaaggaccccaaacgcgcaatggaatctaccctcgccacttctaattccgctactggcccagtgacctttagtcatgtattcggccaacagtgtcagctgatgcaggcggcagtacagagcttacatacgctgaatgaccagattagccacttcatcgttactaaatccaaagcgttggaggaggacaaagatccttttctgcccaccgagaaggaaactttgaagtcctccatgatacttatgcggcatttgttgatggatgcccagtag

SEQ ID NO: 53582 - DNA, 984 bp, Artificial Sequence
  Description of Artificial Sequence: Synthetic coding sequence
atggctagcatggcagccgctatcgccgcatctagaagtgccgtgatgagtggtaaccgacccctggacgaccgtgagcggaaacgcttcacttacttctcgtcccttagccctatggccaggaagatcatgcaagacaaagagaagatcagagaaaagtatgggcctgagtgggcccgtttgccacctgctcagcaggacgaaataattgatcgctgcctcgtgggcccacgcgcacctgctcccagggaccccggtgattcagaagaattaacacggtttccaggcctacggggaccgacggggcagaaggtcgtccgctttggtgacgaggaccttacttggcaggatgagcattccgctcctttttcatgggagacaaagtcccagatggagttttctatttcagcattatctatccaagagccgagtaatggtacggcagcctcagagccgaggccactctccaaggctagtcaggggtcacaagctctcaagagtagccaaggatctcgctcaagcagtctagatgctcttggccctacaagaaaagaagaagaggcctctttctggaagatcaatgcggaacggtcacgcggagaaggacccgaagcggaattccagtccctgacccccagtcagatcaagagcatggaaaagggagagaaagtgcttcctccctgctaccgccaggaacccgcacccaaggacagagaggccaaggtcgaacgccctagcaccctccggcaggagcagcgtcccctgcccaatgtatccaccgagagagagcgcccacagcccgtgcaggctttctcatcagccctgcacgaagcggctccttctcagctggaaggcaagctcccatcacctgatgtccgtcaggatgatggggaagacaccctgttctcggagccaaaattcgctcaggtctcaagttccaatgtggttctgaagacgggctttgactttctggataattggtag

SEQ ID NO: 53583 - DNA, 870 bp, Artificial Sequence
  Description of Artificial Sequence: Synthetic coding sequence
atggcaagaaagattatgcaggataaggaaaaaatccgcgaaaagtacggcccagagtgggctaggttgccccctgcccagcaggacgagattattgaccgctgtctggtcgggccaagggcacccgcaccacgcgaccctggcgactcagaagagcttactagatttcccggactcagagggccaacaggacagaaggtagtgcggtttggagacgaggatctgacctggcaagacgagcactcagcccctttctcatgggaaactaagagccagatggagttctctatatccgccctgtcaattcaggaacctagcaacggtacggcggcttccgagccaaggcctctgtccaaggcttcacagggctcacaggcattaaaaagcagccagggctctaggagttccagcctggacgctttaggcccaactcgcaaggaggaagaggcgagcttctggaagatcaacgcagagcgctcacgcggagaaggacccgaagccgagttccagagtctgacaccatcacaaatcaaatccatggaaaaaggcgaaaaggtgttgccaccctgttataggcaggaaccagcccctaaggacagagaggccaaggtcgaacgcccatcaacgttgcggcaggagcagcgtcccttacccaatgtaagtaccgagcgtgagcggcctcaaccagtgcaggccttttcctccgccctgcatgaggccgcaccaagccagctcgagggaaagctgccgtccccggacgtgcgacaggacgacggtgaagacacactattttctgagccgaagtttgcacaagtctcttcctccaatgtcgtcctcaaaacagggtttgactttctggataactggtag

SEQ ID NO: 53584 - DNA, 594 bp, Artificial Sequence
  Description of Artificial Sequence: Synthetic coding sequence
atggagttcagcatcagcgcgctttcaatccaagaaccttcaaacggaacagctgccagcgagcctcgacccctgagcaaggccagccagggatcccaggccctgaagtccagtcaggggtctaggagcagctctctggatgccctgggcccaactaggaaagaggaagaggcctccttttggaagatcaatgccgaacgctctagaggggagggacctgaagctgagttccagagcttaaccccatcccagatcaaatctatggagaagggcgagaaggtgctgcctccctgctaccggcaggagccggctccaaaagacagggaagccaaggtcgagagaccaagcacactccgccaagagcagcggccactccctaacgtgtctacggagcgcgagagacctcaacccgtgcaggccttcagctctgctttgcatgaggctgctccatcacagcttgagggtaaactgccttcaccagatgtccggcaggacgatggcgaggacaccctcttttctgaacccaagtttgcccaagtttcctcgtcaaatgtggtgctaaagacaggtttcgattttctcgataattggtag

SEQ ID NO: 53585 - DNA, 504 bp, Artificial Sequence
  Description of Artificial Sequence: Synthetic coding sequence
atgccttcacagagcgcctgccctgtgttgtctactgcaccgggaaccccgtgtgatttaagaaagcacctgttgaacatggtaagcgaggagaagagatcaccccagctgtcagctaagacatggaggcgcggactgagactccagaagagacgtaacgccctcttcctgcccgagggggacatttgcgtagttggaagtacttcaggcgctagggccctgattcccgagacctctaaactagagcgtagtgggaccgtgatcgcatactgtaatttggagctccttgctagcagtgatccacccgtgtgggcctcacaatcaactggaatgacgggcatgtcttataggtctcaaccccagctcggctttaagtctaccccgccagcgcactcaagcgtcttccaccactcggtgaaggctcccaaagaagaccaggcccaggaggccgctagccgaccgctgacttcacaggacggatggaatccgaatatcaaaaaatag

SEQ ID NO: 53586 - DNA, 864 bp, Artificial Sequence
  Description of Artificial Sequence: Synthetic coding sequence
atgaacgccctggcaaacattcccgacgtaccggtgaaatatcgcaagaatgatatcccaggtccagggttctacaatgtgattcatcagtcaccagtgtctaactccgtgtccctcagcaaaaaggggacctgcatgtttcccagcatgtgtgcaagactggacactattatcagcaaatacccagctgccaacgcctacactatcccctccgacttcattagcaagcgcgacttcagtaacagctgctcgtcaatgtttcagttgccatccttcatgaaagcccttaaatttgaaacacccgcaccgaactactataacgcatccgtttcttgttgcaaacaaagaaataatgtgtgcactagagctggctttatgagcaaaacccaacgcggatccttcgcctttgcggataagggaccgccaccaggacattacgacatcaatgaatccctagtgaaacagtcacctaataccctaatgtcttgctttaaaagcaagacaaacagaggactcaagttaacctctaccggaccagggcctggatattacaacccttccgattgcaccaaagtgcccaaaaaaactctatttccaaaaaacccaatcctgaacttttcggctcagccatcccccctccctcccaaacccccatttcccggtcccggacaatacgaaattgtggactacctggggcctcgtaaacacttcatctccagcgcgtctttcgtatcaaatacttctaggtggacggccgcaccgcctcagcccggtctgcccggacccgctacctacaagccggaacttcctggaaagcagtccttcctgtacaatgaggacaagaagtggatacctgtcttgtag

SEQ ID NO: 53587 - DNA, 1005 bp, Artificial Sequence
  Description of Artificial Sequence: Synthetic coding sequence
atggataatagcgcccaaaagaatgaacggaccggtaagcacccccgtcgcgcttccgaagtacagaaaggttttaccgccgcttaccccacccagagctctataccctttaagagccaggcatccgttatcccagagagtgaaaagaaaggttttaattcccaagcaaagcgtttcccccacaagaaaaatgatatcccgggtcctgggttctataacgtcattcaccaatctccagttagtaacagcgtctccctcagcaagaagggcacttgtatgtttccctccatgtgtgcccgactggacactattatctctaaatacccggctgctaatgcctatactatcccctccgattttatctccaaacgggatttctcgaatagctgctcctcgatgtttcagctgccgtccttcatgaaggcactcaaatttgaaacaccagctcccaactattacaatgcctcagtgtcctgttgtaaacagcgcaacaacgtatgcactcgcgcaggatttatgagcaaaacgcaacgtggaagcttcgctttcgctgacaagggtccgcctcctgggcactatgacataaatgaaagcttggtgaagcagagtccaaacaccctgatgtcttgctttaaatccaaaacaaaccgtggtttgaagctcacgtcaaccggacccggacccggatattataatccttcagattgtaccaaagtgccgaaaaagacgttattccccaagaaccctatcctgaacttctccgcacagccttcccccctgcccccaaaaccaccattcccgggacccggtcagtacgagatcgtggattacttgggccctagaaagcattttatcagctccgcttctttcgtgtccaatacatctcggtggaccgctgccccacctcaaccgggtcttccgggtccggctacatacaaacccgaacttccaggcaagcagtcttttttgtacaatgaagataaaaaatggatccccgtgttatag

SEQ ID NO: 53588 - DNA, 510 bp, Artificial Sequence
  Description of Artificial Sequence: Synthetic coding sequence
atgtgtgctaggctggacaccatcatttccaaatatcctgcagcgaatgcctacactatacctagcgatttcatctcaaagagggactttagtaattcctgctccagcatgtttcagttgcctagtttcatgaaggctctcaaatttgaaaccccggctcctaattactataacgcttccgtgtcctgttgtaagcagcgcaacaatgtgtgcaccagagcaggatttatgtcaaagacacagcgtgggtcttttgcttttgccgacaaaggccctccacctggtcattacgacataaacgaaagcctggtgaagcagtctcccaacactctgatgtcttgctttaaatccaagaccaacaggggactcaagctaaccagtacaggccctggcccaggctattataacccatcagattgtactaaagtccctaaaaaaacattgttccctggtggctccaaggcttcagacctagcaggccatttaccaaaatccacgcaaccaacttag

SEQ ID NO: 53589 - DNA, 1005 bp, Artificial Sequence
  Description of Artificial Sequence: Synthetic coding sequence
atggacaattccgcccagaaaaacgaacggaccggaaaacacccaaggcgagctagcgaagtccagaaagggttcacggctgcgtaccccacccagagctctattccttttaagagtcaggctagtgttattccagaatcagagaaaaaggggttcaactctcaagccaagagattcccccacaaaaagaatgacatcccgggacctgggttttataacgtgattcaccagagccccgtgagtaattccgtcagcctgagcaaaaaaggcacttgtatgttcccaagtatgtgcgccagactagacacaattatatcaaagtatcccgctgcgaatgcgtataccattcctagcgacttcatctcgaagcgggacttcagcaattcctgttcttccatgttccaactgccatcctttatgaaagctttgaagttcgagacccctgcaccaaactactataatgcttctgtcagctgttgtaagcagagaaacaacgtttgcacgcgcgctggttttatgagcaagacacaaaggggaagcttcgcctttgctgataagggccctcccccagggcattacgatataaacgagtcccttgtgaagcagtcacctaataccctgatgtcttgcttcaagtctaagacaaaccgtgggctgaaactgacttctacaggacctggtcctggatattacaatccatccgattgtacaaaggtcccgaaaaagaccctgtttcccaaaaaccctattttgaattttagcgcccaaccgtcccctctgcctcctaaaccaccgttcccaggcccaggtcagtatgaaatcgtggactacctaggacccaggaaacacttcatttcttccgcaagttttgtatcaaatactagtcgatggaccgccgctccccctcaacccggattaccaggcccagcaacttataagccagagctgcccggaaaacagagcttcctgtataatgaggacaagaaatggatacctgtgctgtag

SEQ ID NO: 53590 - DNA, 435 bp, Artificial Sequence
  Description of Artificial Sequence: Synthetic coding sequence
taattcaccgcagcttatcctacccagtcctccattcccttcaaaagtcaggctagtgttattcctgaatccgagaaaaagggatttaactcccaagcaaagaggtttccccataaaaaaaacgatatccccggtccgggattttataacgtcattcaccagagccctgtctctaatagtgtctctctgtcaaagaaggggacatgcatgttcccatcgatgtgtgcacgacttgatacaatcatctctaaatacccggcagctaatgcctacaccattcctagcgactttatttcaaaaagagacttctctaattcctgctcgagtatgtttcagcttccatccttcatgaaagccttgaagttcgagaccccagccccaaattactacaatgtccgaaccctcccaatgctggcgaagtatcgatcaaactag

SEQ ID NO: 53591 - DNA, 1152 bp, Artificial Sequence
  Description of Artificial Sequence: Synthetic coding sequence
atggacaatagcgcgcagaagaacgaaagaaccggtaagcatccgaggcgcgcatccgaagtccagaagggctttacggccgcttatcccacacaaagttccatacccttcaaaagtcaagccagtgttattcctgagagtgagaagaaggggttcaattctcaggctaaacgcttccctcacaaaaagaacgatattccaggaccaggcttctacaacgtcatacaccagtcccccgtgtctaactcagtgagtcttagcaagaaaggaacatgcatgtttccaagtatgtgcgccagactagacacaatcatttctaagtatcctgcagccaatgcttacaccataccctctgatttcatcagcaaacgcgattttagcaactcctgttcatccatgtttcaactcccttcgtttatgtctaaaacgcagcgcggatccttcgcttttgcagacaaaggccctccaccgggacattacgatattaatgaatctctggttaaacagtctcccaacacacttatgtcctgtttcaagtctaagaccaaccggggtctgaaactaactagcaccggaccaggacctggttactacaaccccagcgattgtaccaaggtcccgaagaaaactctttttcctaagaaccctatactgaatttttccgcccagcctagtccactcccacccaaacctgcttggcctagttatgtacaggcgcgtgcttccaggaaagcggttctgcccttacagaggggacaagaaatggaccctggatcagtgggaatgtcccacaaggttaaggaaaacagcagccatcagccaactctgccctctgtgccgagaaccttcctcaggcgacgccctattatgagcgtggccgcagacaacctgggaggcggaagcactaccctggcctggcaccctagccggaccgccgctattgctttcgtcctgagctggcgtcattgtagcctcgagacgagcccgcagccgcaccgcctgcagtggttgccggagcagaaaggcggagtcgaccgcgcaccatggcttcttccacacgcgccaatccaggctgcttttcgccacgattctctgccccaaacagaaggcacacctgaggcacagactagtcgcagaatcagcccaccctag

SEQ ID NO: 53592 - DNA, 507 bp, Artificial Sequence
  Description of Artificial Sequence: Synthetic coding sequence
tgtgcacgactggataccatcatatcaaagtatcccgctgccaacgcctatactataccctccgatttcattagtaaacgggacttttctaactcctgttcctccatgttccaactgccgtcattcatgaaggctctgaagtttgagacacctgcccctaactactacaacgccagcgtttcctgttgtaaacagcggaacaatgtttgtacacgcgctggattcatgtccaaaactcagaggggctcgtttgccttcgccgataagggcccaccccctggccactatgacatcaacgagagcttggttaagcagtcgcctaacaccttaatgtcatgcttcaaatctaagacgaaccgcggactgaagttgacttcaaccggcccaggccctggatactataatcccagtgactgtaccaaagtgccaaaaaagactttgtttcctggaggctccaaggcctccgatttggcaggacatctcccaaaaagcacccagccgacatag

SEQ ID NO: 53593 - DNA, 864 bp, Artificial Sequence
  Description of Artificial Sequence: Synthetic coding sequence
atgaatgctctggccaatatccctgatgtccctgttaagtataggaaaaatgatattccgggacctggtttttacaatgtgatccaccagtcacctgtgagcaactcagtgtcattatccaaaaaagggacctgtatgtttccctccatgtgtgcaagattggacaccatcattagcaaatatccagcggcaaatgcttacacgattccgagcgactttatcagtaaaagggacttttcaaactcttgcagttctatgtttcagctgccatctttcatgaaggccctgaaatttgagactcccgctccaaactactataatgcatccgttagttgctgtaagcaaaggaataacgtgtgcacaagggcaggcttcatgtcgaagacccaaaggggctcattcgcctttgccgacaagggtccgccacccggtcactacgatatcaacgagtccctggtgaaacagtctcccaataccctgatgagctgcttcaagagtaagactaacagaggcctgaaactcacttcgacagggccagggccaggctactataatcccagtgactgcacaaaggtgcccaaaaagactctgtttccaaaaaatccaatactgaacttttctgcgcagccctccccgttgcctccgaaacccccatttcccggaccagggcagtatgaaatagtggattatctcggccctcgcaagcacttcatatcttccgcctctttcgtcagtaatacttcccggtggaccgctgcgcctccccaacctggcctccctggtcccgctacttacaagcccgaattacctggaaagcagtcatttctgtacaatgaggacaaaaagtggattcctgtgctgtag

SEQ ID NO: 53594 - DNA, 708 bp, Artificial Sequence
  Description of Artificial Sequence: Synthetic coding sequence
atgggtatgctggcccctggcccactccagggcaggagacctagaaagggacacaaagggcaggaggacgccgtggcgccaggctgtaaagcttccggacgcggtagtcgggtaacacacctactgggctacccgacccaaaatgtttccagatcattgaggagaaagtatgcccctcctccttgcgggggtcccgaggacgtggccttggcgccttgcactgcagcggctgcctgcgaggccggaccctccccagtctatgtaaaagtaaagtcagccgagcccgctgattgcgcagaaggccctgtccagtgcaagaacgggctcttggtttccagcccacattgcgaagaaccctgcgctcactcttgtgcccacccaggcctgccccctcacctggtgcataaactgcctctgtcctatttgcaaacccaagacactgatgccgcaagtcggagaatcaacgcaccccttgctgcgggatggagttggctgcgtctctggctggtgactctcgcaagcggtgtggatttccctcaggtgtctgcctggatgcgcgctctgccttcccctgactgccctgggctgcgcaccacaggggaacagatgcagaagctcctccttaaggagaacaaagtcaaaacaaggaaaagcaaaagaaggtcaggtgaaggatcacatcttacgacctccatcttggaacaatag

SEQ ID NO: 53595 - DNA, 366 bp, Artificial Sequence
  Description of Artificial Sequence: Synthetic coding sequence
atgggatgcgccagcgcaaagcatgtcgcgaccgtgcagaacgaggaggaggctcaaaaggggaaaaactatcaaaacggggacgtttttggggacgagtataggatcaagcctgtggaggaggtaaagtacatgaaaaacggcgctgaggaggaacagaaaatcgccgcacgcaatcaggagaatctcgaaaaatctgcttcatccaacgtgagattaaagacaaacaaggaagtccccggtctggtgcaccagccgagagccaatatgcatatttcggagtctcagcaggagttctttcgcatgttggatgaaaagattgaaaaaggacgggattactgttcagaggaagaagatatcacttag

SEQ ID NO: 53596 - DNA, 264 bp, Artificial Sequence
  Description of Artificial Sequence: Synthetic coding sequence
accggcaaccatcactcaacattctgcttacatgagtttgattactcccgcctcttgtgcattctggagaaattcctgtgcgacacggaaaaaagcgcaagttccaacgtacggctcaagacaaataaggaagtgccaggtttggtccaccagccacgcgctaacatgcacatatcggagagccagcaggaattctttagaatgctcgacgaaaagatcgagaaaggtagagattactgttccgaggaggaggatattacctag

SEQ ID NO: 53597 - DNA, 279 bp, Artificial Sequence
  Description of Artificial Sequence: Synthetic coding sequence
atgtggcccgtgttctggacagtggtgcggacctacgctccttacgtcacattccccgtggcgtttgtggtcggcgctgtgggttaccatctcgaatggtttatcagaggtaaagatcctcagcccgttgaagaggaaaaaagcattagtgaaagaagggaagatagaaaactcgatgagctcctaggaaaagatcatactcaggtcgtgtccttaaaggataagctcgagttcgcgccaaaagcagtgctaaaccggaacaggcctgagaaaaattag

SEQ ID NO: 53598 - DNA, 279 bp, Artificial Sequence
  Description of Artificial Sequence: Synthetic coding sequence
atgtggcctgtgttctggaccgttgttcggacatacgcaccctacgtgacattccctgtcgccttcgtggtgggggctgtggggtatcacttggagtggttcattcggggtaaggatcctcagcctgtggaagaagagaaatcgatttccgagcgacgagaagataggaagttggacgaattgctaggcaaggaccacactcaggtggtgagcctgaaggataagcttgagttcgcccctaaagcggtgctaaatcgtaatagaccagagaaaaattag

SEQ ID NO: 53599 - DNA, 279 bp, Artificial Sequence
  Description of Artificial Sequence: Synthetic coding sequence
atgtggcctgtattctggactgtggtgagaacctatgcaccgtacgtcacatttccggtggcttttgtggtgggcgcagtggggtaccatctcgaatggtttattcgcggaaaggacccccagccggttgaggaagagaagagcatcagcgaaagaagggaggatcgcaaacttgacgaacttttaggcaaagaccacactcaagttgtgtctcttaaggataagctggaattcgcaccgaaggcagtcctgaatcgaaatcggcctgagaaaaactag

SEQ ID NO: 53600 - DNA, 279 bp, Artificial Sequence
  Description of Artificial Sequence: Synthetic coding sequence
atgtggcctgtcttttggaccgtggtgagaacgtatgctccttacgtgacttttcccgtggcctttgtcgttggggctgttggatatcacttagagtggttcataagaggaaaagaccctcagccagtagaggaggagaagtccattagcgaaaggcgagaggataggaaactggacgagctgctcgggaaggaccacacgcaggtggtgtctttgaaagacaagctggagtttgctcctaaggctgttctgaatcgcaatagaccggagaagaactag

SEQ ID NO: 53601 - DNA, 279 bp, Artificial Sequence
  Description of Artificial Sequence: Synthetic coding sequence
atgtggcccgtcttctggactgtggtgcgcacatacgccccttacgttacattcccagttgcattcgtcgtaggcgctgtaggctatcacctggaatggttcattagggggaaggacccccaacccgtggaggaggagaagtcgatttcggaaaggagagaagatagaaaactggacgaactcttgggcaaagaccatactcaggtcgtatctctcaaagataagctggagtttgcacccaaggcagtcttgaatcggaacaggcctgaaaagaattag

SEQ ID NO: 53602 - DNA, 381 bp, Artificial Sequence
  Description of Artificial Sequence: Synthetic coding sequence
atgttagccgtgccggtgcgacttaaggtgggatccagaaaacccgagtggggcacaaaccgactaacgtcttgcccagccaaggacccactggacagacgccttcagaacctacgcgaccgcgagagggttcccgaaccacagcggagtctaagacccggagtgcaggaagacagtagggaacacggccaagtaccggaagtgtctgacccacaggttgatctggagtttgtggatcttcaggctaaaccccgataccgcagactaatccttaaaacccagatccctgaagcctcagactcccaggccgcacaaaagccacaggcccatcgccaaattcccgagaccacggaggctgggagagagactacctcgaactag

SEQ ID NO: 53603 - DNA, 690 bp, Artificial Sequence
  Description of Artificial Sequence: Synthetic coding sequence
atgttcgccatacagcccggtcttgctgaaggtggacagttcctgggagacccccctcccggactgtgtcagcccgagttacagcctgacagcaattccaatttcatggcatctgccaaggatgcgaatgaaaattggcacgggatgcctgggagggttgagcccatcttaaggagaagctctagtgagtccccttccgacaaccaagcatttcaggcccctgggtctccggaagagggggtcaggtcgcctccggagggagcagaaatccccggagccgagcctgagaaaatgggaggcgcagggacagtctgctctccattggaggataatggctacgcctcaagctccctgtccatagatagtagatctagttcccctgagccagcgtgtggaacccccaggggaccaggaccaccagacccactgctgccttccgtcgcccaggccgtccagcatttacaggttcaggagcggtacaaggagcaggaaaaggaaaaacaccacgtccatcttgttatgtacagacgccttgctctgttgcaatggatccgcggtctgcaacatcagctgatcgaccagcaggccagactgcaagaatccttcgataccatactggataatcgaaaggagctgatcaggtgtctgcagcaacgggcagcaccatctaggccgcaggaccaggcttag

SEQ ID NO: 53604 - DNA, 600 bp, Artificial Sequence
  Description of Artificial Sequence: Synthetic coding sequence
atgttcgccatccagcccggacttgccgagggtggccaattcctcggcgaccccccacctgggctgtgccagccagaactgcagcctgattcaaacagtaattttatggccagcgcaaaggacgcaaacgagaactggcacggtatgcctggacgcgttgagccaatactgagacggtcatcctctgagagcccatctgacaaccaggcatttcaggcccctggatcacccctcgaagacaacgggtacgcttcctcatccctgagcattgactctcggtccagcagccctgaacccgcatgtggtacccctcgaggacccggtccccctgaccctctattaccgtctgtcgctcaggccgtccagcacctgcaggtgcaggagcggtacaaggagcaggagaaagaaaagcatcatgtccacctcgttatgtacagaagattggcccttctgcagtggatcagagggctgcagcatcaattgatagatcaacaggcacggctgcaggagtccttcgacacaatactcgacaacagaaaggaactgatccggtgcctgcagcaaagggctgctccttctaggccgcaggatcaggcttag

SEQ ID NO: 53605 - DNA, 321 bp, Artificial Sequence
  Description of Artificial Sequence: Synthetic coding sequence
atgcccgacgctcagtttcacaggattatggccagtgagaagctctcctttattcgtgtccaagagaatgagtactccttaaacagtgtcagagctagtggctttcaacgggttctgaacttactggaaagttctctcctttggctgtacctgcccaccacggaaaatctgttatgctcgtctcccaggctgtccggggatcctaccggctacgctgatcccccaccacagaaccaccggcgtcgacagtcaaggagcacgcccagactgcccggacccggacagctgctgtcctcccgcactcggaccttggagggctag

SEQ ID NO: 53606 - DNA, 2289 bp, Artificial Sequence
  Description of Artificial Sequence: Synthetic coding sequence
atggaggacgacggcagcttgctgcccgaagacgagctgttagctgacgctttactcctggaggatgaaagagatgagcttgaagatccagagttcgacatcaaatgtctgctccaggaggctgaggacgatgtggacccaggacacagctcgagtgtgaaagagctagacaccgacgctgacaaactcaaaaagaagaccgcggaagataggactcaggcgtttcatctccgacagaatttgtctgctcttgataagatgcatgaggagcaggagctgttcacggagaagatgaggggcgaactgcgagcctgccgtcaaagaagggacttgatagacaaacagcaggaggccgttgccgcagagatcgcgaccgaggaggaggctggaaacatggctgctgtaggcaggcttcaggccgtctctcgaaggctctttgctgaactcgagaacgaacgagaccttcagagcagaaccgaggcagtcttaaaggagtcagaaaatacgatgtggcacattgaaattcaagagggtcggctggaggccttcagaaccgccgacagagaggaagtggaggccacagggaggaggttgcaagtccgggctgctgagcagctgtgtcgggagcaagaggcattaggcaaagtagagcggaacagattgctgaggattcggaagtctttaaatacgcagaaagagctcggtttgcgacatcaaaaattactggaagacgcaagaaaaaaccataaggtcgctgtgcgcttccttaaggcctccctgggacgcatccgggaacaggagaagaaggaagagatggagtgccacgaatacatgcgcaggcggatggatgccgttgttgcactgaaggggagcatatctgccaacagggacactttaaggaagttccaggcttgggacagggccaaggcagagcttgctgaacagcgagtccaagcggagaaaaaggccatcctggcccagggtcgggatgcgttccggcatttggtgcatcagcgacggcgacaggaattggaggcacagaagcgagcctttgaggaggaacagaaactgcgtaagcaggaaatcattagtcggatcttgaaggaggaggctgaagaagagaagcggaagaagcagcaccctcctacctctgctcgtcaccgccttaccttgcgggataaaacgtggaactacatctctgatttctgtaaaaaaacaacagtgcccacaaacacttatactttagactatgaggctgcagcgggacctggccctagcaggcttctcgaggtggtctctagcgagctgatccaaggtgatcccggagccagcagcgaagaggagacgctcgcagaaccagagatctcaggtctctggaatgaagattacaaaccttatcaggtgccaaaggaggatgtagatcgaaagccggtgggaggtactaagatggacaaggacatcctggaacgaactgtggagagactcaggtcacgagtagttcataaacaggtcgtgtggggaagggagttccagggccgaccattcaacagcaaacctgagttgctccattttcaggatttcgacatcggaaaggtctataagaaaaagatcactcttgttaatacaacttacactataaactactgcaagctggtcggcgtggaggaacacctgagggatttcatacacgtggattttgacccacctggccctctgtcagccggtatgtcttgtgaagtcctcgtgactttcaagcccatgatcaataaggacctggagggtaacatctcctttctggcccagacgggcgagttctccgtgcccttgaagtgctccactaaaaagtgttccctgtcccttgacaaagagttaatagatttcggaagttatgtggtcggcgaaaccactagcaggacaattacgttgacaaacgttggcggattgggaaccactttcaagtttcttcccgctagcgaaccttgcgagatggacgattcacagtctgcgctgaagctgtcctccctactgacttatgaagacaagtctctctacgacaaggcagccacctcgtttagcgagcagcagctcgagggtacggagagcagccaggcagatatgcagtctaggaaggagttggaaaagttagataaggaacaggaagaggagcaaccagccggagagccgggatgtcaagccaaacccggatgggcaggcggagaagggctgagggcagctttccagggcgcagagggcccacggggagggctggagagccgtgagtttagctag

SEQ ID NO: 53607 - DNA, 306 bp, Artificial Sequence
  Description of Artificial Sequence: Synthetic coding sequence
atggaagatgacgggtccctactgccagaagacgagctgctggccgacgctctgttgctggaggacgaaagagacgagctggaagaccccgaattcgacatcaaatgcctgctgcaggaagccgaggacgacgtggaccctggccatagttcctctgtgaaggagctggataccgacgcggacaaacttaagaaaaagactgcagaggaccggacacaggcttttcacctgcggcaaaacctgtccgctctcgacaaaatgcacgaggaacaggagctgtttactgagaaaatgagcgtttcgtag

SEQ ID NO: 53608 - DNA, 516 bp, Artificial Sequence
  Description of Artificial Sequence: Synthetic coding sequence
atgtttgagaacctgaatacagccttaacccccaagctgcaggcaagtagatcctttccccatctatctaaaccagtagccccagggagcgcgccattgggttctggcgagcctggaggacccggtctgtgggtgggtagtagccagcacctgaagaacctgggtaaggctatgggcgctaaggtgaatgacttcctgaggaggaaggagcccagctccctggggagtgtgggcgtgaccgagataaataagacagctggcgcacagctcgcctcaggcactgacgccgcacctgaggcctggctagaagatgagagatccgtgctgcaggaaacttttccacgcctggacccgccacctccaatcaccagaaagcgtacacctagggctctgaagacaactcaggacatgttaattagtagccagcccgtgctgagctcattggagtacggcacagagccctcacctggacaagctcaggactcagctccaactgcccagcctgatgtgccgtag

SEQ ID NO: 53609 - DNA, 948 bp, Artificial Sequence
  Description of Artificial Sequence: Synthetic coding sequence
atgcttgtgctggtcgcccaagcaggtggggacactctcaaagtaaccgggcactatgtcaaatgtgtctttctactgttcgtgagccatctgctaagtgaacccttgagcagaaccgtcgaccatggaatgttcgagaacctcaataccgccctcactcccaagttacaggcttcacgatcttttcctcacctcagcaagccagtcgcccctggaagtgctcccctaggttctggagagccgggaggcccaggactatgggtcgggagctcccagcatcttaagaaccttggaaaggccatgggcgctaaggtgaacgacttcctacggcgtaaagagccatcatccttgggctccgtgggtgtcaccgagatcaacaaaacagctggggctcagctggcctcaggcaccgatgccgcacccgaagcgtggttggaggatgagagaagcgtgcttcaggagactttccccaggctggatcctccgcctccaatcacccgcaagcggactcctagagctctgaagacaactcaagatatgctgatttcttcacagcccgttctgtccagcctcgagtatggtaccgagccaagccccggtcaggcccaagattccgcgccaacagcacagcctgacgtgcctgcagatgcaagccaacccgaagctacaatggaaagagaggagcgagggaaggtgctacctaatggggaagtctccctgagcgtgccagacctgattcacaaagacagccaggatgagtccaaactgaaaatgactgagtgtcgccgtgcttccagtcccagcctcattgaaagaaacggcttcaagctgtcgctcagccctatctctttggcggaatcatgggaagacggaagccctcctccacaggccaggaccagcagtctcgataacgaggggcctcatcctgacttactgagctttgaatag

SEQ ID NO: 53610 - DNA, 819 bp, Artificial Sequence
  Description of Artificial Sequence: Synthetic coding sequence
atgttcgaaaaccttaatactgccctgactccaaaactgcaggccagccggtctttccctcacctcagcaaaccggttgctcctggctccgctccactcgggtccggcgaacccggaggtcccggtctgtgggttggttcctcacaacacctgaagaatttgggcaaggctatgggggcaaaagtcaatgactttctgcggagaaaggagccgtcatctttgggctccgtgggggtcactgaaatcaacaagaccgccggagcacagctcgcaagcggcactgacgcagctccggaggcatggctggaagacgagcggtccgtgctgcaagagacctttcctagactagacccccctcccccaatcacccgcaagcggacaccgagagcactgaagacgacacaggacatgctgatttcttctcagcctgtgcttagtagcctcgagtacggcacagagccctctccaggccaagctcaggacagtgctcctaccgcccagccagatgtgcccgcagatgcaagtcaacccgaggctaccatggagagggaggagaggggtaaagtgctgcctaatggagaagtcagcctttcagtacctgaccttatccacaaggacagccaggacgaaagcaaactgaagatgaccgagtgtcgcagagcatcatccccatcacttatagagaggaacggcttcaagcttagtctcagtcccatatctctggccgaaagctgggaggacggatccccaccccctcaggcgcgaacctcatccctcgataacgaaggtccgcaccccgacctgctgtctttcgaatag

SEQ ID NO: 53611 - DNA, 297 bp, Artificial Sequence
  Description of Artificial Sequence: Synthetic coding sequence
atggccagcatcaacaggactatcgaaattatgaagaagcacggggtaagtaagcagcaccttctcgaagagatcaacaagaagagggaaagcaattgtcttgttgaaaggagtaaccaggtatcgttgctgcgggtccagaagaggcacttccctgacgcttaccagtcatttaccgataccaccacaaaagagccggtgccgaatagcgggcgaagctcttggattaaactctccttacttgcgcacatggagcgaaaacatttcccaccaaagaacaatgcgattttcggatag

SEQ ID NO: 53612 - DNA, 1323 bp, Artificial Sequence
  Description of Artificial Sequence: Synthetic coding sequence
atgacatccataaaggagcaggccgcaatctcaaggttgcttagctttctgcaggaatgggacaatgcgggaaaagtagctaggagccatatcctcgacaaatttattgagacaaaccagggcaaaacagcccctgaactcgaacaagaattttctcagggagcctcactgttccttgtgagattaaccacttccttgcggattacgtacatgacggactcctgtcttgagaaactgctgaggtctatcggcatctttctgagcgcagtgtcgtccaaccgatatctaatcgagttcttggaggttggaggcgtgctgaccctgctcgagattttgggattggaaaagatcaaggaagaagccaaaaaggaatccgtgaaactgctgcaggtgattgccaactccgggcgaacctacaaagagctcatctgcgaaagctacggtgtaagaagcatcgctgagttcctggccaagagcaaaagcgaggaaacacaagaggaagtgcaagttttacttgactcgcttgttcacggtaacccgaaatatcagaatcaggtctataagggcttaattgccttgttaccctgtgaaagtcccaaagcacaacaactctctctgcagacacttcggaccgctcagccaatcattggaaccacacatccaagcatcgtcgattgcgtgctgaaggtgcttggcactatgcacctcgaggttcagtacgaggcaatagagctgattaaggatctggtcggatatgacgttagacaggccctcctgaaggggctggtggcgttgctcatccctagcgtcaaggaaatttcaaaactgcaagctaagatcctgagcgacccatctgtgttacagctgaccccctcactccccatgttcctacagcaggctgctgcggcaaaggctatcggcgtgctcgccaggaatgatatgtctattgctgaagaactgctgtacctccgcgttgtccgaggactgatggctgcaatggggaatactgaccacagtaatagccagagactggcatcattaactcttgagtgtttcgtccagatgtttccgctcgtggccgagcatgtgcggaagtgtatgggtgaggagctctaccagctttttctgtcgaacgccgaggacctatatatgaaaatcgattctatacaggcagacatcttggccgctaatactgtgaatgtgactaaggcactctgtcttcacggatcaagctactccatgaacactttatatggctcaagagacagcgcccagatggcctatctgactcactttgaagaggatgtcgagtcaaaagagtag

SEQ ID NO: 53613 - DNA, 1323 bp, Artificial Sequence
  Description of Artificial Sequence: Synthetic coding sequence
atgacaagtataaaggaacaggctgcaatctcccgtttactgagcttcttgcaggagtgggataacgcaggaaaggttgctcgttctcacattctcgataagtttatcgagacgaatcagggtaaaacagcaccagagctggagcaagaattctctcagggggctagcctcttcctcgttcgacttaccacatccttgagaatcacgtatatgacagactcttgtctagagaaactgctccgctctatcggaatcttcctgagcgcagtgagttctaatcgttacctcatcgagttccttgaggtgggaggagtgctgacattattagagatactagggcttgagaaaattaaggaagaagccaagaaggagtccgtcaagctgctgcaggtaatcgccaattctggcagaacgtacaaggagctgatttgcgaatcttatggcgtgcgaagtatcgccgagtttcttgccaagtccaaatcagaggaaacacaagaggaggtgcaggtgctgttagactcattggtccacggcaaccctaaatatcagaatcaggtatacaaggggctgatcgcactgctgccttgcgagagcccaaaggcccagcagctctcgttgcagactctgaggactgcgcagccaattattgggaccacacatcctagtatagtggattgcgtcttgaaggtgcttggaaccatgcacctggaggtgcagtatgaagctattgaactcatcaaagacttagtggggtacgacgtccggcaggccctgcttaagggcctggtcgcacttctcatcccaagtgtgaaggagatctcaaagcttcaggctaaaatcctcagcgacccctccgtcctccagttaacgccatcactgcccatgtttctccagcaggcggcagcggctaaggctatcggagttctggcccgaaacgacatgtcaattgctgaagagctgctgtacctaagggtggtgaggggattgatggcagccatgggcaatacagatcacagtaactctcaacgcctggccagcctcacactggagtgtttcgtccaaatgtttccattagtggctgaacatgtgcggaaatgcatgggcgaggagctctatcaacttttcctgtctaacgcggaggatctctatatgaagatagactcaattcaagccgacatcctagctgcaaataccgtcaacgtgacaaaggccctgtgcttacatggaagcagttattctatgaatacgctgtatggttccagggattccgcccagatggcctacctgactcatttcgaggaagatgttgaaagcaaagagtag

SEQ ID NO: 53614 - DNA, 714 bp, Artificial Sequence
  Description of Artificial Sequence: Synthetic coding sequence
atgggcctttgtacgctgcagccgctgggccctcccaggaaaagttcaacttcctgtggaacatggactgcgagtggcttacctagcctcgggcacctcccaaggaggctgcgacttgctttcgacttcctggaaccccgagcaaggggccagcgaggaggatcagggggatgccagtctacgcgcgcagcagagaggacacgtcctcctcaccccccaaacgctgtactcctcctccagcctgagccaagtttaacttgggctcagggcaggggatgcagaggtcatttccggagcctccccgctgcagcaagtaggagcggatctcgaacacttcgatgtgcatcttccgatcggagcctgcgtgaacaaaaacagaggagggccggacctgatcctacaccatcccctgctcccccacctgcaggcccacgccctagtcccggaagtctgggcccaagcgccccagccgctccacgaaccgcccgaggggcttacgaactgcaaggcggtgcttctcaagatggccctgggcaagccgcagtgggcgcaaccccaacgaccggacccggtacaggtggggaaggagcccttctcggttgcggcagtggcaggactcctccaacgtccgcgacatggcgcagacgactgctgccggctgaagtgccgcctggagccgctgccgctaatttcccggaacgcgagaggctgtag

SEQ ID NO: 53615 - DNA, 681 bp, Artificial Sequence
  Description of Artificial Sequence: Synthetic coding sequence
atgagagctcctccccttctgctgctgcttgcggcttgtgcccctccaccgtgcgctgccgctgcgcctaccccccctggatgggagccaacccctgacgccccttggtgtccctacaaggtgctgcctgaggggccagaggctggcggtggcaggctgtgttttcgctcccccgctcggggtttcagatgtcaagccccaggctgcgtgttgcacgctccggctggcaggtcactaagggcgtccgtcctaaggaatcggtctgtattgctgcagtggcggctcgccccagccgcagccaggcgcgtgcgtgcatttgcgctaaattgttcttggaggggggcatacaccagattcccttgcgaacgagttctactgggagcttcctgtcgggattatctactgcccgatgtccatgattcagtgctgtatcggctctgtctgcagcctctcccgctgagggccggaccagccgctgccgctcctgagacccctgagcctgccgagtgcgtggaatttaccgccgaacccgctggcatgcaggacatagtcgtggcgatgaccgcagtaggagggagtatatgtgtaatgctggtagtgatttgtcttctcgtagcctatatcacagagaacctcatgagacccgctctggccagacccggattgagacgccacccatag

SEQ ID NO: 53616 - DNA, 792 bp, Artificial Sequence
  Description of Artificial Sequence: Synthetic coding sequence
atgttcgggagctccagggggggtgtgagaggcggacaggaccagtttaattgggaagatgtgaagactgacaaacaacgggaaaactatttgggcaactccctcatggcaccggtgggacgatggcagaaggggagagatctgacctggtacgccaagggtcgggcaccgtgcgcgggtccgtccagagaggaagagttggccgctgtgagagaagccgagcgggaagcgctgttggccgcactgggctacaagaacgtgaaaaaacagccaaccggactgtcgaaagaagactttgccgaagtgtgcaagagggagggtggggacccggaagagaaaggtgtagatcgtcttctgggcctcggttcagctagcggaagcgtcggtcgcgtggccatgagtcgtgaagacaaggaggccgctaaattgggactctcggtttttactcaccacagagttgagagcggcggacccggtaccagcgctgcctctgctaggagaaagccacgggctgaagatcagactgaatcttcttgcgagtctcatcgtaagtcgaagaaggagaaaaagaaaaagaagaagagaaagcacaagaaagaaaagaaaaagaaagacaaagagcacagacgacctgctgaggccacaagttcccctacttcaccggaacggcctcgccatcatcatcacgactcagattctaactctccatgttgcaaacgcaggaagcgtggacacagtggggaccgtaggtctccatcgagacgttggcacgaccgaggatctgaggcatag

SEQ ID NO: 53617 - DNA, 1545 bp, Artificial Sequence
  Description of Artificial Sequence: Synthetic coding sequence
atggaacctgttccccttcaggattttgtgagggctctggatccagcctcactcccaagggttctccgggtctgtagtggggtctacttcgagggcagcatttatgagatctcagggaacgagtgttgcttgtcgactggtgacctcatcaaggtgacgcaggttcgattacagaaggtggtgtgcgaaaacccaaagacaagtcagactatggagctagccccaaatttccaaggatactttactcccctaaacaccccacagagttatgagacacttgaagaactggtttcggccacaactcaaagcagcaagcagctgccaacgtgtttcatgagtactcacaggattgtcactgaaggccgtgtagtgaccgaagaccagcttctcatgctggaagctgtagtgatgcatcttggcatcaggagtgctagatgcgttctcgggatggaagggcaacaggtaatcctgcacctgcctctgtcacagaagggccctttttggacatgggagccatcagcaccgcgaacgctcttacaagtccttcaggaccccgcactgaaagacttggtcctgacttgccccactttgccatggcatagcctgatactgaggccccagtacgaaatccaggccataatgcacatgaggcgtactatcgttaaaattccatctaccctggaagtcgacgttgaggacgtgaccgcaagctcgaggcatgtgcatttcattaagccactcctgttatctgaggtgctggcctgggaagggccattccctctcagtatggaaatcctagaacgcctctctgaccaggcaggggaagatgaagaggaggaatgcaaagaggaggcggaatctcccgaacgagtcctgctgcccttccattttccaggatcatttgtggaggagatgagtgactccaggaggtatagcctggccgacctaacggctcagttctcccttccgtgcgaggtgaaggtcgtcgccaaagacacttcacaccccacagaccctttaaccagcttcctggggctgaggctcgaggaaaagatcactgagcccttcctggtggtctccttggattccgaacctggcatgtgctttgagattcctccaaggtggctggatcttactgtcgtgaaagcgaaaggccagccggaccttccagagggtagcttgccaattgcgacggtggaagagctaacggacacattctactatcgactgcgaaaactacccgcatgcgagatccaagcaccacccccaagacccccaaaaaaccaaggtctgtcgaagcagcggaggcacagcagtgagggcggtgtaaagagcagtcaggtcctcggcctccagcagcacgcacggctgcccaaaccaaaggctaagacgctcccagaatttattaaagacggttcaagtacgtactctaaaataccagcacacaggaaagggcatcgccctgcaaaacctcagcggcaggatctcgatgacgatgagcacgattatgaagaaattctggaacaattccagaagacaatctag

SEQ ID NO: 53618 - DNA, 1932 bp, Artificial Sequence
  Description of Artificial Sequence: Synthetic coding sequence
atggaacctgtcccactccaggacttcgttcgggcactagatcctgcatctttgcctagggtgctgagagtgtgcagcggcgtttatttcgaaggatctatttacgagatttccgggaatgagtgttgcctctcaacaggcgacctcattaaggtgacacaggtgcgtctgcagaaggtggtgtgcgagaacccaaagacaagtcaaaccatggaattagcccctaactttcaggggtattttacacctttgaatacaccccaatcctatgaaaccctggaagaactggtcagtgccaccacccagtcttccaaacagctcccgacctgtttcatgtcaacccaccgcatagtgactgaaggccgtgtagtgacggaagaccaactgctaatgctcgaggcggtcgtgatgcatctcgggattaggtcagccagatgtgtgctgggcatggaaggtcagcaggtgattctccatctacctctgtctcagaaggggcctttctggacatgggaacctagcgcccctcgtacactcctgcaagttctgcaggacccggctttaaaggatctggtcctgacctgtccaactctgccttggcacagtctcatactgagaccccagtatgaaatccaggctattatgcatatgcgccgaacaatagtgaaaatccctagcacattagaggtggatgttgaagatgttacagcctcctctaggcacgtacattttattaagccattacttctgtcagaagttctggcgtgggaaggaccctttccattatctatggagatattggaggttcctgaaggccgtcccatttttctgtccccgtgggtgggatctctgcagaaagggcaacgtctgtgtgtctacgggttagcttcaccaccgtggcgcgtgctcgcttcctctaagggcagaaaggtgccccgtcacttcctagtgagcggcggttaccagggtaagttgcgcaggaggccacgtgaatttccaactgcttacgacttactcggagcattccagccagggagaccgctcagggtcgtcgcaactaaggattgtgagggtgaacgtgaggagaaccccgagttcactagcctggctgtcggggatcgccttgaggtgctcggcccaggccaggcccacggcgcacagggctctgatgtagatgtccttgtctgccagcgcctcagcgatcaggcaggcgaagatgaggaagaagagtgtaaagaggaagctgagagtcctgaaagagtgctgcttccttttcactttccaggaagcttcgtagaggaaatgtccgacagtcggcgttattccctggccgatttgaccgcccagttttcattgccttgtgaagtgaaggtggtggccaaggataccagccatcccacggatccactcacctcattcttaggcttgcgcttggaggagaagattacagagccctttctggttgtttccctggactcagaacctggcatgtgcttcgaaatcccacctcggtggctcgatcttacagtggttaaagctaagggccaacctgatctcccggagggctcgttgccaatagccacagtagaggaactgacagatacattttactacagactaagaaagttacccgcatgcgaaatccaggctcctccaccaagacctccaaaaaaccagggactaagtaagcaacgccgtcactcctcagagggcggagtcaaaagcagtcaagtactgggcctacaacagcacgcccgactgcccaagccaaaagccaaaacgctgccggagtttattaaagatggaagctcaacctatagcaaaatccccgcacaccggaaagggcatcgtcccgcaaaaccacagcgccaggacttggatgacgacgaacatgactacgaggagatcttagaacagttccaaaaaacaatatag

SEQ ID NO: 53619 - DNA, 783 bp, Artificial Sequence
  Description of Artificial Sequence: Synthetic coding sequence
atggagccggtgcccttgcaggactttgtgagggctctggatccagccagtctgccacgcgttttgcgtgtctgcagtggcgtgtattttgagggcagcatctatgaaatttcggggaatgaatgctgcttgagtaccggcgatctaatcaaggtcacacaagtgcgactgcaaaaggtggtgtgtgagaaccccaaaacatcccaaacaatggagctggccccaaactttcaggggtatttcactccattaaatactcctcagtcttatgagacccttgaggaattggtttccgccaccacccaaagcagtaagcagctccccacctgcttcatgagtacacatcgcatcgtgacagaggggcgtgtcgtgactgaagaccaactccttatgctcgaagcggtggttatgcatctagggatccgcagcgccagatgcgtgcttggtatggagggccagcaggttatactgcacctgcctttgtcccagaaaggccctttctggacctgggaaccgtcagcccctcgtaccctgctgcaggtcttacaagaccctgcccttaaggacctcgtcctgacctgccctaccctcccatggcactccctgattctccgaccgcagtatgagattcaggctataatgcatatattctcctccctgagaatcgctgccacaagaagcgctgcccagacccagggggaagatctcgcgagggttcatcagggctggttacagtacgtacaacaggactcttgcccccaagaaggccctcaggccagatag

SEQ ID NO: 53620 - DNA, 372 bp, Artificial Sequence
  Description of Artificial Sequence: Synthetic coding sequence
atggagcctgttccactccaggattttgtgagggcgctcgaccctgcatcgctcccaagggtgctgcgggtgtgtagcggcgtgtactttgaaggatctatttacgagattagcggaaacgagtgttgtctgagcactggcgaccttatcaaagtgacccaagtcaggttgcagaaagtggtatgtgaaaatcccaaaacaagtcaaacaatggagctggcacctaactttcaggtgttctccagccttcgaatagccgcaacacgcagcgcggcacagacccagggggaggatctagcaagggttcatcagggctggctgcagtatgtccagcaagattcgtgcccccaggaagggccacaggccaggtag

SEQ ID NO: 53621 - DNA, 402 bp, Artificial Sequence
  Description of Artificial Sequence: Synthetic coding sequence
atggagccagtgcccttgcaggattttgtgcgagctcttgacccagcaagtctgcccagagtccttcgcgtgtgctcgggggtgtacttcgaaggctactttacgcccctgaacacaccccagtcctatgaaactttggaagaattggtgagtgccacaactcagagtagcaagcagcttccaacctgttttatgtctacgcatcgcatagtcaccgaagggagggttgttactgaggaccagctgctcatgctcgaagcggttgtgatgcatcttggcataagaagtgcgcgatgtgtgctgggcatggagggacagcaggtgattctgcacttacccctgagccaaaagggacccttctggacctgggagccctcagcacctaggactctgctgcagtag

SEQ ID NO: 53622 - DNA, 744 bp, Artificial Sequence
  Description of Artificial Sequence: Synthetic coding sequence
atggagccggtgcctttacaggattttgttcgggctttggaccctgcctctctgcctagagttctgagagtatgctccggagtttacttcgagggcagcatttatgaaatatccggtaacgagtgctgtttgtccactggtgatttgatcaaagttactcaggtacggctccagaaggttgtgtgtgaaaatcccaagactagccaaaccatggagcttgctcctaatttccaggtacgcaggacaatcgtgaagataccctctactttggaagtggacgttgaagacgtcaccgcgtcaagccggcacgtgcatttcatcaagccactgctattgtccgaggtcttggcctgggaaggaccattccccttgtctatggagatacttgaggttccagaggggagaccgattttcctgtctccatgggtcggctctctgcaaaagggacagaggttgtgtgtgtacgggttggcttctcccccatggagggttttggcctctagcaaagggagaaaagtgccaaggcatttcctcgtttcaggtggatatcaaggaaagctcaggcgacggccacgagaattcccaactgcatacgatctgctgggggcttttcagcccggaaggcctctgagagttgtcgccacaaaagactgcgagggcgaaagggaggagaaccccgaattcacttcactagcagtaggagacaggctggaagtactgggccctggccaagcacatggctag

SEQ ID NO: 53623 - DNA, 1176 bp, Artificial Sequence
  Description of Artificial Sequence: Synthetic coding sequence
taaacctgtttcatgtcaacccacagaattgtcaccgaggggagagtggtgacagaagaccagctcctaatgcttgaggctgttgtgatgcacctggggatacggtcagcccgatgcgtcctcggcatggagggacagcaggtgattctccatctcccattaagccaaaagggccctttctggacctgggaaccctcagctcccaggactctgttacaggttctacaagaccccgctctaaaggacctggtgctcacctgtccgactctgccttggcacagtcttatacttaggccgcagtatgagatccaggctatcatgcatatgcgaaggaccatcgttaaaattccctctaccttagaggtagacgtggaagacgtcactgctagttcacgacacgtccattttattaaaccactgcttttgagcgagaggctgtctgatcaagctggtgaagatgaggaggaagagtgcaaagaggaggcggagagccctgaaagagtgctactaccgttccacttcccaggtagttttgttgaagagatgtctgactccagaagatattcccttgccgatttgactgcacagttctccctcccctgcgaagtgaaagtggttgctaaagatactagccatccaactgatcccttgaccagcttcctgggactcagattagaagagaagataaccgaaccattccttgtggtcagcctcgacagtgagcccggtatgtgtttcgagatccccccacgatggctggacctcactgttgtgaaggctaaaggccagccagacctgccagagggatccctgcctatcgcgacagtagaagaactgacagataccttctactaccggctgcgaaagctgccagcttgcgagattcaggccccaccaccgagacccccaaagaaccaaggcctgtcgaaacagaggcgccacagctcagaaggaggcgtcaagtcaagccaggtcctcggcttacagcaacatgcaaggttgcccaaacctaaagccaagacattgccagaattcattaaagatggcagctcaacgtatagtaaaattccggctcacagaaagggtcaccgccctgcaaagcctcagcggcaagaccttgatgatgacgagcacgattacgaagaaatcttagaacaattccagaagactatatag

SEQ ID NO: 53624 - DNA, 600 bp, Artificial Sequence
  Description of Artificial Sequence: Synthetic coding sequence
atggaagacgccgcagcacctggacgcaccgagggcgtgctggaacgacaaggggctccccctgctgcaggccagggcggtgctcttgtggagcttacacctacccctggagggctggccctggtgagcccctaccatactcatcgggcaggcgacccgctggacttggtcgcacttgctgagcaagttcagaaagctgatgagtttataagagccaacgcaaccaataaactcacagtcattgcggagcagattcagcacctgcaggagcaggcacgaaaggttctggaagatgcccaccgcgacgctaacctgcatcacgttgcctgtaacatagttaagaagccaggaaacatttactatctgtataaacgcgaatctgggcagcagtattttagtatcatttcccccaaggagtgggggacttcttgccctcacgacttcttgggtgcgtacaaacttcagcatgatttaagttggacaccatacgaggatatcgagaagcaggatgctaagatttccatgatggacaccttgctgtcacagtcagtggctctccctccttgcacagaaccaaacttccaggggcttacacactag

SEQ ID NO: 53625 - DNA, 336 bp, Artificial Sequence
  Description of Artificial Sequence: Synthetic coding sequence
taatctgctctcctcctgggcgtggatggcctcctgagcggcattctcgctattatctacgtttccgcagcgagcttccatctgtgcttctatagccctggggtaccttcaacctacaaagggctgccttgtccttacgcaagctgtatcctggcttcgactagtttactcacgaaagggaaccgcttcatcctgtgttgtatggctagcctgatgattcttttcatgatggatcaatcatactacccatatgataaaattctggagagcgagaactggaagaaactggtctacatcggcggacagtttcgattcatcattggatggaatttctag

SEQ ID NO: 53626 - DNA, 690 bp, Artificial Sequence
  Description of Artificial Sequence: Synthetic coding sequence
aaaggcacatctttttttctctcccacgatcagagtcactcacaaattaacgaggtgtcttggaaggacgtcactagcgcactgtcactggcgaacatggttctgggtcttttttcaataatctttagcttctcaaggaagtgccactacgcatctaggatgctgctcgtgagcttcctgcttgatatggcggttagggctatgaccagccatataaacatctgttccaaattgggcgcagaactaaacgactttgctgtgtttaccacgttcggcctggcatccgctctgttattaggggtcgacggcttgttgtcaggaatcctcgcaattatttacgtctctgccgcaagcttccatctgtgcttctattctccaggcgtgccttctacctacaaggggctcccatgcccctatgcctcatgcattctggccagcacaagccttctaacaaagggcaaccgattcatcctttgttgcatggcatcccttatgattctgtttatgatggatcagtcctattatccatatgataagatcctcgaatccgagaactggaagaaactggtctacattggaggcgtcattatgctgttctttagtccattgagcctgtcagctttttactgcctcatgtggtctctgagctatattttttttccagatgccctgtgggggaaggccgcttag

SEQ ID NO: 53627 - DNA, 699 bp, Artificial Sequence
  Description of Artificial Sequence: Synthetic coding sequence
tagttctttctctcacacgatcagtcacactctcagataaatgaagttagctggaaggatgtgacctctgctctgtcgctggccaacatggtgctgggcctcttctcaattatcttttctttttccaggaaatgtcactacgcttccagaatgctgcttgtttctttcctacttgacatggcagtgcgggcaatgacctcccacattaacatctgctccaagctgggcgctgaacttaatgactttgcagtgttcactacattcggtctagcttcagctcttctcctgggcgttgatggcctactctctggcatcctagccataatctatgtgagcgcggcttcatttcacctgtgtttctattcacctggggtcccctctacctataaaggcttgccctgcccttacgctagctgtattctggcatcaacatcacttctgactaagggaaatcgatttattctgtgttgtatggcctctctgatgatcctgttcatgatggaccagtcatactatccatatgataagatcctggagtctgagaattggaaaaaactggtatatatagggggagtcatcatgcttttcttcagcccactgagcctgtctgccttctactgccttatgtggagtttaagctacatttttttccctgatgccctgtggggtaaggctgcctgtctctccccgcagcattag

SEQ ID NO: 53628 - DNA, 1158 bp, Artificial Sequence
  Description of Artificial Sequence: Synthetic coding sequence
atggactcccctagctctgtcagtagttactcttcctattcactgtcctcatcgttccccacatctcccgtgaactccgattttggatttccgtctgattcagaaagagaggacaagggcgcacatggcccacggcctgatacggtaggacagaggggcggatcacgcccttcacctggaccaatccggtgccgccacaggtccaaagtgtcgggcaatcagcataccccttcccatcccaaacagaggggctccgcttccccaatggccggtagcggagcaaaacgatcgagggacggcgagctagaaacatcactgaacacacaaggatgcaccacagagggcgacttgctctttgcacagaagtgcaaagagctacagggatttatacccccacttacagacctgctgaacgggctgaagatgggacggttcgaacgcggactaagttcttttcaacagagcgttgccatggacaggatccagcggattgtgggtgtgttgcagaagccccagatgggtgaacggtacctcggcacgctcctacaggtggaaggtatgcttaagacatggttccctcagatcgcggctcagaagtcttcactcggtggcggaaagcatcagctcacaaaacacttcccatcacaccactccgacagcgcagcgtctagtccagccagcccaatggaaaaaatggaccagacccagctagggcacttagcccttaagccgaagcagccatggcaccttacccagtggcctgcgatgaatctgacatggattcatacaactcctatctgtaatcctcccctaagctcccctggaacgatcagctttagccatggtccattgggaacgggaaccggcattggtgtaattctttttttgcagcacggagttcaaccttttacccatagcgctcccaccacgcccgtcccacctacaactgccagtcccgtcattcccggagaacctatgaagttatctggagaaggccctcgctgttacagtttaccggttacacttccgtccgactggagctatactttgtctcccccaagccttccaactcttgctcggaagatgaccattggacatcgcgagcaacagcggtcacaccctccagtggccgcagatgctcatctgctcaatctgtag

SEQ ID NO: 53629 - DNA, 1158 bp, Artificial Sequence
  Description of Artificial Sequence: Synthetic coding sequence
atggacagcccgtcctcagtgtcatcctattcgagctacagtcttagttcctcgttccctacaagccccgtgaacagcgattttggctttcccagcgacagcgagcgggaggataagggcgctcacgggccacgacctgatactgttggtcagcggggaggaagtagaccttccccaggcccaatcaggtgccgacacaggtctaaagtgagtggcaatcaacacaccccttcacatcctaagcagcgcggaagtgcctccccgatggccggtagcggagccaagcggtctagggacggtgaactcgagaccagtttgaacacacaaggctgtacaaccgagggcgaccttctcttcgcacagaaatgcaaagagttacagggctttatccctcctttgactgatctgctcaatggactgaaaatgggccgtttcgaacgcggattgtcttcctttcagcagtccgtggccatggatagaatccagcgcatcgtcggtgtgctgcagaaaccacagatgggggagagatacctgggaaccctcctacaggtcgaaggcatgcttaagacatggttccctcagattgccgctcagaagtcttcactgggcggtggcaagcatcagcttacaaagcatttcccatctcatcattccgatagcgccgcatcctcacctgccagtccaatggaaaagatggatcagacccagcttggccacctggccctcaagccgaaacaaccttggcacctgacccaatggccagcaatgaatctgacatggattcacacaacgcccatttgcaatcccccactgtcctctccagggaccatatccttcagtcacggcccattgggaacgggcactggtatcggcgtgattctctttctgcagcacggggtccagccgttcacgcactctgccccaacgactccagttccccctacaacagcaagcccagtgatccccggagagcccatgaagctctcaggtgaaggaccaagatgttactctctccctgttacgcttcctagcgactggagttacaccctgtcccccccatccctccctacactcgccagaaagatgactataggccacagggagcagcagaggagccatcctcccgtcgctgcagatgcccatctgctgaacctgtag

SEQ ID NO: 53630 - DNA, 1158 bp, Artificial Sequence
  Description of Artificial Sequence: Synthetic coding sequence
atggactccccgtcctcagtctcctcctattcttcctatagcctgagctcttctttccccacttcccctgtgaacagtgactttgggtttccttcggactctgaacgggaagacaaaggagctcatggcccacggccagatactgtgggtcagagagggggaagtaggccatctcccggtcccatcagatgccgccatcggagcaaggtgagtgggaatcaacatactcctagccaccccaagcagagaggcagcgccagtcccatggcaggctctggcgctaagcgcagtagagatggcgagttagaaactagcctgaatacgcaagggtgcaccaccgagggcgacctgctgttcgcccagaagtgcaaagagcttcaggggttcattcccccactgacagacctgctgaacgggctcaagatgggcagattcgaaaggggcctgtcatccttccaacagtctgtcgcgatggatcggattcagagaatcgtgggggtgctacagaagcctcaaatgggggaacggtacctcggcactctgcttcaggtagagggcatgctaaaaacctggttcccacagatcgctgcacagaaatcttctcttggaggagggaaacaccagctaactaagcacttcccaagtcaccactctgattccgccgcatcatctccagcctctccaatggagaagatggatcagacacagctgggccatttagccctcaagcctaagcagccttggcatttaacgcaatggccggctatgaacttgacctggattcataccactccaatttgtaacccaccactgagttctcccggaacaatctccttcagccacgggccacttggcacgggcacgggaatcggggtgatcctgttcttgcagcacggcgtgcagcccttcacacattccgcacctaccacccccgtccctcccactacagcttccccggttattcctggggagcccatgaagctttccggtgaagggccaagatgttattctctccccgtgaccttgccgtcagactggagctataccctgtcccccccttctctgcctacactggctcggaaaatgaccatcggccatcgggagcaacaacgcagtcaccccccagtggcagcagatgcccatctgctgaatctgtag

SEQ ID NO: 53631 - DNA, 504 bp, Artificial Sequence
  Description of Artificial Sequence: Synthetic coding sequence
atggctgcagaagaaaaggacccactctcgtacttcgccgcatatggcagcagttcatcggggtcatctgacgaagaggacaatattgagcctgaggaaacttcaaggcgtacacctgatcccgcaaagagcgcaggcggttgtaggaacaaggcggagaagaggttgcctggacctgacgaactatttagatcggtcacaaggccggcttttctgtataatcccctaaataagcaaattgactgggagcggcatgttgttaaagcccctgaagaaccaccaaaggagtttaaaatatggaagagtaactatgtgccaccgcctgaaacctacacaacggagaaaaaaccccctccacccgagctggatatggccattaaatggagtaacatctatgaggataatggcgacgacgccccacagaacgcaaagaaagcccgtctgctccctgagggagaggagacactcgagtctgctctggaggacctcgagatccagaactag

SEQ ID NO: 53632 - DNA, 549 bp, Artificial Sequence
  Description of Artificial Sequence: Synthetic coding sequence
atggcagccgaagagaaagacccgttgtcttacttcgccgcatatggctcaagctccagcggctcgtcagacgaggaggacaatatcgagcccgaggagaccagccgcaggacaccagatcctgcaaagtccgccggtgggtgcaggaataaagctgaaaagagactgcctggccctgacgagctgtttagatctgtcacaagaccggctttcctgtacaacccactcaacaagcaaattgattgggagcgccatgtggtaaaagcacccgaagaaccaccaaaggaattcaagatttggaaaagcaattacgtgccccctcctgaaacttacacgactgaaaaaaaacccccaccacctgaacttgatatggctataaagtggtctaatatttatgaggacaacggagacgacgccccacagaacgccaaaaaggccagactgctgcctgaaggagaggaaaccctagaatctgacgatgagaaggacgagcacaccagtaagaagagaaaggttgagccaggcgagccggctaaaaagaaaaagtag

SEQ ID NO: 53633 - DNA, 438 bp, Artificial Sequence
  Description of Artificial Sequence: Synthetic coding sequence
atggctgcgcgacagatctgggctcgaaccggtgcggcactctgtcggcagcccagcgccgctccacccccagcacctctgtgggttcgcgctggtttccgacagcagctgtcacttactctgtgccccgctaatgagggcaattgcggaggtagcgccccatccaccccgggtcgaccagaaagggccgctcggcctagcgtttctgaggagttgacagcggctgaacggcagatcgctgagctccacgcagccgcttgtgctgcaggacagctcaactacgtagatcccgctacagggtacgtggttctcacacaaatcgcacacttgcagcgtggcgagtgctgtgggtcggcttgccgacactgcccctacggccaagtgaacgtcaaagatccatccaagaaaaagcagtttaacagttacttttacgtctag

SEQ ID NO: 53634 - DNA, 396 bp, Artificial Sequence
  Description of Artificial Sequence: Synthetic coding sequence
atggacgtcctgtttgttgccattttcgcagtgcccttaatcctcgggcaagaatatgaggacgaagagaggctaggcgaggacgagtactaccaggtggtttactattatacagttacccctagctacgacgacttctccgccgacttcacgattgactattcgatttttgagtctgaagataggctgaatcgattggacaaagatatcacagaagctatagaaaccactatcagtttggaaactgctcgcgcagaccacccaaagcccgtcacagtaaagcccgtcacaaccgagccgtcccctgacctgaatgatgctgtcagcagtctgcgttcccctatccccttactgctttcgtgcgccttcgttcaagtgggaatgtatttcatgtag

SEQ ID NO: 53635 - DNA, 1356 bp, Artificial Sequence
  Description of Artificial Sequence: Synthetic coding sequence
atggcagaggctgcggctctggtctggattagggggccaggattcggctgtaaagctgttcgatgcgcaagcggacggtgtacggtgcgcgacttcatccatagacactgccaggaccagaatgttccagttgaaaattttttcgtgaagtgtaatggcgctttgataaacacttctgacacagttcagcatggtgccgtttattcgctagagccaagactgtgcgggggtaagggcggattcgggtcaatgctacgtgctctgggagcccagatcgaaaaaactactaacagagaggcttgtcgcgacctctctgggaggaggctgcgagatgttaatcatgagaaggcaatggccgaatgggtcaagcagcaggctgagagggaggcggagaaggagcagaagaggctcgagcgactccagcgcaagctcgttgagcccaaacactgtttcacttctcctgactaccagcaacaatgtcatgagatggctgaacgtttagaggactctgtcctgaaaggaatgcaagccgcatcgtcaaagatggtgagcgcagaaatttccgaaaaccgcaagaggcagtggcccacaaaatcccagacggatagaggggcttcagccggaaaacgcagatgcttttggctgggcatggagggattggaaaccgcagaaggctccaacagcgaaagtagtgatgacgacagcgaagaggccccttccacaagtggtatgggcttccatgctcctaaaatcggatccaacggagttgagatggcggcaaaattcccatccggcagccagagagcccgtgtagtcaatactgaccatggcagcccagagcagcttcaaattcccgttaccgattctggacggcacattctcgaggattcatgcgccgaacttggggagtcaaaagaacatatggaaagcagaatggtcacagaaacggaggagacgcaggagaagaaagctgagtcaaaagagcccatcgaagaggaacctacaggcgcaggcctgaataaggataaagagaccgaagaacgaacggacggagagcgagtcgctgaagtggcccctgaggaacgcgagaacgtggcagtggccaaacttcaggagagtcaaccaggaaacgccgtgattgacaaagagacaattgatctgctggccttcaccagcgttgcggaactagagctgctcggcctggagaaactgaaatgcgaactcatggcactcggattgaaatgtggcggaactctgcaggaacgcgcagcaagactgttctccgtgagagggctcgctaaggaacagatagatcccgcactgtttgccaaacctctgaaagggaaaaagaagtag

SEQ ID NO: 53636 - DNA, 1071 bp, Artificial Sequence
  Description of Artificial Sequence: Synthetic coding sequence
atggagcattcgctgacgcccgtcactcagtgcagtatggagttgtttattgtgtggaatccagacttcgccgtggaaaaagaggtcttagatctttgcagcgaacacctggtgctgcgactgagacggcagcccattgagaagctggtagaacccaaacactgtttcacatctcccgactatcaacagcagtgccacgaaatggctgagagactcgaggactccgtactgaaagggatgcaggctgctagttccaaaatggtctccgcagagatttcagagaacaggaagcgccaatggcctactaaaagccaaacggaccgaggggcttcggctggaaagaggaggtgtttttggcttgggatggagggcttggaaaccgccgaagggtcaaactctgaatccagcgacgacgactctgaggaggcaccaagcacctcaggaatgggattccacgccccaaagattggatccaatggcgtcgaaatggcagcaaagtttccctctggctctcagagggctagagttgtcaataccgatcatggctcacccgagcagctgcagattcccgtgacagactcaggtcgtcatatccttgaagatagctgcgccgagctgggcgaaagcaaggaacatatggagtctcggatggtgaccgagacggaggaaacccaggaaaaaaaagccgagtctaaggagccaattgaggaggagcccacgggagcgggactcaacaaggacaaggaaaccgaagaacggactgacggcgagcgtgtcgccgaagtggcacctgaagaacgcgagaacgtcgctgtcgctaaactccaggaatcccagcccggtaacgccgtgattgataaggagaccatagatttactggctttcacatcagtggccgaattggagctgctcgggttggaaaaactcaaatgtgagctgatggctctggggcttaagtgcggaggtacattgcaggaacgagcggctcgcctgttcagtgtgagaggcctggctaaggaacagattgatcccgcactgttcgctaaacccctaaagggaaaaaagaaatag

SEQ ID NO: 53637 - DNA, 1320 bp, Artificial Sequence
  Description of Artificial Sequence: Synthetic coding sequence
atggctgaggcagccgctctggtttggatcagaggtccaggttttggctgcaaagccgttcgctgtgcctccggccgttgcacggttcgtgattttatccataggcattgccaggatcagaatgttccggtggagaacttcttcgttaagtgccatggcgcagtgtatagtttagagccgaggctgtgcggcggtaaagggggtttcggttctatgctgcgggctttaggagcacagatagaaaagacgaccaaccgggaagcgtgccgggacctctccggcaggcgcctacgagatgtgaatcatgagaaggctatggcggagtgggtaaagcagcaggcagaacgggaagcagagaaagagcagaagagactggaacgcctgcagaggaagttagtcgaaccgaagcactgtttcactagtcccgactaccagcagcagtgccacgaaatggctgaacggctggaggatagtgttctgaagggaatgcaggccgcatccagtaaaatggttagcgcggagattagcgagaataggaaaaggcagtggcctactaagagccagactgacagaggcgcttcggcagggaagcggaggtgcttttggctcgggatggaggggttggaaactgccgaggggagcaattccgagagttcagacgacgacagcgaagaggccccatcaacctcagggatgggctttcacgcgccaaagatcggctccaacggagtcgaaatggccgcaaaattcccatctggatcgcaacgcgctagggttgttaacaccgaccacgggtcaccagaacagttgcagatccccgtgactgatagcgggagacacatattagaggactcctgcgctgagctgggtgagtctaaggaacacatggagagcagaatggtgacggagaccgaggagacgcaggaaaagaaagcagagtcaaaagaacctattgaggaagagcccactggggcaggcctaaacaaggataaagaaacggaggagcgcactgacggtgagagggtagccgaagtcgcccctgaagagagggagaacgttgccgtggcaaagctccaggaatcccaacctggaaatgccgtgattgataaagaaaccattgacctgctcgcatttacatccgttgcagaattggagcttctgggcctcgaaaaacttaaatgcgagctgatggccttggggttgaagtgcggaggaacccttcaggaacgcgcagccagacttttcagcgtgcgcggactcgcgaaagagcagatcgaccccgctctcttcgccaaacccctcaaaggcaagaaaaagtag

SEQ ID NO: 53638 - DNA, 873 bp, Artificial Sequence
  Description of Artificial Sequence: Synthetic coding sequence
atgagtaattatgtcaacgacatgtggcctggttcacctcaggaaaaagacagccccagtacctcccggagtgggggttcttcacgcctgagctcacggagtcggagtagatcattctcacgcagcagccgctcacacagcagagtgtcgtcccgcttctccagcaggagccgacggtccaagtccagaagcagaagtcgccgtagacaccagcgcaagtatcggaggtactctcggagctatagtagatcacggagccggagtcgttcccgcagataccgagaaaggcggtatggattcacccgcaggtattaccggagtcctagccggtaccgctcgcggtccagaagcaggtcccggtccagaggccgatcatattgcggcagggcttacgcaatcgcccgaggtcagaggtattatggattcggcagaaccgtttacccagaggagcatagtcgttggagggatagatcacgaacaagatcccgaagccgcactccattcagattatccgagaaggacaggatggaactgctcgagatcgctaagaccaatgctgccaaagccttgggaactacaaacatcgacttgccagcttcacttcggacggtgccatcagccaaggaaaccagcagaggcattggagtttcttctaatggcgcaaagccagagctgtcggagaaagtcactgaggacggcacacgaaaccccaacgagaaacctacccagcagcgcagcatagctttcagttccaacaatagcgtggcaaaacctatccagaagtctgccaaggcagcgacagaggaagctagctctcgctcccccaagatagaccagaaaaagagcccgtatgggttgtggattccgatatag

SEQ ID NO: 53639 - DNA, 876 bp, Artificial Sequence
  Description of Artificial Sequence: Synthetic coding sequence
atgtggcccggaagtccccaggaaaaggattccccatcaacttctcgttccggaggatctagcaggttatcgagcaggtcccgaagcagaagcttcagcagatcatctaggtcccactctcgggtgtcttcacgattctcgagtagatcgagacggtcaaaaagtcgaagtcgttcccggcgacgtcaccagcggaagtatcgccgatattcccgatcctatagtcggtcccgcagcagaagccggtctcgacggtaccgggagcgcagatacggctttacccgcagatactaccggtcgccgtcccgctataggtcacggtccaggagccgctcccggtcgcgaggacgctcttattgcggaagggcttacgccatcgccagaggacagcgctattacggcttcggaaggacggtgtatcctgaggagcacagcaggtggagagataggagcagaacgcgtagcagatcccggaccccctttcggctatccgaaaaggatagaatggaactcctagagattgccaagactaatgcggctaaagccctggggaccacaaatatcgaccttcccgcatccctcagaacggttccatccgcgaaagagacctcacggggtatcgacattgacgaggagaatctgctcgtgatcgatacctgggccaaggccagcgaactctccgagaaagtcacagaagatggaaccaggaatcccaacgagaagcccacacaacagagatccattgcttttagctccaataacagtgtcgctaaacccatacagaaaagcgctaaagctgccactgaagaggccagtagtaggtcccccaaaatcgaccagaaaaaaagcccatacggattgtggattccaatttag

SEQ ID NO: 53640 - DNA, 681 bp, Artificial Sequence
  Description of Artificial Sequence: Synthetic coding sequence
atgtctaattatgttaacgacatgtggccgggtagccctcaggagaaggatagtccatctacttccaggtcagggggaagctcaaggctatccagccgctctcgctctcgcagtttttcccggagttcacggtcacattctagagtaagctcccgcttctcctccaggagtcgaaggagtaagtctcgctccaggtcaagaaggcgccaccagagaaaatacaggcgttacagccggtcctactccaggagtagatccaggagcagatcccgtcgttatcgggagagacgttacggcttcacaaggcgctattataggagcccgagccggtaccgaagtcgatctcgaagcagatccaggtcacgtggacggagctactgcggacgggcatacgccatcgccaggggccagagatactacggctttggaagaacagtataccctgaagagcatagtcggtggagagacagatctaggacaagatctcggtcacgcactccatttcgtctctcagagaaggacagaatggagctactggagatcgctaagaccaatgcggctaaagcccttgggacaactaatatagacctgcccgcatccctccgtaccgtcccgtctgccaaagagaccagccgtgggatcggcgtgagctccaacggggctaagcctgagaagtcctag

SEQ ID NO: 53641 - DNA, 525 bp, Artificial Sequence
  Description of Artificial Sequence: Synthetic coding sequence
atgtccaactacgtaaatgatatgtggccagggtcaccccaggagaaggacagcccctcaacctccaggtcggggggaagctcgaggctgagcagccgttcacggagcaggtcctttagccgctcttcacgctctcacagccgcgtctcatcgaggtttagcagtcggagccgtcgctccaagagcaggtctcgcagccgccgtcggcatcagcggaagtaccgtagaacagtgtatccagaggagcattcaaggtggagggaccggagtcgaacacgttctcgcagcagaacccccttccgcctatctgaaaaggacaggatggagctgctagagatagctaagacgaacgcagcaaaagctctgggcaccaccaatatcgatttgcctgctagtcttcgcaccgttccttcagccaaggagactagtagaggcatcggagtctcatccaatggcgcaaagcccgaggttagcatccttggcttgtcggaacagaattttcagaaagctaactgccagatttag

SEQ ID NO: 53642 - DNA, 510 bp, Artificial Sequence
  Description of Artificial Sequence: Synthetic coding sequence
atggcgccttccgaagaccctcgggactggagagcaaacttgaaaggcactataagagaaactgggctagagacctcaagcggcggtaagctcgctgggcaccagaaaactgttcctaccgcgcatctgaccttcgtgattgattgtactcacggaaagcaactctctttggccgcaacggcgagcccaccccaggcccctagccctaaccgcggtttggttacgcctccaatgaaaacctacatagtgttctgtggtgagaactggccgcacttgacacgggttacacctatgggtggtggctgtctggctcaggcccgagcgacacttcctttgtgcagagggtctgtggcctcggcctcctttccagtcagtccgctgtgcccacaggaggttcctgaggctaaggggaaaccggtgaaggccgctcctgttcgcagctccacgtggggtactgtgaaggattctttgaaagctctctcctcatgtgtgtgcggccaggcagattag

SEQ ID NO: 53643 - DNA, 1872 bp, Artificial Sequence
  Description of Artificial Sequence: Synthetic coding sequence
atggccggttttagtcactttagccagcccccttatcgcgacttgtgggaaccccctcgtcctggtggggaaagagaatccacacaacgccttggtggccagagaagcggggctgactcaacggcatgtagcagggccggtacccctggagccgaaagtgaggctggtgcgtgttggctccatccccactgttcctttactccgaggccccgtcgaagaggatgtagtgattcactcaggggatctcggagcctgagcgacgtcgcccgtcgacctcttgagcgctcaaggaagcacaggccaaggtcaaggagactggaggatgcatggggcgagacagggactaaacctcggccagcatggcagccgcaaactcagctgccaccccagcgtccccagccctgcccacactatcctctggctcagggcgattcgcctcccccatgtcctgggggagccggaacgcctctcagcggcacctttagagtagagaaagcgcaggggggtgatcagtgggccgtgcccctgggtcggcacttgggtcggtggagcccaagcagcgtccccagtgagagatccagcgtgccctcacagaaattcaaaaggcacagcgcctgtgtatgcgcccagaaaagagactcgagcgatcaagtcgagtcgctggctagcagggattcccagccactggcatcaagtaaggagatgagatcccctcatactcaagtgttgaaaagcaaactagaggaggtagtggtttcttctcaggatcagcagatcgttgctcttgtgctcactcgcctgaagaaggcgcagcgaattcgagagttgcagcaacaggctgctaaggcgtgggaggagctgaagcgcagcgaccaaaaagtacagatgactctggaacgcgagcgcagattgctgttgagacagtctcaagagcagtggcaggaaaaggaacagagaaaaaccctgcagtcccctgagcagcgcggactcaggagggactcccaaagaaagaatgtgccgccaggagagtctcggtggaaagagcaacccgaggatcaagaatcgcctagacaagagaagctggagaaggcgagggcacaggcggagcaccggaagcagtgtcaagtcaggaggctgcgggaacaggagaagatgctgaggaacctgagagaacaacattccctgcaacttcagcggaggcttgtggaggcctgccgcaaaagacatcttcacgctgtggaaggacagaagaaggtgcaagacaccaacctatcaagtctcataaactaccaggcccgaaaggttttgatggactgccaggccaaagccgaagaactgctgaggcagctgagtctggaacagagcttccagcgctcacaagagatccaccagggcctgcgaaaagagaggcagagagagcttcgggagaaagcacagaaagaggaggagcagttacagcaggccagatggcgcgcaggagagtcggaggaacaacgcaaaatgaggaagcgtattctggtagaactggcggacgagaaaatccgccaggctcggagtcatgtgcataaaacgacaagagataaggttcaacatctccgcgagctcaatcatctcagagagaaaaaccatcatatcctgaagctgaaggcggaaaaagaagagaagtgtcacattgagggaatcaaggaggccatcaaaaaaaaggaacagcgtgtccagcacatcagtcagggcaaggatccaaattttcaggaatttcaaaaactcccacaggctagcaggagggaggagagggctcccccaaacagcagcctggatcagatggtgctggaagcacagctccgggcttgtcaacaaaatcgagggtactag

SEQ ID NO: 53644 - DNA, 753 bp, Artificial Sequence
  Description of Artificial Sequence: Synthetic coding sequence
atgtgcgatcagcagaagcaacctcagtttcccccatcctgtgtcaagggctctggcctgggggctggacagggcagtaatggggctagcgttaaatgtccagtcccctgccaaacacagaccgtctgcgttaccggaccggcaccatgccccacccagacctacgtgaaatatcaggtgccctgccaaactcagacttatgtaaaatgccccgcaccgtgtcagcggacctacgtcaagtatcctacgccgtgtcagacctacgtcaaatgcccggcaccatgccagaccacttacgtgaagtgccctaccccttgtcagacgtacgtaaaatgccctgcaccctgtcagatgacatatatcaaaagtcctgccccttgccaaactcagacctgttacgtgcaaggagcttccccgtgccagtcttactatgtgcaggccccagcaagcgggagcacatcccaatactgtgtcactgacccttgtagcgctccgtgtagtacttcatactgttgcctggccccaagaaccttcggggtctcccccctgcgtcgctggatccagagaccccagaactgcaatacgggtagctctggatgttgtgagaactctggcagctccggctgttgcggatctggcggttgtgggtgttcatgtggctgcggaagcagtgggtgttgttgcttgggcatcattcccatgaggtcaagaggccctgcctgttgcgaccacgaagacgactgctgttgctag

SEQ ID NO: 53645 - DNA, 753 bp, Artificial Sequence
  Description of Artificial Sequence: Synthetic coding sequence
atgtgcgaccagcagaagcagcctcagtttcctcctagctgtgttaaagggagtggactcggggctggccagggctctaatggggcaagcgtcaagtgcccagttccatgtcagacacaaactgtgtgcgtcacgggcccagccccttgccccacccaaacatatgtaaagtatcaggtgccttgccaaacacagacatatgtgaaatgcccagctccctgtcagagaacctacgtcaagtatcctactccctgtcaaacatatgtgaagtgccccgctccgtgccagacaacctacgtcaagtgccccacaccctgccaaacatacgttaaatgcccggctccatgccagatgacctacatcaagtcccccgcaccttgccagacacagacttgctacgtgcaaggtgcttctccttgccagagctattatgtccaggctccagccagtggcagcacatcccaatattgtgtgaccgacccttgttccgctccctgttcaacttcgtattgttgtctggctccacggaccttcggggtatcccctctgcgacgctggatacagaggcctcaaaactgcaacacgggatccagcgggtgttgcgagaattcaggcagctccgggtgttgtggatctggtggttgtggctgcagctgcggttgcggatcctctggctgttgctgtcttggaatcattcccatgcgatctagaggtcctgcctgctgtgaccacgaggatgactgttgctgttag

SEQ ID NO: 53646 - DNA, 810 bp, Artificial Sequence
  Description of Artificial Sequence: Synthetic coding sequence
atgctgctgctggatctaatgagtagccctagccctcagctgctggtagctgccgcacagcagacattaggcatgggtaagcgccgaagtccccctcaggcgatttgcctgcatctcgcaggagaggtgctggccgtagccagaggcttaaagccagccgtgctttacgattgtaattgcgccggtgcctccgaactacaatcttatttggaagagcttaagggtctgggcttcctgacgttcgggttgcacatcctggagattggcgagaactcactcatcgtttcgcctgaacatgtttgtcagcacctggagcaagttctgctcgggaccatcgcgtttgttgacgtaagtagttgccagcggcacccgtctgtttgtagtctggatcagttgcaagacctgaaagcactcgtagccgaaattatcactcatctgcaaggtttacagcgcgatctctcgcttgccgtttcttactccaggttacacagttccgattggaatctctgcactgttttcggaatactcttggggtatcccgtgccatatacattccatctgaaccagggggatgataactgccttgccctgacacctctgagggtctttaccgccagaatttcttggctcttgggccaacctccaatccttctgtacagcttctccgttcccgaaagcctgttccccggtctcagggatatcctgaatacttgggagaaagatctgcgcactaggttccgcacacaaaacgatttcgccgatctctccatctcttctgagattgtcactctgcccgcagtggcgctatag

SEQ ID NO: 53647 - DNA, 552 bp, Artificial Sequence
  Description of Artificial Sequence: Synthetic coding sequence
atgagaggaagcgtcgaatgtacctggggttggggtcattgcgccccatcacctttactcttgtggactctgctgctctttgcagcaccatttggccttttgggagagaagaccaggcaactcctagagtttgactctactaatgtttctgatacagcagcaaagccactgggcagaccctacccaccgtactcgctcgcagatttttcgtggaacaatatcaccgactccctggaccctgcaactctgtcagctaccttccagggacacccaatgaatgaccctacccgtacgttcgctaacgggtcactagccttcagagtacaggcctttagtcgcagcagtcggccagcgcaacctccaagactcttgcacactgccgacacgtgccagctggaggtagccctgatcggcgctagcccaagaggtaatcgaagcctctttgggctcgaagtggcgacgcttggccaggggcctgactgtccaagtatgcaggagcagcactcgattgacgatgaatacgcacccgctgtgtttcaaaggcgcgattag

SEQ ID NO: 53648 - DNA, 852 bp, Artificial Sequence
  Description of Artificial Sequence: Synthetic coding sequence
atgtgcggcccagagcatctcctttgttgtcccaaagatctggctatgtttcctagacaactgtctttgacagcgtgtctgcccggaacaccggtctcccacaaatgccatcacatttggctgtgggtcggcgtacctgcctggcaccccagagcatctcgctgtggaggggcacagccatcctcttggctccgccagaaggctgcccgagccttttggctaagtctaccagctgccaaactgcggcaccattcctctcggtggctgaggcgcagtggcgcattcagctccggatccactttgaaacccccaccatccccgtcacctgcacccctgtgccacgcagacaaccttagaaccggacgtacccgaccttcaggaggtcgtccctggttcctactgggaggtgatgagagggagaggttgtgggccgagctgttacggactgtgagtcccgaattgatcctggaccatgaagttcctagcctgcccgcatttccgggacaggagccaaggtgtggacctgagccgacggaggtgtttactgtgggcccaaaaacctttagttggacaccgttccctcctgatctgtggggacccggaagaagctaccgtcttctccatggcgctggtgggcatctcgaaagtcctgcacgatcactcccccaaaggcccgcaccagacccttgcagagcgcctcgagttgagcagcagccatcagtggagggcgcagcagcccttaggtcttgccctatgtgccagaaggaattcgctcccaggctcactcaactggacgtcgatagccacctggcccagtgcctagctgagtccacagaggacgtgacatggtag

SEQ ID NO: 53649 - DNA, 543 bp, Artificial Sequence
  Description of Artificial Sequence: Synthetic coding sequence
atggaggccgctagacggcctagattaggactgtcaagacgccgtccacgcccagctggcggacctagcggaggaagaccatggttcttactggggggagatgaaagggaacggctctgggccgaactgctgcgtaccgtctcgccggaactgatcctggaccacgaggtacctagcctgccggctttccctggccaagaaccccgttgcggtcctgagcccacagaggtcttcacagtcgggccaaagactttttcctggactcccttcccaccagatctttggggacctggacgttcgtatcggctgcttcacggcgcaggaggccacctggagtcccctgctcgctctctgccacaacgcccagccccagacccctgccgggctcccagagtcgaacaacaaccatccgtagaaggtgcagcggcactcaggtcatgccccatgtgtcaaaaggagttcgccccaagactaacacagcttgatgttgactctcacctcgcacaatgcctcgccgagtcaacagaggacgtgacatggtag

SEQ ID NO: 53650 - DNA, 444 bp, Artificial Sequence
  Description of Artificial Sequence: Synthetic coding sequence
atggaagcctggggcttgtgcgcctggcctaggggccttcgcggtaacttccacacctgtgcaccaggcctcacccagcgccacgaagtcgccagacccccactgcccggaagcagcgaggatggatcagctaccccggatacatggcaactggctgccctgcccctcggaagcttgtccagtggacagttatgcctccacctcaggggaaccagcaccccagccccaacttgtgtacctctggcccctaagctgccgccatacgtttgggtggcttcggagatgtggggaagacgacattctaggaagaagggaattcggggagccagtacgtcatccgagcacttcatcccacaggatgcaaccagatcactttcttggagaagcagatctgtgcaccgcgtgctgtttccatggaagatgtgcacactggaaacggcatag

SEQ ID NO: 53651 - DNA, 339 bp, Artificial Sequence
  Description of Artificial Sequence: Synthetic coding sequence
atggaggctgcaaggaggccgaggctgggcctctcacgcaggaggccaagacccgctggtgggtcacctggggctgcaagaagccccttaaagagcagcctttctgatccaaggccatttccaggccatccttttaggcgcacctgtggagcacgagccgtgccgaccggatgctttactggccaggagggtacctggaatccacctcctggcccatgcccctccgcacgacatctgattccagccggaccaccaggatggtcctcaagtcgtttgtggcgcgttccacgtccttgcgcagccgcaccttgcgcaagacgcagctcaccaccagggtag

SEQ ID NO: 53652 - DNA, 588 bp, Artificial Sequence
  Description of Artificial Sequence: Synthetic coding sequence
tgagaggcagcaagacggccaagacttggcctctcccgacgcagaccgcgaccggctggaggacccagcgggggtagaccatggtttttgctcggcggagacgagagggagaggctgtgggccgaacttctacgtactgtgagtcctgaactgatactcgaccacgaggttccctctctccccgctttccccggtcaggaaccacgctgcggccctgagcccactgaggtttttactgttggacccaagacatttagctggacaccgttccccccagatttgtgggggcctggaagatcttatcggctactgcacggagccggagggcatctcgagagcccagccagaagtttaccacagagacctgctcctgatccatgtcgggctccaagggtcgagcaacagccctctgtggaaggagcggctgcattacggtcctgtccaatgtgccagaaagaatttgctccaagatctaagaactcttccgggatgaggcgccatcgtagcccaaaacttgcagctaataacaacaacaacaaacggaaaggacgtgctcgctggttaacccccgttattcccgcactctag

SEQ ID NO: 53653 - DNA, 1641 bp, Artificial Sequence
  Description of Artificial Sequence: Synthetic coding sequence
atgtcaagcgcttggaaaacccctagagggtccgacgcaatgcccgaaattatggtaaaaatcatcggcagcaagcacttccagtacttggttgaaaaacccaagattaaagaaaatgatagccttaaaaccgaaactcagaccatgcatcagaaacccatgacagacaacgcccgacagatgtcccgggacacaccagtgccaattaacttcacggatcagcagacgaccgacaaccccgatgatgtaaaagaaaagaagcatcccgaaaataatcaaaaaagcgaaaacaaccaaaaactcctcacaggcgcaaacagttctaggttcctggacgggaatattcccagtcaagctaacgtgcactgtagttccgtgcctaccggggaccaaagtctttcttatgtgcacggaataccccgtagaaagcttagagattggagcctggaacagatggtcagggggagttccgatcagccagaggatattgggcaaagcccatcgggcacaaccaacgaggatgcctttctgctcgccttggtgcgtagagagctgaaaagtcgccctctgagctccaaccttctcgaaaagctgcagaaggagttgaaaatcctggatcccatctcatcagggttcttactgcagagtcagcttagtagactctttctgaagcatgaagttccgctgcagctgcccaccgtgaagatcctgtgccagagattcagtaaaaggggcagcccagagatggtgaattatgaaaaactgctgtggttcttgaatagtgcagcgagtgactatcctcaacaaaacaaggctgccgcagatctccggaaaactgagtcccatggtactcactctcagagcactccccctcagcactcatccagtcaaccagaagtgaatagaagcctgctagagatcctcaagatggctcttaggaccacgaatgggcgactgaatatagacaacctgaacctgtcatttcgtaaagaagaccgctcattctcgggctgtctcccactgcccaaagtaagggctatctgtggaaagcatggactatacctcacgctatcattgctagagaccctacttaatcaccaagacctcggttaccaaaacgagatcaagtggcagaattttgtggagatgctcactagggcctcttctgatttgctcagcgacttgccaaccggcaaaaacgaaaagaaggccccagccccacctatggaaccagaggttcctgagatgtctcagagcaagactgagcacatgaagactccagaagaggagctgcagccagagtcttcccccgctgaaacttctgcctgtaaggatccactgaaacctctaaaaatccggcctgtgtctcagccgtttgttaacccggctgtgaaaaacaaggccgaggaatgcgagacctggattgatcgctttcgcaaacttgaaaatgccctgtatctatgcgatctcagcaacactggtgtgcttgagaaggagagggcacgcagattgattcacaattataaccttatttacaatctgagtctgtctccacaaaaaatagatcaggcactccggagatttagatccggtgagaacatgctgttggaaccagcactccggtacctgaaagagctttag

SEQ ID NO: 53654 - DNA, 543 bp, Artificial Sequence
  Description of Artificial Sequence: Synthetic coding sequence
atgagccggggatgcagctctgatttgaggttccatacttggctggggcttagaatgctgaaaaacatcatagccgtggcacttcttatgctcggaaagaatgagaagaaagcccctgccccacccatggagccagaagtcccggagatgtcccagtccaaaacggaacatatgaaaaccccggaggaggaactgcaaccggaaagctcccctgccgaaacatccgcttgcaaagatcccttaaagcccctcaagattcgacccgtgtcacaaccattcgtgaacccagctgtgaaaaataaggccgaggagtgcgagacatggattgaccgcttccggaaattggaaaacgccctgtacctctgtgatctttcaaacacaggggtgctcgaaaaggagcgagctcgcaggctgatccataattataatctgatttacaacctgagtttgtcacctcagaaaatcgaccaggcacttcggaggtttcgttcaggagaaaacatgctccttgaacctgctctgaggtacctcaaggagctgtag

SEQ ID NO: 53655 - DNA, 714 bp, Artificial Sequence
  Description of Artificial Sequence: Synthetic coding sequence
atgtcctcagcttggaaaacgccgaggggaagtgatgccatgcctgagattatggtgaagattataggttccaaacattttcaataccttgtggagaagccaaaaatcaaagagaatgattctctgaagaccgagactcaaactatgcaccagaagcctatgaccgacaacgcccgacagatgagccgggacacccctgtaccgattaactttaccgaccagcagacaacggacaaccctgacgatgtgaaggaaaaaaagcatcccgagaataatcagaaatcagaaaacaaccaaaagcttttaacgggggctaactcatccagattccttgatggcaacgtcagagccatatgcggaaaacacgggctttatcttacactcagcctcctggagaccttgttaaatcatcaagatctggggtaccagaatgaaattaagtggcagaatttcgtggagatgctgacgagagcatcatccgacctgctctcagatctcccaactggcaaaaatgagaagaaggcccctgctccacctatggaaccggaggttcctgagatgtcacagtccaagacagagcatatgaagaccccagaggaggagctccaacctgaaagttctccagcggaaacaagcgcgtgtaaggatcctttgaaacctctgaagatccggccagtgtcacagccatttgtgaatcccgcagtgaaaaattag

SEQ ID NO: 53656 - DNA, 276 bp, Artificial Sequence
  Description of Artificial Sequence: Synthetic coding sequence
atggtttgttatctgtactgggagacctttcctagcatctcccatctgctcaagataactctcagcgctcgcgactgccacgtgtgcggcctgaatctgtttattttcatggatcccgttgaaaaccaggcacttcaccccgtgatcatggctttgatcctgatgccgagcctccactgctttgggaatattctgatcctgctgttcctcaagtcgccggcacagctcttttgccggatgtccgtggatctggccctgctgtttccacacaaatag

SEQ ID NO: 53657 - DNA, 264 bp, Artificial Sequence
  Description of Artificial Sequence: Synthetic coding sequence
atggaacgaaacaccatttacactggatggctgcagtcgaatctgatactagatccagtggagaaccaggccctgcatccggtaattatggccctgattctcatgcccagcctgcactgttttgggaatatcctcattctgttattcctcaaatctccagcccaactcttttgccggataggcagatttgagacaggggaggagaaaacgaggcgcagggaaggcagtgacgtgaccacagaggctgctataggggtgatgtag

SEQ ID NO: 53658 - DNA, 447 bp, Artificial Sequence
  Description of Artificial Sequence: Synthetic coding sequence
atgcctggaggagacacaactccagaggaggccgcagctccctcatgcgccggatataacccaggactgcttcttttcagagcccaaaaggcacagggcgcatgtgtaaccagcactgaaggggcttggccaagacgtgcaagcgctctatatggcggaaggaagatgcgttgtggggaatccggggctggtccagatcctcgttccaattctgctgaggtcagttcctctcagccggcactggcttccaagtcacagagcaagtggggaccaacttccaacaatccaagaggagctctcactaccactgagtttgagatggcagggaatagatcccagaacatcaagcataagcagactgctttgatagccatccccatgtcctcacagactccccgtatgctaggcaggcctagaaatcaggggcagctgtatcctcagccctag

SEQ ID NO: 53659 - DNA, 627 bp, Artificial Sequence
  Description of Artificial Sequence: Synthetic coding sequence
atggatttcagcattatccagtactcaaagtttatgaccttgctggccatgagcctgcagaacctaaagaccctgcacatgagcctggaggaaagtattaaatggctcggcgaagttatggcggagatagggcctacacactcccagaaaagcgaggactggaatatcttcgatgtgaagcaggccaacgcgatcatcgattaccttaagatcagtctgttccagcattacaagctttatgagtttatgttctacagcgcccgagaagagatagtcatcggcaccgagcaggtgatcgaagtcgtgaaatccgcctgtggaccgttccctaatcctctcgaggagggcatttctttcgacatttactccactttcatcgagcctccaactattcttgacactgagatgaagcggctagatcaggaacagggacccgaggagagccaacctgagaccgacacatccgatatggacccgctggtagggtttaccattgaagacgtgaagtctgtgctggaccaggttaccgatgatattcttatcgggattcagaccgaaatcaacgaaaagctgcagatccaggaggaggcgtttaacgccagaatagaaaagctgaagaaagcgtag

SEQ ID NO: 53660 - DNA, 255 bp, Artificial Sequence
  Description of Artificial Sequence: Synthetic coding sequence
tgagcggacccgggaggcaaccacgcccgtataggagcactccatatgagtctcgaggagtctattaagtggctaggggaagtcatggccgagatcgggccaacccactcccagaagagcgaggactggaacattttcgacgttaagcaggctaacgccatcattgattacctgaaaattagtctgttccaacactataaactgtacgagtttatgttttacagtgcaagagaagagatagtgatcggtacatag

SEQ ID NO: 53661 - DNA, 597 bp, Artificial Sequence
  Description of Artificial Sequence: Synthetic coding sequence
atggaaagtagccggtgggacaaagatcctcccggtgaaaggaggcctcagcagtctcagcactggagaagctgcggagtcgggggtgcaggggaggccacgagaggaggcttattccctgtgccattccccagtggagattcgtggcccgaggtcacccagcactggatgagattccaaggacagggcccatggtgccctggtctctggacgacacctgcacattcccattgcaaacctcagactggtgcagtggacaacgcctcccctaggcagccacacgcgccagatcagcacgaaaagaatgccggtcggcagcacctgcacctatggagcctcgcatgtcccccttggctacactctatcccccatatcaaaggaactatcctgtcagaggccctctctggctttttggtatctgaccggaggacaaaaaccgtagcgggactcaggtggttatggctgagaaaagaggccacaccgactgcatctagaacaaccctcagcagcagcctcgccccaagaggaagaggtgttaatactctggggagagggggatgcaccctgatggtgctgagctctgacttatgtgactag

SEQ ID NO: 53662 - DNA, 666 bp, Artificial Sequence
  Description of Artificial Sequence: Synthetic coding sequence
atggagagcagccgttgggataaagacccccctggcgagagacgccctcagcagtcacaacactggcgggcacgagaccatggggctagagggtgtggcccacggcagcctacagcaactgcttctcccagaccaggtctatggatcacacctgcacacggttcccatactcctcagaccaatacacgcagaacacaagccgataatatcttcatttacgagagttggcttatccaccatggtacacagatgagtagcgtcttgccccagccgcctctagtgcgaggaccctggcataacacaaactctccctgggacagttgggccagcaggggcaagttgagggtatgtccctgccggacaccacggctgcacagttcaggctgttttagtagcaaggcaggaacagccctgagccccagcctgccagttcctggattgaggccacaaccccctttcctgcagaagcctctgagtattttagccccagctacacccccagcactggtttcacccactccccctaagctgagcccaggacaactgtcaccacatagcgttaacgtccactgggggcctcagggacacctgcacctccccagaagcggcacaaccgtgcttcatgcatacctgcaaaccctaagtagtcctgctagtcatcagtag

SEQ ID NO: 53663 - DNA, 681 bp, Artificial Sequence
  Description of Artificial Sequence: Synthetic coding sequence
atggcaggcctcgtcgtcagggggactcaggtcagctatattgggcaggattgtagggaaatacccgagcacctgggtcgggattgcgggcatttcgctaaacgcttagatctttcttttaatctgctaaggtctctcgagggcctgagtgcctttcgctccctcgaggagctaattctcgacaataaccagctgggcgatgacctggttctgcccggactccctagactgcataccttgacattgaataagaacagaatcacagacctagagaacctgctggaccatcttgctgaggtaactcctgcgctcgaatacctcagcctgttgggcaatgtggcttgtccgaacgagctcgtgtccctggagaaggacgaggaagattacaaacggtatcggtgcttcgtgctctataaactgccgaatcttaaattcttggatgcccagaaggtcacacgacaggaacgagaagaagctctggtgagaggggtgttcatgaaggtggtgaagcctaaggctagttccgaggatgtggcatcaagccccgagagacattacacacccttaccgtcggcttcaagggaacttaccagccaccagggagttttggggaaatgtcggtacgtttattacggtaaaaatagcgagggaaacaggtttataagagatgatcaattgtag

SEQ ID NO: 53664 - DNA, 597 bp, Artificial Sequence
  Description of Artificial Sequence: Synthetic coding sequence
atggagaaatacttaagcctcagcggaaatcacagttccaacaagaggtccctggagggattgtctgcatttagatctcttgaagaacttatcctagataacaaccagctgggagatgaccttgttctgccaggtctgcctcgattacacacgctgaccttgaataagaaccgtatcaccgacctagagaacctgctcgaccaccttgcggaagtgacccccgctctcgaatacttgtctttgctgggcaacgtcgcttgtcctaatgaactagtgtccttagagaaggacgaagaggactacaagagatatagatgcttcgttctgtacaagctgcccaacctgaagtttctggacgcccagaaggtcacccggcaggagcgcgaagaggcgcttgtgagaggcgtgtttatgaaggtggtgaagccgaaggcctcctccgaagacgtggcctcatcacccgaacgtcactacactcctctgccatccgcatctagagaactgacttcacatcaaggggtgctggggaagtgtagatacgtttattatgggaaaaattctgagggcaatcgtttcattcgagatgatcagctgtag

SEQ ID NO: 53665 - DNA, 438 bp, Artificial Sequence
  Description of Artificial Sequence: Synthetic coding sequence
atggagagcatggcacctgagatcagcgaggatatcggatgccccttagcctatatgcgtgaaagcgtatgtgctttgctcattaatcagtcatttttttcatgtgtggccgagatgtacattcccgacatgaaccggccaggaaaggccgagcggcgagctgaaaaaggactgagacctcctcgcaagcttgtgggggagaccaggagactccagtcatggccaaccttggcccgatggctgcgtagggtgtcgtttagcttatataagcctcctattcaggcagccccagagcccgatcccggaaattgggcgaagtccccgagattgagcctgggtcctgagggcattaccaaaggcaagcacgggttcaaatttcagggaattaaggagaagttcaatgtgtccaaaaaggtgctcaaaatgacgtttctgtag

SEQ ID NO: 53666 - DNA, 240 bp, Artificial Sequence
  Description of Artificial Sequence: Synthetic coding sequence
atggccaagtccgagaggcgcatctactcgatggaatccatggcacctgagatctctgaagacattggctgcccccttgcatacatgagggaaagtgtatgtgcgctccttatcaaccagtctttcttcagttgtgtcgccgaaatgtacatcccagacatgaatcgtctcgaggaacgaactgccgctttgtacccaataggtttagtccggcagaacggcgagccgaggagggcttag

SEQ ID NO: 53667 - DNA, 468 bp, Artificial Sequence
  Description of Artificial Sequence: Synthetic coding sequence
atggctaagagcgaacgacggatatactccatggagagcatggcacccgaaatcagtgaagatatcggctgtccactcgcctatatgcgagagagcgtttgtgctctgctgattaaccagagtttcttttcctgtgtggcagagatgtacatacccgatatgaatcgacccggaaaagccgaacggagagccgaaaagggcctgcgtccaccacggaagctcgtaggggaaacacgaagacttcagagttggcctaccctggctaggtggcttagaagagtctcgttctcattgtataaaccaccaatccaggcagcgcctgaaccagatccaggaaattgggctaaaagcccacggctttctctgggtcctgagggcattaccaaagggaaacatggcttcaagttccagggtatcaaggagaagtttaatgtgagtaagaaagtgctcaaaatgacatttctgtag

SEQ ID NO: 53668 - DNA, 411 bp, Artificial Sequence
  Description of Artificial Sequence: Synthetic coding sequence
atgcagtctcgcgagcccagcggatggcggaccgcagagcgcagaagaggatggaggtgccggggagtgccaactccatcaggagaccggggtcccggagccgctcgcccagcagcgcgtggcggtgctggcgagaccaccggccagcagcgccctctgcaggtcccgggtgccagcgccgctgccgctaggactcggcttctgcggtggcaccaccgagtccctagtcccagagcgactcgcagcccagggagtatccggcgaacctcaccatgttccggcggaccagacaggccagagcgcccagagtgcgctgacgcgtgttgttacctgttggacccttttaccctgccgttgatccaggatttcttcaggggctgtgccgcttccgacttcgatcggcgagactag

SEQ ID NO: 53669 - DNA, 285 bp, Artificial Sequence
  Description of Artificial Sequence: Synthetic coding sequence
atgtttactagacacactctgttccgacagtttgctgtcttagcagacactagcttcaactatatcaaagtaaagcccttattggtgcagagccgaaccaccatgaccgctatttccagctcgagccattgcacaagtagcattgatggcaagcacgtcgatgtggtgagtgaccaggctgcactgcagctgagtccaaagggaaagctctctgagtcacccaaagaggagtcgttagaggagccttctatgcgtcaaagctctcccgctgaaactgtggattag

SEQ ID NO: 53670 - DNA, 285 bp, Artificial Sequence
  Description of Artificial Sequence: Synthetic coding sequence
atgtttactcggcataccctgttccgacaatttgcggttcttgccgatactagcttcaattacatcaaagtcaagcctctgctagttcagagcagaaccactatgaccgccatatcctcttcttcacactgtacttcctctatagatggaaagcatgtcgatgtggtgtccgatcaggccgcactgcagttatccccgaagggtaaactcagcgagagccccaaggaagagtcgcttgaggagccctccatgcgccagtcatcccccgctgagaccgtcgactag

SEQ ID NO: 53671 - DNA, 168 bp, Artificial Sequence
  Description of Artificial Sequence: Synthetic coding sequence
atggcaagcaaagggttgcaggatttgaaacagcaggtcgagggtaccgctcaggaagcagccatggatcagcttgctaagacaactcaagaaaccatcgataagacagctaaccaagcaagtgatacctttagtggaatcggcaagaagtttgggctcctgaaatag

SEQ ID NO: 53672 - DNA, 231 bp, Artificial Sequence
  Description of Artificial Sequence: Synthetic coding sequence
atggcatcaaagggactgcaagatttgaaacagcaggtggaggggaccgcacaggaggcagtcagcgccgctggcgctgccgctcaacaggtggtcgaccaagctactgaagctggtcagaaggccatggaccagttggccaagactacgcaagagactattgataaaaccgcaaaccaggctagcgatacattcagcggtattgggaaaaagttcgggttattgaagtag

SEQ ID NO: 53673 - DNA, 117 bp, Artificial Sequence
  Description of Artificial Sequence: Synthetic coding sequence
atggcatccaaaggcctgcaggacctgaaacagcaagtggagggcactgctcaagaagccgctatggatcaactggcaaagaccacacaggaaaccatcgacaagactgccaattag

SEQ ID NO: 53674 - DNA, 636 bp, Artificial Sequence
  Description of Artificial Sequence: Synthetic coding sequence
atgagcgagaccgatcatatcgcctcgacctcctcggacaaaaatgtggggaagacaccagagctgaaggaagattcctgcaatctattctctggcaatgagtcctcgaagctggagaacgaatcaaaactgctgtcccttaacaccgacaaaactctgtgtcagcccaacgaacacaacaatcgtattgaggctcaggagaattacatcccagatcacgggggaggggaggactcttgcgctaaaaccgataccggctctgagaacagcgagcagatcgcgaactttcccagcggcaactttgccaaacatatcagcaagacaaacgaaaccgagcagaaggtgacccagatcctggtagaattgcgctcttctacttttccggagagcgcgaacgaaaaaacctattcagagtctccctatgacacagattgcacaaaaaagttcattagcaagataaaatctgttagtgcatctgaggatttgttggaggaaattgaatccgagttactctctaccgagttcgccgagcatcgggtgccaaatggaatgaacaaaggcgagcacgcccttgtcctctttgagaagtgtgtacaggacaagtaccttcaacaggaacatattattaaaaaatag

SEQ ID NO: 53675 - DNA, 636 bp, Artificial Sequence
  Description of Artificial Sequence: Synthetic coding sequence
atgagtgaaaccgaccacattgcaagtacgtccagcgataaaaacgtcgggaagaccccagagttgaaggaggacagttgtaacttgtttagcggcaacgagagcagcaaactcgagaatgagtccaaacttcttagcctgaataccgataaaaccttatgtcagcctaacgaacataacaatagaatcgaggctcaggaaaactatataccagaccacggcggaggtgaggattcgtgcgccaaaacagacacgggcagtgagaattccgagcagattgcaaactttccttctggaaacttcgccaagcatatttcaaagacaaacgagactgagcagaaagtcacacaaatcttggtggaattacggtcctctacttttccagaatcggctaacgagaagacatactctgaatcgccatacgacactgactgcacgaagaaatttatcagcaagattaaaagcgtctccgcatctgaggacttactggaggagatcgagtccgagcttctctctacagagttcgcagaacaccgtgtgcctaacggaatgaacaaaggggaacacgccctcgtgttgttcgagaaatgtgtgcaggacaaataccttcagcaggaacatatcattaagaaatag

SEQ ID NO: 53676 - DNA, 2697 bp, Artificial Sequence
  Description of Artificial Sequence: Synthetic coding sequence
atgtctgaaactgatcacatcgctagtaccagcagtgacaaaaacgtgggaaagacgccggagctgaaggaggatagttgtaatctgttttcaggcaatgaaagctccaagcttgagaacgagagcaaactcctgtctttgaacaccgacaaaacactgtgtcagcctaacgaacacaacaatagaatcgaagctcaggaaaactatatcccggatcacggagggggtgaggatagttgcgctaagactgatacagggtccgagaatagtgaacagattgctaattttccttctggtaactttgccaaacatataagcaagaccaacgaaaccgagcaaaaagtgacacagatcctcgtggagctgcgcagcagtacgtttccagaatctgctaatgaaaagacatatagtgagtccccttacgacacggactgcacgaaaaaattcatcagcaagattaaatccgtatccgcctctgaagatcttctcgaggagatcgaatctgaactgctgagcacggagtttgcggagcaccgcgtgcccaatggcatgaacaaaggtgaacacgctttggtcttattcgagaaatgtgtgcaggacaaatacctgcagcaggagcatataatcaaaaaactgattaaggagaacaaaaagcatcaggagctcttcgtagacatctgttctgaaaaagacaacctccgagaggaattgaaaaagagaaccgagactgagaagcagcatatgaacactattaaacagcttgaatcccgcatagaagagctgaataaggaggtaaaagcctcacgagatcagctaattgctcaagatgtaacagcgaaaaacgcggtgcagcagctgcacaaagagatggcacagaggatggaacaggcaaataagaaatgcgaggaagcccgacaggaaaaagaagccatggtcatgaaatatgttcggggagagaaggaaagcttagatctacggaaggaaaaggagacattggaaaaaaagctccgcgacgcaaataaagagcttgagaagaacaccaacaagatcaaacagcttagccaggagaaagggagattacaccagctgtatgagaccaaagagggtgagacaacaaggctaattcgcgagattgataagctcaaagaagatattaactcgcacgtaatcaaggtgaagtgggctcaaaacaaactaaaagccgaaatggacagtcacaaagaaactaaggacaagctcaaggagacaactaccaaattaacgcaggccaaagaggaggcggaccagatcagaaaaaattgtcaggacatgatcaaaacgtaccaggaatctgaggaaattaagagcaacgagttggatgccaaactcagagttacaaaaggcgaactcgaaaagcagatgcaggagaaaagcgatcagctggaaatgcatcacgcgaaaataaaagagttggaggatctgaaaaggaccttcaaggaagggatggatgaattgaggaccctacgtacaaaagtgaagtgcctcgaggatgaacgcctgcgaaccgaggacgagttatccaagtacaaggagattattaataggcagaaagctgagatacagaatctgttagacaaagtcaaaacagcggaccagctacaagagcagctgcagcggggaaaacaggaaatcgaaaacttaaaggaggaggtggagagccttaactcactgataaacgaccttcaaaaagacatagaagggtcccgcaagcgcgagtcggaactgctgttgttcacagaacgactcacaagcaagaacgctcagctccagagtgagtcgaactctttacagagtcaattcgacaaggtgagctgttccgaatctcagctccagagccagtgcgaacagatgaagcagaccaacattaatctcgagtcccgactgctgaaagaagaggaacttcggaaagaagaggtccagaccttacaggcagagctggcatgccggcagaccgaggtcaaagcacttagtacacaggtggaggagttgaaggacgagctcgtgacccagcgacgcaagcatgcatcctctattaaggaccttaccaagcagcttcagcaggctaggcgcaaattggaccaagtggaaagcgggtcgtacgacaaggaagtttccagcatgggcagcaggagtagcagctctgggtcactcaacgctagaagtagtgccgaagatagaagccctgaaaacacaggaagcagcgtggcagtcgataatttcccacaggtggacaaggctatgctaatagaacggatagtgagattacaaaaggcgcacgcacgcaagaacgaaaagatcgagtttatggaagaccacatcaagcagctggtcgaggagatccggaagaaaaccaagatcatccagtcctatatcctcagggaagagagtggaacgctttcctcggaagcgtcggacttcaataaggtccatctctcaaggagagggggaattatggcgagcctctacaccagtcatcccgctgataatggcttgacgctagagcttagcctcgagattaatcggaaactgcaggccgtgttggaggatactcttttgaaaaatatcaccttgaaagagaatctccagaccttgggaaccgaaatagaacgcctgatcaagcaccaacatgagctagaacagcgaacaaaaaagacctag

SEQ ID NO: 53677 - DNA, 1311 bp, Artificial Sequence
  Description of Artificial Sequence: Synthetic coding sequence
tgacgactgatccgagaaattgataagctaaaggaggacatcaatagtcatgtgatcaaggtcaaatgggcacagaacaaacttaaggcagagatggacagtcataaggagaccaaggataagctcaaggaaactactaccaagctgacccaagctaaagaggaggctgatcagatccgaaaaaactgtcaggacatgataaagacataccaggaatctgaggagattaagtccaatgagctggatgccaagctccgggttactaaaggagaactagaaaagcagatgcaggaaaaatctgaccaactggagatgcatcacgccaagattaaggagctggaagacttgaaacggacatttaaggagggcatggacgagctgaggacgctaaggacaaaagtcaagtgcctggaagatgagaggctgagaaccgaggacgagctgagtaagtacaaggagatcattaacagacagaaggctgagatccaaaacctcctggacaaggtcaaaactgctgaccaactgcaagaacagctgcagcggggaaagcaggaaattgagaatctcaaagaggaggtggagtcactgaatagcctcattaatgatctgcagaaggacatcgaagggagtcgaaagcgggaaagcgagctgcttctttttacagaaagacttaccagcaaaaatgcacaactgcagtccgaatctaacagtttgcagtcacagttcgataaagtctcatgcagcgagagccaactccagagccaatgtgaacagatgaagcagacaaatatcaatctggagtctcgcttgctgaaggaggaggagctgagaaaggaagaggtgcaaactctccaggctgagctggcatgcaggcaaaccgaggtgaaagccctgagcacacaggtggaggaactgaaggacgaactggtgacgcaaaggagaaagcacgcttcaagcatcaaagatctgaccaaacagttgcaacaggctcgccgtaaactcgaccaagtcgagtctggaagctatgacaaggaagtgagcagtatgggctcacgcagctcctcttctggcagcctcaacgcacgctcaagtgcggaggatcgaagcccggagaacacaggcagtagtgtggctgtggataacttcccgcaagttgataaagccatgttaatcgagcgtatagtcagattacagaaggcccacgcgaggaagaatgagaagatagagttcatggaggaccacattaagcagctggtggaggagatccgcaagaaaacgaaaaaaatttataaacacctggagcagaagtag

SEQ ID NO: 53678 - DNA, 3015 bp, Artificial Sequence
  Description of Artificial Sequence: Synthetic coding sequence
gtgggatgcgtgtctcatcgaggcctgtttctgcccctgttagccggatggacccccctttggaagagctggccactgtcccagagttcaagttcgttagtgcgcgcttggccagaggcatggattagcggaaggaaaaaatcctggatctcgagccagaacatctggatccggatactgctgttgtctctcgacaatcttgtgacatgtggcaaccagaaaagggaatacagcaagaatacacagtattcccctcgctgcaaaacaaaaatacggagcagattcgaggaactacagtcggagctcgttccggtgagtatgtccgaaacagaccacatcgctagcacatccagcgataagaacgtgggtaagactcctgaactcaaagaagatagctgcaatttgttctcaggtaatgagtccagcaaattagaaaacgagtctaaactgcttagccttaatactgataagacactgtgtcaacccaatgaacataataaccggatcgaggcacaagaaaactacatacctgaccacgggggaggggaagacagctgtgctaagacggataccggatcggagaattcagagcagatcgccaacttcccttcgggaaacttcgctaagcacatctcaaagaccaacgagaccgagcagaaagtcactcaaatccttgttgagctgcggtccagtacctttccagagagtgctaatgagaaaacctactcagagtctccctacgataccgattgtacgaagaagtttatttccaagatcaaaagcgtgagtgctagcgaggacctgcttgaagaaattgagagcgaactcctttccactgaatttgctgaacacagagtccccaacggtatgaacaagggcgagcacgcactcgtgctgtttgaaaagtgcgtccaagataagtatctccagcaagagcacatcattaagaaactgatcaaagagaataaaaaacaccaggagctttttgtggacatttgtagcgaaaaggataacctaagagaagaactaaagaagcgcaccgaaactgagaaacagcatatgaacactatcaaacagctggaaagtcggattgaggaactgaacaaggaagtgaaagcatcccgcgatcagctcattgcgcaggacgttacagcaaagaatgctgtacagcagttacacaaagagatggctcagagaatggagcaggctaacaagaagtgtgaagaggcgaggcaggaaaaggaagcaatggtcatgaaatacgttagaggtgaaaaggagagtctggacctccgtaaggagaaagaaactctggagaagaaattgcgcgacgctaataaggaactagagaagaacacaaacaagataaaacaattgagccaggagaagggacgtcttcaccagctgtacgagaccaaggagggtgaaacaactcgactgattcgtgaaatagacaagttgaaggaggatatcaactctcatgttattaaggtgaagtgggcgcagaacaagctgaaggcagaaatggacagtcataaagaaactaaagataaactcaaagaaactacaacaaaactgacccaggccaaagaggaagcagaccaaatccgtaagaattgccaagacatgatcaaaacctaccaagaatccgaggagattaagagtaatgagcttgacgctaagttacgagttactaagggggaactcgagaagcagatgcaggaaaagagtgaccagctggaaatgcaccatgccaaaattaaagagctggaagacttgaagcgaactttcaaagaaggcatggacgaacttcgtacgctgcgaactaaagtgaagtgcctcgaagacgagaggctgaggactgaggacgagttgagtaaatacaaggagatcatcaaccggcagaaggcggaaatccagaacctgctggataaagtgaaaacagctgaccagcttcaggaacagctgcaaaggggaaaacaagaaatcgaaaacttaaaggaggaagtggagagcttaaacagcctaatcaacgatctccaaaaggacatagagggcagcaggaaacgagagtctgaattgctgcttttcacggagcgactgacctctaagaatgcccaactccaaagtgagagtaattcgctccagtctcagttcgacaaagtgtcctgcagcgaatcacaactgcagtctcagtgcgaacagatgaagcaaaccaatatcaacctggaatctcggctgctcaaagaggaggagctcaggaaggaagaggtgcagacacttcaggcagagctggcatgcaggcagaccgaagttaaagccttaagcactcaggttgaggagctaaaagatgagctggtcactcagagacgcaagcatgccagtagtatcaaagatcttaccaaacaactgcagcaggcacgtcggaagctagatcaggttgagtctggttcctatgataaagaggtttcaagcatggggtcccgctcaagctcctcaggctctctgaatgccagatcgagtgccgaagatagatcgccagaaaatacaggatccagcgtggctgtcgacaacttcccccaagtcgataaggccatgctgattgagagaatcgtgaggctgcaaaaggcccacgctagaaaaaacgagaagatcgaattcatggaggaccatataaagcagctggtggaggagatacggaaaaagaccaagatcattcagtcatacattctgagagaggaaagcggaactctctcatccgaagcctccgatttcaacaaggtgcatctttcccgcagaggcggaatcatggctagcctgtacaccagtcaccctgctgataacggtctgacattagaactttctttggaaataaaccgcaagctccaagcggtcttagaggatacgctcttgaagaacatcacccttaaggaaaacctacagacattaggtacagagattgagcgactgatcaagcatcagcacgagctggaacagcgtaccaagaagacatag

SEQ ID NO: 53679 - DNA, 1218 bp, Artificial Sequence
  Description of Artificial Sequence: Synthetic coding sequence
atggacagccataaagagacgaaggacaagcttaaagaaacaaccacaaagcttacacaggcaaaggaagaggctgatcagatccggaaaaattgccaggatatgatcaaaacataccaggaaagtgaagagattaaaagtaacgaactggatgccaagttacgtgttacgaaaggcgagcttgagaagcagatgcaggagaagagtgaccagctggagatgcaccacgccaagataaaggagctcgaagatctcaagcggaccttcaaggagggaatggatgagctgaggaccctcagaaccaaggtcaaatgcctggaggacgaaaggttacgtacagaggatgagctgagtaagtacaaggaaatcattaatcgccagaaagcggagattcagaatctgctggataaggtgaaaaccgctgaccaactgcaagagcaactgcagagaggcaaacaagagatagagaatctgaaggaggaggttgagtctttaaacagtcttatcaacgacctgcagaaggacattgagggctcgagaaagcgagagtctgaacttctgttgttcacagagcggctgaccagcaaaaatgcacagctccagagtgaatccaacagccttcagagccagttcgacaaggtgtcatgttccgagtctcagttacagtcccagtgcgaacagatgaagcagaccaacatcaacctggagagtaggctcctgaaggaagaagaactgaggaaggaggaagtgcagaccctgcaggccgagcttgcgtgtcgtcagaccgaggtcaaagcactgtccacccaggttgaagaactgaaagatgaactggtcacacagcgtagaaagcacgcaagctccattaaagacttgacaaagcaactgcagcaggccagacgcaagcttgaccaggtggaatccggttcttatgataaggaggtgtcttcaatggggagccggagtagttcctccggcagcctgaatgcaaggtcctccgccgaggatcgtagtcccgagaacaccggatcttccgtggccgttgataatttccctcaggttgacaaggccatgctcatagagcggattgtgcggctgcagaaagcacacgccagaaagaatgagaaaatcgaattcatggaagatcacataaaacagttggtcgaggaaatcagaaagaagacaaaaaagatttataagcatctggaacagaagtag

SEQ ID NO: 53680 - DNA, 3744 bp, Artificial Sequence
  Description of Artificial Sequence: Synthetic coding sequence
atgcaatccagcgccttagtggagtctctgatcacggtgaaaatggccgctgagaacagtgaggagggcaatacttgtattattccccagcgtaacctcttcaaagcactctcagaagaggcctggaactcggggttcatggggaacagttcgagaactgccgataaagaaaatactttacaatgtcctaaaacaccccttcgccaagatcttgaggcaaatgaacaagacgccagaccaaagcaggagaaccacctgcattccctgggaagaaataaggtgggctaccaccttcacccatcagataaagggcagttcgatcatagcaaggatgggtggttgggtccaggcccaatgccggctgtacacaaggccgctaacggccacagtaggacaaagatgattagcaccagcattaaaacagcacgtaagtctaaaagagcaagcggactccgtattaacgattacgacaaccaatgcgatgtggtgtatattagccaaccaattaccgaatgtcattttgaaaatcaaaagtctatacttagttcgcgaaaaaccgcgcgaaaaagcacgcggggatatttctttaatggcgactgctgtgaactgcctacagtgcgcacgctagctcgcaatttacactcacaggaaaaggcgtcatgttctgccctggcttctgaggctgtgtttaccccaaaacaaacgctcacaatcccagcccctagacacaccgtggacgtgcagctgcctagggaagataacccggaagaaccctctaaagagatcacctcccatgaggagggtgggggtgacgtatccccacggaaggaaccacaagaacctgaagtctgtcctactaaaatcaaacccaaccttagttcttcacctcgctctgaagagacgaccgcgagcagtctggtctggccactgccagcccaccttccagaagaagatttaccagaaggagggagcaccgtaagtgctccgaccgctagtgggatgagttcacctgagcataaccaaccaccagtggctctgctggacactgaggagatgtccgtaccccaggactgtcaccttctgccctctacggagtcattctccggcggtgtgagtgaggatgtcatctcaagaccacactcaccaccagagatcgtgagccgtgaggagagtcctcaatgcagcgagaaccagtcaagtccgatgggcttggaaccccctatgagcctcggtaaggcggaggataatcagagtatttccgccgaggttgaaagtggggatactcaggagctcaacgtggacccgctcctcaaagagagttccacgtttactgatgaaaatcccagtgagactgaggagagcgaagctgctggtggtatcggcaagcttgaaggggaggacggggacgtcaaatgtcttagcgaaaaggatacatatgacaccagtatcgattctctcgaggagaacctcgataaaaaaaagaagggaaagaagtttccagaagcaagtgataggtgcctgagaagccagctgtccgactcatcatccgctgaccgctgtcttagaaatcagtcgtcagacagttcctcagcctgtctcgagatcaaagttcctaagaatccgagcgccaaaagatctaagaaggaagggcatcccggtggcactacacccaaggggttactgcctgattcctttcacacagaaacactcgaagataccgaaaaaccctccgtcaacgaacgaccaagtgagaaggatgctgagcaggagggggagggcggagggattatcaccaggcagactctgaagaacatgctggataaggaagtcaaagaactgaggggagagattttcccaagccgggaccccattaccacggcaggtcaacctctgccaggcgagcggctagaaatatatgtccagtctaagatggatgagaaaaacgcgcacatcccaagcgagtctattgcctgtaaacgggatcccgaacaggctaaagaggaacctggtcacatcccgactcaacatgtggaggaagctgttaacgaggtggataatgagaatacccaacagaaggatgatgaatccgatgccccttgcagcagcctagggctgtcatcctctggaagcggtgacgcagcccgagcgcctaaatctgttccccgacctaaaagactgacatcctcaacctataaccttagacacgcccattctctgggatccctcgacgcctcaaaggtgacaagcgaaaaggaagctgcacaggtgaacccaatcatgcctaaagagaatggagccagcgagagtggggaccccttggacgaagatgacgttgacacggtcgtagacgagcagcccaagttcatggagtggtgtgccgaagaagaaaaccaagagttaatagccaattttaacgctcaatacatgaaagtccagaagggctggattcagcttgaaaaggagggtcagcccacaccgcgtgctcgcaataagtccgataagctaaaggaaatctggaagtcaaaaaagcggtccagaaaatgccgctcatctcttgagtctcagaagtgttctcctgtgcagatgctgtttatgacaaattttaaattgtcaaatgtatgtaagtggttcttagagacaacagagactcgcagcctggtcatagtgaaaaaactcaacacacgcttgcctggtgatgtgccacccgtgaaacatcctctccagaagtacgccccatcttcgctctatccatctagtctgcaggccgagcggttgaaaaagcacctgaagaaatttccaggagcaactcccgctaagaataactggaagatgcaaaagctctgggctaagttccgagaaaatcctgatcaggtggagccggaagacgggtcggacgtctctcctgggccaaactctgaagattctatcgaggaagtcaaggaagacaggaactctcatcccccagccaacttgcctactcctgcatccacaaggatcctgcggaagtattcaaatattagggggaaactaagggctcagcaaagactgattaagaacgagaaaatggaatgccccgacgcactggccgttgagtctaagccttccaggaaatctgtctgtatcaatccattaatgagccctaagctcgctctgcaggtcgatgctgatggatttccagtcaaacccaaatctaccgaaggcatgaaggggcgaaagggcaagcaagtgagcgagatactgccaaaggccgaggtccagtccaagaggaaaaggactgaaggatctagccctcctgatagcaagaacaaggggcctacagtgaaggccagtaaagagaaacatgcggatggagccaccaagactcccgcagccaagcgtcccgctgcaagagatcggtcctcacagcctccaaagaagactagtcttaaggaaaataaagtaaagattccgaaaaagagcgctggaaagagctgtcctccttcccgtaaagaaaaagaaaacacaaataagcgcccatcccagtcaattgccagtgagactctgacaaaaccagcgaaacaaaaaggtgccggagagagtagttcgcgcccacagaaagccaccaacaggaaacaatcttcagggaagacgcgcgcaagaccaagtactaagaccccagagtcttccgccgctcagcgtaaaaggaagctgaaagctaagttggactgctctcactcaaaaagacgtcgcctcgacgctaaatag

SEQ ID NO: 53681 - DNA, 2970 bp, Artificial Sequence
  Description of Artificial Sequence: Synthetic coding sequence
cagcctattactgaatgccactttgaaaaccagaaatccatcctgtcaagccgaaaaactgccagaaagagcacacggggatactttttcaacggcgattgctgtgaactgccaaccgtcaggactctggccaggaacctgcattctcaagagaaggcctcatgcagcgcactggctagcgaggccgtgttcacgcctaaacagacgctcaccattcccgctccacggcacacggttgatgtccagctgcctcgcgaggacaaccctgaggaaccctccaaggagatcacaagtcacgaagaaggagggggagacgtgtcccccagaaaagagccacaagagcccgaggtttgcccaacaaagattaagcctaacctgtcttcttctcctcgcagcgaggagactactgcgagctcgctggtttggcctctacctgctcaccttcctgaggaggatttgccggagggagggtctacagttagcgctcccacagcctcgggcatgagctcgcctgagcataaccaacctcccgtggcactcctcgacactgaggaaatgagtgtcccgcaggactgccacctgttgccaagtactgagtctttctctggcggtgtgagcgaggacgtgatttcccgcccacactcacccccagagattgtaagtcgagaggagtctccacaatgctcagaaaatcagagtagccctatgggactggaaccgccaatgtcactcggcaaggccgaggacaaccagtcaatctctgctgaagtggagtctggggacacccaggagctgaatgttgaccctctcctgaaagaaagctcaacattcaccgatgagaacccttctgagactgaggagtccgaagctgccggaggaatcgggaagttagagggcgaagacggagacgtcaaatgcctctctgaaaaggacacttacgatacatctatcgactctttggaagaaaatttagataaaaagaagaaaggtaagaagtttcccgaggcctctgaccggtgtcttcggtcccaactctcagactcctctagtgccgaccggtgccttagaaaccaatctagcgatagttcctccgcttgtcttgagattaaggtgccaaagaacccctctgccaagaggtccaaaaaggaaggacaccccggagggaccactccaaaaggtctcctgccagacagtttccataccgagacattggaggacacggagaagcccagcgtgaacgagaggccatcggagaaggacgctgaacaggaaggggaggggggtggcattatcactaggcagaccttgaagaacatgctggacaaggaggttaaagaactgaggggggagatattcccctcccgggaccctatcacaaccgctggacaacctctgccaggtgaaagattagagatttacgttcaaagtaagatggatgagaaaaacgctcatataccctccgagagcatcgcctgtaagagagaccccgaacaggccaaggaagagcccggtcacataccaacacaacacgtggaggaggcagtgaacgaggttgacaacgagaatactcagcagaaggatgatgagtccgacgccccttgttcttctctaggcctatcatctagcggcagtggcgacgctgcacgcgctcctaaaagcgtcccacgtcctaagagactgacttccagtacatataaccttagacacgctcatagtttggggtccctggatgcaagtaaggtgactagtgaaaaagaggctgcgcaagtcaaccctatcatgcccaaggaaaatggagctagcgagtcaggggaccctttggacgaagacgacgttgataccgtggtggatgagcagccaaaatttatggagtggtgtgccgaagaagagaaccaggaactgattgcaaatttcaatgcgcagtacatgaaagtgcaaaagggctggattcagctggagaaggagggccagcctaccccacgggcaagaaataagtcggataagctcaaggaaatttggaaaagcaaaaagagatccaggaagtgcagatcctcactcgaaagtcagaagtgtagtcccgttcagatgttgttcatgacaaacttcaagttgagtaacgtttgtaagtggttcctcgaaaccactgagacacgctctctggtgatcgttaaaaaactgaacacacggctgccaggagatgttcctcccgtgaaacaccccctgcagaagtatgccccttcttctctctacccctcctcgctccaggctgaacggctaaagaagcacctcaagaagttcccaggcgctaccccagccaaaaacaattggaagatgcagaagttgtgggccaaatttcgggaaaaccccgatcaggtggagccagaggacgggtccgacgtgtcccctggccctaactcagaagatagtatagaggaggtcaaagaggatcgaaacagccacccaccagcaaatctccctaccccagccagcactaggatcctacgtaagtacagcaacattagaggcaaactgagggcacagcagcggctgatcaagaatgaaaagatggagtgccccgacgctctagctgtcgagagcaagccgtctaggaagagcgtatgcatcaaccccctcatgtcaccaaagctggctctacaggtggacgccgacggctttccagtaaaacccaaaagtactgagggcatgaaagggagaaagggcaagcaggtcagtgaaatcctgcctaaggccgaagtgcaatctaagcggaaacgtacggagggttcatcaccacccgactctaagaataaaggccctaccgtgaaggcctccaaagagaaacacgcggacggcgcaacgaagacaccagccgcaaagagacctgccgcaagagaccgcagtagccagccgcctaaaaaaacttccttgaaggaaaataaagttaagattcccaagaagaaggagaaatag

SEQ ID NO: 53682 - DNA, 1008 bp, Artificial Sequence
  Description of Artificial Sequence: Synthetic coding sequence
atgatccgggagtggaaaaacgattgtcagagaatcgaaaagcagcgtgcttccgacacaatggtgcaagagcggaagaacgaaaagcctgtccggatttttaacactaactcatcctttcaggaccaggccccaacctgttgtcaggaggatctgagtagtgcttcgcccctacggatctggtctaagttttataggtccgatcctcggatagctctgggaaaatattcccctctcgaaaaagagatcctgcggttgggcggaatccacactatcgcagcacggagactcctggcttataagcaagaggaggaatgtagaatgctcaaggagttgcagttgttgtcccctgattataaacaagctatggaatataagaagaagcacagtagtccctgcgcaatttgtgttcccttagaaaagatctggacagccaaagtgatcgctcccctcgaagcatttaagatgccccagcgtgaacaggtgaacgtgtctaagcacatagagcgaatgaggctcgccagagctctcgggaaccaccagcccctgccctatattgagagattcaccagatcttctttcctgtccggcgttgggctcggacctatggcgaagaacaaagctcggcgtaaagaggacaattatgacactcacaactgcgatgatgctaaccaagataagaaagaagaagccgagggaaagaacaccaagagacgggagataaaaatgaacgtggtgtttaaaagcaaagaacctaagaagtgtttaacctatcacggaaatgacaggaaaagctttctccccgcaaagaaacctgagaggtccattgccggactgaccaaccgcaacctgttttgtatcagcgagtttcccggtgatttgatgctgatgaatcaggactttatttccagacgggaccatttcagtgatctcgtcaaaacctatagtctggaggaagagtccatttggaaagaaagaatgcggaaagctacaccataccactattag

SEQ ID NO: 53683 - DNA, 480 bp, Artificial Sequence
  Description of Artificial Sequence: Synthetic coding sequence
taatgtcaaagaattgaaaaacagagagcctctgatactatggtgcaggaaaggaaaaatgaaaaaccagttaggatattcaacaccaactcaagctttcaggaccaggcacccacgtgttgccaggaggatctgtcttctgcgtctccactccgtatctggtccaagttctataggtctgacccacgaatcgcgttgggaaagtattcacccctcgagaaagaaattctacgcctcgggggaatccataccatcgccgcacgcaggcttcttgcatacaaacaggaagaggaatgtagaatgctcaaggagttacagttgctgtctcctgattacaagcaagctatggagtataagaagaaacacagcagtccatgcgcaatttgtgtcccgcttgagaaaatttggactgccaaagtgatcgctccccttgaggcctttaagatgccacagcgggaacaaaattcactggtgacctag

SEQ ID NO: 53684 - DNA, 561 bp, Artificial Sequence
  Description of Artificial Sequence: Synthetic coding sequence
atgactaaaggacgcagattcaaccctcccagcgacaaggatggacgatggtttcctcacatcggcctcactcagaagacaccagaatctattacttccgccacaagtaaggagccacagagtcctcatctcccacgacaggcagaaggcaagctgccccctatatacaaggttcgcgagaaacaggccgtgaacaatcagttcccattttcagtacacgacaaccgacacagcctagagaacagcggctgctatctggactcagggctgggtcgcaagaaaataagccccgataaaaggcaacatgtgtcacggaactttaacttgtgggcttgcgactacgttccttcttgtctagatgggtttagtaacaaccagattagttatgtgtacaaggaggccatggtagtctcttcttttagacgctttccccgatgttacaaggaaatttggaacgccttcacatttctgccagagcgtagctacactgaagttctgaagaaaaaaccaaaggtcaggtttaccgtagataagaaagtggtgtcttccctggaatcttag

SEQ ID NO: 53685 - DNA, 405 bp, Artificial Sequence
  Description of Artificial Sequence: Synthetic coding sequence
atggtggcgctgaaaggggttccagcactgttaagcccagagcttctgtacgcgctagccaggatgggacacggtgacgaaattgtcctggccgatctgaacttccctgcttcgagcatttgccagtgtggccctatggagattagagccgacggcctgggtataccccaactgctggaagccgtcttaaaattgctacccctcgacacatatgtcgaaagccccgctgcagtaatggaactggtcccgtctgataaagaacgcggactccagacgccagtatggactgagtacgaatctatccttagacgcgctggatgcgtgcgggctttagccaagatcgagcgatttgagttctatgagcgggcaaagaaggcttttgcagtcgtggctaccggctgttag

SEQ ID NO: 53686 - DNA, 330 bp, Artificial Sequence
  Description of Artificial Sequence: Synthetic coding sequence
atggagatcagggcggacggattggggatcccccagttactggaggccgtgctcaaacttctgccgcttgacacctatgtggaatccccagctgccgttatggagcttgttcccagcgacaaggagcggggtttacagacaccggtctggaccgagtacgaaagtattctcagaagagccggatgcgtgcgggctctcgctaaaatcgaaagattcgagttttatgaaagagccaaaaaagccttcgccgtggtagccactggcgaaactgccctgtacgggaacctcatcctccggaaaggagtactggctctgaaccccctgctctag

SEQ ID NO: 53687 - DNA, 465 bp, Artificial Sequence
  Description of Artificial Sequence: Synthetic coding sequence
atggtggccttgaagggggtccctgcgctgctatctcccgagctcctttacgccctggccagaatggggcatggggatgaaatcgtccttgctgacctgaactttcccgcttccagtatctgtcagtgcggacccatggagattcgggcagacggcctaggtataccccagctgctggaagcggtcctcaagctgctgcccctcgatacatatgtagagagtcccgcagccgtgatggagcttgttccctcagacaaggagcggggtctccagaccccggtgtggaccgaatacgagtcaattctacgcagagcagggtgtgtgcgagccctggctaagattgaacggttcgagttttacgagcgggctaaaaaggccttcgctgtagtagctactggcgagactgccctgtacggcaacctgatccttcggaaaggggtcctcgcccttaaccccctgctgtag

SEQ ID NO: 53688 - DNA, 333 bp, Artificial Sequence
  Description of Artificial Sequence: Synthetic coding sequence
atgggccacggagacgaaataggtcttggaataccccaactgctcgaggccgttttgaaactgcttcccctggacacttacgtagaatccccagcagctgtgatggagctggtgccctccgataaggagagaggactccagaccccagtctggaccgaatacgagagtatattgcgtcgggcaggctgtgtgcgggctctggcaaaaatagagaggtttgaattttacgagcgtgctaaaaaggcctttgcagtggtggccaccggggaaacggcattgtacggcaatctgattctacgcaagggcgttctggccttgaatcccctgctttag

SEQ ID NO: 53689 - DNA, 519 bp, Artificial Sequence
  Description of Artificial Sequence: Synthetic coding sequence
atgaatcactgcattcagttttcacctcaaagtttacaacgctggttgatactcccctgttatgatctcaaattgcccatctgggccaataccaccgaattctgtccacatgggccaagacgagcctctcaggaccctcagctgttggcgtggctccctgaccagtcccttgaggtgtccctggagctttatgactggaattctatgacatttactttgttcttggagacagtggagcccgtcgccgtcgagtctgaaggctctggcattttctccttcgtatggcagcagttgatctttcctgccgaagctcgatggtgcttttcctgggctcaggattgtggcctggacgggtcatttccaggctctgcccataccgaacccttcgggaaggccgcagcaggccagggcagcgtcgctggaaaagaagccaagaaagccggacccggatttcaccggcaactgctgtatcttcaattccaaaaacgctgcctttttaactaccctgagctgctctag

SEQ ID NO: 53690 - DNA, 480 bp, Artificial Sequence
  Description of Artificial Sequence: Synthetic coding sequence
atgaacttgggcgtctccatgctccgcatactattcctgctcgacgtgggcggtgctcaggtacttgcgacagggaagacccccggagccgaaattgatttcaagtacgcccttattgggacagcagtgggggtggctatcagcgctggtttccttgccctaaagatctgcatgattcgcaggcatctgtttgacgacgattcatccgacctgaagtcaacaccaggcggtttatccgacacgatacctcttaagaaaagggcccctagggctcatgttctgcgcgacggccctgctttaggacctttgcacctccttttttccgtgatcgggatgctcttcgcacgcaaactgcaggcctcgaccctcttcagctttaagtccctgttacagtgtcatcactgtattatggagggactgttcaaggctaagccgcaattccttcagaaggtaagttgcaagtccgaccacttgagttag

SEQ ID NO: 53691 - DNA, 354 bp, Artificial Sequence
  Description of Artificial Sequence: Synthetic coding sequence
atgctaagaatcttgtttctgctggacgtcggtggggctcaagtgctcgccaccggcaagacaccgggagccgagattgattttaaatacgcactcattgggaccgctgtcggtgttgctattagtgcaggctttttggcgctaaagatttgcatgatcagacgccacttattcgatgatgatagcagtgatctcaagagtacccccggaggcttgtcaggtgaaacaactatatctccgaaggcttccggtcagatttgtgcaaacagtcctacaacagaaagcgagaaatttcctaagatttgcctgctcacctcccggaacgatttttccttctgccatcagtcaggatag

SEQ ID NO: 53692 - DNA, 519 bp, Artificial Sequence
  Description of Artificial Sequence: Synthetic coding sequence
atgaacttgggagttagcatgcttaggatactctttctcttggacgttgggggagcacaggtgttagctactggcaagacacccggtgcagaaattgacttcaaatacgctctaatcgggaccgccgtgggcgttgccatcagtgcaggcttccttgcgcttaaaatctgtatgattagaagacacctgttcgacgatgactcatctgacctgaagagcacccccggaggcctctctgacactatccccttgaaaaagcgggctcctagagcccacgtgctgcgcgatggccctgccctgggaccattgcatctgctctttagtgtaatcggaatgctctttgctagaaagttacaagcctcaactctgttttccttcaaatccttgcttcagtgtcatcattgcattatggaagggctattcaaagccaaaccgcagtttctgcagaaacatctcgcacgaagtgttcagattcaccagctgcagaaagtgaagtcctttcccaagtacgcttattag

SEQ ID NO: 53693 - DNA, 390 bp, Artificial Sequence
  Description of Artificial Sequence: Synthetic coding sequence
atgaacctgggggtgagcatgctgaggatcctttttctcctggacgttggaggggctcaggtgctggccaccggtaagacaccaggagctgagattgatttcaagtacgctctgatcgggacagcagtgggcgtcgccattagtgctgggttcctggcccttaaaatatgcatgataagacggcacctgttcgatgatgatagttctgatttaaaaagcacccccggaggtcttagcgatacaattccactcaaaaaacgtgcccctcggaaactgcaggcaagcaccctgttctcatttaaaagcctgctgcagtgtcaccattgcatcatggagggtctctttaaggccaagccacagtttctccagaagcgctgtacgggtgattag

SEQ ID NO: 53694 - DNA, 348 bp, Artificial Sequence
  Description of Artificial Sequence: Synthetic coding sequence
cggatcttatttttactcgatgtcgggggtgctcaggtgctggctactggcaaaacaccgggtgccgaaatcgattttaaatatgctcttatcggaacagccgtcggggtggctatcagcgccggatttctggcactcaaaatctgcatgattagacgacacttgttcgacgacgactcttcagacttgaagtcaacaccaggagggctcagcggagagactacgatatccccgaaagcttcaggacaaatctgtgccaattcacctacaactgagagcgaaaaattccctaaaatctgcttattgactagtaggaacgatttctcattttgtcaccagtcaggatag

SEQ ID NO: 53695 - DNA, 771 bp, Artificial Sequence
  Description of Artificial Sequence: Synthetic coding sequence
atgagcgaagaaatggataatataacagcagaggagatcatagataaacatttacaaaaggaccttgatgccgaagagaaccagaatgttgccaagacgctgcggggaaaggttcgtgagaaactgaaaattagcaagattaacaagggcgaaaagtcaagtacagaacagttgatcgattcagaaatccatcagaggagcaaactgtctccacagactgaagtgtctttagacgagtctctgtcattctttatcctgtctggtgaggagggtagcgccctgggaaaaagctcggagcaacggccagtcaacaggtcctaccccaagtgcttttccctgggcgtgaacctccaaaatgtcgctgagtcggaggaagaagagttcatgaaggaattcatcctgacagacatattgaaagtaaaggctgccgattacgaggacgaccaggagcagatcaagaaacagaaggctaacattttcgtgccttctagctctcccgttgtgaaccagaggaagctgccaaaagacatgatgcctagaattttggaagatgaggggttctacatccagcgtaaacctgagatatataagaagacatgcaataagatggaaaacaggcttttgaagctggaggaggctaagtgttggttcggggagtccggggaaattatgtccttaccaacccccatcaagcagtcctggaacttcagactaaatgtgcgcaaagaaccactgaacccgctgctgaagaccatataccggaagctgtag

SEQ ID NO: 53696 - DNA, 531 bp, Artificial Sequence
  Description of Artificial Sequence: Synthetic coding sequence
atgggtgtgcagatgtcagaggaaatggataatattactgcagaagagattatcgataagcatctgcagaaagaccttgacgccgaggagaatcagaatgtggctaaaaccctgagaggaaaggtgagagaaaagcttaagattagcaaaatcaacaagggcgagaaaagctccactgagcagcttatcgacagcgaaattcaccagaggagcaagctttcaccgcagactgaggtctccctggacgaatcactaagttttttcattctcagtggtgaggaggggtccgctcttggtaaatcctccgagcagcgtccagtcaataggtcctaccccaagtgctttagcctgggagtgaacttacaaaacgtggctgagtccgaagaagaagagttcatgaaggagtttatcttgactgacattctgaaagtcaaggccgctgactacgaagatgaccaggaacaaatcaagaaacagaaggccaacatctttgtgccatcaagttcacccggtaatatcctgagtcagtag

SEQ ID NO: 53697 - DNA, 2337 bp, Artificial Sequence
  Description of Artificial Sequence: Synthetic coding sequence
atgcagcaggagagcgagagatgtcgggtgcgcgctcggcgaccagacatggccctgtacgtccccaaagctcgtaggggagccgtgctgctgaaaactggggatgaggaggaatcgtgtggctccccaaattcagtggtgaaggaaaagcagaaagaatcatctctgtctcagaaggaagtgttcaaggacaagcccgaggctcgacgactgaatattaatccagaccggaaagaacacaattgccgggaggaaaaaaaatcctccacaaagttgcgaatggacacgtgcctacagaaaacaaaccgggtctgcagcaaaagggggaccactgagtccaaagaggtgctgtctcaaggtcagcagcagggagcccctaacgccggtgtgatcaccaatgcccctttacagagacatttcaagcctaagaaggtagagtgtctcgaggttgagacaacagatgtgacaggccatgagcggatcctgctgtcccaagcctgcctcgaaatatccgaagcacaagtcccttcaaagcctttccagaatgtcgaattctgtgatttttcccggcacgaacccgacggggaggctttcgaggacaaggacctggaggggcgtatcgaaactgatactaaggtactggaaatactgtatgagtttcctagagtgttctcatcggtgatgaaaccagaaaacatgatcgtccccattaagttgtcctcggacagtgaaattgtgcaacagtctatgcagactagcgatggcattctcaaccccagcagcggcggaatcacgaccaccagtgtgcccggttctccagatggtgtttttgaccagacttgcgttgacttcgaggttgaatcggtaggcggaatcgcaaacagtaccggttttatcctcgatcagaaagatacagattcaatccctgccactatgggacatatcagcttgagcgaatctaccaatgacaccgtatcacctgtcatgatccgcgaatgtgagaagaatgatagcactgcggatgagctgcacgtgaaacacgaaccacctgacacagccgttctcgctcacgaaacccatcgagattcagggttcaaaaatgtcggagacatcactaataaagcttgcatgatggataccacgggcatgtcttgtagcgatcacgtgactgtggattccccctatgtagtggctgtaagaattgcagacgagactagcataaatacgcggagctttagtaagtttgtaggcatgtctgcagatgctaccccactgcacgtcgctagatcaggcaacgacaccgaggacttcagtaacccttctgcctgcagcgacatctacggcgagtccattagctcccattttaccgaatcaacaggcaagctgattgaatccctgtctgactgcgcgagtagtttacctataaagaaaattgccggaagcaattataatacgttcctcgacagcgaacttagcatgcttaacggcacgaaggtgttgtcggattctgccgttgggatcgatttggggtccacaggagacaccacggaggccctgcatgaactaaggaccgccgaagagtttaaaacggaagagcaggatgatagcggctccatcgagttcggagtatcattccccgatagggaaagttccagtatggaaacctccatagagcccaaagccacagaaaccagccacaccgagggtattaccgccatcgaagaaagctgggagtccatgtttaatgacgacggagattgtctcgaccctcggttgctgcaggaactgtccgggaatacaaaatccagagagtccatccaggaaccaagatctgactactacaaccacgaagttcctgatatcgatctaagcgactgcgagtttcctcatgttatagaaatatacgacttcccacaggagttccacactgaggatctgttaagagtcttttgtagctaccagaagaagggctttgacatcaagtgggtcgacgatacccacgccctcggagtgtttagttcccctatcaccgcacgcgacgcactagggatcaaacacacaatggttaaaatcaggccgttgagccaggccaccagagccgcaaaagctaaagcacgcgcatatgctgagttcctgcagccagcgaaagaacggccagagacaagtgcagcactggcgagaaggcttgtgattagcgctctcggagtcagaagtaaacagagcaagaccgaaagagaggctgagctgaaaaagctacaggaagcgagggaacggaaacggttagaagcaaaacagcgcgaggacatctgggaaggtcgtgatcagagcacagtctag

SEQ ID NO: 53698 - DNA, 585 bp, Artificial Sequence
  Description of Artificial Sequence: Synthetic coding sequence
atgcatatcaagccagaaaaccattgttcaaaactgagtgggaatacaaaatccagggagagtatccaggaacctagatccgactactacaatcatgaggtacctgatatcgacctgagcgattgtgagtttccgcatgttatcgagatctacgacttcccgcaggaatttcacacagaggatctgctaagggtcttctgctcctaccagaagaagggatttgacatcaaatgggtagacgacacacatgccctgggagtttttagttcaccaattacagcgagagatgcactgggcattaagcatacgatggtgaagattaggccactgagtcaggcaacccgggctgccaaggccaaagcaagggcatatgccgaatttttacaacccgctaaggagcggcctgagacatctgccgcactggccagaagactggtgatctccgccctgggcgtgagatctaagcagtctaaaactgagagggaggcagaactcaagaagctgcaggaagcaagggagcgaaaaaggctggaagccaagcagcgtgaggatatatgggagggcagagatcaatctaccgtttag

SEQ ID NO: 53699 - DNA, 2337 bp, Artificial Sequence
  Description of Artificial Sequence: Synthetic coding sequence
atgcaacaggagagcgagcgctgtcgcgtccgggcacgccgacccgatatggccctgtatgtgcccaaggcccgtagaggagctgttttactcaagacgggcgatgaagaggaatcttgcggttctcccaattccgtggtgaaagagaagcagaaggaaagctcccttagtcagaaagaggttttcaaggacaagcctgaggctcgaaggctgaacattaatccagatagaaaagagcataattgcagggaggagaagaaatcctccaccaagctgagaatggatacctgtcttcaaaagaccaatcgggtatgttcgaagagaggaaccactgaatccaaagaagtgctctctcaggggcagcagcagggcgcacccaacgccggagtgatcacgaacgcaccactgcagcgacactttaagcccaaaaaagtggagtgtctggaggtagagaccacggacgtgacagggcatgagaggatcttactgagccaagcctgcctggagatctctgaagcgcaagtaccttcaaagcctttccagaacgtcgaattctgcgactttagtaggcacgaaccagacggcgaagcatttgaagataaagacctagaagggagaattgagaccgatactaaagtgctcgagattttgtacgagtttcccagagtcttcagttccgtgatgaaacctgagaacatgatcgtgcccatcaagctctcctctgattccgaaattgttcagcagagtatgcagacatccgacggaatcctgaaccctagtagtggcggtatcaccacaacttctgtcccgggatcacccgatggtgtgtttgatcaaacatgtgtggacttcgaggtggaatccgtgggaggcatcgcaaattccactggcttcattctggaccaaaaagataccgatagcattcctgcgactatggggcacatatcactatcagagtccaccaacgatacggtttcacccgtgatgatacgggagtgcgaaaagaatgactccacggctgacgagttacacgtcaagcacgagccgccagacacagcagtgctcgcccatgaaacacaccgagactctgggtttaaaaacgtgggggacatcactaacaaagcttgcatgatggatactactggaatgtcttgttctgaccacgttacagtggattcgccttacgtagtagccgttcgcatcgcagacgaaacctccatcaacacccggagtttcagcaagttcgtcggtatgtctgcggacgccacgcccctgcatgtggcaagatctggcaatgacactgaagacttttctaatcctagcgcctgtagcgacatttatggagaatccattagcagccactttaccgagtctaccgggaaattgatcgagtccttgtccgactgcgcttcttccctcccaatcaaaaaaatcgccggaagcaattataatacgttcttagacagcgagctttcaatgctaaacggcacaaaggtgctgtcagacagcgccgtgggaattgacttggggtccactggggacactacggaagccctccacgagctccgcaccgcagaggagttcaagactgaggaacaggacgattcagggtccatcgagttcggagttagcttccctgatagagagtctagttccatggagacctctatcgaacctaaagccactgaaactagccataccgagggaatcacagcaatcgaggagagttgggaatcaatgttcaacgacgatggcgactgcctggaccctaggttgctgcaagagttgtccggcaacactaaaagtagagaatctatccaagaacccaggtccgattactataatcacgaggtccccgacatcgacctaagcgactgcgagttccctcacgtaattgaaatctatgatttccctcaagaatttcacacagaggatttgctccgtgtcttctgtagctaccagaaaaaaggttttgatatcaaatgggtcgatgacacacatgccctgggcgtcttctcgagccccattactgcaagggatgccttgggtatcaagcatacaatggtgaagattcgccctctgagccaggccactcgggcagcaaaggcaaaagctcgcgcttatgctgaatttttacagcccgcaaaagaaagaccagagacctccgcggctctagcacgaaggctggttatttcagccctcggcgtgaggtctaagcagtctaagactgaaagagaggccgagctgaagaagctgcaggaggctcgggagagaaagcgcttggaggcaaaacaacgggaagatatctgggagggaagagaccagagcaccgtatag

SEQ ID NO: 53700 - DNA, 555 bp, Artificial Sequence
  Description of Artificial Sequence: Synthetic coding sequence
atgctgtctggaaataccaagagccgcgagtctatccaggagccgagatcagattactataatcatgaagtgcctgatatcgacttgagcgattgtgagttccctcacgtgattgaaatctatgacttccctcaggagttccatacagaggatttgcttagagtgttctgcagctatcagaaaaaaggttttgatattaaatgggtcgacgatacccacgccttgggcgttttcagctccccgataactgcgagggatgcattaggaatcaagcacacaatggttaagattcgcccactgtctcaggcaacacgagccgctaaagcaaaagccagagcctacgcggagtttttgcaaccagcaaaggagcggcctgagaccagcgccgctctggcacgcagactggttatttccgccttgggagtaagatctaaacagtccaagacagaaagggaggccgaacttaagaaactccaggaggctcgggagcgcaagagactggaagctaaacagagggaagatatttgggagggcagggatcagtccacggtgtag

SEQ ID NO: 53701 - DNA, 984 bp, Artificial Sequence
  Description of Artificial Sequence: Synthetic coding sequence
atgcagcaggagagtgagcggtgccgtgtacgggcacgtagacccgacatggcactatatgttcctaaagcacggagaggtgcagtgctgctaaagaccggcgacgaggaggaatcctgtggcagcccaaactcggtggttaaggaaaagcaaaaagaaagctctctgtcccagaaggaagtgttcaaggacaagccagaggcacgcagactgaacatcaatcctgataggaaagaacacaactgtcgcgaggagaaaaagtcgtccactaaactacgcatggatacctgcctccaaaaaaccaaccgcgtttgtagtaagagggggacaacagagtctaaggaggtgttgtcccagggtcagcagcagggcgcacctaacgcgggtgtgatcaccaacgccccactgcagaggcacttcaagccaaaaaaggtggagtgtctcgaagtggaaacaactgacgtcacaggccacgagagaattctcctaagccaagcatgtttggaaatctccgaagctcaggtgccgtccaagcccttccaaaacgttgaattctgtgacttcagccggcatgaacccgacggcgaagctttcgaggacaaggatctcgaaggacggatagagaccgataccaaagtgctggaaatcctttatgaattcccaagggtgttcagctctgtgatgaagccagaaaacatgattgtgccgattaagttatcctccgactctgagatcgtacaacagtctatgcagacgagtgacggcattctcaatccctcgtccggcggtatcacaactacatcagtgcccggatctccagatggagtattcgatcaaacttgtgtggattttgaagtggagagcgtgggaggaatcgcaaattccactggctttatactggatcaaaaaattcagatcccgttcttgcagctttgggtgacttccctttgtcagcgggctcagatgaccctgctcgtgcaatag

SEQ ID NO: 53702 - DNA, 558 bp, Artificial Sequence
  Description of Artificial Sequence: Synthetic coding sequence
cagaagctaagcggcaacacaaaatctagggagagtattcaggaacctcgcagcgactactataatcacgaggtccccgacattgatctgtccgactgcgagtttcctcacgtgatagagatctatgatttcccccaagagttccataccgaggacctgctccgcgtcttttgttcttatcagaaaaagggctttgatataaaatgggtcgacgatactcacgctctgggtgtattctcaagtcctatcacggcacgggatgctctggggattaagcatacaatggtcaagattcgtccactcagccaggccacacgcgctgccaaggccaaagcaagggcgtacgccgaatttcttcagcccgcaaaagaacggccagagaccagtgccgcactggccaggaggttggtgatctcagccctaggcgtcagatccaaacagagcaagacagaacgggaagccgagttgaagaagctccaggaggccagggagagaaagagactggaggccaagcagcgagaggacatttgggaaggcagggaccaatccaccgtgtag

SEQ ID NO: 53703 - DNA, 321 bp, Artificial Sequence
  Description of Artificial Sequence: Synthetic coding sequence
atgatggccactgggacccctgaatcccaggcgagatttgggcagtctgtgaaaggccttctgacagaaaaagtgacaacatgtgggacagacgttatcgcactaaccaagcaagtgcttaaaggaagtcgctcctctgaactgctcggccaagcagctcggaacatggtgcttcaggaagacgcgattcttcactccgaggacagtcttagaaagatggcaatcattactactcacttacagtatcagcaggaggccatccagaagaatgtagagcagagctccgatttgcaggatcagcttaaccatctgttgaagtag

SEQ ID NO: 53704 - DNA, 321 bp, Artificial Sequence
  Description of Artificial Sequence: Synthetic coding sequence
atgatggccacaggtactcctgagtcccaagcaagattcggacaaagtgttaaaggcctactaaccgagaaagtgaccacttgcggcacagatgtcattgctctgacaaaacaggtgctgaaggggagccgcagcagcgaattactgggtcaggcagccaggaacatggttctccaggaggatgcaattctgcacagcgaagacagcctgcgtaagatggccatcattactacacatttgcagtatcaacaggaggccatccagaagaacgttgagcagagcagtgacctacaggatcagcttaatcacctcctgaagtag

SEQ ID NO: 53705 - DNA, 387 bp, Artificial Sequence
  Description of Artificial Sequence: Synthetic coding sequence
atgaagcacaaatataacaccctatcctggtataaaaaagagcggtcaacccagctgcgccgtttcatcgtgcatcaacctgaggttggcttgttcttcttcctcagggacgtggtgtataattacatcacagagaaaacaacctgcagatgcccacttacacaagagagaccttgtgatacaggaggcaaattcggccgaatctggatctgccaaccggaggagctgggcaagatgcagatctggatttgtcagccggaggagctaggcaaaatgcaaattgacaagaacaggactatggtccagcagatgtggtatatatggtatgggggactcgacacctcaaccaatagcctgcttccaatcctagtccgtggaatggcatag

SEQ ID NO: 53706 - DNA, 387 bp, Artificial Sequence
  Description of Artificial Sequence: Synthetic coding sequence
atgaaacacaagtataacaccctgtcctggtataaaaaggagaggtccacacagctccggagatttatcgtgcatcaacccgaggtgggcctcttcttttttctccgcgatgtcgtatacaactacatcacggaaaaaaccacctgccggtgcccactcacccaggagcgtccatgtgataccgggggaaaatttgggaggatatggatatgtcagcccgaagagcttggcaaaatgcagatctggatttgtcagcccgaagaacttggcaagatgcagatcgacaagaacaggaccatggtccaacagatgtggtacatttggtacggcggactggacacaagcactaactctcttctgccgatcctcgtgagaggaatggcttag

SEQ ID NO: 53707 - DNA, 387 bp, Artificial Sequence
  Description of Artificial Sequence: Synthetic coding sequence
atgaaacacaaatacaataccctctcgtggtataaaaaggagagaagcacccagttgcggagattcattgtccaccagcctgaagtaggcctcttttttttcctccgagacgtggtctataattatataaccgaaaaaaccacttgccggtgccccttaactcaggaaagaccctgcgataccggcggtaagttcggcagaatttggatttgccagccagaagaattgggcaagatgcagatttggatctgtcagccggaggaactgggcaaaatgcagatagataagaatcggactatggttcagcaaatgtggtatatatggtacggcggactggatacttctaccaatagtcttttacccatcctcgtcagggggatggcttag

SEQ ID NO: 53708 - DNA, 912 bp, Artificial Sequence
  Description of Artificial Sequence: Synthetic coding sequence
atggaagagtcgatggaagaagaagaaggtgggagttacgaagctatgatggatgatcaaaaccataacaattgggaggccgcagtcgatggatttagacagcctctccctcctccgcctcccccaagctccatcccagcaccagctcgtgaaccccctggcggacagctcctggccgtcccagctgtgagcgtggaccgaaaggggccaaaggagggcctacccatgggccctcagcctcccccagaagctaacggagtgattatgatgctgaaatcctgtgacgccgctgccgctgtggcaaaggctgccccagcgccaacagccagttcaactattaacatcaacacttctacgagcaagttcttgatgaatgtgattactatcgaggactacaagtccacgtactggcctaagctggacggggctatcgatcagttattaacccaaagccccggtgactacatacctatttcatatgagcagatctattcctgtgtgtataagtgcgtttgtcagcagcattcggaacaaatgtactctgacctgatcaagaagattaccaaccatctcgagcgtgtgagtaaggagctgcaagcaagtccccctgacttatacattgagcgctttaatatagcattggggcagtacatgggcgcactgcagagtatagtccctctctttatatatatgaataagttttatattgaaaccaaactgaaccgtgacctcaaggatgacctgataaagctctttaccgagcacgtggccgaaaagcatatttacagcctaatgcctctgctcctagaagctcagtcaaccccgtttcaggtgactccttccacaatggcgaatatcgtgaagggattgtatacactgaggcccgtcagtcagaactttaccgcagtgtag

SEQ ID NO: 53709 - DNA, 1110 bp, Artificial Sequence
  Description of Artificial Sequence: Synthetic coding sequence
atggaggaaagcatggaggaggaagagggcggaagctatgaagccatgatggatgatcagaatcacaacaactgggaggctgccgttgatggctttagacagccactcccccctcccccaccaccatcctctatcccagcccctgccagggaacccccaggtggacagctcctggccgttcccgcagtgtccgttgataggaaaggacccaaagaggggcttcccatgggcccacaacctcctcctgaggctaacggtgttattatgatgctaaaatcttgtgatgctgccgcagccgttgctaaggctgctcctgcacctactgccagttctacaattaatattaatacaagcacttccaaatttttaatgaacgtgattaccatcgaggactataaaagcacttattggcccaaactggatggcgctattgaccagctcctgactcaatcacctggagactacatccctatttcatacgaacagatttactcgtgcgtgtacaaatgcgtctgtcagcaacactctgaacagatgtactctgatctaatcaaaaagatcaccaaccacctggagagggtgagcaaggagctacaggcctctccacctgacctgtatattgagcgattcaatattgccctcggacaatacatgggagctctgcagtctattgtgcccctcttcatctatatgaataaattctacatcgaaaccaaactgaacagggacctgaaggatgacttaatcaaattgttcactgagcatgttgcggaaaagcacatatatagcctgatgccactcttactggaggcacagagcaccccttttcaagtcactccctcaactatggcgaatatcgtgaaaggcctctacacacttaggccagagtgggtccagatggctcccactctcttttccaaattcattccaaatattctgccacctgcagtcgaatcagagctcagcgaatacgccgctcaagatcagaaattccagagagagttgatccagaatggctttacacgaggcgaccaatcacggaagcgcgcaggcgatgagctggcttacaactcctcctccgcctgcgcaagctctcggggttatcgctag

SEQ ID NO: 53710 - DNA, 741 bp, Artificial Sequence
  Description of Artificial Sequence: Synthetic coding sequence
atgaatgtgatcacaatcgaggactacaaatcaacttactggcccaaacttgatggcgctatcgaccaacttctgacacagagccctggtgactatatccctatctcctatgagcaaatttactcgtgtgtttacaaatgcgtctgtcagcagcactccgaacagatgtactccgatcttatcaagaagataacaaaccacctggagagagtgagtaaggagctgcaagcaagccccccagacttgtacatcgagagattcaacattgcactcggccaatacatgggagcattgcagtcaatagtccccctgtttatctatatgaacaaattctatatcgagacaaaattgaatcgtgatctgaaggatgacctcatcaagctctttaccgaacacgtcgccgagaaacacatctactccctaatgcccctcctgctggaggctcaatccacaccttttcaagtgacaccgagcacgatggccaacatcgttaaaggcctttatactctgcgcccagagtgggtccagatggctccaactttgttctccaagtttatccctaatatacttcctcccgctgtggagtctgaactgtccgaatatgcagcgcaagatcagaagtttcagagagagctgatccaaaatggcttcaccaggggtgaccagtcccgaaagcgcgctggcgacgagcttgcttacaacagcagctcagcctgcgcctcatctcgcggatataggtag

SEQ ID NO: 53711 - DNA, 543 bp, Artificial Sequence
  Description of Artificial Sequence: Synthetic coding sequence
atgacaaccacgcctgtcctgtctcggttcgcctctcctccagacctgtacattgagcgcttcaacatagcccttgggcagtatatgggggcactgcagagtattgtgcccctttttatttatatgaataagttctacattgagaccaaactgaacagagacctgaaagatgacctaattaagctcttcaccgagcatgtcgcagagaagcatatctatagcctgatgcccctgctgctggaagcccagagcaccccatttcaggtgactcccagtaccatggcgaatattgtgaagggcctgtatacactgagaccggagtgggttcagatggcacctaccttatttagcaagttcattcctaatatattaccccctgctgttgaatctgaactcagtgagtacgccgcacaggaccagaagtttcagcgcgaattaatccaaaatgggttcacccggggtgatcagtcgcggaagagagccggagacgaactcgcctacaatagcagctctgcctgtgcctcctcacgcggatacagatag

SEQ ID NO: 53712 - DNA, 1308 bp, Artificial Sequence
  Description of Artificial Sequence: Synthetic coding sequence
atgccagttacacatcgaaagtctgacgcctccgacatgaattcagacacctcaccatcttgccgcttgcgcgcattctcccgcggtggttctcttgagagtcggtccagtagtagcaggagtaggagttttactctcgacgacgaatctcttaagtacctgacacacgaagagaaagacgttttgctgttctttgaggaaaccattgattctctcgatgaggatttcgaagagccggttctgtgtgatggaggggtctgttgtctctgcagtcctagtttagaggagtctacttctagcccgagtgaaccggaggatgtgatcgacctggtacagccggctcctggggcaggcgaagcagaaggtttgcctgagggcactcaggccgctggccctgccccagctggcaaggagcatcggaagcaagatgccgaaaccccgcctccaccagaccctccggctccggagactctccttgctccacccccactcccttccacaccagatcctccccgacgagagctgcgggcacctagtccgcctgtcgaacaccctaggctccttaggtctgtgccaaccccgctggtcatggcccagaagatcagcgagcgcatggccggaaacgaagcgctctctcccacgtctccttttcgtgaagggaggcctggggaatggcgaactcctgccgctcgtggcccaagatctggagacccaggacccggtccaagccatccagctcagccgaaggcaccaagattcccctcaaacattatcgttacgaatggagcagccagggaaccgagacgcacgctgtctcgggcagccgtaagcgttcaggaaagaagggcacaggtcctggccaccatccatgggcacgcaggggcattcccagctgccggagacgcgggtgagggagcaccagggggtggcagcagccctgaaagggtcgcccgaggccgaggattgccaggacccgcagagagcctgcgggcaggaggtcaagcccctcgcggacccgctctggccaacgggtttccatccgctcacgaggctttgaagtccgcccctagcagctttgctccagccggaaagtccctgtgctttcggcctgggcctgcactgccgagcaccagagcgcgtcagtccttccccggtccacgccagcctaatggcgctcaggactggagacgggcagactctctgcccaggccacagggtatcactgtgcagtttgcaggtcgtggatcctctgaggaggcccgtcgcgaggccctccgtaagctgggtctgctgcgggagagcagctag

SEQ ID NO: 53713 - DNA, 720 bp, Artificial Sequence
  Description of Artificial Sequence: Synthetic coding sequence
atggcccagaagatcagcgagcgtatggccggtaacgaagcattgtctcctacctccccattccgagaaggtagaccgggagaatggaggactccggcagcccgagggccacgatctggggaccctgggcctggaccgtctcaccccgctcagccaaaggcccctcgtttcccctcgaacatcatcgtaactaatggggcagccagagagcccaggaggaccctgtccagggccgcagtaagcgtccaggagcgccgtgcccaggtgctggcaactatacatggacatgccggagcctttccagccgcaggcgacgcaggcgagggagcaccgggtggtggttctagtccggaacgggtggctcgcggaagagggttgccgggtcccgcagagagcttgcgcgcagggggtcaggcaccacgcggacccgctcttgccaacggtttccctagtgcacatgaagccctgaaatccgcaccctcttcttttgccccagccggaaaaagcctctgtttccggcctggacctgccctgcctagcacgagagccagacagagctttcccggtcccaggcagccgaatggggctcaggactggaggcgagctgactccctgccaaggccccaaggaatcacagtccagtttgcagggagggggtcatctgaagaagctagacgggaagccctgcggaagcttggcctgttacgggagagctcctag

SEQ ID NO: 53714 - DNA, 1029 bp, Artificial Sequence
  Description of Artificial Sequence: Synthetic coding sequence
atgcctgtaacccacaggaagagtgatgcatctgatatgaactctgacacctctcctagttgtcgtttacgagcctttagcagaggtggctctcttgagtctcgtagctctagcagcaggagccggagcttcacactggacgacgaatctttaaagtatctgacccacgaagagaaagacgttctgctgttctttgaggaaaccatcgactctttagacgaagacttcgaggagccagtgctgtgcgatggaggcgtatgctgcctttgttccccatctctcgaagagtccaccagctcacccagcgagcctgaggacgtgatcgacctagtgcagccggctcccggagcaggggaggccgaaggcttacccgagggaactcaggcagctggaccagccccagctgggaaggagcatcgcaagcaggacgccgagaccccacctcccccagacccgcctgctcctgagactctgctcgctcccccacccttaccgtcgaccccggacccccctcggagggagctacgtgcgcctagtcctcccgtggagcaccctcggttactgcgctcagtccctacaccgctggtgatggcccagaaaatctcggaaaggatggccggtaatgaggctttgagccctacttcccctttcagagagggacggccaggcgagtggcgcactcccgcagctagaggccctcggtccggcgatcctggtccaggaccgtcacaccctcctgctttagctaacggctttccctctgcccacgaagccctgaaaagtgcaccaagctcttttgcacctgcaggaaaatccctgtgcttcaggcccggaccagcactcccaagcacccgggcacgccagagcttccccggacctcgtcagcccaatggggcacaggattggaggcgtgccgattccttgcccaggccccagggtataaccgtccagtttgcaggacgtgggagcagcgaggaggcgagaagggaagccctccgcaagttaggcctgctgagagagtcttcctag

SEQ ID NO: 53715 - DNA, 1026 bp, Artificial Sequence
  Description of Artificial Sequence: Synthetic coding sequence
atgcctgttactcataggaagtccgatgcgtctgatatgaatagtgacacctcccctagttgccgactacgggctttctcaaggggcggatccctggaatctagatcttcgagcagcaggtctcgcagctttactcttgacgatgagtcgttgaagtacctgacccacgaggaaaaagacgtgcttctgttttttgaagaaaccatcgattctttagacgaggattttgaggagcccgtgctgtgtgatgggggagtgtgttgtctgtgctccccatcccttgaggagagcacaagctccccaagtgagcctgaggatgtgatcgacctggtccagcccgctccaggcgctggtgaagccgaaggactgcctgagggaacccaggcggcaggacccgctcctgcaggaaaagagcatcgtaagcaggacgccgagacaccaccgcctccagatccgcctgctcctgagaccttgcttgcccctccccctttaccatccacccccgatcccccaaggagagaacttcgggcaccctcaccaccggttgaacacccccgactcctccgttctgtaccaaccccactagtgatggcacagaaaatcagcgaacgcatggccggtaacgaagcactgtctcctacgagccccttccgggaagggaggcccggtgagtggcggactcccgcagccaggggacctaggtctggggatccgggaccaggtccctctcaccccgcacttgccaacggcttcccttcagctcacgaagctcttaagtcagctccaagctccttcgcccctgctggcaagtccctctgtttccgcccaggccctgccctcccaagtactcgcgctagacaaagcttcccgggtccgagacaacccaatggggcacaggattggcggcgagctgacagcctgccgaggccacagggcattaccgtacaatttgccggacgtggatctagcgaggaagccagacgggaagctctgaggaagctgggactcctccgggaatcctcatag

SEQ ID NO: 53716 - DNA, 258 bp, Artificial Sequence
  Description of Artificial Sequence: Synthetic coding sequence
atgcctgtcacccatcggaagtccgatgcttctgacatgaattctgatacatcaccaagttgtcgactgagggccttcagccggggaggatcactcgagagccggagcagctcttctaggtctcggagcttcacactcgatgatgaaagcttgaaatacctgacccatgaggaaaaggatgtcctcctcttctttgaggaaacgatagacagcctagacgaagatttcgaagagcccgtgctgtgtgacggcggatag

SEQ ID NO: 53717 - DNA, 282 bp, Artificial Sequence
  Description of Artificial Sequence: Synthetic coding sequence
atgccaaaaaacgctgtagttatcttgaggtacgggccatactccgcggcaggtctgccagtggaacaccatacatttcgattacagggtcttcaagctgtgctggccatcgatggccacgaggttatccttgagaagatcgaagattggaatgtagtggaattgatggtgaacgaagaggttatcttccactgtaatataaaggatttggagttcggcggagacgggaagttagaccctttgtgcgagaaggctcgtattgctgtgctcaacgcgtactag

SEQ ID NO: 53718 - DNA, 474 bp, Artificial Sequence
  Description of Artificial Sequence: Synthetic coding sequence
atgcctaaaaacgcggtggttatcttgcggtatggcccttatagcgccgcaggcctgccagtggaacatcacacctttaggttacagggcctacaggccgtgttagccatagatggccatgaggtaatcctggaaaagattgaggactggaacgtcgtggagcttatggtcaatgaggaggtaatattccattgtaatattaaagacctggagttcggcaagctaacaccatctagtgataaacgtacgacctctagctcccgcctgactttccatcagttaagctcaccttgccgtatgaaggtgagtccactgcagcagttccctcagaaaactcaggacctgacctgtaccgtcctagctcagattggatcctgcattcattttcagactaatctgtgcgatttggggtggccaggtttagatcatatgctgatatctggccttgagaagcggggaactcagccctattag

SEQ ID NO: 53719 - DNA, 282 bp, Artificial Sequence
  Description of Artificial Sequence: Synthetic coding sequence
atgcctaaaaacgccgtggttatcttgcggtacggaccatattctgccgctggactccccgttgagcaccacacgtttagacttcagggtctgcaggctgtactagccatagatggacacgaagtgattcttgagaaaattgaggactggaatgttgttgagctgatggtgaacgaggaggttatttttcactgtaatataaaagatttagaatttgggaaaccatttggcgacgcctcctctcagcagttcgccagctctgaggagtccttgaatttctag

SEQ ID NO: 53720 - DNA, 474 bp, Artificial Sequence
  Description of Artificial Sequence: Synthetic coding sequence
atgcccaaaaatgccgtggtgattctgcggtacggaccatatagcgccgcaggcctacccgttgagcaccacacattccggctccagggattacaggccgttttggcaatcgatggccacgaagttatcttagagaagattgaagattggaatgtcgtggagttgatggtgaacgaagaggtaattttccactgcaatattaaagatctggagtttggcaagctgactccgtcctcagacaagagaacaactagttcctcaagattgacatttcaccagctctcatccccctgccgcatgaaagtcagcccgctacaacagttcccccaaaagactcaggatctgacatgcacagtgctagctcagatcggatcttgtattcattttcagacaaatctgtgtgatctgggttggcctggcctggaccatatgctgatctccggacttgaaaaaagaggtacacagccatattag

SEQ ID NO: 53721 - DNA, 456 bp, Artificial Sequence
  Description of Artificial Sequence: Synthetic coding sequence
atgtttctacatttggactcccacagctccctagagcgcaccaagccgactgtcgtaggtgtggacacgcatatggagctcgatgaggttcactgttgtcccggtcgggactctggcggaggcttcatcaaaggtcccatgcttcaaggtctgcagggagagggcaagctcgcgcctattcctaaacctactctgccaagtcccagtcgcttgaccctatttgtgtcatcatcgcagatggaagaccatggctttcccgctcgaaggaatggcctaacacaggccagcttcatctatcagatgcctgcagggtggggaagcccaggaggtctgtttctgccctgccagccagtccccactcccgtggtcctgaaacctcccctacccccttgccctatatcatggggtgaaagcggccctgccgttgatggcatccgaaggaccccagccccttag

SEQ ID NO: 53722 - DNA, 456 bp, Artificial Sequence
  Description of Artificial Sequence: Synthetic coding sequence
atgtttctccacttggattctcactcgtctctagagaggactaaacccactgtggtcggcgtggacacgcatatggagctggatgaggttcactgttgtcccggtagagacagtgggggaggcttcattaaagggccaatgcttcagggactgcagggagaaggcaaactggcgcctattcccaaacccacactcccctctccatccagactgaccctgtttgtgagctcgtctcagatggaggatcacgggtttcccgctcggcgaaacggtctgacacaggcatcctttatttaccagatgcccgctggatggggatcacccggaggactgtttctcccctgtcagcctgtccccacaccggtggtgcttaagccacctctgccaccatgcccaatttcctggggcgagagcggcccagctgtggatgggattcggagaacaccagccccttag

SEQ ID NO: 53723 - DNA, 558 bp, Artificial Sequence
  Description of Artificial Sequence: Synthetic coding sequence
atgatggcccttgtccgggatcggagagcccactatgtgatgagcatagtgatccgctgggtgcactgcttctcttcttcactgcgcggtacttttggaacccgatgggaagccatgaaggctaaagctaccgagctgagggtttgctgcgccaggaggaagcgtgaggccagagaattcaaacccccacagatgcggggtagcacacggctgaacatttccgatgacctaaagatcggatttttttccacggaccatgcaacccagacagattctagcgaaatcctctctgttaaggaactttctagctcaactcagaagttggcccagatgatgaagtcacttcaagtggattttgggtttttaaaacagctgctccaacttaaattcgaggatagactcaaagaagaatctcttagcttgttcactatcttgcacgaccggatcctcgagatagaaaaacactaccaacaaaacgaggacaaaatgcggaagtcctttaaccaacaactggccgatgccattgccgtgattaaagggatgtatcaaccgctatag

SEQ ID NO: 53724 - DNA, 891 bp, Artificial Sequence
  Description of Artificial Sequence: Synthetic coding sequence
gggagaaaaattatggaaggattggaggcgagcatcgagcagtttcagttcaatcctcgcttgaacattagtgatgatctgaagatcggctttttctccaccgatcatgctacacagaccgactcttctgagattctaagcgtcaaggaattgtcatcgagcacgcagaaactagcacagatgatgaagagccttcaggttgattttgggtttctgaaacagctgctccaactgaaattcgaggaccgcctgaaggaagagtctctgtcacttttcaccatcctccatgatcggatattggaaatagagaagcactaccagcagaatgaggacaagatgcgcaaatctttcaatcagcagctggcagacgctatagccgtgatcaagggcatgtaccagcaatttttcgaggtggaagaggagaatgtttccttgcaggatgcctccacagttaagacgaatattctcctgcggaaactgaaggagaaggaagaggtgattaaggaactgaaagaggagctggaccagtataaggactttggtttccacaaaatggaatcttttgcaaaagagacttcttccccaaagtctaatctcgagaaggagaacctggaatacaaggtggaaaacgagcggttactccaaattatatctgaactggaagaggaaattcaaatcaatttgaaggagaactcagggctggaagacgaattaatcagtatgaaagaaatggccgaaaaagaccacaaaacaattcagaaactgatggatagcagagataggttgagggaggaactccactatgaaaaatcattagtacaggatgtgattaataaacaaaaagaggacaaggaaatgcgaaagaaatacgggtccctttcagtgaaatag

SEQ ID NO: 53725 - DNA, 1887 bp, Artificial Sequence
  Description of Artificial Sequence: Synthetic coding sequence
atgactgaagagcagacctaccaggccgctgaaaagtcgcaggcccataatgaggtcccgaatgagcggctggtggttgagcaccaggagagcctctcaaagaccaaactgcagattaagaagcaggagactagcacagagcagcctctgacgacccccgacaaagagccaaacgagaatcttatactccggcatcaggattctatgtcgaaatctgaaatgcaggtgaaagaacagaggacactgaagggacaacgaattattacgcacgatgaggagcccggaaagaacctcgtcctggaacatcaggattctgtaagtaaactcgagatgcaaatcgaaaaaacaaagaaactgccacgggagaagcgacattcgacacatgacgaggaaagcggcgagaatcctatgcttaaacaccaggactcagtgagtaagatacaggtgcagctggagattcaggagacctctgagggtgaagggagaagcattcctgacaaaaacagcatgttcgtacaccaggactccgtgtctaagcttcagatgcaggaaaaaaagaaaatcacaccaggcagggagaggcgcaacaccagaattgttgtacccaatgaaaacgtgatctctgttcatcaggactcgaagagcaaactgcagatgcaggaaaagaaacagatcaacagcggagtcgaacgtcacaaaacattcccattggagatcaaaaagaaagacatctcccttgaacacctccttccagaagaaaaggtcctacttagcaggtcagagtctcaaaccaagaaactgcaggcaaaagtgacatcgcggaaaaaaactgatatcgagtctctacggggtgctttgggcaggcgcctgctcaatgatgaattcaaaacccagtctaagtcctttccgggtccagatatcgagcagctgaccgacgcttttgggcgtgacattttgaaggatgagtttaagaccaggagtaagtcgttgccggagacggacgagaggctgcactctaccacagaacggggaactattaacgatgccatcaagacacagctcaagcgcaagtcatacccggagactgtgctcaagcatctcaaaggggtgaacgggaaagatattatcaaacacctgataaatattcagtctaagtcacacggcgaaactgacaagaacttcttcgcctatgcaacagggagaggtttgatgaaagagagtactacaacccagttgaaaagtcacccggaaaccgacaaggagttcctggccgacgccatcggcagaggcatcatcattggcccaatcactactcaactcaaaagccaccgagagacagacaaggagctgctaaaagatgctattggtcgtgacattatcaagggcccaatctcagctcagttgaagtcacatcaagaaaccgacgttgaacccttaaccaatgccattgggtcctcaaagacaattggagaaatcaaaactcagttacgaacacattatgacgttaatctgttcaaaaataaggatatgtccgtccagagacaggagggcatcttcacacgtagtattacaccaagcaagttccccacaaaggttataaatctgagcccgttcgaaaataaagaggaaacctatgaatactcttctccatacgtcaccgccccatcaaaggctatctatcgaacttatcgagccggaccctccttttccaaagacatccaccttcccttgctgaatcagctgccctctggtcactccaaagtagtgacactttctcaaaagaccattgagtttacactccctaccgtaaccaatactgtcgggaagccgacttacaaggtgttgcacgctgccgctcgtaagagcgtcccacatccttacttttag

SEQ ID NO: 53726 - DNA, 2079 bp, Artificial Sequence
  Description of Artificial Sequence: Synthetic coding sequence
atgacagaggagcagacttaccaggccgcagaaaagtcgcaagcacacaacgaggtgcccaacgagcggctggtggttgagcaccaggaatcgctgagcaagacaaagctccagattaaaaagcaggagacttcgacagagcagccactgactactcctgacaaggagcctaatgaaaatctgatcctaaggcaccaggattctatgtccaagagtgagatgcaagtgaaggagcagcgaactttaaaaggccagaggataattactcacgacgaagagcccggaaaaaatctggtgctggaacatcaggactctgtatcaaagttagagatgcagatcgagaaaaccaagaagctgcctagagaaaaaagacactctacccacgacgaggagtcgggggagaaccctatgctgaagcaccaggactctgtgtccaaaatccaggtgcagctggaaatccaggaaactagtgaaggcgaaggacgcagtatcccagataaaaacagcatgttcgtgcaccaggattcagtcagcaaactgcagatgcaggagaaaaaaaaaataactcctgggagagagcggcgaaacacccggattgtggtcccaaatgaaaatgtgatcagtgtgcaccaggattctaaaagcaaattacagatgcaggaaaaaaaacagattaacagtggcgtagagagacacaagactttccctctggagatcaagaaaaaggacatcagtcttgaacacctgctgcccgaggagaaggtgctgctttccaggtctgagtctcagactaaaaagctccaagcaaaggtgacttcccgtaagataaagaatgaggccgcttctgaattaccggatacagccgagaatttgccagctatgtatccatcaatctctgacctgattatccagttcgatctaaacaaagtagttgagaccgatattgagtctcttaggggagctctgggtcggagacttctcaatgatgagtttaaaactcagtccaagtcgtttcccggacccgatatcgaacagctgactgacgcttttggcagagacatcctgaaagacgaatttaaaacaagatcgaagtccctgccggaaacagatgagaggctgcattccacaaccgagcgcggaactattaacgacgccatcaagacccagctgaagcggaaaagctacccagagaccgtgctgaaacacctcaagggtgtcaacggcaaggacattatcaaacacttaattaatattcagtcaaaatctcatggcgaaaccgataaggaacatcttgctgatgacaccggacggggtatcatcaagggatcaattaatgcccagctcaaaggccatcagaaaactgataaaaacttttttgcatacgccactggacgaggcctgatgaaagaaagcactacaacgcagctcaagagccaccctgaaactgacaaagaattcctggccgacgcaatcggcaggggaataatcatcgggcctatcacaacgcaattgaagagccaccgagaaactgataaagagctcctgaaggatgccataggacgggatattatcaagggccctatctccgcgcagctgaagagccaccaagagacggacgtggagcctttaactaacgcaatcggatcatccaagactatcggggagatcaaaacacagctaaggacccattatgacgtgaatttgttcaaaaataaggacatgtctgtgcagagacaggaagggatcttcacgcggtctattacaccctccaaatttcctacaaaagtgataaacctgagtccctttgagaacaaagaagagacttacgaatacagcagcccatatgttactgcccctagcaaagccatttaccgaacctaccgggctggcccatccttttctaaagatatccacctccccttgctaaatcagctgccctctggccactctaaggttgttaccctctcccagaagactatagagttcactctgccaaccgttaccaacaccgtgggcaagccgacatataaggtccttcacgccgcagccaggaagtccgtacctcatccatatttctag

SEQ ID NO: 53727 - DNA, 1815 bp, Artificial Sequence
  Description of Artificial Sequence: Synthetic coding sequence
gcacacaacgaggtgcccaatgagcgcctggttgtagagcaccaggaatccttgtctaagaccaagctgcaaatcaagaagcaagaaactagcactgaacagccgctgaccacacctgataaagaacccaacgagaacctcattctgcgccatcaggacagtatgtcgaaatcagagatgcaggttaaggagcaacgcacactcaaagggcagcggataatcacacacgatgaggagtcaggtgagaaccccatgttgaagcatcaagacagcgtcagcaagatccaagtccagctggaaattcaggagacatctgaaggagaggggaggagcatcccagacaaaaatagtatgttcgtccaccaagactcggtttcaaagctgcaaatgcaggaaaaaaaaaagattactcccggtcgggagcgtaggaatacaagaattgtggtgcccaacgagaacgtcatctcagtgcaccaggactctaaatccaagctgcagatgcaagagaaaaaacaaattaacagcggggtcgaaagacacaagactttccccctggaaatcaagaaaaaggatataagtctggagcatctacttcccgaagagaaagttctactgtcccgatccgaaagtcaaacaaagaagctgcaggctaaggtgacgtcccgaaagaaaacggacattgaatccctccggggagctcttggacggcgactgttaaatgatgagttcaaaacgcaaagcaaatccttccccggacctgatattgagcagctgaccgacgcatttggaagagatatcctcaaggatgaattcaaaaccaggtctaagtcactccctgagactgacgaacgccttcattccactaccgagagagggacgatcaacgacgccatcaagactcagctgaaacgaaagagttatccggagactgtgctcaagcaccttaagggggtcaacggcaaggatattatcaagcatctcatcaatatacaaagcaagagtcacggcgagaccgataaggagcacctcgcggacgacaccggtcgtggcattataaaaggctccattaacgctcagttgaaaggacatcagaagaccgacaagaattttttcgcgtacgcaacaggcagaggacttatgaaagagtccaccacgacgcagctgaagtcacacccagaaaccgacaaagagtttcttgccgacgccatcggtcgaggcatcatcatcggaccgattacaactcagctcaagtcacacagggagacagacaaagaactgttaaaggatgccattggacgcgatatcataaaagggcctatctccgcccagttgaaaagccatcaggagacagacgttgaaccgctaaccaatgctatcgggagttccaaaacaattggagagattaaaacacagctaaggacccactatgatgtcaacctgtttaagaacaaggacatgagtgttcagcgtcaagagggtatctttacaaggtctattaccccctccaagtttcccactaaagtcatcaacttgtccccatttgagaacaaagaggaaacatacgagtattcatctccttacgtgacagctcccagtaaagcgatttaccgcacctaccgagctggtccgtcattctcaaaggacatacatctgccacttcttaaccaactgccttccggacactccaaggtagtaacactctcccaaaagaccatagagtttaccctgccaactgtgaccaacactgttggcaaaccaacgtataaagtcctccacgccgctgcccgaaagagcgtgcctcatccatatttttag

SEQ ID NO: 53728 - DNA, 2160 bp, Artificial Sequence
  Description of Artificial Sequence: Synthetic coding sequence
atgatgcaggggaacaagaaatgtaccgatgcctttagtgactcctcatccatcggcagcgttttagatgacgccgatagggaagtgagttcattaaccgatcgcgcttttcgttctctgtgcatctccgaggatacctcctttcacgatagctatctggccgtgagccctgatatcacccgccaggtttttggaacattccatcagcgcacggtcggccacactcagagaaaaagtggaatatggagtcagcttcctagccagggaactgaacactcgggttgggctgccaccttccagcaacttcctaaatacgtccagggagaggagaagtatccaaaaacttccccaccccctacacctgtacagaggaggctcgaggtcccggtgtcaggactcaggagtagcaataaacccgtatcaaaagtgagcactctcataaagtcatttgatcgcaccgagagccagaggtgcgagagccggccaacagcttcgaaacccccagccctgaagaatcctccaaagttcgcccctctgcctgagaacagcgtgaacttttgcttcgattccgcctttctcaccgtgcgaagggtgcccgctgaggtgagcaacactcaccaaaacagttatcaaccgggaaggaagcatggagaacaggaatcttcaaaaaaccctgaaatggcttgtcacggttcttccagctttctcccagctgcaaacgataccgctactctgtgtgaatcgaagttcccttctccccaccataaacctgttaccggggaacccggacggggtaaaggaacctttcttcacagcgaaaacagcgccttcgagtcctggaatgcccaccagcccaagcttcttgaacggaaggacacagcaggaactgtaccggagagcaaagcacctaagcattacggcgacacaaccttactaagagagccttgtccccctgaaaggacggtgtccccgtgccaggtgcaagccagttgctcccaagaggagaatagactggctgccggtgcacttagtacaagcattccatgggggtgtcgcgatcctggggctcaggtgtttgccgtggaaggaaaagcaccttcctcgcaacctgatagccaggagaaacccgctcagccaccatggcggaagccgaaaacagggaagaagggaaaagagtcgttgcaggacacactggaggaaaagacgcaaaccaaccagcgcggaccaccactctacacgaaacacaaccctcaggaacaattctctgaaaataatgctcttgaccttccagtggagcccaacgagcactatgacccaccatttaatattagtaaactcttgacccccattatcccatccaagcacgccttagactctgcagattctcagcccgctgaacgtacccccagtccccctggccagctgaacggatatcaggagaaagagccatccgagtgtcagagcagggactcatacaagtcaaaggccccatcactgttgttcaatcttaaagacgtaagaaaaagggtcaagtccacctactcttcatcccccctcttaaaggttctggacgaaaagactcggggaaaagtggacggaaaacaggagccagtgagcaatggggtgatactccccaacggattagaagaaagcccacccaatgaactttcaaaagagcggcctgccgatgatccaaccgctagtcacatcaatccccagaaagacccaacagccgatccctctgaacccagcgctgattcttacctgactctgtccacggcccctacaatcgcgaaagcacctttctatgtcaacggcgaagccgctgagaggagctcttatgaaaataaagaggtagagggtgagctagaaatggggcctgccggatcatcttggtgtcctgactcccgggagcacaggccacggaagcacctgagcctgcgattatgcaatcgggatccagaacctgggggagcgaccgagaagatgaagacacaccagctggagaacggtctctcacgcagcgtcagccaggagacagaacccgagcgcgaggcaggcctgcagaatacgcatacacatacccacacacatactcacacccacgatcatcaacatatcctgagtttattccgttctataaagagccggagacagtag

SEQ ID NO: 53729 - DNA, 4308 bp, Artificial Sequence
  Description of Artificial Sequence: Synthetic coding sequence
atgatgcaaggcaacaagaagtgtaccgatgccttctccgattcgtcgagtatagggagtgttctggatgacgccgatcgggaagtgagcagtctgaccgatcgagcatttcggtcattatgcatcagcgaggacacaagctttcacgattcttatctggccgtgagccctgacattacgagacaggtgtttgggacctttcatcagagaactgttgggcacactcagaggaagtctggtatttggtcccaactgccatcccaagggaccgagcatagtggttgggccgctacatttcagcagctccctaagtatgttcagggcgaggagaagtatccaaaaacatccccaccgccaaccccagtgcagcgtcgtcttgaggtgcccgtgtcaggcctaagatcatccaacaaaccagtctccaaggtcagcacactcatcaagtccttcgataggaccgagtctcagcgctgtgaaagccgaccgactgcttctaaacctcctgctctcaaaaaccctcccaagttcgcccctcttcccgaaaattccgtgaatttctgttttgattcagcctttctcactgtgaggagggtgcccgctgaggtgtcaaatacacatcagaactcttaccagcccggacgaaaacacggagaacaggaatcaagcaagaatcccgaaatggcatgccacggtagctccagctttctccccgcagccaatgacacggcaactctgtgtgagagcaaattcccatcccctcaccacaagccagtgactggcgaaccaggacggggtaaggggacattcctccacagcgaaaatagcgcctttgagtcctggaacgcacatcagcctaagctcctggaaaggaaggatacagctggcacggtccccgaaagcaaagctccgaaacattatggagatacgactctgttgagagaaccctgcccccctgagcgcacggtcagtccttgtcaggtccaggctagctgtagtcaggaggagaacaggctggccgcaggcgctctttctacatctatcccatgggggtgtagagaccccggtgcccaggtgtttgctgtggagggtaaggctccctctagccaaccagactcccaggagaagcccgctcagcctccatggcggaaacctaagaccgggaagaagggcaaggagtctctacaagacacccttgaggagaagacccaaacgaaccaacgtggtccacccctatatacaaaacataacccgcaagagcagttttccgaaaataatgcactggacctccccgttgaacctaatgagcactacgaccccccatttaatatcagtaagttgcttactcctataattcctagcaaacacgcactggattcggccgattcgcagcccgcagagagaacccctagtccacctgggcagctaaatggctaccaggaaaaagagccctccgaatgccagagccgcgacagttataaaagcaaagctccttcactgcttttcaaccttaaggatgtgcggaaaagagtaaagagcacatactctagttcccctttgttgaaagtcctagatgagaagacccgcggaaaggtggatggcaaacaagagccagtttctaatggagtcatcctcccaaatggtctggaggagagtccgcctaatgaactgtccaaagagcgccctgctgatgacccaactgcttcccacatcaatcctcagaaggatccaaccgcggatccctcggaaccttccgctgatagctacttaaccctgagcactgctccgaccatcgccaaggcccctttctacgttaacggcgaggctgcagagcgctcctcttacgagaataaagaggtggagggagagctcgaaatggggccagcaggctccagctggtgtcctgattcccgcgagcacaggccgaggaagcatctgtccttgagattgtgcaaccgggacccggaacccggtggcgcaacagagaagatgaagactcatcagctggagaatgggctttccagaagcgtgtcacaagagacagagcctgaacgggaggctggccttcagaacacccacctcaatcagaagttcttccccggaccactgtctccggaggaagaggacgtgttctactctgacagtcaatcagactttatgcctagcttgaagggaaaagccaagttcagcacatcatcaagtgaccaatcgttcgccagcttcgatgaccaacagaaaatgtggtttactgaaaaccaacgcgaagaccgacggaaggatgtcagcgcaggggattctcaaaaggatgaaaaagaaaatgtgatgagaaaagatgaacttcagtattgcgctctctcaaatggccacgcttgcttggagaaccgatctcagggcgaagcgctccagagggagcgcgaatcagtgagcggaggacgtacaagaaaggcttcagcggaagaggcaaacttcagaggcagctggattggagaaaataaaggcaccaccttcagtcaggccaaggaccttacacctagcccaagctccgccagcaacagacacatgctgtttaccattaaagacaacacactccgggctacaccagtgatcaaaccaatcatgctcccattattgcgcactatgagtctggaagattcgctgtccagtggacataaagaagaggaacttcccaggccagagtggggcgaagaccccggtttttgcgctccagaaaatcaagatatcttggggacgtcaacacccacaaatacgcgcggaacccgcgtaaagtgcatggctaatgaagtcatggaggacccaggccagggctcttccatggcaagaatggaggcctctcagcccgcacctaaaggaaactttccatccatgcccttggttggagaaggcgatcgagtcaaggcgccacccgatgccgctccagggctcgtcgcgtcgaattgcaagagcgggtcagctgattcagggaagctagccgctccctggcatatccctaccattgctctgcccgagggggatatcgaagatcagccaccaccctggcagcccgagaattgttgggaggaacaaacccccggattcaaatctcactttttgtctactcccagagctggcccacccggtcgtaggctcgttccctctgaaagggctaactcgcctaacccagggtctccgggagagtcctcagcctgtagtcccgctgcctctaatatttgggaagagagcagtcaggccccagggggtcccgagctgcttccagaggagccaaaccaggccagcccttgggcctctagttcgcccgctagagtcactcggcgtgaggatctgacccatgcccttgtctgggagggagggtcagaccctctgctggagctatctgccgaggatctgcgcacattaagtccccgaggcagcctgctggatgttgctacctcacccgctgggactagcggccgactggaattgccagcccagctggaacgaaccgcctcaaaacctccggcagtcccacctaagacagagaaggccctgagacgtgccaaaaagctggcatcaaagagacgaaagacagatcaggcccaggaaaaacacggggaaagtcaggaggggaagccctgcccagaagatttagagcagacccagcaaaggcccctttgtccaagagagcgacccaggcataacttcccggtggtgcggtccctccctcccccagtgcatagacacagcgtttccggatttagtgaaccagtgggtcgaagaccagggggaccacaaagccttaccccccttccggcttatcctgccacacagaaagtcctgcaggatccgcaatctggggaatacttcgtcttcgatttaccccttcaggtgaagataaagaccttctacgatcccgagactgggaagtacgtcaaggtctccattccctcttccgaaggagcttcacctgaaccacctcctccagatgcgcttgccgctccctatgtcttgtatccaggcttccaaccagtgcccgtcacagctctgatgcccttgagatgctcctcacagctaagcgctcccacctttctgagacagggacctcgcgcaagtgctgccagggcaagaacccagagtgtgcacgaatcaggactccagctggatccgggtccacatggagactgtactccccactcagccggtcagcggcctcatggcccaccacagtcccccggtgaggaaggtgtggaggccccaggacttgggatcatcagtacagacgacctggaagactttgccacggagggcattagctag

SEQ ID NO: 53730 - DNA, 480 bp, Artificial Sequence
  Description of Artificial Sequence: Synthetic coding sequence
ccgatgcggcataggaaaaaggccgctgataaaaatcttccatgtcgccctctggtgtgtgctgtcctggatttgatggtcgagttcattgtgacgcatatgatgaaggaatttcccatggacctttacatcagatgtattcaagtcgtacataaacttctttgttatcagaaaaagtgtcgggtgagactgcactacacttggagagagctgtggtccgctctgattaacctgctgaaattcttaatgtcaaacgagactgtgttgctagcaaaacacaatatctttacattggccttaatgattgttaacttgtttaatatgtttatcacatatggtgacacattcctgcctacgccctcatcttacgacgagctgtattatgagataatcaggatgcatcaaagtttcgataatctttacagcatggaaccaagcagcaccactcttacgccaaaactcagcccgactcttctttag

SEQ ID NO: 53731 - DNA, 597 bp, Artificial Sequence
  Description of Artificial Sequence: Synthetic coding sequence
atggaaagctacttcttcaaagaaaccagccacgagagtgtggattcatctaaggaggagccccagaccctgcccgagacacaggatggtgacctccacctgcaagagcaaggaagcggtattgattggtgtctttcacctgctgacgtagaggcacagactaccaatgaccagaaaggcaacatacctgatgagtctcaagttgagaagttaaacgtgtttttgtcccctcccgatgttatcaattacttggctctgaccgaggccacggggagaatctgtgtgtcacagtgggaagggcctccacgccttggatgcattttctgtcacggcgatcacctcctggcggtgaatgatctaaagcctcagtctctggaggaagtgtcactgttcttgacacgctccattcagaaggagaaactgaagctcaccattggcaggatacccaacagtgagactttccatgccgcttcatgcatgtgtccctctaaatgccaatcagctgccccttctcagttagataagccgaggctcaaccgcgctccaaagcgcagtccggctataaaaaagtcccagcagaaaggtgcgcgagagtag

SEQ ID NO: 53732 - DNA, 1092 bp, Artificial Sequence
  Description of Artificial Sequence: Synthetic coding sequence
atggaaccgaagcctcaaaagtccccaggcaaacagttcaccttttcttacgaaaatgaagtctgtaaacaggattacttcattaagagtcctccctcacagctgtttagttccgtcacttcctggaagaaaaggtttttcatccttagcaaagccggtgagaaatccttctctctgagttactataaagaccatcaccaccgcggttcaattgagattgatcagaattcctctgttgaagttggcatctccagtcaggaaaagatgcagtccgtgcagaagatgttcaaatgtcaccctgacgaagtgatgtccatcaggaccacgaatcgtgaatatttcttgatcggacacgacagggagaaaattaaagattgggtcagcttcatgagtagtttcagacaagatatcaaggctactcaacagaataccgaggaggagttatcattgggaaataaacgtactctgttctactcctcccccttacttggaccttcttctacaagcgaggccgtcgggagctcctctcctcggaacggacttcaggataaacacctgatggaacaatccagcccaggattccgccagactcatctgcaggatttgagtgaagcaactcaggacgttaaggaggagaaccattacctgactccgagatcagtcctgctggagctcgataacatcatcgcttcgagcgattcgggtgaatccatcgagaccgacggtcctgaccaggtcagcgggagaatcgagtgccattatgaaccaatggagagttacttctttaaggagacttcacatgaatccgtggattcctctaaagaggagcctcagacactcccggaaactcaggatggggaccttcatttgcaggagcaaggctcgggaattgactggtgtctgagccccgcagatgttgaggcccagaccaccaatgaccagaaaggtagcgcctctctcaccgtggtgcagctgtctatcctgataaataatatcccggatgaatctcaggttgagaagctgaacgtctttctatctcctcctgacgtcataaattacctcgctctgactgaggccacaggcaggatctag

SEQ ID NO: 53733 - DNA, 849 bp, Artificial Sequence
  Description of Artificial Sequence: Synthetic coding sequence
atggagcagagttcccccggattccgccagacgcacttgcaggatctgtcggaagccacacaggacgtaaaggaggagaaccattatcttacacccagaagcgtcctgctagagcttgacaacatcattgccagttcggactcaggcgagagtattgagaccgatggaccggaccaggtatctgggagaattgaatgccactatgaaccaatggagagctactttttcaaagaaacttcacatgagtctgtagactcctccaaggaggagcctcagacactgcctgaaacccaggacggcgacctccatctgcaggagcaaggttcaggtattgactggtgcctctccccagccgacgtagaggcacagacaaccaatgaccaaaaaggcagcgcaagtcttacggtagtgcagttgagtattctgattaataacattcccgatgaatcacaggttgaaaaactcaacgtgttcctgtccccaccagacgtgattaattatcttgcactgacagaggctacaggcaggatatgtgttagtcagtgggaagggccaccccgattagggtgcattttttgccacggcgatcatctcctggctgtaaatgatttgaaaccacagtcgctggaagaagttagcctttttctgaccaggtcaatccagaaagagaagctgaagctaaccattggtcgaattccaaatagcgagacttttcacgcggcttcttgtatgtgtcctagcaagtgccagtccgcagctccctctcagcttgataaaccgcgactgaatcgagctcccaagaggtctcccgctataaagaaatcccagcagaagggtgccagagagtag

SEQ ID NO: 53734 - DNA, 1398 bp, Artificial Sequence
  Description of Artificial Sequence: Synthetic coding sequence
atggccggaggaaagcagtttacattctcttacgagaacgaggtgtgtaagcaggactacttcataaagtctcctccctcccagctgtttagtagtgtgacctcttggaaaaagcggttttttattctttctaaggctggggagaagagcttcagtctttcatattataaggaccaccaccaccgcggttctatagaaattgatcagaatagcagcgtagaagttggtataagttcccaggagaagatgcagagcgtacagaagatgttcaaatgccaccccgacgaagtgatgtcaatccggacgaccaatagggaatattttcttatcggacacgatagagagaaaattaaggattgggtgagttttatgtcatcattccgacaggatatcaaggcgacccagcaaaacacagaagaagagctgagtttgggaaataaacgcaccctgttttactcgtcgccactgttaggcccaagcagcacctccgaggctgtcggatccagttctcccagaaatggcctccaggataaacacctcatggagcaaagttcccccggatttagacaaacacacctgcaggatctctccgaagccacacaggacgtaaaggaggagaaccattatctgacccccagaagtgtattgctagagctggacaacatcatcgcctcctctgattccggtgaatcaatcgagactgacggccctgaccaggtttctggtagaattgaatgtcactatgagccaatggagtcgtattttttcaaagagacctcacatgaatccgtggactcttccaaggaggagcctcaaactttgccagagacgcaagacggcgatcttcacctccaggagcaggggagtggaatcgattggtgcttgtctccggctgatgtcgaagcgcagacaactaatgaccagaaaggcaacatcccagacgaaagccaggtagagaaactgaatgtgtttctctctcctccagacgtaataaattatttggccttgactgaggcaacaggcaggatctgcgtgtcgcaatgggagggacccccaagactgggctgcatcttctgccacggtgatcatcttctggcagtgaacgatctaaaacctcagagcctggaagaagtttcactgttcctaacaagatcaatacagaaagaggattcatttcggatcctctcctaccaggtagcctttggggaagggaccgaactgcgggatcgagccccagggtttaggacatccgatcgacacgacgtggctaagagagcttgcatggaatccgattggtgtagagactcaaagacagccccatctacaaacctttgtctttccttcctcttttgcaaaattatgacaaacgacggcgcaggctgctggattatcaagtag

SEQ ID NO: 53735 - DNA, 1101 bp, Artificial Sequence
  Description of Artificial Sequence: Synthetic coding sequence
atgcagtcagtccagaaaatgttcaaatgtcatccggacgaagttatgtccatccgcacaacaaatcgagaatactttttgatcggacacgacagggaaaagatcaaggattgggtatcattcatgagtagttttcgtcaggatatcaaggcaacacagcagaatactgaggaggaattgtcactcggaaataaaagaacccttttctacagctcacctctgcttggcccttcttccacgtccgaagcagtcggttccagctcccccagaaatggcctgcaggataagcatttaatggagcaatctagccccggattccgccagactcatctgcaggacttgtcagaggcaacccaagatgtcaaagaagaaaatcactatctaacacctcgaagcgtgttattagagttggacaacatcattgcctcatcagatagcggcgaaagcattgagactgatggtccagatcaagtaagtgggcgtattgaatgccattatgagccgatggagtcgtatttctttaaggagacttcccacgaaagtgtggattcatcaaaagaagaaccccagacactccccgagactcaggatggcgacctccacttgcaagaacaagggagcgggattgattggtgtctgagcccagcagatgttgaggctcagaccacaaacgaccagaagggaaacatcccagacgaatctcaggtggaaaagctgaacgtatttctgtcaccccctgatgtaattaactatctagcactgacagaggccacagggcgaatctgtgtaagccagtgggaaggcccaccccgtctcggttgcatcttttgccacggcgatcacctactggcggtgaacgatttgaagcctcagtcacttgaagaagtgtccctttttctgacccgaagcattcaaaaggagaaactcaagctgaccatcggaaggatccctaacagcgaaactttccacgcagccagttgcatgtgtccctccaagtgtcagtctgccgctccgtctcagctggataaacctaggctgaatagagctccaaagcgcagtcccgctataaaaaaaagtcaacagaaaggcgctagagagtag

SEQ ID NO: 53736 - DNA, 591 bp, Artificial Sequence
  Description of Artificial Sequence: Synthetic coding sequence
taacaagaacagggatccggtatagattggtgcctgagtccggctgatgtggaagctcagacaacaaacgaccagaaggggtcagctagcttaacggtcgtccaattgagcatactcatcaacaacatccccgacgaatcccaggtggagaagctgaacgtgttcctcagccctcccgatgtaatcaattacctggcacttaccgaggcgacaggacggatctgtgtgagccagtgggagggcccaccgaggctcggttgtatcttttgccacggagaccacttgctggccgtgaatgacctcaagccacagtctctagaggaagtgtcattatttctcacaagatctatacagaaggaagatagttttaggatcttatcttaccaggtcgctttcggcgagggcacagagctgagggaccgagctcccggttttcggacatccgatcgccacgatgtggctaaacgcgcttgtatggagtccgattggtgtcgtgattccaagaccgctcccagcacaaatctatgcctgagcttccttttctgcaaaatcatgaccaatgatggcgcaggatgttggatcattaagtag

SEQ ID NO: 53737 - DNA, 465 bp, Artificial Sequence
  Description of Artificial Sequence: Synthetic coding sequence
atggaacccagtaaaacctttatgagaaacctccccataaccccaggttattctggctttgtcccattcctttcctgtcagggtatgagtaaggaagacgatatgaaccactgcgttaaaaccttccaggagaagacccaacggtacaaggagcagcttcgtgagttgtgctgtgcagtagcaacagcccctaagcttaaaccagtgaattctgaagaaaccgttctgcaggcacttcaccaatacaatctgcagtaccatcctttgatcctggagtgtaagtatgtaaagaagccgcttcaggagccacccattcccggttgggctgggtatttacctcgggctaaggtcaccgagtttgggtgcggcactcggtatacagtgatggcgaaaaattgctataaagactttttagagatcaccgagagagccaagaaggcccatctgaagccttatgaggagtag

SEQ ID NO: 53738 - DNA, 693 bp, Artificial Sequence
  Description of Artificial Sequence: Synthetic coding sequence
atggaaccgtccaaaacctttatgcggaaccttccaatcactcctggttattctgggttcgtccctttcctgtcttgtcaggggatgagcaaggaggacgatatgaatcactgtgtaaagacgttccaagaaaagactcagcgctacaaagagcagctgcgggagctctgctgcgccgtagcaactgcccctaagctgaagccagttaactccgaggagacagtcctgcaggcccttcaccagtataatctccagtatcatcccctgatattagaatgtaaatatgtgaagaaacctctgcaggagccccctattccgggatgggctggatatttgccgcgagctaaggtgacggaatttggttgtggaacgaggtacactgtcatggctaagaattgttacaaggacttccttgagattaccgagcgtgccaagaaagcacatctgaaaccctacgaagagatatatggcgtctcaagcaccaagacatcggccccttctcccaaggtgctgcaacatgaggagctgctgcccaagtaccccgatttttctattcctgacggtagctgcccagcactgggccgacccttgcgcgaggaccctaagactccgctaacctgcggatgcgcccagcgaccatcaatcccttgtagcgggaagatgtatctcgagcccttaagttccgccaagtag

SEQ ID NO: 53739 - DNA, 387 bp, Artificial Sequence
  Description of Artificial Sequence: Synthetic coding sequence
atggcttggagagtccccggagtgcgccctgcgagcacctttttcccccaggtattgagggcatctagcgagctccctaataggttgcctgagggtagcaccgtgggtcccaagccagacagcagttgggaggcaggtagtcaaggaaattggggtctgacgtccagtggtgctggccaagactccagcgcgcagaaactcgggatcctgagcgttcagataagcctgaagatctggacctgggaaaaaccttctggctggggccacctgcacgcagcggtgactggagccagctgctgttctccactcagccaagggggtgccatttgtttggtgaccgcgcctcaggacaagcctgactgttcaccctgcacgagtggacactag

SEQ ID NO: 53740 - DNA, 1338 bp, Artificial Sequence
  Description of Artificial Sequence: Synthetic coding sequence
atggaaacccggacggaggacggcggactgactaggcgcccaaccttagcaagtagctgggacgttgccggaggagctctcacacattcactgcttttgacccgggctggcttgggtcccggagattttgactgggaagaactgttggctccacccgctccgggtcaagatctggtgatcctgaagcggaatcacaacaacaaggacgaaaacccttgtttcctctacttacggtgtggaccagatgggggagaggaaatcgccagcattggcatcctgtcatccgccagaaacatggaagtgtatcttggggaggagtattgtggcacctctagaggaaaaaacgtgtgcacagtgctcgacgatagcgaacacgagaaaattatcctctataagaagaacctgaagttagagagttccacacacgcatgtaaaattaagctgctgtcctttggagaaagacagtgtgtgtttattagcaaggtcgttgtgcacatgcgcagcgtgttcgcaaactcctccacctccagcccagctctaggctctcgcatcgatctggataaggtccaaactatcatggagagtatggggagcaaactgtcccccggagctcagcagctaatggacatggtgcgctgtcagcagaggaattgtataccaataggagagcagctacagtcggtgctggggaactcgggctataagcatatgattggcctacagtcatcaagtaccttagggactctgaacaagagctcttctactccgtttccatttcgaaccggcctgaccagcggaaatgtgaccgagaatctgcagacctacatcgataagtctacgcagttgccaggtggagaaaatagtactaaactggacgagtgtaaagtgatgccccagaaccacagcttcctcgagaatgacttaaagaatgcaatggcctctttcttaccaaagaaagtgagcgataactcgaacattcctaattctgagttacttcccttcctgcagaatctatgcagtcaggtaaatcatctccatgtgggaaacaaaaccgaatgccaagaaaacatcactaagcacggggagaggattttaggagttgggatggaggagcagtctatatgtagttacctcgagaagatcctgagtaagaacatggagctcatggaaaagaaactcatggattacattgaccagaggattcacgaactccaggaacatatcgatgacaaaattgccctccttcttgatctcttacaaaaccctaacagccctccgacgggcatcccacttaggcattacgactcaggagaacggctgagtaacggcgaacggtag

SEQ ID NO: 53741 - DNA, 438 bp, Artificial Sequence
  Description of Artificial Sequence: Synthetic coding sequence
atgtggagcttcctccccggagccgagagcgtttcaatgggacctgttccgggtgtctcttccctgggcgcttgctggacacacgatcaggatagtggcagagccgaggaccgtccgcaggctccgagaatcacgcaatatacttgggtgctgagcttcctctttaccgagaagccccaaacacgcagtacgtcccctatctcgcatcagggtcagccccagaccactcgcgctctgtcgttacgtcaacctcaacacccttccgcaccagcgtctgggcgacctcggcctccacactcttcggggccagatctggctgaggccgctccggtggtagaccaagcttcacaggcggctgggagggcaagctccggcctggggctgtgggaacaggcctcagtctcacaaggattccggaacgccgcattcgaggcatag

SEQ ID NO: 53742 - DNA, 438 bp, Artificial Sequence
  Description of Artificial Sequence: Synthetic coding sequence
atgtggagctttctgccgggtgccgagtctgtgagcatggggcctgtgcccggagttagctcactgggcgcttgttggacccacgaccaggatagtggaagagccgaggataggccacaggcccctcgcatcacacagtacacctgggtcctctctttcttgttcaccgagaaaccgcagacccgaagcaccagcccgatatcgcatcagggtcaaccccaaactacccgggcactgtccctccgtcagcctcagcacccatctgcaccggcttctggccgacctagaccgccacatagctctggccctgacctggctgaagccgcacccgttgtggatcaggcctctcaagctgcaggcagggcgtcatcgggtctgggcctatgggaacaggcatctgtctcacaagggtttaggaacgcagccttcgaagcatag

SEQ ID NO: 53743 - DNA, 774 bp, Artificial Sequence
  Description of Artificial Sequence: Synthetic coding sequence
atggagcggtccaacgcagccacgaagtgtggagaagagccaaggtccggaagcaggcgactgcccaaagccgaaggagataagagtggctccgccggtgcacctagcaagaattcaagtagactcggtggacggccttgcatgtgcaccgctggccgaaggccgaaccgcgcttccggacgcagaagaagaagttgctcccccgcaccaacatggccccctctctgctgctatccacaatctcgtcccacggccagcgccgcagggccaggagcttgtatgagggcaagcggacggccacatggaaatactactgcctccacagccccaccccgtcatccaagaccacgcagaccaggtggccctgccctgagacctacgccgaggccctgtgccggtccggcaccaccccctgcgtcaagagattgtcgctgtcggagaccacggagatggcctagggctggacgtcgtggacggagggccggagcgtgcaagccctcttgcgcgggtgcggcatggtcagccagaggggcacccctgtgctcctacaggactagttgtgcagggtcctgtggggctcgaacagcacccacgcctgctcctacatgtgcgtctcccagtgccgcagcatcttcatgctgcaggcgcagacgggcatgtagcagcccgacgaccgcatggtcaggtgcttgcggagctgggcctaccgcagctaccgctgctcaaccgggaaaaccaaggagcgccgctgccccagggcgagctcgagcctag

SEQ ID NO: 53744 - DNA, 777 bp, Artificial Sequence
  Description of Artificial Sequence: Synthetic coding sequence
atgtccctcgagtcattatttcagcatatcatattcactgagcatcaggccgaagagtctaggcgtctcatgcgcgaggtgcggagcgagattacacgctgtagagagaagatcaagaaggccactgaggagctgaacgaagagaaaataaagttggagagcaaggtgcagcaattttttgaaaaatctttcttccttcagcttctcaaggcgcacgagaatgctttagagaagcagtacagcgagataacaaaccacagaaatatgctcctgcaaacatttgaagcaatcaaaaaacaaatgattgaggaggaagacaaatttatcaaagaaatcacagactttaacaacgattatgaaattactaagaaaagggagctgcttatgaaggagaacgtaaaaatagagattagtgatctggaaaatcaagccaacatgctgaagagcgagatgaaaagcatggaacacgatagctcccagctgaacgagttacaaaagcagaaatccgagctcattcaggagctctttacgcttcaacgcaaactgaaggtatttgaagacgaggaaaacgagagcatatgcacgaccaagtatttggaggccgaaaagattaaaatatctgaaaaaccccagaacgataccgaatgcctgagacttaaaaaggagctcgagttatataaagaagacgacatggaaagtgtatatgaagctctgcagaccgagattgagttcctcgaactcactctggcacagaaagaccttcaggagtccaagtag

SEQ ID NO: 53745 - DNA, 543 bp, Artificial Sequence
  Description of Artificial Sequence: Synthetic coding sequence
atgtcactggagagcctgttccagcacattattttcacagagcatcaagctgaggaatctcgccgactgatgcgagaggtgagatccgagattacacgatgccgggagaagatcaagaaggcaacagaggagctgaacgaggaaaagatcaagctggagtctaaagtgcaacagttctttgagaagtcatttttcctgcaactgctgaaggcccacgaaaatgcgctcgagaaacagtatagtgagataaccaaccataggaacatgcttctccagacattcgaggccattaagaaacagatgattgaggaggaggacaaattcattaaagagattacagatttcaacaatgactacgagatcactaaaaaacgagaactgctgatgaaagaaaatgttaaaatcgagatctccgacctggaaaatcaggctaatatgcttaaatccgacagattaaagaaggagctcgagctgtataaagaggacgatatggaaagtgtatatgaggcgttacagaccgagatcgagtttctggagctgtag

SEQ ID NO: 53746 - DNA, 1404 bp, Artificial Sequence
  Description of Artificial Sequence: Synthetic coding sequence
atggagagtagcaccgggccaagaatgcccctgctcaagtattgctcagtagccacgagcctgaaagccccaggctgggacggggcagccccaccatgggacctgagctttacttaccccttcgctctgcaggccccttggctaactggccacaaacctctcgctcgacatgcatcctcttgtccatgtttacatgtagccgaccctgcatggcagggccctggctggttaggccgtgctggggatgctgcaaatacctgggttctggcaagacgggaggccgacggcttttattacagagcccagataaaagcaacccctgagctcgaacggcagggagtgctcttagtggaatttgaggcacctctggtagcaggccctaagttgccagcacagcagcagcgcgtggtactcgaagaggatgtgattccactcagtccaagtgtagggtattcgctgcgtcccggagacaaggtactcgcgttgtgggaacctgggcagcagcagtacggacctggaactgtattactgggtctggagatgagagaccctcagagagcaagcaaagagaaggagattactgttcatttctggaacggaaaagccgcaaaagttcctctgggcggtgtgcaatcagtttccctgactatttggaaaaaagctgtggagagactgcataagagcttcacccgcgagcaccccagaccacttcactgggcgccttgctgcagcctgcttggccctatcaccggcaggataaccaacgagctgccacccgatgcccctttcctgtgccctctatgtcatcatcatgcttgttgtcagctactgtgtcaagggtgcttgtgcggctgcccaccgtgtggcaccacctggtggccactaactcggaccagcgaagttatggcgagggagctacctgagttagagcctaccgcacagctccttccactggaaggcccaaaagaagagaaagttgcaatgcacgctccattagccgtttcaagctctagtagttcgtcctgtgagcaagacggcgtggagaatgacctcgagatgggtccccctcagagactcatggtcaactcagcagtgaatactgatcccatcttcttagagatgcctcttcgccagtccggattatgccagcccgagtggcgttactggaagcgtaacggcccagaaccatgtctgggtaagcccggtactaggtactccaatatctgcaaagaggagaaagaccataagcagcagcgagctcaaacagctgtggtcgggactaccaaggagctggtgtccaaagcgactcacatgaaaccccctcgtacaccccctggcgaagcggagcataggaagagatcacagagccttgcaatttgccaatggaataagaattcacgttag

SEQ ID NO: 53747 - DNA, 1215 bp, Artificial Sequence
  Description of Artificial Sequence: Synthetic coding sequence
atggagtcatccactggacctaggatgccattgttgaagtactgctccgtagccaccagtctgaaggcccctggctgggacggtgcagccccaccctgggatctgtcctttacctacccctttgctttgcaagcaccttggctcaccgggcacaaaccgctcgcccgacatgcttcatcctgtccatgtctccacgtcgccgaccctgcatggcagggtccaggctggctcggacgggcaggtgatgccgctaatacatgggtgctggcgagaagggaggctgacgggttctactatcgtgcccaaataaaggccacccctgagctggaaagacagggcgtgcttttggtggagtttgaggcccctctggtggctggtcccaagctacctgcgcaacagcagcgggtggtgctcgaggaggatgtcatcccgctcagcccaagcgtgggttatagcctcagaccaggcgacaaggtcctcgccctatgggagccagggcaacagcaatacggcccaggaaccgtcctactcggccttgagatgcgtgacccccagcgggcaagcaaagagaaagagattacagttcatttctggaacggcaaagctgctaaggtacccctgggcggtgtccaatcggtgagcctgacgatatggaaaaaggccgtggagcgcctccataagtcctttactcgtgagcatccccgacccctccactgggcaccatgctgttccctcctgggaccaattaccggaaggatcaccaatgagctccctccagatgccccatttctgtgtcctctgtgtcaccaccacgcatgttgtcagctactctgccaaggctgcctgtgcggttgtcctccctgcggcacaacttggtggccactgaccaggacaagcgaagtgatggccagagaactccccgagctggaacccactgcccaactgctcccactagagggacccaaggaagagaaagtagccatgcatgcacccctggcagtgagctctagcagttctagctcatgcgagcaagatggagtagagaatgatctggagatgggaccccctcaacggctcatggtcaactccgcagttaataccgatccgatcttcttagagatgcccctgcggcagagtgggctgtgccaacctgaatggagatattggaagagaaacggccctgagccctgtctgggaaaacctggaaaggaatag

SEQ ID NO: 53748 - DNA, 369 bp, Artificial Sequence
  Description of Artificial Sequence: Synthetic coding sequence
  Description of Combined DNA/RNA Molecule: Synthetic coding sequence
atggcacctcgaggaaggaagcgaaaagcagaagccgctgtggtagcagtggctgaaaagcgcgagaaacttgctaacggcggagaagggatggaagaggccaccgtcgttatcgagcattgcacaagtugacgtgtatatggcagaaacgctgcagcactatcacaagccttgcgtctcgaggctcccgagctgcctgtaaaggttaacccaaccaaaccgcgtagaggatcatttgaagtgactctgttgcgcccagatggcagctctgcagagctgtggaccggcataaagaagggcccacccagaaagttaaaatttcctgagccccaggaggtggtggaggagctcaagaagtatctctcttag

SEQ ID NO: 53749 - DNA, 285 bp, Artificial Sequence
  Description of Artificial Sequence: Synthetic coding sequence
  Description of Combined DNA/RNA Molecule: Synthetic coding sequence
taaggaatggaagaggctacagtagtgatcgagcattgcacatctugacgtgtctacgggcgaaacgctgccgctctgtctcaagcccttcgtctggaggcgcctgagctacccgtgaaagtgaatccaactaagccacgaaggggtagttttgaagttacacttctacgacctgacggtagctctgccgaactgtggacgggcataaaaaaaggtcccccaagaaagctgaagtttcccgagccacaggaagtggtggaagaattgaaaaagtatctctcctag

SEQ ID NO: 53750 - DNA, 369 bp, Artificial Sequence
  Description of Artificial Sequence: Synthetic coding sequence
  Description of Combined DNA/RNA Molecule: Synthetic coding sequence
atggcgcctcgcggtcgtaagcgtaaagcagaggcggctgtggtcgccgtagcggaaaaacgtgagaagctcgccaatggtggtgaaggaatggaagaagcaacagtcgtgatagagcactgtacttcaugaagggtctatggcagaaacgccgcagccttgtctcaggctctgcgcttagaagctcctgagctgccggtcaaggtgaaccctactaagcccaggcgtgggtccttcgaggttacacttctgcgccctgacggcagctctgcagaactgtggacaggcattaaaaaggggcctcctcgcaagctcaagttcccagagccacaggaagtggtggaggagctgaagaaatacctgtcatag

SEQ ID NO: 53751 - DNA, 1905 bp, Artificial Sequence
  Description of Artificial Sequence: Synthetic coding sequence
atgcgttggctgcgccctgcaggccgaagacgggaacaggagtccgtgtccgggcacctggggcctccggcaggagcacccgcagcccctgagacacccacctgtctacctgatactaccccacacccagctcctgttgtttgtagtgccgacccgcagttagccctggagtccctcgacccaaggactctgcgactcctttggcggcagcgagaactcgaaatccaggcccttagatgggccatccagaacggggaagatgccaggctctgccacattcttgaggaagttgccggtctgccccctaagagatcgtcgcacagccaggaaaaactcttgcagaatcaagtgcagaagctaattcaggagctcaaggagcaaaaagagcgggctcaatgggaaaaagaacaccttgaggaacgtctcctccagactacccggacactgcaagagatggaagcggagctccagaatctgcagaagtcctgccttctgcagctcgccaggtccagttgggtcggtcgcatgttgagatcccagactgggagcgtggaggtcgtgacagccgagacactcatggatcccagcgacttgagtgaaaatatccaagcacctactggagaaggcttcaggctggaagatgtggactggaattctgttgcaaggaggtacccgaatctgttcacgaacatggaaccctcttcaaagcagaagcagcctcgaccatggcctcaactggacacaggctctcccgaaagctctggcaagcactcagaacgccaccataagaccgtcgagtggggctccctaccttgtctgaacacatctagctccggaggcgctgattcagactcctcttcgtgtcgcccaggcctccctagctttgtgcaggtgatagggcatccccctagggaccaccgggcttcttcagaacaagcgctggtacaggccggttcttactcccgggacagcgaagacctgcagaagacacatagcccccgacatggtgaacccgtgctaagtccccagccttgtaccgaccccgatcactggagccctgagttacttcagagccccactgggctgaagattgtagcagtcagctgtcgcgaaaagttcgttcggatattcaacccctcccaggagtcaacggcagatctaagcggcatggttctcaaacagttagtccggggtttcccggagcgactgtataggttccctcccggaactcttctggcccctcgccaccacgtaacggtctggggcgaagcgacgcgctccgcaaagaaaccgctccgcgctagcagtagtcgggaacccgtacctctgctaagtattaggggatgcgccacgctgctcttgtctccaaagggcgaggtgctgagcgaacaccgtatccctcgacgcgagactccagcgccaagagtattcgcagatgggactgatctcagtatagatcggttcccccttccagaggccggtccaggagctgatacccggaaaccaccacgaccaccacggcctttacggaagggacgtgtccgagagcctcgagtgtccagacggcgacctggtacccggggacttctgcccccagtaagctccggaaagctgttccacgccagggaagggccagcacgtcctgagaatcccgagatccccgcacctcagcacctgcctgccattcctggagaccccactctgccttctcccccagccgaggctggattgggactcgaagactgtagactgcagaaggagcatcgagtgcgcgtgtgccgcaagtctgttgaccggtcctgtccactggtggctttatcggtgcaaaatacggctgaatctaggtttggttttcggttccttagctgtctgcccgttaccgccgacacttgccggggtgcatag

SEQ ID NO: 53752 - DNA, 477 bp, Artificial Sequence
  Description of Artificial Sequence: Synthetic coding sequence
atggatctggcctccgaaattacaagtgctactcagaccagttctctctgttcttctggcagagggcacgcgggataccccgcacccggtattgtggcacacggctttgagacacacggcacagcgagggtggctcaaggtcacctcctgccaccttgtttgctcccccctccacagatgccagtactcgctgctctcagggatctgagcagacggggaagcacttcaagctctaggagcccttcccgaccggtgtccacttctgcgtctaaaccatgcctgccagcctcatgtctcggcgagacttggtccattagtataaacctggtggggagtagcgggcatttacaaagcccaggggctcagcgcgatgcacaaagggagaccggttgtttgggcccaagttggcttcctcaccaccaaggcagggatgaggagcttagcctcagtcacagtgcccaaggagaagagttttag

SEQ ID NO: 53753 - DNA, 477 bp, Artificial Sequence
  Description of Artificial Sequence: Synthetic coding sequence
atggatctggcctccgaaataacgagtgccacacagacaagcagcctttgtagcagtggcagagggcacgcagggtatcctgcacccggtattgttgcccacggttttgaaacacatggcaccgctcgggtggctcaaggccatcttctgcccccatgtctgctcccccctccccagatgccagtgctcgcagctcttcgcgacctctccagacggggtagcacgtcatcttctagaagccccagccggccagtgtcaaccagtgcctctaagccctgcctgcctgcctcatgtctcggcgaaacctggtctattagcatcaacctcgtgggatcatccggccacctgcagtcacctggggcacagcgagacgcccagagggaaacagggtgtctgggaccaagctggttgcctcaccaccagggcagggacgaggaactgtctctctcccactccgcgcagggtgaagagttttag

SEQ ID NO: 53754 - DNA, 87 bp, Artificial Sequence
  Description of Artificial Sequence: Synthetic coding sequence
atggacctggcatctgaaattacttccgccacccagacgtctagtctgtgcagctccggacggggacatgccggttatcctgcctag

SEQ ID NO: 53755 - DNA, 477 bp, Artificial Sequence
  Description of Artificial Sequence: Synthetic coding sequence
atggaccttgccagtgagataacctctgcaactcagacttcctccttgtgttcgagcggaagagggcatgccggatacccagctcctggcatcgtggctcatggttttgagacacatggaacagccagagtggcgcagggtcatctactgcctccttgtcttctcccccctcctcaaatgccagtgctagcagccttaagggacttgagtcggaggggatccacatctagtagtagaagtccgtccagaccggtttcgaccagcgcatcaaagccatgtctgccagcatcctgtctcggagagacttggtccatatcaatcaatctggttgggagctctggccacctgcagtcgcccggagcacaacgcgacgctcagcgagaaacagggtgcctggggccatcctggctccctcatcaccaggggcgagacgaagagctcagtctctcacattctgcacagggcgaggaattctag

SEQ ID NO: 53756 - DNA, 423 bp, Artificial Sequence
  Description of Artificial Sequence: Synthetic coding sequence
atgaagggacaagaagggatacgtggtgaaggatgcaccgatccagagatcaaggcaagtcctcagatgtgggcggctaggttcagagggatgcgcagccgcttctctccgctcttctctcaggcaactgagatgggacctcgggtgtcagctggctggtgtctctccggagggggtcgcaaggtgtcttctctccagggggatttcccaccaggaggcttttgggccttaagcaacgactccgccttgtcactccctcctctttctcttccacacccacacccactgcgtccaccaggactgggggtcaatgagttcacccaaggcttacacccaccactccatcccgcagcctccgtgtttcagacatgtttctatcgaaaaccgcattattgttctactttaaggcccacgaccacgtag

SEQ ID NO: 53757 - DNA, 654 bp, Artificial Sequence
  Description of Artificial Sequence: Synthetic coding sequence
atggcactggtccaggcacttgtccctcgcgagcgcgaacccaaactgagcatccttcagatggaccgaggggatcctcagcatagcagccattggtgcccggagcgagaaaaagttaagctcttgacgcttaaaccgagagaaacctcgaagaacatcctaattaacttttaccgagccttcaatcttgacaaggacgttttcatccaccaggctaatcacccactgacagtaccatcttcagtggtgatgggagataacggtcataccctggcagaggacgataagcgcccatgtttcagggtgctgccttgctacctggagagagtctcaagcgggatctccatctcctggatctcagctccactgccggtgggggctatgaaacatcaactgttatgtgaccttatggatctgattacacttagcttctggctggccggacagtgcatgagcctcaaggccaccaacatgcagcattgtaagtgctctatcgccacttccgactgggcaattgaacttgatcgcacagattacaaaaccctgccatcagagtattccatcctcgccctgctacaggtattcgcaggaaaaaactgtatggacagagtgctgcttcatgttgacgtcaattacctgaagtctctcccctag

SEQ ID NO: 53758 - DNA, 1002 bp, Artificial Sequence
  Description of Artificial Sequence: Synthetic coding sequence
atgcttgtcggaaccccaaacctgttaaccctggatgaggctgatgccacctggactctcatcaaagataaggtcatcgaagagcattttggcccaaacgccgtggctgtgccattcctgagtgatgccgcatgctacgatcttcttggtgtactcgtgaagcaaagtcggcctgctcacacacgcctcgcactgccaggaagacagggacgcagagcactgaaacccgtgggccctttaccttcattgttggaacaggcaggtagtgagggtgcatttgcccattgcacaagggaatattcgccgaacggcagagccgagcgggcttacgaagagaccaggatgctggatgggcagccatgtaaaataagactccatatgggagacctgcggaaaaaagtagccttccttctcctacctcccggacaggtcagcctccaacaaacccttccatggctgcgcagcacgcactcgatctatgtgatctaccaggttttttcatgctcttggttgcagttggggctgacatcgacggctagagaaccacaactgcttcggctgcttagatcactcccagtggccttttcctgccttaagttctctctgcagagcaaaggcgttctgggccctcagaaaccccttacaaaagacccactgccgcacggagccaattgggtgcgccctaatctttccattatgcctcccctggcccctacaagcgctcccgctgacacaaccgaagctgccgacgtgcctccacctgtccccgcaccccctaccccacctccacaggaaggacctgaggacaagcccaccaggttttcttataaaggtcgtaatcccttttggagaggaccccagattctgtcagaaaactggctattctcaccccgaagccctcctcccggagcacagggtggaggacccagagatccggacggtcactctatgagcctgcctctgctgcaggggctcagttcagagttcgactctgatgactag

SEQ ID NO: 53759 - DNA, 792 bp, Artificial Sequence
  Description of Artificial Sequence: Synthetic coding sequence
atggccctcgtgcctgggcgaagtaaggaagatggtttgtggacacgcaactctcccggatcttcacagcacccggaatcacctcgcttgccaaatcctctgtgggacaggggtaagatcggcaaggtcgagggtcatcagcacattcaggacttttctcagaagagtcacctgccttctattgtagtggaaagttcggaagtgaacgaggaatcaggcgacctccacctaccccatgaagagctccttctgcttaccgacggggaggaggaggacgccgaggctttctttcaagatcaatccgaggagcctggctgggcctggtctccacaggacccaagatccccgctgaggacattcaacgccggactatcttgggggcaagatcaggacgaggaggacgcgtgttggatccttgaggacacagcatgcttggaggccaccaatcattgtccattttgggatagcactggatctagagtgtgtcgtagcggatttgtggaatacagccacctcctgcccccaaacagcttcgaaggtgccgaggaagaagctgtccagacaccagccggtgtggagtccggcgctgcctccgaagccccaggaggcagaggttgcgataggcccagagcagatcatgccgcaccgcctcaggaagcaggagtccagtgtacctgccaacactacaccgttcgtgaggaagcacagaaaacccctccagcagatccagcctgtcccgaacgcgaggactcccacggtagtgggagccccttcaaggccagtcaggactag

SEQ ID NO: 53760 - DNA, 870 bp, Artificial Sequence
  Description of Artificial Sequence: Synthetic coding sequence
atggcgttggttcctggcagaagcaaggaggacgggctatggacacgcaattcacctggctcaagccaacatcccgaaagtcccagactaccaaacccactttgggatagaggaaagatcgggaaggtggaggggcaccagcacattcaggtgagcacaagctccgcctgcgtgtggcagttggcatacccgcctgtttggcctaatcttccggcagtgccaattcaggatttcagtcaaaaatcccatttgccatcgattgtggtggaatcctcggaagttaacgaagagagcggggacttgcacctgccccacgaagaacttctcctgttgacggacggggaagaagaagatgccgaggcgtttttccaggaccaaagcgaagagcccggttgggcctggtcaccacaggaccctaggagccctcttaggaccttcaatgccggattaagctggggacaggaccaggatgaggaagatgcctgttggatcctggaggatacggcgtgtctcgaggcgactaatcattgcccattctgggacagtactgggtcgcgcgtctgtaggtcaggatttgtggagtactctcatctcctaccgcctaactcatttgagggtgccgaagaagaggccgtccagacaccagcaggtgtcgagagcggggcagcttctgaggctccgggtggtcggggatgcgaccgtcctcgcgcagaccacgccgcaccaccacaggaggcgggagtccagtgtacctgtcagcattatacagtacgagaagaggcgcagaagactcctcctgcagaccccgcatgccctgaacgagaggactcacatggaagtggctccccttttaaggcgtcccaagactag

SEQ ID NO: 53761 - DNA, 249 bp, Artificial Sequence
  Description of Artificial Sequence: Synthetic coding sequence
atggcacttgtgccaggtagaagcaaggaagatggtttgtggactaggaatagccccggaagtagtcagcacccagaaagccctagattacccaatcctctgtgggaccgcggaaagatcgggaaggtcgagggtcaccagcacatccaggactttagtcagaagtcacacttgccatcaatcgtagttgagtcttccgaagttaacgaagagagtggcgatctgcacctgccgcatgaggagctgtag

SEQ ID NO: 53762 - DNA, 792 bp, Artificial Sequence
  Description of Artificial Sequence: Synthetic coding sequence
atggccctcgtgccgggtagatccaaagaagacgggctgtggactcgtaattcccctggatccagccaacatccagaaagccctagacttcctaaccccctgtgggaccgaggaaaaattggcaaagtcgaaggacatcagcacatccaggatttttcacaaaaaagccacttgccgtcaatcgttgtcgagtcttcagaggtcaacgaagagtccggcgacttgcatctcccccacgaggagctgctgctgctgaccgatggagaagaggaggacgctgaggccttcttccaggaccagagcgaagagcccggatgggcttggtcaccccaggatcccaggagtcccctcaggacgttcaatgctgggttgtcttggggacaggaccaggacgaagaggacgcatgttggatcctcgaggacactgcatgccttgaagccaccaaccattgcccattctgggactcaactggctcacgagtatgccggtccggattcgtggaatactctcatctgctgcctcccaactccttcgagggtgccgaggaagaggctgttcagacaccggctggcgtggagagtggcgctgcatctgaagcccctgggggtcggggatgcgataggcccagagcagaccacgccgctcctccgcaggaggccggagtccaatgtacatgtcaacactatacagtccgggaagaggcgcagaaaaccccacccgctgatcctgcctgccccgaacgggaggactcccacggctccggcagtccctttaaggcatctcaggattag

SEQ ID NO: 53763 - DNA, 996 bp, Artificial Sequence
  Description of Artificial Sequence: Synthetic coding sequence
atgctgagtccagagcggctggcactgcccgactacgagtatcttgcccagcggcatgtgcttacctatatggaggacgctgtctgccaattgctcgagaatcgggaagacatcagtcagtatgggatagccaggttctttacagaatacttcaactctgtgtgccagggaacccatattctgtttagggagttcagcttcgttcaagcaaccccccacaatcgcgttagcttcctgcgagctttttggcggtgtttccggacagtcggcaagaatggcgatctcctgaccatgaaggaataccactgccttttgcagctgctgtgtcccgacttccccctggaactcacccaaaaagcagccagaattgtgttaatggacgatgccatggattgcctcatgtcctttagcgacttcttgttcgctttccagattcagttttattacagtgaattcctggatagcgtggccgcaatttatgaggacctcttgtctggcaaaaatcctaatactgtaattgtgccaaccagttcctctggccagcaccggcagcgacctgctttgggcggtgctgggaccttagaaggggttgaggcaagtctgttttatcagtgcctggaaaatctgtgtgaccgtcacaagtacagctgccccccacccgcactggtgaaagaagcccttagcaacgtccaacggctgacgttttacggatttctcatggccctgagtaagcaccggggaattaatcaggcactgggcgctttgcctgacaagggggatttgatgcacgacccagccatggacgaggaattggagcggctgttggctcaggtgccaggcctcgttaactcagtgaccgctagtccggaagcctcctgtttaccatctaggacaccgccacgagtgggatctccgtggcgtcctttacaccatagtagaaaggtcgatggagagagcgatggctctacagaagagactgacgagagcgagacctag

SEQ ID NO: 53764 - DNA, 1014 bp, Artificial Sequence
  Description of Artificial Sequence: Synthetic coding sequence
atgctgagccctgagcggctggccctgcctgattatgagtacctcgcacagagacatgtgttgacgtacatggaggatgccgtatgccagctccttgaaaatcgggaggacatttctcaatatgggattgcccgattcttcaccgagtacttcaatagtgtctgtcaaggaacccatattctatttcgggaattcagcttcgtacaggctacacctcataaccgcgtcagtttcctacgtgcgttctggaggtgtttccgcaccgtgggaaaaaatggcgacctactgacaatgaaggaataccactgtcttctgcagcttctgtgccccgacttccccttggaactcacccaaaaagccgctcgcatcgtgttgatggatgacgccatggattgtcttatgtctttttccgattttttatttgcctttcagattcagttttactatagcgaatttcttgactctgtcgccgctatctatgaggatctcctcagcggaaaaaacccaaacactgtgatcgtccccacaagctcatccgggcaacaccgccaaagacctgcgctgggtggagccggaaccttggaaggcgtagaggcgagtctgttttatcagtgtctggaaaatctttgtgatcgccacaaatattcatgccccccaccggctctcgtgaaggaggcactcagcaacgtgcagcgacttacattctacgggttcttaatggctctgagcaagcatcgcggaattaaccaggctcttggcgctctgccggacaaaggggacctcatgcatgacccagccatggatgaagaactggagcgcctgttactgcccttctttcgcctggcacaggtgcccggactcgtgaactcagttacggcctctcccgaagccagctgcctgccaagcaggacccccccacgagtgggcagcccatggcggccattgcaccactctagaaaagtggatggtgaaagcgatggtagtaccgaggagacagacgaatcagaaacgtag

SEQ ID NO: 53765 - DNA, 825 bp, Artificial Sequence
  Description of Artificial Sequence: Synthetic coding sequence
atgctgagccccgagcggctggcacttcccgactatgagtacctcgcccagagacacgtgctaacttatatggaggacgctgtctgtcaactcctcgagaatcgcgaggatatttctcagtatgggattgctaggtttttcacggagtatttcaactcagtgtgccaaggaactcacattctgttccgggaattttcattcgtgcaggcaacacctcataatcgagtgtcttttctacgcgcattctggagatgcttcaggacagtgggcaagaacggtgacctgctgacgatgaaggagtaccactgtctgttgcaactactgtgtcctgacttccctttggagctcactcagaaggccgctcgcatcgtcctcatggatgatgctatggactgtctgatgagcttttctgattttttgttcgcctttcaaattcaattctactactcagagtttcttgacagcgtggccgcaatatacgaggatcttctgtctggaaaaaaccctaataccgtaatagtgccgacaagttccagcgggcagcataggcagcgccctgcactgggcggtgctggcactctcgagggcgtagaggcaagcttgttctatcaatgtttggagaatctttgtgatcgacacaagtattcttgcccaccgccagcccttgtaaaggaggcactttcaaacgtccagaggctcacgttttacggatttctcatggccctgtccaagcaccggggaattaaccaggcgctaggcgctctgccagataaaggagatctcatgcacgaccccgcaatggatgaggaactggagcgtctttag

SEQ ID NO: 53766 - DNA, 705 bp, Artificial Sequence
  Description of Artificial Sequence: Synthetic coding sequence
atgaaggaatatcactgcctgttacagctgttatgccctgacttccctctggagcttactcaaaaggccgcacggatcgtgttaatggacgatgctatggattgtctaatgtctttttctgatttcttgtttgccttccaaatacagttttactacagcgagttcctcgacagcgtcgccgctatttacgaggacctgttaagtggcaagaaccccaatactgtgattgtccccacttcatcatctggtcagcatagacagcggcctgccctagggggtgccggtaccctcgagggcgtggaagcgagtcttttctaccagtgccttgaaaacctgtgtgatagacataaatacagctgtccgccacccgctttggtgaaggaggccctgagcaatgtgcagaggttgacattttacggatttctgatggccttgtccaaacacaggggaataaatcaggctctgggggctctccctgataaaggcgatcttatgcacgaccccgcaatggatgaagagctggagcgcttgctggcacaggtcccagggctggttaactccgttaccgccagtccggaggcctcctgcctgcctagccgcacacctcccagggttggctctccctggagacctctgcaccactcaagaaaggtggatggcgagagcgatggctctaccgaagagaccgatgagtctgaaacttag

SEQ ID NO: 53767 - DNA, 744 bp, Artificial Sequence
  Description of Artificial Sequence: Synthetic coding sequence
atggagttgcccggtagcagcttgaacaatcttctcacaatgaaagagtaccactgcctcctgcagctgctctgcccagactttccactggagttaactcagaaagccgctaggattgtgctaatggatgatgccatggattgtctcatgtctttctctgatttcctgtttgcttttcagatccaattctactactccgaattcctcgattcagtagccgctatctatgaagaccttctgagcgggaagaatccgaatacggtgatcgtccccacaagtagctcaggacaacatcgacagcggcctgccttggggggagccggaactctggagggggttgaggcgtccctcttctaccagtgtctggagaatctctgcgaccgtcataagtactcctgtccgccaccggctttggtgaaagaggctctctccaacgtgcagcgtctgacattctatggctttctgatggccttgagcaaacaccgaggtattaaccaggctcttggggctctccctgataaaggagatctgatgcatgatcccgcaatggacgaggaactggaacgcttactagcccaagtaccagggcttgtgaactccgtcactgccagcccagaggcatcatgcctcccatcacgtacccctccaagagtcggcagtccctggagacccttgcaccactccagaaaagttgatggagaatctgatggatctactgaggaaacagacgaaagcgagacttag

SEQ ID NO: 53768 - DNA, 981 bp, Artificial Sequence
  Description of Artificial Sequence: Synthetic coding sequence
atgttgtcaccagagaggctggccctgccagattacgagtatctggcccagagacacgtgctcacctacatggaggatgcagtatgccagctcctcgaaaatagggaagacatcagccagtatgggatagcaaggtttttcacagaatacttcaactctgtttgtcaggggactcacatcctgtttcgggagttttctttcgtgcaagctacacctcacaatcgtgtcagcttcctaagggctttctggcgctgtttcaggactgtaggcaaaaatggagacctgctcaccatgaaggaataccactgcctgctgcagttgttatgtccagattttcctctggagctcacccagaaggccgctagaatcgtgttgatggacgacgccatggattgtctgatgtctttcagtgacttcttatttgcctttcagattcagttctattacagcgagttcctcgatagtgttgcagccatatacgaagaccttctctcaggcaagaatccaaacacagtgatcgttccaacaagtagttcaggccaacataggcagcgcccagccttgggaggagcaggaaccttagagggagtggaggccagccttttttaccagtgtctggagaacttgtgtgacagacacaaatactcctgtccacctccggctctggtgaaagaggcccttagcaatgtgcagcgattgaccttctacggatttctgatggccctgagcaagcatcgcggtattaatcaggcactaggagcgttgcccgataagggagacctaatgcatgaccctgctatggacgaagagctggaaaggctagttgttcgaagtaagctgcatagaaccagtaggcaacatcgggctaaagaacctggggcattcggattccaaagacgagaaaaacaggaggcacttgaacgcgtttcatccgcttccgtgccaaccccctaccattacagatgggagccacgagaatag

SEQ ID NO: 53769 - DNA, 732 bp, Artificial Sequence
  Description of Artificial Sequence: Synthetic coding sequence
atggcagccagctccatcagttctccctggggaaaacacgtgttcaaggcaatcctcatggtgctcgtggccctcattcttttgcatagcgcactggcccagtcccggagggatttcgccccacccggtcaacagaagagggaggccccagtagacgtgttaactcagatcggccgatccgtccggggaacgctggacgcatggatcggcccagagaccatgcacttggtttccgaatcatctagccaggtgttgtgggccatctcctctgctatcagcgtcgctttctttgctctctctggtatagctgcccagcttctgaatgccctgggattggccggagattatctggcccagggcctaaagctgagtccaggacaagtccaaacttttctattgtggggggcaggcgctctcgtggtgtactggctgcttagccttctgctgggtctcgtgctggcactcctggggcgtattctgtggggactcaagctggtgatctttcttgctggcttcgttgccttgatgcgcagcgtccctgacccttctactcgggctctcctattgctcgctctgctgattctctatgcactgctttcaagacttactgggtcaagagccagcggcgcacagttggaggctaaagtccgagggctcgagcgccaggtcgaggagctacggtggaggcaacgaagggcagcgaagggagccagaagcgttgaggaagagtag

SEQ ID NO: 53770 - DNA, 366 bp, Artificial Sequence
  Description of Artificial Sequence: Synthetic coding sequence
atgagcacactgtttccatctctttttcccagagtgacggaaactctatggtttaacctcgatcggccatgcgttgaggaaactgaattgcagcagcaagaacaacagcaccaggcatggctccagagtatcgccgaaaaagataacaacttagtgccaattggcaagccagcctcagagcactacgacgacgaggaagaagaggacgacgaagatgatgaagacagcgaggaagattctgaagatgacgaagatatgcaagacatggacgaaatgaacgactataatgaatctccggatgatggagaagtcaacgaagtggatatggaaggtaatgagcaggatcaagatcaatggatgatctag

SEQ ID NO: 53771 - DNA, 366 bp, Artificial Sequence
  Description of Artificial Sequence: Synthetic coding sequence
atgtcgactctgtttccatcgctgtttccaagagtcaccgaaaccttgtggtttaatcttgaccgaccctgtgtggaggagacagagctgcaacaacaggaacagcagcatcaggcctggctgcaatcaattgccgaaaaggacaataaccttgtcccgattggcaagcccgcttctgagcactacgacgacgaagaggaagaggacgacgaagacgatgaggacagtgaggaggatagcgaagacgatgaagatatgcaggatatggatgaaatgaatgattataacgagagccccgatgacggcgaggttaacgaggtagacatggaaggcaatgaacaggatcaggatcagtggatgatttag

SEQ ID NO: 53772 - DNA, 366 bp, Artificial Sequence
  Description of Artificial Sequence: Synthetic coding sequence
atgtccactttgttcccctccctgttcccgagggtgactgagactctgtggttcaacctggatcggccatgcgttgaggagacggagcttcagcaacaggagcagcagcatcaggcctggctccagagtatagcagagaaggacaacaacctggtgcccatcgggaaaccagcttccgagcattacgatgacgaagaggaagaggatgatgaagacgacgaagacagtgaggaggactctgaggatgatgaagacatgcaagatatggatgaaatgaacgactacaatgaaagtcctgacgacggcgaggtcaacgaagtcgacatggaaggcaacgaacaggatcaggaccagtggatgatttag

SEQ ID NO: 53773 - DNA, 366 bp, Artificial Sequence
  Description of Artificial Sequence: Synthetic coding sequence
atgtccactcttttcccctcactttttccaagggtaaccgaaactctatggtttaatctcgaccgtccttgtgttgaggagactgagttacagcagcaggagcaacagcatcaagcctggctccaatctatcgcagagaaggataacaatctggtccccatagggaagccagcgtccgaacattacgatgacgaagaggaggaagacgatgaggacgatgaagactctgaagaggattccgaggacgatgaagacatgcaggacatggacgaaatgaatgactataacgaatcgccggatgatggagaagtgaatgaggtcgacatggagggcaacgaacaagaccaagatcagtggatgatctag

SEQ ID NO: 53774 - DNA, 138 bp, Artificial Sequence
  Description of Artificial Sequence: Synthetic coding sequence
atgtcaactttgtttccctctctatttccccgtgtgactgagactctttggtttaatcttgatagaccttgcgtggaggaaacagagctccagcagcaggagcagcagcatcaggcttggctccagtccatcgcatag

SEQ ID NO: 53775 - DNA, 366 bp, Artificial Sequence
  Description of Artificial Sequence: Synthetic coding sequence
atgtctaccctgtttcctagtttgttcccgagggtcaccgagacactatggttcaacctggacagaccatgtgttgaggaaaccgaactccaacagcaagaacagcagcaccaagcttggctccagtcaatcgctgagaaggacaacaacctggtaccaatcggcaagccagcgtcagagcattacgacgatgaagaggaggaggatgacgaagacgacgaggatagcgaggaggattctgaggatgatgaggatatgcaggatatggatgagatgaatgactacaacgagagtcctgacgacggagaagttaatgaggtggatatggagggcaatgagcaggaccaagatcagtggatgatctag

SEQ ID NO: 53776 - DNA, 198 bp, Artificial Sequence
  Description of Artificial Sequence: Synthetic coding sequence
atgtcaaccttgtttccttctctattccccagggtgaccgaaacactgtggttcaatctcgatcggccttgcgtcgaagaaactgaattacagcagcaggaacagcagcatcaggcttggctccaaagtatcgctgagaaggataacaatttagtcccaatcggaaagcccgctagtgagcactacgacgacgagtag

SEQ ID NO: 53777 - DNA, 366 bp, Artificial Sequence
  Description of Artificial Sequence: Synthetic coding sequence
atgtccactctgttccctagcttgttccctcgcgtcacagagacgctgtggtttaacttagatcgtccctgtgtggaggagaccgagctgcagcagcaggagcagcaacatcaagcttggctccagagtattgcagaaaaggataataacctcgtacctatcgggaaacccgcatctgaacactatgacgatgaggaagaagaggatgacgaggatgatgaggattctgaggaagattctgaggacgacgaagatatgcaagatatggatgagatgaatgactacaatgaatcccctgatgatggcgaggtcaacgaagttgatatggaaggcaatgagcaagaccaagatcagtggatgatatag

SEQ ID NO: 53778 - DNA, 372 bp, Artificial Sequence
  Description of Artificial Sequence: Synthetic coding sequence
atgggtaacagggtctgttgcggcggaagctggagctgtccctccacttttcaaaagaagaagaagaccggcagccagacgcgacgaacgcttaagccccagccgcagcagctccagcaaaacttgccaaaggggcatgagaccacagggcacacctacgagcgcgtgctgcagcaacagggctctcaggagcgatcccccggactgatgtcagaggattctaatctgcactacgccgatatccaagtctgttcccgcccacatgccagagaggtgaagcatgttcacctggagaatgcgacagagtacgccacactgagatttccacaagccactccacgttatgatagtaaaaatggcacactcgtgtag

SEQ ID NO: 53779 - DNA, 135 bp, Artificial Sequence
  Description of Artificial Sequence: Synthetic coding sequence
atgggcaacagggtgtgttgtggaggctcctggagctgtccctccacattccagaagaagaagaagacggggagtcagacgagaaggaccctcaaaccccagccacagcaattgcaacagaatctacctaagtag

SEQ ID NO: 53780 - DNA, 711 bp, Artificial Sequence
  Description of Artificial Sequence: Synthetic coding sequence
atgcctgggagccctgtgactagtgggtattacggcgttaggcgtagcttcctgagtgactcagactttcacaacagtaagcagttcagtaatgatgtgtatacaagctctgtaggcaagccttttccctgcgagagttccgccggacagagtcacgctgccctgctggagccctattttccacaagagccctatggggactacagacctccagcattgactccgaatgccggatcactgttctccgcttcccctctcccccctttactccctccaccctttccaggagatcccgcacacttccttttcagagacagctgggaacaaacactgccagacgggctgtctcagccggaccctgtctccgcggacgcacttctaactctgccaccaagcaccagttgtctctctcagttggagtccgggagcatcgcccaacaccggggttcctcttgggggagctctctggccggtgcccagagctattcactgcacgcgttagaggacctgcatcacacccccggataccctacaccgcctccatacccttttactccatttatgaccgtgagtaatgacctgccgcctaaagtggggcctctctcccctgacgaagaggcagataccggaagcctccatgacccctccccatgggtaaaagaggatggcagcatcgcatgggggtcttacgagtgtcgccgagcatactag

SEQ ID NO: 53781 - DNA, 366 bp, Artificial Sequence
  Description of Artificial Sequence: Synthetic coding sequence
atgatgcgctctatcttcctcccccatcgcaagctgatctgttcgaggcgcggacatctggaccctcggggttgggaagaggacgaaaagatcctcgtgcctgacgccattccaacgctgcctccttatgtttttatccgaacagatcaggcttgtgtcaaggtgtaccccggtttcgtgttaattcggaacggaaaaactcataggcacaggggggattgccacgaagaagaggtgtgtgcccacagaacattagagacaggagggatggcatgccacgtgggtcctcatggcgagggcccaagtctgtggggcttttggggtagctggaagcaggttctgttttttttacctgtggaccattag

SEQ ID NO: 53782 - DNA, 879 bp, Artificial Sequence
  Description of Artificial Sequence: Synthetic coding sequence
atgagccgtatccccctggggaaagtgcttttaaggaacgtgattcgtcataccgacgcgcacaacaagatccaggaagaatcggacatgtggaagatcagagaactggaaaagcaaatggaggacgcgtatcggggtacgaaaagaaagatgctgcccagctcttcgagtcgaatgcgatccgatgggttcgacgaagagtctcagcgctactattggcgtcctaagaatgagatcagtggcactctcgaagatgatttcctgaaagccaaaagttggaataaaaaattctatgactatgaagccaacatgccagatcgctgggggcactccggatacaaggaattgtacccggaggagttcgagactgacagcgatcagcaggatatcactaatgggaagaagacctcccctcaggtaaagtcgagtactcacgagagccgaaaacacaagaagtctaagaaatctcacaagaaaaaacaaaagaagcgttcccataaaaaacagaaaaaaagcaaaaaagaggctactgacattacggccgattcctccagtgagtttagcgaagagacaggtgcttctggtacgaggaagggcaagcagccacataagaggaaaaaaaagagtcgcaaaaagagtctcaaaaaacccgcactctttctcgaggctgaatctaacacttcacactcagatgactctgctagctcttcctctgaagagtctgaagagcgagataccaaaaaaactaaaaggaaaaagcgcgaaaagaaggcacacacctccgtagcaaataacgagatccaagagaggacgaataaacggaccaactggaaggtcgccacagatgagcgctcagcagagtcctctgaagatgactag

SEQ ID NO: 53783 - DNA, 882 bp, Artificial Sequence
  Description of Artificial Sequence: Synthetic coding sequence
atgtcacgtatacctctcggaaaggtgctgttgcggaacgtaataagacacacagacgcccataacaagatccaggaggaatcggatatgtggaagatccgggagttagaaaagcaaatggaggacgcctatcgcggaacgaaacgtaaaatgctgccatcatcttcaagccgaatgcgcagcgacggctttgacgaggagagccagagatattattggagaccgaagaatgagatatcagggaccctggaggacgactttcttaaggccaaatcatggaataaaaagttttatgattatgaggccaacatgcccgaccggtggggacacagtggctacaaggaactgtacccagaagagttcgagactgattcaagcgaccagcaggacatcacaaatggtaagaaaaccagccctcaagtcaaatccagtacccacgaatcccgcaagcacaagaagagcaaaaagtcacataaaaagaaacagaaaaaacgtagccataagaaacagaagaaatctaagaaagaggctactgacataactgctgattcatcgtcggagttcagtgaagagacaggcgctagtgggactcgcaaagggaagcagccccataaaagaaagaagaagagcagaaaaaagagcctgaagaaaccggctctattcttggaggcagagagcaatactagtcattccgacgactccgcctcatcctcaagcgaagagtcagaagaacgcgatactaagaagacgaaacggaagaaacgagaaaagaaagctcacacatctgtggcgaacaatgagatccaagaacggactaataagcgtaccaactggaaggtggccaccgacgagaggtctgccgagtcaagcgaggacgattag

SEQ ID NO: 53784 - DNA, 444 bp, Artificial Sequence
  Description of Artificial Sequence: Synthetic coding sequence
atgaaccccgcaaataccagatcgcaaaggaaccctactaagaagcaaaagaagaggtcccacaaaaagcagaaaaagagcaagaaggaagctaccgacattacagctgactccagtagtgagttctccgaggaaaccggagccagtggcactcggaagggaaagcagcctcacaagcggaagaaaaagagtcgaaagaagagccttaaaaagcctgccctgtttctagaggccgagtcaaatacgtcccattctgacgatagcgccagcagtagctctgaggagtccgaggaaagagatacaaagaaaactaagaggaagaagagagaaaagaaggcccatactagcgtggccaacaatgagattcaagagcgcactaacaaacgaacaaactggaaggtggcaactgacgaaagatccgccgaaagttccgaagacgactag

SEQ ID NO: 53785 - DNA, 879 bp, Artificial Sequence
  Description of Artificial Sequence: Synthetic coding sequence
atgagccggatccctctcggaaaggtccttctccggaacgtgatccgacacactgatgcccataacaaaatccaggaggagtcagacatgtggaagatccgggagttggagaagcagatggaggacgcgtatagagggaccaaaaggaaaatgctgccgagtagtagctctcggatgcggagcgacggcttcgacgaggagagtcagcggtactactggaggcccaagaacgaaatcagtggaacccttgaagacgatttcctgaaagctaagagttggaataagaagttttacgattatgaggcgaacatgcccgaccggtgggggcatagcggatataaggaattgtaccccgaagaattcgaaactgactccgatcaacaagacatcactaacggaaagaaaacctccccacaggtcaagtcatcaacccacgaatctcggaaacataagaagtctaagaagtcccataaaaaaaaacaaaaaaagcggtctcataagaagcagaaaaagtcgaagaaggaggctacagacattaccgcagatagtagctctgaattttctgaagagaccggggcaagcggtactcggaagggaaaacagccacataaaagaaaaaagaaaagtcgcaagaaaagtctaaaaaaacctgctctttttctcgaagccgaatccaatactagccatagcgatgacagcgccagctctagtagtgaagagagcgaagagagagatacaaagaaaacaaaaaggaaaaaacgcgaaaagaaggcccacacatccgtggctaacaatgaaatccaagagaggaccaacaaacggacaaactggaaggttgctactgacgagcgctctgccgagtcctcggaagatgattag

SEQ ID NO: 53786 - DNA, 648 bp, Artificial Sequence
  Description of Artificial Sequence: Synthetic coding sequence
atgtggaaaattcgggagttagagaaacaaatggaggacgcttatagaggaacaaaaaggaagatgctgcccagctcgtcaagtagaatgagatctgacggattcgatgaggagagtcagaggtactattggcggcctaaaaacgagatctccggtacactggaggatgatttcttgaaagcaaagagctggaacaagaagttttatgactacgaggcaaatatgccagaccggtggggacactctggatacaaagagctgtatcctgaagagtttgagacggatagttcagaccagcaagacatcaccaatgggaagaagacttcaccacaggttaaaagttccacgcacgagtcacggaagcacaaaaagtcaaagaagagtcacaaaaaaaagcaaaaaaaacgtagccacaaaaagcagaaaaagtcgaagaaagaggctactgacatcaccgcggattcttcctctgaattttcagaggagacaggggcttctggcactcgtaaaggcaagcaaccacacaagcgcaaaaagaagagtcgcaaaaaatccctgaagaaacctgcactgttcctggaggcagagagtaacacatctcacagtgatgattcagcttcctccagctccgaggagagcgaagaatag

SEQ ID NO: 53787 - DNA, 276 bp, Artificial Sequence
  Description of Artificial Sequence: Synthetic coding sequence
atgtccaggattcctctgggcaaagtcttgctgaggaacgtgattagacatactgacgcccacaacaagatacaggaagaatcagacatgtggaagatacgagagttggaaaagcagatggaggacgcctataggggcacaaagaggaagatgttgcccagctcaagtagtcgcatgaggtcggatgggtttgatgaggagagtcagagatattactggcgacccaaaaatgaaataagcggcacactcgaggacgatttcctgaaggccaaatag

SEQ ID NO: 53788 - DNA, 795 bp, Artificial Sequence
  Description of Artificial Sequence: Synthetic coding sequence
atgtggaagatccgcgaactggaaaaacaaatggaggatgcgtatagaggtaccaagcgcaaaatgctcccatcatcgagttccagaatgagatctgatggattcgatgaagaatcccaaagatactactggcgaccaaaaaatgagattagcgggaccttagaggatgactttctgaaggcgaaatcctggaacaagaaattctacgattacgaggctaatatgccagaccgttggggacattcaggttacaaggaactttatccagaagagttcgaaacagactcctccgatcagcaggatattacaaatgggaaaaaaacatcgccacaagttaagagctccacacacgaaagccggaaacacaagaaatcaaagaaatcgcataagaaaaagcaaaagaaaagaagccacaagaagcaaaagaaaagtaagaaggaggctacagacatcactgctgacagctcaagcgaattctctgaggagactggtgcctccggaaccagaaaggggaaacagccacacaagcgcaaaaagaaaagccgcaaaaagtccctgaagaaaccagcactgttcctcgaggccgagagtaatacatctcatagcgacgatagcgccagcagctctagtgaagaaagtgaggaacgagataccaaaaaaaccaaaagaaagaagagggaaaagaaggcacatacatcagttgcgaacaatgagatacaggagcggacgaataagcgtacgaattggaaggtcgccactgatgagcgctcagccgagagctcagaagacgactag

SEQ ID NO: 53789 - DNA, 879 bp, Artificial Sequence
  Description of Artificial Sequence: Synthetic coding sequence
atgtcacggataccactagggaaagtgctgctcaggaatgtgattaggcacaccgacgcgcataacaaaatccaggaggagtcagacatgtggaagataagagagctcgaaaagcagatggaggacgcctaccgtggaaccaaaagaaagatgctcccctcctccagttctagaatgaggagtgacggattcgacgaagagtcacagaggtactactggcgtcctaagaatgaaatcagtggtactctggaggatgactttctgaaagcaaaaagctggaacaaaaagttctacgactatgaggcaaatatgccagacaggtgggggcactcagggtacaaagagttgtaccctgaggagttcgaaacggattccgaccagcaggatatcacgaacggcaaaaagacgagcccccaggtgaaatcttccacccacgagtcccgcaagcacaaaaagtcgaagaaaagtcacaaaaaaaaacaaaagaagcgcagccacaaaaagcagaagaaatctaaaaaagaggcgaccgacatcactgcagattcgtcgagcgaatttagcgaggaaaccggcgcatctggcacgcggaagggaaaacaaccccataagaggaagaagaaatccaggaagaagtcccttaagaaaccggctctgttccttgaggccgaatctaataccagtcactccgacgattcggcgtcctcatcctcagaggagagtgaagagcgtgatactaagaagaccaaaagaaagaagagggagaagaaggctcacacttcagtcgctaataacgagatccaagagcgtactaataaaaggaccaactggaaagtagccaccgacgagagatcggccgagagttccgaagacgactag

SEQ ID NO: 53790 - DNA, 1167 bp, Artificial Sequence
  Description of Artificial Sequence: Synthetic coding sequence
atgaaaacccttatcgctgcttactctggggttctgaggggcgagcggcaggcggaagcagacaggtcacagcgcagccatggaggacccgctttaagtcgggagggatcaggccgatggggcacaggctctagcatcctgtctgccctgcaggacctctttagtgtgacctggctgaaccgcagtaaagttgagaaacagctacaggtgatctccgtcttacagtgggtcttaagcttcctcgtgttgggggtcgcgtgctcggcaattttgatgtacatcttctgtactgactgttggctgattgcagtgctctatttcacgtggcttgtctttgactggaacacccccaaaaagggaggccgtaggagccagtgggtgagaaattgggcagtgtggcggtattttcgcgactatttccccatccaattagtgaaaacgcacaacttgctaacaacccggaactacatattcggataccatcctcatggcatcatggggttgggagccttttgcaacttcagtaccgaagccaccgaagtctcaaagaaatttcctggcatccgcccttacctggccacacttgcaggaaactttagaatgcctgtgttacgggagtatctgatgagcggaggtatctgtccggtgagcagagatactattgattatctgctgtccaaaaacggtagcggaaacgctattataattgttgtggggggagcagccgaatccttgtcttccatgcccggaaaaaatgctgtcactctgcgaaacagaaagggtttcgtgaaattggccctgcgtcacggggcagatctggtgcccatttactcttttggcgagaatgaagtctacaaacaggtgatatttgaggagggatcatggggacgctgggtgcagaagaagtttcagaagtatatcggcttcgctccatgtatcttccacgggcgtggactcttctcgtccgacacatggggtttagtaccctacagcaagcccatcacaacggtggtgggggagcccatcacaattccaaaactggagcaccccacacaacaggatatcgatctgtatcacaccatgtacatggaggcactcgtgaagctgttcgacaagcacaaaactaagttcgggctgcccgagacagaagttctggaggttaactag

SEQ ID NO: 53791 - DNA, 420 bp, Artificial Sequence
  Description of Artificial Sequence: Synthetic coding sequence
atgggagcagggaagaaggagcatacaggcagacttgtgattggagatcacaaaagcacaagccactttagaaccggcgaggaggacaagaagattaatgaagagctggagtcacagtatcaacagtccatggattctaaactgtctggacgatatcgcaggcattgtggtctcgggttctccgaagtcgaggatcacgacggtgagggagacgttgccggtgatgatgacgatgatgacgatgatagccccgacccagaatcccctgacgattccgaaagcgattctgagtctgagaaagaggaatccgcagaagagctgcaggcagctgagcaccccgacgaggtggaagacccaaaaaacaagaaagacgcgaagtctaactacaagatgatgtttgtgaagtcaagtggttcctag

SEQ ID NO: 53792 - DNA, 1524 bp, Artificial Sequence
  Description of Artificial Sequence: Synthetic coding sequence
atggccgctccatgtgggtccgaactaccagcaaactcccccctgaaaattcccaaaatggaggtccttagccctgcatcaccaggcggactgtctgacgggaacccaagcctgtccgatccctcaacaccgagaggagcctcccctctggggccaggaagcgccgcaggctccggagccgctgcctccggcggactgggtctgggacttggaggcaggagcgccgctagtagttctgtctcctttagccctggcggagggggtggcggtgccgctgctgccgcagcagccgcatgcaggggcatgtcctggacccccgctgaaactaacgcactgattgccgtttggggtaatgagcgtctagtcgaagcacgctatcagcagcttgagggtgcgggtacagtcttcggatctaaggctcctggcccagctatgtacgagcgagtttctcgcgctctggccgagttggggtatgagaggactccgtctcagtgcagagagcggataaaggaactcgaatctgacggtagcacaatggaggactactcccaagaagactgggggaatcactctcaagacttgcacgggtatcccacagaccaagaactggacgaaatccccgtaacaaagcgcaccttaaagatcaagcaggagagcagcgaagaggcacaaaagcgggacattatgcaaaacatagtgcagatcctggagtccgtgcaactgaagtgggagctgttccagtcctggaccgatttctccaggctgcatctttcaaacaagttggcaatctttgggattggttacaataccagatggaaagaggacattcgctaccactatgccgaaatttccagtcaagtgcccctggggaagaggctaagagagtatttcaactccgagaagcccgagggccgtataatcatgacacgggtccaaaagatgaactggaaaaatgtgtactataaatttctcgaaattaccattagtgaggcccgttgcctggaactgcacatggagatcgattggatacccattgcccattctaaacccactggagggaatgtagtccagtatctactgcccggtgggataccaaaaagccccggactgtatgccatcggctacgaggagtgcattgaacggcctctgtctccgcatatggagcagagcagcctagaccctggcaaggagggccgagtggatcttgagacactgagtgctcaggcatcacttcaggtagagatcgaacctactagaattatctactgctacctgggaattgctgaggtaaggacccttcaacagtgcttatttcttcattttcaggcaaacaccaagacctttagcaaagattgggtgggcataaatggatttttatcccagaattgcatcgtagatcccggtgtgtcacccaagtcaatttacatcaaatttgtagaggtggaacgggacttcctctccgccggttctctggtcgagtgtctggagaaggccattggataccctttgaagtttaacaactag

SEQ ID NO: 53793 - DNA, 1680 bp, Artificial Sequence
  Description of Artificial Sequence: Synthetic coding sequence
atggctgcaccttgtggaagcgagctcccagcgaactcccccctgaagatccccaaaatggaggtgttgtcaccagcgtctccaggcggactttcagatggtaacccaagtctttctgaccccagcacccccagaggtgcctctcccctcggtcctgggtccgccgctggctccggcgcagccgctagcggaggcctcggtctaggcttgggcggacgctcagccgcttccagttctgtctccttcagtccgggagggggagggggtggggctgcggctgcagctgctgccgcttgcagaggcatgtcatggacccctgccgagaccaacgccttgattgccgtgtgggggaatgagaggcttgtcgaagcacgataccagcaacttgaaggtgcgggtacagtgtttggttctaaggctcctggcccagcaatgtacgagcgggtaagcagggctctggcagaactcggctatgagcgaacaccaagtcaatgcagagagaggattaagacactgcgaagatgttactcacgggtgaaggagcatggggtcggcaaacgtaaatcctcatacaccttcgaacaactggaacaggtgtttggacaaggagggtgggacgctcagccatgccaaccagttttgataaatagtagtggcctgtatcaggagttggaatctgacggatcaactatggaggactattcacaggaggattgggggaatcattcccaggatctccacggttacccgacagatcaagagctcgacgaaatccctgtgactaaacggacacttaagataaagcaagaaagttctgaggaggctcaaaagagggacattatgcagaacatcgtgcagattcttgagtctgtgcagcttaagtgggagctgtttcaaagctggaccgatttctcccgccttcatctgtcaaataagctggcaattttcggcataggatacaacacccgctggaaagaagatatcagataccactacgcagagatatctagtcaggtgcctttggggaagcgcctacgcgaatacttcaactccgagaaacctgagggtaggattatcatgacgagagttcagaaaatgaactggaagaatgtttactacaaattccttgagataactatcagcgaggcaaggtgtttggaactgcatatggagatcgattggatacccatcgcccacagcaaacccactggaggaaacgtggtgcagtacctcttgccagggggaatccctaaaagtccgggtctctacgccattgggtatgaagagtgcatagagagaccattgtctccacacatggaacagagttcactggacccagggaaagaagggagagtcgatctggaaaccttgtcagctcaggcaagcctgcaagtggaaattgagccgactaggatcatttattgctatcttggaatcgccgaggtaagaaccctgcagcagtgtctgttcttgcatttccaggccaataccaagacattttcgaaggactgggttggaatcaacgggttcctgtcgcagaattgcattgttgatcccggagttagcccaaaatctatctacattaagtttgtcgaagtggaacgcgatttcttgtcagccggtagtttagtggagtgcctcgagaaggccattggctaccccctgaaattcaataactag

SEQ ID NO: 53794 - DNA, 990 bp, Artificial Sequence
  Description of Artificial Sequence: Synthetic coding sequence
atggaggactacagccaggaagactggggaaaccacagtcaggacctccacggataccctacagatcaggagttggacgaaatcccggtaacaaagaggacactcaaaatcaaacaagagtcatcggaagaggcccagaaaagggacattatgcagaacatcgtgcaaatcctggagtctgtgcaattaaagtgggagctgtttcagtcttggacagactttagcagacttcatctgtccaacaaacttgccatttttggcataggatacaacacgcggtggaaggaagacattagataccactacgcggaaatctctagccaggtgcctcttggtaagaggctccgtgagtattttaattcagaaaaacctgagggcagaatcatcatgacaagagtgcagaaaatgaactggaagaacgtctattataaatttctggagatcactatctccgaggctcggtgtctggagctgcacatggaaattgattggatacccattgcgcattctaagcccacaggcggaaatgtggtgcagtaccttctcccaggtggtattcccaaatcaccaggcctgtatgctattggttatgaagaatgtatcgagcgtccgctctccccacacatggaacagagcagtctcgacccaggtaaagaaggcagagtggacctggaaaccctctctgcccaagcctctcttcaggtagagattgaacctacaagaatcatctactgctaccttggcatagcagaagtcagaacacttcagcagtgcctctttctccatttccaggcaaatactaagacttttagtaaggactgggtgggaattaacggcttcctgtcccagaactgcattgttgaccccggagtcagccctaaatcaatctacataaagttcgtcgaagtcgagcgggactttctgagtgccggatctctggttgaatgcctggagaaggctataggttatccactgaaattcaataattag

SEQ ID NO: 53795 - DNA, 1182 bp, Artificial Sequence
  Description of Artificial Sequence: Synthetic coding sequence
atgtggtggagagtgctgagcctgctggcctggttcccgttgcaggaagcatcactgacaaaccacactgaaacaatcaccgttgaggagggacagacgctgactctgaaatgtgtgaccagcctgagaaagaactcatctcttcagtggctgaccccttccggcttcaccatctttctaaatgaataccccgctctgaaaaactccaagtaccagctcctccaccacagcgccaatcagctgagtatcactgtgcccaacgtgactctgcaagatgaaggagtgtacaaatgtcttcactattctgattcagtaagcacgaaagaggtcaaagttatcgttctggccacaccattcaagcctattctggaggcttcggtcatccgaaagcagaacggggaggagcacgtcgttctcatgtgtagtaccatgcggagtaagccccctccgcaaatcacctggcttttgggcaacagcatggaagtcagcggtgggaccttgcatgaattcgaaactgacggaaaaaagtgcaacacgacgtcgaccctcataattcatacctacggcaagaactcaaccgtggactgtattatacggcaccgcggacttcaggggagaaaactggttgccccattcaggttcgaagaccttgtgacagatgaggagacggccagtgatgcccttgaacgtaactctcttagttctcaggatccacagcagccgactagcactgttagcgtgactgaggacagctcaacttctgaaatagacaaggaagagaaagaacagactacccaggaccctgacctcaccacagaggcaaatccccaataccttgggctggcccgtaaaaagtcaggaatcctcctgctgactctggtgtccttcctgattttcattctctttattattgtgcagctgtttatcatgaagttgaggaaggcgcacgtaatttggaagaaagagaatgaagtgtctgaacataccctggaatcctatcgcagccgttccaacaacgaagaaacctcctctgaggaaaaaaatggtcagtcttcccacccaatgaggtgtatgaactatattactaagttgtacagtgaggccaaaaccaaacgcaaagagaacgtacagcatagcaagctggaagagaaacatatccaggtgcccgagtctatagtgtag

SEQ ID NO: 53796 - DNA, 924 bp, Artificial Sequence
  Description of Artificial Sequence: Synthetic coding sequence
atgagcaagagaaaactcattcccaagcttagcatacagtccccagtgttgcatacaaatttgaacgtgcagagcacacatcctccactgaaaaaggaggatcttcatagaatctcaaaggactcccttgaaagtgactcagaatcgttgacgcaagagataatgtgtcactcagagtttgatgatcgcataaggggcaatggcatggagccagactccctggatgaggaagagtctccaaggtggggctcattgcacgaaatggaagaagaagcctccgggaaggccgcacaaatggcccgtgagcaaaatcaccacacttgggatcagggtgccaacaaccggcagcagcctattgaggacaagtattctgatctgcgatacgatcccaattggaagagcaagaaggaggaggggcaactgctatccgtggaggctctgcctgagtctacagacagctcgctagagaacctgcccctggctcctctgtatccatcccaggagaccagcatggagctgagcggcggtaagggcgaacaaaaggagagtccccagtctgctgcatcactgctgggttctgaattcctttcgccgaattacgagcacggagcccgtcgctccaagcccttctcggagctgtccgattctgatctggaggaaaagtcttcttccctgagcccctatgttaagagcagctcgtcacacaacgaggttttccttcctggctcaagagggcctaggcgtcggaagtccaagcagcactttgttgagaaaaacaagctgacgctagggctacctacaccaaagaccgacagctacctgcaactacacaacaaaaagagaggcgaatcccaccctgaacaggtgatcctacgggtgaactctctgcctcgagatggcttcaaaaccttttggtcacagtag

SEQ ID NO: 53797 - DNA, 2337 bp, Artificial Sequence
  Description of Artificial Sequence: Synthetic coding sequence
atgagcaagcgtaaactcatcccaaagctctctattcagtcacccgttcttcacaccaacctgaacgtgcagtcaacacacccccctctgaaaaaggaagatctccacagaatctctaaggacagtcttgaatctgactcagaaagcctgactcaagaaatcatgtgccactctgagtttgatgacaggatcaggggaaacggtatggaacccgattcattagacgaggaggagagcccccgttggggcagcctgcatgaaatggaggaggaggccagcgggaaggctgcccaaatggcacgcgagcagaatcatcacacatgggatcaaggcgctaacaaccggcagcagccaattgaagataagtactcagacctccggtacgatcccaattggaaatccaagaaagaggaaggccaactcctcagcgtggaggcactacctgagagtactgactcgtctcttgagaaccttccactggccccactatacccatcacaggaaacctccatggagcttagcggtgggaagggggagcaaaaggaaagtcctcagtctgcagcgagtctgctcggttctgaatttttgtcacccaattatgaacatggggcaagacgaagtaaaccattttctgagctgtctgattctgacctggaagagaaatcctcctctctctccccatacgtgaagtcaagcagcagtcacaacgaggtgtttctgccgggatccagaggccctcgcagacggaagtctaaacaacactttgtggaaaagaataagcttacactcggcctccctacaccaaagactgattcttacttacaactacataacaagaagagaggagagagccatccagaacagatctcctatcccgtgcgcgtgaccgacaagacctcgatccagaatgcgaaagagatggaaaacgctgctatcgatcccgaggacaagtggcatcaacgggcacagcagctgaagaattaccaggaacactggagtcaatatgagagcactaagtctagtaacgtgcccagggggcagccatcggatatggtcaacgaccaccaacccagccgccgtccagccaagctcaaaatcagaaagcagtgtaagcaccagaacgggctgaagtcatcaaccacagaagaggtgacagctagccagggcaatcagaataaccccccacgccaacaacagaatcagaataaacccctggataccagtactaagccagagtcgatcgttatcatgcacgcttcaaacaacgatgtgcaagcatctagggcacttcggtcccacaatctaaaagagaccagtaacacctttgcacccccaaagcaggccttcgacaaggtcctgtccaagaactcaacagggtgcgatagcgggctgaacgttaacaaagagaggggacacaaggaccaggaagagaaaaggttttcttaccagcagctgcatacgttgtctgatatggatctaaacaacttgaacgaactgtccaagagacatgtgctgctgtcacaaaaggggtcccagtttgtctatcacataaatacccacggttcaaccaaaaataaaaagcagctgaaacagccgtacacggaaactaagtacagaaacttggagatgttgtggaagtttcacagcagttccgacagtcagacagtgcgagcctctcctgattcttggctaacacagattatggaacaacaccagcaggcactcgtacagttaacagacgtgcaaccctctgaaggcgcactcagttccgtgactttacccccaattctttctcgcgtagagtcagagagccaactttcttccgagcgctcccagaggaaccaggttaaaatctctcggtcaaattccgaaggatatctcttccagctcgaaaaagggaagaagcataaaaagagaagttcttccaagaacacaaagctcaagggctaccagaaaagggacgtgaagttgggcggactgggcccagattttgagtccataagggataaaacacagaagctcatccagcaaaaagagtatgctaagcaggtcaaagagtataacatgaaaactctgagtattctatccaaaccccagaccgaaaagacccagaagaaatctgcaattccaagacagaaggcccttgagtacgctaagactattcctaagcctaagccctcaaacctgacccaccaggcaagtaaggagcagaaaaaccccacttacgcaggcaaggaggaaagcttgcctgaaattagcctattggagattctgcagaatagacacgagagggaaaagcaggccgtggcggcatttaaggttctgcatatcgtgtag

SEQ ID NO: 53798 - DNA, 942 bp, Artificial Sequence
  Description of Artificial Sequence: Synthetic coding sequence
atgccttggaaggaagagtctgagttcaccaagcaggacaaagcagcgagggtgatccagcaggcctggaaatcttttcttaacgttgccatttttcagcacttcaaaagcctgattgaccttaggagacagggcgaaccgagacaaatcgtcaagtacatcaaccccaaggaagcagaactgctggatgctgcggctggaatccacgtgcgatttcggcttgggggagtgaaattccctccagacatttattacaagatctttactcatcgcccaatcgaggacttgtgtgccaattcgccaagaaattacgcaaaactgccggctaaacacacgtctcacaataagaatgaccatttgcaggaggaagaccactcaggctggtatcacaggatcgagaataacgggtggcggccagtgagtgataccttttggttgtcgacagatgggatggtcgtggaggacaaaaaggaaagcgaattccacttcagcaaactgaagagacggcaggatttagagaagaagcgcaagcttcggaaaatcgagtggatgaggcagatgtattattctggaagtttggaggcaaagtctacccatcacgaaactctgggactgatacatactgcgaccaagggcttaatccgtgccttcgaagacgggggaatcgattcggtgatggaatgggaggtggatgaagtcctgaactggaccaatactctgaatttcgatgagtacatcgctagctggaaggaaattgctacgtccaactcctccgcaaacttcaaagggtttcgatttaatcaggcccaaaaaaacatctacaactacgggggagatatcagtaagatgcaaatggggatccctgacgacacctactacgagaacgtctaccaggagccaaacgttactcggctgaccccagattctacttatggactgtag

SEQ ID NO: 53799 - DNA, 942 bp, Artificial Sequence
  Description of Artificial Sequence: Synthetic coding sequence
atgccatggaaggaggagtctgagtttacaaagcaggacaaagctgcacgggtaatccagcaagcgtggaagtctttcctgaatgtggcaatttttcagcatttcaaaagcctaattgacctacggaggcagggcgagccacggcagatcgtcaagtacattaaccccaaggaagccgagctgctcgacgcggcagcgggaatacacgtccgctttcgcttgggcggagtgaaatttccgcctgatatctattacaaaattttcacccataggcccatcgaagatctttgtgcaaatagtcctcgaaattatgccaagctcccggcaaagcacacttcccacaataaaaacgatcatctgcaggaagaggatcatagtgggtggtaccatcgtattgagaacaatggatggcgcccagtgtcagacacgttttggctgtccacagacggtatggtggtcgaagacaagaaggagagtgagtttcacttcagcaaactgaaacggcgacaggacctcgagaaaaaacgaaaattgcggaagatagaatggatgcggcagatgtattattctggatccctggaagctaaatctacacatcatgaaacattaggactgatccacaccgcaaccaaaggtctgatcagagcattcgaggacggcggaattgactcagttatggagtgggaagtagatgaggtgctaaactggactaataccctcaacttcgacgaatatattgcaagctggaaagaaatcgccacctccaacagctcagccaattttaaaggatttcgtttcaatcaggcacagaaaaatatttataactatggcggagatatctccaagatgcagatgggtattcctgatgacacctattacgagaacgtgtatcaggagccaaacgtgacacgcctcacgcctgacagcacatatggcctctag

SEQ ID NO: 53800 - DNA, 369 bp, Artificial Sequence
  Description of Artificial Sequence: Synthetic coding sequence
atgacttcaccagagatcgcgtcgttaagctggggccagatgaaggtgaaaggctctaataccacctacaaagactgcaaggtgtggcctggcggtagcaggacctgggattggagagaaactggcacagagcattcgccaggtgtccagccggctgacgtgaaggaagtggtggagaagggcgtgcagactctcgtgataggccgtgggatgtcggaggcactcaaggtaccaagcagtaccgtggaatacttgaagaaacacggaattgacgtcagggttctgcaaactgagcaggccgtgaaagaatataatgcactcgtagctcagggggtacgcgttgggggagtcttccattcaacctgttag

SEQ ID NO: 53801 - DNA, 369 bp, Artificial Sequence
  Description of Artificial Sequence: Synthetic coding sequence
atgacaagtcccgaaatcgcttctctgtcttggggtcagatgaaagtgaagggatctaatacaacttacaaggactgtaaagtgtggcctggcggatcaagaacatgggattggcgagaaaccgggacggagcatagtccaggcgtgcagccggctgacgtgaaggaggtggttgagaaaggcgtgcaaactctcgtcatcggcaggggcatgtccgaggccctcaaggtgccatctagtactgtggaatatctgaagaagcacggcatcgatgtgagggttttgcagactgagcaggccgttaaggagtataatgcactcgttgcgcagggcgtgcgggttggtggggtatttcatagtacctgctag

SEQ ID NO: 53802 - DNA, 882 bp, Artificial Sequence
  Description of Artificial Sequence: Synthetic coding sequence
atggccgcagcagctgctgcagccgtggccggagtcgggaggggcggaggcggtgccgagcctagacaggaaagaagcagggcaagaggttgggccggagtggagcggagtgagggacgatcacgtatggaaccaggcgaagagctggaagaggagggttctcctggcggtcgcgaggacggttttacggcggagcatctggcggcagaggcaatggccgctgatatggacccatggctcgtattcgacgcaaggacaacacccgcaacagaactggacgcgtggttggccaagtatccaccatctcaggtgactagatatggcgatcccggttctccaaactctgagcccgttggttggattgcagtttacggtcagggttactctcctaattctggggatgttcagggtctccaggccgcttgggaagctctgcagacgtcgggtcgccctattactcctggtacgctgcggcagttagctattactcaccacgttttgagtgggaagtggttgatgcacttggccccagggtttaagttagatcatgcatgggcaggaatcgcccgtgccgtcgtggagggacagctccaggtcgctaaagtatcacctcgcgctaaagagggcggaagacaggttatatgcgtgtacactgatgatttcacggacagattaggcgtactcgaggccgacagcgcgatccgggctgccggaatcaagtgcctgttgacctataaacccgacgtttatacatacctagggatatatcgggcaaacaggtggcacctgtgtccaacgctgtatgaaagtagattccaactcggaggctccgcgaggggttccagggtactggaccgtgccaacaacgtcgagctgacatag

SEQ ID NO: 53803 - DNA, 879 bp, Artificial Sequence
  Description of Artificial Sequence: Synthetic coding sequence
atggcagcagccgctgctgcagccgtggccggagtgggacgcggaggcggaggtgctgagcctaggcaagaacggagtcgtgccagaggatgggccggagtggaacggtccgaaggcaggcgcatggagccaggggaggaactggaggaggaaggctcacctggagggcgagaagacggatttacagccgaacacctcgccgctgaggccatggccgctgacatggacccatggctggttttcgacgcccgaacgacgcctgcgacagaactggacgcttggttggcgaaatatcctccaagtcaagtaacaaggtatggagatccgggaagtccgaattctgaacccgtggggtggatagccgtgtacggacaggggtacagtcctaacagcggcgacgtacagggcctgcaggcagcctgggaagccctccagacctcaggtcgccctatcactcctggaacactccgccagctcgccattacacaccatgtgttgagcggcaagtggctgatgcatcttgctccaggatttaagctcgaccatgcgtgggctggtattgcaagggctgttgtcgagggacagctgcaggtggcaaaggtttcaccacgggctaaggaggggggacgccaagttatctgtgtatacaccgatgactttacagatagactgggagtcctcgaagccgactcggcgatcagggccgcaggcattaaatgtctgcttacctataaacctgacgtgtacacctaccttgggatctatagggctaatcgctggcacctatgtcccaccctgtacgagagtcgctttcaacttggcggatccgcaaggggatcacgcgtccttgatagggccaataatgtcgagctaacctag

SEQ ID NO: 53804 - DNA, 165 bp, Artificial Sequence
  Description of Artificial Sequence: Synthetic coding sequence
atgttggggagaattaaggcccaagcattcgggtttgatcagacattccagtcctaccgaaaggacgattttgttatgggatttttccagcgacccaaatgttacagccagttcgaggtcacatttcgctttttctggaccatggatcatatcagattctgctag

SEQ ID NO: 53805 - DNA, 804 bp, Artificial Sequence
  Description of Artificial Sequence: Synthetic coding sequence
atggccacgggggagctgggagatctggggggatattacttcaggttcctccctcagaagacatttcagagcctctcctcaaaggagattacgagtagactgcggcagtggtctatgctgggacgaatcaaagcccaggcattcgggtttgatcagacgttccagtcctatcggaaggacgatttcgtgatggcctttttcaaagaccccaatgtaataccgaatttgaaactgctgtcagactccagcgggcaatggattatacttggcacagaggtcaaaaaaatagaagcaatcaatgtcccttgtacccaattatcgatgtctttctttcatagactatacgacgaagatatcgtacgagactctgggcacatcgttaagtgtttagattccttttgcgacccctttctgatcagtgacgaattgaggagggtgcttctcgtggaggacagcgagaagtatgagattttcagccagccagacagagaagagttccttttctgtttatttaagcatctgtgcctcggtggagctctgtgtcagtatgaagatgtgatttctccctacctcgagaccacaaaacttatctataaggatctggtctcagtgcgtaagaacccacagacaaagaagatacagatcacctcctctgtgttcaaggtgagcgcttacgactccgcgggtatgtgctatccatccgccaaaaatcatgaacaaactttcagctactttattgtagatcctatccggcgacacctccatgtgctttatcactgctatggggtgggcgacatgtcatag

SEQ ID NO: 53806 - DNA, 300 bp, Artificial Sequence
  Description of Artificial Sequence: Synthetic coding sequence
atggctaccggggaactcggagacctaggcggatattattttagatttctgccgcagaaaacatttcagtctctaagttctaaggagattacatccaggctgaggcagtggtcgatgctcggtcgcattaaggcccaggcgttcggcttcgaccaaacgtttcagagttaccgaaaagacgactttgtcatggctttcttcaaagatcctaacgtaatccctaaccttaagctcttaagcgactcttccggtcagtggataattcttggctttgcttcaggccgtctgcgtaagatttag

SEQ ID NO: 53807 - DNA, 444 bp, Artificial Sequence
  Description of Artificial Sequence: Synthetic coding sequence
atggctctgaacaacgtcagcctgtctagtggcgatcagaggtctcgcgtggcatacaggtctagtcatggggacctccggcctcgcgcaagtgcgctggctatggtgtcgggggacggtttcctcgtgtcacgcccagaagccatccacctcggccctaggcaggctgtgcggccatccgtaagggcggagtcgcgacgggtggacggcggaggacgcagccccagagaaccagacggcagaggccgatcccggcaggcccgttttagcccataccctattccggctgttgaacccgatcttcttcgcagtgttttgcaacagcgtctcattgctctcggtgtgactacctggactctgaagctgagcgagtccgccaccccagacctaaggtggtgttcaacctgttcccacagcaacatctttgagattctggtgatctag

SEQ ID NO: 53808 - DNA, 756 bp, Artificial Sequence
  Description of Artificial Sequence: Synthetic coding sequence
atgactcaattgcccgaactgggcctcaggagcccaaacaacaaaagtccgaccggtccccaccctttggaacatcttttggctcggctcctgaagaggcggagaagatcaacactgatgtctagccctaggtccctcctctgctccatcagcgggccaggatcccatctgctctccacccaccccattctatgtcactctgtctaccaaccaccacaacccgcatcaagaccacaggctaagcgctaccaagggctgctgcctgtgccattagcccctcacccattgtgtctgagcggtcagctctatctccccaacatcccatgcactgtgatcgacggctgtggacccgtaatctctcatttgaaactgaccatgtacccttggggattacccccaagtcatcttggcagctcctcaccttttagtgctaatatggagcagtgggattattacaagagtcaaacacgattcgcgccattcctacccgagtctttctgtgggtcaccactgccttcagaacagagcagccggccttttggcctggcttttaaagtactctgtgccgctacctgccagcccccacagtttcaactgctttggctgtgtccatacaagcttgacctccatcaacgaatctgtctcccacctaatctggctttagtgttattaggggctctttggacgagccccccaccgggatccttcctacagccaccttataacaggccgtacaagctctacaagacaaattag

SEQ ID NO: 53809 - DNA, 756 bp, Artificial Sequence
  Description of Artificial Sequence: Synthetic coding sequence
atgactcaactgcccgaactcggactgcgttctcctaacaacaagagtcccaccggccctcatcccctggaacatctcttggctcggcttttgaagaggaggcgcaggtccactctcatgtcatctccaagatccctgttatgtagcatcagcgggccagggtcccatttgctgagcacgcacccaattttatgccactcagtataccaaccgcctcaaccagcttcgcgcccacaggcaaaacggtaccaaggcttgttgccggtccccctcgcaccacacccattatgcctttccgggcaactctacttgcctaacatcccttgcacggtcatcgacgggtgcgggccagtgattagtcacttaaagctgaccatgtacccttggggcctgcctcccagccatctcgggtcctcaagccctttctcagctaatatggagcagtgggattactacaagagtcaaacgcgctttgctcccttccttcccgaatcgttttgcggttccccactgccaagcgaacagtcttcaaggccctttggcctggcctttaaggtcctctgcgcagccacatgtcagccgccacagttccagctattatggctgtgcccttacaaactcgacctgcatcagcgcatttgcctgcctcccaatctggctcttgtgctacttggtgccctctggacatccccaccaccaggctcctttctgcagccaccttataatcgaccatacaaactttataagacaaactag

SEQ ID NO: 53810 - DNA, 666 bp, Artificial Sequence
  Description of Artificial Sequence: Synthetic coding sequence
atgtcagctcacatgagcggcctggagataatggatgaggatcaactgatcaaggatgtgctggacaaattcttaaattgtcacgagcaaacctacgatgaggagttcctcaatacattcacgcacctgagtcaggaggatcatgtttccaagcggggtgtatttggcactgattcttctgaaaatattttcacttccgccaaggtgacccacaagaacgaggccgacgactatcatctacggaacaaaactatatttctgaggacatctagccagtgtctggaggaacaagtggacaacttccttgatctcgaagatctcgatatggatgaggagattaagccgcagatgagcgaagacctgctattgctgcctggtgaagtagagcaggacgtgagcacaagtataccaagctgtattccgttcgtcgcccagccccctacctgcgaggttaaacctaagccctctgtgaaacggatggataagcagactgaggagattctcggtgacgaggtacagcttttctctctcgacgaggagtttgactatgataatgttatgctaacatccaagttctcaccagcggagatcgagaacatcaaggagctttgtaagcagcagaagaggaaggacacgtcccctgatctcgagaagtcatgtgactag

SEQ ID NO: 53811 - DNA, 444 bp, Artificial Sequence
  Description of Artificial Sequence: Synthetic coding sequence
atgagcgcccacatgagcgggctcgagattatggatgaggaccagctgattaaagacgtgctggacaaatttctgaattgtcatgagcagacttacgacgaggaatttcttaacaccttcacacacctttcccaggatctgctcttgctacccggagaggttgaacaggatgtgagtaccagtatcccgagctgtatcccctttgttgctcagccacctacctgcgaggtgaagcctaagccaagcgtcaagagaatggacaagcagaccgaagagattctgggagacgaggtgcagctgttttctctcgacgaggagtttgactacgacaatgtcatgctaacttctaaattttcgcccgctgagatagaaaatatcaaagagctttgcaagcaacagaagcgcaaggacacaagtccagatctggagaagagctgcgattag

SEQ ID NO: 53812 - DNA, 504 bp, Artificial Sequence
  Description of Artificial Sequence: Synthetic coding sequence
atgtcggcacacatgtctgggttggagattatggacgaggatcagctcatcaaggacgtgctggacaaatttcttaactgtcacgagcagacgtatgacgaagagttcctgaacacattcacacatctgtctcaggaggatcatgtcagcaaaagaggggtcttcgggacggattcgtccgagaatatttttacgagcgcaaaggtgacccacaaaaacgaagctgatgattatcacctgcgcaacaaaactatctttcttagaacgtcttcacagtgtctggaagagcaggtggacaatttcctcgatctcgaggatctagatatggacgaggagatcaagccccagatgagcgaagatctgcttctgcttccaggggaagtggagcaggatgtgagtacctctattccttcttgtatcccattcgtcgcccagccgccaacgtgcgaggtaaagcccaagccttcagtgaaacgaatggataagcagactgaagagagttag

SEQ ID NO: 53813 - DNA, 273 bp, Artificial Sequence
  Description of Artificial Sequence: Synthetic coding sequence
atgtctgctcatatgtcaggcctagaaattatggacgaagatcagctgattaaagacgtcctggataaatttctgaattgtcacgagcagacctatgacgaagaatttctcaataccttcacacatctgtcacaggatctcctgctgctcccaggggaagttgagcaggacgtgtctacatcgatcccctcgtgcattcccttcgtggcccagccccctacatgtgaagtgaaacctaaaccctctgtcaaacgaatggacaaacagacttag

SEQ ID NO: 53814 - DNA, 252 bp, Artificial Sequence
  Description of Artificial Sequence: Synthetic coding sequence
atgtcagcgcacatgtcaggactcgagattatggatgaggatcagttaataaaagacgtgctagacaagttcttgaattgtcacgagcagacttacgatgaagagttcctcaacacgtttactcacctctcacaagaggatcacgtttccaagagaggggtgttcggcacagattcctctgagaatattttcacatcagctaaagtaacccacaaaaacgaggcagatgattatcacctgagaaataaatag

SEQ ID NO: 53815 - DNA, 543 bp, Artificial Sequence
  Description of Artificial Sequence: Synthetic coding sequence
atgtctgcacacatgagtgggctcgaaataatggacgaggatcagctgatcaaggatgtgcttgataaattcctgaattgtcatgagcagacctacgatgaagagtttctgaatacttttacacatctgtcacaagaggatcacgttagcaaacgtggtgtctttggcaccgactccagcgagaacatctttactagcgcgaaggtgacccacaaaaacgaggccgatgactaccatctacgtaataagaccattttccttcgcacatcttctcagtgcctcgaagaacaggtggacaatttcttggatctagaggacttggacatggatgaagaaattaagccacagatgtctgaagacctcctcctattgcccggtgaagtggagcaagatgtgtccacaagcattccatcatgcattcctttcgttgcccaaccacctacctgcgaggtaaagccaaaaccttctgtcaagagaatggataaacagacagaggagatcctgggtgacgaagttcagcttttctcgctggacgaagagtag

SEQ ID NO: 53816 - DNA, 360 bp, Artificial Sequence
  Description of Artificial Sequence: Synthetic coding sequence
atgtccgctcacatgagcgggttagagatcatggacgaggatcagttgatcaaggatgtgttggacaagttccttaattgtcatgaacagacctatgatgaagagttcctaaacacctttacacacctgagccaggaagatcatgttagcaaacgcggtgtgttcggcacggacagctctgagaacatcttcaccagcgccaaggtaactcacaaaaacgaagctgacgattaccacctaaggaataagactattttcctgaggacctccagccagtgcctggaggagcaagtcgataacttcctcgacctcgaggatttggacatggacgaggagatcaagcctcaaatgagcgagtag

SEQ ID NO: 53817 - DNA, 444 bp, Artificial Sequence
  Description of Artificial Sequence: Synthetic coding sequence
atgtcggcccatatgtccggtctcgagattatggatgaagatcagctgatcaaggacgtgctggataaatttctcaattgtcacgagcaaacctacgatgaagaatttctcaacactttcacccatctgtctcaggacttactgctgctgccaggcgaagttgagcaggatgtgtccacctcgattcctagttgcatacctttcgttgctcaacctccaacatgtgaagtcaagccgaagcccagcgtcaaacggatggataaacaaacggaggagattctgggtgacgaggtacagctgttttcattggatgaggaatttgactacgacaatgtgatgctcacgagcaaattttctcccgctgagattgagaacataaaggagttatgtaagcagcaaaagaggaaagatacctcgcctgatctggagaaatcatgtgactag

SEQ ID NO: 53818 - DNA, 1461 bp, Artificial Sequence
  Description of Artificial Sequence: Synthetic coding sequence
atggtggcatcagctggcagcctctttggcggaatggtgcttaagaagtttctaaaggagatccagtccatcctgcccggaatttccgcaaagctaacctggacaagtgaggagggctcgtactctcaggatatgaccggggtgaccccttttcagatgattttcgaggtggatgagaaaccacgaaccctgatgaccgactgtctggtgataaaacattttttaagaaagattattatggtgcaccccaaggtccgtttccatttttcagtgaaagtcaacgggatccttagcacagagattttcggcgtcgaaaacgagcccaccctgaacctgggtaatggtattgccctgttggtggacagccagcattatgtgtccagaccaaatttcggaacgattgaaagccactgttcgaggatacacccagtgctcggacacccagttatgctgtttatcccggaagacgtcgctggaatggacctgctgggcgaactgattctgacacccgcagcagccctgtgtcccagcccgaaggtttcctccaaccaactgaataggatatcaagtgtttcaatcttcttgtacggacccctcgggctcccccttattctgagcacctgggaacagccaatgacaacgtttttcaaggatactagctcactcgtcgactggaaaaagtaccacctgtgcatgatccccaacctggatcttaacctggatcgggacctcgtccttccagacgtctcataccaggtggagagcagcgaagaagaccagagtcagaccatggatccccagggtcaaacgctccttctgtttctgtttgttgattttcacagcgcattccctgtacagcagatggagatctggggggtttacacccttttaactacacaccttaatgcaatactcgtggagtcgcacagcgtcgtacagggaagtatccagttcactgtggacaaagtcttggagcagcaccatcaggcagcaaaagccgctgacacacaggagtttcggaccaagctccacaaggtgttcagagagatcacacagcaccagtttcttcatcactgctcttgcgaggtgaaacagcagcttacactcgagaagaaggattcggcacaagggacggaagacgcgcctgataatagcagcctggagctattggccgacactagcggccaagcggagaacaaaagactgaaaaggggcagtcctaggatcgaagaaatgcgggctctgaggagtgccagggccccaagtcctagcgaggcggctccacggaggccggaggccacagcagccccacttactcccagggggcgagagcatcgcgaggcacatggtagagcattggcccctggtagagcttccctgggaagcaggctggaagatgttctctggctacaggaagtttcaaatctatcagagtggctcagccccagccctggcccttag

SEQ ID NO: 53819 - DNA, 2034 bp, Artificial Sequence
  Description of Artificial Sequence: Synthetic coding sequence
atggggtcccgatgtcgtgcttgggcatggactcgcgcttgggcactggccgagttccaagcacgagcggaggaaggcgctgcagctgccgctgccgcagccggtggctacccttccacgggtcgttgccgctgtagcctgcgtggaatggagggcacagccgtggcggtatttgagatcctgaggtttctgattatacactggaagtgcgacattgacgtgtccaagggcgctctgctcgaggggcagctggtaataagtattgaaggcctgaattctaaacatcaggcgaatgctttgcattgtgtgacgaccaggtggtccctcacactgctacctaggcccgagtgcagcggcgcagtcagtgcacactgcaacttacatttgcctggtagcagcgacagccacgcgtctgtgccacgagtcgccggaatcacagacgcacatcaccatgcctggttaatcatggtggctagtgcaggttcgctattcggcggtatggtgctcaaaaaattcctgaaggagatacagtcaatcttaccaggtatcagcgcaaagttgacttggacttcggaagaaggaagctacagccaggatatgacaggcgtaaccccatttcagatgattttcgaagtcgacgagaagcccaggaccctgatgactgattgtctagtgattaaacactttctccgtaagattatcatggtgcacccaaaagtgagattccacttctccgtgaaggttaatggaattctctcaactgaaattttcggcgtggaaaatgaacctaccctgaacctcggaaatggcatagctttgctggtggactcccagcactacgttcgtcccaacttcggaaccatcgagtctcactgctcgagaatccaccccgtgctcgggcatccagtaatgctcttcattcccgaggacgttgccggtatggaccttctgggtgagcttatcctcactcctgccgctgctttgtgtccgagccctaaggttagctcaaatcagttgaatagaatttcctccgtctctattttcctctatggacccctgggtctcccattgattctgagcacctgggagcaaccgatgaccactttcttcaaagataccagcagcctcgtagattggaaaaagtaccacctctgcatgattcccaatctggatctcaatcttgatcgcgacctggtactaccagatgtgagttaccaagttgagagctccgaggaggatcagtcccagacaatggatccccaggggcagaccctgctgctgttcctcttcgtggactttcactccgccttccctgtccagcagatggaaatctggggtgtgtacaccctgttgaccacccacctgaacgcgattcttgtcgagagtcattccgtggtgcaagggtcgatccaatttacagtggacaaggtactggaacaacatcatcaggcggcaaaagcgcaacaaaagctacaagcgtccctgtcagtggctgtaaactccatcatgtcaattttgactggctccaccaggtcctctttccgaaagatgtgtctccagacactacaggccgctgatacacaagagttcaggaccaagttgcacaaagtgttccgagaaatcacacagcaccaatttctacaccactgttcctgtgaagtcaaacagcaactcaccctcgaaaagaaagacagcgcgcaggggaccgaggatgctcccgataactcatcattggagctactcgccgacacctcagggcaagcggaaaacaagaggctcaaaagagggtcacctcgtatcgaggaaatgagggctttgcggagtgctagggcaccctcccccagcgaggctgcaccccgtcgccctgaggcaaccgccgctcctcttaccccacggggaagggagcatcgggaagcacatggcagggctctcgctccgggaagagcttcactggggtctaggctcgaggacgtcctgtggctacaggaggtctctaacctgagcgagtggctgagtccttccccaggtccctag

SEQ ID NO: 53820 - DNA, 1536 bp, Artificial Sequence
  Description of Artificial Sequence: Synthetic coding sequence
atggtcctcaagaagtttctaaaggagatccaaagcatcctccccggaattagcgctaagctgacatggacgtccgaggagggcagctattctcaggatatgaccggtgtgacgccttttcagatgatcttcgaagtagacgagaagcccaggactctgatgacagattgtctcgtcattaagcatttcctgcgaaaaattataatggtgcacccgaaggtgaggtttcatttctccgtaaaggtgaatggaatcctgagtacggaaatttttggcgtggagaacgaacccacgcttaacctgggcaacggcatcgcattattagtggattctcaacactacgtatcgcgccctaactttggtactatcgagtcccattgctctaggattcacccggtactagggcaccctgtcatgttgttcatacccgaagatgtcgccggaatggacctgctcggggaacttattctgacacctgctgctgcgctgtgcccaagccccaaggtgtctagtaatcagcttaatagaatctcttctgtgtcaatatttttgtatggaccgttggggctgccccttatcttgtccacttgggaacagcccatgacgacattcttcaaagacacctctagtctggtggactggaaaaaataccacttatgtatgatccctaacctggacctgaatctggacagagacctagtgcttccagacgtctcatatcaggtggagagctccgaagaagatcaatcccagactatggacccacaggggcagaccctgctgctattcctgttcgtcgacttccactctgccttcccagtccagcaaatggagatctggggtgtgtacacactcctgactacccacttaaatgctattttggtggagtctcactccgtcgtgcaaggcagcatacaattcactgtggataaggtcttagagcagcatcaccaggctgccaaggcccaacaaaagttgcaggcttctctctccgtagcagttaacagcataatgagcatcctgacgggcagtacaaggtcaagcttcagaaaaatgtgccttcagactcttcaagcagctgatacccaagaatttaggactaagctgcacaaagttttccgcgaaattactcagcaccagttcctccatcactgcagctgcgaggttaaacaactgactctggaaaagaaagacagcgcccaaggcacagaagatgcacctgataacagctccctggaactgctcgccgacacttctggacaagccgaaaacaaacgccttaagaggggctcacctaggatcgaggagatgagagccctaaggagcgcccgtgctccttccccctccgaggctgccccacggaggccagaagctacagccgctcctctgactcctcgcggaagggagcacagagaagcccacggcagggccctggccccagggagggcctcacttgggtcccgcctcgaagatgtactttggctacaggaagtgagcaatctaagtgaatggctcagcccttcccctggtccttag

SEQ ID NO: 53821 - DNA, 1146 bp, Artificial Sequence
  Description of Artificial Sequence: Synthetic coding sequence
atggccctcaaagccgaaggagcagctctggattgttttgaagtgacactcaaatgcgaagagggcgaggacgaggaggaagctatggttgtggctgtcatccctagacccgagccaatgctcagagtgacgcagcaggagaaaacccctccgccaagacccagcccgctggaggccggaagcgatggctgcgaggagccgaagcaacaggtcagctgggaacaggaatttctggtgggatcttcccccggagggtcgggtcgcgctctgtgcatggtttgcggcgcagagatccgagctccatccgccgatacagccagaagccacatcttggaacaacatccgcatacactggatctatcgccatccgaaaaatctaatatactcgaggcttggagtgagggtgtcgccctgctccaggacgtgcgggctgaacagccctctcctcccaattccgattccggccaagacgctcatcccgatcccgacgcaaaccctgacgctgcaagaatgccagccgagatcgtcgtgctacttgacagcgaagacaacccttccctgcctaaacggtccagaccccgaggtctaagacccctggaactgccggctgttcccgcaaccgaacccggtaataaaaaaccaagaggacagcggtggaaggaacctccaggtgaggagccagtccgcaagaagcgagggcgaccgatgaccaagaacctggatcctgaccctgaaccacctagtccagattctcccactgagacctttgcagctccagctgaggtgcgccactttacggacggctcattccctgcgggatttgtcctgcagctcttcagccatacccaactgagaggtccggacagcaaggactcgccgaaggaccgcgaagtggcagagggagggcttccgcgagctgagtctccttcacctgctcctcctccaggccttaggggaactctggatttgcaggtaattcgagttcgtatggaagagcctcccgcagtatctcttttgcaggactggtcccggcatcctcagggtaccaaaagggtcggcgcaggagacaccagcgactggcccacagtactatctgaatccagcacaacagtagcaggaaagccagagaaagggaatggtgtgtag

SEQ ID NO: 53822 - DNA, 651 bp, Artificial Sequence
  Description of Artificial Sequence: Synthetic coding sequence
atgtcacttaaacccttcacctacccctttccagaaactaggttcttacatgctgggcctaacgtttacaagttcaagatcagatatggaaagtccataagaggcgaggagatcgagaacaaggaagtgatcactcaggaactagaggatagtgtccgtgtcgttctgggaaacttagacaacctccagccttttgctaccgaacacttcatcgttttcccgtataaatccaaatgggagagagtgtcccaccttaagtttaaacatggggagataatcctgatcccgtaccctttcgtatttacattgtatgtcgagatgaaatggttccacgagaatctctcccctggtaaaccgatttccgattcacccctaggactggtgccagtggagaaaaaagctgtgggcgctgtgatgcggaaacgtaagcacatggatgagccaagcagcccctcgcggcctgggttggatcgaattggaaaggagaaacctaataaagactgccggcgtctgtggcctctcatctctttaatgagtcgcaacaaaatcctgagcggcgatacagcttgtcagggggagttgtctcacccttgcagcaccacccatctccacctgagaagcgagcaaccacccgctagcctcggattttag

SEQ ID NO: 53823 - DNA, 651 bp, Artificial Sequence
  Description of Artificial Sequence: Synthetic coding sequence
atgagcctaaaaccattcacttaccccttcccagagactagattcctgcacgctgggccaaatgtgtacaagtttaagatacgttacggcaaatcaataaggggggaggaaatcgagaataaggaggtaataacccaggagttggaggattctgtcagggttgttttgggtaacttggacaacctccaaccatttgctactgagcactttatagtgttcccatacaaatccaagtgggaaagggtatcccatctcaagtttaaacatggggagattattctaatcccgtaccccttcgttttcacactatacgtcgaaatgaaatggttccacgaaaatctgtcccctggaaaacctatctccgacagtcctctcggcctggttcccgtcgaaaaaaaagctgtgggagcggtgatgcggaagagaaaacatatggatgaaccttctagtcccagccggccaggcctcgataggattggaaaggaaaaacccaacaaagactgcagacgcctttggcctctcatcagcctgatgtccagaaataagatcctgagtggggatactgcctgtcaaggagagctttcacacccttgtagcactactcatctgcatctgcgctctgagcagcctcctgcttcactagggttctag

SEQ ID NO: 53824 - DNA, 447 bp, Artificial Sequence
  Description of Artificial Sequence: Synthetic coding sequence
atgaagtggtttcacgagaatctcagccccggaaaaccaatttccgattcaccgctgggccttgtgcccgtcgaaaagaaagcggtgggtgccgtaatgcggaaaagaaaacacatggatgaacccagttctccttctaggccgggtcttgaccgggcaaagatcggtacatcttctcagggtccgtcgaaaaaaaaaccacccgtagagaccagacggaaccgagaacggaaaactcaacaggggctgcaggagacattagcaagcgatataaccgatgtgcagaagcaggatagcgaatggggccacagcttaccaggcagaatcgtgccacccctacaacataacagcccaccccctaaggaacgagcagcgaccggatttttcggattcctgtcttccctgttcccatttagatatttctttagaaagagttcgcacagttag

SEQ ID NO: 53825 - DNA, 348 bp, Artificial Sequence
  Description of Artificial Sequence: Synthetic coding sequence
atgggaacaggccttcgatcacaatctctcagggagccaaggccttcttatggcaagctacaggagccctgggggagaccgcaagagggccagctgcgcagagctctttccctgagacagggacaggagaagtctagaagccagggtctggagagggggacagaggggccagacgcaaccgcccaggagagggtacccggttcgttgggagacactgagcagctgatccaggctcagcgaagggggtccaggtggtggttgaggcggtatcagcaagtacgacgacgatgggagtctttcgttgctatctttccgagcgtgactctctctcagcctgcctcaccatag

SEQ ID NO: 53826 - DNA, 510 bp, Artificial Sequence
  Description of Artificial Sequence: Synthetic coding sequence
atggaaacgggcccatctgaggagcctagtggaaggaaagagagtcaggagatgtgccctcccggtttgctggtcttcgccggatcctccgagcaggatgccaaccttgcgaagcagttctggatcagcgcttctatgtatccaccaagcgaatcgcagctggtgctccggagggattctagccagcgcctgccggtggcaagacccaggcgatccagagggagcgaaaactcgcattccagtcaatcctttcacctggcctcaaacaagaatagagacattttcgctgaagcactgaagatccaagagagcgaagagaaagtgaaatacttgcagaaggccaagactcgggaagagatcctccagcttctgcggaaacagagggaggagcgaatcagcaaagagctgatctccctaccttacaagcccaaggctaaagagcacaaggcgaaaaaagtggtgagcgaatctgataaagaagatcaagaagaagtgaagaccttggactag

SEQ ID NO: 53827 - DNA, 537 bp, Artificial Sequence
  Description of Artificial Sequence: Synthetic coding sequence
atggagactggtccatcggaagaacctagcggcaggaaagagagccaagagatgtgtccaccgggtctgttggtattcgctggcagcagcgaacaggatgccaacttggcaaagcaattctggatttcggcatctatgtaccccccttccgaaagtcaactggtattgcgccgtgacagcagccagcggctgcccgtagctaggccacgtcggagccgcggatcagagaattctcattcctcccagagcttccatctggccagcaataagaatcgcgacatatttgcagaagcgctaaagatacaagagagcgaagagaaagtcaaatatctccaaaaaaccaggagtcactcagtcacccagaatgaggtgcagtggcacgatcatggctccttgcagccccagctgtcccggattcaggcaaagacccgggaagagatactccaacttctgcgcaagcaacgcgaggagcgcattagcaaggagctaatctcactcccgtacaagcccaaggctaaggaacataaagctaagtag

SEQ ID NO: 53828 - DNA, 1440 bp, Artificial Sequence
  Description of Artificial Sequence: Synthetic coding sequence
atgctgatctccgctgcttccatggcaccggaagtctgcggaccaagcctccagggaacccccggtccacccccacctctcttaccaaagccaggtaaagacaacttgaggctgcagaagttgcttaggaaggcagctagaaagaaaatgatgggtggaactcacctagcgcctccacgggctttccgtacaagcttgagtccagtttccgaggctagtcatgatcaagaggtcaccgctccccacgcagctgaggggcctcatccagccgaggcacctcgcctgcccgaagccccaaggccggctgaggcccctcggatggtcgctgcactgccgaggtcccctcatacgcctatcatacatcatgtggcatcccccttacaaaaaagcacttttagtatcggcctgactcaaagacgcatcttagctgcacagtttcgcgctatgggaccacaggttgtggcctcagcccctgagcccacaagaccacccagcggcttcgtgccggtctctggtggcggaggtacacacgtgacccaggtgcacattcagctggccccatctccacacaacgggacccccgagccacccagaacagctcccgaagtcggtagcaacagtcaggacggagacgcaactccatccccccctcgcgctcagcccttggtgcctgtggcccacattcgtcccctgccaaccactgtccaggctgcttctcctctccctgaggagccacctgttccaagaccccctcctggctttcaggcaagcgtgccgagagaggcgtctgcacgagtcgttgtacctattgcccctacctgtcgcagccttgaaagtagtcctcacagcctggtgcccatgggtcccggtcgcgaacacttggaggagcctcccatggcaggcccagccgcagaggcggaacgagtttcgtcgcctgcctgggccagctctccaaccccaccgagcggcccacatccctgccctgtacctaaggtggcgccaaagccgaggctgagcggttggacatggctgaaaaagcagctgctggaagaggcgccagaaccaccatgtcctgagcctcggcagtctttagagccagaggtgccgacccccacagagcaggaggtcccagctccaactgaacaagaggttccggcactgacggccccaagagcgccagcctccagaacctctcgaatgtgggatgcagtgctataccggatgagtgtagccgaagcccagggcagactcgcaggcccaagtgggggtgaacatactccagcatccctcacacgactgccatttctgtataggccacggttcaacgcacgcaagctccaggaggccacccggcctccccctacagtacggtccatcctcgagctttctccacagcccaaaaacttcaatagaaccgcaacgggatggcgcctgcagtag

SEQ ID NO: 53829 - DNA, 582 bp, Artificial Sequence
  Description of Artificial Sequence: Synthetic coding sequence
atgcccaaggggaggcgcggtagtcacagtccgactatgtctcagcgttccgcccctccactctacttcccttctctgtatgaccgcggaattagttcctctcctctctctgatttcaacatctggaagaagctgttcgttccgctcaaagctggcggagcgcctgtgggtggtgcagcaggcgcacgttccctctcacaggctctgccagcccctgccccaccccctccgccaccacctggtcttggacctagcagcgaacgcccttggccaagcccttggccaagtggactagctagtattccctacgaacccctccgattcttctacagccccccacctggccctgaggtcgttgcctcacctctggtcccgtgcccctcaacacccaggctggccagcgcctcccatccagaggagctttgcgagcttgaaatccgaattaaggagctagaattgctcacaatcaccggtgatgggttcgacagccagtcttatacatttcttaaggcccttaaggacgagaaactacaggggctgaagaccaagcagcccggaaagaagtcggccagcctgagttag

SEQ ID NO: 53830 - DNA, 555 bp, Artificial Sequence
  Description of Artificial Sequence: Synthetic coding sequence
atgcctaaaggtagaaggggttctcactcgcccaccatgagccagaggagcgctccccctctctacttcccctctctctacgacagaggtattagtagctctcccttgtcagattttaacatctggaagaaactgttcgtccccttgaaagccggaggagcaccagtcggaggggctgcaggagccaggtctttatctcaagcactgcccgcaccagctcctcccccacctccccctccgggattgggcccatcttccgagcgcccttggccctctccatggccttccggtttagcatcgattccctacgagcctctccggtttttctattctccgccaccaggccctgaagtcgttgcgtcgcctctcgtcccgtgcccaagtacaccgaggctggcgagcgcctcacatcctgaagaactgtgcgagctggaaatcaggattaaggagctcgagctgctaaccatcaccggggacggtttcgattctcagagctttttggggctctggaccacatgcgcagatgccggacggataccccagcccacttcctag

SEQ ID NO: 53831 - DNA, 375 bp, Artificial Sequence
  Description of Artificial Sequence: Synthetic coding sequence
atggagtcttgttccgttgcccaggccggagtactgacctctcccttcatgtggcgttggaccgggatggctggggctttatccgcattggacaatacaatagaagatgatgccgatgatcagctgccgtgcggagagggcagacccggatgggtgcgcggtgagctattgggatcccagggtgtctgtaaagactccaaggatctgttcgtaccaacatcctctagcctatacgggtgcttctgcgtgggcctagtttctggcatggccatcagtgtgcttctcttagctagtgattttcggaagctagattttagccggcctgaaccgtgtttcgaaaaggaggcctcactatggttcgttgcccagcattag

SEQ ID NO: 53832 - DNA, 375 bp, Artificial Sequence
  Description of Artificial Sequence: Synthetic coding sequence
atggagtcatgtagcgtggcccaggcaggagtcttgacttccccattcatgtggcgatggacaggcatggcaggagctctgagtgcccttgataatacgatcgaggatgacgccgatgaccagcttccctgtggtgaggggagacccggatgggtgcgcggagagctccttggctctcagggcgtgtgcaaagacagcaaagacttgttcgtgccgacctcatcttctctatacgggtgtttctgcgtgggtttagtctctggtatggccatttccgtcctgctcctggcgagcgattttcgcaaacttgatttttcaagacccgagccttgtttcgagaaagaagccagtctgtggtttgtggcccaacattag

SEQ ID NO: 53833 - DNA, 375 bp, Artificial Sequence
  Description of Artificial Sequence: Synthetic coding sequence
atggaatcatgcagcgtggctcaggcaggggttcttactagtccctttatgtggagatggacaggcatggccggagccctctccgcactggacaacacaattgaagatgacgccgacgaccagctgccgtgcggggagggaagacccggttgggtccgcggtgagttgctgggtagtcagggagtgtgcaaggacagtaaagacctgtttgtccctacatcctcctccctgtacggatgcttttgtgtgggactcgtatctgggatggcaatatctgtgctgcttctggcatccgacttcaggaagttggatttcagcaggcctgagccctgttttgagaaagaggctagcctgtggttcgtggcacagcactag

SEQ ID NO: 53834 - DNA, 465 bp, Artificial Sequence
  Description of Artificial Sequence: Synthetic coding sequence
atgcacccagagcctctcttgaacagtactcaatccgcaccccaccactttcccgatagtttccaggcgactcctttctgcttcaatcagagtctgatccccggaagcccttctaatagtagtattctgagcggatctctggactactcttactcccccgtgcagctgcctagttacgctccagagaattataattcccctgctagcctggatacacggacatgcggctaccctcctgaagaccatagctatcagcacctttcttcccatgcacagtactcctgcttcagctccgcaactacctccatctgctactgtgcttcctgtgaagctgaagacctcgatgctctgcaagctgccgagtacttttaccccagtactgactgcgtggactttgctccgagtgcagccgctacctctgatttctataagcgggagaccaactgcgacatctgttacagttag

SEQ ID NO: 53835 - DNA, 465 bp, Artificial Sequence
  Description of Artificial Sequence: Synthetic coding sequence
atgcatccagaaccacttctgaattcgacacagtctgcacctcaccactttcccgattcgtttcaggctacccctttttgttttaatcagtccttaatccccggatcccccagtaacagttctattctctctgggtctctggactatagttatagtccggtgcagttgcccagttacgcccctgagaactataactccccagcctcactggacacccggacctgtgggtatcctccagaagaccactcatatcagcacttgagctcgcatgcccaatatagttgcttcagctcggcaaccacaagcatctgctattgcgctagctgtgaagcagaggatctcgacgccctgcaggcggcagagtatttttatccaagcaccgactgtgttgactttgctccaagcgccgctgctacttctgatttttataaaagggaaacgaactgtgacatctgctacagttag

SEQ ID NO: 53836 - DNA, 324 bp, Artificial Sequence
  Description of Artificial Sequence: Synthetic coding sequence
atgcatccggagccacttctaaactctacacagtcagccccacaccacttccccgacagtttccaggcaaccccgttctgcttcaaccagtcactgatccccggaagcccttctaactcctctatcctctcaggcagcttagattatagttattctcctgtacagctgccaagttacgccccagaaaattacaatagtccagcaagtttagatactaggacttgcggctatccgccagaggatcacagctaccaacacctatccagccatgcccagtactcatgcttctccagcgctacaacctctatttgttactgtgcttag

SEQ ID NO: 53837 - DNA, 1308 bp, Artificial Sequence
  Description of Artificial Sequence: Synthetic coding sequence
atgggtaacaaacagcctcagaaagtcacagtgccgacaggaactgcactccagggcgttgtcctcattgttagtacattgcaccagcctggcggttggatatgtggaaaggacccctgttgtagcctccgcccactgagtaatagcgtacagaacgccctggcatgtaaaagtaagcaagactaccaagcaggcatactgtttaagacgcgggcatttatctctcgagactgtggctcagacgctgccgaagacagcgctagcaagggagagacttacacactgaccctcgaacataaaggggctggagaaggggacctcagaccaagaggccaacccggatggtgcaggctgggcgaccccaggcgagatagcgccaggccagtcgccgctatagaggggccttgtccgggagccgcaagggcttcaagagttctccgcggacggggtttctccagaaacccaagaggaagaggcctgccaagtggcgctggatggcgcggtgctggaggggctggagaaggagcagttacctttcccgaacgcaggggggacgttagacgaaagggcgctggcagagccagatttaagtggcactccttgagcagtgaactccgtgctgtctgggccgctgcgggatacatcagtcgagagccaggtcgccgaggcgcagatggggacagctccgggggtgaaaggttaggtgcccgtagaaattccgccccaagggcaccctgcccacccaccggaccccctgctcgcccacccagtcgcggtgccccagcccgtgcccgagaggggagacgtcatccagctgccgatctggatcctcccccaggggagcctccagccgctgcatcccgaggggctcccgctcaacgcccaccctcagaatcacccggtgcccctccacccggacccgctgatgccggtggtgcaatggcagctaaaccaggggagctgatggggatttgcagtagctatcaggctgttatgcctcacttcgtatgtcttgctgacgagtttccacaaccagtgaggcctgctaaactcccgaaaggccgaggacgcctcaggcgccctaggcagtcaagatttaagacacaaccagtcactttcgacgaaattcaagaagttgaagaagagggcgtttcacctatggaggaggagaaagctaaaaagagcttcttgcaatctcttgagtgcctgaggcgatccacgcagtctcttagtctacagagagagcagctctccagctgcaagctacgtaattccttggacagctctgacagcgattcagcactatag

SEQ ID NO: 53838 - DNA, 1254 bp, Artificial Sequence
  Description of Artificial Sequence: Synthetic coding sequence
atggccttcgctgtcatcagggctcagtccagggtcggatcccgtggcctatacaaaccgagagcctggccgcctcgcggtcgcaggcgccagcagcggagacgggcaccacgaagtgctgctgaacagcgtcctccctctccggtaccccctgacggaagtgccagaccaccggcactcccgagatctgccggaccgggaccaagagggcctccacccccacgcagcagatttgggagtccagccaggcgtgcccctggctgttgtctgccaggcggtcccggtgctgccgctgccttgggtgaacccaggaggcccgctgccagaccaagaagacgccgacgcaggcatgggcgacaggccaggcgggcagacggacacttgctgcagctgcccggaggagatgccgctttacgcgttccaggacggagggttcccgctgcaagggctgcccgtcaagctgctcagggacccggtccagccgcagctgctgctccggtgagtcttcaggatgccgctggcgatcttagacgcgatccaggcggtggagggggtggcggagtgccacatgggggtggcgagggccaggaagtagtcccggctgagcccggtgtcccggcacctcagcatgccgaacccgtcgcagcggctggggctgcccagcagttacagacagaggagcagcctggcttgcagcggctccgtcttggaccggttaggggagctgccaggggaggggacgcccgtgtacggggacccagaggggacaggagggtaaatccggaatctgcaagggctcttctccccggagaccctcagggaccaggcacagcagcaccaagagcgctcgggctgccccctagatgcgaaccagtgggggcacccctggcggctctggccttggccagggagcgccgtgagcgcggtcggtttccaaggccctgtaaatgtttgttttttaacagtagccagtgcgagctctgttgcgagtgcgtgcgaggcggtgccccagccttaagccgcaggcgggtggctaccccatgcccatgtccaatggtgtgtaatagtgacttcgcccatagaagtaccgtgcccccttctgcccatcctttcactttgactcctaccctgagtttgaacacattcatcatagttagacgcggacggtgggactttgggcgatctgccgcagccacagcaagtggtggccttatctttattttcgctcttcggtggctgaaggctttcatatag

SEQ ID NO: 53839 - DNA, 822 bp, Artificial Sequence
  Description of Artificial Sequence: Synthetic coding sequence
atgttgggacagcttctgccccataccgctaggggcctcggagcagccgagatgccagggcaaggcccaggcagcgattggacagaacggtcttcctctgctgagccacccgcagttgccggaacagaaggaggcggaggtggctctgccggttacagttgttatcagaattccaagggttcagaccggatcaaagacggatacaaggtgaactcacatatagccaaactgcaggagttatggaaaacacctcagaaccaaacgattcacctgagtaagagcatgatggaggcttcatttttcaagcatccagacctgaccaccggccaaaaaagatacctgtgcagcatcgccaagatttacaatgccaactacctgaagatgctgatgaagcgccaatacatgcacgtgctgcagcatagttcacagaagccaggagtcctgacccaccacagaagcaggctgtccagccgatactcacagaaacagcactatccttgtacaacatggaggcatcagctggagagagaagattcaggaagctctgacattgccgcagcatccgcccctgagatgcttatccagcactcactttggaggcctgtgcgaaacaaggagggaatcaagaccggatacgccagtaagacgcggtgtaaatctcttaagatcttccggaggccacgcaagttgttcatgcagacggttagtagtgacgacagtgagagccatatgtccgaagaaaaaaaggaggaggatttacttaacaactttatgcagagcatgtctatcgaagagcaaggggagcatttgatgctcacttag

SEQ ID NO: 53840 - DNA, 1812 bp, Artificial Sequence
  Description of Artificial Sequence: Synthetic coding sequence
atggcagccagctgtcccctgcctgtgaccccagacctgcccaccctgcgtgccaaattacaagggctgctgcaattcctgagggatgcactcagcatctccaacgcacacacagtggatttttatacagaatcagtgtgggaggaactggtggatctgccgccagagaccgtgttagccgcactgaggaagtccgctagcgagacagaagccctgccctctgagaccagacccctggtggaagctgaatgggaagccggaatgacagattttcccaagattttctgcgagacctcccagaagctggtctccgttgaagctttcgctctggccgctaagtactactctgtgcagaaccttggaatttgtaccccctttgaacagcttctcgtggcccttcgaggcaaccagaaccaaaggatcggcgagaaccagaaggcggtggaattcatgaacatgaagaagagccacgaggtccaggccatgtcagagctcattagctcgatagcagattattacggtatcaaacaggttattgacttgggctccggcaagggatacctctcatcattccttagcctgaaatacggactcaaagtctatggcatcgacagctcaaacacgaacactcatggtgcagaggaaaggaacagaaagcttaagaaacactggaaattgtgccatgctcaaagtcgcctcgacgtgaatggcctcgctctgaaaatggcaaaggagagaaaagtacagaacaaagttaagaacaaggccgacactgaagaggtgtttaacaacagtcctacgaaccaagagaaaatgcccacctctgcaatcttgcctgatttctccggctcagtgatttctaatattcgaaatcaaatggagacactgcactctcagccgcaccaggaggagaacttgtgttttgaaaactctttctcacttatcaacctcttgccaatcaacgctgtcgagcctacatcatcccagcagatcccaaaccgagagacctccgaggctaataaggagcgacgcaaaatgacatctaagtctagtgaatccaatatatattcacctctgaccagctttatcactgccgattcagagttgcacgatatcataaaagatctggaagactgtctgatggttggactgcacacatgcggagacctggctcctaatacattgcgtatattcaccagcaatagcgaaatcaaaggtgtgtgctccgtgggctgctgttatcatctgctttccgaggagttcgaaaatcagcacaaagagaggacacaggagaaatggggttttccaatgtgtcactatctaaaagaggagcggtggtgttgcggtcgaaatgcacgtatgtcagcctgcttagcgctggaaagagtggcagccggacagggcctccctactgaaagtctgttctatagggcagtactgcaagatattatcaaggactgttatgggatcaccaagtgcgaccggcacgtggggaaaatctacagtaaatgtagctcctttttagactacgtgcggaggagtttgaaaaagttgggtctagatgagagcaagctgcctgagaaaattatcatgaattactacgaaaagtataagcctcggatgaatgaattggaggcatttaacatgctcaaggtcgtcttagcaccatgtattgagactctcatccttctggacaggctttgttatctgaaagagcaagaggatatagcctggtccgctctcgttaaattgttcgatcccgttaaaagccctcgatgctatgctgttatcgccttgaaaaagcagcagtag

SEQ ID NO: 53841 - DNA, 828 bp, Artificial Sequence
  Description of Artificial Sequence: Synthetic coding sequence
atggcgttctgcgcactcaccatcgttgctctttacatactgagccttaaggaccaggaccggcgagtccctaacctacccccttccaacataacctctagccaggagccagcactgctcccaaccgctagttcctccgcaccaaacacatcactagtgaccactcctgcctccttgcaggtaccggaaattaccttctgtgaaattctgccttgccaggaaacatattgctgcccaattcgaggcatgaaagaggtatctagctccccggtgcagcggcagagcgaagagaaagagttccatcagagaagatggtccgaggataagtctaaatccgtgttggcaagaaatgccttgtctggacctgactgggagtcagattggatcgacaccaccatctcttctattcagatcatggagattcaacaaataatagatcaccagtattgcattcaatccctgcagtgtggaagtggaaattataactataacattcctgtgaataagcatacccccaccaacgtaaaatttagcctcgaaattaacaccacagagcctcttatcgtgtttcagtgcaaattcactctcggaaacatctgtttccactctaagcgagggaccaaaggactcgagagtcaccgcgaaatttctcaggagatgacccagggataccagcatatctggagtctgcccgtcgctcctttcagtgattccatgttccattttagagtggcggcacccgacctggccgattgttctacagatccctacttcgctggtatcttctttaccgattattttttctacttttacaggagatgcgcgtag

SEQ ID NO: 53842 - DNA, 978 bp, Artificial Sequence
  Description of Artificial Sequence: Synthetic coding sequence
atgaaaaggctaggaagcgtgcagagaaagatgccttgcgtattcgtgacagaagtgaaggaggagccttcctctaagcgcgagcaccagcccttcaaggtgctggcgactgaaacggtgagccacaaggccctcgacgccgacatttattccgctattcctactgaaaaggtagacggcacttgctgctacgtgacaacatacaaagaccagccgtatctgtgggcgagactggatcgtaagcctaataagcaggccgaaaagcggtttaaaaactttctccacagcaaggaaaaccctaaagagtttttttggaacgtcgaagaggatttcaaacccgctcctgaatgctggattcctgcgaaggaaaccgaacagattaacgggaatccagtgcctgatgagaatggccatatacccggatgggtgcccgtcgaaaaaaacaacaagcaatattgttggcattcaagcgtcgtcaactacgagtttgagattgctctcgttctgaagcatcatcctgacgacagtgggctgttagaaatttcagccgtacccctgtccgatttgcttgaacagactctggagttgattgggacaaacataaatgggaatccgtacggcctgggatctaagaaacatcctttgcacctcctgatcccccatggggcttttcaaattcggaatctgccatctctgaagcacaatgatctagtgtcttggtttgaggattgtaaggaaggtaaaatcgaaggaatcgtgtggcattgttcagacggatgccttatcaaggtccaccgccaccacctgggtctgtgctggccgataccagacacctacatgaacagccggccagtgatcatcaacatgaatcttaataaatgcgactctgccttcgacattaagtgtctgttcaaccattttctgaagattgataatcagaaatttgtgcggctgaaggacatcattttcgacgtatag

SEQ ID NO: 53843 - DNA, 1359 bp, Artificial Sequence
  Description of Artificial Sequence: Synthetic coding sequence
atgcttgcctgcctgcagcgcacgcagaacgcgccaggacagcacctggcctgccctagcaagtctctcgagctgcggaaatgcgaagctgtcgcctccgccatgcatagttcccgttacccgagtcctgccgagctcgatgcttacgcggagaaggttgccaactcccctctttccattaagatcttcccaactaatatcagagtgccccagcataagcacctctccaggaccgtgaacggatacgacacttctggtcagcgatattcaccgtaccctcagcataccgcgggttaccagggcctgctcgccattgtcaaagcagccgtttcctccagctcaactgcggctcctgctggaccagcgaaatccgtgttgaagtcagccgagggcaaaagaaccaagctgtcacctgccgctgtgcaagttggtatcgccccatatccagtgccaagtactcttggccctctggcatacccgaaacctcccgaggctccggcacctcccccaggcttgccggcagctgctacggccgcatcggttatccccctccccggacgcggtctccctttgcccccatccaacctgccatcaatacactcgctcctgtatcagttaaatcagcagtgccaggctccaggagcggcaccgccagcttgccaaggtatggcgatcccacatccatcccctgctaagcacgggccagttcctagctttccctccatggcttattctgccgcagcaggcctgcccgattgccggaaaggcactgagctggggcagggagctactcaggccctcactcttgctggggctgccaaaccggctgggtatgccgattcaggactcgactacctactctggccccagaagccgcctcccccaccacctcaacctctcagggcttactctggctcaacggttgccagcaagtccccggaagcttgtggtgggagagcttacgaaagggcgtccgggtcacccctaaattgtggcgtagggcttccaacatccttcacagtgggccagtactttgctgctccttggaacagcgtactagtcactccaaccagtgattgttacaaccccgcagctgcagtcgtggtcactgagctgggaccaggtgccgcaagggagctcgcgggtccacccgctgatgcccttagcggactgccatccaagagtgtttgtaatactagcgtgttgtcaagctccttgcaatctctcgaatacctcattaacgatatcaggccgccttgtattaaggagcagatgttgggaaaaggttatgaaaccgttgctgtcccgagacttctcgatcatcaacatgcgcacattcgcctccctgtgtacaggtag

SEQ ID NO: 53844 - DNA, 1359 bp, Artificial Sequence
  Description of Artificial Sequence: Synthetic coding sequence
atgctcgcgtgtttgcagcgcacccagaacgccccagggcaacacctcgcctgcccaagcaagtcgctcgaactaaggaagtgcgaggccgtcgcttccgctatgcactccagccggtaccctagccccgctgagctggatgcatacgcggagaaggtggccaacagccctctcagcatcaaaattttcccaacaaatatcagggtgccccaacataaacacttgtcccggactgttaacggatacgacacatctggccagcggtactctccctacccacagcatactgccggttatcagggactgctggcgatagttaaggctgcagttagttccagtagtacagctgctcctgctggacctgctaagagcgtgctcaaaagcgccgaaggcaaaaggactaagctgagcccggcagcggtgcaggtgggaatcgccccatatcccgttccatccacgctgggacctttggcatatcccaagcccccagaggcaccggctcccccaccaggactgcccgctgctgccaccgctgcctcagtgatcccattgcctggaaggggcctgccgctccccccatcaaaccttccttccattcactcactgttataccagctgaatcagcaatgccaagcccctggggcagctccccctgcttgtcagggaatggctatacctcaccctagccccgcaaaacacgggccagttccctccttccctagtatggcttactccgccgctgccggtctcccagattgtaggaagggcaccgagctcgggcagggtgcgactcaagcattaaccctcgcaggagccgcaaagcccgcagggtacgccgattccggcctcgattatcttctctggccgcagaaaccaccacccccaccccctcagccactaagagcttacagcgggtccaccgtggcatcgaagagccctgaagcatgcggaggaagggcttatgagagggctagcgggtcaccactaaactgtggcgtggggcttccaacctctttcaccgttgggcaatatttcgcggctccctggaactctgtgctggtaacccctacatccgactgttacaacccagccgcagctgtggtcgtgacagaactcgggcctggagccgctcgtgagcttgcaggccctcctgccgacgcactatcaggcctgccttcaaaaagtgtttgcaatacctcagtgctgagctcatctctgcagtcattggagtatctcatcaacgatatccggccaccctgcataaaagaacaaatgctgggcaagggctacgagaccgtggccgtacctaggctcctagatcatcagcacgctcacattcggcttccagtttatagatag

SEQ ID NO: 53845 - DNA, 5244 bp, Artificial Sequence
  Description of Artificial Sequence: Synthetic coding sequence
atgaattggaatgagaaaccaaaatctgccaccctcccccctttgtatcccaagtctcagcccccatttctccaccagtcattaattaatcagatcacgacgacatcacagagctctttctcatacccgggtagcaaccaagaggcatgcatgtaccctggcaacagcaatcccatttcccagcctctactgaatatacaaaattatccccagcagatttctgtctctgacatgcataacggaaccgtggttgcatcccatacaagtgtggaaagaattacctatgcgaatgtgaatggccctaaacagttaactcataaccttcagatgtcatctggcgttacacagaatgtgtggctcaacagcccgatgcgcaatccagtgcattcacacatcggtgccaccgtttctcatcaaaccgacttcggcgctaacgtgccgaacatgcctgcactccagagccagctcatcacgagtgacacttactccatgcaaatgcagatgatcccttcaaactccactagacttccagtcgcataccaggggaatcagggattgaatcagtctttctctgagcaacaggtggattggacccagcaatgcatatctaagggactgacttaccctgactaccggccacctcccaaactttatagatatagtccacagtcatttctgcctgactcaaccatccagaagcagaacttcatcccacatacgtcgctgcaggtgaaaaacagccagctattgaactccgtcctcacgcttccttctcggcagacatctgcagtgccaagtcaacagtatgctacccagactgataagcgacctcctccacctccctacaattgtcggtatgggagtcagccactacagtctactcagcatatcaccaagcatctatctatggaagtgccacagtcccgggagatgttgtcatccgagatccgcacatccttccaacagcagtggcaaaacccgaatgaaaacgtgtcaaccatcgggaatttcactaacctcaaagtcaacactaatagcaagcagcccttcaacagcccaattagatcaagcgtagacggagtgcagacactggcgcaaaccaacgaggagaagattatggattcgtgtaatccaacttcaaatcaagtgctggacacctcagtggctaaggaaaagcttgttagagatatcaagacgctcgtagaaatcaagcagaagttctccgaactggccaggaagatcaaaataaacaaggatctacttatggccgcaggctgtatcaagatgacgaatacgagctacagcgagcctgctcaaaacagcaagttatcactgaagcagactgccaagatacagtcgggccctcagatcacgccagtgatgcccgaaaacgcggaaagacagacccccacagtcgtagagtcagccgagacaaataaaactcaatgcatgttgaattctgatatccaggaggtaaattgtaggagatttaaccaggttgatagcgtgttgcctaatcccgtatacagcgagaagcgtcctatgcccgacagttcccacgatgttaaggtgctcacttccaaaacctctgctgtcgaaatgacccaagccgtcctgaatacacagctttcttcagagaatgtaaccaaggtcgaacagaatagtcccgctgtgtgtgaaacgatttctgtgcccaagtctatgtcaacggaagagtataaaagtaagatccagaatgagaatatgctcttgttggctctactgagccaggccaggaaaacacagaagacagtgcttaaggatgcaaaccagaccattcaggactccaagcctgactcatgtgaaatgaacccaaacacacagatgactggaaaccagctgaacctgaaaaacatggaaactcccagcacctctaatgtgagcggacgcgtactggataatagtttttgttcagggcaagagtccagtactaaaggaatgcccgcaaaatctgatagttcttgtagcatggaagtcctggctacatgcctaagcctctggaagaagcagccgagtgataccgccaaggagaaagaatgcgataaactccgaacaaataccacagccgttgggatctccaagcctgcaaacatacatgtcaaatccccttgttccgtcgtcggtaattcaaactctcagaacaagatctctaatccttcccagcagacggcgctctcaatggtgatgcacaattatgaatccagcggcatcaacattactaagggcaccgaattgcaaatcgctgtggtctcgcccttggtgcttagcgaggtgaaaacgctatccgtaaagggcatcacccccgcagtgctgcccgagactgtctaccctgtcataaaagaagggtcagtgtgtagcctacagaatcagctggccgagaacgccaaagccaccgccgcactgaaagtcgacgtaagcggacccgttgccagcactgcaacaagtaccaaaatttttcccctcacccagaaagaaaaacaaaatgaaagcaccaacggcaactcggaggtcacccctaacgtgaaccaagggaaacacaacaagctggagagtgctatccacagtcccatgaatgaccagcagatctcacaggagagccgcaactccaccgtggtgtcaagtgatactctgcagattgataatatttgttccctcgtagagggagacactagctacaattcccagatagcgaagatctttagcagtctgcccctgaagatggtggaaccccagaaaccaagtctccctaatcaacagggtattgggtcaagggagcccgaaaaacagctcgacaacactaccgaaaacaaggattttggtttccagaaggataagcctgttcagtgcaccgacgtctctcataagatctgcgatcagtccaagtcagagcccccattggagtcgtcctttaataatttagagacaaatagggtcattctggaaaaatcatccctcgagcacgctacagaaaagtccaccgcgaatgatacttgttcatcggcagccatccaggaggacatctacccgcaggagatcgacgcatcctccaactacactccgcaagacccggcaaggaatgaaatccactcagataaggcaccggtgctgtaccttcatgatcagctgtcggagctgctgaaagagtttccttacggcatcgaggccgtcaacactcgggagggctccgtggggcagcaaacaacctaccagacaagtgaggaccagaccgctgataaaacaagctccgactccaaagatccagcagaccaaatccagattacaatcctatccagcgagcagatgaaagagattttcccagagcaggatgatcagccgtatgtcgtggacaagctggctgaacctcaaaaagaagagcctatcacagaagtggtctcccagtgcgacctgcaagcgcctgcagccggacagagcagggattcagtcatactggattctgaaaaagacgacattcactgctgcgcactgggatggctttcaatggtgtacgaaggggtcccacaatgtcagtgcaactccattaagaacagtagctccgaggaagaaaagcaaaaagaacaatgttctcctttggatactaacagttgcaaacagggggagagaaccagcgatagagacgtcactgtagtgcagtttaagagccttgtgaataaccccaaaacacccccagatgggaagagtcattttccggaactgcaggacgatagccggaaggatacgcctaaaacaaagcacaagtccctgcccaggacagaacaggagctcgtcgcagggcagttcagctctaaatgcgacaagctgaacccattgcaaaatcacaagcggaagaagctgagattccacgaggtcaccttccattcatccaacaagatgaccgcaagctatgaacaggcttcccaagaaacccgccaaaagaagcacgtaacccagaattcacgaccccttaagacaaagacggcctttctgccaaataaagacgtatataagaagcattcgagcctggggcagtcgctctcccccgagaagattaaactgaagctgaagagcgtctcatttaaacagaagagaaaactggaccaggggaacgtccttgacatggaggttaagaagaagaaacacgataagcaagaacagaagggttctgttggcgctacattcaagctcggagatagcctctccaacccaaatgagcgagcgattgtaaaagagaaaatggtgagcaacacaaagtcagtcgataccaaagcttcatcttctaagttcagtagaattcttacgcccaaagagtacctgcaacgtcagaaacacaaggaagcactgtcaaataaggcttctaaaaaaatttgcgtgaaaaatgtgccgtgcgactctgagcacatgcgtccatccaagctggccgtgcaggtcgagagctgcggtaaaagcaatgaaaagcacagcagcggagtgcagacatcaaaagagagcctgaatggtctaacgagtcacggaaaaaatctgaaaatccatcatagtcaggaatctaaaacctacaacatcctcaggaatgttaaagagaaagttggcggaaagcagccagataaaatttggatcgacaagaccaagttggataagttgacaaatatcagtaacgaggcccagttcagtcagatgccaccgcaggtgaaagatcaaaaaaagctctatttgaatcgcgtcggttttaagtgtaccgagagggaatctatctctttgaccaagttggagagcagtccaagaaagttgcataaggacaagcgacaggagaacaagcataaaacctttctgccagtcaaaggaaacaccgagaagtcaaacatgctcgagttcaagctgtgccccgatatcctcctgaaaaatactaattccgtggaggagcgaaaagacgtgaagccacatccccgaaaagaacaggcacctcttcaggtgagtgggattaagtcaacaaaagaggactggttgaaattcgtcgctaccaaaaaacgcacccagaaggactcacaagaacgcgataatgtgaattctaggctaagcaagaggtcttttagcgctgacggattcgagatgcttcagaatccagtcaaagacagtaaggagatgtttcagacatacaagcagatgtacctagagaagaggagccgatctcttggaagtagccccgtcaagtag

SEQ ID NO: 53846 - DNA, 2028 bp, Artificial Sequence
  Description of Artificial Sequence: Synthetic coding sequence
atgaattggaatgagaaacctaaaagtgcgaccctgccacccctgtaccccaaatcccagccccctttcttacatcagtccctgatcaaccaaattactaccaccagccagtctagtttttcctaccccggaagcaaccaggaggcttgcatgtatccagggaactcaaaccctatttctcagccgctgctgaacattcaaaactaccctcaacaaatttcggtgtccgacatgcataatggtacagtggtggcaagccacacatctgtggaaaggattacgtacgcaaatgttaacgggccaaaacagcttacccataacctccagatgtcatcaggagttactcagaacgtttggctaaattcaccgatgagaaatccagtgcattctcacattggggcaaccgtttcgcaccagactgattttggggctaatgtgccaaacatgcccgctttgcagagtcagctgatcacctctgacacatactcaatgcagatgcagatgattccttctaacagcacgagactgcctgttgcctaccagggcaatcagggcctcaaccagagcttttccgagcaacaggtggactggacccagcaatgtatttccaaaggtctgacctacccagactatcggcctcctcctaagctctatcgatacagcccgcagagctttttacccgattcgacaatccagaagcaaaacttcattccccacacttccctccaagtcaagaattcacagctactaaatagcgttctaacactgccaagtcggcaaacatccgctgtcccgtcccaacagtacgcgacccagacggataaacgacccccaccccctccctacaactgccggtatgggtctcaaccccttcaaagtacacaacatataaccaaacacttatcaatggaagtaccccagagccgagagatgctgtcctcagaaattaggacttcatttcagcagcagtggcagaaccctaatgaaaacgtaagtacgattggaaacttcacaaacctaaaggtgaacaccaactccaaacaaccttttaactcacccattaggtcctccgtggacggcgtccagacccttgcccaaactaacgaggaaaagatcatggactcatgcaatcctacgagtaaccaggtgttggacacatctgtagccaaagaaaagctggtgcgggacattaaaacactggtggagattaaacagaagttctcagaactcgcacggaagattaaaattaataaggatcttttgatggccgcaggatgtatcaagatgacaaacacatcttatagtgagcctgcccaaaactcaaagctatcccttaagcagacagccaagatccagtctggccctcagataactccggtcatgcccgaaaacgcggagaggcagacccccaccgtggtggagagcgccgaaacaaataagacacagtgcatgctaaacagcgacatacaagaggtaaattgtcgccgattcaaccaggtggattcagttctgccaaatcccgtttacagcgagaaaaggcccatgcccgattcctcccacgatgtcaaggtgttaacttctaaaacctccgcggtggaaatgactcaagcggtattaaatactcagttgtcatcagagaacgtgaccaaagtggagcagaatagtcccgcagtatgcgagacaatctcggtgccaaaaagcatgtcaaccgaagagtacaagtcaaaaatccagaacgaaaacatgctgcttctcgccctgctcagccaggctaggaagacccagaagacagtgcttaaggatgcgaatcagacgatccaggattcaaaacctgactcatgcgagatgaacccgaatactcagatgactggaaaccaactgaatctgaagaatatggagactccctcaacttccaatgtcagcggacgggtgttggataattctttctgctctggacaagagtcttcgacaaagggcatgcctgctaaaagtgactcctcatgcagcatggaagtgctcgccacctag

SEQ ID NO: 53847 - DNA, 108 bp, Artificial Sequence
  Description of Artificial Sequence: Synthetic coding sequence
atgaattggaatgagaagccaaaatctgccacactcccacctctataccctaagtctcagcccccttttcttcaccagtcgttaatcaatcagataaccaccacatag

SEQ ID NO: 53848 - DNA, 417 bp, Artificial Sequence
  Description of Artificial Sequence: Synthetic coding sequence
atggagcgtttcttgaattcaaaggcacggcgattgggcagctgctcccacccggcattttatctcttgtgtgtgccggatgaggacaccagctgttccacaatttacctgccgctcaaacgcagagctgaccctgaccaactgtttagcgatttgctgggtggcactcagcgactttggtccaacagattcggtaacgaagagagttttcccggacgtgtgcgcgcactagtcgacaccttttgctggatcgcgagggccccacctctgggcaatccactgagacttgaagagcggattgcctggaggatccagcgcctgaagagcgggcagaccgccttaatcgaaaaaaaaaagcagaaaatcgaggaagatgtgaggcatcagtgccagcaaactacctgcgaccggtgttag

SEQ ID NO: 53849 - DNA, 417 bp, Artificial Sequence
  Description of Artificial Sequence: Synthetic coding sequence
atggaaaggtttctgaattcaaaggcccgaaggctggggtcctgctcacacccagcgttttacttattgtgtgtccctgacgaagataccagttgctctactatctatttgcccctcaagcgtagggctgacccagatcaattgttctccgatctccttggaggcacgcagcgcctgtggagcaaccggtttggaaacgaggaatcgttcccagggagagttcgggctttggtggacactttctgttggatcgctagagctccaccattgggcaaccctttacggctggaagagcggattgcctggagaatccagcgcctgaagtccggacagacagccctgattgaaaaaaaaaaacagaagatagaagaagatgtgcgccaccaatgtcaacagacaacgtgtgaccggtgctag

SEQ ID NO: 53850 - DNA, 1659 bp, Artificial Sequence
  Description of Artificial Sequence: Synthetic coding sequence
atgaaaaagaacagggagcggttctgtaaccgggagcgagagtttgtctacaagttcaaggtgggaagccagtgtctggagctgcgcgtacctctgaaatttccagtgcaagagaacgcttcccaccttcacggtagactgatgctactgcattctcttccttgtttcatagaaaaagaccttaaagaggcactaacacagttcattgaagaggagtcactgtcggactacgaccgagacgccgaagcttccctggcggctgtcaaatccggcgaggttgaccttcatcagctcgcgagtacctgggcaaaggcctacgccgagaccaccctggagcatgcccgtccagaagagccctcgtgggacgaggattttgcggacgtgtaccacgatctcatccactcacccgctagtgagactctcctcaacttggagcacaattactttgtgtccatcagtgagctcatcggtgagcgtgatgtcgaattgaagaagctgagagaacgccagggcatcgaaatggaaaaagtaatgcaggagctagggaaaagcctgacagatcaagatgtgaattcactggccgcacaacatttcgagtcacagcaggatcttgagaataagtggtcgaatgagttaaagcaaagtaccgccattcagaaacaggaatatcaggagtgggtgatcaaactgcatcaggacctgaagaacccgaacaactcctcactttccgaagaaattaaagtgcagccctcacaattccgagaatctgttgaggcaatcgggaggatttacgaggaacagagaaaactagaagaatctttcacaatccatctgggggcacagctcaagacgatgcacaacctgcggctcttgagagccgatatgctcgacttctgcaaacacaagcgcaatcaccgctccggggtgaagctgcatagactgcaaacagcactctccctctactccacttcattatgcggcctcgtgctcttggtggacaatcgcattaattcctacagcggaatcaagcgagattttgctaccgtgtgccaggaatgcacagattttcacttccccagaatcgaagaacaactggaggtggttcaacaggtagtgctctatgcccgaacccaaaggcgaagcaagctcaaagagtctctggatagtggaaaccagaatgggggtaacgacgacaaaaccaaaaacgctgaacggaactacctgaacgtccttcctggggaattctatattacgcgacacagtaacctaagcgagattcatgtagcattccacttgtgtgttgatgaccacgtaaaaagcggcaacattacggccagggatcccgctatcatgggcctgcggaatattttgaaggtgtgctgtacgcacgatatcactactatcagcatccctctgctgctcgtccatgatatgagcgaggagatgaccataccttggtgtctgagaagggcagagctcgtcttcaagtgtgtcaagggcttcatgatggagatggctagctgggatggtggaattagcagaactgtacagttccttgtgccacagtccataagcgaagagatgttttaccagctgtcaaatatgctgccacagattttcagagtttcctccactctgacccttactagcaagcattag

SEQ ID NO: 53851 - DNA, 1659 bp, Artificial Sequence
  Description of Artificial Sequence: Synthetic coding sequence
atgaaaaaaaaccgggagaggttttgtaatcgcgaaagggaatttgtgtacaagttcaaagtaggctcacagtgtttggagctcagagttcccctgaagttcccagtgcaggagaatgcttctcacttacatgggcgtctaatgctgttacacagcctcccctgcttcatcgagaaggacctgaaggaagccctcacccaattcattgaagaagagagcctttctgattatgatagggacgctgaagctagtctggctgccgttaagtcaggtgaggtggaccttcaccagcttgccagtacttgggctaaggcctatgccgagacaacgctggagcacgctcgtccggaagagccgagctgggacgaagatttcgcagacgtctatcacgatctgattcactctccggcaagcgagactctgctcaatcttgaacataactattttgtgtccatatcggaactgatcggcgaacgggacgtggagttaaagaagctgcgggaacgacaggggatagagatggaaaaagtaatgcaggaattgggaaagtccctcaccgatcaggatgtcaactccctggctgcccagcactttgagtcccagcaggatctagaaaacaaatggagtaatgagctgaagcagagtactgcaatacaaaagcaggagtatcaagagtgggtgatcaagttacaccaggatttaaaaaacccgaataactctagcttgtcagaggagatcaaagtccagccttctcaatttagagaaagcgtagaggctattggacgcatttacgaagaacagaggaaactcgaggaatctttcaccattcatctgggcgcacagctgaagaccatgcacaatttaagactgttgagggcagacatgctagatttttgtaaacataaaaggaatcaccggtctggagttaaactccatcgactgcagacggcattgagtttatatagcactagtctctgtggcctggtactgctggtcgacaatcgcatcaactcttattctggcataaagcgagatttcgctacagtatgtcaggaatgtactgattttcactttcctcgcatagaagaacagttagaagttgtacagcaagtggtactttatgcaaggacccaacgacgcagtaaactcaaggagtctctggattccggcaatcagaacggagggaatgatgacaaaaccaaaaacgctgagcgaaactatcttaatgttttaccaggagaattctatatcacaagacactccaatctgtctgagatacatgtggcctttcatctatgcgtggacgatcacgttaagtcgggcaatatcacagccagagaccctgcaattatgggacttagaaacatactgaaggtctgctgcacgcatgacatcacgaccattagcataccattgctgctggttcacgacatgtccgaagagatgaccataccctggtgcctccggcgtgccgagttagtcttcaaatgcgtcaagggatttatgatggagatggcgtcctgggacggcggaatttcccgcactgtgcaatttctcgtcccccagtcgatctccgaagagatgttctaccaactgtccaatatgctgcctcaaattttcagagtgtctagcacattgaccctcacctccaaacattag

SEQ ID NO: 53852 - DNA, 1959 bp, Artificial Sequence
  Description of Artificial Sequence: Synthetic coding sequence
atgaattgggtgggcggatcccgctccagagtcctgataaagcaggagcggagaaaacagaaagagtacttcgaaaaacatcggttgaaaagcaagatgaagtcactcggcgtactgtcacctgtgaaaaactccgctgtctcactcgatatcctcaacttatacatggtgaatcagatctcctgtaagaagaagatccctgagacagtgaggaagccaacccacgtgaatatgaatcgcgacatcaaaatgcccctcagaaagcacaatcttgagctaacaatgtccccgcattgcgttccaagcaagctttgcctggatgacaccgagaccaacgtcaactgtcagcgattaagctctaaagaagacctagggcctgtgcagtcacaaggcatggactcgtatagcatgctacatccccagttctctaaaattgaaaattgctcattcacaccttcctctttcagcgtggagctgccctccaatcggcacataagcaaacttaatttcacaagtggcatcgctcccacacctcaaaaattggcttatgaaaagaagcaaaatgaccagaggtctacagtgaactgtagcgattctctgctgtctaaactgaacaaaagccaagatgtgttttctcccagtcacaaaacaactaggtttggcaccttattcgagcgacttaactcactgggaaatcggaatctcctgactaagagccccgcagtgattatggacgaagattgtcgctcaaccgatgagatcagacagagcgactacattaccgagaaacactcaattcagcacatctggggcaagaacggcaaagaggtctccaacttcctagaggacgtgaatcaatccacacccaacttactgagcgagaactgtgattcttttgtcagtcagaatatgatcaatgttcttaacattgacgagcagcgcattaagaaaaccttcaacaaatgtgattatgattcaatgggcgatacctgtgtagttacgagcagcgacaagaatcacgttacggaccggtgcatccgtaatatttttaccgtcccagaattaacattcagcaacagcacattaaataagacgagttacccagaaaaatgccagcctaacaagaagtatcagagagagtacaacaagaatgaaaggaatgatctttccacatcctttgagaatgactactatcccagctcttcggaacggaaggagaagtttgagaatgactatcaagaaaagacgccccagaaatctattcaaaagtatcctgcaaatagtatggggaatattccttctgaggagttgcattctaagcagtcctgggattttggtctggatgagatcctgatggaggaagggggaatctattcacttaaatcaaagcgtatttcaaccaaaaaaatctctctcgacagtgctcagtccagcaggtcaacatcctatagccccagacccaccgacagctgcttcagctcctcaagtgacttgccttcggaggatgaggatcagattagccagcaaatcgaagactcgaataggatgacaataaaaaccaaagaaaaaatgaataatttctacgttgagcgcatggccaaactgagcggggatagaatagtgaagaatgatgataagatccacaagcagaacgaaaacttttaccagtttagtgtgaagaataacacagaccagtttcctcaactccagtgtaattccgctcatatactgcagaacaaaaccaacgacaactgcgtgcttcaagcggcaaggtgtgacgccggaatccagacagagtctgaatcagtgatggaggagaagctggatgtcgctattcaatgtgatctgatatctaaatgcacttgccgctccgacgtctccctctgcaatttagaacgctgtagcggaaacataaaagctgacacgaccggagggcaggagatccataagaataactag

SEQ ID NO: 53853 - DNA, 1185 bp, Artificial Sequence
  Description of Artificial Sequence: Synthetic coding sequence
atgaatcgcgacatcaaaatgccacttaggaaacacaatttggagctgacaatgtctccgcactgtgtccctagcaaattgtgcctggacgataccgagaccaatgttaactgccagaggcttagctcaaaggaggacctggggccagtgcagtcccaggggatggactcgtatagcatgctgcacccgcaattttctaagatagaaaactgtagctttaccccatcttcgttcagtgttgagcttcccagcaatcggcacataagcaagctgaatttcacttcaggcatcgcccctactcctcagaaactcgcctatgagaagaagcaaaatgaccagcgatccacagtgaattgctcagactccctactgagcaaactgaacaagtcgcaggatgtgttttctccaagccacaagacaaccaggttcggaaccttgttcgagcgattgaattctctcggcaacaggaatctgcttacgaaaagccctgccgtgattatggatgaggattgcaggagcaccgacgagattagacagagcgattatattaccgaaaagcactccatccagcacatctggggcaaaaatggcaaagaggtctctaactttttagaagacgttaatcagagcacccctaaccttctgagcgagaattgtgactcttttgtgagtcaaaacatgattaatgtgcttaatattgatgaacagcggatcaaaaagactttcaacaaatgcgactacgattctatgggagatacatgtgtggtgacatcttccgataagaaccacgtcacggatagatgcatcaggaatatttttacagtccccgaactcacattttccaacagcacgttaaacaagaccagctaccctgagaaatgccagcccaacaagaaatatcagcgcgaatacaacaaaaacgaacgcaatgatttgagcacctcctttgaaaacgactattaccctagcagcagcgagcgcaaagaaaaatttgagaatgattatcaggaaaaaacgccccagaaaagtatccagaagtaccccgcaaactcaatctggtgtacaaaatgcagcgagttcaaggttatatttacccttatccactacgtgctgatgcttaaccttttcctgaagagcttgcgcacagcgttccaggcatttctaaacaacgatctgcaactctag

SEQ ID NO: 53854 - DNA, 324 bp, Artificial Sequence
  Description of Artificial Sequence: Synthetic coding sequence
atgtccaccgtgatctgcatgaaacaacgggaagaagaattccttctgacaatccggccatttgctaatcgcatgcagaaatccccatgctatattcctatcgtcagttctgccacactctgggacaggagcaccccatctgccaaacacatcccatgttacgaaaggacaagcgtcccctgcagccggtttattaaccatatgaagaatttcagtgagtcccccaagttccggtcgctgcatttcctgaatttccccggaagtcaccatggccaggccacacagaaactgcagggggcaatggtgctacacctggaggaatag

SEQ ID NO: 53855 - DNA, 1083 bp, Artificial Sequence
  Description of Artificial Sequence: Synthetic coding sequence
atgtcaaccgtgatctgcatgaagcaaagggaagaggagttcctgctaaccatacggcctttcgctaatcggatgcagaagtccccctgctatattcctattgtttcttcagccaccttatgggataggtctacgccttccgctaagcacatcccctgctacgagcgcacctctgtgccctgttctcggtttatcaaccatatgaagaacttttccgagagccccaagttccgcagcctccatttcttaaactttcctgtgttccctgagagaacacagaacagcatggcatgcaaacggctgctgcacacgtgccaatacatcgtgccgaggtgcagtgtgtcaaccgtcagcttcgatgaggaatcatatgaagagtttcgcagttctcctgcaccctcttccgaaaccgatgaagctcctttgattttcacggcaaggggggagacagaagagcgtgctcgcggtgcccctaaacaggcctggaattcctcttttcttgagcagttggttaagaagcctaactgggcccactccgtgaacccagtccatctggaggcccagggaatccacatatcccggcacacccgaccaaagggacagccactgtcttcacccaaaaagaacagcgggtcagctgccaggccttccactgctatcggcctttgccgcagaagccagacaccaggagctcttcagtcgacgggtccctctaacacagagttggagccggaggaacgtatggccgtccccgctggtgcccaggctcatcctgatgacatccagagtagattgctcggcgcaagcggcaacccagtcggcaagggcgctgtggcaatggccccagaaatgctgcccaaacatccacacactccgagagacagacgccctcaggctgacacaagcctgcacggtaatttggcaggcgctcccctgccgctgttggcgggagcctcgacgcatttcccctctaaacgcctgatcaaggtgtgttcatccgcccctccaagaccaacacggaggttccatactgtctgctctcaggccctgagccggcctgtagtaaatgctcatttacactag

SEQ ID NO: 53856 - DNA, 1083 bp, Artificial Sequence
  Description of Artificial Sequence: Synthetic coding sequence
atgagtaccgtcatctgcatgaagcagcgcgaggaagagtttctgttgaccatccgtcccttcgctaatcgcatgcagaaaagcccgtgctacattcctattgtgtccagtgcgacactgtgggatcgtagcacaccaagcgccaagcatatcccttgttacgaacgaacctctgtaccttgctctaggttcattaaccatatgaagaatttctctgagagccccaagttccggagcttgcatttcctgaactttcccgtattcccagaaagaacgcagaatagtatggcctgtaagaggttgttgcatacctgtcagtacatagtccccagatgcagcgtgtctaccgtgtcctttgacgaggagagctatgaggagtttcggagctctccagcccctagctcggagactgacgaagccccactgatctttacagctagaggcgaaacagaggaaagagccaggggcgcacccaagcaggcctggaactcgtcctttctcgaacaactggtcaagaagcctaactgggcacattcagtgaacccagttcacctggaagcccagggcatccacatcagtcgccacactcgccctaaaggccagcctctcagcagtcctaagaagaattctggttctgcagcccgtccatccacggcaatcgggctgtgcaggagaagccagactcccggtgcgctgcagtctaccggtccctcaaatacagagctagagccggaggagcgcatggcggttccagctggggctcaagctcaccctgacgacattcagagtcgtttgctgggcgcaagcggaaacccagtgggcaaaggggctgtggcaatggccccagagatgctccctaaacacccccatacaccaagggacaggcgccctcaggcagacacctcattgcatgggaatcttgcaggcgctccactgcccctcctcgctggcgctagtacccatttcccatccaagcgactgatcaaagtgtgctcgagtgcccctcctaggccaacccgcaggtttcataccgtctgctcacaggccttgtctcggcctgtggtgaacgcccatttgcactag

SEQ ID NO: 53857 - DNA, 624 bp, Artificial Sequence
  Description of Artificial Sequence: Synthetic coding sequence
atgtcaaccgtcatttgtatgaagcaacgtgaggaagagtttcttctgacaattcgcccatttgctaaccgcatgcaaaagtccccctgttacattcccatcgtgtcatcagccaccctgtgggatagaagtacccccagcgccaagcacatcccttgttacgaaagaacatccgtgccttgctcccggtttattaaccacatgaagaatttcagtgagagtcctaagttccgaagtctccatttcttaaatttcccggtgttccccgagaggactcagaattccatggcgtgtaaacgtttactgcacacgtgccaatacattgtccctcggtgtagcgtgagcactgtgagcttcgacgaagagtcatacgaggagtttagaagctcccctgcaccttcttctgaaaccgatgaggcaccactgatcttcaccgccagaggggaaactgaggaaagagcacgaggtgccccaaagcaggcctggaattcatcttttctcgagcagctcgtcaagaaacctaattgggcccattccgtgaacccagtacacttggaggcgcagggtatccacatcagccgacacactcgcccaaaaggccagccactgagctcccccaaatag

SEQ ID NO: 53858 - DNA, 558 bp, Artificial Sequence
  Description of Artificial Sequence: Synthetic coding sequence
atggaagtgcatggcaaacccaaggcttctccatcatgctcctccccaacacgcgattcttctggggtgcccgtctccaaagaattgctcacagctggaagtgatggaagaggcggtatttgggacaggctccttattaactctcagccaaaatctcgcaaaacttctacattgcaaactgtgcgtatagaaagatcacctctgctggatcaggtccagaccttcctgccccagatggccagggctaacgagaaactgcggaaagagatggcagcagcaccaccaggccgtttcaatattgagaatatcgacggacctcactccaaggtcatacagatggatgtggcacttttcgagatgaaccagagcgatagtaaggaggttgattcttctgaggaatccagccaggattctagcgaaaattcttccgaatcagaagatgaagacgatagcatcccaagcgaagtcaccattgataatatcaaactgccaaactctgaaggaggcaagggcaagatcgaggttctggatagtcccgcttcaaaaaaaaagaagtag

SEQ ID NO: 53859 - DNA, 1245 bp, Artificial Sequence
  Description of Artificial Sequence: Synthetic coding sequence
atggaaatgcaacagaactgctctatttcttgcttctgggaaacacagcctctggggtgcgttaagatctcgtgtatcttttaccattcaaagcccaggaacattaacggattatttctgcccccatcatccaacattaccttgcaaaaggagattcaggagggaatccccttgcaatcccagtctcaggaacctctcaagccccaagagaacatttctcgtcctattcaccatccactggtgctcaagaccaatttcgaggaagaagaggaagttgacgagcagaacgatgcatcttcgttgtggacgaaaactcctgaagagatcgaggaaaagcgggcaatcaaagaaatgtgttataagtccggcgaatactacagattccatacgccgccagacattctcagctccaaatccatgaccccgactgcggagaaacagttggaaaagcccctcgaaaacggatcagagctgcaggaaggcgactccttaacagtgccaacgaaactctcccagtacgagaggcagggggaaataaagacttctctgcatgggaagcccaaaacagacattgcagcctttgagaatggaggaggtgactgttatgtgcctcagcgagtgatctttttgggggtcgacgagagcgaggctctgacagaagagaaggagatcacaatatctaagtgcagcaacactaaagataacaaagatagcccacaccccaagcacagtcttactacccgcttggtacctacaacccacgtgctaaacgcaacggaaaacatttccatgaaatgtagagaggacccttcaagcatgaacgacgttcagcctgtgaagaaacctcacttcaaaggggtcaagaaaaggaagtggatctatgatgaaccacagaatttccccaactccggcatgcagcgcgctgtgcaggccccacggccacaaaataagatgtcatatcaccgtaacaacaagaaccgaaacgctgagaatgccagttacatccacgtgcagagggatgccgtcagaacggtagccctcaacgctccgtcccgcagtaggcctacccacggcagctacaataaagtgcacgccaatagggaacccaagcctaacctcagtcccgacaagtacacttccacctcatacaatgactccgcttggaggaagcgaatcccatttagcaaaacttattccaaatctgagaaaatttatccagagccccgaaggaacgggagcaagtag

SEQ ID NO: 53860 - DNA, 294 bp, Artificial Sequence
  Description of Artificial Sequence: Synthetic coding sequence
atggaaatgcaacagaactgctcaatatcatgtttctgggaaacgcagccgctgggttgtgtgaaaatttcttgcatcttctaccactctaagcccaggaatatcaatggactttttttgccgcctagctccaatatcactctacagaaggaaatacaggagggcatcccattgcagtctcagtctcaggaacccctgaaaccccaggagaacatctcccggccaatacatcacccgctggtcctgaagacgaattttgaagaagaagaagaagtggatgagcagaatgggtag

SEQ ID NO: 53861 - DNA, 384 bp, Artificial Sequence
  Description of Artificial Sequence: Synthetic coding sequence
atggcccagcacccttgtcaggaccaggagcaaaaggtcgaaatgaccagcaaacagcagcgatccacctctatcgaagaaactatgaggcctcaggaaaaacaggtgacgatcacagagaccttgtgggatcaggtgcttactgttttcaaagatatacaaaaagaactgcaagaagatgcaagaattagaggaatgtcaaactgtagtatgacgccgatgaccagcgcgcctcgaactggtagtatccggcctcccgacagccttatgacccccaagctgaggcgtcttcagttctcgtcaggcgagcagcccagcggagggaggatccataacctcaagacacagcttttttcccagtcggcatattatcctggaccatag

SEQ ID NO: 53862 - DNA, 384 bp, Artificial Sequence
  Description of Artificial Sequence: Synthetic coding sequence
atggcgcaacatccatgtcaagatcaagaacagaaagtggagatgacatccaaacagcagagatccacttccatagaagaaacaatgcgaccacaggagaagcaagtcaccatcactgagaccttgtgggatcaggttctcacagtattcaaagacattcagaaagagctgcaagaagacgccaggattcgaggaatgagtaattgcagtatgacccccatgacttctgcgcctaggacgggttctataaggccccctgattcactgatgacgcccaaactgaggaggctccaattttcatcaggagaacaaccttcaggcggacgcattcacaacctcaagacacagttattctctcaatctgcttattaccctggaccctag

SEQ ID NO: 53863 - DNA, 1389 bp, Artificial Sequence
  Description of Artificial Sequence: Synthetic coding sequence
atggcatctccactgccttctggctttcccgctcgccgaaattcacgcttggacgtgtttctaaggcgacacctcccccctgaagtctatgacgccgttcgcgcttatgaaccttgtatagtagtgtccaattccgaaaatcatattctaaagtacgtcgtgctgagcgatagactggtgtatctgactgagaacccccctaagagcattcgacgggttgtcgctctgcgggacgttgtcgccattgatctgatcgatgattacccagagttcctgtcctcccccgacagagagatttcccagcatatccgcattatttactccagcactgtgctcaagaaggaatgcaagaagtctaatagtgtgcgcaagttcctgtttcctttccaccacaccaaagctaataacaaaaaagttaaggaagaaaaaaacggactggccttttggagaagcaaggagagtaggagtctgaaagagagccccttgcgctcagaagagaaaattaagcacttcagtcagctgaagtccgagctgttcctcaaggacaatagcctccggaggatactctctttgttaatggagctgaaggtggcagctcaaaaaaacttcatattgaagcggctcttctggaagacttcggatcttttctatttcatcgttaacaaactgcatgagtaccttcctgagtcccgcgacaagaacgcgctgcagaaccagtctcagcgggtggacgagctggttgcctgtatcgagatcatacagacgcttgttctgatgtttcgtgagaccgaaaccgagagctcacgtttaaatactctggcggcaaagaaaggcgctcttttcaatctgctggttatcctgatttctgagccacagatacccaaaagctgtccggtatttgacattcagttagtcgcagacagtgccctggtcagaatgagcttcgatgccgagctacagaaactgatccttgagtacaccaatactgctacggcattgttgtatgagattttgctcgtatttcagcagggaaatctcggacttggatcaaccaaattcgccatctcctggattatgtcatttcttcagtcctgcccacctatcattaccttcgtagcctccatagtgaagcaggtcgtgcgtggcctgagcgcctccttccagctgttgagcccgtgtcaggctgtccttctctaccagcagttctatatcctcaaatcatgtttgcgccactcacggacccttgccgagtacatcaggaacaactacagggaagagttcaggtatttcattcacatgcccgctctgcagaagcggctgccattgtgttaccccattacacagcctaccatccagctctttcacgaggtcctgaagctggttgagtag

SEQ ID NO: 53864 - DNA, 1878 bp, Artificial Sequence
  Description of Artificial Sequence: Synthetic coding sequence
atggcaagtcctctcccctcgggctttccagccaggcggaattcccggttggatgtgttccttaggcgacatctcccccctgaggtttacgacgcagttagagcctacgaaccctgcatagttgtgtcaaatagtgagaatcatattctgaagtacgtcgtgctcagtgaccgcttagtctatctgacggaaaatccacctaaaagtatacgccgtgtggttgcactgcgcgacgtcgtcgctatcgatttaatcgatgattatccagagtttctaagctcgccggaccgtgagatttcccagcacatcagaattatttacagtagtactgtgttgaaaaaggagtgcaagaaatccaatagcgtacgaaagttcctgttcccatttcaccatacaaaggctaacaacaaaaaggtgaaagaggaaaaaaacggactggctttttggcgttctaaggagagtcgtagcctgaaggaatcaattctccctgaccgggaccagcaggaatccagcaccccgagtaaagactctacactttgtcccagaccgggtctgaagaaactgagcttgcacggccagggagccttcaggccccttccatccccttcccgacgatcctctcaaagtgccccaacaacgggtaaggccgtgtccgagccatcatgcaccacaaacaccaaagagcctcagggactacccgatcacaactcaatttccgagattcctttcaaatgtaatgggaacggcaatgaattttatctaggcaatagcttgctggatagtccctcgcagagcaattcaaacttggaaaagaaggagtctgagcttcacctgtatgtcatctccaccacgtcttcaatttttctgcatctgaaaagttcctggaataactacatcattgtcaaggctacactgctgcaggaccccttttacgctagcgagttcagccctgccattgggtctcagaaaccgtacagatcagaagagaaaatcaagcactttagccaattgaaaagcgagctcttcctgaaggataatagtctgaggcgaatactgagtctactgatggagctcaaggtcgccgctcagaaaaattttattctgaagcgactgttctggaagaccagtgatctgttttatttcatcgtcaataaactgcacgagtatttacctgagagtcgggacaagaatgccttgcagaaccaaagccaacgggtagacgagctcgtagcctgtatagagatcattcagaccctggtattgatgttccgggagacagagactgagagtagccgcttaaatacgctggccgcaaaaaagggagccctgttcaacttactggttattctgatctccgaaccccagatccctaaatcctgccccgttttcgatattcagctggtggcagatagcgcattggtgcggatgtcctttgacgcagagttgcagaagctgatcctggagtatacgaacactgctaccgctttgttgtatgagattctactggtgttccagcaggggaaccttggactcggatccaccaaattcgctatttcttggataatgtccttcctgcagtcttgccctcctataatcaccttcgtggcctcaattgttaagcaggtggtcaggggtttatcagcaagcttccagcttctatccccttgtcaggccgtgctcttgtatcagcaattctacattcttaagtcatgcctccggcattcccgtacactcgctgagtacatccggaacaactatagggaggagttccgatactttatacatatgcccgcactccaaaaacgcctgccgctgtgttacccaataacccagcctacgatccaactcttccacgaggtcctgaagctggtggagtag

SEQ ID NO: 53865 - DNA, 2328 bp, Artificial Sequence
  Description of Artificial Sequence: Synthetic coding sequence
ggttttctgatccaccccctggtggtggcgctccaacaacctcccctacccgtgctaccccctttgcctctgccgccaccccctcccccaccgccatacgggcgattactggccaacagcaatgcccatccagggcctttcccgccatctaccggagcgcagagtaccgcacaccctcctgtttccacccatcaccatcatcaccagcagcaacagcagcagcagcagcagcaacaacaacagcagcagcaacagcagcagcatcatgggaattccggtcctccacctccaggagcgtttccccatcccctggaaggagggagttctcaccacgcacacccctacgcaatgtctcctagcttgggatcgctgagaccgtaccccccaggaccagcacaccttccgccaccccactctcaggtcagttactcacaagctggccctaatggccctccagtgagcagctctagcaatagctcctctagcactagccagggatcatacccctgttctcacccttcaccttcccagggtccgcagggcgcaccatatccatttccccctgtgcccactgtgactacttcttccgccaccctgtccaccgttatcgcaaccgtcgctagcagtcccgctgggtataagaccgcttctcccccaggaccacccccatatggcaaaagagccccaagccctggcgcatataaaaccgccactccgcctggctacaagccgggatcacccccatcatttagaaccggcactcccccagggtataggggcaccagtcctcctgccggtcccggaacttttaaaccaggctctcccaccgtcggccctggtcccctgccaccggctggccctagcggactcccatctttgcctcctccaccggcagcccctgcatccgggcctccgctgagtgccacccagataaagcaagaacctgccgaggaatatgagacccccgaatcacctgtgccacccgctaggtccccgagcccccctcctaaggtcgtcgacgtcccctcccacgcaagtcagagtgcaagatttaacaagcacttggatagaggattcaattcatgcgccagaagcgacctgtacttcgtccctcttgagggtagcaaactagcaaagaaaagggccgacctggtcgagaaggtgcgtcgggaagctgaacaaagggcaagagaagaaaaggagagggagagagagcgcgagcgcgagaaggaaagggagagagaaaaagaaagagaattggaacgttctgtgaagttggcccaggaggggagagcccctgtggaatgccccagtttggggccagttccacatcgaccacctttcgaaccgggaagtgccgttgctacggtgccgccatatctaggccctgacactcccgctcttcggaccctgagtgaatacgcgcgtcctcatgtcatgagccccggtaataggaaccatcccttctatgtcccactgggagccgtggaccccggactgctggggtataatgtgccagctctttattcctcggatccagctgcccgtgagcgggaaagagaggctagggagagagacctgagagatcggctgaaaccaggcttcgaggtcaaaccaagcgaactagagcctcttcacggcgttcctggccctggactcgatccttttccgaggcacggcggtctagcacttcaaccgggtccaccaggtctacaccccttcccctttcatccctccttgggacccctggagcgggaacgcctcgctctagctgccggtcccgcactgagacccgatatgtcgtatgcagaacggttggcggctgagcgacagcatgccgagcgcgtcgctgctttggggaatgatcctctggcccgtctccagatgctgaatgtgaccccccaccatcatcagcatagccacatccattcacatctgcatttacaccaacaggacgccatccacgccgctagcgcctccgttcaccccctgattgatcccttagcttcaggctcgcacctcacaagaatcccttatcctgcagggactttgcctaacccgctcctgcctcaccccctccatgaaaacgaagtgcttcgacaccagctctttgctgccccatatagagacctgccagcctctctctctgcccctatgtccgccgcacaccaactgcaggcaatgcacgctcagagcgcagagttacagaggttagcactggaacagcagcagtggcttcacgctcaccaccccctccattcagtgccccttcctgcgcaggaggactactactctcatctcaagaaggaatctgataagccattgtag

SEQ ID NO: 53866 - DNA, 738 bp, Artificial Sequence
  Description of Artificial Sequence: Synthetic coding sequence
atgagttctgagtctgagaaagataaagagagactgatccaggccgctaagatgttcttttttcacgttcaagacctggcctcagtgattaataccttaacagagctcttttcacggtcaatgaatacacaaatccttcttatggccgttaagaataattcttatattaaggacttcttcgagcagatgctgaagattttcaaagagatgcagagtgtcgtggacgcaaggcatgacaagattcagaaggaatcactttgttccaaggtcgcaatggcaatgtgctcagttgttcagaaaagcactaacgtggaggagctgcatcagtctgctaaagaggtgttcaagagcgctcatacgcccgtaattatcagcgttctgaactcaagcaacattctgggatctctggaatcctcactgtcccacctgatgaagttccctattatgaacttacagttaagcgatttttacacagaagatacaaaagagcagtcagatgtgactacttcagagcggacccggtccccgcctggatcctctaagaccactatgatcgacactctgaaaaaactccaggatgtactcaaaactgaggactccaaaaatcccactaaatctgccgcagatctgctagagcaaattgttaaggctatggggcctatactggagatattgcagaaggccattaagacaatggagatgaatatctcagtgttcaagaaagcatctgacaagtag

SEQ ID NO: 53867 - DNA, 396 bp, Artificial Sequence
  Description of Artificial Sequence: Synthetic coding sequence
atgggcggaaaaagtgctgttagacaccagctagtgctcgactgtcctagagaagctgccagtagtgctcccgcattgcgtcctctgggggcagcagcgacatcccgcgctgccccattggccccacttcctgcaccaagtccgaggtggggcctgggctgcgggcgtgtcaggtaccccggtccccatcctcgtcgagctgtcgaaccagcagcagggccactgtctgcgccaatcattgcgggaggccacccagccgaggctgctgcaggctcagcgaaacagcagcctaggcacagtcgcgaagtccctcggcctcccgtcccccagcatcccagtgggaattctcggagcgccttgcaggaggcgaagaccgaacagacgaagacaccttag

SEQ ID NO: 53868 - DNA, 2418 bp, Artificial Sequence
  Description of Artificial Sequence: Synthetic coding sequence
atggccgctcaggggtccccgagttcaagtccatctgatgattcaactacaagtggaagcctgccggagctgccgccaacatcaactgccacaagccggagtccgcctgaatccaaaggtagctcccgcagttctctgctgcagtggacgtgccccgaggactctcttccccttgctgtgttctacgggcctctggacgctaaaaaccctctactggcctcctgcgaaaaagagattcaggaattacttggatttatgaggaaaaagaaggcacttgctaccaccgaagaggaaaagcacgagttccggagaagatgtgctactagtctcttcaatatctggacaaaatatgcccctcggttgcccgctgattattacaacgaaaagttgctgaaagtgggagattccttgtgccaaatgaaggaatacaagttagctttactgcagtgttacggtagatatttacagcagtttaacacaaacttcgacgagaataaggtagacgtgactcaatttaaagccacattctttccaaagggctttaaagacaagaccgccggattgactttccacgcactatctgggaagaacatgtgtaattaccagctcgtctgtgattccgacgagaatctcaaaaacaaggaaagcgttgttcaatgcctacatatcctctctagcctccgccttattatgcaggtggcactgccacaagagcatttatgctggatcatattcaacggcacgatctatatctataccatttgtagaaaattaatggtcatcgggcagagtagtaaggctctcgaatacttgctttgggctagcatgtgtatggagagcctggtcccactcttaagtcttaggtacttgacatggcgtgcgacactctacacagcggtgtgtcaatgctgctacgactgccatgccggtatccacggagaagccttcgcccgtcgcgctttagcgaagatcgatgaacttcgccagctggaacttatgtcctctagtaaatcccaagaagagagtagacgctatttcagggaggcaacaatgaaaatggccgttatgatattcaagagaggcgtttttgaatcacggagaaaaaataaggccgtctttcgacctaaaattaggatcaatctgcgggaggtgcagaccctgagctggcctaggacagtgaccgagcggctgcttgatgaaatgttcgatagcactgcgtcacaatttttggccgtcctagaggccctgagtgactcaaaccggaggatcctgcaaaccggcccaattgtcaccgatgaggtggagatccacgacgtcgtgagtgagctgttcatggctgggaaagagctgctgatcatgagcaatattggcgctgacggtatgctagatttccctaagacctccctgttggaactaatgatcggtcgcaaggatgtcatttccgtggacgccgcagtgaagtttattaaattagcgtttacctacgaagaatggagcctgttcgagagcagtgcggtgcatctgatctactttttgcaacggcaggatgaccctgagtctaagaaagccgagaaggatctgacgctgctcattgcaatggaaccactcataaatgtcaaacggaacaaaggcctgatcttccccttagaaaactataaagaggggcagtccacacagatctacctgaaaaaaattgcagtacacgatacatgtcttaagacatgtggatatagcgaagatatcttccatctcgccgctaccctgtatgtctgtgtatgtaccgctccacaggatgtgcagccggacaaagaaattgtcgtcgacacaattatgtttctgtggcagaaatgtaagctgggcattcagagactgaacatctcccgcaacgactatgccaagtttacgcaaaagatctctacgaataagtggatctatctgctttggcaaatcaacgaagtcattcactgttataagatggaggacatcgacattgtggtggtggcagaggtgaccctgaggctgagcgagatattggagtctctggggtcccccggaagaaagttcaagcaatctctggatgtgcccctgagagaaggcactaataagtttccaggcgctccgaaagggatcaccgaaatcctgcctatcctgcagaaaaatcctgtggagcaactattgttcgcctacaagcttttggatcgagcaattggcggaattaacctgaattgtatgctgacctccttgccaaacggatcgtccgtgattgaccattgctacgccaagcggacgcaccacatcgacggagatacatacaaacctcttgctagcaacagcttcatgatggatctgcacctggagctcattcaggctcagcaccggatagcagtggtgctgctggacaaattacaaggttcttag

SEQ ID NO: 53869 - DNA, 3594 bp, Artificial Sequence
  Description of Artificial Sequence: Synthetic coding sequence
atgtccgacgaaaatatgtctaaaacccagacagtctatgactctgacagccaatctgggtcttctgcaaaagagaaggatcgcggtgcaaacttgtgtgtgatggatcatttcatgaaaatctttctgtactgtaggcgggctatggtgttggcccacagaggcggatactggactttgctgcagaactgctgccgcgctctgtggaactttacccaggagctccaaatcttgttaaaacaagcagtggatctagacaaaacgttcccgatctcccaggacggatttctgtgcacttcagtgctaccattttacctaggcgcagaattgctgatcgatatgctgatccaattgcagaacacctcctccattaaacccatcgaggataagggtgagttcagcgtcccctcctgctatggcaatatcaaaaatgacaatggtggctcctctttgacatttgagcatcctcttgatgacgtcaacgttgtagacctcaaatggatacatgatttcgtgctgaaaagtctcgaggtgctgtaccaggtagagaaatgggaaactctcgtgtccctggccattcagttcaataccgtaagccatgagcgttacacagaacaggtaacaccactgttggtctatgctcagaggcaacttctcctgcgcatacagaaatttaagggacctgatatcacacaacagccgtgtgcaaggtatgaggcagaatatggggaaaagatcacatgtcgaaactttatcggcaagcaactcaaaatcaacagcagcacaattgaagccacatcaaactgcaccgacctcctgaagatgctcatcagttccgaatattctcgcgctaaagccctagtctgcgtcccggtggatgtcacagacaccctgagatgcttcagggagaccctggagaagtccaagtaccacaatagatccatcaggcactcacgaaagttgctaagtctgttccttgcccagacccaggatgttttacaggcctccaaccagcgctccctcaaagttcaggcactgcactcactgggttcactgctgatctttgctgagaagaaaagggccgctttcaaatgctggtgtcaagccctcgacgacatctttcgaaagcccgatgtgttacacacttggaaggagtttggaccatcactaaccaatgtgaccaattcacattcaccgccaggatttaaggactacagcgaggaatttctgtcacgcgtcgggatttggggttgtctgcagggcgcagtcatcagtgcgaagatcgctcaatttatcaagtctctgaatgtggagaaaaaaaccgattgttgtatcctgagtgcattattgtttcaggggctcctacggactaccctgccccatcctaaagcagagcgatgttacgcccaatacgaaattacccagctcttacctggaattgagctctttagcgatcgatatcgcgctgatatttgttctgttattgcctctttgtactacataattagagaactccactttgtgagacagaaccttatcgtgctgcccttgcttgcgctctaccagtattttgtgtccggaatttgccaggacattacgcgtaacctagaagcgagaattttaaaaatcgaggtgctgatagacctcaggttttttagcgaagctttctacgaaatttcgcagatattttacgggaaaaatatgccctgtcccatccccgcagggtacaaggctaccgggaaaatgaagatctttcagtcatttgactcaggaaagctccttactagcaaggaaaatatccaggctattgacgagttaagaaacaaggggcttccagcagtactcgtgacaattggccagccacatctcctgaacaagtttaattttgtgaaggcctattttttcctgtccgtggccgcaacaataaactgtgtccccgagaacaagtttaaaaccgttatcaccaacaagtcgaagccaaatttgcccaatctcgaagaaatttacagcaaggatgatgggtcaagcttctacaacctcacgaaactcaaagacgaaataacgttgagcatgctgaagagtatgcttcttatggaagcagaagaccgactaaacttcctgctgtctgaagttgagcagaagacgttgagtcagtgttcagccggagaactggaaatagtggtcgaagccaggttacagctcgctgctgtggctctccagaggcaccgcgcagcctatagtgcagcaatagtgttttccactctgacactgctccaggacagtaagctgtttgaaaagaaggtggtgcaggatgatacagaaaaccctgtctctcccggaacaagcgtgaccgaaaataaagacgatagcgaattcttagatcctataagtctgaatgcacgcgaatactttaatatacatttgtggctgcgatgcaggttagctctggtcaccgcattcgtcgctcagatccacggtatcggcatcgttaaggaggacgacatgacagactgtttaagcctcatcaacgaagtgtgtatggaagctaaatcggccggagacaccgaactgcaagcggagtttctgacacaggctgtgatactgggattgcaggaaaaacacttgaaggccgacattatgacgaacctgcaggatattattcatctactcgagggcaacgaatttatatctccacagtccagactgactctggcccgatctcttgtattgctggacgacttgacaaaagcagagaaattcaaagagtcaccatccagcaagacaggtaaactgaatctcctgacacgggctcatagcattctgaccgagcagatgctggcattcggcgagaccatcgagttcaggtcgtccaacactaagtacgcgaaccccttgcaacccctcaagaacatttatttaccccacgtaatgttgcttgccaagatcaaaatgcgcatcgggcacaccgtggcaaaacaggtttactacaaaaataagcgcaaggacccttccaaatggttgcccgctctccatttgtttgatgtagcgttgaagctgtgcagaactactgcggttgaggagcacgaggtggaagctgagattctgtttcagaaggggaaaatcgagaggcagatcttaatggaggagaaaagtcctagcttccagttggagtctctgtatgaggccatacagctttccctgaaaaatgaccaaaacagcgggctgattcgggactcttacctggagatggccctcctgtactttcacctgaaaaagccaaaaataaagatctcgggaagccctctgacgcttaaaccccctctccgccgaagtagttcagtgaaggaaacatccgcaaacaagtttgagatgtattctagtctcgcttggatagccatccgcgcagctgctcaagtttccgaggctgtgctggctattaatctgttgatcggaaaaaaaaataccagaatgcacaaggtgaatcaggtggcgctgccaaacattccagagtttgctgcccttgacctactttcatcttacactgattacctgctagggatgtttggctgcctgcacattatgcagaaaaactag

SEQ ID NO: 53870 - DNA, 1338 bp, Artificial Sequence
  Description of Artificial Sequence: Synthetic coding sequence
atgggcgaatccatccccttggcagcaccagtgcccgtggagcaggccgtgctggagacattcttttctcatctcggcattttttcctatgataaggccaaggataacgtggagaaggagagggaggcaaataagtctgccggaggcagctggctgtctctcctggctgctctcgcccatctggcagccgcagagaaagtctaccacagtttgacttacctgggccagaaactgggaggtcagtcgttttttagtcggaaagactctatcaggaccatctataccagtctccataacgaacttaaaaaggtggtgactggtaggggcgcactaggcggaacggcccctcatgtggaggagttgctgtctcacctgagtgaacagctgtgcttctttgtgcaagctcggatggagatggctgatttttacgaaaagatgtacacgctgtcaactcaaaaattcatcaacgctgaggaactggtgggcctgttggatgccattatgaagaaatactcttctagattccaccaccctattctctctccactcgagtccagttttcagttggaagtagatgtgttatgccatctgttaaaggcgcaggctcaggtaagtgaatggaagtttcttccctctttagtcaatctgcatagcgcgcacacaaagctgcagacatggggtcagatttttgagaaacagcgagaaaccaagaagcacttgttcggcggtcagtcgcaaaaggccgtccaaccgcctcatcttttcctttggctcatgaagctcaaaaatatgctcttggccaagttcagcttttactttcacgaagccctgtctcgccagacaacggccagcgagatgaagaccctgacagctaaagcaaaccctgacttttttgggaaaattagctccttcattagaaaatatgatgccgctaatgtctctctgatatttgataacaggggtagcgagtctttccagggtcacgggtatcaccacccccactcctatcgagaagcccctaaaggtgtggatcagtatccagcagtggtttcactcccttctgaccgtccagtgatgcactggcccaatgtaatcatgatcatgacggacagaacctcggacctgaattctttagaaaaagtggtccacttctatgatgacaaagtgcagtccacgtacttcctgaccaggcctgaaccgcacttcacaatcgttataatttttgagtccaaaaagtctgagcgagatagccattttataagcttcctgaacgaagtgagcctcgctttaaagaatcctaaggtctttgccagtttaaagccgggagctaagggatag

SEQ ID NO: 53871 - DNA, 1032 bp, Artificial Sequence
  Description of Artificial Sequence: Synthetic coding sequence
atggccttgaccccaaccaatctgaataataagatgagtctgcagatgaagatggactgtcaggaacagcagctcacgaagaagaataatggcttctttcagaaattaaatgtcaccgagggtgccatgcaggacctgcttaaggagatcatcaaagttgatcacatcctggaccgctcagacgacgaggatgatatttcctccgagaatcctcagaccgactttctgcataagggcatgttagagttagaagcagagcacgaccaggacttgtccaagcaggataagcaggagaccgatgtggacgaggaccctcaggcttcaacgagcctgcagttcagcaagaagaaccttctcgagctctgccttaagggaatgttcttaaaactgaattattggaacacaaagatcggacttcaggtgaaagagctcggggctgattacatagacggtactgaaaaaattgacaacattataaagaaaatcaacgttaccgagaacactgttaaatccctgctgaaagacatgctaacattaaagggtcagatagagaaactggaggatagggggctcgatctagaccaggggacctcgactgaagtcaacacctgcaacgaggtttacgagctgaaaaagaaggttattgagagactggaggacttatgcaagaatgtggagcttctctccgccaaattacgcatgtaccagatggaggcagaggatacagacagtcactccagtgaagaaatagacaccgaggagatggaggccttgctaccgcaagccccagcaagctttttagtgcaaaaaagtccaccccgaaacacagcttggaagagggcactgcgcatctttattatgtttgatgtgctcacagtcacgggactgttatgttacatcctgttcttcggtgccactttcctgtttgaaagagtcctgctgcggatgctgggatgccggacaacttgggatctacgcgaaatgagggagcccttcctgaacctagaggtagaggcgctcctgccctcttag

SEQ ID NO: 53872 - DNA, 1032 bp, Artificial Sequence
  Description of Artificial Sequence: Synthetic coding sequence
atggccctgacccctacaaatcttaacaacaaaatgtccctgcaaatgaagatggactgtcaggagcagcagctgactaaaaagaacaacggtttcttccaaaagctcaatgtcacggagggagccatgcaagacctgttgaaggaaattattaaagtggatcacattctggaccgatccgatgacgaggacgacatatcttccgagaatccgcagaccgacttcttgcataaagggatgctcgaactggaggcggagcacgaccaggacctttccaagcaagacaagcaggaaacggatgttgacgaagacccccaagcatccaccagtcttcagttctcaaagaaaaatctgctcgaactgtgcctcaagggcatgtttttaaagctgaattattggaacactaagattggactgcaggtgaaggaactcggggcagattatatcgacggaactgaaaaaatcgacaacattattaaaaagattaatgtgacggaaaacacagtaaagtcattgctgaaggatatgcttaccctgaaaggtcagatcgaaaagcttgaggaccgtggcctagaccttgatcagggcacctctactgaagtcaatacttgcaacgaggtctacgagttaaaaaagaaagtaattgaacgtctcgaggacctgtgtaagaatgtcgagctgctctctgccaaactcaggatgtaccaaatggaagccgaggatactgacagtcacagttcagaggagatagataccgaggagatggaggcgctgctgccccaggcccctgcatcctttctcgtgcagaagtctccccctcgcaacaccgcgtggaagcgtgccttacgaattttcatcatgttcgacgttctcaccgtcacagggttactgtgttatatcttattttttggagccacctttttattcgaaagggtactattgagaatgctcgggtgtcgcactacctgggatctccgtgaaatgagggagccttttttgaatctggaggtcgaggccctgctccctagttag

SEQ ID NO: 53873 - DNA, 906 bp, Artificial Sequence
  Description of Artificial Sequence: Synthetic coding sequence
atggcctatagtagctctaattctgatattgaagacgactccagcaagagtaattccaatctctccctaagtgtgggatatttcccatgtgaggacaccccatgtgaggacaccaccagctgggaggatgcacccagtaagggtcctagtatccactttcttcctcctgtgcaaggagcttggggcactgagcgtattggacggcgtatgaaaaggcaggaccagattcaggacgagcccgaacagttttgtaaactgtctatcttcctggcctgggacgtggacatcgggtctgacaatactgactcccgcgcaaatcggctcctcaatggggacaacctatggattgacaagttgcccaaggaacggacaaagctgagtgtcggcaaattaaacaatttggttcaggagtttcaaattttcctagagaatttaaaagatgatgatgccgtgtttccagagaccgcacagcaagatttccagctgtcctctgggagccctcccgagatggtacaggtgagccatcaggagtacgatgcgtgccaggatctgcccaaatgtaagcctccagaaaataaagatgttatgctgaagggccatgagctggccgagatgatttcacaggccacagcatcccagcggacctctgcacctgaaatatcttccatcctcagtgagcagcccgaaaaggatgacaccccgagtcacacccaggcgcaatgctgcttgaactttggatgggccttttcatggctgcgacaacggatcctgccatctctcttaagaagagaccaccccgttaacgcgactaaaagtccccaccgttctgccccaacaaagcgtttatttcaccggggtaagcgcattcaaccacaggagacccttgagctagggcatccaatctag

SEQ ID NO: 53874 - DNA, 810 bp, Artificial Sequence
  Description of Artificial Sequence: Synthetic coding sequence
atggcctacagtagcagcaactcggatatagaggatgactcaagtaagtcaaactccaatttgtcacttagcgtgggatatttcccctgcgaggacaccccttgcgaggacactacatcctgggaggacgccccaagtaaaggcccttccatacactttcttcctccagtgcagggagcttgggggaccgaacgcatcgggaggcggatgaagaggcaggaccagattcaggacgaaccagagcagttttgtaagctctccatttttctggcatgggatgtggatatcggcagcgacaatactgacagcagagcgaatcgcctgttaaatggtgacaacctgtggattgataaacttccgaaagaacgcacaaagttgagtgtgggcaagttaaacaacttggttcaggaattccaaatttttctggaaaatctgaaagacgatgacgcagtgtttccagaaacggctcaacaggactttcagctgagtagcgggagtccacccgaaatggtgcagatgatttcacaggccactgccagtcaaaggacttccgccccagaaatctccagtattcttagcgagcagccagagaaggacgacaccccttcacacacccaggcccagtgctgcttaaatttcgggtgggcatttagttggttgaggcagcgaatcttgcccagtctgctgcggcgtgatcatcccgtgaatgcaactaaaagtccgcatcgctctgctcccaccaaacgcctgttccaccggggaaagagaattcagccacaggaaactttagagcttggtcacccaatatag

SEQ ID NO: 53875 - DNA, 573 bp, Artificial Sequence
  Description of Artificial Sequence: Synthetic coding sequence
atggagaaaacagaaagtttttgtcctgaggtacctcctcaggattgtggagcttcccctcgcccaagcctgcggtctctgcccaaaaaccaaggcagcctcctgcagttcgaccggcaagcaccagggaggatttccacctcacctacgctccggagactccgaacaagaggctgtgggacccggcaggatgcttggcaagtcacaacgtggggtagctggggagcgccagtcggcttcccatgttacctaagcaagagcctcccgggaagccctaaggatagcagccacctgctaagtcccctgcggcttcacagtaggctaacctccgagcccgaacgggctctcaacgcggcagactccctggaaccgcagactcggccaactgacaagtatttgccccctgaactccaacccgtgaatgaaggctccttacaccaggcttctttgcgtcagcaagaaggtcactttctgccttcaccaacactgcgtcacccctcccctcagggggaagagctccatccctctcgctgcgtctgcatctattttctccgatgttacgacatttgctag

SEQ ID NO: 53876 - DNA, 522 bp, Artificial Sequence
  Description of Artificial Sequence: Synthetic coding sequence
atggaaaagacagagagtttctgtcctgaagtaccaccccaggattgtggggctagtccacgacccagtctgcgaagcctgccaaagaaccagggctccttgctgcaatttgataggcaggcccctggacgcatttcaacgagtcccactctccgacgactcaggacaagagggtgtggtacgaggcaagacgcctggcaagttactacctggggctcctggggagcacctgttgggttcccttgttatctgagcaagtctctgcccggatcaccaaaagattcatctcacctgctgtcgccgctcaggctgcatagcagacttacctcagagcctgaacgcgcactgaacgccgctgactcactagaaccccagacccggccaaccgacaagtatcttccgcctgagcttcagcccgtgaatgagggcagcctgcatcaggcttcactgaggcagcaggagggccacttccttccatcacccaccctccgacatccctctccacaggtcacccaattatag

SEQ ID NO: 53877 - DNA, 192 bp, Artificial Sequence
  Description of Artificial Sequence: Synthetic coding sequence
atggggtgcggcaatagcactgctactagtgccggagccggtcagggtccagccggagccgctaaggatgtaaccgaagagagtgtaactgaagatgacaagcgtcgtaattacgggggagtgtacgtaggactgccctcagaggccgttaatatggtatcgagtcagaccaagaccgttcgaaagaactag

SEQ ID NO: 53878 - DNA, 408 bp, Artificial Sequence
  Description of Artificial Sequence: Synthetic coding sequence
atgtttcaaaatctgcagggcaccttcgaaaaagagatcgggaaaattattccattcactatcgcctttaaacgagccgaggcggttgagcccgatggctgtgttcagagttggagatgctgtctgccctgtgaccttggccaggccagcagattcatccatacaaccgtctgctccgctattagatggcgctcatgcaagggggagcgaaacttcgccgaaagacatatcttgcccgcagagctcgaagaacagtctaatcatgccggtatgggacccattttaccagccatgccgtccgttgacggcaaccactttcagcaccctgctggcgactgtcatccctatggcatcctctgcctgcaggcacattctgcctccgtcaccgccaggcaggtgttgcagtag

SEQ ID NO: 53879 - DNA, 438 bp, Artificial Sequence
  Description of Artificial Sequence: Synthetic coding sequence
atgattcctaagctagcaaccccaagggacatcagtctgctagtgattaaggaggcttctagccgggcacgcaacaatatccaaatcctggaccccttggaccacatcgcacgcctgacaaactacacgctgactagctgcttttcttccaacaaggtcccgaccatgccgggaagcctccctaccggttcaaagcaaggcaatgtacagacgctggactccattagatggatgccagcaacacccgtgccggctcccgaatgccaccagaaatatgccattagcactgagacagcctttccgacccttagcacctttatgaacaccgagaaatccgtcaaaggttctaacgcagattttacaaaacggaatcctaggtggcgattcttattggggatctattgttctctgcatcatgccatgactatttttatatag

SEQ ID NO: 53880 - DNA, 870 bp, Artificial Sequence
  Description of Artificial Sequence: Synthetic coding sequence
atggaacagccagggccacgcgctcccgatccgagcctgtgtcatcataaccttcagccaaccgatgatcccaattgggattcatacgcaaccactatgcggactgcttttaccccaaagactggggcagtgccggcactcatcagacagaacggcatacgcaggctcggatatacttactccctgagcgaccctattttgaaccaaactcagtactctgatgagtacacctggaaatctcactccaaggaagacctcattaagacggagacctcgagaggcattaagagtcataagtcacatcttaacgaagacatcttcctgtggaccctcccccattgtcagcaaactggaacattaaagaactgtctcccttggaagattcccgcttcgatgaaagaggtgaacaaagccttgagcaatcagtttatatccttaacaaaaagggactttgtcgataggtctaaagctcagaagattaagaaaagctcacatctttccctcgagtggaagaagcttctgccccagccgcctgatacagaatttcgccgtaattatcagattcctgcaaagatccccgagctgcaagatttcagcttcaagtatggatgctactcctcgctcccagtggccagtcagggcctagtaccatcagtgttacatagctatttgagaaaccaagagcacaccaaaaagcaaactacgtatcagtctgactatgacaagacctatcccgacttcctcatgctgttgaactcgtttacttcaagtcaagttaaagaatacctgcagagtctctcctataaggatcggcaaatcatcgaccgatttattaggacccactgtgatactaacaagaagaagaaatag

SEQ ID NO: 53881 - DNA, 561 bp, Artificial Sequence
  Description of Artificial Sequence: Synthetic coding sequence
atgaacttaccccacctgatgtctctggcttctcacttagccagccatggatttttttgtctgagatttacgtgcaaaggccttaacatagtacatcgcataaaagcctacaagtccgttctgaactatctgaaaacaagcggcgagtacaaacttgctggagtgttcctcggcggacgaagcatgggtagtagggcagccgcatccgtaatgtgtcatattgagccagatgacggtgacgacttcgtcagaggactgatttgcatatcctatccactccaccatccaaagcaacaacacaaactgagggacgaagatctgtttcgactgaaagagccagtgttgttcgttagcggatccgctgatgagatgtgcgaaaaaaatctattggagaaggttgcacagaagatgcaggctcctcataaaatccattggatagagaaggctaatcattcaatggccgtgaagggcaggtctaccaacgacgtttttaaagagattaacacccagatcctgttctggatccaggaaataacagaaatggacaaaaaatgtcactag

SEQ ID NO: 53882 - DNA, 561 bp, Artificial Sequence
  Description of Artificial Sequence: Synthetic coding sequence
atgaacttaccccacctgatgtccttggcaagccacctcgcttcacacggtttcttctgtttgcggttcacttgcaaggggttgaacatcgtacatcgaataaaggcctataagagtgtccttaactacctcaaaacttccggggaatacaagctggctggagtcttccttggtgggcgaagcatgggtagccgcgctgccgcttcggtgatgtgtcacatcgaacccgacgatggagacgactttgtgcgtggtttgatttgcatctcctatccattgcatcacccaaaacagcagcataagctgcgtgacgaggatctcttccgacttaaagaaccagtcctatttgtcagcgggagcgccgacgaaatgtgcgaaaaaaatctgctcgaaaaggttgcccagaaaatgcaggccccacacaagatccactggatcgagaaggcaaaccatagtatggccgtgaagggaaggagtacaaacgatgtcttcaaggaaatcaacacacagattctattttggattcaggaaataacagagatggataagaagtgccactag

SEQ ID NO: 53883 - DNA, 684 bp, Artificial Sequence
  Description of Artificial Sequence: Synthetic coding sequence
atgtctcacaccgaagttaagttaaaaattcccttcggcaacaagctgctcgatgcagtgtgtctggtaccaaataagtctctgacgtatggaatcatcctgacccacggggcttcgggggacatgaacctgccccaccttatgtctctggccagccatctggctagccatggctttttctgccttaggttcacatgtaagggacttaatattgtgcacaggatcaaagcctacaagagtgtcctcaattatctgaaaacgtctggagagtataaactggccggtgtattcctcggcggaaggtcaatggggagtagagccgctgcctcagttatgtgtcatatagagcccgacgacggagatgatttcgtgcgtgggctgatctgcatttcttaccccttgcaccatccaaagcaacagcataagcttagagatgaagatctgtttaggctaaaggaaccagttctattcgtgtccggttccgcagatgaaatgtgcgagaagaacctgctagagaaagtggcccagaagatgcaggcacctcataagatacattggattgaaaaggcgaatcattcgatggcagttaagggaagatcaacgaacgacgtatttaaagagattaatactcagattcttttctggatccaggagattacagaaatggacaaaaagtgtcattag

SEQ ID NO: 53884 - DNA, 420 bp, Artificial Sequence
  Description of Artificial Sequence: Synthetic coding sequence
atgggacagaattggaaaagacagcaaaagctgtggaatgtaccccagctacctttcatccgcgtgcccccatctatttacgacaccagcttgttaaaagccctcaaccagggccagcagagatacttctactccatcatgcggatctacaactctagacctcagtgggaagcccttcagacaaggtacattcactctctgcagcaccaacagcttctggggtacattacccaacgagaagcactgtcatacgcactggtactcagggattcgacaaaacgcgcttctgccaaggtggccccacagagaaccatccctcggaagacctctgctatgaccagacggtgtcccagcgtactgccggtttccgtggtgctgccgagagcccagtctaagagacgccaggtgctgcgcaactag

SEQ ID NO: 53885 - DNA, 420 bp, Artificial Sequence
  Description of Artificial Sequence: Synthetic coding sequence
atgggtcagaactggaaacggcagcagaagctctggaacgtgccccaattaccttttatccgggttccaccgagtatttatgatacctcactccttaaagctctgaatcaaggccagcaacggtacttttattccatcatgcgcatatacaattcacggccacagtgggaggcactgcagacccggtatatccacagtctgcagcaccagcagctgcttgggtacatcactcagcgggaagctctctcctatgctcttgtcctacgggactcaactaagcgggcttctgccaaagtggccccacagcggacaatcccgcgtaaaaccagtgctatgacgcgtagatgtccctccgtgctgcccgtgagtgtagttcttccacgggctcaatctaagagaaggcaggttctaagaaattag

SEQ ID NO: 53886 - DNA, 912 bp, Artificial Sequence
  Description of Artificial Sequence: Synthetic coding sequence
atggcaggagctgcctgtgagcccgtggctcgcccatcactgacctccattagcagtggggaactgcggtcactgtggacatgcgactgtgagcttgcccttctgcctctggcccagttactgcgcttgcagcccggtgcttttcagctatccggcgatcagctggtcgtggctcggcctggagagcctgccgctgcacgcggtggcttcaacgtttttggggacgggttggtgagactggatgggcagttatatcgcctgtcctcatacatcaagagatacgtcgagctcacaaattattgcgactacaaggactatcgcgaaacgattctatcgaagcctatgctgtttttcatcaatgtgcaaacgaagaaggatacaagtaaggagcgaacctacgcatttttggtgaatacgaggcaccctaaaatccgtcggcaaatcgagcagggcatggatatggtgatctcttccgtgattggcgaatcctatagattgcagtttgatttccaggaggcggttaagaacttttttccacccggtaacgaggttgttaatggcgagaacctcagctttgcctatgaatttaaggccgatgcactctttgatttcttttactggtttggactgtccaatagtgtcgtgaaggtcaatggaaaagtgctgaatttgagctccacctctccagaaaaaaaagagactatcaagctgttcctggagaaaatgagtgagcccctaatccgaaggtcatcatttagcgacagaaagttcagtgttacatctcggggaagcatcgacgacgtgttcaactgtaacttgagtcctcgctcctcgctgactgaaccactgctggccgagcttcctttccccagcgttcttgaatccgaagagacccccaaccagtttatttag

SEQ ID NO: 53887 - DNA, 366 bp, Artificial Sequence
  Description of Artificial Sequence: Synthetic coding sequence
atgaacagtcctgaagccaggctctgcgttgcccagtgtcgagacagttaccccggatgtcagcctctcaaagatacaagagcttgggcttctagtctaaaaatggatccagcaggcctggagggaggcccacgcgacgaatcaagagatgagccacctattagggcccaggcggctagctgggaccagccccagggatgtcttacgtacaagggcagacgaagcgctagtggcactcagaaacagttgcagttgcccgatacattatcctctctgctgtgctggagaggcgcaatcatggtctacattaaagtgaccgttcaaacagacgactctaataaactacttagcctgttgtataggtag

SEQ ID NO: 53888 - DNA, 3495 bp, Artificial Sequence
  Description of Artificial Sequence: Synthetic coding sequence
atggcactgtttcccgctttcgctgggctgagcgaagccccagacggcggtagttcccgcaaggaattggactggctttcaaaccctagtttttgcgtgggcagcatcacaagtctgtctcaacagactgaagcagcgcctgcccacgtctccgaaggacttcctttaacaaggtctcatctgaaatccgagtcttccgatgaaagcgacacgaacaaaaaactgaaacagacctccaggaagaaaaagaaggaaaaaaagaaaaaacgcaagcatcagcaccacaaaaagacaaaaaggaaacacggacccagctcatcttcacgatctgagactgatactgactctgaaaaggacaagccctcaaggggggtcgggggttcgaaaaaggaatcagaagagcctaatcagggaaataatgctgccgcagacaccggccaccgatttgtgtggctggaagacattcaggctgtaacaggcgaaaccttccggaccgataagaagccggacccggcaaactgggaatataagagtttgtataggggtgacatcgctcggtataaaagaaaaggggatagctgcttggggattaaccccaagaagcagtgcatatcctgggaagggacatcaacagagaagaagcactcgcggaaacaggtggagaggtactttacaaagaagtcagtcggtctaatgaatatcgacggcgtggccatcagcagcaagaccgagcctccctccagcgagcccatctctttcatcccggtgaaggatctggaggatgcggcacccgttactacctggctcaaccccctgggcatctacgatcagagcactacccattggttgcaaggtcaaggccctcctgaacaggaatcaaagcaacctgacgcacagcccgatagtgagagtgcggcacttaaggcaaaggtcgaagagtttaatagacgggtcagggagaaccccagagatactcagctatggatggcgtttgtcgcatttcaggatgaagtgatgaagtcgccagggctttacgctattgaagagggggaacaggaaaagcgcaaaaggagcctcaagctgatcctggaaaagaaattggctattttggagcgcgcaatagaatctaatcagagcagcgtcgacctgaaattggccaagctgaaactgtgtacagagttctgggaacccagcaccctcgttaaggagtggcagaaactgatctttcttcatcccaacaatactgcgctctggcagaagtatctgcttttttgtcagtcccagttcagcacatttagcattagtaagatccattcactgtatggcaaatgcttgagtacactgtccgccgtgaaggacggctccattctgtcccaccctgctctcccaggtacggaggaagcaatgttcgctctcttcctccaacaatgtcacttcctccgccaggccggacattcagaaaaggccatttcactttttcaggccatggttgatttcacgttctttaagcccgactctgtgaaagatctgcccaccaagggccaggtagaattctttgaaccattctgggactcaggcgaacctcgggcaggtgagaagggggcaaggggatggaaggcttggatgcatcagcaggagcgcggaggttgggtggtgataaatcctgatgaggatgacgatgaacccgaagaggacgaccaggagatcaaggacaaaactctgcctcgttggcagatctggctcgcagccgaacgcagccgcgatcaaagacattggcgaccctggcgacctgataaaacaaaaaagcaaaccgaagaggattgtgaagaccctgaaagacaagtattgtttgacgacattggtcagtcactgattcggctgagcagtcatgacctgcagtttcagctggtggaggcttttttgcagtttctcggggtgcccagcggatttactcctcctgccagttgtctctacctagccatggacgaaaactctatctttgataatggactttatgacgaaaagccgctgaccttcttcaatccactgttcagcggtgcttcttgcgtcggtcgcatggatcgcctaggctacccgaggtggacaagagggcaaaacagggaaggcgaggaatttatacggaacgtgtttcacctggtcatgcctctgtttagcggtaaggagaaaagccagctgtgtttctcatggctccagtatgaaatcgccaaggtcatctggtgtctgcacacaaagaataagaagcgcctcaagagtcaaggaaaaaactgtaagaagttagctaagaacctgctgaaagagccggaaaactgcaacaatttttgtttatggaagcagtacgcccatctggagtggctcttaggcaacaccgaagacgctcgcaaagtgtttgatactgctctcggcatggcaggcagccgtgagttaaaagattccgatctctgtgagctgtcgctcttgtatgccgaactggaggtagaactgtcacctgaagttaggcgggcagccaccgcacgggcagtgcatattttgactaagctcactgagtcaagcccatacggaccttacacagggcaggtgctcgcagtgcatatactgaaggctcggaaagcctatgagcatgcgttgcaggattgcctaggcgattcatgcgtcagtaatcccgctcctacagattcctgctcgaggttgatttccctcgctaagtgttttatgctcttccagtatctgacaatcggtattgacgccgcagtccagatatacgaacaggtgttcgctaagttaaacagttctgtgttcccagaaggctccggtgagggggattccgctagcagccagtcttggacttccgttctggaagcaatcacacttatgcacacatcccttcttagatttcacatgaaggtgtcggtttatcccttggcccctctgagggaagccctgagtcaggcactgaaattgtatccaggcaaccaggtgttgtggaggtcatatgtgcagattcagaacaaatctcattcagcctctaagacgcgtagatttttcgacaccataacacggtccgccaaacccctggagccttggctgttcgccatcgaggctgaaaaactcagaaaaaggctggtagagaccgttcaacgtctggacggaagggaaattcacgctaccattcccgagacagggcttatgcaccgtattcaggccctgttcgagaatgcaatgcgttccgattccgggtcccagtgtcctttgttgtggagaatgtatttgaactttctggtctctctgggaaataaagaacgctccaagggcgtcttttacaaggccctgcaaaattgcccctgggccaaagtgctctacctggacgcggttgaatactttccagatgagatgcaagagatcttggatctcatgactgagaaagagctgcgcgtgcgtctgccactcgaggaattggagttacttctggaggattag

SEQ ID NO: 53889 - DNA, 2802 bp, Artificial Sequence
  Description of Artificial Sequence: Synthetic coding sequence
atgaacatcgatggagtagctatctccagcaaaactgaaccccctagcagcgagcccataagctttatccccgtgaaggacctcgaagatgcagcaccagtgactacctggctcaaccctctgggcatctacgaccagagcaccacccactggctgcagggtcaggggcctcctgagcaggagagtaagcaaccagacgctcagccggacagtgaatccgctgcattaaaagctaaagtggaggaattcaatcgcagggtccgtgaaaaccccagagacacccagctgtggatggcgttcgtggctttccaggatgaagtgatgaaaagcccaggcctgtacgccatagaggaaggtgagcaagaaaagcgaaagaggtccctcaagttgatcctggaaaaaaaactggcaatccttgagcgggctattgagtccaatcagagttctgtcgacctcaagctggccaaactgaaactgtgtacggagttctgggagccctctactctcgttaaagaatggcagaagctcatctttttgcaccctaacaatactgccctttggcagaaataccttctcttctgccagtctcagttcagcactttcagtattagcaagattcacagcctgtacggcaaatgcctgtctaccctctcagccgtgaaggatgggagcatcctatctcatccagctctgcctggtacagaggaggcgatgtttgccctcttcttgcagcagtgccattttctacgccaggcaggacattccgagaaagccattagcctattccaggctatggttgattttacattctttaagcctgattccgtgaaggacctgccaactaaaggccaggtggagttttttgaacccttttgggattcaggagaaccacgggctggtgaaaagggcgcacgaggatggaaggcttggatgcatcagcaagaacgaggagggtgggtcgttatcaatcccgatgaggatgatgatgagccagaggaggatgaccaggagatcaaggataagaccttaccacggtggcagatatggctagcggctgagcgctcaagagaccagcgacactggagaccatggcgcccagacaagaccaagaagcagacagaagaagattgcgaggacccggagcggcaggtgctgttcgatgacatcggtcagtccctgattaggctgtctagtcatgatctccaattccagctggtagaggcgttcctgcagttcttaggggttccatcgggattcaccccgccagcttcctgcctgtacctcgcaatggatgaaaattctatttttgacaacggactttacgacgagaaaccactgactttcttcaatcccctgtttagcggtgcgagctgcgtggggcgaatggaccgcttgggctatcctaggtggacccggggtcagaaccgtgagggtgaggaattcataagaaatgtgttccatctcgtgatgccattattctcaggtaaagagaaatcccagttgtgttttagctggcttcagtacgaaatcgccaaagtcatttggtgtttgcacactaagaacaaaaagaggttaaagagccagggaaaaaattgtaaaaagttagctaaaaacctgctcaaggaaccagaaaactgcaataatttttgcctttggaagcagtatgcccatctggagtggttgttgggtaacaccgaagatgccagaaaagtcttcgacactgcgctgggaatggccggtagccgtgagctgaaggattccgacctgtgcgagttgagcctgctgtacgctgagcttgaggtcgaactgagtcccgaggtgaggcgcgctgctacagccagggcagtgcatatcctcaccaaactgaccgaatcttcgccttatggcccttacacaggccaggtgctagccgttcacatcctgaaggcaaggaaagcatacgaacacgctctacaggactgccttggcgattcctgtgtatccaaccccgcaccaacggattcttgtagcaggctgatctctctcgccaaatgcttcatgctctttcagtatctgacaataggcattgatgccgcagtccagatctacgaacaggtcttcgccaagcttaactcttccgtttttcccgagggtagcggggagggggactccgcttccagtcagagttggacatctgtcttagaggcgattacactcatgcataccagcctgctcaggttccatatgaaagtgagcgtttaccctttggccccactgcgcgaggcgctgtctcaggccctgaaactgtaccctggaaatcaagtcctgtggaggtcctatgtgcagatccagaataaatctcattccgccagcaaaacacgcagattttttgacacaatcacaaggtcagctaagcccctggaaccctggttattcgccatcgaggccgaaaagttgcgaaaacggttggtggagactgttcaacggctggacggcagggagatacacgcaaccatcccagaaaccggcctgatgcaccgtatccaggcactatttgagaatgccatgcggagtgatagcggtagtcagtgccccctcctgtggcgcatgtaccttaactttctagtctcgctcggaaacaaggagagaagcaagggggtcttctataaagcactccagaattgtccatgggccaaggtactctacttagatgcagttgagtattttcccgatgaaatgcaggagattctggatctaatgaccgagaaggaactgcgcgttcgactgcctctggaggaactggagctgctgctcgaggattag

SEQ ID NO: 53890 - DNA, 744 bp, Artificial Sequence
  Description of Artificial Sequence: Synthetic coding sequence
atgtccggcaaggatcgcattgagatatttccatcacggatggcccagaccattatgaaggctaggctgaaaggcgcacagacaggaagaaaccttctgaagaaaaaatcagacgcactgacactccggttccgccaaatcctgaaaaaaatcatcgagactaagatgttgatgggcgaggtaatgagggaggctgcattcagcttagcggaggctaaatttacagccggtgatttctccactaccgtcatccaaaatgtgaacaaggctcaggtcaaaattcgcgcaaagaaggacaacgtcgccggtgtgacgttgccagtgttcgaacattaccacgaaggcaccgattcatatgaactaaccggactggccagaggaggcgagcaactcgccaagctcaaacgcaattatgcaaaggctgtcgagttgctggttgagctggcaagtctgcaaacttcgttcgtgacacttgacgaagccataaagatcacgaatcgtcgtgtgaacgcgattgagcacgtcatcatacctcgaatcgagaggaccttggcctatataattactgaactggacgaacgagagcgtgaagaattctatcgcctcaagaaaattcaggagaaaaagaagattctaaaggagaaaagtgaaaaggacctggagcaaagacgggctgctggcgaggtgcttgaacccgcaaatctgctggcagaggaaaaagacgaggatctgttgtttgagtag

SEQ ID NO: 53891 - DNA, 1449 bp, Artificial Sequence
  Description of Artificial Sequence: Synthetic coding sequence
atggacgagcttgtgcatgacctggcctctgctcttgaacagacttctgaacagaacaagctgggtgagctttgggaggagatggctctcagcccacgtcagcagcggcgtcagctgcgaaagcgcagaggaagaaagcggcgatcagacttcacacatttggcagagcacacatgctgctactccgaggcgtccgagtcaagcctcgacgaggccactaaagattgccgtgaggtggctccagtgacgaacttctccgacagcgatgataccatggtcgccaagaggcaccctgctctgaatgcaattgttaaatctaagcagcatagttggcacgagtccgacagcttcaccgaaaacgccccatgtaggcccctccgaagacgccgtaaggtcaagcgcgttacctccgaggtcgccgcttcactgcagcaaaaactgaaggtttcggattggagctatgaacggggttgccgttttaaatctgccaagaaacaaaggctatctagatggaaggagaacacgccatggacctccagcggtcacggcttgtgcgagtccgcagaaaaccggacatttctatccaaaaccggtcgcaaggagagaatggaatgtgaaactgatgaacagaaacaagggagtgacgagaatatgtcagaatgcgaaaccagcagcgtgtgtagctcctcagacaccggcctcttcacaaacgatgaaggcagacagggcgacgacgagcaaagcgattggttctatgaaggggaatgtgtccccggattcaccgtcccaaatttgctccccaagtgggccccagaccattgcagcgaagttgaacggatggactccggcctggataaattcagcgatagcactttcctccttccatcgcgccctgcccagaggggctatcacacccggcttaatcggctgccaggagccgcagcaaggtgtctgcgtaagggacggcgacgcctggttgggaaagaaacctcaattaatactctgggaactgaacggatcagtcacatcataagcgatccccgtcaaaaggaaaaaaacaaagccctggcctctgatttcccacatatcagcgcatgtgcccacgagtttaatcccctttcccctttatactccctggacgttctcgccgatgccagccaccggaggtgttcgcccgctcattgctcagctcgtcaggctaatgttcactggggccctccctgcagtagagacatcaagcgcaaacggaagcctgttgccaccgcttccctatccagtccatctgcggtacacatggatgccgtggagccgacaactcctgcttctcaggctccaaagagcccatcatctgaatggctggttagaacctccgccgcagagaaggctacagatgccaccactgcaacgttcttcaaaatgccgcaggaaaaaagccctggttactcttag

SEQ ID NO: 53892 - DNA, 1434 bp, Artificial Sequence
  Description of Artificial Sequence: Synthetic coding sequence
atggacgaattggtccatgacttggctagtgccctcgaacagacaagcgaacagaacaagctgggtgaactgtgggaggagatggcactctctccccgtcaacaacgtagacaacttcgcaaacgaagggggagaaagcggaggtcagatttcacccatttggccgaacatacctgctgctatagtgaggccagcgaatctagtctggatgaggctacgaaagactgcagagaagtggcgccagtgaccaactttagtgacagcgacgacacgatggtcgccaaaaggcaccctgcccttaacgccatagtgaagtctaaacagcactcgtggcatgagagtgattccttcactgagaatgctccttgccgtcccttgcggaggagaaggaaggtaaaaagggtgacaagcgaagtggccgctagtcttcagcagaagctcaaagtctcagactggtcctatgaaagagggtgccggttcaaaagcgccaaaaagcagcgcctgagccggtggaaggagaacacaccttggacaagttccgggcacgggctgtgcgagtctgcagagaataggacctttttgagcaagacaggcaggaaggaaaggatggaatgcgagaccgatgagcagaagcagggcagtgatgagaatatgtccgaatgtgagaccagctccgtgtgcagctccagcgacaccggcttatttacgaatgacgagggacgacaaggtgacgacgagcagtcggactggttttatgaaggagagtgcgttcctggcttcacagtgccgaatcttctaccaaagtgggctccagaccactgctccgaagttgagcgcatggacagcggcctggataaattttctgactctacctttctgctgccctcccgacctgcacagcgaggctaccacaccaggttaaatcggctcccaggcgcagcggcacgttgcttaaggaaaggtcggagaagattggtcggcaaggagacctccatcaacacacttggcacggagcgaatatcccatatcattagcgaccctagacaaaaagatttctggctgccctcagcaggaaagcgagagaggaatcagtttaatcctctttctcctctgtatagcctggacgtcctcgccgacgcatcccatcgcaggtgttcacccgctcactgttccgccaggcaggctaatgtccactggggccctccgtgctccagagacataaagagaaaacgaaaaccagttgccacggctagtctctcttctccttccgcggtgcacatggatgccgtggagccaaccactccagccagccaggccccaaagtctccctctagcgaatggctcgtgcggacctctgccgctgaaaaagccactgacgccacaacagcaacattcttcaagatgcctcaggagaagtcacccggttactcatag

SEQ ID NO: 53893 - DNA, 1344 bp, Artificial Sequence
  Description of Artificial Sequence: Synthetic coding sequence
atggacgaactcgtgcacgatctggcctccgcactcgagcagacaagcgaacagaacaaacttggtgagctgtgggaggagatggcgctgtcgcctagacagcagcggaggcagctgcgcaagcggagaggcaggaaacgacgcagcgatttcacacatctcgctgaacacacatgctgttactccgaggcctcagagagtagtctggacgaggcaacaaaagactgccgtgaggtagccccagtgaccaactttagcgatagcgacgacacgatggttgcaaagcgccatcctgctctgaacgcaatcgtgaaatcaaagcagcactcatggcatgagagtgactcctttacagagaatgccccatgtcgccctctgcggcgacgaagaaaagtgaaaagagtcacttcagaagttgccgcttctcttcaacagaagctcaaggttagcgattggagttacgaacgaggttgcagatttaagtctgccaagaaacagaggctcagccggtggaaagaaaatactccctggacatctagtgggcatggtctttgtgaatctgccgagaacaggaccttcttaagcaagaccgggcgaaaagagcgtatggagtgcgaaacagatgaacagaaacagggatcagacgagaacatgtcagaatgcgagactagctctgtgtgtagctcttctgataccgggctattcactaatgatgagggcagacaaggagatgatgagcagtccgattggttctacgagggcgagtgtgtgccaggctttacagttcctaacctgctgcctaagtgggcccctgatcattgcagtgaagtcgagagaatggactctgggcttgacaaattcagcgactctaccttcctattgccaagccggccagctcagaggggctaccataccagactgaatcgattgcccggtgccgcagcccgatgtctcagaaaaggtcgacgcaggctcgtcggcaaggaaactagcattaacacccttggaactgagcggattagccacattattacacttggacgcaagatctctgggtaccatcagcttggtaaagaaaacgagatctccagcattccctgtctcccatttactccttggatgttcctccctatgctcctgactgagggggtgcatcagcataccgctctaccagacaggcagatgtacaccggcgaccatcatgtgcatgtgacttctagaggttccggcaatcaatggccacagcatttatgcctagcgccagtccagttcacatggatgcagtggtcacaacctcaccagcaccacaaacctcctaatcaccctgccctttccgggtggtag

SEQ ID NO: 53894 - DNA, 1056 bp, Artificial Sequence
  Description of Artificial Sequence: Synthetic coding sequence
atggacgaattggtgcacgatctggcaagcgccctcgaacaaacaagcgaacagaacaagctaggcgagttgtgggaagagatggccctctcacctaggcagcagcgccgtcaactgcggaaacgaagaggtagaaaacgcagatcagattttacccacttagccgaacacacctgctgttacagcgaggcgagcgaaagtagcctcgacgaagccacaaaggactgtagagaagtggcacctgttactaactttagcgactccgatgataccatggtcgcgaagagacatcctgcactgaacgccatcgtgaaaagtaaacagcattcctggcacgaatctgatagctttacagaaaacgcgccttgcagacccttgcgcagaagacgcaaagtcaagcgggtgacctccgaggtggcagcatcactgcagcagaaactcaaggtcagcgactggtcctacgagagggggtgccgatttaaatccgccaagaaacagcggcttagccggtggaaagaaaatacgccatggacgtcctccggacatggactatgcgagtcagcagagaatcgcaccttcctttccaaaacaggtcgcaaggagcgtatggagtgtgaaaccgatgagcagaagcaggggagtgatgaaaatatgtctgaatgcgagacgtcctccgtgtgctcttctagcgacaccggactttttacgaatgatgaggggaggcagggagacgatgaacagtcagactggttctatgagggcgagtgtgtgccaggattcaccgttcccaacctgctgcccaagtgggccccagatcattgctcggaagtggagcggatggactccgggcttgacaagttctccgatagcaccttcctgctacctagcagacccgctcaaaggggctaccatactagattgaatcgcctgcccggagcagctgcacggtgcctgagaaaaggcagaaggcgtctggtgggaaaggtgattcctctcactgtatcgctcgcccagtggggagacaatattccatacggcagctgcgtctcgtactag

SEQ ID NO: 53895 - DNA, 1056 bp, Artificial Sequence
  Description of Artificial Sequence: Synthetic coding sequence
atggacgagctcgtgcacgacctggcctccgctcttgaacagacctctgagcagaacaagctgggagaactgtgggaagagatggcgcttagtcctcgccagcagcgcagacaattacggaagcgcagaggcagaaaaagacgctcggacttcacccacttagcagaacatacttgttgctactctgaggcgagcgagtcttctttagacgaagcgacaaaggactgtcgggaggttgcccctgtcaccaatttttctgattctgatgatactatggtggccaagagacacccagccctcaacgccatagtcaagagtaaacagcattcctggcacgagagcgattcattcaccgaaaatgcaccctgtcgcccattgcgacggaggaggaaagtgaaaagggtcaccagcgaggtcgcagcctctctgcaacagaaattgaaggtgagtgattggtcttatgagcgcggatgtagattcaagtccgccaagaaacagaggctgagtcggtggaaggagaataccccctggacaagcagcggccatggcctctgtgaaagtgcagagaaccgcacattcctctcgaaaaccgggaggaaggaaaggatggagtgtgaaactgatgagcaaaagcagggcagtgatgaaaacatgtccgaatgcgaaactagcagcgtgtgttcaagttctgacactgggctctttaccaacgacgagggtcggcaaggggacgacgaacagtcagactggttctatgagggcgaatgcgtccccggatttaccgttcctaacctactccctaaatgggccccagaccactgtagcgaggtggaacgaatggattctggacttgacaaattcagcgacagcacatttttgttgccctctcggccagcgcagagagggtaccatactcgcttgaaccgcctccccggtgcagccgctaggtgtctgcgaaagggcaggaggcgcctcgttggaaaggtgattcctctcaccgtttccctcgctcagtggggggacaatattccatatggctcttgcgtcagctactag

SEQ ID NO: 53896 - DNA, 423 bp, Artificial Sequence
  Description of Artificial Sequence: Synthetic coding sequence
atgccccttgaatcgtcatccagcatgcccctgtcatttccctccctgctcccgtctgtcccacataacactaacccctcaccacctctaatgtcatatattactagccaggagatgaagtgtatcctccattggtttgccaattggtcagggcctcagcgcgagagatttctagaagacctcgtggcaaaggcagtccctgagaagcttcagccactgttggacagcctcgaacaattgtctgtctccggggcagatagacccccaagcatcttcgagtgtcagctgcacttgtgggaccagtggttccggggatgggcagaacaggagagaaatgagttcgtcaggcagctcgagttctcggagcccgattttgtggcgaagttttatcaggccgtggccgcaactgccggaaaagattag

SEQ ID NO: 53897 - DNA, 423 bp, Artificial Sequence
  Description of Artificial Sequence: Synthetic coding sequence
atgccactcgagagtagctcgagcatgcccctgtccttcccttcccttcttccctcagttcctcataacaccaacccaagcccccctctgatgtcctacattaccagtcaagaaatgaaatgtatcctgcattggtttgccaactggtccggaccccagagggaaaggtttctcgaggatctggtggcaaaggctgttcccgagaagctgcagcccctgctggattcattggaacagctcagcgtcagtggagccgataggcctcccagcatctttgagtgtcagctccatctatgggaccaatggttccgagggtgggctgaacaagagaggaacgaatttgtcaggcagctggaatttagcgagccagattttgttgccaagttctaccaggccgtggctgccacagccggaaaggattag

SEQ ID NO: 53898 - DNA, 303 bp, Artificial Sequence
  Description of Artificial Sequence: Synthetic coding sequence
atggaactgctgggcgaatatgtcggacaggagggcaagccacagaagctgcgcgtttcctgcgaagcacccggagacggtgacccttttcagggcctgctctccggggttgcgcagatgaaggatatggttaccgagctgtttgatccactcgtccagggcgaggttcagcatagagttgccgctgcccctgacgaagacttagatggggacgatgaagacgacgcggaagatgagaacaatatcgacaatagaacaaactttgacggaccctccgccaaaaggcctaaaaccccttcctag

SEQ ID NO: 53899 - DNA, 1065 bp, Artificial Sequence
  Description of Artificial Sequence: Synthetic coding sequence
atggagagcgctctggccgtccctcggttacctcctcacgacccaggaacccccgtcctgtcagtggtggacatgcatacaggtggggaacctctccgcatagtgctggctggttgtcccgaggtcagtggaccaacgctcctggcaaaacgtaggtacatgcgccagcatctggaccacgtgaggaggcgccttatgtttgagcccaggggccaccgggatatgtacggggctgtactggtaccaagtgagttgcccgatgctcacctgggggtgttgttccttcataatgagggctactcctccatgtgcggacacgccgtcctcgccctgggacgcttcgctctggactttggcctggtgcctgctccaccagccggtaccagggaggccagagtgaatatacactgcccatgcggcctggtgaccgcctttgtggcgtgcgaggatggacgaagtcacggcccagtgagatttcactcagtgcctgccttcgttcttgccaccgacctcatggtggacgtgcccggtcacgggaaagttatggtggatatcgcatacggcggagcgttctatgccttcgtcaccgccgaaaagctgggcttggacatatgcagcgctaagactagggacctggtagacgctgctagtgccgtaacggaggccgtgaaggcccagttcaagatcaatcaccccgactctgaggatctcgcttttctgtatggtactattctcacagatggcaaagacgcatacaccaaagagccaacgaccaacatctgcgtttttgcagatgaacaggtcgaccggtcccctacaggctctggcgtaactgcccgaattgcactgcagtatcacaaaggtctgctcgagctgaatcaaatgagagctttcaagagcagcgccacgggcagtgttttcacaggcaaggccgttcgggaggcaaagtgcggggattttaaggcagttattgtggaggtatcgggacaggcacactacaccggaactgccagcttcattattgaggatgacgatcctttgcgggatggctttctgttgaagtag

SEQ ID NO: 53900 - DNA, 267 bp, Artificial Sequence
  Description of Artificial Sequence: Synthetic coding sequence
atggcttcatgcactaatcgtggagggttgcctgagaagcattccagctctaaggttagcagccatgcccaaatgatccagaaagcggtggacttcttagacctcttaatagggcatctctccaagtttagccccgtcttaattgtttttcaattctcccccctgggttttcttgtaagacaaagcagtgccgacaacgtacagttcctgtcctttgcaccctccctgatccttccctccgggactggaaattggttggtgtggtag

SEQ ID NO: 53901 - DNA, 903 bp, Artificial Sequence
  Description of Artificial Sequence: Synthetic coding sequence
atggattggttccactgcaaccagtgctttcgcaaagacggagcgcacttctttgtaacttcatgcgggcacatcttctgcaagaagtgtgttacgctagagaagtgcgcagtgtgcggcactgcatgtaagcatctggctctaagcgataacctgaaaccgcaggagaagatgttcttcaagagccctgtggagactgcgctgcaatactttagtcacattagccaggtttggagcttccagaaaaaacagactgaccttctgatagccttttataagcacaggattaccaagctagagaccgcaatgcaggaggctcagcaggccttggttagccaggacaaagaactatcagtcctgcgaaaggaaaacggggaattgaaaaaatttttggccatcttgaaagagagtccctccagataccagggaagccggtcaatcacacctcgacccgtcggtataacatcgccatcacaatcagtaacgcctagaccatccttccagcattcttcccaagttgtctctcgaagcagctccgcagagagcatcccttatagagaagctggctttgggtcactcgggcaaggcggtagaggactgcaaggtcgcagaactcctcgcgactcatacaacgaaaccccatccccagccagcacccactcgctgtcttatagaaccagttccgctagctccggccaggggatcttcagttttagacccagtccaaatggccacagtggtcacaccagggttctcaccccaaacaatttcgcacagagggaatctacaaccactttggaaagcctgccctccttccagttacctgttctacaaaccctgtatcaacagcggaggcacatgggccttccttctgggagggaggcatggaccactagccgctag

SEQ ID NO: 53902 - DNA, 567 bp, Artificial Sequence
  Description of Artificial Sequence: Synthetic coding sequence
atggaggatgaacgctcattctccgatatttgtggcggtaggttggctctgcagcggagatattattctcctagctgtagggagttttgcctgagctgtccaagattaagtctgagaagtctgaccgctgtgacttgcacagtgtggctcgcagcgtatggattgtttacactttgtgaaaactcgatgatcctgagcgctgcaatcttcatcactttgcttggcctgttgggatacctgcacttcgtgaagatcgaccaggaaacactcctaatcattgactcgttaggaatccagatgacatcttcatatgcctcaggcaaagagtccactactttcattgagatggggaaagtcaaggatatagtgattaacgaagcaatttacatgcagaaggttatttactatctatgcattctactgaaagacccggtggaaccacacgggatctcacaggtggtgcctgtctttcaatccgctaagccacgccttgactgtttgattgaagtttaccgatcctgccaggagatcctagctcatcaaaaagctacatctaccagcccctag

SEQ ID NO: 53903 - DNA, 1467 bp, Artificial Sequence
  Description of Artificial Sequence: Synthetic coding sequence
atgcacattcaattcccatcaaagcctacccttccccgtgcttgttgggagggtcgaatcactgccggtagcccaggtatgccccctgacgagatcgaaatcgagccagtgcgccagtcgagcgacaaaatgctgtactgcgaagcggagtctcccccaacagtggagaaggttaaacccgctcgggaaaattccgaaaccgaccttgaaatagaggatgacgagaaattcttcacaactggacagaaggagttatatctagaggcatgcaaactaatgggagttgtgcccgtaagttacttcatcaggaatatggaggaaagttacgtgaaccttaaccatcatgggttaggaccacggggaacaaaggccatagcaatcgctcttgtgtccaacatggccgtcacaaaacttgaactagaagacaattgcataatggaagagggggtactgagcttggtggagatgctgcaagaaaactactacctgcaggaaatgaatatctccaacaaccacctcggccttgaaggggctaggataatatccgattttttcgaaagaaattcgtcatcaatctggagcctcgagctctctggaaatgacttcaaagaggattccgcagccctcctatgccaggcccttagtactaattatcaaatcaaaaaactggacctatctcataaccagttttcagatgtgggaggcgagcatctcggccagatgctggccatcaacgtagggcttacgtcattggatttatcgtggaacaacttccatacacgcggagccgttgctttatgtaatggtctgagaggcaacgttacacttacaaaactggatctgtctatgaacggatttggcaatgaagtagcgctcgccctgggagaggtgctgaggcttaaccgttgcctggtctacttggatattgggggtaatgacatcgggaatgaaggggcttcaaagattagtaaggggttggagtcgaacgagagtcttcgggttctcaagctgtttcttaatccgattaatatggacggcgcaatcctccttatcctcgcaattaagcggaatccaaaaagcaggatggaagagttggatatctccaatgttctggtcagcgagcaatttatgaagactttggacggagtctatgccgtccatccccagctggatgtggtgtttaaggcagtacaagggttgtccccaaagaaaaccatctttctgctcactaatcccatgaaactgatccagtcgtatgctgaccagcacaaaatcactatcgtggactttttcaaatccctcaacccaaccggcacaatgaagatgtccgtggacgaatttcagaaggtgatgattgagcaaaacaaagtgccactcaatcagtaccaggtgcgagaggttatcaaaaagctcgatgaaaagaccggtatggtgaatttctccttcctgaatactatgaaaccgtag

SEQ ID NO: 53904 - DNA, 561 bp, Artificial Sequence
  Description of Artificial Sequence: Synthetic coding sequence
atggataacgataaaccacttcaacctgaaaccgaggatgagattgaaatcgagcccgtgaggcagtcttcggataaaatgctttattgtgaagcagagtccccccctactgtggagaaggtgaaacccgctagggaaaacagcgagaccgatctagagattgaggatgatgaaaagttcttcacgaccggccagaaagagctctatttagaggcatgcaagctaatgggggtggtccccgtcagctatttcatccgcaatatggaagagtcatacgtaaacctgaaccaccatgggctgggccctcgcggtacaaaagccattgccattgccctggtctctaacatggctgtgaccaaattggagcttgaggacaattgcataatggaggagggcgtcttatctctggtcgaaatgcttcaagaaaattattatcttcaggagatgaatattagcaacaaccacttgggcctggagggggctagaattatttctgattttttcgaaaggaattcaagtagcatctggagtctggaactgtccgatcagttgcccaattag

SEQ ID NO: 53905 - DNA, 654 bp, Artificial Sequence
  Description of Artificial Sequence: Synthetic coding sequence
atggaggatagggcaggtgagcaagagcaggaacggcacagcctgaggctcgaaaaattacagcactgggctcggcatcgccagtccgggcacctgctggtactggcagtgagccagctatggctggctgtggttgtcgtgcccttggctgtctcagttgcatgcttgaattctgactgccatatggcaacagctctgcccttaggccctggcgctagcggcttactcacgggcactgtgaccctcgaactgcggcgtgcaccaaggctctggaaggtcagagctatgatgatttttaatacattcaacctgatcctagggtttatagtcgttgttgtggaggtcatgaaaaccgcactcggaccagctccgaccgcaagctcccagcacgctggactcctggtgctggagctgtcagcggaagccttcacactcgggggtgttttggtgtccgtccacgcactgttccttctgtcccagcgcaagcccggatgctgccgatcccagagcttacattaccaggagctgcaggagggattttccgagctcgaagaggtcccagggctcgagaacggacccactgttgcctctacaggcgctaatgagagagtggggcaaagagagcaaacaagggcagccctattgcccccttag

SEQ ID NO: 53906 - DNA, 654 bp, Artificial Sequence
  Description of Artificial Sequence: Synthetic coding sequence
atggaagacagggccggagagcaggagcaggagaggcactccctgagactggagaagctgcagcactgggcacgacaccggcagagcggacatctcctggtgctggccgtgtctcagctttggctggccgtggtcgtcgtgccattggccgtctcggtggcctgtctcaacagcgattgccatatggcaacggcattgcccttaggacccggagcatccggtcttcttaccggcaccgttacactggagctgcggagggccccacgactgtggaaagtaagagcgatgatgatttttaacacgtttaacctgattctgggtttcatcgtcgtggtggtggaggtgatgaagactgcgctgggacccgcaccaactgccagttcacaacacgctggactgttggtgttagagctgtccgccgaagctttcactctaggcggagtactagtctcggtccacgccctgttcctgcttagccagaggaagcccggttgctgcaggagtcaatctctccattatcaggaactccaggagggattcagcgagctggaggaggtgcctggactggaaaacggccctaccgtggcctctacgggagccaacgaacgtgtcggacagagagagcagaccagggcagccctgctgcctccatag

SEQ ID NO: 53907 - DNA, 378 bp, Artificial Sequence
  Description of Artificial Sequence: Synthetic coding sequence
atgcatcggaaagagcccggagccagattggaggccaccagaggtgcagcacgaccacacaagcagggaaccaagcccatgatcacccgcccatctgtgagccagctaggagagggaaagtgtccttcctcccagcacctccagtctctgagacataacaagcagcacgctctaactctgacaaaggcacgatgttgtggagaatgctcgacctgcttctgcacggaggagaaaagcgaatgtcagagacacgaagaaacctctccaggcagctgcaatcaccagatcatgtcagccagcacaatttctgccttttgtgctacaccgaggtttaagcagctgtttaaaggaaccgttgaacaaatgtcgcagatgtag

SEQ ID NO: 53908 - DNA, 228 bp, Artificial Sequence
  Description of Artificial Sequence: Synthetic coding sequence
atgcaccgcaaggaacctggcgctcgcctagaagctactcgcggagcggctcgcccacataagcaaggtacgaagcctatgatcaccagacccagcgtcagccagcttggcgagggcaagtgcccaagcagccagcatctgcagtctctgagacataataagcagcacgcactgaccttgacgaaggctcggtgctgtggtgaatgctctacctgtttttgcacatag

SEQ ID NO: 53909 - DNA, 369 bp, Artificial Sequence
  Description of Artificial Sequence: Synthetic coding sequence
atggggagagaaatgaaaaaaaccggcacccctaggcctttccggattgaggacccaaatcagcaacccacatggcacgaccagcctgaaatgggcagccactacttcgcacaggctgggctggagcttttgggcagcagcaacccacctgcctccgcaagccaatccgcagggattacaggcgtgtcccactgtgcaagaccgggagaacacgatctgaatcatacagtcttccaggtaaaggatagcacgtttctgaggcacctcgagagtgatcgcccagaatttaagtcctgcctgcccccacacttcacagaaccatcagtcagcctatctacaagcgaaggatgtgaagatgctatggggtag

SEQ ID NO: 53910 - DNA, 279 bp, Artificial Sequence
  Description of Artificial Sequence: Synthetic coding sequence
atgggaagtcattacttcgcccaggcgggattggagttactgggctctagtaacccgccagcgtccgcgtctcagagtgccggaatcactggagtgtctcattgcgctaggccgggagagcacgatcttaaccacaccgtctttcaggtgaaggactccaccttcttaagacatttggaaagtgaccgacccgagtttaaaagctgcctgcccccacactttacagagccaagcgtcagcctctccacaagtgaagggtgtgaggatgcgatgggctag

SEQ ID NO: 53911 - DNA, 114 bp, Artificial Sequence
  Description of Artificial Sequence: Synthetic coding sequence
atgggccgtgagatgaaaaaaaccggcacaccccgaccttttcgaatcgaggatccaaaccaacagccaacctggcatgaccagccaggaactgaatccgtgttttggctttag

SEQ ID NO: 53912 - DNA, 324 bp, Artificial Sequence
  Description of Artificial Sequence: Synthetic coding sequence
atgacgggacggatggccaccctggagaaaagtcatagctccgcctgttggagaaaacgtagttctcgcacgtgtgtggaacctgacagaacacaagatgccatccacgagccccgtggcctatctcgaagtcatactgtgctcaggcaccgtcatttcgtatttttgcctctgagcagcggggctcaccccagcgtaccaccaagacgcaagaactgtgcaatgaaaaatggaaagcttctgcgatcgtgttcctccgtcaggagggccgcagataagcttgattggggaaggttttttttacaagatcttcaatctgtatag

SEQ ID NO: 53913 - DNA, 1911 bp, Artificial Sequence
  Description of Artificial Sequence: Synthetic coding sequence
atggggcagggcccacggtccccacataaagtcggccgtaggttccctgccggaggcaagaggggaagaggagccaagggcagcggcagacctcttcctggcagaaagcgtcagccatggccccctcctgatgggcgtagcgagccagcccctgactcgcacccccatcttagtcccgaagctctggggtacttccgcagggcgcttagcgccttgaaggaggccccagaaactggcgaggagcgcgatctgatggttcacaatattatgaaggaagtcgagactcaagccctagcccttagcactaatcgcaccggatccgaaatgctacaagaattattaggcttctctcccttgaaacctctctgccgggtgtgggccgctctacgatcaaatctccgtactgtcgcgtgccaccgttgtggcgtgcacgtgctgcagagtgcgttactgcagctcccccgtctactgggctcagctgccgaggaggaagaggaggaagaagaagacggcaaggacggtccaactgagaccctggaggaactggtactgggactagctgctgaagtctgcgacgatttcctggtctactgcggagatacccatggctcttttgtggttcggacattgctgcaggtcttgggagggaccatcttggaaagcgagcgcgcacggccaagaggcagccagtcctccgaggctcagaaaacccccgctcaggaatgtaaaccagccgacttcgaagtgcccgagacgttcttaaacaggctccaggatcttagcagtagtttcctgaaggatattgccgtgttcatcactgacaaaatttctagcttctgcttacaagtggccctccaggttttgcaccgcaaattgcctcagttttgtgcccatctgtgtaatgcagttattggttacctgagcacaagaggcagctctgtcgacggcagtccgctcctcctgttcttgcgagaccagacatcctcaagactcttggagcaagtgctgctcgtgctcgaaccaccgcgtctgcagtcgttgttcgaggaacatttgcagggccagctgcagacactcgctgcacaccctatcgccaactttcccttgcaacgcctgcttgacgcagtgaccaccccagagttactgtcccccgtatttgaggagctctcccctgttctggaggctgtgctggcacagggacatcccggtgtggtgattgccttagttggagcctgcaggcgagtcggtgcctatcaggctaaggtcctgcagctattactggaagcttttcactgtgccgagcctagctcacgccaggtggcgtgtgtgcctctgttcgccactctgatggcatatgaggtctattatggcctgacagaggaggaaggcgctgtaccagctgagcaccaagtcgcgatggccgctgccagagctctgggagatgtgaccgtacttggttcactgttgttgcagcacttgcttcattttagcacacccggactggtcttgagaagtctgggggcactgactggaccacagctcctgtccttggcacaatccccagccggtagtcacgtgctggacgccatcctcacgtcaccatcggtgacaaggaagctgcgcagacgggtcctgcaaaatctgaagggccagtacgtggccttggcctgcagcagacacgggtcaagggtgcttgacgccatttggtcaggagcagccctgagagccaggaaggaaattgcagctgaacttggcgaacaaaaccaggaactgataagggatccctttggccaccacgtggccagaaatgtggcattgacaacatttctgaaaaggcgggaagcatgggaacaacagcagggcgctgttgccaaaaggcgcagagctcttaattctattctcgaggattag

SEQ ID NO: 53914 - DNA, 564 bp, Artificial Sequence
  Description of Artificial Sequence: Synthetic coding sequence
atggcctacgaggtgtattacggtttaactgaggaggaaggggctgtgcctgctgaacaccaggtggcgatggccgcagctagggccttaggtgacgttacggtgttggggagcctgctcttgcagcatctcctccattttagcacccctggccttgtacttagatctttgggcgcactaacagggccacagctcctctctctcgctcagtcccctgcaggcagccacgtgttggatgctattctgacttctccatctgtgactaggaaactgagacggcgagtgcttcaaaacctgaaaggacagtacgtggccctcgcttgttctcggcatggatctagggtgcttgatgcgatatggtctggcgctgctctgcgtgctaggaaggaaattgctgctgagttgggtgagcagaatcaggaactcatccgagacccttttgggcaccatgtggccaggaatgtcgctctgactaccttccttaagcgccgagaggcatgggaacagcagcagggagctgtagcaaaaaggagacgcgcattaaattcaattttagaggattag

SEQ ID NO: 53915 - DNA, 504 bp, Artificial Sequence
  Description of Artificial Sequence: Synthetic coding sequence
atggagttaagctctatgaaaatctgtgccgcaatacctacatcccgcgctctgcccgaggtcgtacgcaggatgccccgtaagcggataagcggcttggagtggctgctgcagcaagacccaggattttcgctcgtgaatacagttaaagccggaatgatcatatctttcccaagcaacaacatttattcttccgtctgttgttgtcagtcggagatatttaagtacgagttcagcaattccaaaaaaagcagctggatccaggaagagcgtcatctggggaaaaacaacgtgttgtacagtgcccatgatgtcagtccggagaaagtaacctccgctcttaaaaaaacaaacaaacagacaactactatcaataattttcccctgcagtatctgcccggtagcaagctgttggaccggtttttaagcctttccaggtcactgctgtgtctgaactcttggtcatcctccttgcccctcgccccacaggtcaagaagaagtag

SEQ ID NO: 53916 - DNA, 933 bp, Artificial Sequence
  Description of Artificial Sequence: Synthetic coding sequence
atgaaaactctgttcgaagagatcaaagccagtatcaaaaacaactataatcaagaccggtccttttgtagacccgtcctgccatgggggggtgttttcaccatcaaggctgggagaaaggccgtgtcatgtacacctctatatgtcgagatccgactcaagaacacctgcactattgacggattcctgatgttgctgtatgtgatcctgaacgaaaacgaaaacttcccccgagagctgtctctgcactttggaagagaattcgtggattgctttctttatctgatggacacttatagtttcactactgtgaagctcttgtggatctgggataagatggagaaacagcagtataaatcagaggtgcataaagcctccttaatcatcgacttattcggtaacgagcatgacaatttcacgaagaatctcgaaaatcttatgtctactatccaggagagttactgctccaactggagatgtcccacccgagtgcaggaggatcagcagcgaaccataaacatcaatccgcctcaggaaattcctcacggtaacttaattcgtctcgcagtcaacgagctgttctgttcaaaaattgagctgtgcgaagaacacggatgcggaggactccgcgaattcagtcagagaatcttctgccacggcgcaccaccttttgtcgtcctgaatatgcagcattggaagtctgaagacctggcctacgtgccctactacctcgacctgagcgaccataagtacctacttgagggggctactctgtttaacaaagaggagcatcattactccgcagccttccaaattggaggtcattggatgcattacgacggcttgcggaacgttaacctcatactgctgaacaagcctccagaatttctgctgctctcatcgctggtttatatcagggccacagagaaatag

SEQ ID NO: 53917 - DNA, 2487 bp, Artificial Sequence
  Description of Artificial Sequence: Synthetic coding sequence
atggcactcagcccatggaccccaggcttgggggcaggggagaaactcgtccaggccgcagccgtgtctacaggaccctctcttgagttgtgtaccctccccagtacacttggatcatccgtagctgtagaggccttagagcagctcttcgtggttgagcagtcgctgcagtctgactattttaagtgtaatgaagaagctaagatcttcctcaaagatatcgcagtcgcagtgaaaaaattggaggagatgcgaaaggccacaattgaccttctcgagattgaaagcatggagctgaataagctctattacctgctggagactctgcctaactcgattaagcgcgagctagaggaatgcgtgcgggacgcaagacgcttaaatctgttcgagatcaacacgatcaagatgcggatcactagaactgaaaatgaaattgagctgttgaagaagaaaatcacagatctgacaaagtacaatgaagccttaggagaaaaacaggaagagctagcccgaaaacacgcgcgatttgtgctgagcctgaaccagaccatggaaaagaaggccactactacagtgtatattaacgaaacctacacaaagatcaaccttaaaagggaagacatagccttgcaaaagaaatgtatacaggaggccgaggagttgatggaaaaagagagggccgaatacctgattaggaaacaggaactgactgcccaaattaatgagttcgaaaataccagagaggtcaagcggatggaaacataccagaagaagaaggaactggataaattgcagactaagatgtctaaaatcaaggagaccgttacggtttcagcagccgtgctttccgaccacaatctggagattgccaggctgcacgagtccattaggtactgggaacaggaggtgagcgagctgaagaaggatctggcgatcctggaggctaaactgtgcttctttaccgataacaaagaaaaactggatgatatttctaacgatgaaaagaatgaatttctgaataagattaagcagctggtggagactctgcacgccgcacggatggaatacaaagatctgcgagagaaaatgaagactctggccagacagtacaagatcgttcttagtgaagaagagaaggccttcctacagaagcagaaaatccatgacgaaaatcagaagcagctcaccttcattagtcaaaaggaatacttcttatcccagaagagagtggacatcaagaacatggaggaaggacttataaccctgcaggaattgcagcaggcaaccaagactgtctatcagcaacagattaaaatcctttccgctaatttagagcgagaatctcaaaggtgcgtgatcactcagtggaaaatggcttgtctgaggaaaaagcacgcccgatggaccgcaaagattaaggcggaaattcaggcgataacagagaaaatccagaacgccgaggtgagaagaatcgaattgttgaatgagacatctttccgacagcaagagatctccggtttcgtggcgcagatcgagaaactaaccactgaactaaaagaagaagaaaaagctttcgtgaataaggagaaaatgctgatgaaagagctctcaaaatatgaagagatctttgtaaaagagacacagatcaataaggagaaggaagaagagctggtagaatatcttccccaactgcaggttgctgagcaggagtacaaagaaaagcggcgtaaactggaggaactaagtaacattattaccgctcagaggcaagaagaagaccttctaaataatcacatttttctgttcaccagagacttctcacgctatatatcaaatatggaggatgtcaaacaggagctgcaacagctgcgggaccaagagtccaagaagaacaaagatcatttcgagacattgaaaaacctggagaatggattctatatcaacgatcagaaggctgatctcttactgttagaaaacaagaaactcaaggagtacatcctgtacctcaagaacaacatcgagaagtatcgggagggacaggaggctcttatgcatacaagctccgatctgtctagacagctgattgcacaggaggctcaatataaagatctgtgggccgagttccagaccaccgtcaagatattggtcgataacggtgaggagaccttgcaggacatcaataatcttacagacaaactgcgggagcgtgatgaaaagatgcagcatgtcagcacctggctgcggggatctctggaaggtctgaggcttttggtggaacaggaaagccctatggatctgcttagcaaacaacaactgcgcgctctcctggtcacttcaaaagaagagaaaacctgtcagctgagcgaccttgtgattccaaattacgccaccaacattcagttaaatatcgacacatatctggggctgaatacacttgtggtgctatccaatagcgcttttcacctgagggagttctcccgttag

SEQ ID NO: 53918 - DNA, 2382 bp, Artificial Sequence
  Description of Artificial Sequence: Synthetic coding sequence
atggccctgtccccatggaccccaggattgggcgctggggagaaactcgttcaggccgctgcagtgtctactgggccaagtctcgagctctgtacgctgccatctaccttaggatcatccgttgccgtcgaggcgttggaacaactgtttgtggttgaacagtcgctgcagagcgattacttcaaatgcaacgaagaggccaagattttcctcaaggatattgcagttgccgtgaagaagcttgaagagatgagaaaagccaccatcgaccttcttgagatcgagagcatggagttaaataagttgtactatctcttggaaaccttacctaattcaatcaagagagagttggaggagtgcgtgcgggatgccagacgactgaatcttttcgagatcaacaccatcaagatgcggatcactaggacagagaacgaaattgagctgctgaaaaagaaaataaccgatctcactaagtacaacgaagctctcggtgagaaacaggaagaactggcgagaaagcacgctcgctttgttctatcattgaaccaaacgatggagaaaaaggcaactacgacagtttacattaatgagacgtatacaaagattaacttgaagagggaggacatcgctttgcagaagaaatgcatacaggaggccgaggaactcatggaaaaggaacgcgcagagtacttaatccggaagcaggaattaactgcacagatcaatgaatttgagaatacccgtgaagtcaaacgcatggagacttaccaaaaaaagaaagagttagacaaactccagacgaaaatgtcaaagatcaaggagactgtgacagtgagcgccgctgtcctgtcggaccacaacctagagattgccagactgcatgagtctattagatactgggagcaggaagtgagcgagctaaaaaaagatctggccatcctggaagccaaactgtgttttttcacagataacaaagagaagctggacgacatttccaacgacgagaagaacgagtttttaaataagattaaacaattagtagagactctacacgccgctaggatggagtacaaagatctgagagagaaaatgaagacgctggcaagacagtataaaattgtcctcagtgaggaagaaaaagccttcctgcagaaacagaagatacacgatgagaatcagaaacaactgacattcatctctcagaaggagtatttcctgtcacaaaagcgtgttgacatcaagaatatggaggaaggcctgatcactctccaagagttacagcaggctactaaaaccgtgtaccagcaacagatcaaaatcctaagcgccaacttggagcgggagtcacagaggtgcgtgattactcaatggaagatggcatgtctcagaaaaaagcacgctagatggacagcaaagattaaggctgagatccaggcgatcaccgaaaaaattcaaaatgccgaggtccgaaggattgagttgctaaatgaaacaagcttcagacaacaggagatatcagggtttgtcgctcagatcgagaagctgacgactgagcttaaggaggaggagaaagcttttgtgaacaaagagaaaatgctgatgaaagagttgagtaagtacgaggaaatttttgtcaaggagactcagattaataaagaaaaggaagaggaactggttgaatacctgccacaactgcaggtggccgagcaagagtacaaggaaaaacggcgtaagctggaagaactgtcaaatattataactgcacagcggcaggaggaggacctgctcaacaatcatattttccttttcacccgcgatttctcaaggtacatctcaaatatggaggacgtcaaacaggagttgcagcaactgcgtgaccaggagtcaaaaaaaaataaggatcacttcgaaaccctcaagaatctcgagaacggcttctatatcaatgatcagaaggctgacctactcctcctggagaacaaaaaattaaaagaatacattctttaccttaagaataacatcgaaaaatatcgggagggtcaggaggccctgatgcacacgtcttcagacctttcccggcaactgattgcccaggaggcccagtacaaggatctttgggcggagtttcagaccacagtaaaaatcttagtggacaacggggaagaaacgttgcaagacatcaataatctgacagacaaactgcgggaacgggacgagaaaatgcagcacgtgtccacttggctcaggggctctttagaagggctacggctgctcgtggagcaagagagtcctatggacctactgaaaaaaaaaaagcacataagaaccagggtgcacttcccagtagtgaaatgtacggagaagaatacactgacgaaatag

SEQ ID NO: 53919 - DNA, 1764 bp, Artificial Sequence
  Description of Artificial Sequence: Synthetic coding sequence
atgaatgacagtctctttgtgtccttggaccgcctcctgcttgagtttgtcttccagtatgaacaggacatttcaacaaaagaagagatgatacaaagaatcaataaatgctgcgaagacattaaggaaaataaggtgacaatctgcaggatccacgagacaataaatgcaactgacgaggagatagatcactactgcaagcattctgaggagattaaagacaattgtcggaactggaaacctacctgcgacgttttccggaagcatgaggactatatgcaagatcagttcactgtttaccaggggacagtggaaaaagacaaggagatgtaccacgactacatctgccagtacaaagaggtgctgaagcagtaccagctgaagtactctgagacgccattttcacgcgagtactatgagaagaagcgagagcatgaagagattcaaagcagagtgttagcctgcacggagcagctgaaaatgaatgaaacaatctttatgaagttcagggtgccagcccctttcccttccttaaccaaatggaccctgaacatcgttaacctccgatgcgaaacacaagatatactgaagcacgcttccaacctgaccaaaagctcgtcagagctcaagaaggaggttgacgaaatggagatcgagatcaactacctgaaccagcagattagccgccacaatgagacaaaagccctgtccgagaccttggaagagaagaataagaacaccgagaatagaaaggagctgaaggaacggatcttcgggaaggacgaacacgtgttaaccctgaacaagacccaatccagtcagctgttccttccctacgagtctcagaagttagttaggcccatcaagatgcatagttcagagccgagagtggccgacattaaggaagaatccagcgctaagcagagcaagttagccaacatagactttcggcagaaggaaaatgacacccagatcttcaacgatagcgccgtggataaccactcaaagtgtagccacatcacaactatcacaagttcacagaagttcatgcaggttcggctcctgacaccccagaaacagagcaattctaaccaatggagtgagaagggagataaagacgccgaatatggggataaaggtacagtacgacaagttcgggaaagcaaatgtactagtcaagccatttacaccgagcacttcgggaaatctgtcgagaatgatagtgatgaggtggaggagcgagcagagaatttccccaggacttctgagatccccatcttcctgggcacaccaaaagccgtgaaagccccagagtctctcgagaagatcaagttccctaagactcctcccttcgaaatcaaccgtaacagaaatgctgtccccgaggtccagaccgagaaggaatcaccgggactgtccttcctgatgagttatactagccggagtcccggactgaatctttttgactccagtgtttttgacaccgagatctcctccgaccaattcaatgaacattacagcgccagaaatcttaatccactgtcatctgagcaggagatcggaaacctgctcgaaaaaccagaaggcgaggacggctttacattctctttccccagtgatacctccactcatacgttcggcgctggcaaagacgacttctcatttccgtttagtttcggacaaggtcagaacagcataccctcttctagcttgaaggggttttcatcttcatcacaaaacactacgcagttcacattcttctag

SEQ ID NO: 53920 - DNA, 267 bp, Artificial Sequence
  Description of Artificial Sequence: Synthetic coding sequence
atgaacgattccttgttcgtgtcactcgaccgtctactgttggaatttgtgttccaatatgaacaggacatcagtaccaaagaagaaatgattcagcggattaacaaatgctgtgaggacattaaagagaacaaggtcaccatttgccgcatccacgagactatcaatgccacagacgaggagattgatcactactgcaagcacagcgaagagatcaaggataactgcaggaactggaaaccaacttgcgatgtcttcaggaaatag

SEQ ID NO: 53921 - DNA, 1590 bp, Artificial Sequence
  Description of Artificial Sequence: Synthetic coding sequence
atgccctcgaagggaaaagataaaaaaaaaggcaaaagcaaggggaaagacaccaaaaaactgataaaaactgacgagagcgtggtcgatagagctaaagctaatgcctccctgtgggaggccagactggaagtcactgaactgtctcgaataaagtaccgggatacctcaagaatccttgccaaatcaaacgaggaccttaagaaaaagcagtgcaaaatggagaaggatatcatgtcagtcctgtcttatctcaaaaaacaggaccaagagaaggataacatgatcgaaaaactgaaacagcaacttaatgagacaaaagaaaaggcccaggaggaaaaggataaactggaacagaaatatacacggcaaatcaacgagctcgagggacagttccaccagaaagccaaggaaattggcatgatccatactgaactcaaggccgtccgacaatttcagaagcgcaagattcaagtggaaagagaattggacgatttaaaggaaaatttacggaacacagagcgcatacaccaagaaaccctgaggcgactggaatcacgtttttttgaggagaagcacaggctggagcaggaagcagaaaaaaaaattattatgctcgctgagagagctcaccacgaagccatcgttcagctgaacgatgcagggcgtaacgttttcaaggaaaatgactacctacaaaaagccttggcttatcacctaaaggaaaccgacgctctccaaaaaaactctcagaagctgcaggagagtcatacgttacttctacatcagaaagaaatcaacgacctgttggtgaaggaaaaaattatgcagttggtgcaacaaaggtcccaaatacagactctccagaagaaagtggtgaacctggagacggccctgtcatacatgactaaagagtttgaatccgaggtattgaaactccaacagcacgctatgatcgagaaccaagccggtcaggtcgagatcgacaaacttcagcacctgctgcagatgaaagacagggagatgaaccgggtgaaaaaactggcgaaaaacatccttgacgagagaaccgaagtggaacggttcttcctcgacgctctccaccaggtgaagcagcagatacttatttccagaaagcattacaaacagattgctcaggcagcctttaaccttaagatgcgggctgcatgtacggggcgaaccgagtatccaaagattcggacattcgacggcagagagcacagcaccaattcagtaaaccaggacctcctggaagcggagaagtggacccatattgagggaaacgtcgatatcggtgatctgacttgggagcagaaagagaaggtgctgagacttctctttgctaaaatgaatggctgcccaagtagaaagtacaatcagtcttccagaccaccggttccagactacgtcgtttcggactctggggaaaccaaggagttcggagacgagagtaagttgcaggataaaatctttatcactcagcagatcgcgatttcagacagctccggcgaggtcgtgctgccgactatcccaaaggaaccacaggaatctgatacgggaaccttctag

SEQ ID NO: 53922 - DNA, 798 bp, Artificial Sequence
  Description of Artificial Sequence: Synthetic coding sequence
atgcagctggtccaacagaggagtcagatccagaccctgcagaaaaaggtagtcaacctggagaccgccctgagttacatgaccaaggagttcgagtcagaagtcctcaagctccagcagcatgccatgatcgaaaaccaggcagggcaagttgaaattgataagctgcagcatctcctccaaatgaaagaccgcgagatgaacagagtcaagaagctggctaagaacattctcgacgaaagaactgaagtggagcgattctttctggatgctttacaccaagttaaacaacagatccttatttctcgtaagcactacaaacagatcgcccaggccgcatttaacctcaagatgcgggcagcttgcactggtcgtacagaatatccaaagattcgaacatttgatggcagggagcattctaccaactccgtgaaccaggacttgctggaggccgagaagtggacacacatcgagggcaatgtggacataggcgacctgacgtgggagcagaaagaaaaagtgcttcggctcctatttgccaagatgaacgggtgcccatccaggaagtacaatcagtcctcgaggccccctgtgcctgattacgtcgtgtcagattcaggagagaccaaggaattcggggatgaatcaaaattacaggacaaaatcttcataacccagcagatcgccatttctgactcctctggtgaggtggtgctccctaccatccccaaggaaccgcaggagtccgacactagcacccagaagcctagtgatgagaatttctctaccagttattag

SEQ ID NO: 53923 - DNA, 384 bp, Artificial Sequence
  Description of Artificial Sequence: Synthetic coding sequence
atgcccacaatgtggagaatgttacatcaagcactcaaacttagacgccgtacagtactcgcgggacaggaaatctcatacgtattgcccgtcatgtttgtcgtatctgaagaggattccaatagagatgtcttcctggtagctggatatcgccatctggagttcggagaacgaatagctatttgggggagcagtatgcagcacgtcgaaaggcgaaggtggccactagattccatccagaagaggatgggccaatcctttacgggctgggccgaggaggccgctcccggaatgaaaactaaaaaggaatacgccgaaattggggtgaagccccgacaaaatgcatgcgagatgtgtcctggcatgattctctccaccacctag

SEQ ID NO: 53924 - DNA, 978 bp, Artificial Sequence
  Description of Artificial Sequence: Synthetic coding sequence
atgcaaggtaggcgagagctgggaggggaacccttgagtgatctgcaggaggaagctgcctctgcttccctcagagtggccccagaacggctatccgacgatagcctggagtggcgaagaacttgtcctgacttactgctctccgacggcaaagcaagcatctccatgcctagagagggcggttcaacctgcacagccagatgtccagacccgggagaacacagtagcacttggggcgaattcgagggctttcgcgaaagcagcgctaaatccggtcagttctctcaatccctcgaactactcgagggtccgactgagcctcaacctccacgcacaactagcgcccctaaggagtgtagctcacatcagccgtgtcaaggcggtccctgggtgacagggacttcagcagtgccacctagtgagccaatcctgagttatgagaacatccttaagtgtgcgttccaggagatcaccgtccagcaggcagctgaggatgtgagtaccatcgatcacttcttggagatttcctctgaggagaagcctggtgtagagagagttcacaaactgtgtaatgagagccgtaaactgtggcgagctttacaatccatccatacaacctctacgtcccagcgtctttggtccgagtcaagatgtcaggaaaacttctttctagtgctagggattgacgccgctcaaaagaacctgagtggaggccagggacacattatggaagactgcgaccttaaggagcctgaagggctgcttactgtgtctagcttctgtctgcagcactgcaaagctctgatccagactaaactgagcggacccccagggtcaaagcaagggagactgatgacctgctctcggtttctgaaaactccttcctgtgggggaggacagcacatcaccattcccaggaaaaggatgttcactccccgaaagctcaagctcacactgttcaacagcgatgtgtgttag

SEQ ID NO: 53925 - DNA, 1065 bp, Artificial Sequence
  Description of Artificial Sequence: Synthetic coding sequence
atgtccggacagaggggcgactgggtccagacaagcgcactttggcagttgctcttccgggtcctgagccctctgcccgctggaaacgcgctggcaagcctagcactggaggtgcaagccagattggtgaagagcgctttgtgctcccagggctacccacggctggcactggctcaactcccggaggatggctcgcaagggtcaagagaactgcttctcgccctgagctggctactagctagaggtcccgtcccggaacagatgttggcgcaggctagagtccccctcggggacgaaatgacggtctgtcagtgcgaagcccttgcctcccctgggccacccgcaccccatatggaggcggagggacccgtcgacgttcgccatgtgcagtggctcatgggaaaactgcgctttaggtggcggcagctagtcagctctcagcaggaacaatgtgcccttctttctaaacttttgcggaccctggaacgggagaatcagcggctcgaagcggtgctggcatggcgacgctcagaactggtattctggcggtggatggacactgttctgggcacatgcgcccctgaggttcctgccgcagctagccagcctacttttttgccttgggtccctgagcggggagggggagaactagacctggtcgttcgggaattgcaagctcttgaggaggagctacgcgaggccgctgagcggagacgggcagcctgggaggcaaaggctggcggatgtggcaggggtcccgagtggtcagccgcacggagagcctcacgtgaagccgttgagaaggagctgggggcactccaacaatgttgggagagagatggaggtccagctcagcctcatggaccgcataggctggtgaggcgggaggatggcgcagctggagatcgcgatctccgggcagctgttgtgatccggactttacgtagccaggaggcttgccttgaggccgtactgcggagattgcaagggcaatgccgccaggagctggctcgcttggtcggtgctagaccgggtctcatctggattcccccacccggtaggtag

SEQ ID NO: 53926 - DNA, 1059 bp, Artificial Sequence
  Description of Artificial Sequence: Synthetic coding sequence
atgtccggccagcgtggcgactggacctctgctctctggcaactgttgttcagagtcctgtcccccttgccagctggtaatgccctggctagcctggccctggaggtgcaagcaagactcgtgaagtcagcgttgtgctcccagggctaccctaggctggccctggctcaattgcccgaagatggatctcagggttccagggagctcctgctcgctctgagctggcttttggcgagagggcctgtgcctgaacaaatgcttgcgcaagccagggtgccactcggggatgaaatgacggtatgtcagtgtgaagcgctggcttcacccggacccccagcaccccatatggaggcagaaggccctgttgacgtccgacacgtgcagtggctcatgggcaagctgaggttcaggtggcggcagctggtgtcatcccaacaggagcagtgtgctcttctttctaagctgcttagaaccctggagcgcgagaatcagaggctggaggcggttctggcatggaggcggtccgagctggtgttttggcgctggatggacaccgtcctgggaacctgcgcgccagaggttcctgccgctgcttcgcagcctactttcctgccctgggttcccgaacgcggaggtggcgagctggatctggttgttagagaactgcaggccctggaggaggagctgcgtgaggccgcagaacgtaggagggccgcttgggaggctaaggctggagggtgtggcagaggcccagagtggtctgctgccagacgtgcttctcgcgaggccgtagaaaaagagctgggcgcactgcagcaatgctgggaacgggacggcggaccggcacagcctcacgggccacatcgtttagtcaggagagaggacggcgcagcaggcgatagggacctgcgcgcagccgtagtcattaggactctgcgctcgcaagaagcttgcctggaggccgtcctcagacggttgcaaggtcagtgccgccaagagctagccagacttgtgggcgcaaggccaggactcatatggataccaccccctggaagatag

SEQ ID NO: 53927 - DNA, 1182 bp, Artificial Sequence
  Description of Artificial Sequence: Synthetic coding sequence
atgggaaggcgcaggcagagggtcgacccggcagccggtgctagggcaggggcacttccggaggcaattgcagcactgagcaggagcctgcctagtgggccttccccggagattttccgcagagccaagtttgaccgccctgaagccacaagcgctctttggcagcttttgtttagggtgctcagtccattacctgcaggaaatgctctggcatcacttgccttggaggtgcaggcaaggttagtcaaaagcgcgctgtgctcgcagggttaccccagattggccctggctcagctcccagaagacggctcacaggggtcccgggaactgctgctggccctgtcctggctcctggcaagaggcccagtgcccgagcagatgctggcccaggcccgtgtgccactgggtgatgagatgactgtgtgccagtgcgaagctttagcatcccctggcccacccgctccccacatggaagcagagggacctgttgatgtgagacacgtgcagtggctcatgggaaagcttcgctttcgatggcgtcagttggtttcctctcaacaagagcagtgtgctctcctttcaaagctgctgagaacgctagagagagaaaatcaacgcctggaggctgtgctggcttggcgcaggtcagagctggtgttttggagatggatggacaccgtgcttggcacttgcgcaccggaagtgcccgcagctgcctctcagcccacttttctaccctgggtgccggaaaggggcggaggtgagcttgacctagtggtgagagagctgcaagctctggaggaggagctgcgggaagcagccgaaagaagacgcgcagcctgggaagctaaagctggaggctgcggcagaggccctgagtggagcgcagctcgacgggcatcaagggaagctgtagaaaaggagttgggggcactgcaacagtgttgggaaagagacggcggtcctgcccagccccacggaccgcataggttggtgcgacgcgaggacggggcagctggcgatcgagacctacgggcagcggtagtcattcggacactacgcagtcaggaggcctgcctggaggcggtgttgcgtaggttgcaggggcagtgcagacaggagctcgctcgacttgtgggagctaggcccggtctgatttggatcccccctccgggaagatag

SEQ ID NO: 53928 - DNA, 1281 bp, Artificial Sequence
  Description of Artificial Sequence: Synthetic coding sequence
atgggacggaggcgccagcgcgtagacccggctgcgggtgctcgggctggcgctttaccggaggcaattgcagcgttatctagaagcctcccatccgggccttccccagagatttttcgtcgcgcaaaatttgacaggcccgaggcaactagtgccctttggcagctcctttttcgcgtgttgtcacccctgcctgccggaaacgctctcgcaagcctggctctggaagttcaagctcggttggttaagtcggcgctgtgttcacagggctatcccagactggccctggcccagctgcctgaagacggatcccaagggagcagagagctgctgctggccttgtcttggctgctggctcggggaccagtgccagagcaaatgctggcccaggcacgcgtgcctctgggggatgaaatgactgtttgtcaatgcgaggccctggcgagccccggtccgcctgccccacatatggaggctgagggcccagttgatgtgcgacacgtgcagtggctaatggggaagttaagattccgctggcggcagcttgtctcttcacagcaggaacagtgtgccctcctgagtaagatacacttgtatactagaggctgccacagtgaccagagcttaagccatctgtctgtcacggaagcagagatgctgcgggatcctgagggcggacagcaattgctaagaacactggagcgcgaaaatcaaagactcgaagctgttctggcgtggaggagatctgagctggtgttttggaggtggatggacaccgtgttgggaacctgcgctcctgaggtacccgctgcagcaagtcagccaacattcctgccatgggtgcccgagcgtgggggtggggagctggatctcgtcgtgcgagaactccaggcactagaggaagagcttcgcgaggctgcggaacgtcgcagggcggcttgggaggccaaagccggtggatgcggcaggggtcctgaatggtccgccgctcgcagagccagcagggaggcggtggagaaagaactcggagcccttcaacagtgttgggagagagacggaggtcccgctcagccccacggccctcacaggctcgttcgcagggaggatggagccgcaggagacagagatctgcgggctgccgtggttataaggacgctgcggtcccaggaggcttgcttagaagccgtgctcaggaggcttcagggccagtgtcgacaagaattagcacgtctcgtgggagccaggcccggactgatttggattccacccccaggccgatag

SEQ ID NO: 53929 - DNA, 1488 bp, Artificial Sequence
  Description of Artificial Sequence: Synthetic coding sequence
atgggtcggaggagacagcgggtggatcctgcagccggagcacgggctggcgcactccctgaggctatagcagcattgagtcgaagtcttccgtcaggccctagccccgaaatttttcgcagagctaagttcgacaggcccgaagccaccagcgccctgtggcagctgctgtttcgggttctcagcccacttcccgctggcaacgcccttgcatctctggctttagaggtgcaggctagactggttaagagcgcactttgcagccagggctatccgcgactggcgttggcccagctgcctgaagacgggagtcagggcagcagagagttgctgctggccctgagttggctcctggctaggggtccagttcctgaacagatgctggcccaggctcgggtgcctctcggtgacgaaatgaccgtgtgccagtgtgaggctctcgcctcaccaggtcctccggctcctcatatggaagcggaaggacctgtggacgtcagacacgtacaatggctcatgggcaagctaaggtttcggtggaggcagctggtcagctcgcagcaggaacagtgcgctctgttgagcaagatccacctgtacacaagggggtgccactcagaccagtccctgagccacctctctgtgaccgaggccgagatgctgcgcgatccggaggggggacagcaagtgtccggcgcaggcgcagcccaaaacctcgatctggcatatcctaagtgcctgcacagcttctgcacccccggtatgggcccaagaaccttttggaacgatctgtggctggtgtgcgagcaacctggcctgctgcccggagattgggctgccccactggatcctggcggtgcctcggcttgttccttgctgagtccctttagagcgttactgcgcactctagaacgggaaaaccagagattagaagcagttctcgcttggagaaggtccgagctggtcttctggcgttggatggacactgtccttggcacttgcgctcccgaagtgcctgccgcagcatcacagcctacctttcttccttgggtccccgagagaggcggaggggaactagacctggtggtaagggagctgcaggcccttgaggaggaactgcgagaagcggctgagagacggagggccgcttgggaagccaaggctggtggttgcggccgtggtcctgaatggtctgctgctaggagggcatcgagggaggccgtcgagaaggaactgggagcactacaacagtgttgggagagggacggcggtcctgctcaaccacatggaccacacagattggtgaggcgtgaagatggcgctgcaggagacagagacctgcgggcagcagtagtgataaggactctgcgcagccaggaggcctgccttgaggccgtgctacggagactacaggggcagtgtcggcaggaattagcacgtcttgtgggagctagacctggccttatttggatcccgccacccggaaggtag

SEQ ID NO: 53930 - DNA, 1059 bp, Artificial Sequence
  Description of Artificial Sequence: Synthetic coding sequence
atgagcgggcagaggggcgactggacgagtgccctgtggcaattgctcttcagagtactgtcccccctgcctgcgggtaatgcactggctagcctagcactggaggtccaagcacgactggtaaagagcgccctctgcagccagggataccctcgactggctctcgctcaactgcctgaggacggttctcagggcagccgggaacttctccttgcactgagttggttgctggcgaggggccctgtcccagagcaaatgctcgcgcaagcacgggtaccccttggggacgaaatgaccgtgtgccagtgcgaagcattggctagtcccggaccccctgcaccccacatggaagcagagggcccagtggacgtccgtcacgttcagtggctgatgggaaaactgcgcttccgttggcggcaactcgtgagttctcagcaagaacagtgcgctctgctgtccaagctcctacgaacgcttgagcgcgaaaaccagagactggaagcggtcctcgcctggagacgatccgaattagtgttttggcgctggatggacaccgtgctgggaacgtgcgcacccgaagtgcctgcagccgctagccagcctactttcttaccatgggtcccagagaggggcggaggcgagctggacctggtcgttcgggaactccaagcgttggaggaggaactgagagaagccgcagaacgacgaagagctgcctgggaagctaaagccggtgggtgtggtaggggcccagaatggagtgccgcaagacgcgcaagccgtgaagctgtagagaaagagctgggagctctgcagcagtgttgggagagggacggtggccctgcccaaccgcatggcccacatagactggtgcggagggaggatggagccgcaggtgacagagacctgcgtgctgccgtagtgattcgaacgctccgtagccaggaagcttgtcttgaagctgtcttgcgtaggcttcagggccaatgccgacaggaactggcaaggctggtgggagctcgcccaggtttgatctggatacccccaccaggtagatag

SEQ ID NO: 53931 - DNA, 474 bp, Artificial Sequence
  Description of Artificial Sequence: Synthetic coding sequence
atgcttgcacaagctagggtacccctaggagatgagatgactgtgtgtcagtgcgaggctctggcttcccccggaccaccagcccctcacatggaagccgagggtcccgttgatgtgagacacgtgcagtggcttatgggcaagttgaggttcagatggaggcagctggtgtcctctcagcaggaacagtgtgctttgctttcaaaaattcacttatatactcgtggatgccactcagaccagtcactatctcaccttagcgtgaccgaagcggagatgctgcgggatcccgagggcggacagcagcttctaaggacactcgagcgcgagaatcaacggctggaagcggttctggcctggcgacgaagcgagttggtcttctggcgatggatggacactgtgctgggtacgtgcgcccctgaggtacccgctgccgcatcccagccaacgtttctgccctgggtgcccgagtag

SEQ ID NO: 53932 - DNA, 243 bp, Artificial Sequence
  Description of Artificial Sequence: Synthetic coding sequence
atgagtgggcagcgcggtgattggacctccgcattgtggcagctcctcttcagagtgctctccccgttgcctgcaggtaatgccctggcatcccttgcccttgaggtgcaggctagactcgtcaaatcagccctgtgtagtcagggctaccccagattggcacttgcgcagctgccagaggatggatcgcaagggtctcgcgagctactcctcgccctttcctggctcctggcaagggggtag

SEQ ID NO: 53933 - DNA, 333 bp, Artificial Sequence
  Description of Artificial Sequence: Synthetic coding sequence
atgtccgggcagcgtggcgactggacatcagctctgtggcaattgctgtttcgcgtgctgtcacctctcccagccggaaacgccctggcttcactggctctggaggttcaggctcgtctcgtcaaaagcgcattgtgctcacagggttatcctagacttgccctggcgcagcttccggaggacggttcacaagggtcgcgcgaactccttctcgccctttcatggctacttgcgagaggtccagtgcctgagcagatgctggcccaagcacgggtgcctctaggggacgagatgaccgtctgccagtgcgaggccttagcttctcctggctag

SEQ ID NO: 53934 - DNA, 747 bp, Artificial Sequence
  Description of Artificial Sequence: Synthetic coding sequence
atgctggcgcaggcccgagtgcccctgggcgacgagatgacggtgtgccagatccatttgtatacaagaggctgtcactcagatcaatcactctcacatctgtccgtcaccgaggctgaaatgctccgagatcctgaggggggacaacagcttctgagaacactggagcgtgagaatcagaggctcgaagcagtgttggcttggcggaggagcgaacttgtgttttggcgttggatggacaccgtgctcggaacatgtgcgcctgaggtgccagccgctgccagccagcccactttcctgccgtgggtccccgaacgcggagggggagaactggatctggttgtccgggaattgcaggctcttgaagaggagctgcgagaagctgccgagcgtcggcgagcggcatgggaggcaaaagccggtggttgtgggaggggcccagaatggtcagcggctcggagggcatccagggaagccgtggagaaagagctgggtgcgctccaacagtgttgggagagggacggcggacctgcccagcctcacgggccacatagactcgtgaggcgggaggatggtgcagctggagatcgagaccttcgggctgcagtcgtgatcaggacccttcgctcccaggaggcctgtttagaggccgtgctacgtcgcctacaagggcagtgtcggcaggaactcgccaggctggtgggggctcgtcctggtctgatatggatacctcctcccggaagatag

SEQ ID NO: 53935 - DNA, 165 bp, Artificial Sequence
  Description of Artificial Sequence: Synthetic coding sequence
atgctagcacaggctagagttcctttgggcgacgagatgacggtctgccagtgcgaggctctcgctagcccgggacctccggctccccacatggaagcagagggtcccgtagacgtgcgtcacgtccagtggcttatgggcaaactgagatttcgatggcgatag

SEQ ID NO: 53936 - DNA, 597 bp, Artificial Sequence
  Description of Artificial Sequence: Synthetic coding sequence
atggccacagctgaaccaagcgggagagccctccggctcagcacccctggcccaaggccaagcggagcgagagatcgggctcccggagcagctggaccaccaagcggacagattggaaacagagccctgcgccttggcgagcgcacccctgcagccgtcgagaagcgtggaccgtacatggtaacgagggcacctagcatccaagccaagctgcagaaacatagagatttagccaaggcagtgctgcggaggaaagggatgttgggggcttctcctaacagacctgattcttcaggcaagcgaagtgttaagtttaacaaaggatacactgccttgtcgcagagtccagatgaaaacctagtcagcctcgattcagactccgacggcgagctaggttcgcgttattcttcaggctattcgtccgccgagcaggtgaaccaggacgtgagccggcagttgctccaagatggatatcatctggacgagatacccgatgacgaagacctcgatctaatacctcctaagccgatggcttcatctacgtgctcctgttgttggtgctgcctaggagattcttcttcctgcacactgcagtag

SEQ ID NO: 53937 - DNA, 447 bp, Artificial Sequence
  Description of Artificial Sequence: Synthetic coding sequence
atggccactgcagaaccatcagggagagccttacgcctgagcactccaggacccaggccatccggggcacgtgatcgcgctccgggagcagccggacctccctccgggcagattggcaatcgagcactgcgacttggggaacggactccagccgctgttgaaaaaagggggccatatatggtcaccagggcaccttccattcaagctaaacttcagaaacaccgggacctcgcaaaggcggtgctgaggcggaaagggatgctgggtgcatcaccaaaccgccctgacagctcgggtaagaggtccgtaaaatttaacaagggatatacagcattgtctcagtcaccagacgaaaacttggtgtccctcgacagtgaccgtccgttcatgtacataccgggaccgttctcttccgagcagtatccattccctgggtggcttgggtag

SEQ ID NO: 53938 - DNA, 906 bp, Artificial Sequence
  Description of Artificial Sequence: Synthetic coding sequence
atggcccaaaacgtatacggaccgggtgtccggatcggaaactggaacgaagatgtatatcttgaggaggagttaatgaaggatttcttagagaaaagagataaggggaagcttcttatccagcgatcaaggcgcctcaagcagaatctgctcagacccatgcaactctcagtgaccgaagatggctacatccactacggcgacaaggttatgttagtcaatccagacgacccagatacagaggccgacgtgtttctgcgcggagacctaagcctctgtatgacacccgacgagatccagtctcacctcaaggacgaactggaagtcccctgtggcctctctgctgtgcaagctaaaacccccatcggaaggaacacatttattattctctctgtgcatcgagatgcaaccgggcaggttcttcggtatgggcaagacttttgtttagggatcacaggcggtttcgacaataagatgttatacctgtcttcagatcacagaactttactgaagtcttccaaacgaagctggttacaggaagtgtacctgacagacgaggtcagccacgtcaactgttggcaggcggcattccctgatccgcaacttcggctcgagtacgagggcttccctgtgcccgctaacgcaaaaatcctgataaaccattgccatacaaaccgcggtctcgccgctcatcgccatctgtttctttccacatactttggcaaggaggctgaagtcgttgcccacacttacttggattctcatcgcgtggagaaacccaggaaccactggatgctagtcaccggaaacccgcgtgacgcctcgtcatctatgttggacctcccgaaaccgcctacagaggataccagggcaatggaacaagcaatggggctggatacacaatag

SEQ ID NO: 53939 - DNA, 600 bp, Artificial Sequence
  Description of Artificial Sequence: Synthetic coding sequence
atgaaggactttctggagaaacgagataagggaaaactgctcattcagcggtcgaggcgtctgaagcagaacctgcttcggccaatgcaactctccgtcactgaggatggatacatacactatggcgataaagtgatgcttgtgaatccagacgatcctgacacagaggccgatgtgttcctgcggggtgatctctccctgtgcatgaccccagatgagatacaaagtcacttgaaagacgagctggaggtgccttgcgggcttagcgccgtccaagcaaaaaccccaattggtcgaaatacattcatcatactgtctgttcatcgagatgccacgggacaggtgcttaggtatgggcaagatttctgccttggaattaccggcggttttgacaataaaatgctctacctcagttctgatcaccggactctgctcaagagcagtaaaaggtcgtggctccaggaagtctaccttaccgacgaagtgagtcacgtaaactgttggaatatgaaggcaagtccttcccgtcagatgttaaaattctccagcattaccgtgacccaaatcggtgactggcagccgaccggaattttttcctag

SEQ ID NO: 53940 - DNA, 537 bp, Artificial Sequence
  Description of Artificial Sequence: Synthetic coding sequence
atgaataagcggacctcagtggatgcgagtaaagaggatcttcaccccgctgacccccagagtggcgagggagttccacccaacagaaagaataccaagacttcacccagaggggagggaaccgcaccaccattttctgccagaccatgcgtatggacactatgcgagatgctgagcattcttgctctggtaggcgtcttacatccattctatcgaagcaacaaccaggtataccaaaaactcaagactcaccttagatgccaaagctctcgggtagacggcctgatgcttaagcccacactgttaactcctagccagctaaagtccccagaggggcatctgattttacccacatttaatcacctggtaatcaggcatatcttagaccccaagcaaatcttttgtgtggccgatgtttgtacagattgtaaattcaattgtggcagtattgaacgccaccagaaaaggcatttaatgcgtgtgagccaggactgggagcacctaatccgctaccggaaccagatctgtcttagttag

SEQ ID NO: 53941 - DNA, 1527 bp, Artificial Sequence
  Description of Artificial Sequence: Synthetic coding sequence
atggcagggcagcggacatgtcaaagaagatctagcagggccggaccaggtaaaatgcaggagccccctaagtctattgaggagttcttaaagttccagaactgggactattggcctagagagatccactttcgcgatgacgataagtggagctgcaccctgaaaaaaatcaaggaagactctagcttcgtgtcaatttacacgcacctgtgggaaaacgtgcctcgcatatttgaggccctgctgatcatggagtctaagctgaaagagtatagtctcatcctgcagaatcacacctccgagatcttcaagtggaagtcgatgatttccgagaccagcagctacaggaagttggagcggtatggcgaattcttgaagaaataccacaagaagaaaaaaatcatgctctccgacgaaatggagaccgaaaagaatattgaaggctgctcattcacaggctttaaggccaacgagctaacacagctgccacgtcatctggatgccgagcaaatttatctgttcattctaaaagcccacaactttgatgaacgcgtgttcaagatatggaaaacacactttttgtctgaggcttctattgccttgctccacgatagcttttggtggtggtttctgcataaattccggcctgatcgggagaatcaggactgcctcttcgatagaatctcggaaagttatgtcacgctttttatgagcatcccccttagtcggaaagatgcctttttccagatttacccagattgcctcgctcaggccatttacgcaacttttcacgaagcattcccagagtcatcatatttgttcaacgacgagtttaaagaggatctcgggaataatatatttctatggtgttcaggactgaagccccagaaggggttttggatccattggaaattaaaagagctctctactactaccatccacggatccaaaaaggcccctgctaagagcgtcaaggagcgtatcgctgacagccaggagcacatctccacttcgatcgacttcaacatcataaaaatcctcaataatcctcgcgcttatacactacccatttcaaaggaagagagcagactgagtaggctggcaaccaagtcccactattcctcaaccgggccagaatttaaccgggtgctgtttaacttcggaggacagtctcctctgattctttattacttgaaaatgcatgagctcgccggaatttcaaaagccccaaaaaagaccaagatcaaactgaccaaaatattccaagagcctcttccggctcccacgtatagagatgtcatcaaagaggctaaaaggcagttcgcgagaaatcagaaagactttagaatcctccaggcaaaggctactaagaagcctcacgaagtgaaacaggatttcgagaagtttcttcacaaactgaggtccgaggcggagatcgagcgcgaatgcgtcgcctctctgagtagcagctcctctagttccccaagttccaccgataactacaattttgaggaagaggagtattag

SEQ ID NO: 53942 - DNA, 912 bp, Artificial Sequence
  Description of Artificial Sequence: Synthetic coding sequence
atggctgggcagagaacttgccagagacgttcatccagagcagggccagggaagatgcaggaaccaccaaagtcgatagaggaatttctcaagttccagaactgggactactggccaagggagatccacttccgcgatgatgacaagtggtcctgcacgctcaagaagataaaggaagactcaagtttcgtgagtatctacacccacttgtgggagaatgtgccccgtatattcgaggccctcctcattatggagagcaaactgaaagagtactctctcatcctgcagaaccatacgtccgaaatctttaaatggaagagcatgatcagtgaaacgagcagctaccggaagttagagaggtacggagaatttctgaagaaataccataaaaaaaagaagataatgctgagtgacgagatggaaactgagaaaaatatagaagggtgctccttcaccggattcaaagcaaacgaactgacacaactgccacggcatttggatgcggagcagatctacctgttcattctgaaagcccacaatttcgacgaacgcgtcttcaagatttggaagacgcactttctgagtgaggccagcatcgccctcctgcacgactcattctggtggtggttcctgcacaaatttaggatttatcccgactgcctcgctcaagccatctatgccaccttccacgaggcgtttcctgaatcatcatatctgttcaacgatgaatttaaggaagatctcggtaacaacattttcctctggtgttcaggcctgaaacctcagaaaggtttctggattcattggaaactcaaggagctcagtactaccacaattcacgggtccaaaaaagctcctgccaagagtgtaaaagaacgcatcgccgattcccaggaacacatcagcacctag

SEQ ID NO: 53943 - DNA, 549 bp, Artificial Sequence
  Description of Artificial Sequence: Synthetic coding sequence
atggctggacagcggacctgtcagaggcgatcttccagagctgggccaggtaaaatgcaggagccccctaaaagtatagaagaattcttaaagttccagaattgggactattggccgagagaaatccactttagggacgatgacaagtggtcatgtaccctgaagaagatcaaagaggactcttcattcgtgtctatttatacccatttgtgggaaaacgtaccacggattttcgaggccctactgatcatggaatctaaactgaaagagtatagtctgattctccagaaccacacctctgagatttttaagtggaaaagcatgatcagcgaaacgagctcttataggaaacttgaaagatatggagagttcctgaagaaatatcataaaaaaaaaaaaattatgctctcagacgagatggaaaccgagaaaaatatcgaaggctgctcctttacgggcttcaaggcaaacgagttaacccagctgcctcggcatttagacgcagagcaaatttacttgttcattcttaaagctcataacttcgactag

SEQ ID NO: 53944 - DNA, 915 bp, Artificial Sequence
  Description of Artificial Sequence: Synthetic coding sequence
atggcaggccagcgtacttgtcagaggagatcttctcgagctggcccaggaaagatgcaggagcctccaaaaagcattgaggagtttttgaagttccagaactgggattattggcctcgcgaaattcatttcagagatgatgacaaatggtcctgtactcttaagaaaataaaggaagactcaagcttcgtcagtatttatacacatctatgggaaaacgtgcccaggattttcgaggcactgctgattatggagtccaagcttaaagaatactcactgatcttgcagaatcatacgtctgagatcttcaaatggaagtcaatgatcagcgagaccagctcctaccgtaagctagagcgatatggggaattcctgaaaaagtaccacaagaagaagaagatcatgctgagtgacgaaatggaaaccgagaaaaacattgagggctgctccttcacgggctttaaggcgaacgagttaactcagctacctaggcatctggacgctgagcagatatacctgttcatcctcaaggctcataattttgatgaaagggtgtttaaaatttggaagacacactttctgagcgaggcgtcgattgctctgctgcatgattcattttggtggtggtttctccacaagtttcgaatctatccagattgcttggctcaagctatctacgctacttttcatgaggcattccccgagtcatcctacctatttaatgatgaatttaaggaggacctggggaataacattttcctgtggtgttcagggttgaagccccagaagggcttctggattcattggaaactgaaggaactatcgactacaactattcacggctcgaagaaggctccagccaagtctgttaaagagagaattgctgattctcaggagcacattagcacatcgtag

SEQ ID NO: 53945 - DNA, 393 bp, Artificial Sequence
  Description of Artificial Sequence: Synthetic coding sequence
atgccccgtcccgcaagcgagtcctggtccccaattcagagtaggattccagcctacaaagccgtgtcccatttgaggctgctgcctacagctaatagcccgtccggcagcaaccagcccaccaatcctaatagggcacaacacccggagggaccccagtccagagaaggggctacatcacccgtgctggctagtttggagccaccgactcccacagacctgcccagcgccagagccagaccacgggtacctgccgagtccggccctggctggctacacaaagctagaaggcccacacggggaattctccgcgatgtgctccggcatcggggtgttccggcacagcctcgccctgcccctggcgctcatcagctgtcatctccttcatcctag

SEQ ID NO: 53946 - DNA, 681 bp, Artificial Sequence
  Description of Artificial Sequence: Synthetic coding sequence
atgagtaggatataccatgatggcgctctgagaaacaaggcggtgcagtccgtccggcttcccggtgcttgggatcctgccgcacaccagggaggcaacggcgtcttgttagagggggaacttatagacgtatcaaggcattctatactggacactcacggtcgcaaggagcgctactatgtactatatataagaccttcacacatccacagacggaaattcgatgcaaagggcaacgagatagagcctaacttcagcgccactcgcaaagttaatactggcttcctcatgagctcttataaagtcgaggccaaaggcgacaccgaccgcctgacccccgaagcattaaaaggcttggtgaataagccagaacttctggccctaactgagtctcttaccccagaccatacagtggcattttggatgcctgaatctgagatggaggttatggaactagaactgggggcaggtgtacgcctaaagactcggggtgatggcccttttcttgacagcctggccaagctggaggcgggtaccgttaccaagtgtaatttcaccggcgacggtaagaccggagctagctggaccgacaatatcatggcccagaagtgctcaaagggggctgccgctgagattcgggagcagggagatggggcagaggatgaggagtgggacgactag

SEQ ID NO: 53947 - DNA, 3144 bp, Artificial Sequence
  Description of Artificial Sequence: Synthetic coding sequence
atggccgaaaagcgtccattgcgcacccttgggccagtgatgtatggcaaactgccgaggctagagacagactcaggactggaacacagcttaccccatagcgtgggaaatcaggatccttgcacctacaaaggcagttacttctcctgtcccatggcgggaacccccaaagctgagtctgagcagctggctagctggacaccatacccgccactgtactcaacaggtatggcgggacctccgctgcaggccgacaacctgctgacgaactgccttttctacagatcccctgccgaaggcccagaaaaaatgcaggattccagccctgtagaactgctgccttttagcccacaagcccattcttatcccggacccccactggccgctcccaagcccgtttacaggaatccattgtgctatgggctgtcgacctgtttaggggagggagcagttaagcgaccgctggacgtagactggaccctcgccacagggcctctgttgccatccgccgatcccccttgctccttggccccagcgccaagcaagggccagaccttagatggtacatttctgaggggtgttcctgctgaaggctccagtaaagacagtagtggcagtttctcaccatgccaaccctttctggagaaataccagaccatccattcgaccgggttcctggcaagtcgctatacgggaccatatcccagaaacagcaagcaggctatgagtgagggcccatcctccccctggactcagctcgctcaaccgttgggccctccttgtcaagatacaggtcccactcactacccaccccctcatcaccccccaccacatcctccacaggcccttccttgtcctcctgcctgcagacatccggaaaaacaagggtcctacagtcccgcactgccgttgcaaccactgggaggtcacaaaggtaccggatatcaggctggcggactggggtcgccatacctgaggcagcaggccgcacaggctccatacattcccccactgggcctggacgcttacccctatccttccgcaccactccctgctccaagtccgggacttaaactggaaccccctctgacccccaggtgtcccttggatttcgctccgcagacgctttccttcccctacgcgcgagatgacctgtccctttatggggcttcccctggcctgggtggtactccaccttcccaaaacaatgtgcgggcagttccccagccaggcgcatttcaacgggcttgccagccgttacccgcatcacagccatgtagtgaacccgtcagacctgcccaggaggctgaggagaagacgtggttgccatcctgtcggaaagagaaactgcaaccaaggctgtccgagcactctggccctccaattgtgatccgagattctccggttccttgcaccccacccgcactcccaccttgtgcacgcgagtgccagagtcttccccagaaggaaggggctcggccaccttcttcacctcctatgccagtgatcgacaatgtatttagcctggccccttacagggattacctcgatgtccccgctcccgaggctaccactgagcccgatagcgctactgcagaacccgacagcgccccagccacctctgagggacaggacaagggatgcagaggtaccctccccgcacaagagggaccaagtggctctaagcccctacggggatccttgaaggaggaagtggctctggacctcagtgtgaggaagcctactgcggaggcgagccccgtgaaggcgtcccggtctgttgagcatgccaaaccaaccgctgccatggatgtccctgatgtggggaacatggtctctgacctcccgggacttaaaaagatcgatacggaggctccaggtctgcccggagtcccggtgactaccgatgcgatgcccaggactaactttcatagcagcgtggctttcatgtttcgtaagtttaagatcctaagacccgctcccctgcccgcagctgttgtgccatccacccccaccagcgcacccgcacccactcagcctgcaccaactccgacctcaggaccaattggcctgcgtatactggcacaacaaccactgagcgtcacgtgcttctcattggctttaccttctcccccagccgttgccgtggcgagtcccgctccagcccctgccccttcgccagcacccgcaagggctcaggccccagcgagcgcgcgtgatcccgctcccgctcctgccccagtggccggtccagcaccagcatcaacctcagctcctggcgactccctggaacagcacttcacaggcttacatgcctccttatgtgatgctatctcaggaagcgtcgcgcacagtcctcccgaaaagttgcgcgagtggcttgagaccgccggtccatggggccaggccgcttggcaagattgtcagggtgtacagggactcctagccaagttactaagtcagctccaacgctttgatcggacccatcgatgccccttcccgcacgtcgtgagagcaggagccatctttgtgcccatccacttggttaaggaacgcctgttcccccgacttccccctgctagcgtggatcatgtgctacaggagcatagggtggagctacgcccaactacactgtccgaagaaagggcactgagagagctagcactccccggatgtacttctcggatgctcaagctcctggcactcagacagctcccagacatctatcctgacctcctcggactgcaatggcgagattgcgtcagaaggcaactgggggacttcgacaccgaggcgggtgccgtgtccagttccgaaccaaccgttgcacggggtgaaccagagtcactggcactggcccagaaatctcctgctcccaaagtgcggaagcctgggaggaagcctccaacacctggcccagaaaaggctgaagcagctgccggagaagaaagctgcggtgctagtcctacaccagcaacatcagcctctcctccgggaccgacactgaaggccagatttcgctccctgcttgagacagcctggctgaatggtcttgctttgcctacctgggggcataagtccagtcgcccagatcagccatctccatgccctcaactgctcgattcccagtcccaccatctatag

SEQ ID NO: 53948 - DNA, 3144 bp, Artificial Sequence
  Description of Artificial Sequence: Synthetic coding sequence
atggctgagaagaggccgctccgaacccttggcccagtcatgtacggaaaactgccaaggctggagactgatagtggcctcgaacatagtttaccacattcagtgggcaatcaagatccctgtacttacaaggggtcctacttcagctgtccaatggccggtactccgaaggccgaaagtgaacagctggcatcctggaccccgtatccacccctttactctaccggaatggccggtccaccactgcaagctgataatctcctgacaaattgcctgttttataggagtccagctgagggccctgaaaagatgcaggactcctcccctgtggaactgctgccattcagcccacaggctcatagttatcctggcccacctctcgcggctcctaaaccagtgtatagaaatcctctctgctacggactttcaacatgccttggcgaaggcgctgtgaagcgccctctggacgtcgactggaccctggccacaggtcctctcctgccatccgccgaccctccatgtagcctcgccccagcgcctagcaaaggtcagacattggacggaacctttctgagaggggtaccggcagaagggagtagcaaggacagctctgggagtttctccccctgtcagccattcctggagaaataccaaacaattcatagtacaggcttcctcgcttccaggtatactggtccttaccctcgcaatagcaaacaggcaatgtcagaaggcccatcatcaccctggactcagctcgcccagcctctgggaccaccatgccaggataccggtcctacccactaccccccaccacatcacccccctccacaccctccccaggccttaccgtgcccaccagcctgtcgacaccctgagaagcagggcagctactccccagccctgccattgcagccactggggggtcacaaaggcactggctatcaagcaggtggcctgggaagcccttatcttcggcagcaggccgctcaggctccttatatccccccactgggattagatgcatatccctacccttccgcacctctccctgccccatcccctggcctgaagctcgaaccacccctcacccctcgatgccctctggacttcgcccctcagaccctgagctttccttacgccagggacgatctctccttgtacggcgcatctcccggacttggtggaacccccccatcacagaacaatgttagagcagtgccccagcctggcgcattccagagagcctgccagcctctgcccgcatcacagccttgttccgagcctgtgcgcccagctcaggaggcagaggaaaagacttggttgcctagttgccgcaaagagaaacttcagcccaggttaagcgagcactccggccctcccatcgtgatacgcgactcccctgtaccttgtacacctcccgctctgccgccatgcgccagagagtgtcagagtttacctcagaaagagggtgcaagaccgcctagttctccacccatgcctgtcatagacaatgtgttcagcctcgccccatacagagattacctggacgtacctgcccctgaggcgacgacagagcccgacagtgcaactgctgagcctgactctgccccagcaacatccgaaggtcaggataagggttgccgaggaacgttaccggcacaggaagggcctagcggcagcaagcccttacgcggaagtctcaaggaagaagtggctctcgacctcagcgtgagaaaacccacggctgaagcttcacccgtgaaagcctccagaagcgttgagcacgccaaacccaccgcagcgatggacgtgcccgatgtgggcaacatggtctcggacctgcccggtttgaagaaaatcgatacggaggccccaggactccctggtgtgccagtaactaccgatgccatgccgcgaacaaactttcactcaagtgtcgccttcatgttccgcaagttcaaaatcttacgccctgccccactgcccgctgccgttgtgccatcaactccgacatcagcccctgccccaacccagccggcacctacaccaacctcagggcctattggtctgaggatccttgcccagcaacccttgtccgtcacctgcttttcactggccctacctagcccaccagcagtggccgttgcctcccctgcccctgctccagcgccttctcctgctcccgcacgcgctcaagcgcctgcctcggcaagggaccctgcacccgcaccagcaccagtggccggacctgccccagcaagcacctccgcgcctggagatagtctcgagcagcattttaccggattgcacgcatcactgtgcgatgccatctctggttcagtggcacactctccccctgagaagcttagggaatggctcgagactgccggtccatggggccaggcagcttggcaggactgtcagggcgtccagggactgctggccaagctgctgagccagctgcaaaggttcgatcggacccatcggtgcccatttccccacgtggttagagcaggtgcgatctttgtgccaattcacctcgttaaggagagactcttccccaggttacctcctgcctcggtggaccacgtcttacaggagcatcgagttgagctgcgccctaccacactaagtgaggagagggcactgagggagctggcactccctgggtgcacttctcggatgctcaaactgctggctcttcggcagctccctgatatctatcccgacttgttaggcttacagtggcgagactgcgtgcgcagacaactgggcgactttgatacggaggccggagccgtgagctcttctgagcctacagtcgccaggggagaacccgaaagtctcgctttggcgcagaagtcacccgcaccgaaggtgagaaagccaggtagaaagccacccacccccggtccagagaaagcagaagccgcagctggtgaggagtcttgtggagcatcgcctacccctgcgactagtgcttcccccccaggtcccacgcttaaagctcgatttcggagtctgctggaaaccgcctggctcaatggactcgcgttgcctacatggggacataagtcatcccgaccggatcagccgagtccttgccctcagctgttggacagccagtctcatcacctgtag

SEQ ID NO: 53949 - DNA, 1338 bp, Artificial Sequence
  Description of Artificial Sequence: Synthetic coding sequence
atggatgttcccgatgtgggaaatatggtttcagatctgcccggacttaaaaagatcgacaccgaagcaccaggtctgcctggcgtgccggttacaacggatgctatgccacgtacaaattttcactcaagtgtcgcttttatgttccgaaaatttaagatcctcagacctgcacctttgcctgccgcagtggttccatcaaccccaacaagcgcgccagcacccacccagccggctccaacccctacttctggcccaataggcctgcgcatccttgcgcagcagccactgtccgtaacctgtttctcgctggccctcccaagtccacctgccgttgcagtggccagcccagctcctgcccctgccccttcacccgctcccgcaagagctcaagcgccagcctctgcccgagatccagcccctgcccctgcccctgtcgcaggaccggctccagccagcactagtgctcccggtgacagcctggaacagcactttactgggttgcatgcttctctgtgcgacgctattagcgggtcagtcgcacactccccccctgaaaaattacgagaatggctggagactgcgggtccatggggccaggccgcttggcaggactgtcagggagtgcagggtctgctcgcaaaattactgagccagctgcagcgtttcgatcggacacacaggtgtccgtttccgcacgtcgtccgggctggggcaatattcgtgccgatccaccttgttaaggagaggctgtttccccgtctccctcccgcttccgtggaccacgtacttcaggagcatagggtcgagcttcgcccaaccacactttctgaagagagggctttgcgagaattggccctccctggctgcacatccaggatgttgaagctactggccctgaggcagttgccggatatatatcccgacctgctcggcctacagtggagggattgtgttcgcagacagctgggtgacttcgacacagaggcgggagcggtttcctcaagcgaaccaacagtggctaggggtgaacccgagagcctggccctggctcagaaatcccccgctccaaaggtacggaagccgggacgcaagcctcctacacccggacctgagaaggccgaagccgctgctggtgaagagtcttgtggagcttcccctacgcccgctaccagcgcttccccacctggacccaccctgaaggccaggtttagaagtctgctggaaacagcgtggctgaacgggctcgctttgccgacctggggccataagtctagtcgtccagaccagcctagtccctgtccccagctgctggactcgcagtctcaccacctgtag

SEQ ID NO: 53950 - DNA, 381 bp, Artificial Sequence
  Description of Artificial Sequence: Synthetic coding sequence
atgcctaagaaggccggagcaacaacaaagggtaagtcccagtccaaggaacctgagaggcccctgcctcccttagggcctgtagctgtggatcccaaagggtgcgtgacaatagccatccacgccaaacccggaagtaagcaaaatgcggttacagacctaaccgccgaggcagtgaacgtcgctatcgcggcaccgcctagcgagggcgaggcaaacgccgaactctgtcggtacctctccaaggtcctcgagctgaggaagtcagatgtggtcctggataaagggggaaagagccgcgaaaaggttgttaaattacttgcctctacgaccccggaggaaattctggagaaactcaagaaagaggcaaaaaaaacctag

SEQ ID NO: 53951 - DNA, 504 bp, Artificial Sequence
  Description of Artificial Sequence: Synthetic coding sequence
atgctcagactgcgaagcgggcttaggcatctgagggcgacgcccaatacaagaggaagtgctcggctgttatgcgccgaaatgcctaagaaagctggggcaacgactaaaggcaaaagtcaaagcaaggagcctgagcggccactgcctcctttgggacctgtggcagtggatccgaagggttgtgttaccatcgccattcacgcaaagccaggatccaaacagaacgctgttactgacctgactgccgaggcggtgaacgtggcaattgccgcacctccctccgagggtgaagccaatgcagaactctgccgctatctttctaaggtgctcgagctgagaaaatctgacgtggtattggacaaaaccgggagctgctatatcgcccaggctggactggagcttctcgccagcagcgacctgcccgcttcagccagccaatccgcgggaatcaccggcgttagccaccacacccagcccgctctcttacttatatcactgtag

SEQ ID NO: 53952 - DNA, 462 bp, Artificial Sequence
  Description of Artificial Sequence: Synthetic coding sequence
atgctccgcctgcgatctggacttcgtcatcttcgagcaacacccaatactcgaggtagcgcgaggttattatgtgccgaaatgcctaagaaggcgggagcgacgactaaggggaaaagccagagtaaagagcccgaacggcctctaccaccactggggccagtcgcagtcgacccaaagggctgcgtaactatcgccatccacgctaagccaggatctaaacagaacgctgtcacggacttaaccgctgaggctgtaaatgtggccattgccgctcctccctcagagggtgaggccaatgccgagctctgtagatacctgagcaaggtgctggaactcagaaaatctgatgtggtgctcgataagggcggtaaaagccgggagaaggtggtcaagctgctggcatctaccaccccagaagagatcctggagaaactgaaaaaagaggccaagaagacctag

SEQ ID NO: 53953 - DNA, 450 bp, Artificial Sequence
  Description of Artificial Sequence: Synthetic coding sequence
atgctcagactccggtctgggcttcggcacttgcgagcaacacctaatacaagaggttcagccaggcttctctgcgctgaaatgcctaaaaaggccggagccaccaccaaagggaagtcgcagtctaaggaacccgagaggcccttacctccgctaggaccggtggcggtcgaccctaaagggtgcgtaacgattgccattcatgccaagccgggttcaaagcaaaatgctgttaccgatctgactgccgaagctgtgaatgtagccatcgcagcaccgccaagtgaaggcgaggctaacgccgagctgtgtaggtatttgagcaaggtgcttgaattaagaaagtccgacgtggttttggataaactgtgttacagcattccccagcagttggaagagactcaagaaggtgtatccggtatacctgataccccctgccacttcttgtag

SEQ ID NO: 53954 - DNA, 552 bp, Artificial Sequence
  Description of Artificial Sequence: Synthetic coding sequence
atggccagactaatccttgagcgtttccttcaggaacatgaggaaaccccaccctcaaagtccataatcaattcgatgctccgggacccaagccagatcccggatggggtgctggccaaccaggtgtaccagtgtatcgtgaacgactgctgttacggacccctcgtagactgtatcaaacacgcaatcggccacgagcacgaggtcctgctgagggacctcctattggagaaaaacctcagcttcctggatgaagatcagctgagggccaaagggtatgataaaacccccgacttcattctgcaagtgcctgtcgccgttgagggccacattatccattggatcgagtctaaagcctcattcggcgatgaatgcagccatcacgcttacctgcacgaccagttctggagttactggaatagattcggaccaggccttgttatatattggtacggcttcattcaggagttggattgcaatagggagcgaggcattctgctcaaagcttgcttcccaaccaacattgtcactttatgccactccatcgcctag

SEQ ID NO: 53955 - DNA, 846 bp, Artificial Sequence
  Description of Artificial Sequence: Synthetic coding sequence
atgatactcacaaaagcccaatatgacgaaatcgctcagtgcctggtctctgtgcctcccacccgtcagagtctgcggaaactgaaacaacgcttcccttcgcagtcacaggcgacacttctgagcatattttctcaagagtaccaaaagcacatcaagaggacacacgcaaaacatcatacttctgaggctatagaatcatactaccagcgctacttaaatggggtggtgaagaacggtgccgcacccgtgctcctcgacttggcaaacgaggtcgattacgccccttctctgatggcaaggctgatcctggaacggttcttgcaggaacatgaagagacacccccttcgaaatcaattattaatagtatgctccgggacccctcacagatccctgacggggtattagcaaatcaggtttaccaatgcattgttaacgattgctgctacggccctctggttgattgcatcaagcatgcaatcggacatgagcatgaagtgctcctgcgagatctccttctagaaaaaaatctgtctttccttgacgaggatcagctccgagctaaaggttatgataagacgccagacttcatcctgcaggtcccagttgcggttgaaggccatatcatccactggatagagagcaaagcctcttttggtgacgagtgttcacaccatgcctaccttcatgaccagttttggtcctactggaacaggtttggtcctggtttggtgatctactggtacggctttatccaggagctggattgtaatagagaacggggtatcctacttaaagcgtgttttcccaccaacatcgtgacgctgtgtcactctattgcctag

SEQ ID NO: 53956 - DNA, 552 bp, Artificial Sequence
  Description of Artificial Sequence: Synthetic coding sequence
atggccagactgatcctcgagaggttcctgcaggaacacgaggaaacccccccttctaagagcattataaattctatgttgagagatccctcccaaattccagacggggtgcttgcgaaccaagtgtaccagtgtatcgtcaatgactgctgctacggacccctcgtcgattgtatcaagcacgccattggccacgagcacgaagtgctgctgagagatctgctgctggaaaaaaatttaagcttcctggacgaagaccagctgagagccaagggctatgacaaaacgcccgacttcattctgcaggtccctgtcgccgtagagggtcatatcattcactggatcgaatctaaagcatcattcggcgatgaatgctcccatcacgcttacctccacgatcagttctggtcttactggaatcgtttcggtccaggtcttgtgatctattggtatggctttattcaggagctggactgtaaccgagagcggggaattctgctgaaggcatgttttccgactaacatcgtgacattgtgtcactcgatcgcttag

SEQ ID NO: 53957 - DNA, 663 bp, Artificial Sequence
  Description of Artificial Sequence: Synthetic coding sequence
atgttccagggtcagcggggttggttttgtggcagcgttagtcaagatctgaggcagttctgggtggccgagggcggtacaatctctgaccctcgggcagctgacttccttttttcttgcgacgcaagccatccagatacactgaggatctaccaatctttggattatattgaagacaacgctacggtcttccacgcctactatttatcagctgtggctaatgcgaagattaagaattccgtggcccttgggcacttcatcctccctcccgcttgcctccaaaaggagatccggaggaagatcgggagcttcatctgggaacaggaccagcacttccttattgaaaagcatgacgaggttacccccaacgagataaaaacgctgcgggaaaacagcgagctcgcaacggaacacaagaaagaactttccaaatcccctgagaagcactttattaggacccctgtggtggaaaagcaaatgtacttcccccttcagaactatccagtcaacaatatggtcaccgggtacatctccatcgatgcaatgaagaagttcttgggcgaactgcatgatttcatccctggcacaagcggctacctagcttaccacgtccagaacgaaattaatatgtccgccatcaaaaacaaacttaaacgaaagtag

SEQ ID NO: 53958 - DNA, 1557 bp, Artificial Sequence
  Description of Artificial Sequence: Synthetic coding sequence
atgcccaccgttgttgtgatggacgttagtctctcgatgactcgcccagtatccattgaagggagtgaggaataccagcggaaacaccttgccgctcatggactgacaatgctatttgaacacatggccactaattacaaattggagtttacagcacttgtggtgttttcgtctttgtgggaactgatggttccgttcactagagattataacactctccaggaggccctctcaaatatggacgattacgacaaaacctgcttggaatctgcccttgtcggtgtctgtaacattgtgcagcaggagtggggtggcgcaattccttgtcaggtggtgctggtgaccgatgggtgcctcggtattggcagaggctccctcagacactcgctggcaacccaaaaccagcgtagtgaatccaaccgctttcctctgcccttccccttccctagcaagctgtatatcatgtgcatggccaaccttgaagaactccagagtaccgactccctcgagtgtctggaaagactgatcgaccttaataacggtgaggggcagatctttactatcgacggcccactatgtctcaagaatgttcaatccatgtttggaaaattaattgatcttgcatatacaccctttcacgcggtgcttaaatgcggtcacttgaccgcagatgttcaggtgttcccccgaccagagccgttcgttgtggacgaggagattgatccaatcccgaaagtaattaatacagacctggagattgtcggctttattgacattgcagatatatccagcccccctgtccttagcaggcacctcgtgcttcccatagccttgaacaaagagggagatgaggtcggcacaggaattaccgacgacaatgaagatgagaattctgcgaaccagatcgctggcaaaatacctaatttctgcgtgctccttcatgggagcctaaaggtcgaagggatggtagcaatcgtacagctggggccagagtggcacggcatgctttacagtcaggccgacagtaaaaaaaagtcaaacctgatgatgtcactgtttgaaccaggccctgaaccgcttccttggctggggaaaatggcacaactgggcccaatatctgacgcaaaggagaatccctacggcgaagacgacaataaaagtcctttcccgctacagcccaagaacaagagatcatatgcccaaaacgtgacagtatggatcaagccaagtgggctccagaccgacgtgcagaaaatcctgcggaatgctagaaaactgccagagaagactcagacgttctacaaagaactgaatcgactgaggaaagcagccttagcctttgggttcctggatttgctcaagggagttgcagatatgttggaacgcgagtgcacactcctcccggagactgcccacccggatgccgcattccagctcacacacgccgctcagcagttgaaactggcctcgaccggcacgtctgagtatgccgcttatgatcaaaacatcacaccccttcacactgatttttccggctcaagcactgaaaggatatag

SEQ ID NO: 53959 - DNA, 1557 bp, Artificial Sequence
  Description of Artificial Sequence: Synthetic coding sequence
atgcccacggtggtagtcatggatgtgagtttatctatgactcggccagtcagcattgagggtagtgaagaatatcagcggaaacacctcgccgcacatggccttaccatgctgttcgaacacatggcaaccaattacaaattggaattcacagccctggttgtcttctcaagcctttgggaactaatggtgccgtttacgagggactataataccttacaggaagcactgagcaacatggacgactatgacaagacttgtttggaatccgccctagtcggggtctgcaacatcgttcagcaggaatggggaggcgctatcccttgccaggtggtgttagtaaccgacggttgcttaggaatcgggagagggtctctgaggcactctctggccacacagaaccagcgttccgaaagtaatcggttccctcttcccttcccgttcccaagcaaattgtacattatgtgcatggcaaacctggaggagttacagagcaccgactccctcgaatgtctggagcgcctgattgacctgaacaacggggaaggtcagatatttacgatcgacggaccgctgtgcctcaaaaacgtccagagtatgtttggaaagttgatcgatttagcctatacccctttccacgccgtgcttaaatgcggtcacctaactgccgacgttcaggttttccctcggccagagcccttcgtagtggacgaggagattgatcctatccctaaggttatcaatacagatttggagatcgttggttttatcgatatcgccgatatatcctctccacctgttctgtcacggcatctagtgctgccgatcgcactgaataaggaaggtgacgaggtcgggacgggcattacagacgataacgaagacgagaacagtgcaaatcagatcgcaggcaagataccaaatttttgtgtgttactgcatgggtcactgaaggtggaagggatggtggcaattgtccagttgggccctgagtggcacggaatgctgtattctcaggccgacagcaaaaaaaaatccaacctgatgatgtccctttttgagcccggtccagaaccactgccatggctgggtaagatggctcagttaggaccgatttcagatgccaaggaaaatccttacggagaggatgataataaatctccgtttcctcttcaacccaaaaataaaaggtcttatgcacagaatgttacggtatggattaaacccagcggcctccagactgatgtgcagaagatcttgagaaacgccagaaaacttcccgagaagactcaaactttttataaggagcttaaccgcctgcgcaaggctgcccttgcatttggatttctcgatctactgaaaggcgttgctgacatgttggagcgagaatgtaccctgctgccagaaacagcacaccctgatgcagctttccaactgactcatgcagcccaacaattaaaactcgcctctactggaactagcgaatacgcagcttatgaccaaaacattaccccactgcacacggacttcagcgggagcagcaccgagcgcatctag

SEQ ID NO: 53960 - DNA, 1386 bp, Artificial Sequence
  Description of Artificial Sequence: Synthetic coding sequence
atgcccactgagtcattgtgtagacgcaccgtctccggtgatggccacggcgaggcactgtccaacatggacgactacgacaaaacatgcctcgaaagcgcccttgtgggagtttgtaacatcgtgcagcaggagtggggcggagctatcccatgtcaagtagtcttggtaacagatggatgtctgggcatcggcagagggagcctgcgccacagcctggctacccaaaaccaacgatcagagtccaaccgatttcctctgccttttccttttccatccaagttgtacataatgtgtatggccaacctggaggaattgcaaagtactgattctctcgagtgtctggaacgcttaatcgacctgaacaatggcgaaggccagatctttacaattgacggtcccctgtgcctgaaaaatgtccagtctatgttcggtaaactgatagacctggcctacactcctttccacgctgtgcttaagtgcgggcacctaacagcagacgtccaggtgtttccccgtccagaacctttcgtggtggacgaggagatcgaccctatccccaaggtgatcaacactgatctggaaatagtgggcttcatcgacatagctgacatctcctcaccacccgtcctgtcccggcatttagtactcccgatcgcattgaacaaggaaggcgatgaggtgggcacagggatcaccgatgacaatgaggacgaaaacagtgccaaccagatcgcaggcaaaattcctaatttctgtgtgctgctgcatggttctctaaaagttgaaggaatggtcgccatcgtgcagctgggaccagagtggcatggcatgctgtattcacaggccgatagtaagaagaaatcaaacctgatgatgtcactcttcgaaccgggacccgaacccttaccctggctgggcaaaatggcgcagttaggccctatttccgacgctaaagaaaacccatatggcgaagatgacaataaatccccattccctctgcagccaaagaacaagcgcagctacgctcagaatgtcactgtatggattaaaccctctggcctccaaacagacgttcaaaagattttgagaaatgccagaaagctgcctgaaaaaactcagacattctacaaggagctcaatcgcttacggaaggccgctctagctttcggctttctggacttgttgaaaggagttgcggacatgctggagagagagtgcactttgcttccagagacggctcatccagacgccgcttttcagctgactcatgccgctcagcagcttaagttggcatcaaccggaacatccgagtacgctgcctacgaccaaaacatcacccccctccacacagatttcagcggttcctcgaccgagcgcatctag

SEQ ID NO: 53961 - DNA, 1320 bp, Artificial Sequence
  Description of Artificial Sequence: Synthetic coding sequence
atggatgactatgataaaacatgtctcgagagtgctctcgtaggcgtgtgcaacatagtgcagcaggaatggggcggtgccattccttgtcaggtagttctggtgacggatggctgcctcggaatagggaggggatcactgcgacactcccttgcaacccagaaccagaggtcggaatcaaacagatttccactgcccttcccctttcctagcaagctgtacatcatgtgcatggccaatctggaagagttgcaaagcaccgattctctggagtgcttggagcgtcttatagatttgaataatggcgagggccaaatcttcactatcgatggaccgctgtgcctgaaaaacgttcaaagcatgtttggtaagctcattgatctggcctacacccccttccacgcagtcctcaagtgcggccacctgacagctgatgtgcaggtgttcccacgtccagagccgttcgtcgtggacgaagaaatagacccaatccctaaagtgattaatactgatctcgaaatcgtgggttttattgacatagctgacatcagttccccaccagtattatctagacatttggtgttaccgattgcactaaacaaggaaggtgacgaagtggggaccggtataaccgacgacaatgaggacgaaaactcagccaatcaaattgccggaaaaattcccaacttttgtgttctgctccatggatccttaaaggtggaggggatggtcgccatcgtgcagttaggtcctgagtggcatggtatgttatactcccaggctgattccaagaaaaagtcaaacctcatgatgagtcttttcgagccaggccctgagccattgccttggcttgggaaaatggcccagctgggaccgatcagcgatgcaaaggagaacccttatggtgaggacgataacaaatcgcccttcccattgcaacctaagaacaagagaagctatgcccagaacgtaaccgtgtggattaagcctagcggcttacagacggacgtccagaaaatcctgagaaatgcaagaaaactgcccgagaagactcagacattttacaaagagctgaatcgattaagaaaagccgcactggcctttgggttcttggacctgctgaagggtgtcgccgacatgcttgagagggagtgtactctgctgcctgagaccgcccacccagacgccgctttccagctgacacacgccgctcagcagctcaagctggcctctaccggcacatcagagtacgccgcatatgaccagaacatcactccacttcatacagattttagcggcagttcgaccgagcgaatctag

SEQ ID NO: 53962 - DNA, 1449 bp, Artificial Sequence
  Description of Artificial Sequence: Synthetic coding sequence
atgcctactgttgtcgttatggatgtgagtctcagcatgacacgtcctgtgtctatcgaggggtctgaggagtatcaacggaagcacctcgccgctcacggtctgaccatgctgtttgagcatatggccactaattacaagctggaattcactgcgctggtggtgttctctagcctttgggaattaatggttccatttactcgcgattacaacacactacaggtggtgctcgttacagatggatgtctggggatcggtcgcggtagccttaggcactctttagccacacagaaccagcgatctgagtcaaacaggtttcctctcccttttccatttcctagtaaactatacatcatgtgcatggccaacctcgaggaactgcagtctacagactccctggagtgcctggagcggcttatcgatctgaataatggtgaggggcaaatattcacaattgacgggcctctctgtctgaagaacgttcagtctatgtttggtaagctgattgatttggcctacacaccctttcacgccgtgctgaagtgcggtcacctgacggccgacgtgcaggtctttcctaggcctgaaccgtttgtggtcgacgaggaaatcgacccgatccctaaggtgatcaatacggatctggagattgtcggctttattgatatcgcagatatttctagcccccctgtgttgagccggcatctggtgcttccgattgctctcaacaaagagggggacgaagtgggcacggggatcacagatgacaatgaggatgagaatagcgccaaccagattgccggaaagatacccaacttctgtgtgttgttgcacgggtccctgaaagtggaagggatggttgccatagtgcaacttggacccgagtggcatggcatgctgtactcccaggctgactcaaagaagaaaagcaatctgatgatgtctctattcgaaccaggcccagagccgctgccatggctgggaaaaatggctcagctggggcctatctctgatgcaaaagagaacccatatggggaggacgacaataaatccccttttcccctccagcccaaaaacaaaagaagctatgcccagaatgtcactgtgtggatcaaaccgagcgggctgcaaactgacgtgcagaaaatcctcaggaacgccagaaaactcccagagaaaactcagactttctataaggagttgaatagactgagaaaagcagctttggcatttggattcctggacctcttaaagggcgtggccgatatgttggaaagagaatgcaccttactgccggagacagctcatccagatgctgccttccaattgacacacgccgcacagcagctgaaactggcctcaaccggcacctccgagtacgcagcctacgaccaaaacataaccccactgcatactgatttttccgggtcgtctactgaaagaatctag

SEQ ID NO: 53963 - DNA, 774 bp, Artificial Sequence
  Description of Artificial Sequence: Synthetic coding sequence
atgcctctcgcctgtgagcaccccgtcggtgtttccagctccgttggcaacgctggcagggccggagtagggacccaggcgtgggggactacggaacgcacccagcaccccggtcctgcccaacactgtccctgcggacttagagtatttgtactccaggaaaagagagtggtgtcccgcaattgggcaagaggaacctgcggtccgagagtaaccaacgagatgctcgaggacgaagacgcggaggaccacgggggaactttctgcctgggtgagctcgtggaactggcggtcactatggagaacaaggcagaaggcaagcggatcgtctcagaaaaacccaccagggccaggaaccaggggatcgaaggttcacccggaggccgagtgacacggtctcctcccactcaggtcgcaatatcatcagactctgctagaaaggggtcctgggagccctggtcccggcctgtaggtgagcctccggaagcaggctgggactacgcacaatggaaacaggaacgggagcagattgacctggctcgccttgcgaggcaccgtgacgcccaaggcgactggcggagaccctgggatctcgacaaagccaagtctactctccaagactgctcccagctcaggggcgaaggacccgcaagagccggatcccgccgaggcgaaccaaccccaacttcttctcttcccagcttggctctgtttatcttccacccccttgttctgagcttcctgtgtttgctggtgtcctatttccaaagttag

SEQ ID NO: 53964 - DNA, 975 bp, Artificial Sequence
  Description of Artificial Sequence: Synthetic coding sequence
atgagacaccgcgagggcagctgggagccttggtcacggccagtcggtgaacctcctgaggcgggatgggactatgcccagtggaagcaggaaagggaacagatcgacctggccaggctagcacggcatagggacgcacagggagattggagacgtccatgggacctcgacaaggcaaagtccacattgcaggattgtagccagttgagaggggagggacctgctcgagcagggtcaagaagaggaccgcgatcccaccaaaagttacagccacccccactccttcctgacggaaagggcagaggaggccaggcctctagaccctccgtggctcccgcaacagggagtaaagccagaggcaaagagcgactgacaggtcgagctcgccgttgggacatgaaggaggacaaggaggagcttgaaggccaggagggaagccagtccacgagggagaccccatcggaggaggagcaggcgcagaagcagtccgggatggaacaaggcaggttgggctccgccccagccgctagtcccgctctggcaagtcccgaaggtcccaaaggtgaatctgtggcgtccacggcttcttccgtgccctgctcccctcaggaaccagatctcgcacctctggaccttagtctaggaggagccggtatccctggaccaagagagtctggttgtgttcttggccttcgtcctggcgctcaagaatcccccgtttcctggccggagggttccaagcaacagccgttgggatggtctaaccatcaggccgagctcgaagtgcagacttgtcccgagcctcagcggggagccggtctgccagagcctggagaggaccgcagtgggaagtccggcgcacaacaaggactcgcccctagatctcgaccgacacggggtggatctcagagaagccggggaacggctggagtccgtcgccgaaccggacgccctggcccagcaggaagatgctag

SEQ ID NO: 53965 - DNA, 1605 bp, Artificial Sequence
  Description of Artificial Sequence: Synthetic coding sequence
atgatctcttgtgcagagcagagatcaaggcagggtgaagctggaagggggcctgctccggtggcgccagccttccttcctctgtggctgccacggggttgttccggaatattatccgttcctgcagttgccatgcattctgctggcacccctagagccgaatccccaatgagccgtcaagaaaaagacgcagagcttgaccgccgaatcgttgctttgcgcaaaaaaaatcaggcgctgctgaggcgctaccaggaaatccaggaggataggagacaggccgagcaggggggtatggcggtgaccactcctgcgctccttcagcctgatggactcaccgtgacaattagccaggtacccggtgagaagcgcgtcgtcagcaggaattgggccagggggacttgtgggccacgggtgactaacgaaatgctggaggacgaggacgctgaggaccatggaggaactttttgtcttggggagctcgtggaactggcagtgactatggaaaacaaggccgagggcaagaggatcgtgagcgagaagcccacacgtgctaggaaccaggggatcgaaggaagcccagggggtcgcgtgacaagatctcctcctacacaggtagctatctctagcgatagcgcgcgtaaagggagctgggaaccatggagcaggcccgtaggggaaccccctgaagcagggtgggactacgcccagtggaaacaagagagagagcagatcgaccttgccagactcgctcgacatagggacgcccagggagactggaggcggccatgggatttagacaaagccaaatctaccctccaggattgcagtcaactgcggggagaaggtccagctagggccggatctcgcagaggcccacgtagccaccaaaagttgcagccgcctccattgctgccggacggaaaaggcagaggcggtcaggcatcaaggccatccgtcgcacctgctacgggctcgaaggccagaggcaaggagcggctgacagggagggctcgcaggtgggatatgaaggaggacaaggaagagctcgagggccaggagggatctcaatccactcgggagaccccctctgaagaagagcaggcccaaaaacaaagcggcatggagcagggacggctgggctccgccccagccgcttctcctgctctagcctctcctgagggacccaaaggtgaatccgttgcctcaaccgcctcctctgtcccatgttcgccccaagagccagaccttgctcccctggacttgtcgttagggggagcgggtatacccggtccaagagaatctgggtgcgtgttgggcctacgacctggcgcacaggagtcgccagtcagttggcccgagggctctaaacagcagccactggggtggagcaaccaccaggctgagctggaggttcagacctgtcctgaacctcagagaggagcgggacttcccgagcctggtgaagaccgctctggaaagtcaggcgctcagcaaggcctggcccctcggagccgcccaaccagagggggtagccagaggtccaggggcaccgccggagtcaggagacggactggccgtccagggccagctggaagatgttag

SEQ ID NO: 53966 - DNA, 540 bp, Artificial Sequence
  Description of Artificial Sequence: Synthetic coding sequence
atggagctgcaaggcgctcaggaggatttgggcattagcctctctagccctagaagaaaccacgagacgaggccgggatctaaggccaaaggacgatctagtatttgccttcaggcttccgtgtggatggccggtggtaaactgcggttacgtgcttccgagcatctcacccaagggcaccaacaggaactgcgcgactggaaccttggagaagatgctagtttacttttcagcaaatcacctttcggcgctggtaaacttatacaggccccagcccatgtgtttaggcagtgctgggtgcaaggtaacgcttggatctcctgcattactaagtttgattcgaagagatcccccgaagtggcttctagccccagctacctcactgtacccaggaggtccccactgcccgtcttcctgaggcctagcgatagatgtgtgtgtgggggttgttatctgggaaagtcaactaggcgacgcgcttgccaaagtctactctcagaccccttaggcgtcactttccctacgcagacccggccatag

SEQ ID NO: 53967 - DNA, 552 bp, Artificial Sequence
  Description of Artificial Sequence: Synthetic coding sequence
atggaagtgaaattcatcaccggaaagcatggaggacgacggccacagagagcagagcctcagcgaatctgccgcgcactgtggttgaccccttggccatctcttatattgaagctgctgtcttggatcattttgtctaacctgtttctgcacctcagggcgacacatcatatgacagagcttcccttgcgattcctgtatatcgcgctgtccgaaatgaccttcagggaacaaacctcgcatcaaatcattcagcagatgtcactctctaataagctggaacaaaaccagctctacggcgaggtgattaacaaggagactgacaatccagtcatttcttccggcctgacacttctgttcgcccagaagccccaatcgcctggatggaaaaacatgagttcgactaaacgtgtgtgcactatactggctgacagctgtagggcccaggctcacgccgcagaccgcggtgaaagggggcacttcggcgtccaaatcctgcaccacttcatcgaagtcttcaatgtgatggcagtgaggtcaaaccccttttag

SEQ ID NO: 53968 - DNA, 552 bp, Artificial Sequence
  Description of Artificial Sequence: Synthetic coding sequence
atggaagtgaaattcattaccgggaaacacggtggcaggaggccccagagagcagaaccacagcgcatttgcagagcactttggctaacaccatggccctctttgattctcaagcttctgagctggatcattctgtccaatctgttccttcacttaagggccacgcatcatatgaccgagctaccactgcggttcctatacatcgcccttagtgaaatgaccttccgagagcagaccagtcatcagattatccagcagatgagcttgagtaataaacttgaacagaatcagctctatggcgaagtcatcaacaaagagactgataatcctgttattagctcgggattaacgttgctgtttgcgcagaagccacagagccccggatggaagaatatgtcctctaccaaacgggtctgcactatcctggcagactcatgcagagcacaggctcatgcggcagacaggggagagcgcggtcacttcggtgttcagattctgcatcacttcatagaggttttcaatgttatggctgttagaagtaaccccttctag

SEQ ID NO: 53969 - DNA, 486 bp, Artificial Sequence
  Description of Artificial Sequence: Synthetic coding sequence
atgcctcgggctggccgagcacctgctgaaggaggtcctgctcctggcacacggtccagcaggtgtttgaggcctcggcctctggcctggagacggttggtccctaattttggcgcatgggcccctaggaaaggcgcagcacgagtgggtagacccgtgctgagcccgagaaccagcggtgctgctggcgagccaacttgtggcgctggaagccccggaaccctggaggagggcgtggccagcggacgtacacgcagaagaacccagtcagccggtgaagtggccaagtgtcgctggggactcgggcaggagccactctgcccccgaggcgctgtgctccttaatagtttctctcccccagcctggccacagtttccccctgcccttagattgagagctctggcgtggcctcagccacgcggtcctgcctgtggcagcacggcccagtggccacctagaggggatccgacctggaggatttcgtag

SEQ ID NO: 53970 - DNA, 558 bp, Artificial Sequence
  Description of Artificial Sequence: Synthetic coding sequence
atgaagatgtttgagtctgccgattctactgcgaccagatccggtcaagatctttgggccgagatttgcagttgcttgccaaatcccgaacaggaagatggggctaataacgccttctcagatagcttcgttgattcatgtcccgaaggagagggacagagagaggtggccgacttcgcagtgcagcccgctgtgaagccatgggcccctctccaggactcagaagtgtacctggcttctctcgagaaaaaactgaggcggatcaagggactgaatcaggaagtaaccagtaaagatatgctgcgcactttagctcaggccaaaaaagaatgctgggaccgcttcctgcaggaaaagcttgcatctgagttctttgtggacggtctagactctgatgagtcaacccttgaacactttaagcggtggctgcaaccggacaaggtggcagtcagcacagaggaggtgcaatacctgattcccccagagagccaagtggagaagcctgtagctgaggacgaaccggctgccggagataaaccagctgccgctgaacaatag

SEQ ID NO: 53971 - DNA, 558 bp, Artificial Sequence
  Description of Artificial Sequence: Synthetic coding sequence
atgaaaatgttcgaatctgccgattcaacagcaacacgctcaggacaagacctctgggcggaaatctgcagttgtctccctaatccggagcaagaagacggagctaacaacgccttctcggattctttcgtcgatagctgcccagagggcgaaggacagcgggaagtcgccgatttcgctgtgcagcctgcggtgaagccgtgggccccattgcaggattcagaagtgtacctggccagcctggagaagaagctccgcagaataaaaggactgaaccaggaagtcacaagcaaagacatgctccggacactggcacaggctaaaaaagagtgctgggaccggttcttacaggagaagttagcttcggagttttttgttgatgggttggattctgatgaatccaccctcgagcactttaagaggtggctccagcctgacaaggtcgccgtttccaccgaggaagtccaatatctgatccctccagaatcgcaggtggagaagcctgtcgccgaagatgagccagctgcgggagacaagcctgccgctgctgagcaatag

SEQ ID NO: 53972 - DNA, 585 bp, Artificial Sequence
  Description of Artificial Sequence: Synthetic coding sequence
atgaggggttcaggccttcgctttcagatgaagatgtttgaaagcgccgacagcaccgccactcgtagtgggcaggatctttgggccgagatttgcagttgcctgcctaaccccgaacaggaggacggtgcaaacaatgcattttctgacagcttcgtcgacagttgcccagagggagagggacagcgggaggtggctgacttcgctgttcaacccgctgtcaaaccctgggccccactgcaggatagcgaagtctatctggcatcactggaaaagaaactaagacgaatcaagggcttgaatcaggaagttacaagcaaggacatgctgcggacccttgctcaggcgaaaaaggaatgttgggacagattcctccaggagaaactggcttccgagttcttcgtcgacggactcgactccgacgaatcaaccctcgaacacttcaagcgctggctgcaacccgataaggttgcagtctctacagaagaagtccaatatctcatcccacccgaaagccaagtggagaagccagtcgctgaagatgaaccagctgccggagataaacctgccgcagcagaacagtag

SEQ ID NO: 53973 - DNA, 405 bp, Artificial Sequence
  Description of Artificial Sequence: Synthetic coding sequence
atgaaaatgttcgagtcagccgattccaccgctacccgctccggccaggatctgtgggctgagatctgttcgtgccttccgaaccctgagcaggaagatggagctaataacgccttctcagattcatttgtggatagttgccccgaaggagagggacagcgcgaagtcgccgatttcgcagtgcagcccgctgtgaaaccttgggcaccactacaagactccgaagtgtatttagctagcctcgaaaagaagctccggagaatcaagggccttaatcaagaggtcacttctaaggacatgctccggacgcttgcacaggctaagaaggagtgttgggatcgtttcctgcaagagaaactcgcctccgagttttttgtggatggactcgacagtgatgagcggtag

SEQ ID NO: 53974 - DNA, 513 bp, Artificial Sequence
  Description of Artificial Sequence: Synthetic coding sequence
atgaagatgtttgagtctgccgatagtaccgcaactcggtccggccaagacctctgggctgagatttgcagctgtctccccaatccagagcaggaagatggtgctaacaacgcgttttcagattctttcgtcgattcttgccccgaaggcgagggtcagcgtgaagtggccgatttcgcggtgcagcccgcagttaagccatgggcgcctctccaagacagcgaggtgtatctcgctagtctggaaaagaagctgcggaggataaaaggcctgaaccaggaggtcacatcgaaggacatgctgaggacgttggcacaagctaaaaaggagtgctgggacagatttctccaggaaaaacttgcctcagagttttttgtggatgggctcgactcagatgaatccacactggaacactttaagcggtggttgcagcctgacaaagtcgcggtgtcaactgaagaagtgcagtatcttatccccccagagtcacaggtcgaaaagccagtagcgtag

SEQ ID NO: 53975 - DNA, 882 bp, Artificial Sequence
  Description of Artificial Sequence: Synthetic coding sequence
atgaacatcaggggagcccctgatctcggccagcccagcgacgatccgagttctggcggagagagagaaaggatacgccagcgtatgaagatggtgatcggtcagctggagggcattttgcgtgaactcaaagaggtggctaaagagctacgcgaagtggtttcccagattgacaagctgacatcggattttgattttgagctagaaccggatgattggaccaccgcaactgtatcctccacttcctcttctgacaaagccggaatgggcggacccttcgacttgggccacctggattttatgactgctgacatcctgtcggatagttgggagttttgcagttttttggatgtgtcgacacctagtgacagcgtggacggccctgagtcgactaggcctggtgcgggacccgattacagacttatgaacggtggtaccccaatcccaaatggaccgcgagtcgaaacacccgattccagttccgaggaagctttcggcgctggccctacggtgaagtcccagctgccccaaagaacccctggaactcgagagagagttcgcttcagcgataaggtactgtaccatgctctgtgctgcgatgatgaggagggagatggtgaacaggaagtggaagaggaagaagttgggctacctcctgagccagctcacaccgaggcgcacgcgggtccccacaagcccagccctgccccatacaaaagcagacggagccctctgacttctaggcactccgggtccactcttgccccagagcagactagacgcgtaaccagaaactcttctactcagaccgtgagcgacaaatccacccaaacggtcctcccttacaccgctactcgccagaaggcaagaggaaagaattag

SEQ ID NO: 53976 - DNA, 882 bp, Artificial Sequence
  Description of Artificial Sequence: Synthetic coding sequence
atgaacatacgcggagctcccgatctggggcaaccatcggatgacccatcaagcggcggagaaagggaaaggattagacaaaggatgaagatggtcattgggcaactcgaaggaatcctgcgcgagctgaaggaggtcgccaaggagcttagagaggtggtgagccagattgataaactgacgtcagactttgacttcgagctggagcccgacgactggaccacagccacagtgtcttctacatcttccagtgacaaggccggtatgggcggaccctttgatttaggtcacctcgatttcatgacagcggatatcctatctgattcatgggagttctgtagcttcctggatgtcagtaccccttcggactccgtcgacggcccagagtccacccgaccgggagcagggcctgactacagattaatgaatggagggactcccatccccaacggccctcgcgtcgaaacacctgatagctcctctgaagaggccttcggtgccggtccgacagtgaaatcacaactgccccagcgcacacctggaacccgagagcgggtgcggttctctgacaaggtgctgtaccatgccctgtgctgcgatgacgaggaaggcgatggtgaacaggaagtggaggaagaagaagtgggattgccacccgaacccgctcacaccgaggcccatgccggaccccacaaaccctccccggcaccttacaagagccgaaggtcccccttgaccagccgccattcagggtcaactctcgctcctgaacagacgcgtagggttacgcgcaattcctcgacccagacagtgtctgacaaaagtacacaaactgtgctcccttataccgctactcgacagaaagccaggggaaagaactag

SEQ ID NO: 53977 - DNA, 801 bp, Artificial Sequence
  Description of Artificial Sequence: Synthetic coding sequence
atggccgaggcaggaaaggttcccctcagcctgggcctgactgggggagaggctgccgagtggccactgcagcggtacgccaggtgcatccccagcaacaccagagacccaccaggaccttgcctagaagcgggaaccgcaccgtgcccaacttggaaggtcttcgactcaaatgaagaatctggatacctcgttttgactattgtgatcagcggtcactttttcatcttccaaggacaaactctgctggaaggctttagtctcattggttccaaggattggctcaaaatcgttcggagagtggactgcttgctgtttggcaccacaatcaaggacaagtcaaggcttttccgagtacagttctcaggcgaaagcaaagagcaggcacttgagcattgctgcagttgcgtgcagaaactcgcacaatatataactgtgcaggtgcctgatggtaacatacaagaacttcagcttatccccggaccacctagggctactgagtcccaaggcaaggattccgctaaatccgtccctaggcagcccggttctcaccaacacagtgagcagcagcaagtgtgtgttactgccggaaccggtgctcctgatggacgaactagcctcacacagctggcccagaccttactggcctctgaagagctgccccacgtatacgaacagtctgcttggggcgcagaagagctcggaccgtttctgagactgtgcttaatggaccagaacttccccgctttcgtggaagaggtcgagaaggaactaaagaaacttgctggcctgagaaactag

SEQ ID NO: 53978 - DNA, 390 bp, Artificial Sequence
  Description of Artificial Sequence: Synthetic coding sequence
atgcgcaggagaggggaaatcgatatggcaactgagggcgatgtggaactggagctggaaaccgagacgtcgggcccagagcggcctcccgaaaagcctagaaagcacgactcgggagcagctgaccttgaacgtgtcactgattacgccgaggaaaaggaaatacagagcagcaaccttgaaaccgctatgtccgtgatcggtgaccgtcgatcacgagagcagaaagctaagcaggagcgcgagaaggagttggctaaagtgacaattaagaaagaagacttggagcttatcatgaccgagatggagattagtcgcgctgccgctgaacgctcccttcgcgaacatatgggcaatgtggtggaagccctgatagccctgactaattag

SEQ ID NO: 53979 - DNA, 390 bp, Artificial Sequence
  Description of Artificial Sequence: Synthetic coding sequence
atgaggcgcagaggagagatcgatatggccaccgaaggggacgtggaattggaacttgagactgaaacgagtggtcccgaacgcccaccagagaaacccaggaagcacgacagtggagctgccgacctagaacgcgtcacagattacgcagaagaaaaggaaattcagtccagtaatctcgagaccgccatgtctgtgattggagacaggcggtcgagggagcaaaaggctaaacaggaaagggaaaaagaacttgctaaagtgacaattaagaaggaggacctagaattgatcatgaccgagatggagattagccgcgctgctgctgaacggagcctgcgcgaacacatgggaaatgttgtggaagcactgattgccctgactaattag

SEQ ID NO: 53980 - DNA, 1716 bp, Artificial Sequence
  Description of Artificial Sequence: Synthetic coding sequence
atgtcccgggaagcaggctcgtgtcgcgtgggtaccggcgctcgagccagaagtagaaagccgaagaagccccattacattcctaggccttgggggaaaccctataattacaagtgttttcaatgtccatttacttgtttagagaagagccacttgtataatcacatgaagtacagcctgtgcaaagatagtttatctctgttgctagacagtcctgattgggcatgccgcaggggatcgactacacctcgcccacacgctccaaccccagatagaccaggtgaatctgatcccggacgccagccacagggggctcggccaactggggctgcccctgctccagatctcgtggtcgccgacatccactcccttcactgtgggggaggccctaaaagtcgagctaaaggttcacctgggcctccaccaccagtcgcacgtgctacgcgcaagggccctggaccaagtggcctacttcctgagtcttggaagcccggtatgggtggggatcctagaggagttggcgcaggcgatatggcctccgctgggcctgaagggtccgttccttgctatccccctcctgctccaggcgaatttcctgaggcgcacagtttacacctcagcctgcttggcgtgaactaccccctgtctcctgggctgttttcttacctcggcccatcactcgcggcagcagctcacgtcccatttcttgcctccgcctccccactactgcctccggcaactgcatttcctgctgtgcaaccgcctcaacggccaacgccagcccctcgcctgtattaccctttgttacttgagcatactttgggcctcccggcaggaaaagctgcccttgcaaaggcccctgttagcccaagatctccttctggcactcctgcgcctggtttgttaaaagtccctgtgcccggtctcggcccatggcctagggtgacccctcgagatcctgggcaggagggggagctggaacgggcagcccagagcgatcctcggaggcgcctgtcccttggtagtagactggagttgcccaaggcatctccgtctttaacccgattttgttccagatcatcccttcccaccgggtcctcggttatgttgtggcctgaggacggcgaccctggtggccctgaaacccccggaccagagggcccactcccactgcagcctcggggtcccgtacccggaagcccggaacacgtgggggaagatctgactcgggctctcggcgactatgcgagggtcgagcagagactaggacaactagggccagcagggggattagcgccaaggccgcttagagaacagctgggaaaaatccgtctggaattgctgactatacatcaggccctcgagcaggccgtaaggccaccagacgcacctctagatctctcagtgaagcgcgctcccgctaaaggcccacaggccctcggcgaggcttgggggaggcctgaactggggcctgtactgaccggaggtacccctgagccccctgggatgttggggcctgcggcaccgcagccatttagtggccatacaactaaatgtgaagcggactcctccgttccccctccgggacttccgcttgccgctcccgacgacccagtgataccagggtctgggtgggggacctgcgtggctacacgaagctcacagacaccggaagcggtgtgtggccttcagtctccccagggcgctgaggtatag

SEQ ID NO: 53981 - DNA, 615 bp, Artificial Sequence
  Description of Artificial Sequence: Synthetic coding sequence
atgcttgtggctgcagcagccgagcgaaataaggaccccatcctccacgtgctgaggcagtacctggaccctgctcaaaggggggtgagagtgctggaggtggcatcaggcagtggccagcacgctgcacacttcgctagggccttccctctcgctgaatggcagccttcagacgtcgaccagcggtgcctggacagcattgctgctacaacacaagcacaaggcctgacaaacgttaaagccccattacacttggatgtcacttggggatgggaacactggggtggtatcctaccacagagcctggatctgctactgtgcattaacatggctcatgtaagcccactccggtgcactgaggggctctttcgggctgctgggcatctgttgaagccccgtgctcttctcatcacatacggcccatacgccataaacgggaagatttctccgcaatctaatgttgacttcgatctgatgttgcgatgccgcaatccagagtgggggcttcgcgatactgcactgctcgaggatctcggcaaggcaagcggtttgctgctggagcgcatggtggatatgccggcaaacaacaaatgcctcatctttcgtaagaactag

SEQ ID NO: 53982 - DNA, 324 bp, Artificial Sequence
  Description of Artificial Sequence: Synthetic coding sequence
atgctcgtggcagccgcagccgaaagaaacaaggacccaatcctacatgtgttaaggcagtaccttgacccagcccagcggggagttcgagtgcttgaagttgcctcaggatccggacagcatgctgcacacttcgccagggcttttccgctggcagaatggcaaccctctgatgtggatcagagatgcctggatcgcaacccagagtggggcctgagggatacagcactgttagaggacctcggaaaggccagtgggttgctgctcgaacgcatggtggatatgcccgctaacaacaagtgcctgatattcaggaagaactag

SEQ ID NO: 53983 - DNA, 384 bp, Artificial Sequence
  Description of Artificial Sequence: Synthetic coding sequence
atgttagtggccgctgccgcagagcgaaacaaagaccccatacttcacgttctgcgtcagtacctggatcctgcccagcggggagttagagtgctggaagtagccagcggttcgggacagcacgccgcacactttgcccgagcctttcccctggctgagtggcaacccagtgatgtggaccagagatgtctggacagaggaagcagtgagcagcaggacacttgttccaacccaggcccatgcagcagccccaccggaaatcctgaatgggggctgagagatacagcgctgttagaggatttgggaaaagcatcgggtctcctactggagcggatggttgacatgcccgctaacaataagtgtctgatatttaggaagaattag

SEQ ID NO: 53984 - DNA, 558 bp, Artificial Sequence
  Description of Artificial Sequence: Synthetic coding sequence
atgctcgtggcagccgctgctgaacgtaacaaggaccccattcttcatgtgttaaggcagtacctcgatccagcccaaaggggtgtccgcgtcttggaagttgcgtccggatcgggacagcatgccgcacactttgcacgcgctttcccactggcagaatggcaacctagcgatgtcgatcaacggtgcctggattctatcgcagccacgacacaggcccagggactaactaatgtgaaagccccactccacctggatgtcacttggggatgggagcattggggtggcatccttcctcagtcactcgacctgctgctgtgcattaatatggcacatgtctccccactgcgttgcactgaagaaccgaggatgggagctagcggacactctcctcccggtgggccaggaaaagggcaatggcctgcccctggcgaagacggcggacacgccagccagcagcagatgcctgacctgccagaaaaattatccccgtccttcacaccagcacatctgcatccgtgtcggaggctgtgcgaggcacggacacttccaccctag

SEQ ID NO: 53985 - DNA, 618 bp, Artificial Sequence
  Description of Artificial Sequence: Synthetic coding sequence
atgctcgttgcagcggcagctgagcggaacaaggaccccatcctacacgttctcagacagtatctagaccccgctcagaggggggttagggtgctggaggtggcctccggatccggtcagcacgccgctcattttgctcgggctttccctctggctgagtggcaaccatcagatgtagatcagcgctgtctggattcaattgccgctactacacaggcccagggcctcaccaacgtcaaggcccctcttcacctcgatgtaacgtgggggtgggagcactggggcggtattctgccccagagtctcgatttattgctctgcattaacatggcccacgtcagtcctcttcggtgtaccgagggactttttagggctgctggccacttactgaaacctagggctctgctcatcacatatggtgaaccacgaatgggagcgtccggacatagtcctcccggaggcccaggcaaaggccagtggcccgctcctggtgaggacggtggacatgcgtctcaacagcagatgcctgacctccctgaaaaacttagcccatctttcacgcctgctcatctgcatccgtgtcgtcggctgtgcgaggctaggacactaccaccctag

SEQ ID NO: 53986 - DNA, 939 bp, Artificial Sequence
  Description of Artificial Sequence: Synthetic coding sequence
atgggcaggcggagggctgcaagggggcctggggcagaaggaggcaggcccaggcatttgccaacccggtccttagaagcttttgcggaagaagtgggagcagccctacaggcatctgtggaacccggagctgccgacggggagggcggtccaggaccagccgcattgccatgcactctggcaatgtgggagttggggcattgtgatcctcgacgatgtaccggaagaaagcttgctcgcctggggttggtgcgatgtctgagattaggtcaccggttcggcggactggttctgagccccgtcggcaagcagtatgcgtcacctgctgaccgccagcttgtggcccaaagtggcgtcgctgtgatagactgctcctgggcaaggttagacgagactcccttcgggaaaatgcgaggatctcatttgagattgttgccttacctggtggctgccaacccagtgaactacggtcgaccctatcgcttgtcatgcgtagaggcttttgccgctacattttgtatcgtcggatttcctgatctggctgtgatcttactgcgaaaatttaagtggggaaaagggtttctcgacctcaatcgtcagttattggacaagtacgctgcctgtggatctccagaagaggtgttacaagctgaacaagaatttctcgcaaacgcgaaggagagcccacaggaggaagagattgacccgttcgatgttgactctggcagagaatttggcaatccaaacaggcctgtcgcttccacacggctaccatcggatactgacgactccgatgcttccgaagaccctggtcccggtgccgagcgtggtggcgcttcctcctcctgttgtgaggaggagcagacccagggtcgtggagccgaagcacgagcgcctgctgaagtttggaaaggaattaaaaagcgccagcgcgattag

SEQ ID NO: 53987 - DNA, 615 bp, Artificial Sequence
  Description of Artificial Sequence: Synthetic coding sequence
atggaattaaagcagagcctgtcaacccatcttgaagctgagaaaccattgaggagatacggggctgttgaggagacggcgtggaaaacagagcgcctgggacgaaaccagctagacattattagcatggccgaaaccacaatgatgccagaggaaatcgagctagaaatggccaagatccagcgtctgcgggaagtgctggtgagacgcgaatccgagttgagatttatgatggatgatatacagctttgcaaggacatcatggacctgaaacaggagttgcagaatttggtagcgattcctgaaaaagaaaagaccaagttacaaaagcagcgggaggacgagctcattcagaagattcacaaactggtccaaaagagagatttcctagtggacgatgcagaggtggaacggttgcgagaacaagaagaagacaaagagatggctgacttcctgaggattaagctaaagccgttagataaagtcacaaaatcgccagcttcctctcgggcagagaaaaaagccgagccacccccaagcaagcctacagtagctaaaactggcctggccctcatcaaggactgttgcggagcaactcagtgtaacatcatgtag

SEQ ID NO: 53988 - DNA, 564 bp, Artificial Sequence
  Description of Artificial Sequence: Synthetic coding sequence
atgtggggcgacctgacggagaccggatgcatggggagacgctctgctaaaaaagatcagctggatataatctctatggccgaaacgaccatgatgccagaggaaatcgagctggagatggccaagatccagagactcagggaggtgctggtgcgacgagaatctgaactgagattcatgatggatgatatccaactttgcaaggatattatggacttaaagcaagagctgcagaacttggtcgcaatcccagagaaagagaagaccaagctgcagaagcagagagaggatgaactgattcagaaaatccataagcttgtccagaagcgggatttcctcgtggatgacgcggaagttgagcgcctccgagaacaagaggaggacaaggaaatggccgattttctgcggattaagctgaaaccgttggacaaggtgactaaaagccctgcgtctagccgggcagaaaaaaaggcagagccccctcctagcaaacccactgtagccaagaccggcctggccctgatcaaagactgttgcggagctacgcagtgcaatattatgtag

SEQ ID NO: 53989 - DNA, 1188 bp, Artificial Sequence
  Description of Artificial Sequence: Synthetic coding sequence
atggatctctgccagaaaaacgaaactgatctggagaatgccgaaaacaacgaaatacaattcactgaggaaacggaaccgacctatacttgtcctgacgggaaaagtgagaaaaaccacgtgtactgcctgctggatgttagcgacattaccctagaacaggacgagaaggcaaaggagttcataatcggaaccggctgggaggaggccgtgcaggggtggggcagaacctcccctgccgcttgtatctggcccagaaagatccccaagaaggccagagtgggggaaggagcttgtagcgactgtctagtgtgcgtcaatttgtcacattggtccctgcagaccaagccacctactgagggaggcccagaaaaagatcagagctctccctcgcagactcaggcggcaccccagggaccttcgaccgcatctagagcaatctctgacatttgctttcccacatatttcagggctgagaagaaatcgctccagatcaaggaatttatatggtgcaacaaagattgggctattccaggaaccaaccggggtaaagcgtctggcaacccttcaggaggggctcaccggggattatccattccaggaccccttacaagcagggcccttctggtactgcctcccctgaaagctagtcttagcaatgcgttggacgtgcttggcaaaaagagtaagaatagcttcctgcagagtgaagagaaggtcttagatgtcgagaaagatgggtgtgtcgcctatgcctacggcctgaagacggctgatggaaaaggtgaaaaacgagctagcgagctggccaaacatcccatggtgaatgatacaccaagcagtccctctcccgcagcacagattagcttgttaacagaccctgagcagagatgcttgcattggagtctactgtctgaaaagaacctggcttgcccacctgaccccagtaatgtgcgctatctcgccgcactgcagctgctacagaagagaggtgtgcaaagttacaaatcaaaattcaaggctaaggaacccagatctccagtcattaccagaaaacatgttttgccaaaggcaaagcaggagaatcgtccccagatgctcgagaccaaggtgtttcctcgacccgtgctgccaagcctgacagtgagccgggtgattatcccagtatcaactcatcggatcctgtag

SEQ ID NO: 53990 - DNA, 1167 bp, Artificial Sequence
  Description of Artificial Sequence: Synthetic coding sequence
atggacctctgtcaaaaaaacgagacagacctggagaacgctgagaataatgagatccaatttaccgaagagactgagccaacctacacctgccctgacggcaaaagtgagaagaaccacgtttactgcctcctcgacgtgtccgacatcactctggagcaagatgaaaaggctaaagagtttattatcggcacagggtgggaggaagcggtccaggggtgggggcgaacttctcctgcagcctgcatctggccaaggaagatccccaaaaaggcccgtgtgggcgagggagcgtgctccgactgtctggtgtgcgtgaacctctctcattggagcctacagaccaaaccccctaccgagggcggaccagaaaaggatcagtctagcccctcacagacgcaggcggctcctcagggacctagcaccgccagccgtgcgatttcagatatttgcttccctacttactttcgggcagagaaaaaatccctgcagatcaaggaattcatctggtgtaataaagactgggcaatccccggaactaatagaggtaaggcatccgggaacccatcaggtggtgcccatcgcggtctcagcattccaggtcctcttaccagccgcgctctgctggtgttgccacccctgaaggccagtctgtctaatgctttagacgtccttgggaagaaaagtaaaaacagcttcctgcagagcgaggagaaagtgctagacgtcgagaaggatggatgcgttgcctatgcatatggcctgaaaacagccgacggcaagggggagaagcgagcatccgaactggcaaagcacccaatggttaatgacaccccctcctcaccgtcgccggctgcccagatctctctcctcactgaccccgagcagcgctgcctccactggtctctgctatctgaaaaaaatctcgcttgcccacccgacccctcaaacgtccgctatcttgcagccctgcaactgttgcagaagagaggcgtgcaaagctataaatccaaatttaaagctaaagagcccaggtctcccgtgattacccgcaagcacgtgcttccaaaggctaagcaagagaaccgccctcagatgttagaaaccaaagtgttccctcggcctgttctaccttctctaactcatcggaagaagaagataaagtag

SEQ ID NO: 53991 - DNA, 369 bp, Artificial Sequence
  Description of Artificial Sequence: Synthetic coding sequence
atggtaaatgacaccccgtcttcccccagccctgccgctcaaatttctttgctgaccgatcctgaacagcgatgtctacattggtctctgctgagcgagaagaatttggcttgtccaccagatccgtctaatgttcggtacctcgcagcccttcagctgctccagaaaagaggtgtgcagagctacaagtccaagttcaaagctaaggaaccacgatcaccggtcattacacggaagcatgtgctgcctaaggccaagcaggaaaatcggccacaaatgctggaaaccaaagttttcccaaggccggtgttgccctctcttactgtttcccgggttatcattcccgtgagtacccaccgaatcctgtag

SEQ ID NO: 53992 - DNA, 504 bp, Artificial Sequence
  Description of Artificial Sequence: Synthetic coding sequence
atggacaagctcacaataattagtggatgcttgttcctggccgctgacatattcgccatcgcgagcatcgcgaaccctgattggatcaacaccggagaatctgcaggggcacttaccgtgggcttggtgcgtcagtgccagactattcatggaagagatcggacttgtattcctccccgactcccccctgaatgggtgacaaccctgttcttcattattatggggattatatcattaaccgtgacatgcgggctgctggtagcatcccattggcggagggaggctacaaagtacgctagatggatcgctttcaccggtatgatccttttttgtatggccgctcttatcttcccaatcggattctacatcaacgaggtgggaggccaaccgtataaactccccaataatactgtggtcgggagcagctacgtgctgtttgtattaagtatttttttcacaatcgtaggtctgttattcgccggaaaagtttgtctccccggatag

SEQ ID NO: 53993 - DNA, 420 bp, Artificial Sequence
  Description of Artificial Sequence: Synthetic coding sequence
atggtcacacacgccgcaggggctcggaccttttgcgaagaacagaagaagggatctacatattccgtgcctaagagcaaggagaaactgatggaaaaacactcccaggaagccagacaggcagatagagaatccgaaaagccagttgatagtttgcaccccggagctggcaccgcaaaacatcccccacccgctgcttccctcgaagagaagccagatgttaaacagaagtcatcaaggaaaaaagtggtggtgccacagatcatcatcacgcgggctagtaatgaaactctagtgagttgcagttcttcgggctcagatcagcagaggacaataagagagcccgaagactggggaccataccgacgccacaggaacccttccactgctgacgcctataacagccacctcaaagagtag

SEQ ID NO: 53994 - DNA, 423 bp, Artificial Sequence
  Description of Artificial Sequence: Synthetic coding sequence
atgggcctatcaaagtccaaggagaagcctaggaagggcgaggaacaaaagaaaggatctacttacagcgtgcctaagtctaaggaaaagcttatggagaagcactcccaggaggcaaggcaggcagatagagagagcgagaagcccgtagactctcttcatccgggagccggtactgctaaacaccctcctcccgctgcgagtttggaggagaaacccgacgtcaaacagaaatcaagcagaaagaaggtcgtggttcctcaaatcattataactcgcgcatccaatgaaactttggtctcatgtagctccagtggcagtgaccagcagaggacaatccgggagcccgaagattggggcccataccggaggcataggaatccgagtacagcggacgcctacaactcacaccttaaggagtag

SEQ ID NO: 53995 - DNA, 1302 bp, Artificial Sequence
  Description of Artificial Sequence: Synthetic coding sequence
atgctgccagctggttgttccagaagactcgtggcagaactccaaggagctctagatgcctgtgctcaacgtcagctgcagctggagcagagcctgagagtgtgccgaagactgttgcacgcctgggagcctactgggacacgggctctaaagccaccaccgggacctgagacaaatggtgaagaccctcttccagcctgcacacctagccctcaggatctgaaagagctggaattcttgacacaagcgctggagaaggccgtgcgggtgaggcgcggaatcactaaagctggagaaagggataaagccccttcccttaagtcccgctcgatcgtaacgagttccggtaccacagcctcagcgccaccacattctccaggccaggccggtggacacgcatccgacacacgaccaacaaagggtctacgccagactaccgtcccagccaagggacatcctgagaggcgattactgagcgtgggagatggcaccagggttggtatgggtgcaagaaccccgagaccaggtgctggactcagagatcagcagatggccccaagcgctgcccctcaagctcccgaggccttcaccctaaaagaaaaaggacacctgttgaggctgccggctgcctttcgaaaagcagcaagtcaaaactcctctctgtgggcccagttgtctagtactcagacatccgactccacagatgcagcagcggctaagactcagtttttgcagaacatgcagaccgcaagcggtggacctcagcctcgcctgagcgcagtggaggtggaggcagaggcagggcgtctgaggaaagcctgctcactcttacgacttcgcatgcgggaggagctctccgctgcaccaatggactggatgcaggagtataggtgcttgctaactctggagggtctccaggctatggttggacaatgtcttcaccgcttgcaagagcttcgggctgccgttgctgagcagcccccaagaccttgtcccgtgggacgtccgcctggcgcttccccatcttgcgggggtcgcgctgagccggcttggtcccctcagctcctggtttactcttccactcaggagctccagaccctggccgcactaaagctcagagtcgcggtgctggaccagcaaatccacctggagaaagttctgatggcggaactattgcctctggttagtgctgcacagccccagggaccaccctggctggccttgtgcagggccgtccactcgctgctgtgtgagggcggtgccagggtattgacaatattgagggatgagcccgctgtttag

SEQ ID NO: 53996 - DNA, 1119 bp, Artificial Sequence
  Description of Artificial Sequence: Synthetic coding sequence
atggcacccgcaccacctcctgcggcaagcttcagtcccagcgaggtccaacggaggcttgccgcaggagcctgctgggtgaggagaggagccaggctgtatgatctttcctccttcgtgcgccatcatcctggaggagagcagttgctacgcgcaagggccggacaggacatctccgcagacctggatgggcctcctcaccgacactctgcaaacgctcggagatggctggagcagtattatgtgggcgagttgagaggcgaacagcaagggtctatggaaaatgagcccgtcgctctggaagagacacagaaaactgacccggctatggagcccaggttcaaagtggttgattgggacaaagaccttgtggactggaggaaaccactcctgtggcaggtcggacacctcggagagaagtatgacgaatgggtccaccaaccagtgacaagacctataaggttgttccactcggacctcatcgagggtttgtctaaaactgtgtggtattccgtgccaatcatctgggtacccctcgtgctgtacttgagctggagctactacagaacctttgctcaaggaaatgtgcggctgttcacttcttttactactgagtacacggttgcagtccctaagtccatgtttcccggattatttatgctggggacattcttatggtcactcatcgaatatctgatccatcggtttttgtttcatatgaaaccaccctctgacagctattatctaatcatgctgcacttcgttatgcacggtcagcaccacaaagctccttttgatggatctaggctggtctttcctcccgtgcctgcttctttggtgattggcgtgttttacctttgtatgcagctcattcttcccgaggcagtgggagggactgtcttcgccggaggtctcctaggctatgtgctgtatgacatgacacactactatctgcacttcggttcgccgcataaaggctcttacctctactccctgaaggcccatcacgtcaagcaccactttgctcaccaaaagagtggcttcggaattagtaccaagctgtgggactactgcttccacactctgactcccgagaagcctcacttaaaaacccagtag

SEQ ID NO: 53997 - DNA, 1317 bp, Artificial Sequence
  Description of Artificial Sequence: Synthetic coding sequence
atgttactgtgccccgcacaaaagactgtgttcagactgcagctgacgactgcagctcagtgcctctgggtgtaccttcgggataagcaagtggtcgtcttccttgcctaccccactagggcccctggcaggaacaatggtgttactagccttcactggccagaccctacactgtccctttcctggacacaggaggcgtataccgaatatctaaggagtatccactatatctcgcaagtcctgctcgaggaagtagaaaccaccaaagaggctggtgagaccgtccccccagacaccagcaagatgctgaaactcgctcagcagtgtttggagcgtgcacagtcaactgcagcaaaactgggaaaaaccagactcaagccaacaatgccagcggcagctcccatcccccaacctgcagggaggcacagaagggtctactccgacgagggcggtaagctatcacctttcttacccccagaaatcttccagaagctgcagggagctgagagtcagtcctgtaagaaagagctcacgccactagaggaggcgagtcttcagaatcaaaaactcaaggcggcttacgaagcgagaatggcacgcttagatcctagccaggctatgcagaaaacctcacttaccctgtcactgcagcgccaaatgatggaaaatttggtgatagcgaaggcccgtgaggagactctgcagcgcaaaatggaagagcgcagactgcgcctgcaggaggccgcaaacaggcgcttttgtagccaagttgccctgacacccgaagaaagagagcaaagagccctgtatgccgcaattctcgagtatgagcaggaccacgactggcccaaacattggaaggctaagctgaagcggaaccccggagacctttctctcgtaacttccctggtgagccatctactgtctctgcccgatcacccaatcgcccaactcctgaggagactgcagtgttcagtgtactctgccctctaccccgctgtgagcagagcagccgcacctgctcctggatgttgcccccctacacccaatcccggaagccgcagacttagaccaagccaaagcctgcactgtatgttgagcccccctgagcccagcgcagcacctagaccgcaggatagcccgccaacaccacctctccagcctggaccctggggactacctcacccatggggtacccctcacttagattgccagacccgaaccgcacggtcccgcacctggtcttcaagttgggggaggctttctggtcgcgcaggcgcagttggctactcaaggtctccgagttgctccagctag

SEQ ID NO: 53998 - DNA, 1896 bp, Artificial Sequence
  Description of Artificial Sequence: Synthetic coding sequence
atggcagcagccgcaggcgacggcacggtcaagcccctgcaaagcgccatgaagctggctaatggcgcaattgagttggataccggaaatcggccacgagaagcttacaccgaatatctccgcagcattcattacatttctcaggtgctgctggaggaagtggagactactaaggaggctggggaaacagttcctccagataccagtaagatgctgaaacttgcccagcagtgcctcgagcgggcacaatccaccgccgctaagcttggcaaaacacgtctgaagcctaccatgccagcagctgcacctatcccccagccagcaggtagacatcggagagtgtattctgacgagggcggaaaactgtcccctttcctgcctcccgaaatttttcagaaattgcagggagccgagagtcagtcatgcaagaaggaattaactccactcgaagaggcaagtttgcagaaccaaaagctcaaagcggcatatgaggcacggatggcacggctcgatcccagccaggcgatgcaaaaaacaagcctgacactcagcctgcaaagacaaatgatggagaatcttgtcatagccaaagcgagggaggagaccctccagaggaaaatggaggaacggaggctaaggctgcaggaggccgctaaccgtaggttttgtagccaggtcgctttaacccctgaggagcgcgagcaacgcgctctgtatgcagcaatccttgaatatgagcaagaccacgactggcccaaacattggaaggccaagttgaaaaggaatcctggcgacctctcactcgtgacatccttggtttcacacctcttatctttgcccgatcaccccattgcccagctgctaaggcgtctgcaatgttctgtttacagcgctctgtatccagcagtgtcaagggctgctgcacccgctccaggctgctgcccccctactccgaaccccggatcccgcagactgaggccctcacaatcactgcactgtatgctctcaccccctgagccctctgcggctccccgaccacaggactcaccaccaactccaccccttcagcccggtccagtgggatctccctccccactgggcgacacagcctcaggtctccccgacaaggattcgagttttgaagacctggagcaattccttggcacttctgagcggcaggggagaggccgaggtgtgcaacccgagcctcagcttcagcagctgaaaaccgctgtggaagagatacacaatgccgttgatcgtctgctaagcctgacactactcgccttcgaggggcttaatactgcggctagcaaggataggtgcctggcctgcatagaggaacctttttttagccccctatggcccctgctcctggccctgtacaggagtgtgcatcgcgctagagaggcagcactgagtagaagcatggagctgtatagaaacgcccctcctaccgcgatcgggattccaacaaagctgttaccccagaacccagaggccaaaggggctaccggatatccttattgcgctgccgcacaggaactggggctgttagtgctggagtcctgccctcagaagaagctagaatgtattgttagaactttgagaattatctgcgtatgtgctgaggactactgccccactccagaagctacccctcaggccggacctccgccaatcgcggcagccgcaatcggagccgacgacttgcttcctatcctttcatttgtcgtgctgagaagcgggctgccgcagttagtctctgagtgcgccgctctggaagaattcatacatgaaggctacctgattggcgaggaagggtattgccttacatccttacagtctgctctctcatacgtggaactgttaccccgaggcggattagcaaagtag

SEQ ID NO: 53999 - DNA, 1563 bp, Artificial Sequence
  Description of Artificial Sequence: Synthetic coding sequence
atggcatcaaacgacaagggcatggcaccttctctgggcagcccttgggcgtcccagatgggcccttgggacgctatccttaaggctgtcaaagatcagttaccaagtttagattctgactcccctctgtcagactatggagaagaagagctttttattttccaacggaatcaaacgagcctgattccagatctgagtgaggaactcgccgaagatcctgcagacggcgacaagtctcgagcttgggtggccgctgcagaggagagtctgccggagcctgttttggtgccggcagagctggcaaccgaaccagggtgtaggcagaacacgaggaccaaggatgccagttcccaggaagggcgtgacccaggcaggcctttcgagagctctggagaggtgagcgctctgttgggcatggctgaagagcctcccagatggctcgaaggagacctgggatctctgtcatttaacactaaaggatcacagggtccgccttgggatccccaagccgaagctaccttgtcctgccatgagggtgaccccaaagccgagcctttgtccacagcctcccaggaatcagtaaacagacgcgcacttcggcaggaacgcaggaagatgattgagacagatattctccagaaagtcacacgggacgcctgtggaccaacaagcagcgacaagggaggtgtgaaggaagcgccatgtcacgctgccgaaagtgctccgagaagcaagatgccattagttgagcctcctgaaggccctcctgtgcttagcctgcagcaactggaagcgtgggatctcgatgatatcctacagtcactagctggtcaagaggacaaccagggtaatcgcgctcccggaacagtatggtgggcggctgatcacagacaagtccaggatcgtatggtgccaagtgcccacaataggctgatggaacaacttgccctgttgtgtacaacacaaagcaaagcttcagcatgcgctcgtaaagtaccagccgacacgcctcaggacacaaaagaggccgatagtggatctcgctgcgcctcccgaaagcaaggatcacaggccggacccggtccccagctggcacagggcatgcgactcaatgcggagagccccacaatttttatagacctgaggcagatggaactccctgatcacttgtctccggagagtagctctcattcctctagtgacagtgaagaagaagaagaggaagaaatggccgctctgggcgacgccgagggcgctagccccagtagcctaggtctgagaacatgcaccggtaaaagtcagttactgcaacagctccgggcttttcagaaaggaacggcacaacccgagctgccagctagtaagggacctgcagggggtagggcgcaggctcctgaggataccgctggatcccggacagggagaaaacagcatatgaagctgtgcgctaagggtcagagcgcacaagcccgtttgccccgaggaaggccgagagctttgggcgatgtacccgagccaggggctgctagagaggccctgatgccgccactggagcagctgtag

SEQ ID NO: 54000 - DNA, 828 bp, Artificial Sequence
  Description of Artificial Sequence: Synthetic coding sequence
atgcccctggtggagccccctgagggtccaccagttctgagtctccagcagctggaagcgtgggatctggacgacattctgcagtccttggctgggcaagaggacaaccagggtaatagggcccctggtaccgtctggtgggcagccgaccatcggcaggttcaagaccgaatggtccccagcgcccataataggttaatggagcagctggccctgctgtgtactacccagtccaaagcctccgcctgcgctagaaaggttcccgctgacacccctcaggatactaaggaagctgactccggatctcgatgtgcctctaggaaacagggctcccaggcaggtcccggacctcagctggcgcaaggtatgcgactaaatgccgagagccctacaatatttatcgaccttcgccagatggagctgcctgaccacctgagcccggagagcagttctcacagtagttctgattccgaagaagaagaggaggaggagatggccgctttaggagatgccgaaggggcaagtccatcaagcctcggcttgcgcacatgtaccggcaaatcccagttgcttcaacaactccgcgcattccagaaggggacagcacagcccgagctgcccgcttccaaaggccctgccggtggccgtgctcaggccccagaggataccgctgggtcgcgtacgggtcgcaagcagcatatgaagttgtgcgctaaggggcaaagcgcccaggcccgactacctcgaggaaggcccagggccctgggagatgttcccgaacctggagctgccagggaggctctgatgccaccactggagcagctatag

SEQ ID NO: 54001 - DNA, 828 bp, Artificial Sequence
  Description of Artificial Sequence: Synthetic coding sequence
atggaggaacgaaaagaggagggagaagctgagatccaggaacacggcccagaacactggttctctaaatgggaacgccagtgtctggcagaagccgaacaagacgaacaattgccacccgaacttcaggaggaggccgctgcagctgctcagcccgagcataaacagcagaagttgtggcacctgtttcaaaactccgctactgctgtggcgcagctttacaaggacagagtgtgtcagcagccaggcctcagcctctgggtcccgtttcagaacgcggctacggccgtgactaacctttataaagagtcagtagatacccaccagagatcttttgatatcggaatacagatagggtatcagagacgcaataaagatgtgctggcctgggtgaagaagcgcaggcgcacaatacgcagagaggacctgatttctttcttatgcggcaaggtaccgcctccccgtaactctagggcccctcctaggctgactgtcgtctcccccaacagagcaactagtactgagacatcatcttctgtcgagaccgatcttcagcctttccgtgaggccattgccctccatggactgagcggcgcaatggccagcatttccgttcggtcctcaacccccggttcccctacacacgtctccagtggtagcaacgcttctcgacgcagaaacggactgcacgatgtggatttaaacaccttcattagtgaggagatggccctacacctggataacgggggaacacgcaaacgtactagcgcccaatgcggggacgtcataaccgatagtccgactcataaacgcaatagaatgatctag

SEQ ID NO: 54002 - DNA, 798 bp, Artificial Sequence
  Description of Artificial Sequence: Synthetic coding sequence
atgagcgaacagcaaatggatttaaaagacctcatgcctacaaagagaaaatacatgtggaagacagcagaggatagaaggatgagtgatctcacctgcgtcttggaatggctcgaaaggaggcaaggtaagaagaagcaagctcctgagaagcaaaaaccaaaggtcgtgactgtgctgaagaggaacaaaaagaaggaggaaaagaagggaaagggtttgatgaccgcccgaggcggaaacaggagagacaccgagacaagtcagcaggcattggggaaacgcttcagaaaggacgcagccagttacagaagcctttacggcgtcgaacagaagggtaagcacctcagcatggtgccagggtcatatatcaaggacggtccaaagaagtccgacaccgatattaaggatgcggtggatcctgaatccacacagaggcccaacccttttagacgccagtccattgtcctggaccctatgctgcaggaaggcacattcaacagccaacgggcaaccttcattcgcgactggtccaacaaaatgcctgacatggcctatgaaaggaaactgaagtccctaatggaaaagtctaccgaaccgaagatggagacaatgaggatgttgaaaccagaggaggtgcttagctgcagatacttgagactatccaaggagaatatcagaactctgctgaagctgtgtaaggacgctggcatgaacgttgatatccatccacatatggtagaagaggatattgacgccaaaaaggtatttaccggcatccccagcatggccctttag

SEQ ID NO: 54003 - DNA, 687 bp, Artificial Sequence
  Description of Artificial Sequence: Synthetic coding sequence
atggaaccggcaagttgctgcgccgagagacctaaacccggtcctactggagtcaagaccaagccaagctgcggcggatggagggctgttagcctgctgctgttattgcttttgcttgtgctggctgctgtgggcgttgtggctggtggtctactgggatcggcgcaaggccctcctaaaccccgactgcaaaccctgcggatgaccctccctagtccccatatgccacggccaaatcaaactatattagtggacgtcgcccgaaatgcagccactattacagttacacctccacaaagcaaccacagctgggccgttctgtttgatggccaaagtggatgtatttgctaccggcctgaggagcatcaggtgtgtttcctgcggctcatggaagattccgacagggagacattaagactgctcgtcgatacttctaaagtgcaggaggcctgggttccaagccaagacacgcaccatacacaagaacttcttgctgtgcagggcagcctggaggtggacccagcacaggccggagccctggttcagagattgtgcatgcggactccaatctattgggctcgcagggctgagggaccacgaaggcagagactcatctatttgtgcatcgatatctgcttcccatccaacatttgcgtgagtgtctgcttttactacctccccgactag

SEQ ID NO: 54004 - DNA, 582 bp, Artificial Sequence
  Description of Artificial Sequence: Synthetic coding sequence
atgttcaaaaatacattccagtccggatttctaagtatcctatactccatcgggtctaagcctctacagatctgggataaaaaggtgcgcaatggccacatcaagcggatcactgacaacgatatccagtctctggtattagagattgaaggaactaatgtgtccacaacctacattacctgccccgctgatcccaaaaagacacttggtatcaagctgccctttctggtgatgattattaaaaatctcaagaagtactttactttcgaagtgcaggttctggacgacaaaaatgtgcgccgaagatttcgggctagtaattatcagtcaacaacgcgcgtcaagccttttatctgcaccatgcctatgagacttgatgacggatggaaccagattcagtttaacttacttgactttacccgccgagcatacggcactaactatattgagactctgagagtacagatccatgctaactgccggattcgccgagtgtacttctccgaccggctgtactcagaggacgagttaccggcagagttcaaactgtacttgcccgtccagaacaaggctaaacagtag

SEQ ID NO: 54005 - DNA, 444 bp, Artificial Sequence
  Description of Artificial Sequence: Synthetic coding sequence
atgattgtatctaggtatggactggtgggctgtgatgccggacaagttcgcccaaaagtcgagctgtctttgcccgcttttcttgcccttcccaaaaaagaatttaaggataagcccgaggttgaagaaaataatctgatcgaagaagctgtgtggcaaacatctctgaagattcctctgccgcaagctcaggtgcgagagaggggcggaggttccgctggaatcagcgcagctcatccaagtcagctctgcacagccggagttcgaccatctagcgctctccgtgcctcgcgacccggatggagtctgcaaacagctgcactgcaagagccgacaggtgcagattcttttttgcctaggagtcacaaaaccgcagtcgatctgcactccgcaaggatcccgctctacatccacacgaagtgtttgctgatggaatcagtgtag

SEQ ID NO: 54006 - DNA, 954 bp, Artificial Sequence
  Description of Artificial Sequence: Synthetic coding sequence
atggcgtccgccggagcagagcggcgacctggagtgcaggaggccactgtggttggccagggccaactcactgaagagcccggttccgcacagacctcagagtgtcccgttgccggtgaccagtttctggtcccggctcatgaggccagagggacacagtccgaggatcagcggccagcaggggcagcaagtgagtcggagctgcaggaggaggggcctaaacttggcgaagagagacctaagccccatgcgggagctctggaagaacgcggaccacgacctgttgtctccatcgtcagacccagacacgggccaaagagaaaacctgttaagagcctctcactgccaggcctgcgcgctcatctgaaggccgaagcagaacttcccccaaaattgcctctgcaggaggaagagcccgaggactcacagagtgagccctctccgtccgccaaacagcataaaaaagctaagaagcgcaagtctcttggcgctccagttctccatgctgtggcttcaatggtgtccgctcccttagagacacttcggctggagcggaaagcccagcggctcagacctttatatcagtatgtgaactactgtaatcccgaactgaaccaggctggaaaaggagacggggaagcggaggtagaggcagaagcagagcttgcacccgttccggaggaaggcggagtggagcaactccaggccttgctgccactcgcaggagagctcgggccaggattagccctgccctgtcccagcccacttgttacacctactcatgcattggctccactgggggaagaggctggcgaagaacccggaggcttacctagtctcggtgtgagcgaccataaggcagaggtagacaagtcaactcaggtggatattgacaagatgctatccgtatgcacggcgcctctagtacctccactgagtccccagtacaagtag

SEQ ID NO: 54007 - DNA, 465 bp, Artificial Sequence
  Description of Artificial Sequence: Synthetic coding sequence
atgtctgccacccgagccaagaaggtgaagatggccactaagagctgtcccgaatgcgaccaacaggttcctgtcgcttgtaagtcctgcccgtgtgggtacattttcatcagccggaagctgcttaacgccaagcatagcgagaaatcaccccctagtactgaaaacaaacacgaggccaagcggaggaggactgagcgggtgcgacgggaaaaaatcaatagtaccgtgaacaaggacttggagaaccggaagaggagccgctccaactcccatagtgatcatatacgtcggggaaggggtcggccaaagagtgcttccgctaaaaaacacgaagaagagcgggaaaagcaggagaaagagattgacatttacgccaacttgagcgacgaaaaagcttttgttttcagcgtcgcactcgccgaaataaatagaaaaattattaaccagcgactgatcctgtag

SEQ ID NO: 54008 - DNA, 282 bp, Artificial Sequence
  Description of Artificial Sequence: Synthetic coding sequence
atgagcgccacacgggctaaaaaagttaagatggcaaccaaatcatgcccagagtgtgatcagcaggtgcctgtggcatgcaagagctgcccttgcggctacatctttattagcaggaaactcttaaatgccaaacatagtgagaaatctccgccaagcacagaaaaacaggaaaaagagattgacatctacgccaacctctccgacgagaaggcctttgtcttctccgtcgccttagctgagattaataggaaaattatcaaccagcgcctgatattatag

SEQ ID NO: 54009 - DNA, 576 bp, Artificial Sequence
  Description of Artificial Sequence: Synthetic coding sequence
taagagcaaggtccagcagcaccaaaatcatggttgctgcttccaaccacactggccctccacggcagtctggacgctgtatcccaggcacagggcagacctggccacccggatgccccacccaacatatatgaggggggactcgggtcccctcagccccagtgcccgtcagcacagggaagtaagcccaagaattttagacttcgtcaccttagaggactgggcctgtatctcgagagtcacccaccccctaccggacagtgtgaatctcattggctgggtagactgatggcaggcggttgcctcccccagccagaaggcactgcttgggctctggatctacctcagggaaccctgggtcctcgcaatagtctttgtagtgccctccttgaggctaggttacccagagactcgctgggttcttctgccagcagcagctccatggaccctgataaaggagccctgccgcaaccctcaccttctagactgagacccaaacgcagctggggcacctgggaagaggcaatgtgcccgttgtgtaagcgcacacgaagcggcgctttggagcgaccctag

SEQ ID NO: 54010 - DNA, 996 bp, Artificial Sequence
  Description of Artificial Sequence: Synthetic coding sequence
atgctcaaccgaaaaacgtcgcacttcctaggcatgcgcgtgcagagcgagctggaacacctaagcgagctgaggagggaagcaggtaaggatagatcctctgtacacggtagcgctgctaggacacgggcatccgtgcggacacaatggactaccgcggcagccgctaaagcagacgaggaccccggagcaaacctgttcccacccccactacctcgcccacggatctgtatgtggaagtacttggatgtgcactctatgcaccagctcgaaaagacaacaaatgcagagatgcgtgaggtcctcgcagagttgctggagctgggatgcccagaacagtctctgagagacgccatcactctagatttgttttgccatgcccttattttttgccgccagcagggcttttccttggagcaaacgagcgccgcttgcgcactgttgcaggatctgcacaaggcatgtattgccacacctttggggaatgtcgaagaatgttatcggtactttaccagtgttctattttgtcatggagtaaggaggccccctttttccattgatctgtttaaggaggagcagctgctggcactggaggactatgtcgtcaacacctactttcggcacttcaagctatataagtacgtgtttaccccgcaggtgagactggacctgtccctgacatacatgggactgcagcccccaaagctttggccagagtcggaaaccgagaaagaagaaagcaaggagatggaggagcaggccgtgactccccaaaaggaggagctcgaaaccgtcgctcctcctgaaccagaacctagtcatatccatgtattgcgggcttatatcaaaacccaggtgaacaaggagctggaacaactccaaggactggttgaagagaggctgaaggcttccgaggaaaggttatcatcaaagctgactgccctcgagcgcccattccaactgcctcctgggaagggaaaatccaagaccaaatag

SEQ ID NO: 54011 - DNA, 534 bp, Artificial Sequence
  Description of Artificial Sequence: Synthetic coding sequence
atgctgaaccgtaaaacctcccactttttggggatgcgcgtgcagtccgagctggaacacctgtcagaactacgaagagaggcgggtaaagatcgctcctcggtgcacggttcagcggctagaacaagggcgagcgtgcgtacacaatggaccacagcagctgccgctaaggccgacgaagacccaggcgcaaatctttttccccctccactccccaggccacgaatctgcatgtggaaatacctggatgtgcattcaatgcaccagctggagaagaccactaacgctgaaatgcgtgaagtcctagctgaactgctggaactcggatgccctgaacaaagcttaagagatgcgataaccctggacctgttttgtcacgcattgatcttttgtagacagcaagggttctcactcgagcagacttcagccgcatgtgccctcctccaagatctgcacaaagcttgcataggcgagagaggccaattacccggactctccccccgagagaagagaaaccgagcgtggcacaaatag

SEQ ID NO: 54012 - DNA, 720 bp, Artificial Sequence
  Description of Artificial Sequence: Synthetic coding sequence
atgagagcaagtaggagcccaccttccccacggaggtgtcatcaccaccacgaagccaccggtgccgcttccggtgccgctgccggaggtcccggagctggatgtgtgggcttatgcagactggccttgactccctctgcccaggacggacggaattcaacatttcagacctacaagaaagaggtttgtcttccccgtcacagcatgcatcccggaccttgggctatctgctgcgagtgccagactcggtttgggggtagattgcccgtgtcccgtgtggaagcagcgttaccttactgggtccccctgagcctgaggccaagaaagcagtctcaaaaaactgtccaattcccaattccacagaccgccaagatgtgtccatgcctgtgccataggttcggaggaaggcttcccatgccacgcgaccaggcagttatgccgtactgggtccctcaggtactccggtcccaacagcagatagtccggcgacagcaatctctgaagggaatacaggctcccctcctcgacgcttgttgctggcacaattgttggaggatatgcggagacgaatgtctgttgtccaaattccagcagctgcaggctccatatcaggaccaattgcccgctcccgcagctaggctgctacctctggggctgctaacgctcctgcaggcaattccccgagtgatcatggccattcgccagtgcttcggcgtgtag

SEQ ID NO: 54013 - DNA, 3426 bp, Artificial Sequence
  Description of Artificial Sequence: Synthetic coding sequence
atgtccttcagcttgacgtttacagagctggcgaatatcgctattccacagtgcggcgtgctcaacttcaaagctcttcatcttttactgcacgggattctggagcatatccacatggctgagcttaagaaagtgctgtctggggatgaagactttttacaaacgtcacaggtcgtgatcatgcccagggagggggatgctcagccaatcttgaatcccatgaagaggttaagtaatgtattcgaccatgtcgttagccggctcgacaaactcgaaaaccagctcgctttgctccaagacctgccttcaacggcccagctactagaagcgtcccaggggactgctaggcctgtgcaagatctgtggcaccttataaagctacggaagatggtcgaaggccacgatgaagttatggcaaagtcaatgcagacgctccaggatttactaaccgacctgcacgcgttacaagtgacaatcacagccctgcgcaaggaggtggatatgttgaagaacatgctggacaaagttcaccctgagaggatggacattttcgccgaagatttcaaaatccagaactggaagatggtggcgctgcaacgagaggtggcctctctccagaataagttcaagaccatcccgaaaactgaggacatggtgctgtggtctgggctgcatgatgcaatgttcacctccgaaatcggctcgagccccttagatctctggcagtccgtcgagcagctgccagaggccgctctggctcagactaccaagtatctggaagcaacacgggctattcaggtgagtgagcctgtccagaatccacagctcttacaaactgtctggcactatgaggtacctgaattgcttccagagggctcttcagcacaagccgtaagcctctcaagagcgcaagagccggctcagcctccagccctcacaccggagtcagcgcctgggtgcactaccgaattcgctcctggtccagccccagggaccgaaccagtgcccggtttggaactggggttggaactggagccagtgccagctcttggacccgtgccaggccctagcgtgactcccggttcattaccggcaccttggcctgtgcttggcccagtgccagcccctggggctcagccaccccctctgggcgactggccagcgcttccaaggcggtggcccttgcctcagggatggccaagagtggggtcgtggcccctatgggatcttggtgtgttgagacctacccaacctcagcctagccgcgcaccccctcccgctacagagtttggcagcctctggccgagacccttgcagccttaccagtcgaggcagggcgaggcactgcaactagctgcagtgcaggtgaaaggtgaagaaaatgatgtgccttctctgcggggactgagagaaagagcgaggaaggacggagcacctaaagaccgcaccagaaaagacggagtgcccaaggatcgcggaggcaaggacgtggaccctaaggacagagctcataaggatgacgtcccaaaagacaggggtggcaaagatgtggaccccaaagaccgggctcacaaggacgatgtcccaaaggatagagggggaaaagacggcgacccgaaggatcgggtgggaaaggatggcgctccaaaagaagcccaaccaaaagcccctcaatccgccctgcatcgcctgaaaacaactgcggcaatcgctgctgctgcggctgccgcttacgccgcagctactagcagtgcggctcaggctgcgaaggtagcagccaagttcgttaaggacgcacccgctactaagatggcagcaatagcgaccgacacggcagccgctgggcctctgggcgtttttgctgatgtcctgggggcaggtccttccagaggagccaccgagagccaaatacttggagatgacagcgagatctacgaaatcctttcaccaagctacagtgcggctagcatcggacccgatccagctctgtcacaggctatggtggctacaaaacaggccatgtcacccgaggacaaaaagagggccgtgaagtactccatgtcacacatcgcgcagattcccgtgaagcacgacagtctaaaggaggagttcgcgcagctcagctgtaatctgaaccagcgcctgtcctatctggccaacatgggcggtccctcttccctgggtacaacggtggacatcctgcagaaaaagatcggctctctccaaaaatctcgcttaaaagaagaggagctggagcgaatctggggcaaccagattgagatgatgaaggatagatacattactctggacaaagccgtggagaatctgcagattagaatggacgagtttaagacactccaagcacagattaaaagactggagatgaacaaggtgaataagagtacgatggaagaggaactgagagaaaaagcagatcggtcagctttagcgggtaaagcttcccgggttgacctggagacagtggccctggagttaaacgaaatgattcagggcatattatttaaagtcacaattcacgaggatagctggaagaaggctatggaggagctgagcaaggatgtgaatacgaaactggtgcatagtgatcttgaccccctgaaaaaggagatggaagaagtctggaagatcgtgcgcaagctcctgatcgagggcctgcggctggaccccgattcagctgcaggctttcgtcgcaaattgttcaaaagggtgaagtgtatctcctgtgacagacctgtggagatgatgacagggcctcagctaattacaatcaggaaagcacacctcctgtctcggttgcggcctgcttccgctaacagctgcgagtacctacaaaggcaacaaatgcgagaacagcagtggctgcaactgcaggatctcggaatccaggaggattgtcagcaggactggggggacggtccccagaatgccacgtctctgaaatgtaaatcatgtaatctgcttacgctgtatccctacggtgatccgcacgtcatagattacgattcagccgaggttgacattcttggcgttgatggaatactgtataagggcagggtgaattcccagagaggagctcaacccctggccgtggcaaaagaactggccgctgttaaggctccctcacccccttcccagtcactgtatgacagggtccattcctccgcgctttttggagcaatttgcccacccttatgtccacgaagcagcgcctgcagcgccgcatctgggcctcatctaaccatgcccgctagacccccaagtctaccacccctcctgctgcttcctcccctgattccatccttaagggatccccaacaagccccaggaagcacgcgactttccagagcccctcacattgagagccgcgttggtcggaagccgccagaggaacccgctaacccctag

SEQ ID NO: 54014 - DNA, 495 bp, Artificial Sequence
  Description of Artificial Sequence: Synthetic coding sequence
atggccagcgctaggggcgcaaagcaaagctccccaagggtgggcactactcgatatacagaaacctccactgtgagggtcgaaacaagctcccatcgtgtggaaacgagctctcgtagagtggaaaccagccagcgcagatccgagggcccatccctgtcacccagcggcaagcgactgcctaggattctggaggcttcctcaagacacgtcgagtcctccagtcagcgcacagagaccaccagccgacatgtgagggcctcttccttacgcgtggagacgtcattacattgcgccgaatctccaacccctagaccaagtagaccacccgcaagaactaaaaaacgaccagacgagatgctgttaccaaaaggccatcaaggtgcacgcgctttaagtcaagacaggaaggcctcatcctgccagcccgctagccagttacccggtggtcccattattttcggattcatggagaccaaccacaagtccatgtag

SEQ ID NO: 54015 - DNA, 504 bp, Artificial Sequence
  Description of Artificial Sequence: Synthetic coding sequence
atgttcgactttagcttccctacaccggctagcgccggaactcggatgggacctgcctcctgtggcggacgatcgcttcacctgccccagttgcgatttagtagagtcgatgccactgccgtcacagatgtgccgttccagaggatgcatgccccacatagggctcccgaggtgttctgctccaggtcttctcgaggggctggtagaggccatcctacgccgacacctcgagtaagatgggccctcgccggaaatcagcctagatgctgtgctcaactgctaagcggccgaggcggatccggcgcacaactccgggctggttgggtgagaggcgctgccgtcggtaatcttttcatactcctgcttggcaaggaggatggcgaagaagagggcaccgttctatcatactcctcaatggttcacatctcgaacattacaggcattgtcggcaccactgtgtcaaggacaaagcctgctcttgttctcatggagctgactttctag

SEQ ID NO: 54016 - DNA, 339 bp, Artificial Sequence
  Description of Artificial Sequence: Synthetic coding sequence
atggcacacagcgccgctgcggtgccgctcggagcacttgagcagtgtcctatccgcgtggaacacgacagaagaagaaggcaattcactgttcgcctgaatggctgtcacgatcgtgccgtgctgctgtacgagtacgtgggcaagcggattgtcgacctgcaacacacagaagtgcccgacgcatatcggggacggggaatagccaagcacctcgcaaaagcagctcttgatttcgtagtcgaagaagatctcaaggcacatcttacatgctggtacatccagaaatacgtcaaggagaatccgctgccgcagtatctggagaggctccagccatag

SEQ ID NO: 54017 - DNA, 2478 bp, Artificial Sequence
  Description of Artificial Sequence: Synthetic coding sequence
atggaggtgaggaggggcgatacatgccctcgccctcatccgtctggtctgcgtgaggagggcctcgaacctaaggtcgcttttccagggggagccaacagatgctggaacctgggcgcagacgccggtagtaggttaaccgacgtttttggatctgttatgctgaccgggagtgcttctttttacgactgttataccagtcagagcgaggataacgttgatctgagacaaacttacaccccattttcttcaaccgaatatagcagcagcgtggattcatccctattttgtgctccatggagcacatacggagacgatatcaagcaacctagtaactctcagatttctatcaagaaccgaattcagaccgaacgcaacgactacggttctgagacagacctgtacggtctcgtgtcaaatatcttggaggagcaggacaaatcacagccttattttgcagagggaacctgctcttcaaatctcaagtcggtgtggcctatgaacaccagtcgctttgcagaccaccatgacttgctgacagaaactaagagacccatcgacactgtgatcagtcagcaggctttctacagtgacgaatccgtgagtgctatggaaaaacagtatctacgaaactcaaacctgactcctcagcagaagatcgacgaactgcatcacgggtttacaggcctcgacttagaggagcagtggatgtacccaagcaggtctgaccacagcaactgtcataatatccagaccaacgatacagcaaagactacctttcaggagtaccctcttattaagaattgctttaccccacagaccggactctcagatattatgaaggaatccggggtggacatctaccattacggacgggacaggatatgcaccaagggcttagaggccccattacagcagaagcgagccgagatgtttctcagtcagtttaatagatacaacgaaaacgttgattactgccgctaccctgaatatgttcatccaaataaggccaagctcaacaagtgtagtaacttctcagttcaggattccaaaaaattggccaatggaaccccagaaaccccgaccgtagaagcggatacatacactaagctgtttcaggtaaaaccagcaaatcagaaaaagatggaagagacaatccctgatcagcaaaacttcacctttcccaagaccacccctcacctgacagagaaacagtttgcgaaggaggcagttttcacagcagactttggtcttacctctgagtatggcctgaagccacatacagcatgtcccgcaaacgatttcgccaatgtcaccgaaaaacagcagttcgcaaagcctgacccccctcatagcgagtatttcaaatctgtcaatctgttatcaaattccgctacatcctccgggggtataaatttaaaccggccaacctggatgaatgtccaaaccaaaaataacactcctattccctatcgcaaccagggaaacttgatgaagctgaactcacacctgtcggctgcttctaaggggagtaatcacagtagtgacttcccgcagctctccagcacaaatctcacgcccaactccaatctttttcaaaagtactgccaggagaatccatccgctttcagtagtttcgactttagttattcaggagcagagcggatccaatcagtcaaccatatcgaaggcctaactaaacccggagaggagaacctgtttaaactggtaactgacaagaagatcaagcaacccaacggcttttgcgataattattctgcccagaaatatggtatcatagagaacgtcaataaacacaattttcaggctaaaccacaatctggccattacgatcccgaagaggggcctaaacatctagatggactctcccaaaatacgtaccaagatctcctcgagagccagggacattccaacagccacaggacccgtggcggagacaactccagggtaaaccgcacacaggtttcctgcttttcaaataactatatgatgggcgacctccgtcataatcaatgttttcagcagctggggagcaacggcttcccactgagatctactcacccgttcggccacagcgtggtaccactgcttgactcttacgacctcctcagctacgatgatctgagccacttgtatccatatttcaacatgatgtatggagataatagcttcagcgggttgatgcctacttttggtttccaaaggccgatcaaaaccaggtcgggtccagcgtcggaactacatatacgcctggaagaatgttgcgagcaatggagggcccttgagaaggagcgaaaaaagactgagctagccctggcgaaaaactatcccggtaagaaggtctcatctactaacaacacccctgtcccaaggctgacaagcaatccaagccgggttgatcgcctaatcgtggatgaattaagagagctagcacgtgttagctgtaaaaacagatag

SEQ ID NO: 54018 - DNA, 2859 bp, Artificial Sequence
  Description of Artificial Sequence: Synthetic coding sequence
atggaagtgaggagaggagatacttgccctagaccacatccttccgggctgcgcgaggagggcctggaacctaaagtggccttccctggtggtgcgaatcggtgttggaacctgggcgctgacgctgggtctcgactgaccgacgtcttcggatctgttatgcttaccggtagcgcttctttttatgattgttacacatcccagtcagaggacaacgttgacctgcgtcagacatacaccccctttagctcgaccgagtacagtagctccgtcgactcctccctgttctgtgcaccatggagcacttatggcgacgacatcaagcagccatccaattctcagattagcattaaaaaccgaatacagacagaaagaaacgactatggcagcgagacggatctctacggcctcgttagcaatatcctggaggagcaggacaagagccagccatacttcgccgaaggaacatgcagctccaatttgaagagtgtgtggccaatgaataccagccgctttgcggaccatcatgatcttctaactgaaaccaaaaggcccatagacacagtcatcagtcagcaggcattctatagcgatgaatcagttagcgctatggagaagcagtatcttagaaactcaaatctaactcctcagcagaagatagatgaactgcatcatggctttactgggctcgacctggaggaacaatggatgtatccttccaggtctgatcattctaactgtcacaacattcagacaaacgataccgccaaaactacttttcaggagtaccccctgattaagaattgcttcaccccacaaacaggcctgtctgacattatgaaagaatccggagtggatatttaccattatggcagagatcgtatttgcacaaaaggcctggaggctccgctccagcaaaaacgtgcagagatgttcctgtcacaattcaaccgatacaatgagaacgtggactactgtaggtatcccgaatacgtccacccaaataaggccaagcttaacaaatgctcaaacttcagtgtccaggactcaaagaagctcgctaatggaacaccagagacgcccaccgtcgaggcagacacatatactaagctgttccaggtgaagccggctaatcaaaagaaaatggaagaaactattcccgaccagcagaatttcacttttcccaaaaccacaccgcacttgacagaaaagcagttcgccaaggaagcggtgtttaccgccgatttcggcctgacaagcgagtatgggctgaagcctcataccgcttgcccagctaacgattttgcaaacgtgaccgaaaaacagcagtttgccaagccagacccaccccattctgaatactttaagtcagtaaacctactgagcaattcagctacttctagtgggggtatcaatttgaacagacctacatggatgaatgtccaaaccaagaataatactccaattccctacagaaaccaaggcaatcttatgaaactcaattcccatctcagtgctgcatcgaagggaagcaatcattctagcgatttccctcagttaagctcgaccaacctaaccccaaactccaacctgttccagaaatattgccaggagaacccgagtgcatttagctcttttgatttctcctactctggcgcagaaagaatccagtctgtgaaccacattgaaggcctgaccaagcctggcgaggaaaacctattcaagctagtgaccgacaagaaaatcaaacaacctaatggtttttgcgacaactattccgcccagaagtacgggataattgagaacgtgaataaacataactttcaggctaagccacagagcggtcattacgatcctgaggagggccctaagcaccttgacggtctctctcaaaacacctaccaggacctgctcgagtctcagggccacagcaactcacacagaacccgaggaggcgacaatagccgcgtcaaccgcacccaagtcagctgcttctctaataactatatgatgggggacctgcgccacaatcagtgtttccaacagttggggagtaacggttttcctcttagaagcacccaccccttcggtcacagcgtggtaccactgctggatagttacgacctcctgtcgtacgacgatctcagtcatctctacccatacttcaatatgatgtacggggacaacagtttttcagggctcatgccaaccttcgggtttcagaggcccatcaagacaagatcaggaccagcatccgagctgcatatcaggctcgaagagtgctgcgaacagtggagggccttagaaaaagaaagaaagaaaacagaactggctctagccaagaattaccccggtaagaaggtatcttccacaaataacactccggtaccaaggctgacatccaaccccagtcgagtggaccgtttgattgtggatgaactcagagagttggctagagtcgtaacactgttaggcaagatggagcgcctgagatcaagcttgctacacgcctctatcagtacagccttggacagacatttagagtccatccacattgttcaatcccggagaaaggacgaaatagtcaatgcttcgaacagacagcgacaaggagtcccaaggtgccaggatgaccgggacgtctttgccctcgcgtccgctattaaagagatgtgtgtggccacaagaaagactaggaccgctctttggtgtgctctgcaaatgaccttgccaaaaacagccagcaccgcagacgtggtaaaaccactccaggatacggtgaactgtgaggataaggtgcacgagtctatcaattcatctaatccaatgaaccaaaggggcgagaccaacaagcattag

SEQ ID NO: 54019 - DNA, 1980 bp, Artificial Sequence
  Description of Artificial Sequence: Synthetic coding sequence
atgaacacatcaagattcgcagaccaccatgacttactaactgagacaaagcggcctatcgacactgtaatctcacaacaggcattctactctgatgaatccgtctctgcgatggaaaagcagtatttgcgaaatagtaatctgaccccacagcagaaaatagacgaactgcaccacggatttaccggtctggatctagaggagcagtggatgtacccgtcaagaagcgatcactcgaactgtcacaatatccagacgaacgacacagcaaagacaacctttcaggaatatccactcatcaagaactgttttacacctcagactggcctgagtgatatcatgaaagagagtggagtggatatctaccactacggtcgtgaccgcatctgtacaaagggccttgaagcaccattgcaacagaagagagccgaaatgttcctgagtcagtttaaccggtataacgaaaacgtcgattattgcagatatccggagtacgtccaccccaacaaggccaagttaaacaagtgtagcaacttctcggttcaggattcaaagaagcttgccaacggcacccccgagacaccgacagtcgaggcagatacctacacaaagcttttccaagtgaaacctgccaatcagaagaagatggaggagacaattccggaccagcagaatttcaccttccctaaaactacgccccatctgaccgagaagcagtttgccaaagaggctgtgttcacagctgacttcggattgacttcagagtatggtttgaagccacacaccgcatgccctgccaatgattttgccaacgttacagaaaaacaacagttcgcgaagccagacccgcctcacagcgagtattttaaaagtgtcaatttgttaagcaacagcgcgacaagctcgggcggaatcaaccttaaccgccctacttggatgaatgtccagacgaaaaacaacacacctatcccttacaggaaccagggcaatctgatgaaactcaattcccacctctctgcggcaagtaaaggatcgaatcactctagcgattttccacagttaagtagtaccaatttgacccctaactctaacttatttcagaagtactgtcaggagaatccctcagcgttctcaagctttgactttagttactccggggctgaacgaattcagagcgttaaccatatcgaggggttgacgaaacctggcgaggagaacctctttaaactagtcactgacaaaaaaatcaaacagcccaatggcttttgtgataactattctgcgcagaaatacggcatcatcgagaacgtcaacaaacataacttccaggccaaacctcagagcgggcactacgatcctgaggagggccctaagcacctggacggactgtcgcagaatacctatcaggatcttctcgaaagtcaagggcattctaattcccacagaacacgtggcggagacaactcacgggtgaaccgcacccaggtaagttgcttctccaacaattacatgatgggggatctccgacataatcagtgttttcagcagctcgggtcaaatggattccctttacgctctacacatccgtttggccatagcgtggtacccctgctagatagctacgatctgttgagctacgacgatttgagtcatctctacccatacttcaatatgatgtacggcgataattcattctccgggctcatgccgacatttgggttccagaggcctattaagacccgaagtgggcctgccagcgaactacatatcaggctggaggagtgctgtgagcagtggcgcgctctggaaaaagagcggaaaaagactgagctggcactggccaagaattatcccggaaagaaagtttcttctacaaataacaccccggttccccgtttaacaagcaaccctagcagagtggaccggttaattgtcgatgagcttagagagttggccagggtctcctgcaagaaccgctag

SEQ ID NO: 54020 - DNA, 492 bp, Artificial Sequence
  Description of Artificial Sequence: Synthetic coding sequence
atgaacacctctcgctttgcagatcaccacgacctgctgaccgaaaccaaacgaccaatcgacacagtcatttctcagcaggcattttattctgatgaatccgtgtctgccatggaaaagcaatatctgcggaactccaacctcacccctcagcagaagatcgatgaactgcatcatggattcactgggctggacctggaggagcagtggatgtatccttcccgctcagaccattctaattgtcataatattcagacaaatgacactgcaaaaactacattccaggagtatcctcttattaaaaattgttttacgccccagactggcctgagtgatatcatgaaggagtcaggggtggatatctaccactatggccgagaccggatttgtactaaaggactcgaggcacccctccagcagaaaagagccgagatgtttttaagtcagttcaatcgttacaatgaaaatgtggactattgtagatatccatag

SEQ ID NO: 54021 - DNA, 390 bp, Artificial Sequence
  Description of Artificial Sequence: Synthetic coding sequence
atgaacacaagcaggtttgctgaccaccatgacctgctgactgaaacaaagaggcctatcgacacagtcatttctcaacaggcattctattccgacgagagcgtatctgccatggaaaaacagtacctacgcaattcgaacctcactccacagcaaaagattgacgaacttcaccacggatttacaggcttggatctggaggaacagtggatgtatccgtctcgctcggaccattcaaactgccataatattcagacaaacgacacagcaaaaaccacatttcaggaataccccctaatcaagaactgtttcacgcctcagacggggctatccgacatcatgaaggagtctggggtcgatatttatcattacggccgtgataggatttag

SEQ ID NO: 54022 - DNA, 495 bp, Artificial Sequence
  Description of Artificial Sequence: Synthetic coding sequence
atgaataattccctggactacctcgcttaccccgtgattgtgagtaaccaccgacagtcgacaacatttaggaaaaaacttgacttcggccactatgtgagtcataagaatcggatccaaatcgccaaaccgactgtggacaccaagcctcccgtcgcccataccaatcatatattgaagctctcaaaacttcagggtgagcagaaaaagataaataagatagagtacgaaaataaacagctgtgccagaagattgccaatgcacacagaggaccagccaaagttgactgctggaatgaatatttctccaagtctctgaaccgagaaacaaggaaccgagagcttgtgcgcatcacaatggaaaatcaagggatacttaaacgtctcgtcgacaggaaaccgcactacgaccgaagagctagtgagatcgattggcagaattcacggaggtacattcggaatacaacgaggtatttactgagccagaacgagtag

SEQ ID NO: 54023 - DNA, 573 bp, Artificial Sequence
  Description of Artificial Sequence: Synthetic coding sequence
atgaaagggacaccttcttctttggacacattgatgtggatttaccatttccacagcagtacagaggtagctctgcaaccaccactgctcagcagtttggagctgtctgtggccgcagctcacgaatatctagaacaacggttccgggagctcaaatcattggaacctcccgagcccaaaatgcagggaatgttgcctgcccctaaacctacattgggattggtgcttagggaagccacagcatctctggtgagcttcggcacaaccctgctggaaataagtgccctgtggctgcaacaagaggcacgccgtctggatggaagtgctggccctgcccctgacgggagggatccaggagccgcactgtccagggtcgcacaggccgcagggcagggcgttaggcaagccggtgccgctgtaggagcttcagcacggctcctggtgcaaggagcttggctgtgcctttgtgggaggggcttgcagggtagcgcgtcttttcttaggcagagccagcagcaactaggcctgggaatccctggggaacctgtatcatctgggcatggcgtgtcttag

SEQ ID NO: 54024 - DNA, 237 bp, Artificial Sequence
  Description of Artificial Sequence: Synthetic coding sequence
atggcgcctcttcctggtgctgaattggtgagaaggccccttcagctctacaggtacctattgcgctgctgccagcagctcccgacaaagggaattcagcagcactacaaacacgcagttcgccagtcgtttcgtgtacacagcgatgaagacaacccggaacgcatccagcaaatcatcaagcgcgctattgaggacgccgattggattatgaacaaatataaaaagcagaattag

SEQ ID NO: 54025 - DNA, 189 bp, Artificial Sequence
  Description of Artificial Sequence: Synthetic coding sequence
atggatcaactcgtattcaaagaaacaatctggaacgacgccttctggcaaaatccatgggatcagggtgggctcgccgtcattattttgttcattacagcggtgcttttgttgattctgttcgcgatcgtattcggcctactgacatccacggagaatacacagtgcgaagcaggcgaagaagagtag

SEQ ID NO: 54026 - DNA, 903 bp, Artificial Sequence
  Description of Artificial Sequence: Synthetic coding sequence
atgtgtgcaagaggacaggtggggaggggaactcaactccgcaccggtaggccgtgcagtcaagtgcctgggagccgctggcgccctgagcgcctgttaaggcggcagagagctggtggcaggccctctcggccacacccagctagggcaagaccgggactgtccctccccgctacgttgctaggctcccgggctgccgcagctgtaccattgccactaccacctgctctggccccaggcgatcctgcaatgccggtccgcacggagtgcccgccacccgctggcgcatctgcagctagcgccgcatcgcttattccccctccacccattaacactcagcagccaggtgtggctactagcctcctgtatagcggatcaaagtttcgcggtcaccaaaagagcaagggaaatagctacgatgtcgaagtggtgctccagcacgtggatacgggaaattcttatctctgcgggtatctcaagatcaaaggactaacggaggagtacccaacacttacgaccttttttgaaggagaaattataagcaagaaacaccctttcctgacgaggaaatgggatgccgatgaggatgtggaccggaaacattggggaaagtttctcgcattctatcagtacgccaaaagcttcaatagtgatgactttgactacgaggaactcaaaaatggcgactacgtgttcatgcgctggaaagagcaattcctggtgcccgatcataccatcaaggatatttctggggcttcctttgccggattttactatatttgctttcagaaatccgccgcttccattgaagggtattactatcaccggagctctgaatggtaccaaagtctgaatctgactcacgttccagaacatagtgccccaatctacgagtttagatag

SEQ ID NO: 54027 - DNA, 681 bp, Artificial Sequence
  Description of Artificial Sequence: Synthetic coding sequence
atgcccgtcagaaccgagtgcccccctcccgcaggagccagcgctgcttcggccgcaagcctgattccgcctccgccaatcaatacccagcagccaggcgttgctacttccttgctgtatagtgggagtaaattccggggtcatcagaagtcgaaaggaaacagctatgatgtagaggttgtgctccagcatgtggacactgggaattcctacttgtgtggttatttgaagatcaaggggctgacagaggagtaccctacattaaccaccttttttgagggggagatcatatcgaagaagcatcccttcttgacccgcaagtgggatgccgacgaggacgtcgataggaagcactggaatataggtcggtatctcgacctgcagacgctgttggactggaccgaaaccttctgggttagggaggagttacgcagaccacctctcgttctcgcgtgcgaagtgtggctgtctcagggcgctgaacctatggagtgcttcttactgcaacaatttgtggcagcattcgtggtactctcgatctctcccaatttccaccactcatggcgcacacctcggttcccaagggggacgcctggcgctctatattgtacatgggtttgtctgcgattcactatgtctaataccctacacctggggtgccacttttttattatcaactag

SEQ ID NO: 54028 - DNA, 1155 bp, Artificial Sequence
  Description of Artificial Sequence: Synthetic coding sequence
atgggagtcacaggcgctcatggcttcccatgttgcggcaaggggtccgttgaggtagcagagatgcgcgatgacctgagtcagcaccagatccaggaggagcaagaactcgaagccgacatgcttgagcagaagccccagctgcaggttgatctcgacttagaccctgatcctgatcctgatcccgaactagagatagggcaggtccccgctttgctcgaatccgaactgtacccagcgttaaaactcgaggccgaattggataccgaggctaattccaacgaggaatccgatttcgaggagcctatgcaactggtgtgtaaaatagaaagtgttcattcaaacatgggtctcccaactcctcagacttttagaccatggtccctgaattctaactgtaggtctttcactgaagaaaatcacgtctcggcctgccaccactcaatttccgctcagacaagcaaacatctcttctgggcaaataaactcattcaggcctctgaacactccctgcagagagccattaacatgcaactcaacaatggcagcgcgggacaaccaatccgctccccactaagagaagcaatacccaccaacgccctgtgctccgaagagcaattgcagatcccggacgcccactcggcccctcccaccacttctagccaagccccatccccactcctgtcatcggacctgccgccacccattgatctgaccgagctaattacgtttgcgtcatcgctggcgatggcttccagttcgcgaatggatctcccctcccttgagcatatgatgaaggctcctcctcaggaggccctggagccttctacagaacccttgcttacaaccgtcgaggaacgggagcctgagaaccacgccgagactctacctgagaaacccagggaggctcgcgcacccctaaagtcctggtcccaagaggataaaaatttcgcacagtcatacttcgacttcagcaagccgggtatcaagcgcgctacaattaagggccagatccagctcctgcaacccccagctacaagccccttgcttcagggctctaaggaggattcagtccctcctggtaaggagaaagagaatcccctgctggtcaaaatccacttcaagctcagtgcccctacaatacctgagaagtag

SEQ ID NO: 54029 - DNA, 1092 bp, Artificial Sequence
  Description of Artificial Sequence: Synthetic coding sequence
atgagggacgatctgtctcagcatcagatccaggaggagcaggagctggaggctgacatgctggaacaaaaaccacagcttcaggtggatctggacctcgatcccgaccccgatcctgaccctgagttggaaatcggacaggtgcccgcactgttggagtcagaactctatcccgcactgaagctagaggcggaactagacactgaagctaattcaaatgaggagtccgacttcgaggagccaatgcagctagtctgtaagatagagtctgtgcattctaatatggggcttccgacccctcagacttttaggccctggtcactgaattccaactgtcggagtttcactgaggagaaccatgtgtctgcttgtcaccacagtattagtgcacagacttcaaagcacctcttctgggctaataaactgatccaagcaagcgaacattcactacagcgggcaatcaatatgcaactgaataatgggagcgctggacagcctatccgttcccccctccgagaggccatccccaccaatgcattgtgctcggaagagcagctccagattcctgacgcccacagcgctcctccaacaacttcaagtcaagccccttcccctttgctttccagcgatctgcccccaccaatagatctgacagagctgatcacctttgcttcttcactggccatggcatccagcagccgcatggatcttccttcactggagcacatgatgaaagctcctccccaggaagccctggagccgagtacggaacctcttttaacaactgtcgaggagcgcgaaccggagaatcacgccgagactcttcccgaaaagccccgagaggcacgggcacccttaaaatcatggagtcaggaggacaagaactttgcacagagctactttgatttcagcaagcctggcatcaagcgcgctaccataaaggggcagatacagttgctgcagccgcctgccacaagccctctcttacagggatcaaaggaggatagcgtgcccccaggcaaagagaaagagaatcccctcctcgtgaaaatccacttcaagctgtctgcccctacaatcccagagaagtag

SEQ ID NO: 54030 - DNA, 1713 bp, Artificial Sequence
  Description of Artificial Sequence: Synthetic coding sequence
atggttaagaccaacaaacccggagccaaggtcgccgtgtcagctcagagaggttccgaagtgacaaccaacacttcaccccaacaaggccatggctacgtgttggcctctagtcatcgctccgccgcagtcagcctgaacccttcccatcgcaggtcagaggccgctcaccctactaccccgcactcggcctcggactatcctcggtcggtcagtcttcagtctggccctggacattatgctgtgccaactcccaggggccctgaaacaggacccagaaccgagtcaagccgacactcctccccccatctgaagtctcaaaaaacacagaccctggcaagccacgcttcaagccgtcaatggaaggtgtcaccgcctagggaggaagccgctaggcgaggctccgagtctaaatccggacgcgaagttggtcaccacgccagctcaatcccagacgcaaagtccacccatcagctgagtttccaggaccagaagaataatctgcaatctcagattctggaggacgatcccccatccaaggtgcaaaatccacagggcgtccgcgtccctcgcagaatcttatcatatccaaaggacgaggctgtgcagaccgaacctattcagaggattacaacgaccagtgagataagatctcccaggtcaccgtctttgctcgagcacggaagcagctgtgtgtctgcagattaccagaccgcccaacgcagagtccctgtggaagaaagtgagactggtccttacggtcccataccctctaagccaaaggctttgtatcgtaatatgaaccttgacagcctgctaaaactgtcagtgctcaaggactctgacggagtacacagggtgagcgcacgggtcgaccctgaaagcctgcataaatactctgcgtatccagaaacgaagcccagcgctaaagtgttagtctctagccaagtcgaaagcaacgtgcgcacacctattagaggcaattcagaggtgggacggcgagtgacaataagccctggtgtacagtcagttgagcccacccaccacgtaacagtcccctccgtatctgagggctcgcacaagtccagtatgtttgttacccccgaaccgatctacaagcagcaaacccagaagcctcctgagattacatacatgtctcagggccctacgcctcgctatcccgagctgtcacagaagccgagtatccatgcagaactcgagctcaccccacgtccgctgcctcctcgtagtttaccacggtacgggcctgattcaagctggtggcctcttctgaatcccgaagttgaaacccctcagagtcagctcaccacaccggattttgaaccaaagtgttcaccctccctcgacctcctgctgtctggattcaagatcgactcctccccattctgcgaggacctgaagttccagcgggaaaaggcctccttgtctcccccttcaccacccaaggagttccctagttgggcccctctgagcgaagtcccccagacgccaaaacacacttgcaaacagcccattcaacgatttaccgccttcttcctggacgtcagtgaggagatgtataaccgagttatttggtggctcaaggggctgtgtttcagcctcctgtgggctcattgcggtagcctaggtgacggacggacaggggaggaatggcatctgtgcatatatagggccggaagtttccggaggtag

SEQ ID NO: 54031 - DNA, 1029 bp, Artificial Sequence
  Description of Artificial Sequence: Synthetic coding sequence
atggacgacaagcccaatccagaggctctatcagattcttcagagaggctgttctcttttggagtaattgctgatgttcagtttgctgatctggaagacgggtttaattttcagggcactcgacgcaggtactaccggcattccttgcttcatttgcagggagccatcgaggactggaataacgagtcctccatgccctgctgtgtgctgcagcttggcgacatcatcgacggttataatgctcagtataatgcttccaagaagtctctggagctcgtgatggatatgtttaagcggctgaaggtgccggtacaccatacttggggaaatcatgagttctacaattttagcagggagtacctcacacacagtaaactaaatacaaaattcctggaagatcagattgtgcatcatccggagacaatgccgtcagaggattactacgcatatcacttcgtgccgtttcctaaatttagattcattttattagacgcttacgatctgagcgtgctgggagtggaccagagttctcctaaatacgagcagtgcatgaagattttgcgtgaacataacccaaatacagagttaaactctccccaaggtctgtccgagcctcaattcgtgcaattcaacggcggtttctctcaggaacaactgaattggctgaatgaagtcctcacattcagcgataccaatcaagagaaggtggtgattgtctcacatcttccaatatatccagacgcttcagataatgtttgtctggcgtggaactatcgggatgcactagccgtcatctggtcccacgaatgtgtggtatgcttttttgctggacatacccacgacgggggatatagcgaagaccccttcggggtatatcatgttaacctagagggcgtgatagagactgctccagacagccaggcgtttggaaccgtacacgtttacccggacaaaatgatgctgaaaggacggggtcgagtgccggaccggattatgaactacaagaaggagcgagccttccactgttag

SEQ ID NO: 54032 - DNA, 525 bp, Artificial Sequence
  Description of Artificial Sequence: Synthetic coding sequence
atggataagcacggcgtaaaaacccctctctggaagaaggagacagaggaactgagggccgaagacgcagagcaggaagagggaaaggaaggatccgaagacgaggacgaagacaaccagagaccattggaggacagcgccaccgagggagaagagcccccaagagtggcagaggaaggtgaagggagagaacgacggtcggtctcatattgtccgttaaggcaggagagttctactcagcaagtcgcccttttgcgccgtgcagacagtgggttctggggttggcttgggccactcgccctcctgggtggccttacagccccaacagaccgaaagcgctccctgcccgaggagccctgtgtgttggagattagaaggagaccaccaagacgcggtggatgtgcctgctgtgaacttctgttctgtaagaaatgtcggagcttgcattcacacccggcttatgtagcccactgtgttctcgatcaccccgacttgggaaaagcaggagccgctggcaactcttag

SEQ ID NO: 54033 - DNA, 666 bp, Artificial Sequence
  Description of Artificial Sequence: Synthetic coding sequence
atgggtgaaaagtctagaagaaaggggccagcgcctcgccacgcagacggtaagctcggccgaacctgcgatcacccatacgccccttggtccttcactccctcctctcgcgctccgacagcttgggttcggccaccctgccccgtgtgggcgagcagattacaagaacattcccctgagccacgtcgcgctagagcccctccaacccggagagctcaagcggcactgtacgctccagcactcaggctgcgcgaccatctagacaggttctccatattgatgacttcctgtacgtcctggctacaggccccacaagccccaggcctctgcagggacgagcaaagctccagaatatcagttcctcaactcagcggagctcctattctcctgcccgacttggaaggcaccaaactgtccaacttccaggagtcttccccactgcctcacaaacacgagcgtaaagataaacggagcaccccagaggaggaaggccgtagcgccccagaaaagattatccagtcactgaagctctgtcccggtggccatcgcccagccagcttgagcagtgggtgccccgcagggtgtcggttatcttttaacctccctccttcaatgttgctgtcagttcagaagtgttgtatgccttcttccctgaagacttgctag

SEQ ID NO: 54034 - DNA, 1566 bp, Artificial Sequence
  Description of Artificial Sequence: Synthetic coding sequence
atggcctgtagcctgcaaaaattgttcgcagtggaggaggaattcgaggacgaagatttcctgtctgctgtcgaagatgccgaaaataggtttacgggatcgcttcctgtaaacgccggtcgcctcaggcctgtctcgtctagaccacaggagaccgtccaagcacagtcaagcaggcttctgttgctccatccaaccgcccctagtgaggcgctggggctccctgacctggacctttgcctacctgcgtcttcgacacctagtgctgactctaggccttcctgtatcggagctgctcctctgcgtccggtgtccactagcagctcttggatcggcaaccaacgcagggtcactgtgaccgaggtgcttagggagaccgcaaggcctcaaagctccgcccttcatccactcttaaccttcgaaagccaacagcagcaagttggcggtttcgagggacccgaacaggacgaattcgataaagtgctggcaagcatggagttggaagagccgggtatggagttggaatgtggggtgtccagtgaagcaataccaatactccccgctcagcagcgggagggatcagtgctggcgaagaaagccagagtggtcgatctgagcgggtcgtgccaaaagggcccagtgcccgctattcacaaagctggtatcatgagcgcccaggacgagtcattggatcctgtaatccagtgccgtaccccgaggccccctctgcgaccgggagccgttgggcacctgccagtgccaacggcattgaccgtgcccacacagcaattacattgggaggtctgtcctcaaagaagtccggttcaagcgctgcaacctctccaggctgccagaggcaccatccagtcatcccctcaaaatcgctttccatgtcagccattccagtcaccaagctcttggctgagtgggaaggcgcacttgccgcgaccaaggacgcccaactcctcttgtagcacaccttcgcggacctccagtggcctcttcccccgtatccctctgcagccccaggccccagtgtcgtccattggtagtccagtgggcacccctaaaggccctcaaggcgcacttcagacccctatcgtgaccaaccacctggtgcaacttgttacagctgcctcccgcaccccgcaacagcccacccacccaagcaccagagccaaaacacgccgatttccgggaccagcaggcatcttacctcatcaggccgctctaaagcagctacccaggaataaagtccccaatatggctgtcatgatcaagagcttaacccggtccaccatggatgcttcggtcgtattcaaggatccaacaggcgagatgcaaggaacagtgcaccgcctgttactcgaaacttgccagaacgaattaaaaccaggatctgtcttactgctaaaacaaataggagtcttttctccctctctgcggaaccattacctcaatgtgaccccaaataacctagtgcatatttatagcccagacagcggagacggcagcttcctgaaaccaagccagccctttcccaaaatgacttggatggactcatag

SEQ ID NO: 54035 - DNA, 414 bp, Artificial Sequence
  Description of Artificial Sequence: Synthetic coding sequence
atggcttgctcattacaaaagctattcgcagtcgaagaggagtttgaggatgaggacttcctatccgccgtggaagacgccgagaaccggtttacgggctccctacccgttaacgccggtcgactgaggcctgtatcttcacgccctcaagaaactgttcaggcacagagcagcaggctgctgttgctacatccgaccgctccctctgaggccctcggactgccagacctggacctctgccttcccgcttcttcaactccaagcgccgactcccgcccttcttgtatcggagcggctcccctccgccctgtgtcaacttctaattgtctgaactcaagccacagtgccaccccgttaggcagcctttcagccaccctaccatgcagtagcacaagtgcttccccctcgtgttag

SEQ ID NO: 54036 - DNA, 1944 bp, Artificial Sequence
  Description of Artificial Sequence: Synthetic coding sequence
atggcctgttctctgcagaagctgtttgccgtcgaggaagaatttgaggacgaggatttcctgtcagccgtagaagatgccgagaaccggttcactggttccctgcctgtgaacgcaggtagactcaggccagtgagtagccgacctcaggagacagtccaggctcagagctctaggctgctgcttttgcacccgaccgccccaagcgaggcactaggtctgcctgacctggatctgtgcctgccagcatcaagcactcccagtgcggactcgcgacctagttgtattggagctgcccctctgcggcctgtatcaacctcaagcagctggattgggaaccagcgcagagttaccgttactgaagtgctaagggagacagccaggcctcagtcttctgccctgcaccccctgctgacttttgagagccaacagcagcaagtagggggtttcgagggcccagagcaagatgagtttgacaaggtgctggccagtatggaactggaggagcccggaatggagcttgaatgcggagtctcctccgaagctatcccaattctcccagcccagcagagggagggctctgtgctggccaaaaaagcacgggttgtagatctcagcggatcgtgccagaaaggccctgttccagccatacataaagccggtataatgagcgctcaggatgagagcctcgaccctgtcatacagtgccggacacctagaccacccctgagaccaggtgcggttggccacctgccagtacccaccgccctgacagtccccacccaacaattgcattgggaagtttgtccacagagatctcctgtgcaggccttacagcccctccaggccgcaagaggtacaatccagtcctctccccagaatcgcttcccatgtcaaccctttcagtcccctagcagttggctgagcggcaaagcccacctacctaggcctcggacgcctaactcttcctgctcaaccccttctcgtacttcatctgggctgttccccaggattcctcttcaaccccaggctcccgtgtcaagcatcgggtcacccgtggggaccccgaagggcccacaaggagcgttacagacccccatcgttacaaatcacctggttcaactggttactgcggcttcaaggacaccacagcagcccacccacccgtccacccgcgctaaaacccggagatttccagggcctgccggaatactgccacatcagcagtcagggcgttccttggaagatatcatggtcagcgcccctcagacccccacccacggggctttggctaaatttcaaactgaaatcgtcgctagtagccaggcttccgtggaagaggatttcggacggggaccttggctgactatgaagtctacactcggtctggatgagcgggacccatcctgctttctctgtacttactcaatcgtcatggtgcttcggaaacaggcagctctgaaacagctacctcgcaacaaggtccccaatatggctgtgatgatcaaatccctcacaagatccactatggacgcctccgtggtgtttaaagaccccactggggagatgcagggcaccgtacaccggttgctgctcgaaacctgtcaaaacgagctgaagccgggtagcgtgctcctcctgaagcagattggagtgtttagtccctctttgcggaatcactacctgaacgtaactcctaacaacctggttcatatttactccccagacagtggagatggctcatttttaaagccgagtcagccatttccaaaggacagcggatccttccagcacgacgtggcagctaagcccgaagaagggttcagaactgctcagaatctggaagcagaagcctcacctgaggaggagctccccgaggctgatgatcttgacggcctactctctgagctccctgaggattttttttgtggaacctcctcctag

SEQ ID NO: 54037 - DNA, 2922 bp, Artificial Sequence
  Description of Artificial Sequence: Synthetic coding sequence
atggaaacaaaggtgcatctgttctgccaagctgaagaaaacatagacctgctcgacgatgggagcaacagtttcgcaactgacctctcatccggaaccatcaatcacaagaagtacatcaagtttagcaagacaattgagaaggaaatttcaccagagatccgctcgctgtcgcctgagtataaaaagatctttgagacgtctattatcttttgtggggaagaaaagtccagcgatttttccggagagaaaaaggtcggccgtaagtccctgcaggtacagcagcattccaaacggaccgagataattccgccatttctgaaactcagcaaagaaaaggtgactaggaaggaaaactccctttgtaaattgcccaaccagtactccgttcacaaaacaagttcgcctctgtgtacatcttccgcaattacacgagagaaagagatgctgtccaatctgtacatgaccctgtacgacgaagtgacgcatgggtatctgcacagcaaagagctgtctgccttgcataaagcctgtaaaatctttagcaagatccgctctgggaaaatctatgtgaatgatctgcctgtgattctatgtattctgaggatatcaatttccgacctggaaatgcggcaggccctgaaaacagtcgacatcgatgccttccaggatgccttgaaaattttttgccggattaaggggggacgcgtgagcacagacgatgtgttcgcagttctggatagtatgggaataccaatcaatagagagattctagaggaagtgaccaagcacacctacattgatagtaatcacatggttgatatcggcgacatcattttcaccctaaatgagctgcaggagcaatacgaggatgtttctatcaccgaaggttctcccctgaatgagattacaagtgacaggaaacttagctcagttgccggatgctaccttaaatacaaaaaaaaaaattcactctcaagtaaattgccagagccatccatcagcaagaagctgaacaagaaatcaaaccaatattacagcaagattatggagaacgatgacctggaatctaagcgtcccaagaacacatggcagatacgaaaatttttgggtggtgtgggctcttctaacgtgggggtccaggaaccatattccaaaaatggcattaattttaagaagcacagcgaaaagggagagatacacgactccaagtccaagccccaatcacttaaatcttccaccagcctgtcgaagtcgcttgataagtcagacatctcatccattcctaaactgcaaaagcctgcagttcgaaaacattcttcattgcagaaacaagttagctcaaccgaaaaaacagcaatctctacactcgaaaacttttgtgaggccatctctaaactgcaggagaattatatcgccgctgaagaactccagtcaatcctgccctcaaccggaataaatctgttggatgaggaatttcagaaaatcgtcaccgatacaagccgcaacgaaaacggaatggtcgaactggatgatttcgttaacgcccttgccaaggagaggagctttccggagtgcaatgccctgcccggtgttatcaaggctatcgataagataaaagataagaacgtggactacgaggatttgaatacctgccttcagaattttggcatctatctcagcaaacctgagtttaagaagatcaccgagctcaccgaagctggtgagaccaaaaaagtgaacttcaaggaatttattgataccatgatgagcaatacagagtgcttctccgagaagctggtgctgcctgacgcaatagaaacgctagatgacttacggaaggagaccatgtcagtcagtgatctgtggaacacactctccagcctgaattctaacttaaagaaggacgagttcctggcagcccttgagctcgtgacagtggatgagggagataaggtacagttcgaagagttcgccaaggtggtcagaaacatgcgcgatgctgctcgtctggaagagcttcaggaagtagtgctggcggctgatctgctggaaggcgatatgatcgctggaaaaaacctcgaagattttctgcggaatgtaggcattaaatcaccaaaggaagaagtggaaaagatactgcagtcggatttcgtctccgaagataatatggtgaacattaaagactgtatgcgcgctctgcgcgacacacaaaaattttctaattatatagatttccggaaagaagcgagtaacctgaaactgcctaaggtgaacgaaatcaaggaagccgctaatatcttaagtcatgtagacaatggcaagataggaattcccgatctggagcacgcgctgaaatgcttgaacgtgaacctgacagaggaagatttcaatgaggcactcaactgttgcaatgtgagtgacaatatggaggtggatttgaaagattttctcatgaaaatgaaagaaagccctcacttccagaagtctaaggcgacccagatcttacttgcgaccactcagattcttcagaacgacctggtcgacgtgagcgatttaaaaaccttgttgatggataaggacctgcacacggcaaatgccatccttaccgtgatgttgcgccacgtcccagagcacgagagtggcaaggtgtcgattcaggagtttatgaccaaactgtccgacattcttactatacctaaggcagcgggtaaattctacctgatttgcacttactgcccagacttagagagacaggcagttgtgtacatgctgaagacaatccaggatagtattgtaaaggctcaagtgtccaagaagcagtataacatgaacattaagcagcacaaaatctcgctgcataacttctgcctcaattcaaaggcgaacattgctaaactgaaccccaactcgaaattctag

SEQ ID NO: 54038 - DNA, 1596 bp, Artificial Sequence
  Description of Artificial Sequence: Synthetic coding sequence
atggagactaaggtccacttattttgccaagccgaagagaatatcgatctgctggatgatggaagtaatagcttcgccacagatctctcctcaggaactatcaatcataaaaaatatatcaagttcagtaagactatagaaaaggaaatatctccagagattagatcacttagtcccgaatataagaaaatttttgagacctctatcatcttttgcggggaggagaagtccagtgactttagtggagagaagaaggtgggcagaaagtctttgcaagtgcagcaacatagcaagaggactgagatcatcccgccattcctgaagctgtcaaaggaaaaggtgacacgcaaggaaaattccttgtgcaaattacctaatcaatactccgttcataaaacaagttctcccctttgtaccagcagtgctataactagggaaaaagagatgctgagtaacctatacatgactctgtacgacgaggttacacacgggtatctgcattcaaaagagctgtcggcgtttcaggatgctttgaagattttctgcaggatcaaaggtggtcgggtcagtacagatgacgtcttcgcagtgctggactcaatgggcatccccatcaaccgagagatattggaagaggtgaccaaacatacttacatagatagtaatcacatggtggatatcggggacattattttcacattaaacgaactccaggaacagtacgaggacgtcagtatcactgaaggatctcccctcaatgagataactagcgaccggaaactatcaagtgttgccggttgttatttaaagtataagaagaaaaactctctgtcctccaaactccccgaaccatctatctcaaaaaagctgaacaagaaatccaatcaatactacagtaaaattatggagaatgacgatctggagtcaaaacggccaaaaaatacttggcagatcagaaaattcctggggggagttggctcttcaaatgtgggtgtccaggagccatactcgaagaatggcatcaacttcaaaaagcactctgaaaaaggcgagatccacgactctaagtctaagccccagtcgcttaaaagttcaacttcgctcagcaagtctctggacaagagcgacatttctagtataccaaaacttcagaaacccgcagtgagaaaacactccagtctccaaaaacaggttagctccactgaaaaaactgctattagcaccctcgaaaatttctgcgaggccatcagcaagctacaggaaaactatattgccgctgaggagctgcagtctatactgccaagtaccggaattaacctgcttgatgaagagtttcagaaaattgtgacagacacatcccgcaatgagaacgggatggtagagttggatgacttcgtcaacgcgttggctaaagaaagaagctttccggagtgcaacgcactcccaggtgtgatcaaagccattgacaaaatcaaggacaagaacgttgattacgaggatctcaacacctgccttcaaaattttgggatatacttgagcaaaccagagtttaagaagattaccgaactgactgaggcgggtgaaaccaaaaaatag

SEQ ID NO: 54039 - DNA, 162 bp, Artificial Sequence
  Description of Artificial Sequence: Synthetic coding sequence
atggagaccaaagttcacttgttctgccaagcagaggagaacattgatctactcgacgacggcagtaactccttcgcaacggatctgtcctccgggaccattaatcataaaaagtatattaagtttagcaagacaattgaaaaggagatctccccagaatag

SEQ ID NO: 54040 - DNA, 114 bp, Artificial Sequence
  Description of Artificial Sequence: Synthetic coding sequence
atggagacgaaagtgcacctgttctgccaggccgaagaaaatattgatctcctggacgatggcagtaattcgtttgccacagacctgagttccggtacgattaaccataagtag

SEQ ID NO: 54041 - DNA, 228 bp, Artificial Sequence
  Description of Artificial Sequence: Synthetic coding sequence
atgaaccgtctttacctgacaccggatgggttcttttttagggttcatatgcttgccctcgactcatcttcatgtaataagccttgccccgaatttaaacccggaatcgagacagatctgaacgacgccgcttacgtactgtacaccaccgtctgcaacgtcggtgccaccgcaagggctgtggggcgaccagcttttttttgggaacgctgggagactatgacatag

SEQ ID NO: 54042 - DNA, 294 bp, Artificial Sequence
  Description of Artificial Sequence: Synthetic coding sequence
atgaatcggctgtatctcacacctgatggcttcttcttccgggtgcacatgctggcccttgattcctctagttgtaataaaccctgtcctgaattcaaacccggtagtcggtacatcgtgatgggacacatttaccataagcggaggcaattgcccactgccctgctgcaagtcctgagagggaggctaaggccgggtgatggacttttgagatcttcatccagctatgtaaagagattcaatcgtaagcgggagggtcaaatccaaggggcaattcatacccagtgcatttag

SEQ ID NO: 54043 - DNA, 228 bp, Artificial Sequence
  Description of Artificial Sequence: Synthetic coding sequence
atgaaccgattgtatctcaccccagatgggttctttttcagggtacacatgctcgctctggactcttcatcgtgtaataagccctgtccagaattcaagcctggtatagagaccgatttgaatgatgccgcatatgtgctgtacactactgtgtgcaacgtgggcgctactgctagagccgtcgggcgacccgcttttttctgggagaggtgggagacgatgacctag

SEQ ID NO: 54044 - DNA, 228 bp, Artificial Sequence
  Description of Artificial Sequence: Synthetic coding sequence
atgaatcggctttatttaacccctgacggtttcttttttagagtgcatatgttagcacttgatagcagtagctgcaacaagccctgtccggagtttaagccaggcatagagactgacctcaatgacgctgcctacgtcctgtacacaaccgtgtgtaatgtgggcgcaacagcacgcgctgtgggccgacctgcttttttttgggagcgctgggagacgatgacatag

SEQ ID NO: 54045 - DNA, 1689 bp, Artificial Sequence
  Description of Artificial Sequence: Synthetic coding sequence
atgcttgcgtgcctgcccggtcccggagacttgtccttccagctgctctcacacacacaaatgaacacaggcttgcagaagtgggacaccacacagaaaatgaggactgcccactatccaactcccgcagagctcgatgcttatgccaagaaggttgcgaataaccccttgactattaaaatatttccaaactccgtgaaggtgccacaaaggaagcacgtcagacgcactgtaaacggattagatacctccgcgcagagatatagtccctatccaacacaagctgccaccaaggcaggattactggccattgtgaaggttcctgcaaagagcatcctgaaagacttcgacggtaccagagcgaggctcctgccagaggcaattatgaatccccctgtcgctccctacgcaactgtcgctccatcaaccctcgcccatcctcaggcccaggccctggctaggcagcaggccctacagcatgcccagacgctggcccacgctccccctcagacactgcagcacccccaggggatccctcccccacaggccttatcacacccccagtctctacagcagccccaaggactcgggcacccccagcctatggcccaaactcaaggccttgtgcaccctcaggcactcgcccatcagggactgcagcacccccacaaccctctgctgcacggcggaagaaagatgccagactctgatgcaccacccaacgtgactgtctctacatcaaccatcccacttagcatggcggcaactttacagcacagtcagcctccggacctttcttcaatcgttcaccagatcaaccagttttgccagacaagggccggaatttctaccacgagcgtctgcgagggccagattgccaatccctcccctatatctcgctcactgctgattaacgcttctactcgtgttagcacgcattccgtccctacaccaatgcctagctgcgtggtcaatcctatggagcatacccatgccgcaacagctgcactgccagccgcagggccagtgaatctgcctacgggcatctcccgtgtgccaacgggatacccatccgacttaaagccggtcacatggaaccagcaccagctcgctcaccttcaacagatgtgctccgaagctagcggaactcctgcacccggtctgacagggaagcacgctgccggtagggaactagccggacccggatttgtcggcaaggcacccgcatacccacaagaactatgcttggcccagtctttccatctgaaacccccactggagaagccaactccgagccccccagtgaatggtatggctgccccattggcttacccaaatggacactatttccagcccctgtggaataacatcctgcccacccccaacagcgattcaagtgggtcccaagacctggctatgccttttcatggcggacagcctaccggagctcccctggattgtgccgcagcgccaggggcacattatcgagccggaactggcggtggacccgtagcgtcccaaaactcactgatgcaaaccgtggattacctgtccggcgattttcagcaagcgtgtttcagggaacagagcttagccatgttatccaaggcccacagggcaccaggtaacagggcccctgatcctaccgaaagcaggtccttgcacatccagcatccaggttaccgctag

SEQ ID NO: 54046 - DNA, 1689 bp, Artificial Sequence
  Description of Artificial Sequence: Synthetic coding sequence
atgctagcctgccttcccggtccgggagatttgagttttcagttgctgtctcacacccagatgaacacgggcctgcagaaatgggacacgacccagaaaatgcgcacagcccattatcctactcccgctgagctcgatgcctatgccaaaaaggtggcaaacaaccctctcaccattaagatcttccctaactccgtgaaagtccctcaaagaaaacacgtcaggagaaccgtgaacgggctggatacctccgctcagcgctatagcccttatcccactcaggctgcaactaaggctggactgctagcgatagtgaaggttccagctaagtcgattctaaaagactttgacggaaccagggcccgactcctccccgaagcaatcatgaatcctcccgtcgcaccttacgcgaccgtggcaccaagcaccctggctcatcctcaggcccaggccttagcccgacagcaagcactccagcacgcccaaaccctcgcccacgcaccaccccaaactctgcagcacccacagggtatccctccccctcaggccctctcccaccctcaaagcctgcagcaaccacagggactggggcaccctcagccgatggcccagacacaaggcctggtgcaccctcaggccctcgcccaccagggactgcagcatccacacaatcctctgctgcatggtgggagaaaaatgccggatagcgacgctccccctaacgtgacagtgtcaacatctaccattcccctgagtatggcagccacactccagcattcccagccccctgacctgagtagtatcgtccatcagatcaaccagttctgccaaacgcgcgcaggaattagtacaacctctgtctgtgagggtcaaatagctaacccttctccaatcagtcgtagcttgctgatcaatgccagcactcgcgttagtacccacagcgtgcctacgccaatgcctagctgcgtagtcaatccaatggagcatactcacgccgcaacagccgctctgccggctgccggacctgtgaatctacctacaggcatttcaagagtccctacaggctatccttccgacctcaagccagttacctggaaccagcaccagctggcgcacttgcagcaaatgtgcagcgaggcctctggcacccccgcacccggtcttaccggtaaacatgctgcaggtagagagctcgcgggtccaggcttcgtgggaaaagcacccgcttaccctcaggagctgtgcctcgctcaaagtttccatctcaaacctccccttgagaaacccactccaagtccaccggtgaatgggatggccgctccgttggcctatcccaacggtcactatttccaacctctatggaataatatcttgcccaccccaaattctgacagcagtggcagccaggacctggccatgccttttcacggcggtcagcccacaggcgcacctctggattgcgccgctgctcctggggctcactacagggcaggaacgggaggtgggccagtcgcgagccaaaatagtttaatgcaaacagttgactacctgagtggcgatttccaacaggcttgtttccgtgaacagtcactggcaatgcttagcaaagctcatagggctcccggaaatcgagcccctgaccccactgagagccgctctttgcacattcagcaccctggatatcgttag

SEQ ID NO: 54047 - DNA, 711 bp, Artificial Sequence
  Description of Artificial Sequence: Synthetic coding sequence
atggaagccagcgacgggcaggggggagagggagacaagcctctggagcaggttaccaatgtgagctgcttggaaacctcaagcagcgcttcccctgcccgtgactcactaatgaggcatgcaaaaggcttagaccaggacacttttaagacatgcaaggagtatctccgcccactcaagaaattcctgcgtaaattgcatctgcccagggatctgccacagaaaaagaagcttaagtacatgaaacagagtctcgttgtgctgggtgaccacatcaatacatttctgcagcattactgccaggcttgggaaattaagcactggcggaagatgttgtggcgattcatttccctctttagtgaattggaagccaaacagctgcggagactatataaatatacgaaatcatcacagccagccaaattcctggttacattttgtgcttcagacgctcctgagcggagtctcttagcagaccgtgaggactctttgcccaagttgtgtcatgcatggggcttgcattcaaacataagcggcatgaaggaaagactgagtaacatgcagacgccagggcaggggtcacctctgccaggccagccgaggagccaggatcatgttaaaaaggactctctccgcgaactgtcccaaaagcctaaactgaagcggaagagaataaaagaggctccagagacacctgagacggagccttag

SEQ ID NO: 54048 - DNA, 582 bp, Artificial Sequence
  Description of Artificial Sequence: Synthetic coding sequence
atgtcaggtccaccctctgcaccacaaggcgctctagccgctccgaggtctcccgcagtgcgcagaaagggcttgcaggccccttcatgggggtcgcccggacgtcctgctgcacatagtccttgggcgtgcggtcccccacattggggccctcagagaggccctcggaacgctgcggcagctcggcctggacctaggtcacgctggcacaagagatgtgctgccgcatgtggggcatgtgccaggccgccaggccatcaactccagccaccgggagccggagcacctcagccaggtgtagcatgtagctacctgggcccaagacctcagcgaaccccctgcagcgcccagtctcggcctggatggtgcgccggtccaaggcgtagacatgcacctggcaccgagccacacgttgctccgggtcgtgcccctccaccaagggcaggggcatcacccggatccagattgcttccaggatctcccagtcttctcttgccagccgctacatggcgcacctggggacaagagtccaaggtgctccgtaaaatactcaaggcatgggacccctttagtctcttgtag

SEQ ID NO: 54049 - DNA, 1713 bp, Artificial Sequence
  Description of Artificial Sequence: Synthetic coding sequence
atggcttacgaaaaaagcacagatatttcggacgtctcgcgttccatgttcctgtacccatggttggagtatccagacaaaacaaaagagcttagaaaggcaatggctcctgttcacctgccactctcatgctatcagatgccgaaggaggaattccctccctccccagaatgctggcgccaacacccatcaaagcccaatagtgtaccttattgttacttcaaaaagcccgagatctatactcactggcatgatctgtacgaccagagggaggagcgggaggcggagaagatgctacgcaaaatgcgggacgactgcaggtacataaaggaagtgcatcaaacccatattaaaatgttccacttacctatgtcaaaactgaccatcaagtccgagatgcgcagccgccctctggagcctacgcaggatcccctgaagtggcagcgccttcgggaactgacgaaaagccttgagtcacctcgggaagatgaacagttttatgcagcccaggccctcggatgtctgcgaatctcggataagttcgtaatggaggctctacaacaggttgctcagactggcccagagaaagttaagtatgaggcttataggacattagctattctggggtgcctcaataagcacgtgatccgggcactcatcaaacagcttaaggaaaaaaatgagggacagcgtatggagacattaactggattacgcatggcattaaactcttgggctgccgtctcaaaagacaaacggacccaggtgggcgacgagggaaagctcgtcccggtattgcaaactctgattaaaaaatctagtagtgaagcctccttagaagcagcattgtgcctggggtttcttcggccttgtagtaatatggtccaggaatttctcctccagtgcttgtgtcaagggctgaagactcagcgcatgaaggctcttcgtatgctcgttaaagtgatgcatgtccatagtgcacccgtgattaaggcgatcttggatcagctgtgcagcagctccgtgcttgaggatagatttgaagctacacagatgttgaagacaattgggctcgaacagattcaggcccagggactggaagagctcacctttaatcttctgcgcagaaaaacacataacgaacccttcctggcagtgaggcaagccgttgcgcagactgttgaagagctgaagttaaagcccaccatgatgaacctggtcgaggcccagctgatgaaccctgacgccacagctcgtcaggaggcggtcataagtcttggtgtccttggcatccgcagtccacaggtgtttcacttgttgttggacttgcttgatgcagagaaccatcaagcagttaagaaaagcctgcaggagactctgatactatgcgcgagcatcgatccctggatacaaaataaattgaagaataaagtactgtctgtctacgaagcacctaagaccaatgttaaagctgaaccaactagatttcagaaagagcctgagaatccagaggagctgactattcaggatttcagattggctaagcttaatcctttattcatcgcaaagagtattacaaaagtgggtcaaaagaaaactcccgcttttcctccgtgttgttcaaagccaagaaagcatagaccacaggtcattgggccttggcagccaaggattaaaaaacaactgcgggtgctggcagagatcgcaaaatag

SEQ ID NO: 54050 - DNA, 1422 bp, Artificial Sequence
  Description of Artificial Sequence: Synthetic coding sequence
atgttgccaggccctgccctccgcggaccagggcctgcccagtatcagcgcccaggtatgtctccgggaaaccgcatgcccatggccctggcgggaggcaccccatgttggctgcctatttggtgtagctcaagtgcatcaacctggcacgcaactcatcacgacggatccatccctaaaacaccggcttgcgcaccccagccacctatgcccgctcagcgccgaggtttaaaacggaggaaaatggccgacaaggtgcttcctcagcggattcgggaactggttcctgagtcgcaggcatacatggacctgctggcattcgagaggaagctggaccagactattgccaggaaaagaatggaaatccaagaggcaattaaaaaacctctgacccagaagcggaagctgcgcatatacatctctaacacgtttagtccgtctaaggcagaaggagacagtgccggtacggctggaactcccggtgggaccccggctggtgataaggttgcatcctgggaactgagggtggagggaaagctgctggacgatccatccaagcagaagaggaagttttctagcttcttcaagtcactagtgatagagctggacaaggagctttacggacccgacaaccatctggttgagtggcacaggatgcctaccacacaagagacagacggtttccaggtgaagaggcctggagatctgaacgtgaaatgtaccctgttgctgatgttggatcatcagccgccacagtataaattagatccacggctcgcacgtcttttgggggtccacacccagacgagagccgctattatgcaagctctgtggctgtacatcaagcacaaccagcttcaagacggccatgaaagggagtacataaactgtaacaggtattttaggcagatctttagctgtggacgcttacgtttttccgagattccgatgaagctggcaggcctgctacagcatcctgaccctatagttattaatcatgtgataagtgtagatcccaatgatcagaaaaaaactgcctgttacgatatagacgtcgaggtcgacgatcctttaaaggcacagatgtcaaattttctcgcaagtaccaccaatcaacaagaaattgcatctctcgatgttaagatccacgagacgatagagtccattaaccaattgaaaacccagagagattttatgctgtcgttcagcacagatccccaagacttcatccaagaatggctgaggagccaacggcgtgatctcaaaatcatcacagacgtaattggcaatccggaggaagagaggcgggctgccttctaccaccaaccttgggcccaggaagccgtgggtcggcacatctttgctaaagtacagcagcggagacaggagctggagcaggtcctggggatcaggttaacgtag

SEQ ID NO: 54051 - DNA, 570 bp, Artificial Sequence
  Description of Artificial Sequence: Synthetic coding sequence
atggcctcaggtgccggaggcagttggggacggtctcctccccagtccgccgtccctacaccttgggtaacctttctgcagccactgtcctgggcggtcccgcctgcacctccacagcctgggagagtgaaggaggatttactggagcttatgatgttacagaacgcccagatgcatcagcttctcttgtcccggctcgtggctggcgctctacaaccacgacccgctagcccctgtcctcaggtgtacctcgaggtgccacaggaagagcctgaggaagaagaggaggagatggatgtgagagagaagggcccactagtctttcatcatcactacctcccatacctcatgccttctcccggagctctgcttccctggcctgcaccctttttcccaaccccagcctgtcagccatacttgcaggatgtaccaagaatccagcactgtcccgcttcacgggagcgggaggtccgcgctgttccacctcccccacccccttctgccactgggaccgtaggagcagatgttcctcctgctagcgactactatgacgccgagtcactgctgtag

SEQ ID NO: 54052 - DNA, 711 bp, Artificial Sequence
  Description of Artificial Sequence: Synthetic coding sequence
atggccagtggagccggaggttcatggggcagaagccctccccagtcggcagtcccaaccccttgggtgacatttctgcagcctctctcctgggccgtgccccctgcgccaccacagcccggtcgtgtcaaggaagacttgttggaactcatgatgctccaaaatgcacaaatgcaccaactgctgttgtcccgccttgtagccggagccctgcagccccgtcccgcttcaccttgtccacaagtctatcttgaagtgccacaagaagagcccgaagaggaggaagaggaaatggacgtccgtgagaagggtcccttagtgtttcaccaccactacttaccctacctgatgccttccccaggtgctttgctcccctggccagcaccattttttcctactccggcatgtcagccctacctccaggacgtgcccagaattcaacactgtcccgcaagcagagaaagagagaccacaatgatgccgagagctagctacgaggatcggccacgcccatgggaactccaccaactgccagcgttggataccgctccggaacccccacccgctccactgctgagtaccccacgatgcccgtggctcgccgtgttgctcacacctagcacttctgcacgcccttccagcccaggtgagatttctccttgtcctacaccaatgtcctcttggacaggcagaatctgtgcggtcgtctag

SEQ ID NO: 54053 - DNA, 420 bp, Artificial Sequence
  Description of Artificial Sequence: Synthetic coding sequence
atgatgttgcagaacgcccaaatgcaccagctgcttctcagcaggctggtagctggcgctctgcagccacgcccagcctccccctgcccacaagtgtacctggaggtaccccaggaagagcccgaggaggaggaagaggagatggatgtgcgcgaaaaaggaccgctcgtcttccaccaccattatctgccctatcttatgccctcaccaggtgctctgcttccttggcctgctcccttctttccgacacctgcatgtcagccctatctccaggacgtgcctaggattcagcattgtcccgcatcccgcgaacgagaggtccgggcagttcctcctccccctcctccgagtgccacagggaccgtgggtgctgatgtcccccctgcatctgattattatgatgctgagagcctgttatag

SEQ ID NO: 54054 - DNA, 297 bp, Artificial Sequence
  Description of Artificial Sequence: Synthetic coding sequence
atggcatctggcgctgggggtagctgggggaggtcacccccacagtccgctgtccctacaccctgggtaacgtttttgcagcccctgtcctgggcagttcctccagcacccccacagcccggaagggttaaggaagatctcctggagcttatgatgctacaaaatgcccaaatgcaccaattactgctcagtcgtctggtggccggagcattgcagccccgacctgcatctccttgccctcaagaatcttgcgcacctacccccaccccccagtgccacagagactgtggatgctag

SEQ ID NO: 54055 - DNA, 1506 bp, Artificial Sequence
  Description of Artificial Sequence: Synthetic coding sequence
atggagaatcagctgtggcataacacagtccgctgttgcaaccagtatcaggagagcccccacgatgcagaggacattctgttactgctgctgggactgattgtcctggttaacattggtatcaacgtggctactatgatgtggcacggactacaaaacgccttggacaagatgattgattgggccacacagaagaatgaaatccaggcctccgagtctccacccagcggtcccccagacaaggctcaagacgtgcacattcattgtatccttgatcctgtacaggttaaaatgtctcgccctactcagtactcttcttttagttgccaccacttttccaatcaccacagcagcagcctcttgagatgtgtgcgcagaaggaggcggaggcacaggagatgcaggcggagatgttgcaaccaccagcaaagaccacagaactatagacagatccctcattcccacagcgtctttagaaacccccataggtctcaaaagatgagtcagttgcaccgcgtgcctttctttgatcaggaagaccccgactcctatctagaagaagaggataatctcccattcccctatcccaaataccctcggagaggctggggaggtttctaccagagggccggactgccgtctaacgttggcctgtgggggcaccaggggggtatactggcctccctgccgccaccttccctgtatctgtccccggaactaagatgtatgcctaagcgcgtggaggcacgatcagagctaagactacagagttatgggcgtcacgggagccagtcacggttatgggggaatgtggaggctgaacaatgggctagctctccccctccgccacaccgtctgcccccaaatccctcctgggtccctgtcggccatagcccatatccgagtgtggggtggatgttgtatgattcctgggatcagcggaggagaggaacagagggatttgagcgccctccggcaagcgttagccggaacgcgcgaccggaggcccaaggatgtcgagagcaccacagtccccagtctcatcagcagtcattgctgggtcacgcctatggccagagtcataggagcccccacccctctaccgaaccactcggctattcctcacaggacccacgggaggtgagacggagggcagcagattgggccgaggccctgcctgcctggaggcccctgaccaccagtgcctcgctgaccgtcctggatgaagcgtcacaccagcggacccctgctccaagtagcgtccttgtgccccactctagccagccttggccaaaagtgcaggcagcagatcctgcgcctccaccaacaatgtttgttcccctgtcaagaaatccaggcggaaacgccaattaccaggtgtatgatagtctggaattaaaacgacaggtgcaaaagtcaagggctcgctcatcttcgctccccccagcctctacatcgacccttagaccctctctgcatcggagtcagacggaaaaactcaactag

SEQ ID NO: 54056 - DNA, 1812 bp, Artificial Sequence
  Description of Artificial Sequence: Synthetic coding sequence
atgtccggttactcgtccgacagggaccgaggcagggatcggggtttcggtgcacctcgctttgggggttcgcgcgctgggccactgtctggaaagaaattcgggaacccaggagagaagctcgtcaaaaaaaagaacttctaccaggaacatcctgatctggcaaggcggactgcacaagaagttgagacctaccggaggtccaaggaaatcaccgtgcgtggccataactgccccaaaccagtgttaaatttttacgaagctaatttccctgcgaacgtcatggacgtgattgctaggcagaatttcacagagccaaccgcgatccaggctcagggatggccagttgcgctcagtggcctggacatggttggggtggctcagactggctccggtaaaactttgtcttacctgttgcccgcaattgtacacattaaccaccaaccttttttggagaggggggacgggcctatatgtctcgtgctggccccaacaagagaactggcacaacaggtacagcaggtcgctgcggaatactgccgcgcttgcagactgaagtccacctgcatatatggcggagcacccaaagggcctcaaattcgcgacctggagagaggagttgaaatttgcatcgctaccccgggtaggctgatcgatttcctggaatgcggcaagaccaacctcaggagaacaacctacctggtcctcgacgaggcggaccgaatgttggatatgggattcgaacctcaaattaggaaaattgtggatcagatccggccagaccgacagacattgatgtggtctgccacttggcccaaagaggtacggcagttggcagaagactttcttaaggactacattcacattaacattggagcactggaactatctgccaatcacaacatcctccagattgtggacgtgtgccacgatgtggaaaaagatgaaaagctgatcagactgatggaggagataatgtctgaaaaagagaacaaaacaatcgttttcgtggagaccaagaggcggtgtgacgaactgactcggaaaatgcgtcgagacggttggcctgcgatgggaatacacggagataagtctcagcaggaacgtgattgggtgctgaatgaatttaaacacggaaaggctccaattttgatcgccactgatgtcgcttctcgtgggctagatgtggaggacgtgaaatttgtaataaactacgactacccaaattcatccgaggattacatccaccggattggtcgaacagcccgtagcaccaagacaggcactgcctacaccttcttcacccctaataacattaagcaagtatctgacctcatctccgtcctcagggaggctaaccaagccatcaaccctaagttactacaactcgtggaggaccggggatctggtagatcccgtgggagaggaggaatgaaggacgaccggagggaccgatattctgcaggtaagcggggagggtttaatacctttagagatcgtgaaaactacgaccgaggctatagttctcttctgaagagagacttcggtgcaaaaacccagaatggcgtctattcagcggctaattatacaaacggctccttcggtagcaatttcgtgtcagcgggtatccagacctcttttcggactggtaatcccactggcacttatcaaaatggctacgattcaacacagcaatatgggtcgaacgtaccaaacatgcacaacggcatgaaccaacaggcctatgcttacccagccaccgccgctgccccaatgattgggtatccaatgccaaccgggtactcccaatag

SEQ ID NO: 54057 - DNA, 1191 bp, Artificial Sequence
  Description of Artificial Sequence: Synthetic coding sequence
atgctgccctcattgcaagagagtatggacggagacgagaaagagctagaaagcagcgaggagggcggatccgcagaggagcgtcggttggagcccccatccagctcccactactgcctatactcctaccgtgggtccaggctcgcccaacagcgtggcgattccgaggacggcagtcccagtggaaccaatgccgaaacccccagcggagacgacttttcactctcattggccgatacaaatcttccctctgaagttgaaccggagctacgctctttcattgctaagcggctgagcagaggagcagtcttcgagggcctgggtaacgtggccagtgtagaactgaagattccagggtatcgtgtggggtgctattattgtctcttccagaacgagaagctgctacccgagaccgtgactatagactctgagcgaaacccaagcgagtacgttgtctgttttctgggaggctcagagaaggggctagaactcttccggctcgagttggacaaatatatacaggggttaaaaaataatatgaactgtgaagctaggggcctggaatcccatatcaaaagctacctgagctcatggttcgaagatgtcgtgtgtcccattcagagagtggtcctgttgttccaggagaagctgacattcctgttgcacgctgctttgtcctacacaccagttgaggtgaaagagagcgatgagaagaccaagcgggatataaatagattcttgtcagtggcgtccctgcaaggtttaatacacgagggtacgatgacttccctgtgtatggccatgacagaggagcagcataagtctgttgtgatagactgctctagtagccagccacagttctgcaacgctgggagcaatcgattttgtgaagactggatgcaggcatttcttaatggggcaaaggggggaaacccgttcctcttccgccaagtcctggagaactttaagctgaaggcaatccaggacaccaacaacctgaagcgttttatacggcaagcagaaatgaatcactatgcgctgtttaaatgctacatgtttctgaagaactgtggtagtggagatatcttgcttaagattgtgaaagttgagcacgaagagatgccagaagctaagaacgtgattgccgtattggaggaattcatgaaagaagctcttgaccagagcttctag

SEQ ID NO: 54058 - DNA, 732 bp, Artificial Sequence
  Description of Artificial Sequence: Synthetic coding sequence
atggatgagcttgcactgagctttagcctaacatgcctgttgccagagaacagggccagcttgtccccatcgcagccattgagctttcagtgccttaaggcaccagctaccctgacctgggaggacgagaagcagcagagatgggggcaaccgcatgggccagtcagcagtccccttctgggcgaccatcgctgtttggttcccttcagggacctgaatccctcaagtgaggtcaatactgctaacctgcttgaatccccctcttctctgttgctcacaagctgctatatatgtagctatttctctttttatattcttggcgagaaacggtgtcactctctgaaaagattgagatactctgtatgttgtaaagtctgccctaacttttgtgcttgcggcaaagaaaacgtctcagggactgggcaagtgtgtactggggttcacgtcggggcaaaagaacaagaggagcccggtggcacccaagcactgcgctcctgcgggatttattgtctggaggagcgaaccgataaggccagccatgaggaatgccgggagagatccactttagggagaccccaatgtaccgggctgactcccagtctggcaggtgaaagcccatgcccaagactgctccccggatccccgaccgtgaggcatttgatcgcctcttcttgcccgggtctgtcagaccctctcccgttaccacctggtaccctccccctcggcagctag

SEQ ID NO: 54059 - DNA, 732 bp, Artificial Sequence
  Description of Artificial Sequence: Synthetic coding sequence
atggatgagctggctctttcctttagcttgacttgccttctccctgaaaatcgcgcatcactgtcccccagccagccattgagcttccagtgtctcaaagctcctgcgacccttacctgggaggacgaaaaacagcagaggtggggacagccccacgggccagtgagttccccactgttgggagatcacagatgtcttgtaccattccgggacctcaacccaagctccgaagtgaataccgcgaacctgctcgaatctcccagttctctcttgctcacctcctgctatatttgcagctatttttccttctatatcttgggggagaagagatgccactctctgaaaagactgcggtactccgtctgctgtaaagtgtgccctaacttctgcgcctgcggaaaggagaacgtgtctggaacaggccaagtgtgcaccggagtgcatgttggagccaaggaacaggaagagccgggaggcacccaggcactgaggagctgcggcatttactgccttgaggagcgtacagacaaagcaagccacgaggagtgccgagagcgttcaactttggggcgaccccagtgcactgggttgaccccttccctggcaggcgaatccccttgcccccgattactgcccggtagtcccaccgtccgacatctgatcgcgtcaagctgccctggtctcagtgatcctctcccgttgcctccaggtactttaccgctagggtcatag

SEQ ID NO: 54060 - DNA, 117 bp, Artificial Sequence
  Description of Artificial Sequence: Synthetic coding sequence
atggacgaactggcgctgtctttctctctcacatgcttactaccggaaaaccgagcttccctgtccccaagtcagccactctccttccagtgtctgaaggcaccagccacactgtag

SEQ ID NO: 54061 - DNA, 756 bp, Artificial Sequence
  Description of Artificial Sequence: Synthetic coding sequence
atgggccgacctctagaaggtcaaccgctgagagcattagacctctacccagagccagcctttctgagatccggcaaggacccaaagagttctcccgcttccagtccctcgtttgcagtactgggacccgaagtgaggagcactgggggtcaggcgggtagccgaaggcgtccatcggctccttgctcccaggatcgggcagctgccgaaggcgcaccggcactgcttggaggatcacctagtagtgggtcacccggacatccccctgggtccgcgtttggggtagaggctggctgccgagcgctgaacgtgtccgaacacgcaagaggaggattcgccctgggactgccctttggactcagcgggggtgcctacctgtttcttttgctcgacggtgctggggatcccaaaccaaccccggaggcccctatttccagtgccgacggccgagcctggtttcccagtgagtcctcctggcagctgccgcagctgcccgctggatctacaagcggtagtgagccaagggctcggccaggcttggggccaaggcagcttctgaccggacctagggatggagcagcgggacaaggcccaggaagggggttgactgcaaggctgggccgtgaacgagagatcgactgtgggcctcggcaagcgggacatggcggtaccgctaccgacaccgggcgagctggcagtggggcaagacaccggccacccagggaccgaggaacacccggtttaagaacccattag

SEQ ID NO: 54062 - DNA, 435 bp, Artificial Sequence
  Description of Artificial Sequence: Synthetic coding sequence
atgactcggatgactaggccactgaagagccacgtgcaagtggttccatctaccctcatgtggcaatcccaggcgcgaactcagccagcaccgctgtgctgtaagttgctgacaccaaggtggttaccattgttgctgccgacgcacccccattcgcattgccttgctggccacttgtttttccccgcacggtacagctgtagcagcgagtggaaacagcaactgacgtgccatctttgcgttaccgattctgcaccgccacgccacaccggagtagtcgtgtcggaacatcttaggaggaccgaaaagctgttttttaccatcctgagccccaaccagtccaaaccatttaagacatggaagatgctgaaggccaccattcctatttttgtctgtttcctgctgaatctagcccagaaccctcgcccactgtag

SEQ ID NO: 54063 - DNA, 1023 bp, Artificial Sequence
  Description of Artificial Sequence: Synthetic coding sequence
atgaagtacgggaaccccaattatgggggtatgaaagggatcctctcaaatagctggaaacgtaggtaccatagtaggaggattcagcgtgacgtgattaaaaaaagggccctgatcggtgatgatgtggggctcaccagctacaaacataggcactcaggtctcgtaaatgtgcctgaggagcccattgaggaggaagaggaagaggaagaggaggaggaggaagaagaggaagaggaccaggacatggacgccgatgatcgggtggtcgtggaataccacgaggaactgcccgcactgaagcagccacgcgaaagaagcgcctcccgccgttcttcagcctcctctagcgatagtgatgagatggattacgatctggaattaaaaatgatctccacaccctctccaaaaaagtccatgaaaatgacaatgtatgccgacgaggttgagtcgcagctcaagaacatccgcaatagcatgagggccgacagtgtttcttcttctaacatcaagaatcgcatcggaaataagctgccacctgaaaaatttgccgatgtgcgccacctgctcgatgaaaaacggcagcactcacgcccacgacccccagtgtctagtaccaagtcagacattaggcagagactggggaagcggcctcactcaccagaaaaggcgtttagttctaaccctgttgtgaggagagagccctccagtgatgttcactcccggctgggcgtgcccagacaggattctaagggactgtacgctgatacccgggaaaaaaagagtggtaatctttggacccggctgggttccgctcctaagacaaaggagaagaacactaaaaaggttgatcaccgggctccgggagccgaagaggacgattcggagttgcagagggcttggggcgcattaattaaagagaaagaacagtctcgacagaaaaaaagcagactcgataatctgccctcattgcaaatagaggtgtctcgtgagagctctagcggatccgaggcagagagctag

SEQ ID NO: 54064 - DNA, 1863 bp, Artificial Sequence
  Description of Artificial Sequence: Synthetic coding sequence
atggccgcagtcagaggcttacgcgttagcgttaaagctgaagctcccgctgggccagcactaggcctgccttccccagaagctgaatctggcgtcgaccgcggagaaccagagccgatggaggtggaggaaggcgagctggaaatcgtccccgtccgcagaagcctgaaggagttaatacccgacacatccaggcgatacgagaacaaggccggttccttcatcaccggcatcgacgtgacatctaaggaggctattgagaagaaagaacaaagggccaagcgttttcattttcgtagcgaagtgaacctggctcagcgaaacgtagcactcgatcgagacatgatgaagaaggccatccctaaggtgcggctcgaaaccatatatatttgcggagttgacgagatgtccactcaggacgtgttttcatactttaaagagtacccccctgcccacatagagtggctggatgatacctcctgtaacgtagtctggctcgatgaaatgactgccaccagagccttgattaatatgtccagtctgcctgcccaggacaagattaggtcacgcgatgcatccgaagacaaaagcgcagagaagcgcaaaaaggacaagcaggaggattcgtcagacgacgacgaggccgaggaaggtgaggttgaggatgagaacagttcagatgtcgagctcgacacattaagccaggtggaggaggagagtctgcttcggaacgatttgagacctgctaataagttggccaaaggcaatagattgttcatgagatttgccacaaaagatgataagaaggagctgggggctgcccgtcggagtcagtactatatgaagtacggcaacccgaattacggcggaatgaagggcatcctgagcaacagttggaagcgacgctaccatagcagacgaatacagagggatgtgattaagaaacgtgccctcatcggtgatgatgtcgggctaacttcgtacaaacaccgacacagtgggctggttaatgtcccagaggaacccatagaagaggaggaggaggaagaggaggaggaagaggaggaagaagaggaggaccaggatatggacgccgatgaccgggtagtcgtggagtaccatgaggaactacctgctttgaagcaaccacgcgaacggtccgcttctaggcgaagctccgctagcagctcggatagtgacgagatggattacgatctggagttaaagatgattagcacccctagcccgaagaagagcatgaaaatgaccatgtacgcagatgaagtcgaatctcagttgaagaacatccgcaactcaatgcgcgctgattccgtgtcgtcctccaatataaagaacaggatcgggaacaagctcccaccagagaagttcgccgatgtcagacacctacttgacgagaagcggcaacactctaggcctaggccccctgtctcctctactaagtccgatattagacagcggttgggaaagagacctcactcaccggaaaaggcattcagctcgaatcctgtggtgcgcagagaaccgtccagcgatgttcacagccggctaggggtgccacgccaagacagcaagggattgtatgctgatactcgggagaagaagagcggaaatttgtggacaagactgggctcagcccctaagactaaggagaaaaacactaaaaaagtagaccatcgtgcacctggcgctgaagaggatgattcggaactacaaagagcctggggtgcactaatcaaggagaaggaacagagtaggcagaaaaagagccggctagacaatctgcccagccttcagattgaggtctccagggagtccagtagcgggagcgaagccgagtcctag

SEQ ID NO: 54065 - DNA, 1140 bp, Artificial Sequence
  Description of Artificial Sequence: Synthetic coding sequence
atggagaccctctgccccgcaccacgccttgcggtgcccgctagccctcggggttccccatgttcgccaacccccaggaaaccttgtcggggtacacaggagtttagtcccttgtgcttacgagctctggctttctgtgctctcgcaaagcccagggcaagttccctagggcctggccctggtgagttggccgctaggtccccggtactgcggggtccccaagctcctctgcgcccaggcggatgggctcccgatggtctcaagcacctgtgggcgcctaccggacgaccaggtgtgcccaacacagcagctggcgaagacgcagatgtcgctgcctgtcccagacgtggggaggaggaggaagggggtgggggtttccctcattttggtgtcaggtcatgcgcaccccctggaaggtgcccagccccaccccatcccagagagagtacaacttcattcgcgagtgctcccccacggcctgcgcctgggttggaaccgcagcggggtcccgcagctagtccaccacaggaaccgtcatcacgcccacctagccctccagccggtctgtcgacagaaccagccggtcctggtactgctcccagacctttcctcccagggcaacccgctgaggtggatggaaacccgcctcctgcagctccagaggcccctgccgcatccccctctacagctagcccagccccagccgcaccaggagatctgcgccaggagcattttgaccggctgatcagacgttcaaagctctggtgttacgctaaaggcttcgccctggacaccccgtcactacgcagggggcctgagagaccccctgcaaaaggccctgcgcgaggagcagcaaagaagcgtagactgccagccccaccgccacggacagcccagcctcggaggccagctccaacactgcccaccacctcaacttttagcctgctcaactgctttccgtgtcctccagccctggtggtgggcgaagacggagatctaaaacctgcctcttctcttagattgcagggggatagcaaaccccctcctgctcatcctctctggcgctggcagatgggcggacccgctgtgcccgagcctcctggactgaaattttgggggataaacatggacgagtcttag

SEQ ID NO: 54066 - DNA, 1272 bp, Artificial Sequence
  Description of Artificial Sequence: Synthetic coding sequence
atggaaaccagagggcctggcctggcagtgcgggctgaatctcggagacttgttgggatcggccctcgcgcacccccaggcagagtaggcctccagccaagtggccgacttgaccggcgtggtggtgcgggaactatgggatataaggacaacgatggcgaggaggaagagcgggaaggaggcgcagccggtcccaggggtagcagattgccacctataactggcggagcctcagaactggcgaagaggaaggtgaagaagaagaaaaggaaaaagaagacaaaaggctctggtaaaggtgacgacaagcaccaatcacagtccctgaaatcccagcctctgtctagtagttttcatgatattctcagcccttgcaaggagagaggacccaagcctgagcatcggcaatcgaaagtagaaaaaaaacaccttcccagcgatagttccaccgtgtccctgcccgacttcgcggaaatcgaaaatctggctaacagaataaatgagtccttgcggtgggatggcattttggccgacccagaagccgaaaaggaacggatccgtatctacaagctgaatcgtaggaaacgctataggtgcctggccctcaagggattccaccctgatccagaagccttgaagggattccatccagacccagacgccttgaagggttttcatccggatccagaagccctcaagggctttcatcccgacccagaagcccttaaggggatccatcctgaccccgaggccctgaaggggtttcatcccgatccagaggccttaaagggattccatcccgacccagaagccctgaagggctttcacaccgaccctgaagcactaaagggttttcacattgacccagaggctctgaaaggttttcaccctgacccaaaagcgctgaaaggctttcaccctgaccctaaagcgctcaaaggattccacactgaccccgaggctttgaagggattccatcccgacccaaaggctctcaagggcttccatcccgatccggaagcacttaaaggattccatccagatccggaagctcttaagggattccatcctgaccccgaagctctaaagggcttccataccgatccaaacgcggaggaggcgccagaaaatctgccctacctgagtgataaggatggctcttcttctcacaggcagcccacctcgaaggccgagtgccctaacctttgtttcgagggaaacctaactccaaaactactgcattccgacctcgccccaaccctgctggagtag

SEQ ID NO: 54067 - DNA, 465 bp, Artificial Sequence
  Description of Artificial Sequence: Synthetic coding sequence
atggcatatttgagcgagtgcaggttgcgcctggagaaaggcttcatcctggatggcgtcgcggtcagcactgccgcacgcgcatacgggagatcccgaccaaaactatggagtgctattcctccttacaatgcgcaacaggattaccatgctagatcctacttccagtcccatgtggtaccaccactgctccggaagaccgatcaggaccacgggggaacaggaagagacggttggatcgtggattatattcatatttttgggcaggggcagcggtaccttaacagaaggaactgggcgggaacaggacacagcttgcagcaggtgacaggccatgatcactataacgccgacctgaagccaatcgatggcttcaacggcagattcgggtaccgtcggaatactcctgccttgcgccagagcacaagtgtattcggcgaggtaacccattttcccttgttctag

SEQ ID NO: 54068 - DNA, 798 bp, Artificial Sequence
  Description of Artificial Sequence: Synthetic coding sequence
atgggtttgcccggattattttgcttggccgttttggcagcttccagcttcagcaaagcccgtgaagaggaaataactcccgtggtgagcattgcttataaggtcctcgaggttttccccaaagggaggtgggttctgatcacgtgttgcgccccacaacccccaccccctatcacctactctctgtgtggcacgaagaatattaaggtggctaagaaagtcgtcaagacccatgagcccgcttcatttaacctaaatgtgacccttaagagctccccggacttgctcacatatttttgttgggctagcagcacctcaggcgctcatgttgatagcgcccgactccaaatgcactgggagctgtggtcgaaacccgtgagtgagttaagagccaattttacccttcaggatcggggagctggaccaagggttgagatgatctgtcaggcgtcgtcaggttctccacccatcacaaactccctcatcggtaaggacgggcaggtacatctgcagcaaaggccttgccaccgccagccagcgaatttttcttttctgccttcacagacttcagattggttctggtgtcaagccgctaataacgccaacgtccagcattcagccctgacagtggtgccaccgggaggagaccagaagatggaggattggcaggggccacttgaatctccaatcttggccttaccattgtacagatcaacgagaaggttgagtgaagaagagttcggtggattcaggattggaaatggcgaggtgaggggcagaaaagccgcagcaatgtag

SEQ ID NO: 54069 - DNA, 903 bp, Artificial Sequence
  Description of Artificial Sequence: Synthetic coding sequence
atgtcaaggccagggattgtggagagctacgaaattacccctgttgtgagtatcgcatataaagtactggaggtgtttcccaaagggagatgggttctcattacctgttgcgcccctcagccccctccgccaatcacttactccttatgcggaaccaaaaatatcaaggtcgccaagaaggtcgtcaaaacccatgaacctgcatcattcaatctcaatgttaccctgaaaagctctcctgatttgctgacctacttctgctgggcctcatccacctctggcgctcacgttgactcagcacgccttcagatgcattgggagctgtggagcaagcccgtgagcgaattacgggctaactttactcttcaagaccgtggcgcaggcccacgcgtggagatgatctgtcaggcgtcaagcggatctcctcctattacgaacagcctgatcggtaaggacggtcaggtacacctgcagcagcgcccatgccataggcagccagccaacttcagcttcctacctagtcagacaagtgattggttttggtgccaggccgcaaacaacgccaacgtgcaacacagcgctctgacagtagttccccctggtgaacgcgctctgggctttccagagggccagctggccctcctatgtcgagagggtgctagtgtgcaggataccgggcgatgggaggtgggtcagttatacccggctactgccgagagccgggaaggcaccggtggaaatcatgcccacccgggtccctgcctgaaggaggcccagccctcctgcttgagacctctcccaggtgggctaccgcgtgcacctacaattgtcctcgttggttccctggcctccactgccgcaattacgtctaggatgctcggctggaccacctgggccagatag

SEQ ID NO: 54070 - DNA, 399 bp, Artificial Sequence
  Description of Artificial Sequence: Synthetic coding sequence
atggttaagaagtttaaagatagtaagtccgtcctgctgattacatgcaaaacatgtaacaggactgtcaagcatcacggcaagtccagatcatttgtgtccacgctgaaatctaaccccgcaacccctaccagtaagctcagtctgaaaacccccgagaggcggaccgccaatcctaaccacgatatgagcgggtctaagggaaagtcaccagccagcgtcttcaggacccccacctccggacagtccgtctccacgtgcagcagcaagaacacttctaaaacaaagaaacactttagccaactaaagatgctcctcagccaaaacgaaagccaaaaaattcccaaggtcgattttaggaatttcttgtccagcctgaaaggcggtctgttgaagtag

SEQ ID NO: 54071 - DNA, 663 bp, Artificial Sequence
  Description of Artificial Sequence: Synthetic coding sequence
atgaggcagaaacattatctggaagcggcagccaggggtttacacgacagctgtcccggacaggccagatacctgctttgggcctataccagtagccacgacgataagagcacatttgaagaaacctgcccttactgtttccaactcctcgtgcttgataatagtagagtacgcttgaaacccaaagcgagattaacccctaaaatacagaaactcttgaatcgtgaagctcgcaattatacactgtccttcaaagaggctaagatggttaaaaagtttaaagactccaaaagcgtccttttgattacatgcaagacatgcaacagaactgtgaagcaccacggtaagtcaagatcctttgtatccacgctgaagtccaaccccgctacccccacatctaaactgtccctgaagacgccagaacgcagaacggccaaccccaaccatgatatgtctggatccaaagggaagagccctgccagcgttttccgcacgccgacctcaggacaaagtgtgtccacttgttcaagcaagaatacaagcaaaaccaagaagcacttctcccaactaaagatgcttttaagccaaaatgagagtcagaagatccctaaggtggactttcgcaatttcttgagtagcctgaaagggggacttctgaagtag

SEQ ID NO: 54072 - DNA, 663 bp, Artificial Sequence
  Description of Artificial Sequence: Synthetic coding sequence
atgcgtcagaaacactatctcgaggcagctgctaggggcctgcatgacagttgtcccggtcaagctcgttatctgctttgggcatacacaagttcccacgatgataagagtacttttgaagaaacttgcccttactgtttccagttgcttgtcctggataactccagagtgcgcttaaagcccaaggccagactcacaccgaagatccagaagctcttaaacagagaggctcgcaactacacgttaagttttaaagaagcaaagatggtgaaaaaatttaaggactcaaaaagtgttctgttgattacgtgcaaaacctgcaatcgcactgttaagcaccatgggaagtcccggagtttcgtctccacactgaagagcaatcctgccacgccaacttccaaattgtcgttaaaaactcctgaaagacggactgccaaccctaaccatgatatgtctggctcgaaagggaagtctcctgcatcagtgtttaggacccccactagtggccagagcgtctctacatgtagttccaagaatacaagcaagacaaagaagcatttttcccagcttaaaatgctgctctcccaaaatgaatctcagaaaataccaaaagtcgattttaggaattttctcagtagcctgaaaggcggactgcttaaatag

SEQ ID NO: 54073 - DNA, 1212 bp, Artificial Sequence
  Description of Artificial Sequence: Synthetic coding sequence
atgaaaatggaagaagctgtgggaaaggtcgaagaattgatcgagtctgaggccccacctaaagctagcgagcaggagacggctaaggaagaggatgggagcgttgaacttgaaagccaggtgcaaaaggatggcgtggcggatagcacagttatctcctctatgccttgtttgctgatggaattgcgtagggattccagtgaatcgcaacttgctagcaccgaatccgataagccaactacaggccgagtttacgagtccgatagctcaaaccactgtatgttgagccccagttcctctggccatctggcagactccgacaccctctccagcgccgaggaaaacgagccaagtcaggccgagactgctgtggagggcgacccctctggggtctccggagcaaccgtggggcgaaaatcgcggagatcccggagtgaatctgagacttccacaatggctgcgaagaagaacaggcaatctagtgataagcagaacggtagggtagccaaagtgaaaggccatcgaagtcagaagcacaaggagagaatcagattgttgaggcagaaacgagaagccgctgctcgtaaaaaatacaacctgttacaagacagttccaccagtgattcagaccttacatgtgactcttctacgtcttcctccgacgatgatgaggaggtcagcggctcctccaagaccataactgccgagattcctgatggccctccagtagtagctcattatgatatgtctgacaccaattcggacccagaagtggtcaacgtggacaacctgctcgccgcagccgttgtgcaggaacactccaatagcgtgggcggtcaggatacaggcgctacgtggcgaacttctgggttgctggaggaacttaatgccgaggcaggacacctggatccagggtttttagcctctgacaagacgagtggcaacgcgccattgaatgaagaaattaacattgcctcctccgacagcgaggtggagatagtgggcgtgcaggaacacgctagatgtgtccatcccaggggtggggtgatccagtccgtatcttcatggaaacatggatccgggactcagtatgtttccaccaggcagacacagtcttggacagcagtgacgccccagcagacgtgggccagcccggcagaagtggtagaccttaccctcgacgaggattctaggcggaaatatctcctctag

SEQ ID NO: 54074 - DNA, 1029 bp, Artificial Sequence
  Description of Artificial Sequence: Synthetic coding sequence
atgaaaatggaggaggccgtcggtaaagtggaggaactgatcgaaagcgaggcacctcccaaggcatcagagcaggaaaccgcaaaggaggaggatggcagtgtggaactggaatcccaggttcagaaggacggcgttgctgatagcaccgtgatctctagtatgccttgcctgctgatggaacttagaagagacagttctgagtctcagctagcgagcacagaatctgataaaccgactactggacgagtgtacgagtccgatagctcaaatcattgcatgctgagcccttctagctccggccatctggcggattcagacacattgtcatcagccgaagaaaatgagccatctcaggcagagaccgccgtcgagggagatcccagtggcgtttctggcgctaccgtcggacggaaatcccgcaggtctcggtccgagtcagagacctccaccatggcagctaagaagaaccgtcagagcagcgacaaacagaacgggagagtcgctaaggtaaaaggacaccgaagtcaaaagcacaaggagcggatccgcctgctgagacagaagagggaagctgctgctcgaaaaaagtacaatctccttcaagactcctctacaagcgattcggatttgacttgtgattcttcaactagcagctccgacgacgatgaggaggtctccgggtcctccaagactattacggctgagatccccggtcatcttgaccccggttttctagcctccgataaaacaagcggcaatgccccattgaatgaggaaattaatatcgccagctctgacagtgaggtggagattgtcggagtgcaggagcacgccaggtgtgtgcaccctcgcggtggcgtgatccagtccgtttcaagttggaagcacggatccggcacccagtacgttagcactcggcagactcagtcctggaccgcagtgaccccccagcagacttgggctagtccggcagaggttgtggatctaactctcgacgaagacagccggagaaaatacctgctgtag

SEQ ID NO: 54075 - DNA, 231 bp, Artificial Sequence
  Description of Artificial Sequence: Synthetic coding sequence
atggtgtgtatcccttgcattgtcatccctgtcctgctctggatttataaaaaattcctagagccctacatttatcctctggtctccccctttgtcagtcgcatctggcccaagaaggccattcaggaatcaaatgatactaacaaggggaaggtgaatttcaaaggagcagatatgaacgggttgcccaccaagggtcctactgaaatctgtgacaagaaaaaggactag

SEQ ID NO: 54076 - DNA, 231 bp, Artificial Sequence
  Description of Artificial Sequence: Synthetic coding sequence
atggtttgcatcccatgtatcgtcatccctgtgttgctatggatttataagaaatttctagaaccctacatttacccacttgtttctccatttgtgtctcggatttggcctaaaaaagctatccaggaatctaatgataccaacaagggtaaggtgaatttcaagggagctgacatgaatgggctgcctactaagggccctactgaaatctgcgataagaaaaaggattag

SEQ ID NO: 54077 - DNA, 2490 bp, Artificial Sequence
  Description of Artificial Sequence: Synthetic coding sequence
atgactgaaaacaagactgtgagctccagttccacacgcgacgatcaaaccaatatcggactcacttgccaggaagtgaaagccctcagggaaaaagcctggagccggaccaatgaaggcaatgcaatgtctcagtctttggtgctgtatggagcatctaaggagaatagcgagggctttcacgagtctaagatgaccaacaccgagggggtaaataagggaatttattttagctatccgtgtaggagacactcgtgcgccgtggtgaacatacccgctccctgcgtgaataagatgatatctcacattcaggacgtcgaaagtaagatccaagagcatctgaagcgttttgaaacgagtttcgaggagtggagccggacatctagtacgaaggacttaaaggaggattggtccgtaaccactcctgtgaaagaggttaagcccggtgagaagcgagatgaaaaatgcccggagctgaagcaggagatggagacactcctgtcagaagcaataagactgataaaaagcttggagaccgatcgcgctgacgcagaagaagccctgaagcaacaaaggtcacgcaaaaacatgatcaatatgaagattgatagctggtcagtatggaagttacaggagttgccgcttgcagtccagaaagagcatgaggcttacctcagcgacgttatcgagctccagtggcatctggaagataaagccaatcagcttcagcactttgaaaaacagaagactgagctagaagaggcgaacgcaaaaattcaagcagacatagactacatgaatgagcatgggcctctcctggactctaaacaaaatcaagagctgcaggatctgaaaaatcattataagaaaaaaatggaggtaatggacctacaccgcaaagttaatgaagagttggaggaggctctggaggcatgcgaaaacgcacggctgaaggctcagcagattaaggaggagattgacaaggatatctatcaggatgaaaaaaccattgaggcttataaacgggaaatataccagctgaactctctcttcgaccattactcttcaagcgtgataaacgtgaatacaaacattgaggaaaaagaggaagaggttactgaggcaattagagagaccaagtcttccaagaacgagctgcacagcctgtctaagatgctggaggatctccggcgtgtttacgaccaactgacatggaagcagaaaagccatgagaaccaatatcttgaggcggttaacgatttctacgcggcaaagaaaacttgggacattgaactcagcgatgtggccaaggacttttccgccatctctttggcctgcaccaagctcacagaggataacaaaaagctggagattgatataaacaaaattacagtaaagactaatgagtctatcagaaagaagtcaaaatacgagtctgaaatcaagtatttaaccataatgaagttgaaaaatgataagcatcttaagaacatttacaaagaggcctaccgtattggtactttattccaccttaccaagcacaagacagacgagatggaggacaaaattgcagaagtaagacggaagtttaaagggagggaggagtttctgaaaaaattaacacagggagaagtcgccgctggtatggttctccagaagaaactgtactctatctacgaggttcaggccctcgagcgcaaggagctgataaaaaatcgtgctatttgtgcgatgtctctagctgagctgcaggaacctctcctgcaactggaggatgaggcggaaaggatccgcagcctcgataaggagcactctgttagcaaacgctctgcgattttcaaggacttagaagcgaccaaaagcaagaccatgatcttttacgccaaaatcaacgagcttaacgaagagctgaaagcaaaggaggaggaaaaaaagtctttcgaccagacactcgaaattctgaaaaataaattcattacaatgaggtttaaacgggaacacgcacaaacagtgtttgaccactacatgcaggaaaagaaagactgtgaagaaagaatctttgaggaagatcaacggttccgtgtcctactggccgtgagacagaagacccttcaagacacacagaagatcatcgccgattccctggaagaaaatttacgcctggctcaggaataccagcagctgcaaatcacatttttgaaggagaaggataactactttaatatctacgacaaacaactgagccttgacacgtccattagggacaagaagcagctgtgccagctgcaacggagaatgcataccttatggcaggaacactttaagctcgtggtcctgtttagccagatgcgcctggctaacttccaaaccgactctcaggagtctattcaaaaaattctcgcagtacaggaagagagctctaatctgatgcagcatattctggggttcttccaaactctgacagatggaacttgtgaaaatgatggttag

SEQ ID NO: 54078 - DNA, 2604 bp, Artificial Sequence
  Description of Artificial Sequence: Synthetic coding sequence
atgactgagaataaaaccgtgtcttcatcatccacacgcgacgatcagactaatataggtttgacctgtcaggaggtgaaagccctgagggagaaagcctggtctcggacaaatgagggtaacgccatgagccagagcctcgtcctgtacggtgcgtcaaaagagaattctgaagggttccatgagagcaagatgacaaatacagaaggggtgaacaaggggatctattttagttatccatgccgaagacatagttgcgcagtggttaacatcccagccccatgcgtgaataaaatgatttcccatatacaagacgtggagtccaagatccaggaacaccttaaaagatttgagactagctttgaggaatggtccagaacatcaagcacaaaggacctgaaggaagactggtctgtgaccactcctgtgaaggaggtcaaaccaggcgagaagcgggatgaaaaatgcccagagctgaagcaggaaatggagacactcctgtctgaggcaattagactcattaagtctctggaaactgatagagctgacgccgaagaggcattgaagcagcagaggagtagaaagaacatgataaacatgaaaatcgattcctggtccgtgtggaagctccaggaactgccgcttgccgtgcaaaaagagcacgaagcttacttgtccgatgtgattgaactgcagtggcacctcgaagacaaggctaatcagctccagcactttgaaaagcaaaaaaccgaactcgaggaggccaacgcaaaaattcaggcagacatagattacatgaatgagcacgggcctctgctcgattccaagcagaaccaggagctgcaggatctgaagaaccattacaagaagaaaatggaggtgatggacttacaccggaaggtgaatgaggagctggaagaggctctggaggcctgtgaaaacgcccgactcaaggctcagcaaataaaagaagagattgacaaggacatataccaggacgagaagacgatcgaggcatacaagcgagaaatttaccagctcaattccctgttcgatcattacagtagctctgtgattaacgtgaataccaatatcgaggaaaaggaagaggaggtgacagaggcgatacgagagacgaaatccagtaaaaacgagctgcactctctctctaagatgctggaagatttacggagagtttacgaccagttgacctggaagcagaagtcacacgagaaccagtatctcgaggctgtgaacgacttttacgcagcaaagaaaacgtgggacattgagctcagcgatgtcgccaaagactttagcgcaatctccctggcttgtacaaagctaacggaagacaacaaaaagttagaaatagatattaacaagatcacagtgaagactaacgagagtatccgtaaaaaaagtaagtacgaatccgagattaaatacttgaccatcatgaagctgaaaaatgacaaacacctgaagaatatttacaaggaggcctatcgaataggaacgctcttccaccttacaaagcacaaaaccgacgagatggaggataagattgccgaggtgcgcagaaaatttaaaggcagagaggaattcctgaaaaaactgactcagggggaggtggccgcaggaatggtgcttcaaaaaaaactctactccatctatgaagttcaggccctcgagcgtaaagagctgataaagaaccgggcaatctgcgctatgtcgcttgctgagctgcaggaacctctcttacagctggaagacgaggcggaaaggattagatcactggacaaggagcacagcgtcatgcttaataatatcattgaccaaaaggacttgatacgtcgaaaggtggggaaagtgaaaaaaaagttgcgaaaaaagggcaaaaaaacactggatgcactaatcgaaacagagtcaaaaaggtctgccatctttaaagacttggaagctaccaaatctaaaacaatgatcttctacgctaagataaacgagttgaatgaagagctgaaggccaaagaggaggaaaaaaagtccttcgatcagacactcgaaattctgaaaaataagttcatcactatgaggtttaaacgagagcatgctcagacggtatttgatcactacatgcaagaaaagaaggattgcgaagagagaatttttgaagaggaccagagatttagggtcctgctggccgtccgacagaagaccctgcaagatactcagaagatcatcgcggacagtctggaggagaatctccgtcttgctcaggagtatcagcaactccaaatcacatttctgaaggagaaggataattatttcaacatctacgataagcaactgagtctggatacgagtatccgagacaaaaagcagctttgccagttacagcggaggatgcacaccttgtggcaggagcacttcaagttggttgtgctgtttagtcagatgagactagctaactttcaaaccgactctcaagagagtattcaaaagatactcgcggtgcaggaggagagttcaaatttgatgcaacacatcttggggtttttccagaccctgaccgacggcacatgtgagaacgacgggtag

SEQ ID NO: 54079 - DNA, 894 bp, Artificial Sequence
  Description of Artificial Sequence: Synthetic coding sequence
atgacagaaaacaagacagtgtcctcatcctcaactcgggatgatcagactaacattgggctcacttgtcaggaggtgaaggccctccgagaaaaggcatggtcccgaacaaacgagggcaacgccatgtcacagagcttggtcttatatggggcttctaaggaaaactccgaaggctttcacgagtccaagatgacaaataccgagggcgtaaacaagggaatctacttctcctatccatgcagaagacattcctgcgccgtagtgaatataccggctccatgcgtaaataaaatgatttctcatatccaggacgtggaatcaaagatccaggaacacttaaaacggtttgaaaccagctttgaagagtggagtagaactagttctacaaaggacctcaaagaagattggtctgtaactaccccggtcaaagaggtgaagccaggtgaaaagagggacgagaaatgccctgagctgaagcaggaaatggaaaccctactatccgaggccatccgcttgattaagtctctagagaccgatcgggcagacgctgaggaagctttgaaacagcaaaggtccagaaagaatatgattaatatgaaaattgactcatggtccgtctggaagctccaggagctgcccctagcggtgcagaaggagcacgaagcctatctgtccgatgtgatcgagctgcagtggcaccttgaagataaggctaatcagctgcagcattttgagaaacagaagaccgaactagaagaagccaatgcaaagattcaggcggatattgactatatgaacgaacatggcccactcctggacagcaagcagaatcaagagctgcaggatctcaagaaccactataagaagaagataaagaagaagaagaagtag

SEQ ID NO: 54080 - DNA, 2454 bp, Artificial Sequence
  Description of Artificial Sequence: Synthetic coding sequence
atgaccgaaaataaaacagtaagctcttcaagcactagagatgaccagactaatatcggcttgacatgccaagaagtgaaggccctgcgcgaaaaagcctggtcccggactaacgagggcaacgccatgtctcaatcactcgtgctgtatggcgcttccaaagagaatagcgaaggtttccatgaatcaaagatgactaatactgagggggtgaataaggggatctatttctcctacccctgtcgtaggcattcctgtgccgtggttaacatcccagcgccttgcgtgaataagatgatttcacacattcaggatgtcgaatccaaaatccaggagcatttaaaaaggtttgagacatcatttgaggagtggtcacgcacatcatccactaaagacttgaaggaagattggtctgtcactacccctgtgaaggaagtgaagcccggagagaaaagagacgagaaatgccccgagttaaagcaggaaatggaaactttgctctcagaggcgattcggctgattaagagtctggaaactgatcgagctgacgcagaagaagcacttaaacagcagcggagtaggaaaaacatgatcaatatgaaaattgactcgtggtctgtctggaagctgcaggaactgccattagcagtacagaaggagcacgaggcttacctgagtgatgtcatagagctgcaatggcacctggaggacaaggcgaatcaactccagcatttcgagaagcagaaaaccgagctcgaggaggccaatgctaagattcaggccgacattgactatatgaatgagcatggccctctgctggattccaagcagaaccaggaattgcaggacctcaagaaccattataaaaaaaaaatggaggtcatggaccttcaccggaaagtcaacgaagaattagaggaggctcttgaggcgtgcgagaacgctaggcttaaggcccagcaaatcaaggaggagattgataaggacatctaccaggatgaaaagactatagaggcctataaaagagaaatttatcagctgaacagtctgttcgaccactacagttctagcgtgatcaatgtgaatacaaacatcgaagagaaagaagaggaggtcaccgaggccattcgcgagactaagtcttcaaaaaatgaactgcattccctgtcaaaaatgctcgaggacctgcgccgtgtctacgatcagctaacatggaagcagaagtctcatgaaaaccagtacctagaggccgtcaacgacttctacgcagctaagaaaacctgggatatagagctctctgatgtagccaaggattttagtgcaatcagtctcgcctgcacaaagctgactgaggacaacaaaaaactggaaattgacattaataagattaccgtaaaaactaatgagtccattaggaagaagtcgaaatacgagtctgaaataaagtatctgacaatcatgaaactgaagaacgataaacatctgaagaatatctacaaggaagcctataggataggcactctgtttcatttgacaaaacataagacagacgagatggaagataagatcgcggaagtcagacggaaattcaaaggtcgtgaagaattcctgaaaaagctgacacaaggcgaagtggccgcagggatggtactccagaagaagctgtactctatttatgaagtgcaggcactggaacgaaaagagctgattaagaatcgagctatatgcgcaatgagcctggccgaactgcaggaacctcttcttcagctggaagacgaggccgagcggatccggtccctggataaggaacactctgtcatgctgaataatatcatcgatcagaaagatctgatcagacgtaaagtgggaaaagtgaagaaaaagcttcgcaaaaagggcaagaaaaccctggacgccctgattgagacagaatccaagcgcagcgcaattttcaaagatctagaggctacaaaatccaagacaatgatcttttacgccaagattaacgagctaaatgaggagttaaaggctaaagaagaagagaagaagtcattcgaccagaccctcgagattttgaagaacaagttcatcaccatgcgatttaagcgcgaacacgcccaaaccgttttcgatcattacatgcaggagaagaaagattgtgaagagaggatatttgaggaggatcagcgcttcagggtgttactggctgtgagacagaaaactctccaagacacgcagttgtgtcagctgcaacggcgtatgcacaccctttggcaggagcatttcaagctggtcgtgttgtttagccaaatgcgtttagcgaacttccaaacagatagccaagaatctattcagaagatcctggctgttcaggaagaaagttccaacctgatgcagcacatcttgggattctttcagacactcactgacgggacctgtgagaatgatggatag

SEQ ID NO: 54081 - DNA, 2604 bp, Artificial Sequence
  Description of Artificial Sequence: Synthetic coding sequence
atgaccgaaaacaagacagtgtctagttcaagcaccagggacgatcagacaaacattggcctcacctgtcaagaggtgaaagcactgagagaaaaggcgtggagcagaaccaacgagggcaacgctatgagtcagtccctcgtgctctatggcgcatcaaaggaaaattctgagggctttcatgagtcgaagatgaccaatacagagggcgtaaacaaggggatctacttttcttacccctgcaggaggcatagctgtgccgtggtcaacattccagcgccttgtgtgaacaagatgatcagtcacatccaagatgtcgagagtaaaatccaagagcatctgaaacgatttgaaacctcttttgaagagtggagtagaacaagcagcactaaagatcttaaggaggattggagtgttaccactcccgttaaggaagttaaacccggagaaaaacgagacgagaaatgccctgaactgaagcaggaaatggaaacactgctgtcggaggcaatccggttaatcaagagtctagagacagatcgagccgatgctgaggaggccctgaaacagcagagaagccggaaaaatatgattaacatgaagatagattcatggtctgtttggaagctccaagagctgcctctagctgtccagaaagaacacgaagcgtatctgtccgacgtgattgaacttcagtggcatctcgaggacaaggctaaccagctgcagcattttgagaagcagaagacggagttggaggaagctaatgcaaaaattcaggctgatatcgactacatgaatgaacatggcccacttctcgactccaaacagaaccaggagctgcaggacttgaagaatcactacaaaaagaagatggaggttatggaccttcataggaaagtgaacgaagaattggaggaggcactcgaggcatgtgagaacgccaggctgaaggctcagcagataaaagaagagatcgacaaagacatctaccaggatgagaagaccattgaagcctacaaaagagaaatttatcagctgaactctctttttgatcattattcttcaagcgtgataaacgtgaacactaacatcgaggagaaagaggaggaggtcacagaggctatcagggagacaaagtcctccaagaatgaattgcattccttgtcgaagatgctggaggatctgcgaagagtttatgatcaactgacctggaagcagaagtctcatgagaatcaatacttggaggcagttaatgacttttatgcagccaagaagacctgggatatagaattatctgatgttgctaaagacttctccgccatatcacttgcgtgtaccaagttgactgaagataacaaaaagctggagatcgacattaataagataactgtaaagaccaacgagtctattcgaaaaaagtcaaaatacgagtctgaaatcaagtatctgaccataatgaagctcaagaatgacaagcatttgaaaaacatctataaggaggcttaccgaatcggaaccctgttccacctgacgaagcacaagactgatgagatggaggacaaaatagctgaagtgagacgtaagttcaaaggaagagaggaattcctgaagaagctaacgcagggggaggtcgcagctgggatggtgttacagaaaaaactgtattctatctatgaggtccaggcactggagcgcaaagaactgattaaaaatcgcgctatctgtgccatgtcccttgctgaactgcaggaacctctgttacaactggaagatgaggctgagagaatccggtcactcgataaagagcattccgtaatgttgaacaacattattgaccaaaaagatctgattcggagaaaggttgggaaggtgaaaaaaaagctgaggaagaaagggaagaagaccctggatgccctaatagagacagagtccaagcggagcgcaatttttaaggacctagaagcaactaaatcaaagacgatgatcttttatgcaaaaatcaatgaacttaatgaagaactcaaggccaaggaagaagagaagaagagcttcgatcagacactggagatcttaaagaacaagtttattaccatgaggttcaagagggaacatgcacagacggtgttcgaccactacatgcaggagaagaaggactgcgaggagagaatttttgaagaggatcagcgctttcgcgtgctactggccgtccgccagaagaccttgcaggacacccaaaagataatcgcagacagcctggaagagaacctcagattggcacaggagtaccagcaactgcaaatcacctttctcaaagagaaggataactactttaatatctatgataagcagctgtctcttgatacaagtataagggacaaaaaacagctctgccagcttcagcgacgaatgcatactttgtggcaagagcatttcaagctcgtagtgcttttctctcagatgcggctggcaaatttccaaaccgactcacaggagtcaatccagaaaattctcgccgttcaggaagagagctcgaatttgatgcagcacatcctcgggttttttcagactcttaccgatggcacatgcgaaaatgatggatag

SEQ ID NO: 54082 - DNA, 2676 bp, Artificial Sequence
  Description of Artificial Sequence: Synthetic coding sequence
atgactgagaataaaacagtcagttcttcatctacccgcgacgatcagacgaatattggcctgacatgccaagaggtgaaagcacttcgggagaaggcatggtcacggacgaatgagggaaatgctatgtcacagtcactggtgctgtatggcgcatctaaggaaaactccgagggctttcacgagtctaagatgacaaatactgaaggtgtgaacaagggaatctatttttcctacccctgtaggcgacacagttgcgcagtcgtgaatatacctgcgccttgtgtgaataaaatgatctcgcacattcaagatgttgaaagtaagatccaggaacacctgaaaaggttcgagacatcttttgaggagtggtcccgaactagcagcacgaaggaccttaaagaggactggtccgtgactacccccgtcaaagaggtcaagcccggagaaaaacgggacgaaaagtgccctgaactgaaacaggaaatggagacgttactctcagaagctattcgcctgataaagagcttggaaacagacagggcagacgccgaggaggcactcaagcagcagcgcagcaggaagaacatgatcaacatgaaaatcgactcttggtccgtgtggaaattgcaggaactgccgctggcagttcagaaggagcatgaggcctacctctcggatgtgattgaattgcagtggcacctggaggataaggccaatcagctacagcattttgaaaagcagaaaaccgagctggaggaagccaatgccaaaatccaagctgatatcgactacatgaacgaacacgggccactgttagatagtaagcagaaccaagagctgcaggacctgaagaatcattacaagaagaagatggaggtcatggacttgcaccggaaggttaatgaagagttggaggaagccctggaagcgtgtgagaatgccagactcaaggcccagcagatcaaggaggagatcgacaaggatatttatcaggacgaaaagaccatcgaggcctacaagcgggaaatttatcagctgaacagtttgttcgaccattactcctcctctgttatcaacgttaatactaatatcgaggagaaggaggaagaggtgaccgaggcaatccgggaaacaaagtcctcgaaaaacgagttgcactcactatctaagatgctggaggatctgaggagggtgtacgaccaattgacctggaagcagaaaagtcacgaaaatcaatatctggaggcagtcaacgatttctatgcagcaaagaaaacctgggatatcgaactgtccgacgtagcgaaggatttctccgccatcagcctggcctgcaccaagttgaccgaagataataaaaagcttgagattgatatcaacaagatcaccgttaagaccaacgaaagtataaggaagaaaagcaagtatgaatccgaaataaagtacctaaccattatgaaactgaaaaatgataaacatctaaaaaatatctacaaagaggcatacaggattggcaccctgttccacctgacaaaacacaaaaccgacgagatggaggacaagattgccgaagttaggcgaaaattcaaaggaagggaggagtttctgaagaaactgactcagggcgaggtagccgctgggatggtgttgcagaagaaactctacagtatttacgaagtgcaggctctagaaaggaaggaattaattaagaacagggccatctgtgctatgtccctggccgaattacaggagcccctcctgcagctggaagacgaagccgaaaggatcagaagcttagataaggagcattcagtgatgctcaataacatcatagatcagaaagacctcattcggcgaaaggttggcaaagttaaaaaaaaactgcgaaagaaaggcaaaaaaacactggacgcactgatcgagacagagtccaagcgctccgccatttttaaagatttggaggccaccaagtccaagacaatgattttttatgctaaaattaacgaactcaacgaggagttaaaagccaaggaggaagagaagaaatctttcgaccagactcttgaaatcttaaaaaataaatttattaccatgcggtttaaaagggaacacgcacaaaccgtctttgaccactacatgcaagaaaagaaggattgcgaggaaagaatctttgaggaagatcagcggttccgtgttctcctcgccgtccgccaaaagaccctgcaggacacgcagaagataattgccgattccctcgaggagaacctacggctcgcccaggagtatcagcagctgcagatcacctttctgaaggagaaggataattattttaacatctatgacaagcagctgtctctcgataccagtatcagggataaaaaacaggtagccggatttttgcctaagaaactgccaaacagcctgcctattattagcgatgagctgtctaatttccagttgtgtcagcttcagcggagaatgcacacactatggcaggagcattttaagctggtcgtgctcttcagccagatgaggctggctaactttcaaactgatagccaggagagcattcagaagattctggctgtgcaggaggagtccagcaacttgatgcagcacattctgggcttcttccagacccttaccgacggaacatgcgagaacgatggatag

SEQ ID NO: 54083 - DNA, 210 bp, Artificial Sequence
  Description of Artificial Sequence: Synthetic coding sequence
atggtctttgcgcctggtgagaaaccaggcaatgaacccgaggaagtgaaactgcagaatgcaagcaagcagatcgtccaaaatgcaattcttcaggccgttcagcaggttagccaggaatctcaacggagggaggagaggatatccgataatagagatcatatccagctcggtgtgggggagctcactaagaaacacgaaaagaaatag

SEQ ID NO: 54084 - DNA, 372 bp, Artificial Sequence
  Description of Artificial Sequence: Synthetic coding sequence
atgacccctgccagcggggctaccgctagtctgggcagactgcgagccaggccacggtcccgctgggacgcggcatacttgcccgctgtcgcggcagtctgcgtggccagagcgtcccacgtgcctaacgggaccctcagatttggcgtgtgcaaggcaagacgcaccatgcggcctcttccgcgaaggattgaggtgaggaccaaacggggtccacagaggcccgctgctccagagagaagtccacagcccagactgccaccctccagacatccatcgagacgcggtcctcggaggcacctgagtggatgctcagcccctgcgtgcagaataccaaccggctgccgctgtccttgcggaaggccatcctag

SEQ ID NO: 54085 - DNA, 2058 bp, Artificial Sequence
  Description of Artificial Sequence: Synthetic coding sequence
atgaacgatagtcgtcagcagagcctgtttttcatcaccctaccggacctcaataagctctgtgcggtccggattatactgtccaataaggtggcggacacagaaatccggaccattcagatgaagatgtgtagacagctactattcctgcatcaggacatcttaacttctcctgtctctggaattctgaatcagatctgggttgtaatggctattccattctacaaggccaggaagttgaacgcctacgtagaaaagtatggggctaagatggaggcacctcagcgagtcattcccgtgattttgcagaattgtctctcctattcattcatggccagactcgctccagcgtggaataggaccgggcacttgctgattcaggggagagacttcctgtcgcagatgggcaaacagagcgcggtggttttgaacattaatgtgacggaaactcaggtgtgtctcagcatcgaggcttgtactatcagactccctgcccctgagcttaaggaatttgagatcagtcaatcaatcataaaagatttccacgccaacaagcatgctgtgattgagaggcacagcatactgtcgaattggtgctatgtgctgccaagtatgaagatggggcagataattaacattttccatgctatcccggctgcctgcccgttccatagctacggcgatttccaaaggcactgggacgcactctacggctacaagttgcctggcgactgtggcaaaatcaaaatttattgtaatatatacttcaagatgttaggcgagcgcacgttcacttaccctctgagctgcattaggagtcagcccatgcaattcttcccacgcgtggacagcgaagtggttctgaagtcttttttgtctgatcttaaaagcaagctaccacatatctgtgggttcccaatcaaaatgacaagcaagccctgctactacacccaggagctaaccaaacccaatattcaagagcataaagtcaagccccctaaccttaccaccaaaaaaatgctacgggcttcgctcacccaggctactagtagaaaaccagcatgtgcgcagagccttctgccatgctccgtagctgtcgaccacaaggtggagctctctgtctctcaaccaacatctggcatctttagcgccctccaccttcaaccggagtctgtgcagggccgaaagaagtcactgagcatccgggctccccaggtgcactctgaagtgttgatgccgaataggggaaacacccaggtgcagcacactaatctctccagccagtccaacattacacctaagtttgtacccgtgtttaagaatagactcctccagatgaataaaaacacctccgttcttggctctcccaaaaggaaacagcatgatgtgacccagagtaagctgttcagccttaagacctccatgatccagcacgataagctgaacttgggtccagcaattaaaaatcgatatagttcgaacatccaaatgcaggcggcaaacaatctaaaccaagaaaactctagacccctgcaggagaagaacaccgagtcgtccgagaatatgaccaagttcccttcctctagagggaagtctacagttagcttgaacaaaaacaagcagctctcaaatagcgctgtctttgtggtgtctaataacaacttgggagtggtcaaaagcgctgtcgactttcagatgaaaggcaaagagaacctaacaggcaaaggtattacccagatacttgggaaaagccatggctcactgaaactgaagaggcagcctcatatttttgagtccgacggagaaacagaagaccccagactgctgcagcagcagtcggaaaaccaagctaaagaggtgggcaccagtgatcacagactgatcgtcagcaaaatagcacacagatccaagcggaagctttgccccgaaagcagtaaaacatcaaagaaacatcactccgatacggtccactatggccaaagctcctcgtcaaagaagcagatcctcgattccgacaagtcaaagttgaagaaaagcctgattatccacaacgcttag

SEQ ID NO: 54086 - DNA, 1974 bp, Artificial Sequence
  Description of Artificial Sequence: Synthetic coding sequence
atgggggaagaagactattacctggagctgtgtgaacggccagttcagttcgagaaggcgaaccctgttaactgcgtgttctttgacgaggctaataagcaagtgttcgctgtcagaagtggtggggctacaggcgtggtggtcaagggacctgacgataggaatccaatttctttccgaatggacgacaaaggggaagtcaaatgtattaaattttccctcgagaataagattctggcggtgcagcgcacctccaagaccgtggatttctgcaactttattcccgacaacagccagctggagtacacacaggaatgtaaaaccaagaacgcaaacatccttgggttttgctggacctcatctactgaaatcgtctttatcacagatcagggcattgaattttatcaggtgctgccagagaaaagatccctgaaactgctcaaatcacacaatctgaacgtcaactggtacatgtattgtcctgagagtgcagtgatcctcttgtcaaccaccgtactcgagaacgtgctccagccatttcatttccgggcagggaccatgtccaagctgcccaaatttgaaatcgagttacccgctgcccctaagagcactaagccctccctgtccgagagagatattgcaatggcaaccatctatggccagttgtacgtccttttcctccgccaccacagtcggaccagtaacagtaccggagctgaggtggtactgtatcacctcccaagggagggcgcttgtaaaaaaatgcacatactcaagctcaacagaaccggtaagtttgccctaaacgtggtggataatctagtggtcgtgcatcatcaggatacggagacttccgttatctttgacatcaagttgaggggagaatttgatggtagcgtgaccttccaccaccccgtacttccagctcgctctatccagccataccagatccctattaccgggcctgcagcagtcacctcccagagccctgtgccttgcaaactttattctagtagctggatcgtattccagcctgacattataatcagtgcctcccagggctatctctggaacctgcaggtcaaattggaaccaattgttaacctgcttccagacaagggacggctgatggatttccttctgcaaaggaaggaatgcaagatggtaatcctctctgtctgttcccagatgttgtccgagagcgatcgagcctctttaccagtaattgccaccgtgttcgataaattaaatcacgaatataagaaataccttgacgccgaacagtcatatgctatggctgtggaggctggtcagtcacggagctctccgctgctcaaacgtcccgttcggactcaggctgttctggaccagtctgatgtctatacgcacgtcctgtcagctttcgtggagaaaaaggagatgccccacaagtttgttattgcggtgcttatggagtacatccgctccctcaaccaattccagatcgccgtgcaacattacttacatgagctcgtgatcaaaacattggttcagcacaacctcttttacatgctccatcagttcctacagtatcacgtgctctccgactcaaagcctctcgcctgtctcttactctccctcgagtccttttaccctccggcacatcagctgagcttggacatgctgaagagactgtccactgcgaatgacgagatcgtagaggtattactctccaagcaccaggtgctggctgccctgcggtttatccggggaatcggtggccacgacaatattagcgcaagaaaattcctcgatgccgctaagcaaaccgaggacaacatgctgttttacaccatatttaggttcttcgaacaacgaaaccagagattaaggggctcgccgaacttcaccccgggagaacattgtgaagagcacgtggccttcttcaaacagattttcggagaccaagcgcttatgaggcctacaacattttag

SEQ ID NO: 54087 - DNA, 1830 bp, Artificial Sequence
  Description of Artificial Sequence: Synthetic coding sequence
atgggagaggaggactactacctagaattgtgcgaaagacctgtccagtttgagaaagccaacccagtgaattgtgtttttttcgatgaggccaataaacaggtgtttgccgtgcggtcgggaggggcaaccggggtggtcgtgaagggcccagacgaccggaatccaatttcatttaggatggatgataaaggcgaggtgaagtgtattaagtttagcctggagaacaagatactggctgtgcaaagaacgtctaaaacagtggttttaccagagaaacgctcattaaagttgttgaaatctcacaacctgaatgttaattggtatatgtattgtcccgagtctgctgtcatactcctcagtacaactgtgctggaaaacgtgctccagccatttcactttagagcgggaacaatgagtaagctgccaaaatttgagattgaactaccggctgcccctaagtcaacaaaaccttcactttccgagcgggacattgctatggctacaatctatgggcagctttatgtgctgtttttaaggcaccacagccgcaccagcaacagcaccggcgcagaggtagttctctaccacctacctcgagaaggcgcatgtaagaagatgcacatcctgaagctgaatcgcaccggcaaatttgctctcaacgtcgtggataacctggttgtcgtgcaccaccaggataccgaaacttctgtcatattcgacatcaagctgagaggcgagttcgatggctccgtgacttttcaccaccctgtcctgcccgcacgaagcattcagccatatcagattcccatcactggtccagccgctgtgacatctcagtcacctgtgccatgtaagctttactccagcagttggattgtctttcagccagatatcataatctctgcttcccagggctatctgtggaatctgcaggtgaaacttgaaccgatcgtaaatcttctgcccgacaagggacgactcatggattttctgcttcagcgtaaggaatgtaagatggtcattctgagcgtttgcagtcagatgttgagcgaaagcgaccgagccagtttgccagtcatcgcaacggtgttcgataagctgaaccacgaatataagaagtatttagacgccgagcagtcttatgctatggccgtcgaggccggtcaatcccggtcatcgccactgctcaaacggccagtgcggacacaagccgtgcttgaccagtctgacgtatatacccatgtgttatctgctttcgtggaaaaaaaggagatgccccacaaattcgtcatcgccgtgctgatggaatatatcagaagtctaaaccagttccagattgccgtgcagcactatctccatgagctggtgatcaagacgttagtgcagcataatctgttttacatgcttcatcagtttcttcaatatcacgtactgtccgactcaaagccactcgcctgcctgttgctctcacttgaatctttctacccccctgcccatcagctgtcactggacatgctgaagcggttatccactgctaacgacgagatcgttgaggtgttgctgagcaagcaccaggtgcttgccgctttgcgttttattcgagggatcggtggtcatgacaatatctccgcccgaaagttcctggatgcagccaaacagaccgaagacaatatgctgttctatacaatcttccggttttttgaacagcgaaatcaaaggctgcgaggatcccccaactttacaccaggggaacattgtgaggagcacgtggctttctttaaacagatatttggggaccaggctctgatgaggcctacaacattctag

SEQ ID NO: 54088 - DNA, 1503 bp, Artificial Sequence
  Description of Artificial Sequence: Synthetic coding sequence
atgtactgtcccgaatccgcagtaatattactgtccaccacagtgttggagaatgtcctgcagccttttcacttccgcgcaggaaccatgagcaaacttcccaaatttgagattgaactcccagccgctcctaagtctaccaaacccagcctctccgaacgcgacatcgcaatggccaccatctacggacaactttacgtcctgttcctgcgccaccattcaagaacgagtaactcaaccggggctgaagtagttctgtatcatctgcccagagaaggggcttgtaagaagatgcacatcctgaaactgaatcgtacaggtaagtttgccctgaacgtcgtggataatttggtggtggttcatcatcaggataccgagaccagcgtgatttttgatatcaaacttcggggagaatttgatgggagcgttacgtttcaccacccagtactgcctgccagatctattcagccctaccagatcccgattacaggacccgctgcagtgacatcacaaagtcccgtaccctgcaaactttactcaagctcctggattgtctttcagcctgacattatcattagtgccagccaggggtacctgtggaacctgcaggtgaagctggagccgatagtgaatctgctgcctgacaaggggagacttatggatttcttattacagcgcaaggagtgcaaaatggttattttatctgtctgcagtcagatgttgtccgagagcgacagggcatccctgcccgtgatagccactgtcttcgacaagctgaaccacgaatacaaaaagtacctggatgccgagcagagctacgcaatggctgtagaagccggacagtcacgctcttctcccctgttaaagcgcccagtgcggacgcaagccgtacttgaccagagcgacgtctatacccatgtgctatccgcattcgtcgagaagaaggagatgccacacaagttcgtcattgccgtgcttatggagtacatccgatccttgaaccaatttcagatcgccgtacagcactacttgcatgagctggtcatcaagaccctggtccaacataaccttttttatatgctccaccagtttctgcagtatcatgtactgtcagacagcaaaccattggcttgtttgctcctgtcactcgaatccttttatccgcctgcacaccaactgagcctggacatgctgaaaagactaagcacagctaacgatgagattgtggaagttcttctctccaagcatcaggttttggctgccctacgatttattagaggtattggtggccacgacaacatttccgctcgaaagttcctggacgccgctaagcaaactgaagacaacatgctgttttataccatttttcgattcttcgaacagcgcaaccagagactgagggggtcacccaactttaccccaggggaacactgcgaagagcacgtcgcgtttttcaagcagatcttcggggatcaggccctcatgaggccgaccaccttttag

SEQ ID NO: 54089 - DNA, 1359 bp, Artificial Sequence
  Description of Artificial Sequence: Synthetic coding sequence
atgtattgtcctgagagcgcagttatcttgctgagcacaacagtgctggaaaatgtgctgcagccctttcactttagggcgggaaccatgtcgaagctccctaaattcgagatagagctgcctgcagctcctaaaagtacaaagccaagtctgagcgagcgcgatatcgcaatggcgaccatttacggacagctctacgtactgtttctgagacaccattcgcggacttctaattcaaccggcgctgaggtggtgttgtatcatttgcctagggaaggtgcatgcaagaagatgcacattttgaaattaaaccgcacaggaaaattcgctttgaacgttgtggacaatctggtggtcgtacaccaccaggacactgaaaccagcgtcatattcgacattaagttgaggggagagtttgatggttcagtaacttttcatcatcctgttttacctgcccgatcaattcaaccctaccagatacccattaccggacctgccgctgttacaagccagagtcccgtgccctgcaaactgtattcgagtagctggatagtctttcaacctgacattatcatctccgctagtcaaggatacctctggaatcttcaggtcaagttggaacccattgtgaatttattacccgacaagggtaggctgatggactttctgctccaacggaaggagtgcaaaatggtaatcttatctgtctgcagccagatgttatcggagtctgaccgcgcatccctgcccgtgatcgctacagtgttcgataagttgaatcatgagtataagaaatatttggacgccgagcagtcttacgcgatggccgtcgaggccggacaaagcaggtcatctcccctgctcaaaagaccagttcgaacccaggccgttctagatcagtccgacgtatacactcatgtgcttagcgcctttgtagagaagaaagaaatgccccataagtttgtaattgccgtgctgatggaatatatccgctcattaaatcagttccagattgctgtgcagcattatttacacgaactggtgattaaaactctggtgcagcataacctgttctatatgctgcaccagttcttgcaataccatgtgctcagcgactctaaacctttggcctgcctgctcctgtccctggagtccttttatcctccagctcaccagctgtcactcgatatgctgaagatgctgcaatcacggcttaaaaccacatgcttcagcatccaatactctgccttcttgaattctgaaacgagtgtttgcgaaggcgcacctatatctcatcagggcaatactgttaaaaatatgctgttattctccaaccggttccttgaaacgaagctctag

SEQ ID NO: 54090 - DNA, 711 bp, Artificial Sequence
  Description of Artificial Sequence: Synthetic coding sequence
atggccaggccactggtgccatcttctcagaaggcccttctcttagaactgaagggacttcaagaggaacccgtcgagggattcagggtgacattagtggatgagggcgatctatacaactgggaggtcgcaatatttggtccaccaaacacatattacgagggaggttatttcaaggcacgtttaaaattcccaatagactacccctacagtcctcccgcttttcgctttttgactaagatgtggcaccccaatatctatgaaactggcgacgtgtgtatttctatactgcacccccctgttgacgatccccagtcaggcgagcttccttctgagagatggaatccaactcaaaatgtgcgcaccatcttgcttagtgtcatttccctgctgaatgagcccaacaccttctcccctgctaacgtggacgcctcagtgatgtaccgaaagtggaaggagtccaagggcaaagaccgtgaatacaccgatatcatcaggaagcaggtcctggggacgaaggtagatgccgaacgggacggtgttaaggttccaacaactctcgcagaatactgcgttaagacaaaggcacccgcacccgatgagggtagtgacctcttttacgacgactactacgaggacggcgaggtcgaagaagaggcggattcttgcttcggcgacgatgaagacgactccggcaccgaggagtcatag

SEQ ID NO: 54091 - DNA, 486 bp, Artificial Sequence
  Description of Artificial Sequence: Synthetic coding sequence
atgggctccaaggcaaagaagcgagtgctgcttccaacccgcccagctccacctaccgtcgaacagatcctggaggatgtgaggggagcgccagcggaagaccccgtgtttaccattttggctcctgaagacccaccagtcccatttaggatgatggaggacgctgaagcacccggagaacagttataccagcagtctcgtgcctacgtagctgctaaccagagactgcagcaggccggaaatgtgccgaggcttccaccgcaggcagacttaagtgggcctgcaggcctgggatccgcgcaaggtgggctgcaccccggttttccatgggggtctgtgggcccacgcttggccttcactggctctcagcctacgtgggttctcacgcaggcaccactgctcatgctgggcctgagatttattcgaagactcattcatgccgaattggtgggtcctacccaactcgccccatcatgtgtcacctag

SEQ ID NO: 54092 - DNA, 477 bp, Artificial Sequence
  Description of Artificial Sequence: Synthetic coding sequence
atgggttctaaggctaaaaaacgagtgctcctgcccacccggcctgctccacccacagtggaacaaatcctggaggacgtgcgcggtgcacctgcagaggacccagtattcactattctggcaccagaggggaggggatctcccgtgcccggaaaaagtgggcctgagacacctgcagctaggggaagggaacgaagtaccccactcaccccggatccaaccccgtgggaaccccctcagcatgggcatgatccacctgttccattccgtatgatggaggacgctgaggcaccaggagagcagctataccagcagtcacgggcatatgtcgcggctaaccagagactccagcaggctggaaatgtcctgcgccagaggtgcgaactactgcagcgcgctggcgaggatttggagcgcgaggtggcccagatgaagcaggccgcactgcctgctgccgaggccgcttcatccgggtag

SEQ ID NO: 54093 - DNA, 357 bp, Artificial Sequence
  Description of Artificial Sequence: Synthetic coding sequence
atggggtcaaaggcgaagaagcgtgttctgttgcccacacgtccagcccctcccactgtcgagcagattctggaggacgtgcgcggagcacccgctgaggaccctgtcttcaccattctggcccctgaagaccccccagttcctttccggatgatggaagacgccgaggcccctggcgagcagttgtatcagcagtcacgggcatacgtggctgcaaaccagaggctgcagcaggcaggcaacgtcctccgccaaaggtgtgagctgctacagagagctggggaagatttagaacgggaagtggctcagatgaagcaagctgctctcccagccgctgaagcagcctcatccggctag

SEQ ID NO: 54094 - DNA, 507 bp, Artificial Sequence
  Description of Artificial Sequence: Synthetic coding sequence
atgctgcctgccgctctccttcgcaggcccggattgggtaggctggttcgccacgcccgtgcttacgctgaagcggctgccgcacccgcagcagcctctggcccaaaccaaatgtcttttacattcgccagccctacacaggtgttttttaacggagccaacgtgcgccaggtggacgtacccaccctgacaggagcatttggcatcctggcagcacatgttcctacattacaggtcttgcggccaggtctcgtcgtggtgcacgcagaagatggaacgacttcaaaatatttcgtttcttccggaagtatcgctgtcaacgctgacagctccgtccagctgctggcggaggaagccgtcacactggatatgttagatcttggagctgcaaaggccaatctggaaaaagctcaggctgagctcgtgggaactgctgacgaagcgacacgagccgagatccaaattcgcatcgaggcaaatgaagctcttgtgaaagctctcgagtag

SEQ ID NO: 54095 - DNA, 1422 bp, Artificial Sequence
  Description of Artificial Sequence: Synthetic coding sequence
atgagttcgcctgaacccccaacagagcctcccgagcctgacaatcccacatggtccacacagccgacctacagtaatttgggccaaatccgggctcacctgctgccatcgaaggcttgtagacttcggacccctgggtctctttctacgaaccctgagccgcttccaccaccattacctaaaaagatccttacacggactcaatccctaccaaccagacgaactcttcatcccagttcaatccaagtgcagccccctcggcgaccttttctcggatctcatagtgtggacaaatcccaggccgcagtgggcccagcctgtctaccggctgagcttacttttgggcctgccgacgccccactgggattaagccttagagatctgcacagcccggaagctgttcacacagcgcttgccgcacggcagttacagggcctgcggacgatttacgcaaggttaagagcaaggttaatgggcggacaccccggaccttgccacccagggcatagcttccgtttgcttgactccagcccctgtgccgaaagtggtgatgccttgtattatagagtggtgcgggcacacgaggacgcctggcacatccttgtggccaaggtgcccaaacctggtgctgacgtgccacacccctggggactggagttacaagcctcgctctccccccattttaatctccaggggctgtgcggcctggtgcccgagggcacattacctggagccccatggcggggtgccgttgccctggccgctgaagttccagaacggactgtggcccagtggcttgcagaagcatgcacgcagcccccagaggagtttgtctgggctgtggcacttctgttgttgcagctttccgctgccctaaagttcctggaagcgtggggtgccgctctggtggagctgcgaccagagaacctgctgttggtcgctcccagggggtgcgctaccacagggcctccacgtctcctgctgaccgactttggacgggtgtgtctgcagccaccgggacccccaggatctccaggcccacacgcccctcagctgggcagtctcctgcgtgcactgctgtcccttgccgcacccagtacaacccctctggctgctgggttggaactgttggcagcccagctgaccagattgaggccaagtgcaagcagaactagaggcgctctccaagccctcctatggggacccggtccagagctgcgcggtaggggcgctccactggggccatggctaagggccctcgggccatggttacgcgtccgacgcggactgctggtcctgcgattggcagaacgggctgcaggtggtgaagcaccttcccttgaggattggctgtgttgtgagtacctggccgaggcgaccgaatccagcatgggccaggctcttgcactgctgtgggattag

SEQ ID NO: 54096 - DNA, 228 bp, Artificial Sequence
  Description of Artificial Sequence: Synthetic coding sequence
atgatcggtgacatactgcttttcggcaccttactgatgaacgccggagctgtgctgaactttaaactgaaaaagaaggacacccagggtttcggcgaggagtcaagagagccctctactggcgacaacattcgagagtttttactgtctctccggtactttcggatttttattgcgctgtggaacattttcatgatgttttgcatgattgttctgttcggctcttag

SEQ ID NO: 54097 - DNA, 531 bp, Artificial Sequence
  Description of Artificial Sequence: Synthetic coding sequence
atggcggctcggggacgtcgagctgagccccagggtcgggaggctccagggccagcgggaggagggggagggggatctagatgggccgagtccggtagcggaacttctcctgagagcggggatgaagaggtctcaggcgctggatcatcccctgtgtctggcggtgtgaatttatttgcaaacgatggttcattcctagagctgtttaagaggaaaatggaagaggagcagcggcagcggcaggaggaaccccctccaggacctcagagacccgaccagtccgccgcagcagcgggtccaggtgaccctaaaaggaaaggaggacctgggagtacgctgagctttgtgggaaagaggcgcggaggaaataagcttgcactgaaaacaggcatcgttgctaagaagcagaagaccgaagatgaagtgctgaccagcaagggcgacgcctgggccaagtacatggccgaggtgaagaagtataaggcacaccagtgcggcgacgatgacaagacgcgcccactagtgaagtag

SEQ ID NO: 54098 - DNA, 1518 bp, Artificial Sequence
  Description of Artificial Sequence: Synthetic coding sequence
atggcaactggagcactgctgccatgttccagaccgtgccccatgagtcggctggactttctgaaggcttcccatttcagcctgggcccagaccttcgactccatgaggggactatgcgaaccaccagtcatcgtgatttcgcctaccccgctgctactagggaacctccatccctgcagcccccaccagccctcctgtttcccatggacccgaggtgggatcgtgaagagcgcgtgagtgaggcccaccgagccttcccaccaccttccacaccaccttgggagctattgcaggcacaagcgcgagagcgaacccttgccatgcaggcgggtaacctccacttgcatgaggatgcacatgctgggattggcctgtccaacgcgcacgccgcatacggctggcctgagctgccagcacgaaccagagagaggatcagaggggcaaggctgatcttcgacagagatagtttgccacccggagacagagataagctaagaatccctcctaccacacaccaggctctgttccctccccacgatgctcggccacaaccacgggctcctagctgccatctaggcggtcccaatacattgaagtgggattatactaggcaagatgggactagctaccagcggcagtttcaggcactgcccggaccccctgcgctgagatgtaagagggcttcttccggcgtcgagctcggagactgcaagattagttacggaagcacctgttctgagcaaaagcaggcttataggccacaggaccttcccgaggaccgctatgacaaagcccaggctacggcgcatattcattgtgtgaatattcgacctggggacggactctttagagatcgcactaccaaggcagagcatttttacgcccgagagcccgaacccttcgtcttgcaccacgaccagactcccgaatcccacatactaaaggggaattggtgtcctggacccggatcattagacactttcatgcagtatttctatggccagcctccgccacccactcagcccccatcacgtcacgttccccacgagaagctacaatcccacgtgacattgggagaacctaagctactgaaacggttcttcaagacgactatgggctccgattattgcccctcggagtggcgccaggtccagaaagccccaaatctgcatctgcagcagagctaccttccccgaggcaccggagaatttgactttctgaccatgaatcagaaaatgctaaaaccccatagaactccccctgcacctgttaccgaggagatgctccagagatgcaagtactcccacatggagccaccgctaggaggcctacgatttttctccacccaatacaaggacgagtttccctttaaataccaggggcctgctgcactcagactcaaaaacccacaggagggattcgtgccactgggaacaccccatcagcggggttgcagggagaaaatcgaccccttagtacctcaacccccaatgtacttgtgcccatcacagcagtag

SEQ ID NO: 54099 - DNA, 672 bp, Artificial Sequence
  Description of Artificial Sequence: Synthetic coding sequence
atggccaccggagccctcttgccgtgctctcggccatgcccaatgtccaggcttgatttcttaaaggcgagtcactttagccttggcccagatctcagactgcatgagggcacaatgaggacaacgtcccatagagattttgcttatcctgcagccacacgggaacctccttccctgcaaccacccccagcactgctgttccctatggaccctcgctgggaccgcgaagagcgggtttctgaagctcatcgcgcattccctcctcctagtaccccaccatgggaactgttgcaggcccaggctcgagaacgaaccctcgccatgcaggctggtaaccttcacctgcacgaagatgcccacgctggcatagggctgagtaatgcccacgccgcatacggatggcctgagctgccggcacgcacacgggaacgaattcgcggtgcgagactcatatttgatcgagattcgttaccaccaggcgacagagacaaactgcgcattcctccaaccacacaccaagccctcttcccgcctcacgacgcaagaccccagcctagagctccttcctgtcatctaggaggtcccaacacgctgaagtgggactataccagacaggacggcaccagttaccagcgccagttccaagcattacctggtccccctgccctgtag

SEQ ID NO: 54100 - DNA, 579 bp, Artificial Sequence
  Description of Artificial Sequence: Synthetic coding sequence
atggctactggcgcactcctcccttgtagccgcccttgcccaatgtctcgtttggacttcctcaaagccagccacttctccctgggcccagatctgcgcctgcacgaaggcacaatgagaacaacctcccatcgggactttgcataccctgccgcaaccagggagccgccttcactgcagcccccaccggcattgctatttccgatggatccgaggtgggacagggaggaacgcgtatctgaagcacatcgtgcctttccgccacctagcacaccaccttgggagctgttacaggcccaggcgagggagagaacactggcaatgcaggccggtaacttgcacctgcatgaggatgcccacgctggaatcgggttatctaacgcacatgctgcgtatgggtggcccgaactaccggcaaggactagagagagaattagaggggcaagattgatcttcgacagggatagtcttccacccggagatcgggacaaactgcgcatccccccaacgacgcatcaggctctgttcccaccccacgacgctagacctcagcctcgtgccccttcttgtcacctatag

SEQ ID NO: 54101 - DNA, 1269 bp, Artificial Sequence
  Description of Artificial Sequence: Synthetic coding sequence
atggttatggcggctctctccctggttgccgcatgctggggacgagcagcggcagacgaatcagttcagttacccgcagcccctggcagtagcgttcgcgctcgggagaccatggtctctgtcacgatggccaccagcgaatggattcagttcttcaaagaggcaggaattcccccaggccctgccgttaattatgccgtgatgtttgtggataatcgcattcaaaagtcaatgctgctggatctgaacaaagaaattatgaacgagctgggtgtaacagtggtgggcgatattatcgccatcctgaaacatgccaaagtagtccaccggcaagatatgtgtaaagccgcaacagaaagcgtcccttgttcaccctcaccgctggccggtgagattcggagaggcacatcagccgcaagccgaatgattacgaattcactcaaccacgactcaccacctagtacccctcctagacggccagacacgagcactagcaaaatcagcgttaccgtgagcaataaaatggccgctaaaagcgcgaaggctacggcagcactcgccaggcgcgaggaagagtcactggcggttccagctaagcgacgaagagtcactgctgaaatggaggggaagtatgtgattaacatgcccaagggcacgacccctcggacacggaagattctcgaacagcaacaggctgccaagggcctccatagaacaagcgtgttcgaccggctcggggctgagacaaaggccgatacgaccaccggcagcaaaccaactggggtattctctcgcttaggcgcaacacctgaaacagacgaagacttggcatgggacagcgataacgattcttcgagctccgtcttgcaatacgccggagtcctgaagaagctcggtcggggaccagctaaagcctcgcctcagcctgcgctaacagtgaaggccaaagctactagcagcgccacaacggccgcagcgcctaccctgcgccgactagccttatccagtaggtcgggacttgaacgcaagcccgaatccttgtctaaagtaagtatcatcaaaaggttgggagctgcagcgttagtgccagaggcgcaggactctcaggtaacctcaacgaaaagcaagtcctcagccgaagtcaaggtgacaatcaaacgcacgttggtgggcccacggggatcttcgagctctgagggactcggcgctcagatggaccacgccggaactgtgagcgtgttcaaaagactgggaaggcgcactttctag

SEQ ID NO: 54102 - DNA, 1068 bp, Artificial Sequence
  Description of Artificial Sequence: Synthetic coding sequence
atgttcgtcgacaaccgaattcagaagagtatgctcctagacctgaacaaagaaattatgaatgagctgggtgtaactgtggtcggggacattattgctatccttaaacatgctaaggttgtgcatcgacaggatatgtgtaaggcggctacagaaagtgttccatgcagtccttcccctcttgccggagagattcggagagggacatccgcggcatcccgcatgattacaaattccctaaaccatgattccccacccagcactccacctcgtcgtcccgacacatccacaagcaagatttcggtaaccgtgtcaaataagatggccgctaagtcagctaaggctacagccgcactggccaggcgtgaagaggagtccctggccgtgcctgctaagcgccgacgggtaaccgccgagatggaaggcaagtacgttataaacatgccgaaggggacaactcctaggacccgcaagattctggaacagcagcaggcagccaaggggctgcatagaacgtccgtgtttgaccggctgggagccgaaacaaaagccgacaccacaaccgggtctaagccaacaggcgtgtttagtcgactgggagcaacacccgagaccgatgaagaccttgcctgggatagtgataacgacagttctagcagtgtcctgcaatatgctggcgtccttaaaaagctaggtcgcggacccgctaaggcaagccctcagccagcgctgaccgttaaagcgaaggctacaagctctgcaaccacggccgcagcaccgacactcagaaggctcgccctgtccagtcggtctgggctggagagaaagcctgaatcactttcaaaagtgagcatcatcaagaggctgggcgcagcagcactcgtcccagaagcccaggattctcaggtcaccagcacgaagagtaaatcttctgcagaagtcaaggtgactatcaagcggaccctggtgggccctcgcggatctagttcatccgagggattgggagcacagatggatcatgctgggaccgtctccgtgtttaaacggctgggcagaaggaccttctag

SEQ ID NO: 54103 - DNA, 1269 bp, Artificial Sequence
  Description of Artificial Sequence: Synthetic coding sequence
atggtgatggcagctctcagcctcgtcgccgcttgctgggggagggccgcagccgatgaaagcgttcagctgccagccgcaccgggttcgagcgtcagagcgagagagactatggtgagtgtgactatggccacctctgagtggattcagttctttaaagaagcaggtatccctcctgggcctgcagtgaattacgcagttatgttcgtagacaatcgaattcaaaagagcatgctcctggacctcaacaaagagattatgaacgagcttggcgtaactgtagtcggcgatattatcgcgatcctcaaacatgctaaagtggttcacagacaggatatgtgcaaggccgctacagaaagtgtgccgtgctctcccagccccctggcaggcgagatccgtcgtggtacgagcgccgcatccaggatgatcacaaatagcctgaatcacgatagtcctccgtcaactcctcctagaagaccagatacatcaacttccaaaatctctgtgactgtgtcaaataagatggccgcaaaaagtgcgaaggctacagcagccctggcccgaagggaggaggaaagcctggccgttcccgctaaacgacgtagggtcactgctgaaatggaaggaaaatatgtgattaacatgccaaaaggaaccaccccaagaacgcgaaagatcctcgaacagcagcaggccgcaaaaggtctccatcgaacgtccgtgtttgaccggttaggcgctgaaaccaaggccgataccacaactggatcaaagcccacaggggtcttctctagactgggagccacgcctgagactgacgaggacctggcctgggactccgataatgactctagcagcagcgtcttgcagtatgcaggagtgctgaaaaaactgggtcgcggacccgctaaggccagcccgcagcctgccctaacggtcaaggctaaggccacgtcatctgcaacaacagccgcagcccctacgctccgtaggctggcgctatcttcccggagcggcttggagaggaagcccgagtctttaagcaaggtgtcaatcataaaacggctgggagccgcagcactggttcctgaagcccaggattcccaggtaacatccaccaaaagcaagtcctcagccgaggtgaaggttactatcaaacgcacgttggtgggacccaggggaagctcttcctctgaggggctgggggctcagatggatcacgcaggcacagtctctgtcttcaaacgcctgggacggaggaccttttag

SEQ ID NO: 54104 - DNA, 354 bp, Artificial Sequence
  Description of Artificial Sequence: Synthetic coding sequence
atgaccgtcctggaagctgtgctagaaatccaggccattaccgggtccagactcctttcaatggtcccaggacccgctaggcccccaggatcatgttgggacccgacccaatgtacccggacatggcttctttcccacactcccagacgtcgctggatcagcggccttcctcgagcaagttgtagactgggtgaggagccccctcccctgccctattgcgaccaagcttatggggaagagcttagcattagacatagagaaacctgggcttggctgtctcgtacagatacagcgtggccaggcgctcccggagttaagcaagcgagaatcctgggcgagctactcttagtttag

SEQ ID NO: 54105 - DNA, 354 bp, Artificial Sequence
  Description of Artificial Sequence: Synthetic coding sequence
atgaccgtgctagaagccgtcctggagatccaagctattaccggatcacgactgttgtcaatggtcccgggtcccgcacggcctcctggctcatgttgggatcccacccagtgcactcggacctggctcttgtcgcacacaccgcgtcgccgatggattagcggcctccccagggcctcttgtcgactgggcgaggagcctcctccactcccatattgtgaccaggcctacggagaggaactgtccatcagacacagagaaacctgggcctggctgtccagaacagacacagcatggcccggtgcccctggcgtgaaacaggcccgaattcttggggagctgttgctggtgtag

SEQ ID NO: 54106 - DNA, 1827 bp, Artificial Sequence
  Description of Artificial Sequence: Synthetic coding sequence
atgcttccccttctggactcgagcaaacgtgccggtactttaggaagcggatgcggtgtgccgcgagtccactcagccgcattgagtcgagaagagggtgcctcacgcgatatctggcgcatcaaggtctgggctcgagtaatgaccactccggcaggctccggctctggctttggatctgtgtcatggtggggtctgagtccagctttggacctgcaagctgagcgagacgcaaccgttgacgctctgcctactaccatggtgccacagcccgctgtcatactacccggtcctccagtggatcctgatagccaggcagacaccgttcactcaaatccagagctagatgtcttgttattaggaagcgtggacggacgtcacctgctgaggaccctgagtcgggctaaattctggccaagaaggcgtttcaatttttttgtgctggaaaataacctggaagctgtggctcgtcatatgttgatcttcagcctggccctggaagaacccgagaaaatgggccttcaagaacgctcagagacgtttctggaagtttgggggaacgcactgcttaggcccccagtcgccgcattcgtgcgagcccaagccgaccttttagcccacttagtccctgaaccggacagactcgaagaacaattgccttggctaagccttagagccctcaagtttagagaacgcgatgcgctcgaggccgtgtttaggttctgggcgggaggggagaaaggtccacaggctttccccatgtcacgtctttgggattcacgactgaggcactatcttggctctcgatatgatgctcgaaggggtgtgtcggactgggatcttaggatgaagctgcatgatcgaggagctcaggttatacatcctcaggaattccggagatggagagatactggagttgcattcgagcttcgtgactcttccgcttatcacgttcctaatagaaccctagcatccggaagactgctgtcttacagaggagaacgggtggctgcgcgtggctattggggcgacattgctactggtcccttcgtcgcatttgggattgaagccgacgatgaaagcctgttacgaacaagcaatggccagccagtcaagactgcgggagaaatcacacagcataacgttactgagctgcttcgggacgttgccgcttgggggagagctcgagcaaccgggggtgatttggaagagcagcagcatgccgagggatctcctgaacccggaacaccggctccaacgcccgagtcattcacagtgcatttcctgcccctagacagcgcccagactcttcatcataagagttgctataacggtagatttcaattactttatgtggcatgcgggatggtgcacctgctgatccccgaactgggggcatgtgtggcccctgggggaaacctcatcgttgagcttgcccgatatctggttgatgtgcggcaagaacagctgcaagggttcaacacacgggtgagggagctcgcccaggcagcagggttcgcaccacagaccggcgcacggccttcagaaaccttcgcaagattctgtaaaagtcaggagagcgcgctcggaaataccgttcctgctgtggagccgggaacccctccccttgatattttggctcaaccactcgaggcttccaacccagctctagaaggactcactcagccactgcagggaggtactccacactgtgagccatgccaactcccaagtgaaagtcctggctctttgagtgaggtgcttgcacagccccagggggctctcgcccctcccaattgcgagtccgattctaagaccggggtgtag

SEQ ID NO: 54107 - DNA, 1767 bp, Artificial Sequence
  Description of Artificial Sequence: Synthetic coding sequence
atgctgcccctgctcgacagctctaagcgcgcaggaaccctggggtcaggctgtggggtcccacgagtccatagtgcggctctgtctcgggaggaaggggcatctcgggacatctggcgtataaaggtgtgggctcgtgtcatgactacccccgctgggtcaggatctggtttcggctccgtgtcctggtggggactctctcccgctctggatttgcaagccgaaagccctccggtggacccagacagtcaagctgatacagtacacagtaatcccgagctggatgtactgctcctgggaagtgtggatgggagacatctgctcagaactctgtctcgggcaaaattttggccaaggcggaggttcaatttttttgtcttagaaaacaacctcgaagctgtcgctaggcatatgctcattttttcccttgcccttgaagagccagagaagatgggtttgcaagagcggtctgagaccttcctggaagtgtggggtaatgccctgctccgaccccctgtggccgcttttgttcgcgctcaagctgaccttttggcccacctcgtcccagagcctgacagacttgaagagcagttgccgtggctgtccctccgcgctctgaaattcagggaacgcgatgccttggaggctgtttttcgcttttgggcaggtggagagaaggggcctcaagcttttcctatgagtcgcttatgggatagcaggttgagacactaccttggttctcggtacgatgcacggaggggggtatccgactgggatctgcggatgaaattacacgatcggggagcacaggtgatccacccacaagagttcaggcggtggagagacacaggcgtggcattcgagcttagagactcatccgcctaccatgtgcccaaccgcacgttggcatcggggagacttctttcatacaggggagaacgcgtagccgctcgaggctactggggggatatcgccacgggcccttttgttgcatttggaattgaggctgacgatgaatctttacttcggacaagcaatggtcagccagtgaagacagcaggcgagatcacccagcataacgtgacagaactgctcagagacgttgcggcatggggtagggccagagcaactggtggagacctggaagagcagcagcatgccgagggtagtcctgagcctgggacccccgctgcaccaacacctgaaagtttcactgttcactttttaccgctcgactctgcccagacgctgcatcataagtcctgttacaacgggagatttcaacttttgtatgtcgcatgtggcatggtacatctcctgatacctgaactgggagcttgcgtggccccaggtggtaatcttattgtagagctggcacgctacttggtcgacgtcagacaggagcagctgcagggctttaacacacgggtgcgagaactggcccaggccgcaggcttcgcaccccagaccggcgctcggccttcagagacatttgccagattctgtaagtcacaggagagtgcccttgggaacacagttcccgcagtagagcccggaacgccaccattggacattctagcccagccattagaggcaagtaatccggcacttgaagggctaacccaaccactgcaagggggaacacctcactgtgaaccttgccagctgccctctgaatccccgggtagcctcagcgaggtgctggctcaaccccagggcgctttggccccacccaactgtgagagtgattcaaagaccggcgtgtag

SEQ ID NO: 54108 - DNA, 1464 bp, Artificial Sequence
  Description of Artificial Sequence: Synthetic coding sequence
atgaagatgcgggcacagattccagagtccctgcgcgaagaagggattgaaatactgaagccacagtttttcgtgcttgagaataatctcgaagccgtcgcgaggcatatgcttatattctcccttgcgctggaggagccggaaaagatgggacttcaggaacgatctgagacttttctggaagtctggggcaacgcgctgttaagaccacccgttgcagcgtttgtgcgtgcccaagccgatctgctcgctcacctggtacctgagcctgatagactggaagagcaactcccctggctgtcgctgcgagcgctaaaattcagagagagagatgctttagaggcagtctttcgattctgggcagggggagagaaagggcctcaagcatttccaatgagtagactctgggacagtcgactaagacattacctgggctctaggtacgacgcacgaaggggcgtatctgactgggaccttagaatgaaacttcacgatcggggtgcacaagtcatccatccccaggaattccggaggtggagggatactggcgtcgcattcgaattacgagactccagcgcttaccatgtgccaaacaggacattggccagtggcagactcctctcctaccggggagaacgcgtggccgcacgaggctattggggcgatattgcaactggtccttttgtggcattcggaattgaagcggacgatgaatccctgctcagaacatcaaacgggcaaccagtgaagaccgccggtgagattactcagcacaatgtaacagaactgctgcgcgatgtggccgcatggggcagagcccgagccacaggaggagatcttgaagagcagcagcatgccgaaggctctcctgagcccggaactcccgctgcgcctacaccagagagctttactgttcactttctcccactcgatagcgcccagactctccatcacaagtcttgctataatggacgcttccagttgctgtatgtggcctgtggtatggtccacctccttatccctgagttaggagcatgtgtggccccaggcggaaacttaatagtggagctggccagatacctggtcgacgtgcggcaagagcagttgcaaggatttaacacaagagttagagaattggcccaggcagccggattcgcaccccagactggtgcgaggcctagtgagacattcgctcggttctgtaagtcacaagagagcgcgctgggaaatactgtcccagcagtagaaccaggaactcctcccctggatatcctggctcagcccctggaagccagcaatccagctctcgaaggcttgactcagcccctgcaaggcggtacccctcactgtgagccatgtcagctgcccagcgaatctccaggaagcctgtcagaagttctcgcacagcctcagggcgctttggccccacccaactgcgaatcagacagcaagacaggcgtctag

SEQ ID NO: 54109 - DNA, 783 bp, Artificial Sequence
  Description of Artificial Sequence: Synthetic coding sequence
atggcagccgcagcattgcggcgattctggagccgtagacgcgcagaggcaggcgacgcagtggtagccaaaccaggggtgtgggcaaggttgggatcctgggcaagggcactcttgagagactatgcagaggcttgtagggacgcgagcgctgaagcccgtgctcggcctggtcgcgcagccgtttacgtgggactgctcgggggagccgctgcttgttttacactagcgccttccgaaggagcattcgaggaggccctgttggaagcctccggcacactcctgttactggccccagcaacgaggaaccgggagagtgaggctttcgtgcagaggcttttatggctccggggacggggaaggctgcggtatgtaaacttgggtctgtgcagtcttgtgtatgaggcaccctttgacgctcaggcctccctctaccaggcaagatgccgatacctccagccacgatggaccgactttcccggacgtgttctggacgttggctttgttggccgatggtgggttctgggggcatggatgcgcgattgcgacatcaacgacgatgagtttttgcatttaccagctcacctgcgggttgtgggaccacagcagctccacagcgaaacgaacgagcgtctgttcgacgagaaatacaaacccgtcgttctgacggatgaccaggtggaccaggccctgtgggaggaacaggtgctgcagaaggaaaaaaaagaccggctggccctttctcaagctcactcactagtacaagccgaggcgccacgctag

SEQ ID NO: 54110 - DNA, 1005 bp, Artificial Sequence
  Description of Artificial Sequence: Synthetic coding sequence
atgaaaccacctcccagacggcgagccgcacccgcaaggtacctgggtgaggtcaccggacctgctacatggtctgctagagagaagaggcagctggtcaggctgctccaggccagacagggccagcccgagcctgatgccacagagctggctcgcgaattgcggggtcgtagcgaagctgagattagggtctttttacaacaactgaaggggagagtggcacgcgaggctatccagaaggtccatccaggcggtttgcaaggacctcggcgacgagaggcccagcctcctgccccaatcgaggtgtggacagatctggccgaaaagataactggccctctagaggaggctctggccgtcgcattctctcaagttttgacaattgctgcgaccgaacccgtgactcttctccactccaagccgcctaagcctacccaggccaggggaaagccactgctactttccgccccaggcggtcaggaggatcccgctcctgaaatcccaagctccgcaccggcagccccatccagtgcccctaggacacccgatcccgcaccagaaaagccttcagagagctcagctgggccaagcactgaagaggatttcgctgttgacttcgaaaaaatctataagtatctgtcctctgtcagcagatccggccgatctcccgagctgagcgcagctgagtcagcagtggtgctcgatttgctcatgagtttaccagaggaactaccgctgctaccgtgcacagctctggtagaacatatgaccgaaacttatctgaggctgaccgctcctcagcccattcccgctgggggatctttgggtcccgcagccgaaggcgatggtgccggatctaaggctcccgaggaaacacccccagctaccgagaaggcggagcacagtgaactgaaatctccctggcaggccgctggcatttgcccccttaaccccttcttagtaccccttgaattgctaggaagggccgcaactcccgcacggtag

SEQ ID NO: 54111 - DNA, 300 bp, Artificial Sequence
  Description of Artificial Sequence: Synthetic coding sequence
atggcccaaggacagagaaaatttcaggctcataaaccggcaaagtccaaaaccgccgcagccgcaagtgaaaaaaaccggggtccaagaaaaggcggtcgggtcattgcacccaagaaggctagggtagttcagcaacagaagctgaaaaagaatcttgaggtcgggattcgtaagaagatagagcacgatgtggttatgaaggcaagctccagtttgccaaaaaagctcgctctgctgaaggctcctgcaaagaagaaaggcgcagccgcagctacatcatctaaaacgccatcttag

SEQ ID NO: 54112 - DNA, 420 bp, Artificial Sequence
  Description of Artificial Sequence: Synthetic coding sequence
atgagagcgggtggactcgttgatgggagatattctcccgttgcccctcagtggagacctcctggtgagacccacaccggcggacatgggaaacggctccacggtccaggtagagacgtgctctccacttcttacgatgaagatttcaatcatgagccttgtcagaggaaaggccacaaggctcactgggctgtttcggctggagtgctgctaggggtcagggcagtgccttcactcggatacacggaggatccggaactcccagggctgttccacccagtgttgggcactccctgtcaaccaccatcacttccagaagagggcagccccggtgcagtgtacctgctgagtaagcaaggtaagtcctggcattatcagctctgggactatgaccagggaccacccttaagttctcattag

SEQ ID NO: 54113 - DNA, 1056 bp, Artificial Sequence
  Description of Artificial Sequence: Synthetic coding sequence
atgacctccccatgctccccaccacttaagcctccgatctcgcctcccaaaacgcctgtcccacaagcctcaagcatccctagtcccccactacctcccagccctctagacttctctgccttgcccagtcccccttggagtcagcagacccccgtgcctccgcctctgcccctaccaccgcctccagcagcaacaggcccagcccctaggcatgtcttcggccttgagaagtctcagctgcttaaggaggccttcgataaggcgggacccgtgcccaaggggagggaggatgtgaagaggttgctgaaactccacaaagaccgttttcgtggagatctgcgctggatcctcttctgtgctgacctgccttccctcatccaggagggcccacagtgcggacttgtggcactatggatggccggtaccttgctgtcaccacctagtggcgtgccccttgagaggctcatccgcgtggctacagaacgcggttacaccgctcagggagaaatgttctcagttgcagatatgggtcgattggcacaggaagtgctcggttgtcaggcaaagttactgagtggaggtttgggcggaccgaatcgtgacttagtattgcaacatctggttactggccaccctttgctgattccttatgatgaggacttcaatcatgagccgtgccagagaaagggccacaaagcgcactgggctgtgtccgccggtgtactgctgggggtccgcgcagtgccttcgcttgggtacactgaagatcctgagctgcccggtctgtttcaccctgtgctaggaaccccttgccagccccctagcttgcccgaagaaggttcaccaggggcagtttatttgctgagcaagcagggaaaatcctggcactaccagctgtgggactatgatcaggtaagggaatctaacttgcaacttaccgactttagcccctctagggcaacagatggtagggtgtacgtggtgcccgtgggtggcgtgcgagctggattatgtggtcaggcactgttgctcacgccccaggattgcagtcactag

SEQ ID NO: 54114 - DNA, 1440 bp, Artificial Sequence
  Description of Artificial Sequence: Synthetic coding sequence
atggaccgctcattgcccgtgtttagcattcaagattccccgttcggcgacgcaccgttgggccgatcacactattggcccagccaatcacaaacttggtgtccgaagacactttcccctagcagaagccagcgtagcagattaccccaggcccctaaggcactagcgactggcccaaatagtcctgaactctttgaggagtcctggccatcctcctctggcacaccttcactgcctagtacgactgaaggacagatgtgggcctcccctgcacccactctcatcgatagcggcgacagcgtggtcgcaaaatacattaatcgatttcgtcaggcccagcctacgagtcgagaggaaaggcagcctgccggacccaccccagccgacttctggtggctccagtcagactcccctgatccgtcatcccagagcgcggctgcaggtgctaataaacccgaagggcgaccccacacagcagtgccaaccgccgtcaacgtgactagcgcctcccacgccgttgcccctttgcaggagatcaagcagaatctgcacacgtggaactcgagcttactggatctcgaaacgttgagcttgcaatcccgtgccgctaggcttctgaagcgaagcaaagccagtatcagttcttctagttctctttcgccctccgacgcatctacatcctcttttcctactagctccgacggcctgagccccttttctgaaaccttcattccagattccagcaagggattgggtcccagggcaccagcctccccggctccagcacaggcgcaaacacctacgccagccccagctccggcatcttcgcaggcaccactgagacctgaggacgatattctgtatcagtggaggcagcgacggaaactggagcaggctcagggctccaaaggtgacagggcctgggtcccacccctcacgcctgcccttagaactctggctgagagtctcaaggcaaaggctctgccccctgccgcaggatcagtcatccgcaagtccgaagcaaccccttcaccaggcgcatgcctccagcccgaagtgcccctcagtcccgcagagcaagcaaccacagtcaaagcctccccgcctgctttccaggttggctcacctgaggctctggcaccccctccgccagccgcagaccatgcaccttcggaggccttgctggctcaggccctcctcctgcaggccgcagaagattcggatggatcggaatttcaggacgatcctgtgctccaggtcctccgggcacatagggcagagcttagcagacaaaagcgagaggctgatgctcgcctgtccttcctattggaccaggccgaagacctgggaagctggagccctccagccggatctccaccacggtctccacgaagactgctgagaagggagggggattcccttgaggctcgtcggctgtag

SEQ ID NO: 54115 - DNA, 330 bp, Artificial Sequence
  Description of Artificial Sequence: Synthetic coding sequence
atgtgggccagccctgcccctactctgatcgactcaggcgattccgtagtggcaaagtacatcaacagatttaggcaggctcagccaacctccagagaggagaggcaacccgctggacctacaccggcagacttttggtggcttcagtctgactcgcccgaccctagttctcaatccgctgcagccggagccaataagccggagggtagaccacacacagcagtgcccaccgccgtcaacgtgacttctgcatcacatgccgtggctccattacaggagattaaacaagtgacgtccccatttacgccttcactgggctgcctcaattag

SEQ ID NO: 54116 - DNA, 1914 bp, Artificial Sequence
  Description of Artificial Sequence: Synthetic coding sequence
atgacgaagaggaaaaaattgcgaacttccggtgagggcctgtgcccaccaaaacctctgaagaacccaaggctcggagacttttatggagatcctcagagcagcatgcttggttgcctgcaccaccccgaagaacccgagggcaagctcggccctgtccctagtacccagcagcacggagaggagcccggaaaagccgtgtctagctctccagatgaggagacaggctctccctgccggctgctgcggcagcccgagaaggagccagccccactgccaccttctcaaaacagtttcggacgattcgtgccacagtttgcaaagtcaaggaagactgtaacccgaaaagaggagatgaaagatgaggataggggttcaggagcattctcattggagactatcgcagagagtagcgcccagtcccccggttgccagctcctggtcgaaacacttggcgttccgttgcaggaagcaactgagcttggcgatccgacccaggctgattcagctagaccagaacaaagttcccagagtccagtccaggccgtccctgggtcgggcgactcacaaccggacgacccaccggacagaggaactggactaagcgcctcccagagggccagtcaagatcatctgtcagagcagggagctgacgactccaagcccgagaccgatcgggtgccaggcgatggcggacagaaagagcacctcccctcgatcgactcggagggggaaaaaccagaccgcggagcacctcaggaaggcggagcccaacggacagcaggtgccggattaccagggggtccgcaggaagaaggggacggcgtcccctgcactcctgcctcagcccctactagcggccctgccccaggcttgggacctgccagttggtgtctggagccagggtcagttgcacagggatcccccgaccctcagcagaccccttctagaatgggaagggagggcgaaggtacacactcctctctcggctgctccagtttaggtatggtcgtgatcgccgatctaagcactgatcctacagaactagaagaaagagcattagaagtggccggacccgacggtcaggcaagcgcgatatctcccgcatcacctagacgcaaagctgcggacggcggacatcggagggcattgccgggatgtacatctcttacaggcgaaaccaccggggagtccggagaagccggacaggacggtaagccaccgggagacgtgcttgtgggtccgacagccagtcttgccctggctccagggtctggtgaatcaatgatgggggcaggcgattctggccatgctagtcccgacacgggcccttgcgtgaatcagaagcaagagccaggccctgcacaagaggaagcagagctgggagggcaaaatcttgagcgtgatctcgagggattccgggtgtccccccaggcatctgtcgtcctggagcaccgcgaaatcgccgacgatcctctacaagagcctggcgctcaacaggggattccagatacgactagcgaactagccggtcagcgcgaccacctgccgcatagtgccgatcagggcacctgggcggattcccttgccgtggaactcgacttcttactggattcacagatccaggatgcgctggacgcctctgactttgaggcgccacctgaacagcttttcccaagtggcaataagccaggcccttgttggcctggcccttcctcccatgctaatggcgatcccgtggcagtggccaaggctcagccaagtaggctgattatgggtacccaccgggatcttgaagccttcaaacggctaaattatcggaagacaaagctcggcggaaaagcaccgttgccttatccaagtaagggaccaggaaatatcccgaggggtgacccaccgtggcgtgaactgtag

SEQ ID NO: 54117 - DNA, 2007 bp, Artificial Sequence
  Description of Artificial Sequence: Synthetic coding sequence
atgacaaaaagaaaaaagctgagaacatctggcgagggtctgtgcccacccaagcccctcaagaatcctcggcttggcgatttttatggggaccctcagagctcaatgctcgggtgtttacatcatcccgaggagcctgagggcaaactcggcccagtgccctctacacagcaacacggggaggaaccgggaaaagctgtgtcgtcatctccagacgaggagacggggtctccctgtcgattacttagacagcccgaaaaggagcctgcccctctccccccatcccagaactcttttggcagattcgtaccacagttcgctaaatcgaggaagactgtaacacgcaaagaagaaatgaaagatgaggacagaggctctggagcatttagcttggaaactatcgctgaatcctcagcccagagccccggatgtcagctactggtcgagacacttggagttcctcttcaggaggctaccgaactcggcgaccctacacaagctgactccgccagacctgagcagtcctcacagagtccagtccaggccgtgcccggtagcggcgactctcaacctgatgacccacctgacagagggacaggactgtccgcttcccagagggccagccaggatcacctgtccgaacaaggagctgatgacagcaagcccgaaacggaccgtgtccccggagacggtgggcaaaaggagcatttaccctcaatcgactctgagggagaaaagcctgatcggggagcgcctcaagaaggcggtgcacagaggacggcaggagcaggcctgcccggaggacctcaggaagagggagacggggtaccgtgcacacccgcttccgctcctacatctggtccagccccaggccttggtcctgcatcatggtgcctggaacccggttcagtggcacagggttctcccgatccccagcaaactcccagtagaatgggacgggaaggggaaggcacacattcttcacttgggtgcagcagtcttggcatggtggtaatagcagatcttagtactgacccaacagaactggaggaaagagcgctggaggtggctggcccagacggccaagcatctgctattagcccagcttcaccgaggagaaaagctgcggacgggggtcaccgccgagcactcccgggatgcacttcgctcaccggcgagaccacgggggaaagcggcgaagccggacaagatgggaagccccctggggacgtgctggtcgggccaactgcttctctggctctggctccagggtcgggtgaatcgatgatgggggctggggactcagggcacgccagcccagacacggggccttgtgtaaatcagaaacaagagccgggtccggcacaggaggaggctgagttggggggacagaacttggagagagacctagaaggttttagagtgagccctcaggcgagcgtggttctggagcaccgcgagattgctgacgacccgttacaggagccaggcgcacagcagggtatccctgataccaccagtgagcttgcaggacaacgggaccatctgccccacagcgccgaccagggaacctgggccgacagccttgcagtcgaattggactttctgttggacagccagatccaggatgcactcgacgcaagcgacttcgaagctcccccagagcaactgtttccatcgggcaataagcctggtccttgctggcccggaccatcttctcatgctaatggagacccagtggccgtggccaaagcccagcctaggaccttcgtcggcatccaagcatctgaagcctcaaggatggaggatgccactaacgtggtgaggggactcatagtggagctgagcaaccttaaccgacttatcatgggcacgcatcgagacttggaagccttcaaaaggcttaattaccggaagacaaaactggggggtaaagctccactgccctacccgagtaaaggccctgggaacatacctcgaggcgaccccccatggcgcgaactgtag

SEQ ID NO: 54118 - DNA, 606 bp, Artificial Sequence
  Description of Artificial Sequence: Synthetic coding sequence
atgattacagagactgcggcagagcccacggtgccagctgtccccgcagctgaggaagctacagaagccagagggcgagaggagccggcatggccctggaaggacgcgcctatccgcacactggtgcagagaattcaccagctgcaggcggaacgcgctcaaggctttcgccgactcgaggagtggcttgcacccgttcagggccttcgcgcatgggggagggggctcagagtgcccacctgccggagaggacatcgacagtaccttaggagcggcccagactatgattttgccagatacagatctacagtgcacggcgttactcaagcctttgccgctgcctctagagaggtgctagcagtcgaggccgagctaggcggtccccgtcgacagcctttgctggctggccatgtccgaagcttgcaggagctcgaacagacacgtctgggtactgtggccctccttcagctcatggagactcctgagcttgccggtcaggaggacgccgtgcggatgcagcaactcaaaatgaaggtaatcaaaacaatggaagccatttccgaagtcctgcaggatcttcggtttgacgccgaatccgcggaatag

SEQ ID NO: 54119 - DNA, 540 bp, Artificial Sequence
  Description of Artificial Sequence: Synthetic coding sequence
atgattacagaaactgccgcagagcctaccgtccccgctgtgcccgcagctgaggaggcaaccgaggcccgtggccgtgaagagcctgcttggccttggaaggacgcccctatccgcacactcgtccagaggattcaccagctgcaggctgagagagcccaggggttccggaggctggaagaggggcataggcagtacctccgtagcgggccagactacgattttgcccgttacagatctactgttcacggcgtgacgcaggccttcgctgcagccagtcgcgaggtgctggccgttgaagctgaattaggcggtcccagaagacagccgctattggcaggacatgtaagaagtttgcaggagctggagcagaccaggctcggcactgttgcactgctccagcttatggaaacaccagagctcgctggacaggaagacgcggtccggatgcagcagctgaagatgaaggtgataaagacaatggaggccatctcggaagttctgcaggatctgcgcttcgacgctgaaagcgcagaatag

SEQ ID NO: 54120 - DNA, 876 bp, Artificial Sequence
  Description of Artificial Sequence: Synthetic coding sequence
atgagccaggaaggagtagagctcgagaaatctgtgcgcagattgagagaaaaattccacggcaaggtgagctctaagaaggctggtgccctcatgaggaagttcgggagtgatcacacaggggtggggagatcaatcgtttacggagtgaagcagaaagatggtcaggaactctctaacgacctcgacgcccaagacccacctgaagacatgaagcaggaccgcgacatccaggccgtggccacaagccttcttcccctgacagaggctaacctgcggatgttccagcgagctcaggatgacttaattcctgctgttgacagacaattcgcatgttcaagttgcgatcatgtttggtggaggagggttccacagaggaaggaggtctcgaggtgtcggaagtgtcggaaacggtatgagcccgttccggctgacaagatgtgggggctcgccgaatttcactgcccaaaatgcagacataactttaggggttgggcacagatggggtcccctagtccttgctatggatgtggtttcccagtttaccccacgcggatcctcccgcctcgctgggaccgagatcccgatagaaggtctacccacacgcactcctgcagtgcggcagactgttataaccgaagagagccacacgtcccgggaacgtcatgcgctcatcccaagagcagaaagcagaatcacctcccaaaagtgctgcacccgtccaatccccatattagctccggaagcactgtggccacttgcctctcgcaggggggtttacttgaagatctggataacctgatcctcgaggacctcaaggaggaagaggaggaggaagaagaggtcgaagatgaggaaggagggcctagagaatag

SEQ ID NO: 54121 - DNA, 723 bp, Artificial Sequence
  Description of Artificial Sequence: Synthetic coding sequence
atgtctcagcaccagcaggcctgtggcatctgccgccaagaggacccaccggaggatatgaaacaagatagggatatccaagccgtggccacctcactcctacctcttacagaagcaaatttgcgcatgttccaacgtgcccaagatgatctgatccctgctgtggaccggcagttcgcatgttcctcatgcgaccacgtgtggtggcgcagagtgccccaaaggaaggaggttagtaggtgtcgaaagtgccggaagagatacgaaccagtcccagccgacaagatgtggggcctggccgaattccactgtcctaaatgcagacacaactttcggggatgggcacagatgggtagccctagtccatgttacggctgtgggttcccggtctatcccacgagaattctacccccacgttgggacagagaccccgacagacgctcaacacatactcactcctgtagtgcagcggattgttataaccggagggaacctcacgtaccagggacgtcctgtgctcatcctaagtctaggaaacagaaccacctgcccaaggtgttgcatccttcaaacccccatataagcagcgggtccactgtcgccacctgtctctcccagggtgggcttttagaggacctggataatctgatcttggaggacctgaaggaagaggaggaagaagaagaggaggttgaagatgaagaaggtgggccaagagaatag

SEQ ID NO: 54122 - DNA, 1884 bp, Artificial Sequence
  Description of Artificial Sequence: Synthetic coding sequence
atggagcggcctgaaccccctcccggtactgccgcaggtcaggaggagcaagagctgagagaaagagcgttcttctcctgggccgaatttagcagatttttcgatgcctggtgtcagcagcgcttggccctgttcttcgttaagtccagtatgcacttggctcgctgtaggtgggcctctgctccaccactgtatacgctgatagatgtgctcaaatatagctacgtcaggctggtgtgtaaggacgtccgcgcaccctcgcgaccagccgtcggccctcctcagcctggctgccctgcatttataatcgtgaagctgtcccccctgcgggataggctcgtggtgacagagtgccagctgacgcattctcatccggcatgccctctggagttcgcatattactttcgtcccggtcacctgctggcgaatgcatgcctgcccgttagaacaacgaataaaatcagcaaacagttcgtggctccagccgacgttcgtaggctgctgagctactgtaaagggcgtgatcatggggtactggacgcccttcacgtgctagagggtctgttcagaaccgatcctgaggccaaggtcaagctggtctttgttgaggatcaggctgtggtcgaaacagttttcttcctgacgtcaagaactcgggctcttttgcggaggttccctaggatgcttctggtcgaccgcctgccaggactgcaaggagcactggatcttctggcagttctttgtgtcgacggaagtgggagggctagacaggcagcctgttgcgttgctcgccctgggacgccatcactcttgcgctttgccctggccagtttactgcagagtgccccagatgtcaaagggagagtgcgctgcctaaccgccggtcccgaggtggccgctcaattaccagccgtcagacagctcctgccctgtgctagggtgcagatttgccgggctcagggcctggagaccctgtttagcaaggcccaggaactcgggggagcagggagagaagacccaggcctgtggagcaggctctgccgcttggccggagcgtcctcccccgcagcttatgacgaggccctcgccgagttgcacgcccacggccctgccgcttttgtcgactactttgagcgaaattgggagcccaggcgagatatgtgggtccgctttcgagcttttgaagcggcaagggatctggatgcctgtgccttggtcagaggtcatcgcagacgccttttaagaagactttcacctagtaggggtgtggcacagtgtctacgagatcttgtcgcgatgcaatgggctgacgccgctggggaggctgttccggaaggtcctgatgggggagggccatggctggaagatgaaccagggagaggggctcagggggagaatgagagggtccggggactggagacaggtgactggggcggagctcctaaagagggctccatttggagaggcgcacagatggagaaagaatgggccagagcactcgagacaagggattgggggggagcccagtttgagggagaaaagggcagagctctgcagatccgcgactggaggggcggacggctggaaaatcagaagccaagggggctggaaggcggtgtgctaaggggctccaagctggaaaagggacatctaaggggtcccgaaatacgagattggcggggaccacaactcgagggggagaaggattggggcctcgaaggttacgtgtggcggggatcacaattggaggatcaagcattgaggggtctcgagggctatacttggagagtcgcgcaactcgaggataggcggagcaccactgacctgcgaggcacccagttcgactacgagcgaggcaagggtgaatcaactgaggatagatag

SEQ ID NO: 54123 - DNA, 393 bp, Artificial Sequence
  Description of Artificial Sequence: Synthetic coding sequence
atggagctgtggaggcaacttaatcaagcaggtcttgtcccaccaggcctggggccacccccacaggcgctcagagaggtgtcccctgtcgaaatccctgggcagacactcagaaccgctggggctgatactggtggcgcttgcgattcacttctctggataagggaggaactgggcaaccttcgccgtgtggacgtgcagctgttgggccagctgtgttcccttggccttgagatgggagctctgcgcgaagaacttgtaacgatactggaagaggaggaggagagttctaaggaggaagaggaggatcaggagccccagagaaagcaggaggaggaacatttagaagcctgcccagcaccacaccccccagatttcgaaatgatgatatag

SEQ ID NO: 54124 - DNA, 630 bp, Artificial Sequence
  Description of Artificial Sequence: Synthetic coding sequence
atgcagaccctgagacaggaggcagcacgcccatgcattccttccggcacactagaagcaagtttccccgctcccctgtattcagacgactacctgtctctcgaagggagccggtggccaccagctattagacaagcaacacggtggaaatacacccctatgggaagggatgcagccggacagttgtggtacacaggtctgacaaatagcgacgcatgggaggcgtggtacaacctgccccgagctccggcaagcccttttagagaagcctacaatcgctggcattcatgctaccagcacagggaatgctcaatgccaagcgcttacacccagcatttgcgcgaaactgcctggcacgaccccattgtgcctgcccaataccaggccccttccacgcgctgggggtcggcgctctggaaggacagacctataaggggaaaagagtatgtcctcaaccggaaccgctatggcgtggagcccctctggagggcctcggattacgtgcctagcctatccgccccacagaggccacccggtacgacacagaattacagggagtgggttttggagccctactgcccaagcacttgtcagcgctcccctccctctctcacccccacgcctcgatag

SEQ ID NO: 54125 - DNA, 390 bp, Artificial Sequence
  Description of Artificial Sequence: Synthetic coding sequence
atgcgacttaaggttgggttccagggtggcggatgttttagaaaggacgctctctgtctggagggcggtgtgtcggccagatgggcccgagctccccacagcgctccgctgcgccctcccagggaactgcacgccgctccacctccagcaacacctacgcagaccgtagtacgaccagccggatttcctcggagaacacgcttaatggtgcgcagtgcccctccaacacagcggccacctactggctcaggctgcgttagcggactgtggcggaagggacttggtctccgtccccaaacattactgagggtggggtcagtggtgctgtcctctgcacccgctttgcggccacgcctagggccttgcctgcgccctcccccatctgactag

SEQ ID NO: 54126 - DNA, 222 bp, Artificial Sequence
  Description of Artificial Sequence: Synthetic coding sequence
atgggagtgaagctggagatcttcaggatgattatttaccttaccttccccgttgcgatgttctgggtatcaaaccaagctgaatggttcgaggacgatgtgatccagcgaaagcgggaactgtggccccctgaaaagctgcaggagatcgaggaattcaaagaacgcctgaggaaacgcagggaagagaagctgctgcgggacgcacagcagaacagctag

SEQ ID NO: 54127 - DNA, 5954 bp, Artificial Sequence
  Description of Artificial Sequence: Synthetic coding sequence
atggaattgacgcctggggctcagcagcaggggatcaactatcaggaattgacatcaggttggcaagacgttaaaagtatgatgctggtacccgaaccgaccaggaaattcccatccggccctctactcacctccgtaaggtttagtaacctttcaccggaatcccagcaacaggatgttaaaagtttggaatttactgtcgaacctaagctacagtcagtgaagcacgtgaagctgtctagcgtcagtctgcagcagacaataaagagcgtcgaactggcgcctggttcccttcctcagagagtgaagtatggagaacaaactccgcgaacaaactaccagataatggaatccagcgaattaatacctaggcctggacatcagtttgccaagtacgctgaaatgataccgcaaccgaagtaccagatacccaagagtgccaatctgatatctatccccatctatcacgcaaccgaatcatccgagatggcccaaggcctcgcatataaagggattgataccgtagagaaatctgtggggttaacccctaagctgacagggagagcaaaagagtctctgggaatgctcttacagcctgatctgcaggtccccaagtttgtggatctgacccctatggtgagggaccagggctctaaatttctcggactgactccagagaaaagctatcagatccttgagactatggagctgcttagccagtcgagacctagagtgaaggacgtgggcgaactgtacatgaagcctctccagcagactgtggaatacgagggcatcactcccgaactcaagcactactttaccgaggccatggggctgacagcggaggctaggatccaggcaaatgaattttttggaatgacaccaaaacccactagtcaggcgactggatttgccgaacggagccccaggctgtgtccccaaaatctggagtgcgtggaagtgatctccgagaagagactccaaggcgaggaatctgtcgttctcatcccgaaatctcttcaccacgtacctgattccgcatctggcatgactcctggcctcgggcatagagttcctgaaagtgttgagctgacgtccaagtctggtgttcaggtggagaaaacgctgcagctcacgccgaagccccagcaccatgtgggctcacctggcattattagcggcctgggccatcaggtacccgagagtgttaacctgacttgcaaacagtggcttcagatggaggaatcgctagaggtaccattgaaacagaccagtcaggtgataggacacgaggaatcagtcgagctcacctcagaagctcgacagcacagggaggtctctatgggtctcaccaagtccaagaatcagtcgatgaagtcccccggtacaactcctggtcctctggggaggatcgtggaattcatgaggatttcgcccgagccgctggatcaagtgactgagtctgcccgaacgcagctgcaggtcgcccagagcgaggaggtcatcctgattgacgttcccaaagttgtgcagagcgtcaaggttacaccagggcctccattccagattgtaaaatccgtgactattcccaggcccaccccccaaatggttgagtacattgaacttacacccaaattgcagtatgtccggcctagcgagcaccatactgggccttgccttcaggacgtgaagtctactaaactcatcacaaagccgaagcaccagattctggaaaccgtagagctgactggattccaaattgtgaaaactatgctgatcccagggccatctctgcagatagttaagagcgaagagctggctcctggaccaattccacaagtggtcgagcctattggggtagctctggaaagcggtatcgaagccattaattgtgtcgatctgttacctcggcctcatttgcaggaactaatcgtccccgcagagctcacccctagcccatgtacgcaggtcaaaagcgcggagctgactagtcctcaaacctcaccctttgaggagcatactatcctaacccacaagcagggtcttcaggctgtcaaatctactgtcatcaagacagaaccacccaaggtcatggaaaccgaagatctgaaccttggtcacgtatgccagaaccgtgattgccagaagttgacatctgaggagctacaggtcggcacagactttagccgtttcttacagtcgtctagtaccacattgatttccagcagcgtaagaactgcaagcgaactcgggggactgtgggattccggcattcaggaagtcagccgtgctttagatataaagaacccgggtacagatattcttcagcccgaagagacatatattgaccctacaatgattcaatcccttacctttcccttagctctgcataatcagtcttctgacaaaacagccaatatagtcgaaaacccatgccccgaaattctcggcgtcgacgtgatctccaaagaaacgaccaagcgaaagcaaatggaagaactcgagaattctctgcagaggcacctgccacagtcttggagatcacgttcgaggaccttccaggccgaatctggcgttcagaaggggcttataaagtcattcccgggaagacagcacaacgtctgggagagtcacgcctggcgccaacgactccctaggaagtacctgtcaacaatgctcatgttgggcaatatcttaggcaccaccatggaacgtaagctgtgtagccagaccagcctcgcggagcgtgctactgcagatacatgccagagcattcaaaacttgtttggaatcccagcagaactgatggaaccatctcagtcccttccagaaaaagggccagtgacaatttcccagccttccgtagtgaagaattacatccagaggcacacattctatcacggacataagaaaagaatggccttgcggatttggactaggggatcaacaagctccattattcagcagtactctggcactagagtgcggataaagaagactaacagtacgttcaatggaatttcacaggaggtcattcagcacatgcctgtgagctgcgccggaggtcagctgccagtgcttgtgaagagcgagtccagcctgtctattttttatgaccgggaggatcttgtgcccatggaagagtctgaagattcccagagtgacagccagactcgaatcagcgaatctcagcactcacttaagcctaactacctgtctcaggcaaaaactgacttctctgagcaattccagctgttggaagatctgcagttgaagatagcggctaagctgctgcggagccagattccacccgatgtccctccgcctctcgcttcagggttggtactgaagtatcctatctgtctgcagtgtggccgttgtagtgggttgaactgtcaccataagttgcagacgacatcaggcccttacctgctgatctaccctcagctccacttggtccgcactccagaaggccacggagaggtgagactccatctgggattccggctgagaatcggaaaaagatcccagatttctaagtatcgggagcgcgacagaccagtgatccggcgtagtccaatttccccgagccagcggaaagcgaagatttacacacaggcttcgaagtccccgacgagtacaattgatcttcagagtgggcctagccaatctcccgctcccgtccaggtgtacataagacgtggccagcgaagtagaccagacctggtcgagaaaactaagaccagagcacccggacattacgagttcacacaagttcacaatctccccgaatcggacagcgaatctactcagaacgagaagagggctaaggtcaggacgaaaaaaaccagcgatagcaaatatcccatgaaaagaatcactaaaaggctccggaagcaccggaagttttatacgaatagccgcactaccattgaatctccctcgcgggagctcgccgcacacctgcgcagaaaacgcatcggagctactcagaccagtactgcgagtttgaaacgtcaacccaaaaagccatctcaacctaaattcatgcagctgctctttcagagtttgaagcgcgcattccagaccgcacacagagttatcgccagtgtgggcagaaagccagttgacgggactagaccggacaacctgtgggcatccaagaattattaccccaaacagaacgctcgggactattgcttgccctcgtccattaaaagagataagcgtagcgccgacaaactgaccccagctgggagtacgataaaacaggaggatatcctgtggggcggtacagtgcagtgcagatcagcccagcagcctcggagggcttattctttccagcccaggcccctccggttacctaaaccaacagacagtcaatccggtatagccttccagaccgccagcgtgggtcagccacttcggacagttcaaaaggatagctcatccagatcaaaaaaaaacttttacaggaatgagacttccagccaggagagtaagaatttaagcactccagggaccagagtgcaggccaggggacgcattctccccggtagtccagtcaaaagaacatggcatcgccacttgaaagacaagctaacgcacaaggagcacaatcacccaagcttctatagggaacgaacgccccgagggccttctgaaagaacccgccacaatccatcctggaggaaccacagatctccctctgagcgcagccagcgctctagccttgaacgcaggcatcactctccttctcagaggagccactgttcacccagtcgcaagaaccatagcagtcccagcgagcggtcgtggcgaagcccatcacagcgaaatcattgtagtcccccagaaagatcatgccacagcttgtccgagaggggcctgcactcgccatctcagcggagccacaggggaccttcccagcgcagacaccactcaccctccgagcgttctcaccggtctccaagcgagcgctctcacaggtctagctctgaacggaggcatcggtcaccctctcagaggagccatcgcggaccaagtgaacgcagccattgctcacctagcgagcgcaggcaccgtagcccctcacagcgctcccacaggggtcctagcgagcgaaggcaccacagtccatctaaaaggtcccaccgctctccagcccgtcggagtcacaggagcccatcagagcggtcacatcactctccttccgagaggagtcaccattctccttccgaacgccgtcatcacagcccttctgagaggtctcactgcagtccatcagagcgctcccactgttcgccctccgagcgacgccaccgcagcccttccgaacgccgacaccattcacctagcgagaaaagccaccactctccaagcgagagaagtcaccatagccccagtgagaggaggcgccactcacctctcgagcgatctcgccatagcctgctggagagatctcaccgttcaccttcagaacggagatcccaccgctcttttgagcgctctcacaggagaatcagtgagcggtcccactccccaagcgagaaatcacacctcagcccactggagcggagtagatgctcaccatcggaacggaggggccactcatcctctgggaagacctgccactcaccctcagagcgctcccatcgatccccttcagggatgcggcaagggcgaacatctgagcggagccacaggagcagctgtgaaaggactaggcacagccccagcgagatgaggccaggtcggcctagtgggaggaatcactgcagcccgtcagaacgatccagaaggtcacctctgaaggagggtctgaagtacagctttcctggagagcgcccttcccactctctgtctagagatttcaagaaccaaaccactctactgggcactacacataagaatcccaaggcgggacaggtgtggaggcccgaagccaccaggta

SEQ ID NO: 54128 - DNA, 612 bp, Artificial Sequence
  Description of Artificial Sequence: Synthetic coding sequence
atgacggtcaagtggaaacagttgagtgctcctgcgtcaggtgctgagatccagcgattcccagtgcccgcagtggagcctgtcccggctcctggggctgattcacccccaggaaccgccttggaacttgaagaggcaccggagccatcatgtagatgccccggaacggcacaagatcaaccttcagaggagctgccggactttatggcaccaccagttgagccacccgcaagtgcacttgagttgaaggtgtggttagagctggaagtggcagaacgcggtgggcagcactcatcgagccagcagctgccccattgctcacagtcctgggcccagtggaaactctggagacagaggccagggttcgccatatgggctccccttccccattggagaggtacatccctaattcaacagtcaagctccccagctgccgaaggccctgcggcaactgccgctggggcagtgtgccttcccgcagggggtgcaggagagcaggagaaggagccggtctcccggggatctagtcgtagctcttgctctcagcgacgcccaccacctccaggcatggaagtgtgtccccaacttggaatatgggccatctgtccctag

SEQ ID NO: 54129 - DNA, 630 bp, Artificial Sequence
  Description of Artificial Sequence: Synthetic coding sequence
atgtttgttaggcctgagtccggagagcagggcccagagacgctagccccagccagtggcgctgagatccagaggttccctgtgcccgctgttgagccagtccccgcacctggcgcagacagccccccaggtacggctctagagttagaagaagcaccggagcccagctgtaggtgccccggaacggcacaggatcagccgtctgaagagctgccagattttatggctccacctgtagaacctcccgcatctgcactcgaattaaaggtttggctggagcttgaagtggcggagcggggagggcagcattccagctctcaacagctgccgcactgtagtcaaagctgggcccagtggaagctttggcgacaacgacccggtttcgccatctgggccccactgccgcactggcgcggtacatctttgattcaacaatcgtcaagccccgctgctgaaggaccagccgctactgcggctggtgcagtgtgtctgcctgccggaggggcaggcgaacaggagaaggagccagtctcaagagggagcagccgcagctcgtgttctcagagacggccaccgccaccaggaatggaggtatgtccgcagctgggtatctgggcaatctgtccttag

SEQ ID NO: 54130 - DNA, 1725 bp, Artificial Sequence
  Description of Artificial Sequence: Synthetic coding sequence
atggaaccgaattccctcagaaccaaagtgccagcttttctgtctgatttgggcaaggctaccttacgaggtatacggaagtgtcctcgatgcggaacatacaatgggacgagggggctgtcctgtaagaacaaaacctgtggcaccatatttagatacggggcacgaaagcagccttcagtggaagctgtaaagatcattacagggagcgatctccaggtgtactctgtaaggcagagagaccgcggacctgattaccggtgcttcgtcgaactgggcgtaagtgagacaacgatccagactgtggatggaaccatcatcacccagctgagcagcggaaggtgttatgtcccctcgtgccttaaagctgctactcagggcgtggtggagaatcagtgccagcacatcaaactggcagtgaattgtcaggcagaagctactcctttaacactcaagtcctctgtgctgaatgcgatgcaagcgtcaccagagaccaagcagacaatctggcaactcgctaccgaacccaccggtcctctggtacaacggatcaccaaaaatatcctcgtggtcaaatgcaaagcatcacagaaacatagtctggggtatcttcacacaagcttcgtccagaaagtgtctggcaagagcctgcctgagagaagattcttctgctcttgccagaccttgaaatctcataagtccaacgccagcaaggatgaaaccgcccagcgatgcatccacttcttcgcttgcatctgcgctttcgccagcgatgaaaccctggctcaggagtttagtgatttcttgaatttcgattcttccggcctaaaggaaatcatcgtgcctcagttgggatgccactctgagtccacggtgtccgcctgtgaaagcacggcaagcaagagcaaaaaacgccgaaaggacgaggtgtcaggcgcacagatgaacagcagccttcttcctcaggacgcagtgtctagcaacctgagaaaatctggactcaagaagccagtggtcgcctcctcactgaagcgacaagcgtgcggccaactcctggatgaagcgcaagtcaccctatcattccaggactggctggcaagcgtgacagagaggattcaccaaactatgcattaccagtttgatgggaagcccgagccgttggtgttccacatcccgcagtccttcttcgatgccttgcagcaacgaatctcaattggcagtgcaaagaagcggctcccaaattccacaaccgccttcgtaagaaaggatgccctgccccttgggactttctctaaatatacgtggcacattactaacatcctgcaggttaaacagatcctcgacacccctgagatgccgctagagattactcgaagttttatacagaatcgagacggaacctacgagctctttaagtgtccaaaagtggaggtcgagagtattgcagaaacctacggccgtattgaaaaacaacctgtactgcggcctctggagctgaaaacctttctcaaggtcgggaatactagccccgatcagaaggagcctactcctttcattattgagtggatcccggatatccttccacagtccaagattggagaattacgcattaagttcgagtacggccatcacagaaacgggcatgtggcagaataccaagaccagcggcctcctcttgatcagccgctcgaactggcccctcttactacgatcactttcccctag

SEQ ID NO: 54131 - DNA, 69 bp, Artificial Sequence
  Description of Artificial Sequence: Synthetic coding sequence
atggaacctaacagcttgcgaactaaggtgcccgcttttctttccgacctcggtaaggctaccttatag

SEQ ID NO: 54132 - DNA, 480 bp, Artificial Sequence
  Description of Artificial Sequence: Synthetic coding sequence
atggaaccaaactcactaaggaccaaagtgcctgctttcctgagcgacctggggaaagctactctaagaggaatccggaaatgccctcggtgtggaacgtataacggcacacgtggactgagttgcaagaataaaacgtgtgggacaatcttccggtacggcgctcggaagcagcccagtgtggaagcagtgaaaattatcactggctcagacctgcaagtatattcagttaggcagcgggatagaggacccgactatcggtgtttcgtagagctgggcgtgagcgagaccaccatccagacagtagatggaactataatcacccaactgtcatctggtcggtgttacgtgccttcttgtctgaaggccgctacccagggagtcgtagagaaccagtgtcagcacattaaacttgcagtcaactgccaggctgaggccaccccgctgaccttgaagtcaagtgtgcttaatgctatgtag

SEQ ID NO: 54133 - DNA, 387 bp, Artificial Sequence
  Description of Artificial Sequence: Synthetic coding sequence
atggagccgaatagccttcgaacaaaggtgccagcatttctgtccgacctgggcaaggccactctacggggtataaggaagtgtcccaggtgcggaacttacaacggcaccagggggttaagctgtaagaataagacgtgtgggaccatcttcagatacggggctcgtaagcagccctctgtggaagcagtcaaaataatcaccgggtccgacctgcaggtatacagcgtgaggcagcgggacagaggtcctgactatcggtgttttgtcgagctaggtgtgagcgagaccactatccagactgttgatggcactatcatcacccagctgtcctcaggtaggtgttacgttccgagttgtttgaaagccgcaacccagggagtgtag

SEQ ID NO: 54134 - DNA, 1725 bp, Artificial Sequence
  Description of Artificial Sequence: Synthetic coding sequence
atggagccaaatagccttcgtactaaggtccccgcttttttgtccgatctgggaaaagccacgctgagggggataagaaaatgcccgagatgcggaacatacaatggcactcgaggactgagttgcaagaataaaacatgtggcaccatattccgctacggcgctcggaagcaaccaagcgtggaggcagtaaaaataatcaccggcagcgacctccaggtttactctgtaaggcaacgtgatcggggtcccgattaccgatgttttgtggagctgggggtctcagagaccacaattcaaactgtcgacggtacaataatcactcagttgtccagcggcaggtgctatgtgccatcttgtctgaaggccgcaacccagggcgttgtcgaaaaccagtgtcaacacattaagctggcagtgaactgtcaagctgaggctaccccactcactctaaaaagctcagtgttaaatgctatgcaagcgagtcccgaaaccaagcagacaatttggcagcttgccaccgagccgacagggccactggtccaacggatcacaaaaaacatcctcgtagtcaagtgtaaggcaagccagaaacacagtctgggttatctgcatacatccttcgtgcagaaagtgtcgggaaagtccctgcctgaaagaagatttttctgttcctgtcagacattgaaatcccataagtctaatgcatcaaaggacgaaactgcacaacggtgtattcactttttcgcatgtatctgcgcttttgctagcgacgagactttggcgcaggaattttccgacttcctcaacttcgactcctctggcctgaaagagatcatcgtcccccaactgggatgtcacagtgaatctacggttagtgcctgtgagtccaccgcttcaaagtctaagaaaaggagaaaggatgaagtctccggggctcaaatgaattcctccctgttgccccaggacgcagttagctcaaacttgagaaaatccggattgaagaaacccgtcgtcgcttcaagcctaaaaaggcaggcctgcgggcagctgctggacgaggcacaggtgactctgtcttttcaagattggctcgcttctgtcacagagcgcatccatcagacaatgcactatcagttcgatggaaagcccgaaccactggttttccacatcccgcagtctttctttgacgctttgcagcagaggatttctatcggttccgctaaaaagcgcctgcctaattccactaccgccttcgtgcgtaaagacgccctgcccctgggtacctttagcaaatacacctggcatattacaaacattctccaagtaaaacagattctcgatactcctgaaatgccgctcgagattacacggtcatttatccagaacagagatgggacctatgagctttttaagtgtccaaaggtggaagtggagagcattgctgaaacctatggcaggatagaaaaacaaccagttttacgcccactggagctaaaaaccttcctgaaggtagggaatacaagcccagaccagaaagaaccaactccttttatcatcgagtggatccctgatatcttgccccagtccaaaatcggcgagctccgtatcaaattcgagtatggacatcacagaaacggccacgtagccgagtaccaggaccaacggcctcccttggatcagcctttggagctcgctccactcacaacaatcacattcccatag

SEQ ID NO: 54135 - DNA, 180 bp, Artificial Sequence
  Description of Artificial Sequence: Synthetic coding sequence
atggagccgaactccttgcggactaaggtgccggcttttttgagcgacctgggcaaggcaacactccgaggaatcagaaagtgccctcgttgtggcacatacaatggcacaagaggcctttcctgtaagaataaaacctgtggaacgatctttaggtatggagccaggaagcagccttag

SEQ ID NO: 54136 - DNA, 183 bp, Artificial Sequence
  Description of Artificial Sequence: Synthetic coding sequence
atggagccaaattctcttcgtacaaaggtccccgcttttttaagcgatctgggcaaggccacccttcggggtattaggaagtgtccacgatgcggtacatacaatgggaccaggggcctgagctgtaagaataagacctgtggtaccattttccgctacggtgccaggaagcagccaagttag

SEQ ID NO: 54137 - DNA, 96 bp, Artificial Sequence
  Description of Artificial Sequence: Synthetic coding sequence
atggagccgaatagtcttcggaccaaggtaccggcatttctgtcagatctggggaaggcaaccctacggggaatcagaaaatgccctcgatgctag

SEQ ID NO: 54138 - DNA, 507 bp, Artificial Sequence
  Description of Artificial Sequence: Synthetic coding sequence
atggagcccaatagtctgcgtacaaaggtcccagcttttttatccgatctggggaaggccacattgcgcggaattcggaagtgccctcgatgcggaacttataatggtactcggggtttatcgtgcaaaaataagacttgtggtactatctttcgatacggcgctaggaagcagcccagtgtggaagcagtgaagattattacgggtagcgaccttcaagtctattcagtgcgtcaaagggaccgcggaccagactatagatgttttgtcgaactgggggtgtctgagactaccatccagactgtggacgggacaataatcacccagctgtcatctggccgttgttacgtgccatcatgtcttaaagcagccacacaaggtgtcgttgagaaccagtgtcagcacatcaagctcgctgttaactgccaagctgaagctacccccctgaccctaaagagcagcgtcctgaatgccatgcaggcaagccctgagacaaaacagacatag

SEQ ID NO: 54139 - DNA, 339 bp, Artificial Sequence
  Description of Artificial Sequence: Synthetic coding sequence
atggaaccgaatagtctccgcacgaaggttcctgcatttctatctgacttgggtaaagccactttgaggggcataagaaaatgcccgcgatgcggtacctacaacggcacaagaggtctcagctgtaagaataagacttgcggcactatctttagatatggcgctcggaagcagccaagtgtagaagccgtgaaaattattacaggctccgacttgcaggtctacagcgtgaggcagagagacaggggccctgattatcgatgcttcgtcgagttgggggtctcagaaaccaccatacagaccgtggatggaaccatcattacgcagctctccagttag

SEQ ID NO: 54140 - DNA, 978 bp, Artificial Sequence
  Description of Artificial Sequence: Synthetic coding sequence
atggactctgaactaaaggaggagattcccgtgcacgaggagtttatactttgtggtggggctgaaactcaggtgctgaaatgtggcccttggaccgacctattccatgatcaatccgttaagagaccaaaactgcttatcttcattatacccggaaaccccggatttagtgctttctacgtgccattcgctaaggcactgtatagcctgaccaatcgtcgcttccccgtgtggaccatttcccacgctgggcatgctctagctcccaaagataagaagatcctgacgactagcgaggactccaacgcccaggagataaaggatatttacggcttaaatggccagatcgagcataaactggcattcctgcggactcatgtacccaaagatatgaagctcgtccttataggacacagtatcggcagctattttactctccaaatgctaaaaagagttcccgagctgcctgtgatcagggcattcttgctcttccctacgatagagcggatgtccgagtctccgaatggccgtatcgctaccccactgttatgttggttcagatacgtgctttatgtgaccgggtaccttttgctgaaaccttgtcccgagacaattaagagtctgctgatccgaagaggactgcaagtgatgaatctggagaacgaattctctccacttaacatcctcgaaccgttctgcttagcaaatgcggcttatcttggtggacaagagatgatggaagtggtcaagcgggatgacgaaactatcaaggaacacctttgcaagctcacattctactacggtacaatcgatccgtggtgcccgaaggaatactacgaggatatcaagaaggattttcctgagggcgacattagactgtgtgagaagaacatcccacacgcgtttatcacccactttaaccaggagatggcagatatgattgctgacagcctgaaagacgatctgtcaaagatgtag

SEQ ID NO: 54141 - DNA, 834 bp, Artificial Sequence
  Description of Artificial Sequence: Synthetic coding sequence
atggattctgaactgaaggaagaaattccggtgcacgaagaattcatcctctgtgggggtgctgaaactcaggtgctgaaatgcggaccttggacggatttattccacgatcagagcgtgaagaggccgaaactgctaatctttatcattccagactcaaacgcccaggagattaaggatatctatggtttaaatggccagattgagcacaaactcgcttttttgcgcacacatgtgccaaaagacatgaagctggtgctgattggacacagtatcggcagctatttcactctccaaatgctgaagagagtgcccgagttgccagtgatcagagcctttttattattccctactatcgaaagaatgtccgagagtcccaatggacgaattgctacaccactgctctgttggtttaggtacgttttgtatgtcacaggatatctgctcctgaaaccctgccccgaaactattaaatcacttctgataagacgcggtctgcaggtgatgaacctcgaaaacgagttttcccccctgaatatcctcgagcccttttgcctggcaaatgcggcttacctcggaggccaggagatgatggaagttgtaaagcgggacgacgagactattaaggagcacctgtgtaagcttacattctattacgggaccattgacccctggtgtcccaaagagtactacgaggacattaagaaggacttcccggagggggatatacgactatgcgagaagaacattccccatgccttcattactcattttaaccaagaaatggccgatatgatagctgactccttaaaggacgacctgagtaaaatgtag

SEQ ID NO: 54142 - DNA, 501 bp, Artificial Sequence
  Description of Artificial Sequence: Synthetic coding sequence
atggactcagaattgaaggaggagatacctgtgcacgaggaattcatattgtgcgggggagcggaaacccaagtgctgaagtgcggtccgtggaccgacttgtttcacgatcagtccgttaagaggcccaaactcctgattttcatcattcccggtaatcctggcttcagtgcattttacgtcccatttgccaaggcactgtatagtcttacaaaccgccgatttccggtgtggaccattagtcatgctgggcatgctcttgctcccaaggacaaaaagattctgacaacttccgaagattccaacgctcaggaaattaaagatatatacggcctgaacggtcagatcgagcataaactagccttcctaagaacccatgtgcctaaggatatgaagctagtactgatcgggcatagtataggatcatatttcaccctacaaatgctcaaacgggtgcctgagctccccctgatgcttccaacgctgggggcaaagaagtag

SEQ ID NO: 54143 - DNA, 588 bp, Artificial Sequence
  Description of Artificial Sequence: Synthetic coding sequence
atgaagctggtcctcatcggacatagcatcggcagctactttaccttgcagatgctgaagagggttcctgagctgccagttattagggccttccttctatttccgactattgagcgaatgtccgagagtcctaacggtcggatcgctacccctctgctctgttggtttcgctatgtgctctacgttacaggctacctgctccttaagccatgtccagagactatcaagagtttactcatcaggcgaggccttcaagttatgaatctggaaaacgaattcagtccgctgaatatcctggagccattttgtcttgctaatgccgcatatctgggcggacaggagatgatggaggtagttaagagggatgacgagactatcaaagagcatctgtgtaaacttaccttctactacggaacaatcgacccgtggtgcccaaaagagtactatgaagacattaaaaaagacttccccgaaggagatattcgtctgtgtgagaagaatataccacatgcctttatcacccacttcaatcaggagatggcggacatgatcgccgacagcctgaaggatgaccttagcaaaatgtag

SEQ ID NO: 54144 - DNA, 2166 bp, Artificial Sequence
  Description of Artificial Sequence: Synthetic coding sequence
atggagctgggcaaagggaagctcctgaggactggtctgaatgcgctccatcaggccgtgcatcccatacatggtctcgcttggaccgacggcaaccaagtagtcttaacagacctgcggttgcatagcggggaggtgaagtttggggattcaaaagtgattggacagttcgaatgcgtatgtggcctatcttgggcccctcctgtggctgacgatactcccgtgctcttagctgtgcagcatgagaagcatgtcacagtgtggcagttgtgccctagccccatggagtcctcgaagtggctgacttctcagacctgcgaaatcaggggaagccttcctatcctgccccagggttgcgtgtggcaccccaagtgcgccatactgacggttcttacagcccaggacgtgtcaatctttccaaacgtccacagcgatgacagtcaggtgaaagcagacattaatacccaaggccgtatacactgcgcgtgttggactcaggatggactgaggttggtagtagctgtggggtcatctttgcactcttacatttgggacagcgctcagaaaacccttcaccgatgttcatcatgtctagtgttcgatgtcgatagccacgtgtgcagcatcacagccaccgtagattcacaggtcgctatagcaaccgaattgcctttggacaagatttgcggcctgaatgcaagcgagacttttaatataccacctaactccaaagacatgacgccctacgctctccccgtcatcggggaggtaaggagcatggacaaggaagccaccgactcggagaccaattctgaagtgtctgtttctagttcctatctagagccgctcgatttgacccatatccattttaatcagcacaagagcgagggaaattcgctgatttgccttcgcaaaaaggactacctcactggaacgggacaggattcatcgcacctggtgctagtgacgttcaaaaaggccgtgaccatgactcgcaaagtgacaatccccggaatcctggtgcctgatctgatagcttttaacctgaaggcccacgtcgtcgcagtggcctcgaacacatgcaacatcatcctcatctactcggtcattccttcatcagtgccgaacatccagcagatcagactagaaaatactgaacggcctaagggtatctgtttcctgacagatcaattactactgattctggtgggaaagcagaaactgacagataccacctttttaccttctagtaagtccgaccagtatgctatctctctaatcgtgcgggaaatcatgctcgaggaggagccgtccatcaccagcggggagtcccaaaccacatactcgacctttagtgctcccctgaataaggccaataggaagaaactaattgagtccctctcacctgacttttgccaccagaacaaagggcttttgctcacggtcaatacttcatcccagaacgggcgtccgggtcgcaccttgattaaagagattcaaagccctctaagcagcatctgtgatggctcgatcgctttagacgctgagcctgtgactcagccagcctccctccctcgtcatagtagcacccccgaccacactagcacactggaaccacctcggctgcctcagagaaaaaacctccagagtgagaaagagacttatcaactttcaaaagaggtagagattctgagtcgcaatctggtggagatgcaacgttgcttatccgaactcactaaccggctccataacggcaaaaaaagttcctctgtgtatcccctgagtcaggaccttccctatgtccatatcatctatcagaagccctattatttgggaccagtcgttgagaaacgcgctgtgctgctctgcgacggaaaactgcgcctttctacagtccaacagacatttggactgtccctgattgagatgttgcatgacagccattggattctgctttcagctgactccgaggggtttataccactcacttttacggccacacaggagatcatcatccgggacgggtccctctcccgctccgatgtcttcagggattctttttcacacagcccgggagctgtttcgtctctgaaggttttcaccggcttggcggcaccatccctggataccacgggatgctgtaatcatgtagacgggatggcctag

SEQ ID NO: 54145 - DNA, 525 bp, Artificial Sequence
  Description of Artificial Sequence: Synthetic coding sequence
atggagctcgggaagggcaaactcctgaggacaggacttaacgccctccaccaggccgtgcatcccatccatggtcttgcctggacagatggaaaccaagtcgtgctgacagacctgcgccttcactcaggagaagtaaagttcggggattccaaggtcatcgggcagttcgagtgcgtttgtggactctcatgggctcctcctgtcgccgacgacacacccgtgctcctcgcagtccagcatgaaaagcacgtcacagtgtggcaactctgcccctcccccatggagtcatccaagtggctcaccagccagacatgcgaaattcggggtagcctgcctattctgccccagggctgtgtctggcatccaaagtgcgccatcctaactgtgttaacagcacaggatgtctcaatctttccaaacgttcattcggatgatagtcaggtgaaggccgacattaacacacagggcaggatccactgcgcttgctggacgcaggacggattgcggctcgtcgtcgcctag

SEQ ID NO: 54146 - DNA, 1869 bp, Artificial Sequence
  Description of Artificial Sequence: Synthetic coding sequence
atggaactgggaaagggaaaattgctgaggacaggcctgaatgcacttcaccaagcggttcaccccattcacggactagcatggaccgacggcaaccaagtggtgctgaccgacctccgcctccactccggagaagtaaagttcggagactccaaggttattggacaattcgagtgtgtctgtggtctctcgtgggccccacccgtcgccgacgatactcctgtactgctggctgtacagcatgagaagcatgtgacagtatggcagctatgtccctcccctatggaatcctccaaatggttaaccagccagacatgtgagatccgaggctcacttcccatcctgccacagggctgcgtctggcaccctaagtgtgctatcctgaccgtcctgaccgcacaggacgtctccatatttcctaatgttcactctgatgatagccaagtgaaagctgacattaacactcagggaaggatacactgcgcctgctggacgcaggacggtttgcgacttgtcgtagcagtgggcagcagtcttcacagttacatctgggatagcgcacagaagactttacacaggtgctcatcttgtctcgtcttcgacgtggactcccacgtctgctctataaccgcaactgtggacagtcaggtggccatcgccactgagctgcctctggacaaaatttgtggactgaacgcctccgagaccttcaatattcccccaaactcgaaggatatgactccatacgcgttgccagtcattggcgaagtgcgctccatggataaggaagccaccgacagcgagaccaacagtgaggtgagtgtttctagcagctacttggagcctctggacctgacccacatccatttcaatcagcacaagagcgaaggtaacagcttaatctgcttgagaaaaaaagactatctgacagggactggtcaagacagctcccacctggtgctcgtgaccttcaagaaagccgtcacaatgacccggaaagtgaccattccaggtatactcgttcctgacctcatcgcattcaacttgaaagcacacgtggtagccgttgcaagtaacacgtgtaatattatcttgatttacagcgtcatccccagctcagtgcctaatattcagcagattcgcctggaaaatacagagcgccctaagggtatctgttttcttactgatcagctcctcctgatccttgtgggtaaacagaaactcaccgacaccacctttttgccatctagcaagtccgatcagtacgccatctcactgatcgtgcgcgagatcatgcttgaagaggaaccatctataacctccggcgagtcacaaaccacatatagcacatttagcgctcccctcaacaaggctaatcggaagaagctaatcgaaagcctgtctcctgatttctgtcaccagaacaagggtctcctcttgaccgtgaatacatcttcacagaatggtcggccaggtcgtacgctgattaaagagatccagtctcccctgtctagcatttgcgatggatccatcgctctggatgcagagccggtgacccagccagcatctctgccccgacactcttctacaccagaccacacctctacgttggagccgcctagactgccccagcggaaaaatctccagagtgaaaaagaaacctatcagctgtctaaggaggtggaaattctgagccggaatctggttgaaatgcaacgttgtctttctgagttgacaaacaggctccacaatggtaagaaaagttcctccgtatatcctctgagccaggaccttccttacgtgcatatcatttatcagatccctaccggatttttctcattgctgaccgtcagggccttatcacggtag

SEQ ID NO: 54147 - DNA, 480 bp, Artificial Sequence
  Description of Artificial Sequence: Synthetic coding sequence
atggagagccgaccttcgggccgtcagcacgctagtgagggcgatggcgatcaaagcccaactcaatgtgccggtatgcggtcgtctggcagaagtgatcaaccgtacgtcctgaaagggaaccccttacttttacgcgtgcggtgctatagtgggtgcgccagcgggtccggtagacaactccagctgtcagtgttccaggacctcaatcagttcagccattgccgtgtgtggaggtcacccgctcttatcgtgaagggcgagccaccctggtgttcccagcaggatactcagagccctttccagaccgggaccccactcgagcgcccttgctttcgcatgaagctctcagggtgggagctgacaaagaatgcacagagagcgctgggatccaagttacagcatattctgtccctagatagcacgcaggcatgcggagccggtggccctactattttgagaccacctcgagccccatag

SEQ ID NO: 54148 - DNA, 699 bp, Artificial Sequence
  Description of Artificial Sequence: Synthetic coding sequence
atggccggagatgtgggcggtaggtcctgtacagacagtgagctcctgcttcatcccgaactgctctctcaggagtttctacttctgacactagaacaaaagaacatcgccgtcgagaccgatgtaagagtaaacaaggactctctgaccgacctgtatgtccaacacgccatacccttaccgcagcgggacctgcccaagaacaggtggggtaagatgatggaaaaaaagagagaacagcacgaaatcaaaaacgagactaaaaggagctccactgtggacggcctgcgtaagcgaccattgatcgtgttcgacggcagctcaacctctacgtctataaaggtgaagaaaactgaaaatggcgataatgaccgcctgaagccgcctccccaagccagttttactagtaatgctttccgaaagctctccaattcctcttcttcggttagtcccctgatcctgtcctcaaacctgcctgtcaacaacaaaaccgaacacaataacaatgacgcaaagcagaatcatgacttaacccaccgaaagtcaccttccggccctgtaaagtcgcctccactgtcccctgtgggaaccacacccgtgaagctaaagcgcgcagctcccaaggaggaagcagaagcaatgaacaacttaaaaccacctcaggccaagcgcaaaattcagcatgtgacttggccatag

SEQ ID NO: 54149 - DNA, 687 bp, Artificial Sequence
  Description of Artificial Sequence: Synthetic coding sequence
atgcgaaggctgcgtgtgaccactcacgcttctttgaggccatcaacctctttgccccagcggttcctacgaggcgctttatgggttgcagactggggtctgctcgcaaccaccatggcaggggatgtggggggacggagctgtacagacagcgagctgctactgcaccccgagttgctttctcaggagttcctcctactcacgctcgagcaaaagaacatagctgtcgagaccgacgtccgggttaataaggacagccttaccgacctttatgtacagcacgctattcctcttccacagcgcgacttgcccaagaatcggtggggcaagatgatggagaagaaaagggagcaacatgaaattaaaaacgagactaaacgctcatcaactgtggacggactgcggaagcggccactcatcgttttcgacggctcaagtacatccaccagcattaaagttaaaaaaactgagaacggcgacaatgaccggttaaagccgcctccccagaaccatgatttgacccatcgcaagagcccatcgggccctgtgaaatctcctccgctgagtccagttggcactaccccagtcaagctgaaacgcgcagcgccaaaagaggaagctgaagctatgaacaatcttaagcctcctcaggcgaaacggaaaatacaacatgttacttggccgtag

SEQ ID NO: 54150 - DNA, 489 bp, Artificial Sequence
  Description of Artificial Sequence: Synthetic coding sequence
atggggtcccatcctactcccggattgcagcggaccacctctgcgggatataggctgccacctacccggcctccagcttctgtgtctcctgccgcaagggggggacctatggcttcccgagggctagctggtggatgccaggcccctcaggctctgaaggcgcaacgggtggctcagggtgctgcctgcgacggcgtgcaacaggaccagctctggagggagttgctcgaggccgagagaaggggacagcagcggtggatccagaattggtcttttctgaaagattatgaccctatggggaataaaaaggagcccgaaaaacttcctgaccacgtgcccctcttcagcgacactgtgccttcttccaccaaccaagttgttggatctcggcttgatactcctctgggccaaactcttatccgaatggatttcttctttaccgaaggagctcgcaaaaaaaagttagaagaccagatgcaacctatttag

SEQ ID NO: 54151 - DNA, 489 bp, Artificial Sequence
  Description of Artificial Sequence: Synthetic coding sequence
atgggctcacaccccaccccagggttgcagaggaccacttcagctggctacagattgccacctacacgcccacccgctagtgtaagccctgccgcaaggggcggacctatggcctcacgcggtctagctggcggatgtcaggcccctcaggccctaaaagctcagcgtgtcgcccagggggctgcctgcgacggcgtgcaacaggaccaactgtggagggagctcctggaggccgaaaggagaggccagcagaggtggattcagaattggtcatttctgaaagactatgatcccatgggaaataagaaggagccagagaagctgcctgaccacgtgccactgttttctgatactgtgccctcgtccaccaaccaagtggtgggatccagactggatacccccctcgggcagacgctgatacggatggacttcttttttaccgaaggggctcggaagaagaagttagaagaccaaatgcagccgatttag

SEQ ID NO: 54152 - DNA, 1239 bp, Artificial Sequence
  Description of Artificial Sequence: Synthetic coding sequence
atgctcccccagaacaaggatcaagtgcttccacagaccagtgttttgccagggagaccaacgtggggcttctcacagctggtggactcatcacctcataatcttcagcctctgtcaccacaccaaggattaccacctagccagcctcccttctcctccacgcagagtcgcagaccatccagccctcccccagcttctccctcccccggatttcaatttggctcttgtgacagcaacagtgactttgcccctcacccatactccccgtcgctaccttcttctccaacgttcttccaccagaattacctgtcgttgccccgaccacgagcttcaagcccctccaatcactggctgtatccttctcccccactgaccccatcctttagtccgtctcagccgcagaatagctctttgcctcactcgccttgccagtctccctctcatcctgaagaactccattcctcaaccctgacatctcccggaccgtccccgccttcccacaggttacactctaatcgccagacatggcgttggcatcagtaccgggataccggatcaggctctccaggggtggtagaaaggtgcgtcccatccgaaaaagatccagcccagttcagagaccctggcgcacttgcacaggccttggtagttcagttgggccaccgcagaattgcccacgacttgagactcctgcttctgcaacacctgtggctggggaggacaggccaagcacccgtggtcgaataccccatttgcctagtgtgcctaaggcctaggtctcccagctgtccgctccccaggtaccggactggaccaagactcctggccttccctcagctgctaccgtgtgtccaaggacaagagtctggacccctgcgcattgggatcggcttcggtctgcgcctaccacaaggacaagccagggctctccacctgcttccagaaaagcgaccgaaggaagctggccctcagggtaaagccacacaggcatgcgggcaccagctgcccgctagtcagcctccagcagcccaggccagagccgatcccgtacccggtacacctagccagaccaggtccttccggagcgcaggccttcagagccctaatagccctcggtgcttcagtggccctcctcccagggcaccgaagcaggttacaaccagcttaaagccgaggccatgccccggtccaaagcggcctgtgagcctggagctcattttgcaaaaaagcagcgtctag

SEQ ID NO: 54153 - DNA, 897 bp, Artificial Sequence
  Description of Artificial Sequence: Synthetic coding sequence
atggacacaggtgtgtggggttggggagcggcagcctgcagatggggacccgctgagagggcagccggatcattgaatgccgcttctctgagagaggaacagctgcatttgtcattattggtttcctctggatggcggacgattagttttcacgtggtgccggttgtgaggcgtaaactcggagctccagcgctggagggcgtccagcaaatgccagggtttcctgaaggttcactccgtcgcattctatcccaaggcgtagacctggtccctgccagtgcacagctctggaggacctccaccgattatctacttaccagactcttgggagagttagggtctctgcagggccacaggctcgattctctgagcatcctcgaccgagtgaaccatgagtcttggagggacagcggccagactgatggactcacgtttggacatctgaaaatggttcttctctgggcgagtgtgctattcctggcccctgaggattgggcagagttacagggagcggtgtacagactgttggtggtgctgctgtgttgcctggccaccaggaagctaccacactttctgcacccacagcgaaaccttttgcagggaagcgggctcgatctgggtgccatctaccagcgggtcgaggggttcgccagccagcccgaggccgctctgagaatacacgcgacacacttgggaaggagtccaccgcctaggatcgggtccgggctgaaggccctgctgcaacttcctgcatcagacccgacatactgggctaccgcatacttcgacgttcttttagacaaatttcaagttttcaatattcaggacaaggaccgaatctccgcaatgcagagcatcttccagaagacccgcacgctgggcggagaagagagttag

SEQ ID NO: 54154 - DNA, 1344 bp, Artificial Sequence
  Description of Artificial Sequence: Synthetic coding sequence
atgcctgcgcctgcattgccaacttctgccatggccgtgcaggtgccattgtggcatcactatctgcaggctattaggagtcgcgaggctcctagagctcaggattttcagcgtgccgaaaacgtgctccttactgtgttggagcgagtgcatgctttagatccaagatttattgtcgattacagccgcggtctggaggcctttcagttcgcactgagaagcagtgaagatcccatggatatggaggtcccattatgggtagatgccgaagcgctgctgattgaggagcccgaggcaacccaacctgaagatggattagaactgtgtcatctgggggtccctcgtgaaggggctggcctagaaagatggacaacggaagatacgtttaccgccagctctgagggagatgcaaagtgcagaggccatatcgtgccaagtaaggtgctgtgcgtcctcaaagacctgttagtggctgcaattgtgcattgtaagcatcactcattaattgctcctgggagtctcaatgctgccagtctccgggaggaacagctgcacttaagtctgctggtgagcagcggctggcggacgatcagtttccacgtagtgcctgtggttcgcaggaaactcggggctcctgcgctggagggcgtgcaacaaatgccaggattccctgagggaagcctgcgtagaattctgagtcagggcgtggacttggtgcctgcatctgctcaactatggcgcactagcaccgattatctgctgacgcgcctgttaggtgagctggggtcactccaggggcatagactggactcactctcgatattggacagagtgaaccatgagtcctggcgcgattccgggcagaccgatgggctgacatttggccatctgaagatggtccttctgtgggcatcggtgttatttctggcccctgaagattgggccgaactacagggagccgtctaccgacttctggtggtactgctatgctgcctggctacacggaagctaccgcactttctccaccctcagaggaacctcctgcagggaagtggcctcgacctaggggctatttaccagagggtagaaggcttcgctagccagccagaggccgcactcaggattcacgctacccatctggggagaagccccccacccagaatcggcagcggcctgaaagcactgctgcagctacctgcgagtgatccaacgtactgggccacagcttactttgatgttctcctagacaagtttcaagtatttaatattcaggacaaggaccgtatttccgcgatgcagagcatctttcagaagacccgtactctcggaggcgaggaaagctag

SEQ ID NO: 54155 - DNA, 840 bp, Artificial Sequence
  Description of Artificial Sequence: Synthetic coding sequence
atggacactggatccctcaacgccgcttccctgagggaggagcaactgcatctgagtctgcttgtgtcttccggatggcgcacgatcagctttcacgtcgtgcctgtcgtgaggcgcaaactgggcgcacctgccctggagggggtgcagcaaatgcctgggtttccagaaggaagtctccgacgtatactgtcccagggtgtggacctggtgcctgcatccgctcagctgtggcggacatctacagactatctgctgactcgactgctaggggagttaggatctttgcaggggcacagactcgacagcctttcaatcctcgatcgagtcaatcacgaatcctggagggattcgggacagactgacggtttaacatttggacatctcaagatggtgcttctgtgggcttctgttctcttcctcgcaccagaggactgggctgagttacagggagccgtataccggctgctcgtggttctcctttgttgtctggccactaggaagttgccccactttttgcacccccagcggaacctgttacaggggtccggcctagacctcggtgctatctatcagcgtgtggagggcttcgctagccagcctgaggcggcattgcgcattcacgccacacatctcggaaggtcccctccccctcgcataggtagcggcctgaaggctctactgcagctgccagcctccgaccctacgtattgggccaccgcctacttcgatgtgctcctcgacaaatttcaagtgttcaatattcaggataaggacaggatttccgctatgcagagtattttccagaaaaccagaactcttggcggagaagagtcatag

SEQ ID NO: 54156 - DNA, 402 bp, Artificial Sequence
  Description of Artificial Sequence: Synthetic coding sequence
atgcccgcaccggcactgcccacgagtgccatggctgtccaggtgcctttatggcaccactacttgcaagcaattcgctctcgggaggccccacgagctcaggacttccagcgggctgagaatgttctcctgacagtgttggaaagggttcacgccctggatccacggtttatagttgattacagccggggattagaagctttccagtttgcgctacgctctagcgaggatcccatggacatggaagtgcccttgtgggttgacgccgaagcgctgctgatagaggaaccagaggccacccagcccgaggatggtctggagctctgccacctgggcgttccccgagagggcgcaggcctggagcggtggactacagaggacacctttacagcatcaagttag

SEQ ID NO: 54157 - DNA, 2889 bp, Artificial Sequence
  Description of Artificial Sequence: Synthetic coding sequence
atgatctctaccagggtgatggacattaagttgagagaggctgcagagggactcggagaggattccacgggtaaaaaaaagtccaaatttaaaactttcaaaaagttcttcgggaaaaagaagagaaaggagtctccgtcatctactggcagctctacttggaagcagagtcagacccggaacgaagtcatagccatagaaagcggccctgtggggtacgattccgaagatgagcttgaggaaagcagaggcaccctggggtctcgcgcactgtcacatgatagcatttttattccggaatctggccaggatgccacccgtccagttagggtgttcagtcaggagaatgtctgcgatcgtataaaggcactccagctgaagatccagtgcaatgtcaagatgggccctccgcctcctcccggagggctccccgcaaagaggggagaggacgccggaatgagtagtgaagacgatgggttgccccgtagcccccctgagatgtcactcttgcatgacgtaggccctgggaccacgatcaaggtgagtgtggtaagtcctgatcacgtgagcgacagtactgtgagcgcgagaatatcggacaactctctcgcccctgttgctgatttcagttatcctgccgaatcgtcttcttgtctggacaactccgccgcaaagcataagttacaggtgaagcccaggaatcagaggagttcaaagatgcggaggctcagcagccgggctcaaagtgaatctctgtcagacctgacctgcactccagaagaagaagagaacgaggaaaagcctcttctggaggtaagtcccgaagaacgacccagttctggtcagcaggacgtagccccagaccgtggccctgaacccggtcctcctgcccctctgcctcccccagggggagccagggcccgaagggcgcgactccagcacagctccgcactgactgcttctgtagaggagggcggagtgcccggtgaggacccttctagtcggccagccacccctgagctggccgaacctgagtctgcgccaactctgagagtcgaacccccaagcccacctgaaggcccacccaatcccggtcccgacggcggaaaacaagacggagaggctccacccgctgggccttgcgctcctgccacggacaaggccgaggaagtcgtgtgtgcccctgaagatgtcgcatctccatttcccacagccattcccgaaggtgatacgacgccccctgaaactgacccagccgctacgtccgaggccccatccgccagagacgggccagaacgctccgtccccaaagaggctgagcccacacctccagtgctcccagacgaagagaaggggccacccggaccggctcccgagccggagagggaggcggagacagaaccggagcggggagctggtaccgagcccgagcgaatcggtactgagccctcaactgcacctgccccaagtccccctgcacctaagagttgcctgaaacaccgcccagcagcagcctctgagggcccagccgcttcgccacccctggctgcagcagagtctccaccagtcgagcctggccctggatccctagacgctgaggccgcagctcccgaacgaccaaaagcggagcgggctgaggcccctcctgcaggagctgagagagcggctcctgaaagaaaggctgagagaggcggtgcagagctacgtggggctaagaagttctccgtgagtagctgccgggctcgaccacgcccaggcgttagtaggccactggagcgggcttcaggcagattgccacttgcgagatctgggccagtttggagaagtgaggcagcgctggatgacctgcagggcctgcctgaaccccaacacgcgaaaccagggcctcgtaagctggccgaacggggaccgcaggatagtggggacagggctgcgtcaccagccggaccgagaaaatctccccaagaggctgccgctgcgccaggaactagggagccatgcccagccgctcaggagccagcaccttctgaagaccgcaatcctttccccgtgaaacttagatccactagtttatcgctgaagtatcgggatggggctagtcaagaggttaaaggagtcaagcgctactctgccgaagttcgtctggaacggtctctcaccgttctgccaaaagaggagaaatgtcctctggggactgctcctgcactaagaggaacaagggcacccagcgatcaggggaagggtaaagcgaggccgcctgagccactctcctctaagccccctctgccgaggaagcctctactgcagagcttcactctgccgcatcagcccgcaccacctgacgctggacccggtgagcgagagcccagaaaagaacccagaaccgccgaaaagcgccctctgaggcgcggtgcagaaaagagcctccccccagctgccacaggacctggtgccgacggccagcccgcaccaccatggattactgtgactcggcagaagcgtagaggcacactggaccagccacctaaccaggaggataagccaggtgcgcgaaccctgaagagcgagcccggtaaacaggcgaaggtacccgagcgaggtcaggaaccagtcaagcaagccgacttcgtgcggtcaaaaagctttcttatcactcctgtgaaaccggctgtagaccgcaagcagggagcaaaattgaacttcaaagaaggtctgcaacggggaattagcctcagtcaccaaaacctggcacagagtgccgtcatgatggagaaggaactgcatcagttgaagagagccagctatgcttctaccgaccaaccctcttggatggagctcgctcggaagaaaagtcaggcatggagcgatatgccacaaataataaagtag

SEQ ID NO: 54158 - DNA, 1188 bp, Artificial Sequence
  Description of Artificial Sequence: Synthetic coding sequence
atggccttgccaggctatcctctgggtaacgtggatgactctcggtccaaagacagcccagcgggtgaaccccaaggccaggtcccactgacggctgatgtgcttgcagtcagctcatctgtggctagcactgattggcaggacatcgaccaagcatcctttaagaccgcaacgccacgcgctatctctaccagcggggacaaagataaaagcgccgtggtcccagaacacggacaaaaaacacctaggaagatcacacctcttttaccatctcaaaatccatcacccttacaggtgagtatgtccctccagaatccagcctgggatcgacaggtccaggacgcacgtacgtctcagtcgctggtggtgttccccagtcacctactgggtaaggataaaatgtctcaaatggctagcgtcccggaacgcgaaccagaatcagccccttctgccccttcagcagagctacaaagcacacagcacatggaagcacaacccgtggagagtgatgcggaccacgtaacagccggtgcaaatggccagcacggaccgcaagccgctagcacaacgaagtcagctgaagagaaagctgagcatccaaaggccccacaccctgaggcggaagccctgcctagtgatgagagcccagtggcaatgggggctaacgtcgtagactccctgggtgatctacagacgtggttcttccccccaccgccagccggatccgtatcgccttccccaggccctcacgaagtggccctgggcaggcgcccactggatagtagcctatatacagcctcagaggagaattcttacatgagaagcatgaccagtctgctggacaggggggaagggtcaattagcagccttgctgatatcttggtatggtcagagactactatgggcatggctattgccaccggattcttagatagtggacacagcacagtcgccgatttactgcatagctctgggccatcactgcggtccgttccctcccttgtgggctcagtgtctagcgcgtttagttccggtttggtatcagggacttcctcggcgctgaggaccattactagggtgttagagacagtggagcaacggaccgttgaggggattcgttccgctatgcgatacctaacctcccacctgacccccagacaggcacaggccgatcctaattacgactag

SEQ ID NO: 54159 - DNA, 534 bp, Artificial Sequence
  Description of Artificial Sequence: Synthetic coding sequence
atggatcagcctgccgtggcaactgctagtaccagtatacgtgaagatctggtcggtggggaatcttttattacagcctccaagccggctcagaagactagcagctttgagagggagggatggtggaggattgctctgacagatacacccatacctggtacctatcacttgaagaccttcatcgaagagtctctcctgaatcccgtgatcgccacctacaactttaaaaacgagggacgcaagaaacctcccttagtgcagagaaacaaccccgtgctcaatgacctgcctcaatatatgcctcctgactttctggatctgctgaagaagcaggtcgctacttactcattcaaagataaacctagaccctctccttccacattagtggacaaggatcagtccctacagctaagcccaggacaatacaacgtgctcccagcacctgtacctaagtatgcctccaggagctgcgtcttcaggtccacagtgcaaaggttccctacgacttatttcattcctgttagcatcatgtag

SEQ ID NO: 54160 - DNA, 747 bp, Artificial Sequence
  Description of Artificial Sequence: Synthetic coding sequence
atggaccaaccagccgtggcaaccgcttcaactagtattagggaagacctagttggtggcgaaagctttattaccgcttccaagcctgcccaaaaaaccagcagttttgagagggaaggttggtggcgtatcgcactgacggatacccctattccaggcacctatcacctcaaaacattcatcgaggaaagcttgctgaaccctgtgatcgccacttataactttaagaacgagggcaggaagaagcctccccttgtacagcggaacaatcctgtgctcaacgacttgccccagtatatgcctcctgacttcctcgatctgttgaaaaagcaggtggctacgtacagcttcaaagacaagccgcgaccctccccaagcaccctggtggacaaggaccaatccctccaactttcccctggccaatataacgtcctgcccgctcctgtgccaaaatacgcctcacgcagttgtgtgttccgcagcaccgtgcagcggttcccaactacgtactttattcctcacgaggggcctggacccggtcattacaacgtgaagatgccccctacatcatcagtgacatcctgctttcagtcccgtgtccctcgtttcctcccaagctgtagtaaaacacccggtccgggagcctacacaacgctacgccaattcccaaaacagtcaccaactatcgcaaagatgggccaggagcactcactcttcttcaacaataataactggctgctcaagtag

SEQ ID NO: 54161 - DNA, 1164 bp, Artificial Sequence
  Description of Artificial Sequence: Synthetic coding sequence
atgtcttctaaggtctacagcaccgggtctagagcaaaagatcaccagccctcagggccagagtgtttgcctttgcctgaggccaatgctgaggcaattgactttttgagttctctgcataaggaagagctgcagatgctttttttctcagaaacactcgccatggtgtctgacacaggtgaaccccagggtgagttgacaatagaagttcaaaggggtaagtaccaggaaaaattaggtatgcttacgtactgcctgtttgttcatgctagctccaggggatttctggacaaaatgctctgtggaaactctctgctcggttacctgtccgagaaattggagctgatggagcaacacagccaggactttatcaaattcctgatcctcccaatggagagaaagatgtcccttttaaaacaggacgaccaactcgccgttacacggtctattaaggagggtgaagaggtcaagactggggtgacctcctttccctggtccagcatcaaaggcttcattagcgaggctgccaacctcgttctccttagggtgatggcatggcgtcggatggtcccaagtaacgccagatttctaaccttagataccgaagggaagctgtgctatttaacataccagaacttgggcttccagaccatccaggtggatcaccaacaagcagaagtttttattgtggagcaaaccgtacatgcagaagaagggattcccatgtcgtgccagtactatctgctgtctgatgggcatctggcaaagcggattcaagtcggctcgccgggatgctgtataatcaccaagatgcccatcttgcgggaagaggatgaaatagaacccaggccagtgttcgagaagaaaccgctcgtctgggaggaggacatggagctgtactcaaaattcctcgaccgcaaagaagaacttcgactcggccacgcaagttatcttaggcagcaccctgaggcccatgctctcatctcagacttcctgctgtttctgttgctgaggcagcctgaagatgtggtgacatttgctgccgagttttttggccctttcgacccgtggaggccatccagtcccgcattgggcagttcacacagacccaacccatttcgttccttagagccagagggcgacgcgaggtccggggctgcgtag

SEQ ID NO: 54162 - DNA, 1761 bp, Artificial Sequence
  Description of Artificial Sequence: Synthetic coding sequence
atgtctgttcaccaaatacgaaagcatgccgttctgccacccattatatgtcgaagtgacaaagagttcttggaatcagtgcagagatatatcattacggagacagagcggctggggtgttccgaggaaggacctgccgacgaatattacatcatctacagaaacgtgttcgataaggtgattgagcacatcactgcttacaaatccatcctaacatcaatcaagaaagagtatgatgcgtttatagaaaccatcaagaaggatagaaggactaccttttgcctgcacggaaaactgaaaggtctcgctgccgagccaactgccctcgtctactatcgcaagcggactatccagctcgaggccaaaatgcgaattatcgaaagcaatagttcaaagattcagtctcagattgatcatattaagcaatgccgggctgagtacgacacaaaagaggttaagtattgtacgttctcaaaggatccctctaaacccatcccaggcatgaccctgcaggagagtatgaatttagatgctttgaccaagtacatgaagcacctcgaggacaaatatgcagaaattaagcaggccatgctcatcaagtacgtaccggctcaacggaaggccgatctggatgaagaaatgatcgttctgctgaagcgtagggacgtggccgagaacttgaataagaaactccagttctgtcaccagaggctccagatcatctcgcaagccctgtcctcatgggtgaagagcgatatgtcttctcccttccaagacttcgtagagcaaatccaaaaaaccaagtatctgcagggagatcaaggcatagtcgaagagctgatggaggacgatccccgtcgggcaaaggaagctgaaattatgctccattacattgaaaggttcaacgaactgatctcattgggtgaatacgagaaggcagcttgctatgcagctaattcgcctcgcagaattttgcggaacatcggaactatgaacaccttcaaagccgttgggaagatccggggtaagcctttacctctgcttttgttcttcgaggctttatttattactagccacgcgtttccatgtccagtagacgccgcacttaccctcgaggggattaagtgcgggctctcagaaaagcgccttgatttggtcacgaactgggtgacccaggaaagactgaccttcagcgaggaagcaggcgatgtgatctgtgattatggcgagcaggacacttataacaaggctaagtgcttagccctagcccagattgtttactctgaatgcggccttcacaagaaggccatcctgtgtctgtgcaaacagggtcaaacccatcgcgtgatggagtatattcagcagctgaaggattttaccaccgacgatctgctccagctacttatgtcgtgcccgcaggtcgaattaatccaatgccttaccaaggaactgaacgaaaagcagccgagcctgtcatttggcctggctattttgcacctcttttccgcagacatgaaaaaggtaggcataaaactcctgcaggagattaataaaggcggaatagacgctgtagaatccttaatgattaacgacagtttctgcagcatagaaaagtggcaggaggttgccaatatttgcagccaaaacggattcgacaaactgagtaatgatatcacatccattctgcggtcccaggccgctgtaaccgagatcagcgaggaggatgacgccgtgaacctgatggaacatgtgttttggtag

SEQ ID NO: 54163 - DNA, 141 bp, Artificial Sequence
  Description of Artificial Sequence: Synthetic coding sequence
atgtcagtacatcagatcagaaagcacgccgttttaccgcctattatctgcaggagtgacaaggagttccttgagtctgtacaacgatatataatcacagagacagagaggctggggtgctctgaggaaggtcccgcatag

SEQ ID NO: 54164 - DNA, 414 bp, Artificial Sequence
  Description of Artificial Sequence: Synthetic coding sequence
atggagtatattcagcagcttaaggatttcaccacagacgatctcctccagctgcttatgtcttgtcctcaggtggagcttatccagtgtctgacaaaggagctcaacgagaagcagccctcactgagcttcggattagccattttgcatctcttctctgccgatatgaaaaaggtcggcatcaagctactgcaggaaattaacaagggcggaattgacgctgtggaaagcctgatgattaatgattctttctgcagcatcgaaaagtggcaagaagtagccaatatctgcagccagaacggctttgataaactgtccaatgatatcaccagtattctgcgatcacaggccgctgtcactgagatcagcgaggaggatgacgccgttaatctcatggaacacgtcttctggtag

SEQ ID NO: 54165 - DNA, 1761 bp, Artificial Sequence
  Description of Artificial Sequence: Synthetic coding sequence
atgtcagttcaccagatccggaagcatgccgttttgccacctataatctgccgctctgataaggagttcctggaaagcgtgcagagatatattatcaccgaaacggaacgcttgggttgttctgaagagggtcccgcagacgagtactacattatctacaggaatgtgttcgacaaggtcatcgagcacattactgcctataagagcatcttgacctcaatcaagaaggagtacgacgcctttatcgaaacaatcaagaaagataggcgtacaacattttgtctccacggaaaactcaagggcttagcagccgaacctaccgcacttgtttattataggaagcgtacgatccaactcgaggccaaaatgcgtatcattgagagtaatagctcgaagatccagtctcaaattgaccacattaagcaatgtagagcagagtacgacacaaaagaagtcaaatattgcactttctcaaaagatccctccaaaccgatcccgggaatgacacttcaggagagcatgaacctcgatgccctgacaaagtacatgaagcacctcgaagataagtatgcagagattaaacaagccatgcttattaagtacgtgcccgctcaaagaaaagcagatctggacgaagagatgatcgtcctgctgaagcgccgtgatgtcgccgagaatctgaacaagaaacttcagttctgtcaccagagactccagataatcagccaggcattaagctcctgggtcaaaagtgatatgagcagccctttccaagatttcgtggaacagatccaaaagaccaagtatctgcagggagaccaaggaattgtggaggaactaatggaagatgacccgaggagggccaaagaggcagaaataatgctgcactacattgagaggttcaacgagttgattagtctgggagagtacgagaaagccgcatgttacgcagccaactcacctaggcgtattctgcgcaatatcggcacaatgaacactttcaaggccgtcggcaagattagggggaagccacttccactgctcctgttcttcgaggccctctttattacaagccatgcttttccatgtcccgttgatgctgccctgacccttgaagggatcaaatgcggcctgagcgagaagcgtctggacctggtcacaaattgggttacccaagaacgactgaccttcagcgaggaagccggagacgtgatttgcgactacggtgagcaagacacatacaacaaagcgaaatgccttgccctggcccagatcgtctacagcgaatgcggcttgcataagaaagccatcctatgcctgtgcaagcaggggcaaacccaccgtgtgatggaatacattcagcagctgaaggactttaccacagacgatctcctgcagcttttaatgagctgcccccaggtggagttgatacagtgtttgacaaaggaactgaacgagaaacaaccttctctctcattcgggctcgccatactacatctcttctctgccgatatgaagaaagttggcataaaactgctgcaagaaatcaataagggaggcattgacgccgtcgaatccctgatgattaacgattccttctgttccatcgagaaatggcaggaagttgccaatatttgctcccaaaacggattcgataagctgagcaacgacatcacgagcatccttcgcagccaggccgctgtgacggaaattagtgaggaggacgatgccgtgaacctgatggaacacgtcttttggtag

SEQ ID NO: 54166 - DNA, 54 bp, Artificial Sequence
  Description of Artificial Sequence: Synthetic coding sequence
atgagcgtccatcaaattaggaagcacgcggtgcttccccctataatttgctag

SEQ ID NO: 54167 - DNA, 243 bp, Artificial Sequence
  Description of Artificial Sequence: Synthetic coding sequence
atgtccgtccatcagatccggaaacatgcagtcctgccacccataatctgtagaagtgataaagaatttcttgaaagtgttcaaagatatatcatcactgaaactgagcgactgggctgttctgaagagggcccagcagacgaatactatattatttaccgtaatgtgttcgacaaagtgattgaacatatcacagcctataagtccatactaacatctattaaaaaggagtacgatgcttag

SEQ ID NO: 54168 - DNA, 501 bp, Artificial Sequence
  Description of Artificial Sequence: Synthetic coding sequence
atggaggcaggtccgcacccccgtccaggccactgctgcaaaccgggtgggcgtctggatatgaaccacggattcgtacaccacatcaggagaaaccagatcgccagagatgactacgacaagaaggtcaagcaagccgctaaagagaaggtgaggcgcagacacacacccgctcccactcgccctaggaaaccagacctccaggtgtatctccctaggcaccgagatgtgagcgctcatcctaggaatcctgactacgaggagtccggggaatcttcttcgtcaggaggctctgagcttgaaccaagcggccaccagctcttttgcttggaatacgaagccgacagcggagaagtcactagcgtgatcgtgtatcagggggacgacccaggaaaagtatccgagaaggtcagcgcccatacaccccttgaccctcccatgcgtgaggccctgaagctgcgtatacaggaggagatcgctaagagacaatctcagcattag

SEQ ID NO: 54169 - DNA, 384 bp, Artificial Sequence
  Description of Artificial Sequence: Synthetic coding sequence
atggaagctgggccacatcccagacccggacactgctgcaaaccagggggtcgcctggacatgaaccacgggttcgttcaccacatcagacgcaaccagatagctcgtgacgactatgataaaaaagtgaagcaggcagccaaagagaaagtgcggaggagacacacacccgcaccgacccgtcccagaaagccagatctacaagtgtacctgcccaggcaccgcggagaagcggcaagacctgcatgtttgcaaccagcccgtagtagttgcaacgccctgcccttttccatcggcaagaaccatttcctactcttaagattctcctcatcccgtctctttccggaaccgcctccacaacggtcccaaatttctgccgagtag

SEQ ID NO: 54170 - DNA, 606 bp, Artificial Sequence
  Description of Artificial Sequence: Synthetic coding sequence
atggcgtcacgatctgccggaactctactaacagagttcaacgccgcatacgtccctccgggacttatgcccggataccaagggcatgtgccgaccgtcgccttttctttcggggctccctatgggactacaaccctcaaatactttcaggaccacaggaatcgagccatggagaagtctcacactcctttctcccaagggggacatttcccaacaatctttagcacaaatccaaacctcttactgatggagagagcatcaacccgggaccgttggttacataagccaagctatactaggtttaacctagacagccaccgcagtactgaactcacaaacttctaccagatggtgcaacagcatcgcaagtactaccaggacaaaactggaaccgtcccgcgagtgccttacttcgccatgccagtgagggagccagagaggtatcctctgccaaccgtattgccccctctgtgcccgaagaagaaatggcacctactgcgcttggcgccagagaacctaaagacttatcagactttcccatccggaaaacgggtgtcacctcaggagcggaagaaaagagactgttactttgaatttcgcgcttag

SEQ ID NO: 54171 - DNA, 348 bp, Artificial Sequence
  Description of Artificial Sequence: Synthetic coding sequence
atgcaggtgatgaacctcaatgttccaatgcgtccaggcattctggttcaacgtcaatccaaagaggttctcgctacaccccttgaaaacagacgcgatatggaagctgaagaggagaatcagattaatgagaagcaagagccggagaatgcaggggagacaggccaggaggaagacgacgggctgcagaaaatccacacatccgttacgcgcacgcccagcgtggtggaaagccagaagcgacctctcaaaggtgtgaccttttcaagggaagtgattgtcgtcgacttgggaaacgagtaccccaccccacggagctatacccgtgagcataaggaacggaaatag

SEQ ID NO: 54172 - DNA, 585 bp, Artificial Sequence
  Description of Artificial Sequence: Synthetic coding sequence
atgtcccttctcgctaaaccaatgtcctttgagaccacggcgattaccttctttattatactgctgatatgtctgatttgtatcctcttgctcttggttgtctttctctacaagtgttttcagggcagaaagggaaaagagaccaagaaggtgccttgcacagatgccaacggaggagtggattgcgcagccgcaaaagttgtaactagcaaccccgaggatcacgagcgcatactgatgcaggtgatgaacctcaacgtgccaatgagacctggcatcctggtccagcggcaatccaaggaagtcctggctacacccctcgaaaatcgacgggacatggaagccgaagaggagaatcagattaatgaaaaacaggaacctgagaacgctggggaaactggacaggaggaggatgacggactccagaaaatacacacatcggttacacgaaccccctctgtggttgagagccagaagaggcccctcaagggagtgactttttctcgcgaggtcatagttgtggacctcggcaacgagtaccctaccccacggtcctataccagagaacataaagagcggaagtag

SEQ ID NO: 54173 - DNA, 381 bp, Artificial Sequence
  Description of Artificial Sequence: Synthetic coding sequence
atggccccaggggaagttaccatcactgttagactgataagaagtttcgagcatcggaactttaagcctgtcgtatatcatggagtaaatctggaccagacagtaaaagaattcatcgtgtttctcaaacaggatatccctctgcgcaccaacctgccgccacctttcaggaactacaagtatgacgccttgaagataatccaccaagctcacaaatccaagactaatgagttagttttgtctttggaagatgatgagcggctgctgttgaaggaagactcaaccttaaaagccgctggcatcgcgtctgagacagagatcgcctttttttgtgaggaggactacaagaattacaaggctaatccaatctccagttggtag

SEQ ID NO: 54174 - DNA, 381 bp, Artificial Sequence
  Description of Artificial Sequence: Synthetic coding sequence
atggccccaggcgaggtgaccatcaccgtcagattgatccgcagttttgaacatcggaattttaagccggttgtttaccatggagtgaaccttgatcagacggtgaaggaatttatcgtgtttctgaaacaggatattcctctcaggaccaatttgccaccaccattcaggaactataagtacgatgccctgaagattatccaccaagcccacaagtccaagacgaacgagctcgtgcttagcttggaagacgacgaacgactcttgctgaaagaggattccaccctcaaggcggcaggcatagcctcggagacagagattgctttcttctgcgaggaggattataaaaactataaagcgaaccccatctcctcctggtag

SEQ ID NO: 54175 - DNA, 381 bp, Artificial Sequence
  Description of Artificial Sequence: Synthetic coding sequence
atggctcccggtgaggtgactataaccgtcaggctcattagatcattcgagcacagaaattttaaaccagttgtgtaccacggagtcaacctggatcagactgtcaaagaattcattgtgttcctgaaacaagacattccgctgagaacgaatctccctcctccttttcggaactacaaatatgacgccctcaaaatcatccaccaggctcataagtctaaaaccaatgaacttgttctgtcattggaggatgatgagagattactgttaaaagaagatagtacactcaaggctgccggaatcgcctcagagacggaaattgcctttttttgtgaagaggattacaagaactacaaagcaaaccccatcagcagctggtag

SEQ ID NO: 54176 - DNA, 381 bp, Artificial Sequence
  Description of Artificial Sequence: Synthetic coding sequence
atggcccctggggaggtgactattacagtgagactcatccgcagtttcgagcacagaaacttcaaaccagtggtgtaccacggcgtcaatctcgaccagaccgttaaagagttcatagttttcctgaagcaagatattcctcttaggaccaatctgcctcctccttttcgaaactataagtatgacgcactgaagataatacatcaagcccacaaatccaagaccaacgaactggtgctgagtctggaggacgatgaaagactcctgttgaaagaagactcgactctgaaagccgcaggtatcgcgagtgaaactgagatagcattcttttgcgaagaagactacaagaactacaaagctaatcctatctcttcttggtag

SEQ ID NO: 54177 - DNA, 1659 bp, Artificial Sequence
  Description of Artificial Sequence: Synthetic coding sequence
atggacacgagctcggaaatgttggtccgctttggtagacgatgtggccgagcaaaggagtctaccgaaattagaaacagcgaggaggaccaggtgctctacctgcccttactgccgagcaaagtggatctccagcaggtcaccatcatcccccacgatgagtggaagcggatccaggatagcctcgatcgcttaaccagagaagcggcatgcctaagggcagaacggaaggcaaaaaaagaaatgcatctgcggtctcaggaggtagtgaaacattggacaaacacttacgcagggatgaaggagcagaagctagaagctaaaaagaagagggatgaggagatcgaagccgaacgccagatcctcgatctggaagaggagatctataagcagggcaaacggaaaaaagcgatagagaatgctaaacagtatcagttttaccaaactgaacgggtgaagaacttccactccggccttctgttgagtcgggtgatgaaggagagagacgcgcagatcgagtttcggaaatcaaaaataaaatcagacaagaagtgggaggagcagctaaagcttaatatagagaaggcgttcaaagaagaacaggaaaaagctgaaaaacgacaccgggagcgggtcgctttggccaaggaccatctcaaacagatcaaagaacacgaggaagaagaggaaagaagaaaaaagtacgaagagaaagacgcggaagaaatcaagcgccagaacgccctgtatgagatcgagatgaggaagaagctggaaaagaagagggaggaaatgcacgaatcacgcagaagattcctggaacatatgcaggataagcatataatcaaggcagtcgaacagcaacagcaggaagaagaggacgaaaaaatgcgaaagttcataaaagcgaagaagcggctgatccagatggggaaggagaaggaagccgagacgcatagactgatggagaaaagaagagagaggatccacaactttctaagcgaattactaaaggaaaagctggataacgaggatatgattattgctcgcgatatcgctgaagcggaagccgaatgggagaaacgggaaagagagaaggacgagaaaaacaaagcagaactcaagacaatcgccgaataccgcgcaatcgtaatgaagaataaagaagaggaggagcgtcagaggaaaatcgaagcaaaggaacagctattagcggtgatgaaagccgatcagattttttgggagcacgagaaggagaagaaatgcaaggccgataaagagcatcaggaggtccaagatgctcacatccagcaaatggcaaagaataaattcaatgccaagcaagctaaacaggccgaactagattattgtcgtctgaccgaagctctggtcgccgaaaaagagaaggagttccaggactatgctcgcgaggtgattgagctggagagtgagactactaacaaatacatctaccctctggtcaaggccgttcaggagggacccggagggggacgtgggccagtgttcgtcgataggggcggactccggccaagttatcaggcgaacgatgtgactggcgtacaactccccttttacaatagtcaggggcctaaatacaattttcagaagagtaaacggagactcggctttacttggtag

SEQ ID NO: 54178 - DNA, 2679 bp, Artificial Sequence
  Description of Artificial Sequence: Synthetic coding sequence
atgcactggctggcatcagctactcaaacaagtgcctcaatagtctcatcctcactgttatcagcagttgatgtctccagtagccttaccatgtcggaatatttccaaaacacctctttacccggaacagctaattcccgtcaattcagtctgcctgtggtaagcaacgctgcctttctgactgggtctatctctaactttagccgtgcatccgccccagcaatcagttccgcatggcttcaaccttccgctagcggaacaagctttcagcccctgatggggtctgcctacttgtaccagcattcttctactaccatgctttctggtgtgacaggacagtcacacatatgtacttcagcagcctcgtatcccggtgtttttgagtgggattctacagcctcaaccgtgaagaagtcatcaagcttaagagacttcactgttactgttatagaccagaacactgcagtctctagtatgtccatgacagctcaatactacaaaacctcagacacgaacactatggtgcctttgtacccctcattgagcgcctcactggtgcagggaaccctgacccaaatcccgaaccaacaggggcacaatctcagcctcccctgccaaatcggttcccaagtgtactattataaccagggcacactcggaccccagctttcatgtctgcagtcttatggatcagtgagctatactggttacagagcatccgcccaccagccggaaatggtcatggtgctcaaagaggtccagcctacgaacgttttacccccagtctccacgagtgggatgtattactcggtgtcatcgcaacccatcacagagacaagtgtccaggtcatggagacctccctgggcatggacacatccctaggtctgcagtccccatcccagactttctgtctgccgcaaactcctgaattctccaagtccttctcctcaaggaacactcagactttagaatcaaatccatcacccgaactgggcgacatctccatcacacccgtgcagagccctactaacttactgactctgtcacctgccccatcccaggagaaaaatgaaaatgagaatttagatgagatcaaaacaaatctgagtcgaaaccaggacccgcctcttctgcccgttgagatcccagacattcaccccctgctggcttgtattgatcccctgggacaggaagagcaacccggtagcgaaaacgctaatcttcgtaacaagtctctttctcttgaggaccagggaattttcgaaaatgggatcgagtctagttcagatctggctgatataactacttgggtcgaggacacgtacctgcctccaatattcagcagccttcaggacttagaccagcccgagaaaagctgtgttataaaaggacactctgaccaagtgcggaaaaacaaacacaaagccagtgagcctattcagggtgcgcctaaggccaagatccaacccaaaaatcccgagtgtctgctggagagggaggtggtagttggaagtgccactgtatccaacagtgcctcagtcaataaggccaagcatagcagtaacaaaccccacaaagctgcctcctcaaggatttccaagactaagtcccacggccaagaaaagaccaaaggcaaccggaagaactcaagtaagaagtcagaggagtcaaagcagagtggcaaaaaggttaaggtggaagagaagcagaccatccctaatatgaagagaaagaagaatcagccggaactctctcagaagacactgaagaagcccagatccagcctagggatgcacatgctggagtctgtacaagtctttcacgcgctggggaagaaaatagacatgaaaacagggttcagctcttcacgcacactgggctcttcttccaacacccagaaccgccagcctttccccgctctgaagccatggctggatatccagcatgagggaaagggcccagagaagattcaagtgaaggcccagaagttggacgggagtgccgagaaagaatgtaccagcccttcgcattctgagttacctccccctggcaaggtgaaactgattcccctgccgtttctgactcttgatcagccgcaagccagacacgtgtcgagacggcctaatcctctcgcctcccggaggcctgccgtggcgtatcccgcaagacctgactcgactaattccgctcaaagtaacgccgtaaacccgagtcgccctgccccaacgaacactagtctgacggggcctgccactccggctcagcccatcagcgccaaagccacgcagccttccagcgcaaaccccacccaacctacggtgccccagtcagccgctagccgcccaagtgcttataaaacgtctagctgctcatccctccagagagaaccagttagcaccgccgtgacgtcccttagatcgttgcctaagccccaaaatcaatttctcatccaggatttcagtctacagccgaggccatggcggaagcctacagtcccagagccagtcatgagtacaccaataacggaggagcaaagacctgagagggaggctatgaagaggaaggctcaacaggagagggaaaatgcagcgaagtacacctcccttgggaaggttcagttctttatcgaacgggaaagagacatggaaattgcagagtactacggttacaccatttag

SEQ ID NO: 54179 - DNA, 2769 bp, Artificial Sequence
  Description of Artificial Sequence: Synthetic coding sequence
atgcactggctggcctccgctactcagacgtcagcaagcatagtgagctctagcctcctgagcgctgtggatgttagttcctctctaactatgagtgaatactttcagaacacctccttaccaggcacagccaacagccgacagttcagtctgcctgtggtgtcaaatgctgccttcctgactgggagtatttccaatttttcccgtgcctccgctccagcaatcagctcagcctggctgcagccgagcgcttcaggtacctcgttccaacccctaatgggtagtgcttatttgtatcagcactcttccactactatgttatccggcgtgaccggacagagtcatatttgtactagcgctgcctcttaccctggtgttttcgagtgggactcaaccgcaagcaccgtaaaaaagagttcaagccttagagacttcacagtcaccgtaatcgaccagaacacggcagtgtcctccatgtccatgactgcccaatattataaaacctcggacacaaatactatggtgcccttatacccaagcctgagcgcgtcactcgtgcaggggaccctcacccagatccctaatcagcaaggacacaacctctctttgccatgccagatcggatcacaggtgtactactataaccagggaactctcgggccacagttgtcttgtctacagtcttacggtagcgtcagctacacagggtatagagcctcggcccatcagcccgaaatggtcatggtcctgaaggaggtccagcccacaaacgttttgcctccagttagcaccagtggcatgtactatagtgttagctcgcagcctattactgaaacatcagttcaagtgatggagaccagtctggggatggataccagccttggtctgcagagcccctcccagacgttctgtctgccccagactcccgagttttccaagagtttctctagccgtaacactcaaactctcgagagtaatccctcgcccgaactgggagacatatcaataaccccagtgcagagcccaactaatctccttacattgtcccctgctccaagccaagaaaaaaacgagaatgagaacctggacgagataaaaaccaacctgtcgaagcccttagacgttcaccaaatcttaattggcaatcaggaccctccgctgctgccggtggagatccccgacattcaccctttgctggcctgtatagatcccctggggcaggaggagcagccaggctctgaaaacgccaatctgaggaacaagagcctgtccctcgaagatcaggggattttcgagaatgggatcgagagctcctctgacctggccgatattaccacttgggtggaagacacatatctgcctcctatattctcctccctgcaagatcttgatcagcccgaaagcccttccgcaaaaaaagcaaaggacactagcgctatcaaagtgaaccaagtccaggaaaaatcttgcgtgattaaaggacattctgatcaggtgaggaagaataagcacaaagcctctgagccgatccagggagctcccaaagcaaaaattcagccaaaaaatcccgaatgcttgctggagcgagaggttgtcgtgggtagcgctacagttagcaatagcgcctccgtcaataaggccaagcactccagcaataagccacacaaagctgcctcttcccgaatcagcaagacaaaatctcatggtcaagagaagacaaaaggaaacaggaaaaacagtagcaagaagtccgaggagtccaagcagtctggaaaaaaagtcaaggtcgaggagaagcaaaccattccaaatatgaagaggaagaagaatcagcctgagctgtcccagaaaacccttaaaaagccaaggagtagcttaggcatgcatatgctggagtcggtacaggtcttccacgcccttggaaaaaaaatagacatgaaaacaggatttagctccagtaggaccctaggctcgtcctctaatacacagaataggcagccgttcccagcactgaaaccttggctggatattcagcacgaggggaaaggcccagaaaaaattcaggtgaaggctcaaaagctggatggttccgctgaaaaggagtgcacaagccccagccactctgaactccccccacccggaaaagttaaactgatccccctgccgtttctcactctggaccagcctcaggctagacatgtaagcaggagaccaaacccacttgcctcacgccgaccggctgtggcttaccctgccaggccagattctaccaatagtgcccaatcgaatgcagtcaatcccagccggcctgctccaactaacacgtccctcaccggcccagccacccctgctcagcccatctctgcgaaggctactcagcccagttcagcgaatccaacccagccaactgttcctcagagcgccgcaagtaggccttccgcatacaaaacctcgagctgctcgagcctccagagagaaccagtatctaccgccgtgactagcctgagatccctgccaaagccacagaatcaatttctgatacaggacttcagcctgcagcctcggccatggcgaaagcccacagtcccagagccagtcatgtcaacccccatcacggaagagcaaagacccgagcgcgaagccatgaagcggaaagcccagcaggaaagagagaacgcagctaagtatacaagcctgggaaaggtgcagttcttcattgagcgagagcgcgacatggagatcgctgagtactatggctacacaatttag

SEQ ID NO: 54180 - DNA, 582 bp, Artificial Sequence
  Description of Artificial Sequence: Synthetic coding sequence
atggagcgccgacttattaagaaggagatgaaaaagctgctcggagattacatcgggattcgccttcgcgagaatgaattcgatcccaagggacgacgacaactcacatttctcgacgatatggctcactatgacctggcaatttcagtcgccctgcagtggcttgacccgtccgaggatctgacctggctcgagtgggaggagctcaagatcccactgcatgggaggcccatctaccccaatcgcagagagcgtgaagctatgattctctcgagttacgctggcatcctcatgaacagcatccccatcgaagaggtgttcaagatttacggggcagacagctccgcggattctggcaccataaaggtccctcgcgtttcaagcttatgcctttccctgcacccatttgccatgctaaccgccccaaaggcagctgcttacgcccgaaagcaaagcgttaagtctcggaaagtaactaccaacaagaacgccacaagtatcagcgccaaggaagccaacgccacagagtggaagtcatcccagagattcagcgacacgcagcccaagcacaaggtgacttag

SEQ ID NO: 54181 - DNA, 201 bp, Artificial Sequence
  Description of Artificial Sequence: Synthetic coding sequence
atggagaggcgactaatcaaaaaggagatgaaaaaactgctaggtgattacattggcattcgccttcgcgagaacgagtttgaccccaaaggacggagacaactcacttttctggatgatatggctcactacgatctggccatttccgtcgcgttacaatggctggacccttctgaggacctgacgtggctggaatggtag

SEQ ID NO: 54182 - DNA, 1767 bp, Artificial Sequence
  Description of Artificial Sequence: Synthetic coding sequence
atggagatgcagtcacccattgtgcagaggcaggagcgacaggttcgtgaccggggtgtgacaagatccaaagcggagaaagtgagaccacccaccgtccccgtcccacaggtggatattgtccctggtcggttgagtgaggcagagtggatggcgcttacagcactggaggaaggcgaggacgtcgtaggagacatacttgctgacctgctcgccagggtaatggacagcgccttcaaagtgtatcttacacagcagtgtataccattcaccatttcacaggcccgagaagccatgctgcagattaccgagtggcgcttcctggcccgtgacgagggggaatccgcagtcgccgaagacccaacatggggcgaggatgaggaacctagtgcatgtaccaccgattcctgggcccaaggatctgttcccgtactacatgcttcaacctcagagggtctggaaaacttccagggggaagaccctggaggagtggaccgtatcccactgggaagaagctggatgggcagagggtctcaggagcaaatggaaagctgggaaccatctccacagctgagggtgacttcggctcctcccccaactagtgagctcttccaggaggccggtcctggcggacccgtcgaggaggcagatggccagtcccggggtctaagttcagctggaagcctgtcagccagttttcagctgagtgtggaggaggcccctgcggatgacgcagaccccagtttagacccataccttgtggcctcgcctcaagcatccacaggtaggggtcacccattgggattccatttaagcctggaagatctgtattgctgtatgccccaactagacgccgcaggcgatagactcgaactgaggtccgaaggggttccatgcattgcgtctggtgtcctggtttcttaccctagcgtcggcggtgccacaagaccgagtgcgagttgccagcagcagcgtgccggtcattctgacgttaggctgtcagcccaccatcacagaatgcgacgcaaggccgctgtaaagcggctggaccctgcacgtttgccttgtcactgggtgcgcccactggccgaggtattagtgccagattcccagaccaggcctctggaggcatacagggggcgacagaggggggaaaaaacaaaggccagggccgaaccccaggctttggggcctgggacacgagtgagccccgcagcctttttcccacttagaccgggaatcccattccgtgacctcgactccgggcctgccctgttgttcccaacactcaacctcggcctgtcttctccatcactcgagagcaagttgcctcttcccaactcccgtatcaggttcctgaccactcaccccgttctccccgatgtggcgcgtagccgaagtccgaaactctggccatcagtgagatggccctctggatgggaggggaaagctgaactcttgggggagttgtgggccggaaggacccgtgttccaccccagggacttgaacttgccgaccgtgaagggcaggacccaggaaggtggcccagaaccaccccacccgtcctggaggctacctcacaagtgatgtggaagcctgtcctgctgcctgaagccctaaagctggccccaggggtcagcatgtggaatagaagcactcaggtactgctgagttcaggggtgccagaacaggaagacaaagagggaagcacctttccaccagtcgagcagcacccaatacagactggagctcctaaaccaaggtag

SEQ ID NO: 54183 - DNA, 63 bp, Artificial Sequence
  Description of Artificial Sequence: Synthetic coding sequence
atggcttcctgcttggccctgagaatggcactcctgcttgtgagcggggtgttggctccgtag

SEQ ID NO: 54184 - DNA, 453 bp, Artificial Sequence
  Description of Artificial Sequence: Synthetic coding sequence
atggaggattatgccctgacattcggcattaaccccttcatcgctttgatgatccagcccatcgtcactatgacggtcgtggataaccagggccttgggctcccagtggacatccagcacaaggcaaaacccagtcctaaagcatcccaaatgctccctccagaccttgggcctccgtcatttcagaacctgctgagcccatccgaaaaactggaaccctgggacccaggaatgaggaaattgaccgtacaaacctgtgggctcacctttatccatccagcgggtcacggactgtgccaccccacggcagaggcatctgcagagacgctgtcttctactgctctgaacagaccaagtgtgcgggaaggtgcatgtaatgagaagagcactgagaacaagaagccccaggactcagtcctttggagccacagtaggtggtttcagggcaattag

SEQ ID NO: 54185 - DNA, 291 bp, Artificial Sequence
  Description of Artificial Sequence: Synthetic coding sequence
atggaggattacgctctgaccttcggtataaacccattcatcgctctcatgatccaaccgatagttacaatgacagtggtggacaaccaaggtctaggactgccggtggatattcagcacaaggccaaaccttcccctaaggccagtcagatgcttccgcctgatttgggccctccatcgttccagaactgctttacgtgccgaactgccccatccttagtcatggtcctgtcttggaaaagcggcgtgaggagagaggtgcctgtgcatccatcatacgctaaatattag

SEQ ID NO: 54186 - DNA, 621 bp, Artificial Sequence
  Description of Artificial Sequence: Synthetic coding sequence
atggccgcaaccaagactgcaagctatgatgaacacttcagacccgagaagctgagagagtggcccgagccagagtctgttagtctgatggaggtgcttgccagagaagacattgatgaggccgtctgcgccattctcttcaaagaaaatagcatcgttaaggtgacagtcccaccctttgtggatccacttttccaacggcagcaagaggtggatgaagagcgcagaacaggactgcagtgcgaaaccggcaaacgtcacagcatcaaggaactggaagagatcgagaaggcccgtctgcacgcgagcagcccttattttacatttacatcccactgcgttatcccgaaagaatggcataaggctagtgccagagcgaggtccaagacttacaagtactcacctgagaagttgatatatgcggacaaaaaacaaaagcgcaaagagaagaaaaccgctgatttgtctcaggctgcttttgagagacaattcctctcttccaagttgtcccagaaaaataaagttggcgaacgaaagggcctggtctcccgcggtctcggcaggggctggcacgcgggattgtgttccacccacgagcaacacatcttagtaccagagtag

SEQ ID NO: 54187 - DNA, 288 bp, Artificial Sequence
  Description of Artificial Sequence: Synthetic coding sequence
atggggtgtatgaagtcaaaacagactttccccttccccaccatatacgagggtgagaaacagcacgagagcgaggagcccttcatgccggaagagcgctgtttgccccgaatggcctcgccagtgaatgtgaaggaagaagtaaaagaaccgcctggcaccaatacagtgattctcgaatatgcccacaggctgtcccaagacatattatgtgacgcactccaacaatgggcatgtaataatataaagtatcacgatatcccctacatagagtcagagggtccttag

SEQ ID NO: 54188 - DNA, 288 bp, Artificial Sequence
  Description of Artificial Sequence: Synthetic coding sequence
atgggatgtatgaagtccaaacagacctttcccttcccaactatctacgagggcgagaagcagcacgagtccgaggagccatttatgcccgaggaaagatgcttgcctcgcatggcttcaccagtgaatgtcaaggaggaggtgaaagaacccccaggaaccaacaccgtcattttggaatatgctcaccggttgtctcaagacatcctgtgcgatgccctgcagcaatgggcttgcaataacataaagtaccatgacatcccgtatattgagtcagagggcccatag

SEQ ID NO: 54189 - DNA, 204 bp, Artificial Sequence
  Description of Artificial Sequence: Synthetic coding sequence
atgggatgcatgaagagtaaacagacctttccctttcccacaatttatgaaggcgagaagcagcatgagagtgaagagccctttatgcccgaagaacggtgtctgccaaggatggcctctcccgtgaacgtgaaagaagaagttaaggaacctcccggtacaaacacggtaattctggagtatgcccacagactcagtcagtag

SEQ ID NO: 54190 - DNA, 288 bp, Artificial Sequence
  Description of Artificial Sequence: Synthetic coding sequence
atgggttgcatgaagtccaaacagacctttccttttcccacgatctatgagggggaaaagcagcatgagagtgaggagcctttcatgcccgaggagcggtgtcttccgcgtatggcatcccccgtgaacgtgaaggaggaggtgaaggagcccccaggaacaaacacagtgatcctggaatatgcccacaggctgtcacaggatatcttgtgtgacgccctgcaacagtgggcatgtaacaacataaagtaccacgatatcccttacatcgagagtgagggcccatag

SEQ ID NO: 54191 - DNA, 288 bp, Artificial Sequence
  Description of Artificial Sequence: Synthetic coding sequence
atggggtgcatgaaaagtaaacagacttttccatttcctaccatttatgaaggtgagaagcagcatgagagtgaggagccgttcatgccagaggagcgctgtttgcctagaatggcctcccctgtgaacgtgaaagaggaggtgaaggaaccccctgggacaaacaccgttatccttgagtatgcccacagactgagtcaggacattctgtgcgacgctctgcagcagtgggcttgcaataatattaaataccatgacatcccatacatcgaatcagagggaccttag

SEQ ID NO: 54192 - DNA, 93 bp, Artificial Sequence
  Description of Artificial Sequence: Synthetic coding sequence
atgggctgtatgaagtccaaacagacattccccttccccacgatctacgagggcgaaaaacagcatgaaagtgaggagccattcatgccttag

SEQ ID NO: 54193 - DNA, 396 bp, Artificial Sequence
  Description of Artificial Sequence: Synthetic coding sequence
atggttcgaatgtcgcggccactttttctggactgggcatggcgccctctctgttcaccaagccagtctctgccactaacatacggacccgagggatggattcttcagtggaagggcacatgccgccaacagactgctttacattgtcctttcgacttcccacaagccccacttaggggtcggcacaccttgtcacaggtgcccaataagggccacgagaaagcgagtgcggtgcagctgccagaaaagcagggcactgaccagtcgcggagggggccaacttctgcagtcacaaaagccagaacctcttatccagagtccgaaacattcatcgtctatctgtgtagctacttctggaattcttccaaaggagtttacatgtccgggtctacctag

SEQ ID NO: 54194 - DNA, 879 bp, Artificial Sequence
  Description of Artificial Sequence: Synthetic coding sequence
atgaagtcagaagccaaggatggggaagaggagtctctgcagaccgcattcaaaaagctgcgtgtcgatgccagcgggtcagtcgcttctctgagtgtgggtgagggaacaggggtcagggccccagtgcggaccgccacagacgacactaagcctaaaaccacctgtgccagtaaggatagctggcatggtagcacgaggaagagctcacgcggtgccgtccgcacgcagcggaggcggaggagcaagtcaccggtccttcatcccccaaagttcatccactgcagtacgatcgcctcatctagttcctctcagctgaagcacaaatcacagacagattcgcccgatggctctagcggattgggcatttcgagccccaaggaattctcagccggagagtccagcacctcattggatgccaatcacaccggtgctgtggtcgagccacttcggacatccgtgcccaggctgccatccgagagtaagaaagaagactcttcagacgctacccaagtgccacaggcaagtctgaaagcaagtgatctctccgattttcagtccgtgtcaaagctcaaccagggaaagccctgcacatgtatcggtaaggaatgccagtgtaagagatggcatgacatggaagtctacagcttctctggcctacagagcgtgccaccccttgcccctgagaggcgtagcacacttgaagattacagtcagtccctgcacgctcgcactctctctggcagccccagatcttgttccgaacaggctagggtctttgtggatgatgtgactattgaagacctgagcgggtacatggaatactatctttatatacctaagaaaatgtcacatatggcggagatgatgtatacatag

SEQ ID NO: 54195 - DNA, 879 bp, Artificial Sequence
  Description of Artificial Sequence: Synthetic coding sequence
atgaaatcagaagctaaagacggcgaggaagaatcattgcaaaccgcatttaaaaaactgagagttgatgcctcgggatcagtggcatctctgtccgtgggggagggcaccggtgtcagggccccagttagaacggctactgacgatactaaaccaaagacgacatgcgcgagtaaggactcttggcacgggagtactaggaaatcctctcgcggtgcagtgaggacccagagaagaagacgctccaaaagcccagtcctgcatcctcccaaattcatccactgctctacgatcgccagtagcagctcttcccagcttaaacacaagtcgcaaaccgacagtcctgacggctcttcaggcttaggcatctctagtcccaaagagtttagcgccggagagagttcaacctctctggacgccaaccatactggtgccgtcgttgagccgctccgtacgagtgttccacggctgccttccgagtcaaagaaggaggactcatcggatgcgacacaggtgccacaagcttcccttaaagccagcgacctttccgactttcagtccgttagcaagctgaaccagggcaagccctgcacatgcattggaaaagagtgccaatgcaaacgttggcatgacatggaggtgtattccttctctggactgcagagcgtgccccctctcgctcccgaaaggaggtccaccttggaggattattctcagtccttgcatgccagaactctatctgggtcaccaaggtcttgtagcgaacaggccagggtctttgtggacgacgtcactatcgaggatttgtcagggtatatggaatactacctatacataccaaaaaagatgtcacacatggcagaaatgatgtacacatag

SEQ ID NO: 54196 - DNA, 528 bp, Artificial Sequence
  Description of Artificial Sequence: Synthetic coding sequence
atgggccaggtggtgtatgtccctgtgaagactggaagcggcgcagacgggctttcagagcccgaaggaatctccctgaagcgggtggcagtcgtcgaggattttttcgacatcatttacagcatgcacgtggagagtagcgctgaaccaggtaaagcccctaaacacgccggtcagaagaagacataccgggcaattgccgagacatacgcgttcctgccacgcgaagccgtgactcgctttctcatgagttgcaccgaatgtcagaaaaggatgcacttcaacagtaatggtctggagcctaaagagaatgagcccccatccccgctggtgagtgggattattgactacaatatgccactgacctccacttacctaaaacagatgaaacttagggtgatgaatagccaggaacagtgccttccatctggtgcagaggatattatgtcgggcggacctaccctggaggccgcagagttcgatgacttgattggtaagtgcctacccgatcggccaatagctgagtag

SEQ ID NO: 54197 - DNA, 276 bp, Artificial Sequence
  Description of Artificial Sequence: Synthetic coding sequence
atgagcgatagtacatggatgtccgcagatccccatctggcctcttccctgtcaccttcacaagacgagcgaatgaggtccccccagaatctgcattcacaggaggacggccctcataggcttagccacctgagtcagggtttgaatatcatatgcagtctggacacgtctctacgggcaagaaaccctcgcgtaagcgctgagcgaaacgatttctctttccgcggaagatcccggtgcgttacttccaacagtctcgccaaggatggatactag

SEQ ID NO: 54198 - DNA, 1311 bp, Artificial Sequence
  Description of Artificial Sequence: Synthetic coding sequence
atgagtgactccacgtggatgagcgccgacccccacctggccagttccctctcgccatctcaggacgagcggatgagaagtccacaaaacctgcacagtcaagaagatgacgactcctcttcggagtccggatcaggtaatggcagttcgaccctcaacccctcgacatctagctccacccagggtgatcctgcctttcctgaaatgaatggaaacggagccgttgccccaatggactttacaaccgctgccgaggaccagcccatcaatctgtgcgacaagcttccacccgcaactgccctcgggaccgcctcttatccctcggacggctgcggcgctgatggactccgatcacgggtcaagtacggtgtgaaaacgacccccgagagtcctccctactcttcgggctcatacgattctattaagaccgaggtttccgggtgccccgaggacctgaccgtcggcagagctcccactgctgacgatgacgatgatgaccatgacgatcatgaagacaatgataagatgaacgactcagaaggtatggatcccgaaaggttgaaggcttttaacatgtttgtgcgactgtttgtcgatgagaatcttgatagaatggttccaatttcaaagcagcccaaagagaaaatacaggccatcatcgaatcctgcagtcggcagttcccagagtttcaagagcgagcgaggaagaggattaggacttatctaaaatcctgccggagaatgaaaaagaatgggatggaaatgactcgcccaacgcccccacatctgaccagtgcaatggctgagaacatcctcgctgctgcatgcgagtccgagacccgaaaggcagctaaaagaatgagattggagatttaccagagctcccaggatgaacccatcgcgctggataagcaacacagtcgtgacagtgccgctataactcatagcacatatagcctgcctgcgagctcatacagccaggatcctgtatatgcaaatggtggcctgaactattcctacaggggctacggggctctgtcctctaatctgcagcctcctgcatccctgcagactggcaaccactccaacggcccaactgacctcagcatgaagggcggtgcaagcaccacttccaccactccaacacccacaccttcttctacctctacttcgcgcccagtgccaacagcccagctgagcccgactgagatcagcgccgtgcggcaactcattgctggatatagagagtccgccgcttttttgttaagatcggcagacgaattggaaaatctcattttgcagcagaattag

SEQ ID NO: 54199 - DNA, 246 bp, Artificial Sequence
  Description of Artificial Sequence: Synthetic coding sequence
atgtcctgtaccgaatgtcaaaagcgcatgcacttcaattcaaacggtctggaaccgaaagagaacgaacccccttctcctttggtctccgggattattgactataatatgcccctgaccagtacctacctgaagcagatgaaactgagagtcatgaacagccaggaacagccttcttcgctgagtcctgccccaggtttcgttaacacggttataactgtccttatctgtgcccacgaagagtag

SEQ ID NO: 54200 - DNA, 342 bp, Artificial Sequence
  Description of Artificial Sequence: Synthetic coding sequence
atgaagttaagagttatgaactcgcaggagcaggacgaaacgagtgtaagttccgaggatttcgatatgagcgatagcacctggatgagcgcggatccgcatttggccagctcgctgtccccaagtcaggatgaacggatgcgctcacctcagaatctgcactcccaagaggacgggcctcacaggctgtcgcatttgtctcaaggtcttaacatcatttgcagtctagatactagtctccgggctaggaatcccagagtaagtgctgagcgaaacgatttctctttccggggaagatctagatgtgttactagcaatagtctagctaaagacggttactag

SEQ ID NO: 54201 - DNA, 468 bp, Artificial Sequence
  Description of Artificial Sequence: Synthetic coding sequence
atgcacgttgagagttcagctgagcctggaaaagctcctaagcatgcaggccagaaaaagacttaccgtgccatagcagagacctatgctttcctccccagagaggcagtcactcgatttctgatgtcatgcacagagtgtcagaagcgaatgcacttcaatagcaatggcctggagcccaaggaaaacgaacccccttcaccgctagtcagcggtataattgactacaacatgccactaacctctacttatttgaagcagatgaaacttagagtaatgaactcacaggagcaggacgagactagcgtgagctcggaggacttcgatatgtcagattcgacatggatgtccgcagatccgcatctggccagttctctcagtcctagccaagatgagaggatgagatcgccgcagaatttgcactctcaggaagatggaggtgtatgcttacaagggcctaccgcatag

SEQ ID NO: 54202 - DNA, 1197 bp, Artificial Sequence
  Description of Artificial Sequence: Synthetic coding sequence
atgtcggactccacttggatgtcagctgatcctcatcttgctagtagcctaagcccatctcaggacgaacgcatgcgctcccctcagaatcttcattcacaggaagacgacgattcttcaagcgaatctggatcagggaacggttccagtaccctgaatccttccacaagttcatctacccagggggatcctgcgtttccagaaatgaacggaaacggggctgtggcaccaatggatttcacaactgccgctgaagaccaacccatcaatctgtgcgacaagctgccccctgctaccgccctcggaaccgcttcttatccatctgatgggtgcggagctgatggattgcgatccagggtgaagtatggggtaaagactacccccgaaagcccaccttactcgtcagggtcttatgattcaattaagaccgaagtgagtgggtgtcctgaagacctgaccgtcggcagagcacccactgccgacgacgacgacgacgaccatgatgaccacgaggacaacgataaaatgaatgactccgagggcatggacccagaaagacttaaagccttcaatatgtttgtcagactcttcgtcgatgagaatctcgacagaatggtgccaatcagcaaacagcctaaagagaaaatccaggctatcattgagtcctgtagcaggcagttccccgagttccaggagagggcgagaaagcgaatccgtacatatttgaaatcctgccggagaatgaaaaagaacgggatggagatgacacggccaacacctccacatctgacgtccgcaatggcggagaatatcctggcagctgcatgcgaaagtgagacacgcaaggcagcgaaaaggatgagactagaaatataccagagctctcaggacgagcctatcgctctagataagcagcactccagagactcagccgcaatcactcatagcacttattctctacccgcttcgtcatattctcaggaccctgtatatgctaacggcggtctcaattattcctatagggggtatggcgctctgtcatccaacctccagccaccagcgtcgttacagacaggcaatcactcaaatggaccaacagacttgagcatgaagggcggagcttcaaccacaagcactactcccaccccacgcctcggggctccactcactagacggtggggatgctcaagcgtatag

SEQ ID NO: 54203 - DNA, 231 bp, Artificial Sequence
  Description of Artificial Sequence: Synthetic coding sequence
taacagaagcgcatgcactttaactcaaatggtctggagcccaaggagaatgaacctcccagcccgttggtctccggcattattgactacaatatgcctttgacaagcacatatctcaagcaaatgaagttacgggtgatgaactctcaagagcagccttcctctctgtcccctgctcccggattcgtgaacaccgttatcacagtcctgatttgcgcccatgaggagtag

SEQ ID NO: 54204 - DNA, 648 bp, Artificial Sequence
  Description of Artificial Sequence: Synthetic coding sequence
atgcggggtctgcgatggcgatacacacgcctcccatcccaggttgaggatactctgtccggtgaggagggcaacgaagaagaagaggaagaggaagcagcgcctgaccccgctgccgctccagaggacccaaccgtgcctcagcttacagaggcatcacaggtgctgtcggcgagtgagattagacagctcagcttccattttcccccacgcgttacagggcacccgtggtccctcgtgttttgcacttccagggacgggtttagtctccaaagcctttacaggcgaatggaggggtgtagtggacccgtgcttctcgtgctgcgcgaccaggatggacaaatctttggggctttcagttcctcggccatcagactgtctaaagggttctacggaaccggtgagacatttctcttctctttctccccacagctgaaagtgttcaaatggactggcagcaatagttttttcgtcaaaggcgacttggattcactcatgatgggcagcggaagtggcagattcggtctctggctggacggtgatttatttcgcggaggatcctcaccctgcccaaccttcaacaacgaggtgctggctagacaggaacaattctgcattcaagaacttgaagcttggctcctcagctag

SEQ ID NO: 54205 - DNA, 3210 bp, Artificial Sequence
  Description of Artificial Sequence: Synthetic coding sequence
tgagtggctggaactcccacctcctcccagccgagtttcggaccttctatccgggagagaccctctcagagtctttgcccgtgtccgtgcccagctggcgagggtgaccctgcttggcctgctttggagcgtcggctggtaacgtcccggggacgtcagcctagtcctcagtcccatgcacagctcctgactcgtcgtcgacatagcagcgagcaagttccacctgaatctgaacctagggccgattttagatcgggcaaatggttgcaggagcccgctaccggcgatgcccgtgattcaaggcaggccctgcgggctcgcatgagctcaaaacaccggatttgctcccaggaggaagtcgtgatcccttgcgcctacgactcagactccgagagtgtggatcttgagctgtctaatctggagataatcaagaaaggttccagttctattgaactgaccgatctggacatccctgacattcccggattgcactgcgagcccctgtctcatagcccgagacacctgactcagcaggatccattgtctgaggccatcgtcgaaaaactcattcagagtatccagaaggtgtttaatggagagcttaagggcgaacttgagaaactgaaattcctgggagatctctcgagtttgtctcaggccctcccgtacgacgagacggccaaaagcttcatacacagccacatagccgacatcgtgcatacccttaacgttctcgtacaggaggagcgaccccactcgctgagctccagtatgaggcaagaggtgttcgtgacgatcgccgacctctcctaccaggatgtgcaccttctgttaggctccgaggatagagcagagttattcagcctcactataaagtcaattatcaccctgccctccgttcgtacgctcacccaaatccaagagattatgccgaatggaacatgcaacaccgagtgcctgtacaggcagacctttcaggccttttcagagatgctccaatccctagtcgttaaggacccccacctcgaaaatcttgatacaatcattaagcacttagttccctggttacagagtgttaaagatcatgagagagagagggccacagcttccatggcccaagtccttaaatgtctttcaaagcacctgaatctgaagctgccattgcggttccaaaggctcggacacctggtcgcgcttatggctctcctctgcggggacccacaggagaaggtggccgaggaggccgctgaaggcatccattccctgctgcatatcaccctcaggctgaagtatatcactcatgataagaaagaccagcagaacctgaaacgggcactgaccaaatgtagagagtttctggagcttcattcaagcgctgccaagtgcttctacaactgcccctttcgcattgcgcaggtgtttgaaggatttctggactccaatgagctgtgccagttcattatgacaacctttgacactctgaagactctcaagcatccttgcatccagagatctgccggtgagctactgctaactctggcaaagaacacagaatcgcagttcgagaaagtgcccgagatcatgggcgtaatctgcgcccagttaagtatcatctcgcaaccccgtgttcgccagcagataatcaatacagtctccctgttcatctcccgcccaaaatacactgacatcgtgttgagcttcttactatgccacccagtgccctataacaggcacttagctgaggtttggcgtatgttgagcgttgaactgccttctactacatggatcctgtggcgcttgttaaggaagctccaaaaatgtcacaatgaacctgcccaggaaaaaatggcttatgtggcagtagcagctacagatgccctgtatgaagtgttcctaggaaacaggctgagagccgctacttttagattgttcccccagctcctgatgaccttattaatccagattcaccactccatcgggctcacgatgtcagacgtggacatcccgagcggtctttataccgaacaggaggttccttccgaagtaacccccctctgctttgccatgcaagcaacgaaaacattacttctgaggacatgctgtctgcaggagtttaacataatggaaaaaaacaaagggtgggctctcttgggtggaaaggacggccatctgcaaggactgtttctccttgctaatgcattgctggagcggaatcagctgttagctcagaaggtaatgtatctcctggttcctctcctgaacagggggaatgataagcacaagctgactagtgctggctttttcgtcgaactcctgagatctccagtcgctaaaagattgccctccatctattcggtagccaggtttaaggactggttacaagatggtaaccatttattccggattcttgggctgcgaggcctctacaacctcgtgggacatcaggagatgcgtgaggatatcaagtccctgctaccatacatcgtggactcgctgcgggagaccgacgagaaaatcgtgctcagtgcaatccagatcttgcttcagctggtgaggaccatggacttcactacactggctgccatgatgagaactcttttctctttatttggagacgtgagaagcgacgttcataggttcagcgtcacgctattcggagcagccatcaagagtgtgaaaaatcctgacaagaagtcaatcgagaatcaagtgcttgatagtttggtgcccctccttctgtatagccaggatgagaacgatgcagtggctgaagagtctcggcaggtcttgaccatatgcgctcaattcctgaaatggaaattgccgcaagaagtgtatagcaaggacccttggcacatcaaacccacagaggccggtacaatctgccggttcttcgagaagaagtgtaaaggcaagatcaacatattagagcagaccctaatgtattcgaagaacccaaaactgccaatccggcgatcagctgttctctttgtcggccttttatccaaatatatggaccataatgagctgaggcggatggggacagactggatagaagacgaccttcgcgatttgctctgtgacccagagccatcgctgtgtatcattgcgtcccagactctcctactcgttcagatggccagggctgagcccaagcccaagcagagggtgaactggttacagaagctaatgggtaggtccagcgcatag

SEQ ID NO: 54206 - DNA, 1890 bp, Artificial Sequence
  Description of Artificial Sequence: Synthetic coding sequence
taacagccacgacaggtggcaggcaccccgaccagttctcagcctagcttcggaccctcaattcgggagagacccagtcagtctttgtgtccttgtccctgtcctgcaggagagggtgatccggcatggcccgcactggaacgcagattggtcacatctcgcggtagacagcctagcccacaaagtcacgctcaactgcttactagacgacgacatagctcagagcaggtcccaccagaatccgagccgagagcagatttccgctcaggaaagtggttgcaggagcctgctaccggcgacgccagggactccagacaggccttgcgagctaggatgtcctccaagcatcggatttgctctcaggaagaagtcgtgataccatgtgcgtatgattcagattcggagagtgtggacctcgagctttccaatctggagatcattaaaaaggggagctctagcatcgagctcacggatcttgacatcccagatatcccgggattgcattgcgaaccactcagtcactcccccagacatcttacccagcaagaccccctgtccgaggctatcgttgagaagcttatccagagtatccagaaagtcttcaacggtgagctgaagggggagctggaaaagcttaagtttctgggggatctctcgagtctgtcgcaggcgctgccttatgatgagaccgctaaatcttttatccattcccacatcgccgacatagttcatacccttaacgtgctggtgcaagaggagagacctcattccctgagcagcagtatgcgacaggaggtgtttgttaccatcgctgatctctcctatcaagacgtgcaccttctgctgggctctgaggaccgcgctgagttgtttagcttgacaatcaaatctatcataactttaccatcggtccggaccctcactcagattcaggagattatgccaaatgggacctgcaacacggagtgtctctatcgccagacttttcaggccttttcagaaatgctgcagagcctggtggtgaaagacccacacctggagaacctggatacgatcatcaagcatctcgtcccttggttacaaagcgttaaagatcacgaaagggagcgagctaccgcctctatggcacaggtactaaagtgcttatcgaagcatttgaatttgaagttgccacttagattccagcgtctggggcatttggtggctctgatggctttgttgtgcggcgatccccaggagaaggtcgctgaagaggccgcagaggggattcacagcttgctacacattaccctgcgtctcaaatacattactcatgataagaaagatcagcaaaacctgaaaagggccctgaccaaatgtagagaattcctggaactgcacagtagcgccgctaaatgcttctacaattgtccattccgcatcgctcaagtcttcgaaggcttcctggactctaacgaactgtgtcagtttattatgactacatttgacaccctgaagacacttaaacacccctgcatacagcggagtgcaggcgagctgcttttaacgctcgctaagaatacagagtcgcagtttgaaaaggtacccgagatcatgggcgtaatctgtgcacagctgtcgatcatttcccagcccagagtgcgccagcagattattaacactgtcagcctgttcatctcccgccctaaatatacggatatcgttctgagctttttgctgtgtcacccagtaccttacaacagacatctcgctgaggtatggcgcatgctctctgtagaactcccttccactacttggatcttgtggagactgctacgcaaactgcagaaatgtcacaatgaacctgctcaggaaaagatggcatatgtagccgttgccgtgagtccatag

SEQ ID NO: 54207 - DNA, 3129 bp, Artificial Sequence
  Description of Artificial Sequence: Synthetic coding sequence
atgcccttgtctcgacgtggacgcggatcaagactcgctggctcacgagctgccacatccaacctcccacgagctacagctctgtcccctaagcacgctcaactgctgaccagaaggagacattcaagtgagcaagtcccccctgaaagtgaacctagggcagattttagaagcggcaaatggcttcaagagcctgctacaggcgatgcacgggacagccgccaggccctgagggcacgtatgagttcaaaacaccgaatttgcagtcaggaagaggtggtcatcccttgtgcctacgactccgactcagaaagcgtggacttggaattgtcaaacctcgaaattattaaaaaaggtagctcgtcgatcgagcttactgacctcgatatccccgatatcccagggttacattgtgagcctctgagtcactcccccaggcatcttacgcagcaagacccactctctgaagcaatcgtcgagaaactgattcagagcattcagaaggtttttaatggggagttgaaaggggagttagagaagctgaagtttctgggggacctgagcagtttatcacaggcccttccctatgacgagaccgctaaaagctttatccactctcacatcgcagacattgttcatacgctgaatgtcctggtgcaagaggaaagaccccattcgctgtcaagctcaatgcgacaagaggttttcgttacgatcgccgacctgtcttaccaggacgtccatctcctgctgggatccgaggacagagcggagctgttttctctgaccatcaagtctatcatcaccctgccatcagtgcgcacgttgacacaaatccaagaaattatgcctaacggcacatgcaacactgagtgcctttatcgtcagaccttccaggccttttctgagatgcttcagtctctggtggtaaaagacccacatctggaaaatctcgatacaattatcaagcatctagtaccatggctacagagcgtaaaagaccatgaacgggaaagggctacagcttctatggcccaagtattgaagtgcttgtctaaacacttaaacctaaagctcccactacgttttcagagactgggccacctggtcgcacttatggccctcctatgtggcgatccacaggagaaggtcgctgaggaggcagccgagggcattcactctctgttacatattactctcagactcaagtacattacccatgataagaaagatcagcagaacctgaaaagagctcttacaaagtgtagagagttcctagaactacacagctcggctgctaagtgcttttacaattgcccttttaggatagcccaggtgtttgaaggattccttgattcaaatgagctctgtcagttcattatgacaaccttcgatactctgaaaacccttaagcacccgtgtatacaaagatccgcgggagagctactgcttaccctggcaaaaaacacagagtctcaattcgaaaaagttcccgagattatgggagtcatttgcgcccaactgagcattatctcacagcctcgcgtacgacaacaaattatcaacacagtgtctctcttcatttcccgccctaagtataccgatattgtactgagcttcctgctgtgccatccagtcccttataaccgacacctggcagaagtgtggcgaatgctctctgtggaactgccctcaaccacctggatcctatggcgcttgctgaggaaactgcagaaatgccataacgaacccgctcaggaaaaaatggcatacgtggctgtggccgctaccgatgccctttatgaagtgtttttagggaataggctccgagccgctacttttcgcctgttcccgcagttgctgatgactttgctgatccaaatacatcactctatcggcctgactatgtctgatgtggacatcccaagcggactttacacagaacaggaagttccatctgaggtgactcccttgtgtttcgcaatgcaggctaccaagacgctgctgcttcggacatgttgcttgcaggagtttaacattatggaaaagaacaagggttgggccctcctcggtggtaaggacggccatctgcagggcctcttcctactggcaaacgcattgcttgaaaggaatcaactgctcgcacagaaagttatgtatttgctggtgcccctcctcaatcggggtaacgataaacacaagctcacgtctgctgggttttttgtagaacttctccgcagtcccgtggccaaaaggttaccctcaatctacagcgtcgctcgcttcaaggactggctacaggacgggaaccacttgtttagaattctggggttgcggggactgtataacctggtgggccatcaggaaatgcgggaagacatcaagtcgctgctcccctacatagtggacagtttgcgagagacggacgaaaaaatcgtactgtcagctatccagattctgctgcaactggtgcgcactatggattttaccaccctggccgcaatgatgaggacgcttttcagcctttttggcgacgtgcggtccgatgttcacagattctcagtgacactttttggagctgccattaaaagcgtgaaaaacccagacaagaagagtattgagaatcaggtcctggactctctcgtgccacttttgctctatagtcaagacgaaaacgacgccgttgctgaagagtccaggcaggtgctcacaatctgcgcccagttcctgaaatggaaactaccccaagaagtctactcaaaagatccctggcacatcaagcccaccgaagcaggaaccatctgtaggtttttcgagaaaaagtgcaaaggcaagattaacatcttagagcaaaccctcatgtattccaagaatcctaagttaccaattcggagaagcgcagtgctctttgtgggactcctgtctaaatatatggaccataatgaactgcgacggatgggcactgattggattgaagacgacttgagggatctgctatgcgaccctgagcctagcttgtgcatcatcgcttctcaaacactcttactggtgcagatggccagagccgagcctaaacccaagcagcgagtcaactggttgcaaaagttaatgggcaggagtagtgcatag

SEQ ID NO: 54208 - DNA, 2013 bp, Artificial Sequence
  Description of Artificial Sequence: Synthetic coding sequence
tagtgtaacacggagtgtttgtatcggcagacctttcaggccttcagtgagatgttgcagtctcttgtggtgaaggaccctcatctggagaatctcgataccatcattaaattgcctctcagatttcagcggttgggtcatctggtggccctcatggctctattgtgtggggacccccaggaaaaggtggccgaagaagcagccgagggaattcacagtttactgcatataactttgaggcttaagtacattacgcatgataaaaaggaccagcagaacctaaagcgggctctcacaaagtgccgtgagttcttagagttgcacagctccgctgctaagtgtttttacaactgtcccttccggatcgctcaggtcccagaaattatgggtgtgatctgtgcccaattgtctatcatatcccagccccgagtcaggcagcagataatcaataccgtctccctgtttatctcgcgccctaagtacaccgacatcgtgctaagctttctgctttgtcaccctgttccttacaatcgacatctcgccgaggtgtggcgcatgctgtccgtcgaactgccatcgactacctggattctctggagactccttcggaaactgcagaaatgccacaacgaacccgcacaagaaaaaatggcatacgtggctgtcgccgcaaccgatgctctttacgaagtcttcctaggcaacagactccgggctgctaccttccgtctgttccctcagctgctgatgacgctgcttatccagattcatcatagtatcggcctgacaatgtcggatgttgatattccctcgggattgtacaccgaacaggaagtgcccagtgaggttacgccgctgtgcttcgctatgcaggcaaccaagacactgctgttaagaacctgctgtcttcaagaattcaatataatggaaaagaataaggggtgggctctcttaggcggaaaggacggccacctgcaggggctctttctccttgcaaatgctctgctcgagaggaaccagctgcttgctcagaaagtgatgtacctgctggttcctctgttaaatcggggaaatgataagcataagcttacgtctgctgggttcttcgtggaactcttaagatctccagtagccaaaagactgccgtccatttactcagtggctcgatttaaagattggctccaggatggcaatcacctctttagaattcttggactgcgtggcttgtataacctggtgggccaccaagaaatgcgtgaggacatcaagtctttattaccatacattgtcgattctcttcgagagaccgacgagaaaatagttctttcagctatccagatcctcctgcaactcgtgagaaccatggatttcactacacttgctgcaatgatgcgcaccctgtttagcttattcggagacgtcagatcagacgtgcacaggttttccgtcaccctgtttggcgctgccatcaagtccgtcaagaaccccgataagaagagtatcgagaatcaggttttggatagtttggtccctctgctgctgtattctcaagatgagaacgacgccgtggcagaagagtcccggcaagtcctcaccatttgcgctcagttcctgaaatggaagctgcctcaagaggtctactccaaagacccatggcacatcaagcccacagaagccggtacaatatgtcgattcttcgagaaaaagtgtaaggggaaaatcaacattctggagcagacattgatgtacagcaagaatcctaaactgccgattcgtcgtagcgcggtgctgtttgtcggtctgcttagtaaatatatggaccataatgaactgcggagaatgggcacggactggattgaagacgatctgcgcgatttgctgtgtgatcctgagccttcactttgtatcatcgcctctcaaacactgctgcttgtgcagatggctagagctgagccgaagcctaagcagcgcgtgaactggctgcagaagctgatgggtcgcagcagcgcatag

SEQ ID NO: 54209 - DNA, 1803 bp, Artificial Sequence
  Description of Artificial Sequence: Synthetic coding sequence
taacacccatcgccacggcatcagccacggcaggttgccggaactccaactagttctcagccgtcttttgggccaagtattcgggagagaccaagtcagtccctctgcccatgcccttgtcccgcaggcgagggagatccagcttggccagctttagagagacgactggtgacctctcgaggccgacagccttcgccccagtcacatgcccagctactgacgaggcggagacactcaagtgagcaagtgccacccgagagcgaaccgagggctgactttcggtctggcaagtggctgcaggaaccggctactggagacgctcgcgattctcgccaagccctgcgggcaagaatgtcatccaagcacagaatctgctctcaggaagaagtggttattccctgcgcgtatgacagcgactcagaatccgtagatctcgaactttcaaatctcgagattataaaaaaaggatctagcagcatagaattgacagacttggatattcccgatattcccggactacactgcgaacccctaagtcattcccccagacaccttacacagcaggaccccctgtctgaggccatcgtggaaaaactaatacagagtatccaaaaggtcttcaatggcgaattgaaaggagagctcgagaagctgaaatttctcggggacctatcaagtctcagccaagcactcccatatgatgagactgctaaatccttcatccatagccatattgctgacatagtgcacaccttgaacgttctcgttcaggaagaacgcccacactccctgtcttccagcatgagacaggaggtgttcgtcactattgctgacctgagctaccaggatgtccacctactgttagggtccgaggacagagctgaactcttttctctgacgatcaaatccatcataaccctgccttccgtgagaaccttgacacagattcaggaaattatgcctaacggaacctgcaataccgaatgcttgtacaggcagacctttcaagccttcagcgagatgcttcaatcccttgtggtcaaagacccccatctagagaacttggacactatcattaaattgcctcttcggttccagcggctagggcacctggtcgcattaatggcgttgctttgtggcgacccacaagaaaaggtggccgaggaagccgctgagggcatccactctctgctgcatatcactcttcgcttaaaatacatcactcacgataagaaagatcagcagaacttgaaacgagctctgactaaatgccgcgaattccttgagctacattcttccgctgccaaatgcttttataactgcccatttcggatagcccaggtattcgaagggttcctggacagcaatgagctttgccagttcatcatgaccactttcgataccctgaagaccctgaagcatccgtgcatccagcggtccgcaggagaactcctgctaacgttggcaaagaacacagagtcccagttcgaaaaggtgcctgaaatcatgggtgtgatctgcgcacaactttctatcatctcccagccccgtgtacgacaacagatcattaacacggtgtctcttttcatctccaggccgaaatacaccgatatagttctctcattcctgttatgtcatcccgtgccctacaaccggcatcttgccgaagtctggaggatgctgtcggtggagttaccctcaaccacctggatcctgtggcggctgctgcgcaaactgcagaagtgccataatgaacccgctcaagaaaagatggcgtatgtggctgtagctgtgagcccctag

SEQ ID NO: 54210 - DNA, 75 bp, Artificial Sequence
  Description of Artificial Sequence: Synthetic coding sequence
atgaggcaggaagtgtttgtcactatcgcggacctgtcatatcaagacgtgcatctgctcctgggcagcgagtag

SEQ ID NO: 54211 - DNA, 105 bp, Artificial Sequence
  Description of Artificial Sequence: Synthetic coding sequence
atgcgccaggaggtttttgtcactatcgccgacctttcataccaagatgtgcacctactgttaggttccgaagatcgggctgaattgttctcactgaccatctag

SEQ ID NO: 54212 - DNA, 2799 bp, Artificial Sequence
  Description of Artificial Sequence: Synthetic coding sequence
gccggatccagggctgccacctccacttccaggggtgcactgtctcaaagccacgcacagctgcttactcgtcgcaggcacagcagcgaacaggttcccccagagtccgaaccacgcgctgattttcgttctgggaagtggttgcaagaacctgccaccggcgacgccagagatagcaggcaggccctcagagccagaatgtcatctaagcacaggatttgctcccaggaggaagtagtgattccgtgcgcgtacgacagtgacagtgagagcgtggatctggaattgtccaacctggagattattaagaaaggtagtagctctattgaactgacggacttagacatccccgacatccctggcctccattgcgagcccctgagtcactcaccaaggcacctcacccagcaggaccctttgtctgaagcgattgtggaaaagttgatacaatccatccaaaaagtctttaatggcgagctgaagggggagcttgagaagctaaagttcctgggggatctaagcagcctctctcaggccctgccatacgacgaaacagccaagtcttttatccactcgcacatcgccgacatcgttcacactcttaacgtgctcgtgcaggaggagagacctcatagtctgtcatcgagcatgagacaggaggtgttcgtgactatagccgacctatcataccaggacgtgcaccttcttttgggttcagaagaccgcgctgaactgttctctctaaccattaagtcaataattacactcccctctgtgcgcacgttgacccagatccaagaaattatgcccaacggaacatgcaatactgagtgcctgtatcgccaaacgttccaggcattcagcgaaatgttacaatccctggtggttaaagatcctcaccttgagaacctcgacaccattattaagcacttagtcccgtggttgcagtccgtaaaagaccacgaaagagaaagagctaccgccagcatggcccaagttcttaagtgcctgagtaaacaccttaatctcaagctgccacttagattccagaggcttggccatctggtggctctgatggccctgttatgcggcgacccacaggagaaggtagctgaagaagccgctgagggcatacatagtctgttgcatataacactcagactcaagtacataacacacgacaagaaagatcagcagaatttgaaaagagccctcactaagtgccgggagttccttgaactacattctagcgcggcaaagtgtttttacaattgtcccttccgtatcgcacaggtgttcgaaggattcctggacagtaacgagttgtgtcagtttattatgacgactttcgataccttgaagacactgaagcatccatgtatccaaaggtcagctggggaacttttactgaccctggccaagaatacagaatcacaattcgagaaggtaccagagatcatgggtgtgatctgcgcccagctctccatcattagccagccccgagtgcgccagcagattataaacacagtgtctctttttattagccgacccaagtataccgatatcgtgttgagctttctgctctgtcacccagtcccctataatagacatttggctgaagtgtggagaatgttgtccgtggaattaccgtcaactacatggatactgtggagactcctcagaaagcttcagaagtgtcataatgagcctgcccaggaaaaaatggcctatgtggccgtggctgctaccgacgccctttacgaggtctttctggggaatcgcctcagggctgcaacttttcgtctgttcccccagctgctgatgaccctgttgatccagattcaccatagtattggcctcacaatgtctgatgtcgatatccccagcggattatatactgagcaggaggtcccctctgaggtgacacccctgtgctttgctatgcaggccacaaagacactgctcctgcgaacatgctgtctgcaggagtttaatattatggaaaagaacaaagggtgggccttactgggcggaaaggatgggcaccttcaagggttgttcctgcttgccaatgcactacttgaacgaaatcagctgctggcccaaaaggtcatgtacctgctagtgcccctcttaaatcggggaaatgataagcacaagctgacctcggcgggttttttcgtcgaactgctgaggtcaccggtagctaaaaggctgccaagcatttacagcgtagccaggtttaaagattggctgcaagatggcaatcacctgtttcggatactgggccttagaggtctgtataacctggttggccaccaggagatgagggaggatataaaaagtctgttgccatacatcgtcgactcactgcgggaaaccgatgagaagatcgtgttatcagctattcagattctgctccagttggtcagaaccatggattttacgacactggctgccatgatgcgcacactcttttcactgtttggggacgtgaggtctgatgttcacagattcagcgtcacactttttggggctgcaataaaatctgtgaagaaccccgacaagaagagtatcgaaaaccaggtgttagattcattagtccctttactactatactcacaagacgagaatgacgccgtggcggaagagtctcggcaagtgctcacgatttgcgcacagttcttaaagtggaagctgccccaggaagtttacagtaaagacccgtggcacattaaaccaacagaggccggtacaatctgtaggttctttggtaagaaagtgcaaggggagaactag

SEQ ID NO: 54213 - DNA, 462 bp, Artificial Sequence
  Description of Artificial Sequence: Synthetic coding sequence
atgggaaattactccagccataagaggaccaaggcgccaaaacaggccagaaaagagcgtcctgcagatatggataaagcctggtggaagagcttcctgaatcatcttacccggaaaaagccagccacccgcatagtcctcattttacctctagacaagagacaaccgcttgccaatgccggtcaaagaattgactacgctagtggagcaggcctgggctccccagctgcacccagactgcggggagccggagaaggctcagagcgggaaccaagaatgcccgtgctcctgttactgcgacgtcaggaggcccgaagacctgaggagggcggagccagagccgctctgagctggcccagactcctgagtcgtttcaggagccctggtaaagcccctagggaggcaggaccggctgaggaacagccacgcaagagatgtcgctgtccaaggccacaattgtag

SEQ ID NO: 54214 - DNA, 1995 bp, Artificial Sequence
  Description of Artificial Sequence: Synthetic coding sequence
atggaaagctttatggagagcctcaatagactgaaggaaatacacgagaaagaagtactgggcctccagaataagttgctcgaattgaactctgaaagatgccgggacgctcagcgaatcgaggaactgttttccaaaaaccaccagcttagagaacaacagaaaactctgaaggaaaacttgcgcgttctggagaataggttgcgggctggtctttgcgatcgatgcatggtgacacaggagctcgcccgaaagaggcagcaggagttcgagagtagtcacttacagaacctgcagcgaatcttcattctgaccaacgaaatgaacggactgaaggaggagaacgagactcttaaggaagaagtgaagcggctgcggggactcggcgatcggccaaaacctagggccaaggaggggacgagcgatccgccttctcccttattattgccatctcccggtggctggaaagctatcacagagaaaccccctggaggtcatgaggaagccgaggaggaccaccagggcgtcggtctccgcggtgaggagaaacctgcagggcatcgtacttccccggtcgctaaaataagccctggcgctaccttacccgagtctcgtgcgcctgacatgagtcctcaacggatcagcaatcagctgcacggtaccatagctgtggtcaggcctggctctcaggcctgtcccgctgacaggggacctgcaaacgggacaccccctccactgccagccaggtccagtccaccctcacctgcatatgagagaggactatcattggactcattcctgagggcttctcgaccgagcgcgatgacgcatgaggctccaaaactctcaccaaaagtagaccgcctgtgccttttgaaccgccctctgtctctacacctccagagcccacatagcagtccactggcccctgccgcagccccaagcgacccgagattgcaggatctgaaggcgagggaagccgaggcctgggaagaaccgaccgaacttctcggactcccgtcagcattggctgggatgcaggacctgagactggagggggctctgcacctgctgctggctcagcagcagctccgtgcacgtgccagagctggatcagttcgtccaaggggacagccaacgccaggcgagatgttaccaagcctcccagtgggatctgactcagaaggtcctgaaaatgaggggacccgcgcagccctcgccgcagctggattaagtggcggtagacacacccagcccgcaggtcccggtcgggcacagcgtaccgaagccgcagccacccaggattgcgcactcgacaagccgctggatttgtctgaatggggcagagctcgcggtcaggacacccccaagccggcaggacagcacggctcactgtcaccggcagccgcacacactgcctctcccgagccgccaacccagtccggcccacttactaggtcaccgcaagccctgtctaacgggaccaagggcaccagggtacccgaacaggaggaggcttccacaccaatggacccaagccggccactgcccggatcacagctgagcctgagttccccagggtcgactgaggatgaagacaccggccgtcccctgccaccgcctcatccccagccgcctcctcacccccagccccctgacctcgatgggcaccctgaacctagcaaagccgaggtacttaggcctgaatctgacgagctggacgaaaccgacacaccgggatctgaagtggggttatcttctcaggccgaggcaactacttctaccactggagaagggcctgaatgtatttgcacacaagaacatggtcaggggccacctaggaagaggaagagagcttcagagccaggcgataaggctagtaaaaaaccgagccggggacggcgaaaattgacagcaaccgaaggacccggttcgcctcgtgatgccgaggaccactccccgagtcccaactctagtccttgggaagaaacatag

SEQ ID NO: 54215 - DNA, 1719 bp, Artificial Sequence
  Description of Artificial Sequence: Synthetic coding sequence
atgcggagacacatggtgacctatgcatggcagctgctaaagaaagagctgggcctgtaccagcttgccatggatattataatcatgatccgggtctgcaagatgttcaggcaaggcctacgaggctttagggaataccagatcatcgagacggcccactggaaacatccgatctttagcttctgggataaaaagatgcagagtagggtaactttcgataccatggactttatagccgaagagggacattttcctccaaaagcgatacagatcatgcagaagaagccttcttggcgaacagaggacgagatccaagctgtatgcaacattctacaggtcctggattcctatcgaaattatgccgaacccctacaattgctactcgctaaggtgatgaggtttgagagattcggacgaaggagggttatcataaagaagggccagaagggcaattctttctactttatttacttgggaactgtggcaatcactaaggatgaagatggctcatcggcttttctcgacccacaccctaaactcctacacaagggttcatgctttggcgaaatggatgtcctgcacgctagtgtgaggcggtccactatagtctgcatggaggagaccgagtttctcgtcgttgaccgggaagactttttcgccaacaagctagatcaggaggtgcagaaagatgcacagtaccgttttgagttctttcgcaagatggagctttttgcttcttggagtgacgaaaagctttggcagttggtggccatggcaaagattgaaaggttctcttacggccaattgatctctaaggactttggcgagtcgccctttatcatgttcatcagcaagggttcatgcgaagtcctgcggctgctggatctgggggcttctccaagctaccggcgatggatctggcagcacctcgagctcatagatgggagacctcttaagacccacctgtcagagtactctcccatggaacgatttaaagagttccagattaagtcgtatcccctacaggatttctcgtctttgaaactcccacacctgaaaaaggcctggggactgcagggcacttcctttagccgtaagattcggacatcaggggataccctgcccaaaatgttgggccctaagatccagtctcgtcctgcccagtccatcaagtgtgctatgatcaacataaaaccaggagagctgccaaaagaggccgcagtgggagcatatgtcaaagtccatacagtggagcagggagagatcctggcattcctccccgagggcgaatgtgacaccaggcctcttattctgatgagcctaggtaacgagctgatacgcataaggaaggagatcttctatgagctgatcgataacgacgacgaaatgatcaaaaagctgctgaagttaaacatcgcttttccctcggacgaagacatgtgtcagaaatttctccagcagaacagttggaacatcttccggaaagacttactccagctgttggtagagccatgtcaatcccagctgtttacccccaatagacccaaaaaaagagagatctacaacccaaagtctgtcgtgttggatttgtgctccatcaacaagacgacgaagccaaggtatccgattttcatggctccacagaaatacctgccgccattgcggatcgttcaagcaattaaagctcccaggtacaaaatcagagagcttctcgcatag

SEQ ID NO: 54216 - DNA, 1731 bp, Artificial Sequence
  Description of Artificial Sequence: Synthetic coding sequence
atgcggaggcacatggttacctacgcctggcagcttctgaagaaagagctaggactctatcagctggccatggacattatcattatgataagagtgtgcaaaatgttccgccagggactgcgcggattccgtgaatatcaaatcatcgagactgcacactggaagcacccaatcttcagcttctgggacaaaaaaatgcagtctcgcgtgacctttgacacgatggactttattgcagaggaggggcatttccctcctaaggcaattcagataatgcagaagaagccatcgtggagaacagaagacgagatccaggctgtgtgcaacattcttcaagtgcttgacagttaccgaaactacgcggagccattacagctcctgctagccaaagtcatgcgctttgaacggttcggcaggcggagggttatcattaaaaagggacagaagggaaactctttctatttcatctatctgggcaccgtggccatcactaaggatgaagacgggtcttccgcatttctggacccccacccaaagctgctgcacaagggaagctgctttggcgaaatggacgttcttcacgcctctgttcgacggagcaccatcgtgtgcatggaggagacagaattccttgtggtcgatagggaagatttcttcgctaataaacttgaccaggaggttcagaaagatgctcagtatcggtttgaattttttcggaagatggagttattcgcctcgtggtccgacgagaagttgtggcagctggttgctatggcaaaaatagagcgtttcagttacggccagctgatcagtaaggatttcggcgaaagccccttcatcatgtttattagtaaaggatcttgtgaggtactcagattgcttgacctcggcgcatctccgtcctaccgtaggtggatatggcaacatctggagttgattgatgggaggcccctgaagacccacctctctgagtatagccctatggaaagatttaaagagtttcagatcaagagctacccccttcaggacttctcttccctaaaactaccacatctgaagaaagcgtggggactacaggggaccagtttttccaggaaaattcgtaccagtggagacactttacctaaaatgcttgggcctaagatccaatcacgccctgctcagagcatcaagtgcgccatgataaatataaagcctggggaactgcctaaggaagctgcggttggcgcatatgttaaggtgcacacagtggagcagggcgagatcctgggcttacatcaggccttcctgcccgagggggaatgcgacacccgaccactgatcttgatgagtctgggaaatgaactgatacggatccgcaaagagattttctatgagttgatcgacaacgacgatgagatgatcaagaagcttctcaaactgaatattgcgtttccctccgacgaagatatgtgccaaaagttcctacaacagaattcatggaacattttcaggaaagatctcctgcagctgctggtcgagccttgccagagccagctattcacaccaaaccgccctaagaaaagggagatctacaacccgaagtccgtggtgctcgatctgtgttcgattaataagactaccaagcctagatacccgatttttatggcgccacagaagtatcttccacccctgcgtattgtccaggccattaaggccccacggtacaagatccgggagctacttgcttag

SEQ ID NO: 54217 - DNA, 1272 bp, Artificial Sequence
  Description of Artificial Sequence: Synthetic coding sequence
atgcgccgacatatggttacttacgcgtggcagcttcttaaaaaagaattaggtctgtatcagttggccatggacataatcattatgatcagggtatgcaaaatgttccgacagggactgcgcggatttcgcgaataccaaattatcgaaacagcacactggaagcaccccatcttctcattctgggacaagaagatgcagagtcgggtgacattcgataccatggacttcatcgccgaagagggtcactttcctccaaaagccattcagatcatgcagaaaaaacctagttggcgtaccgaggatgaaatccaggcagtttgcaacattctgcaagtgctagactcttataggaactacgcagagccactgcaactattgttggccaaggtgatgcggttcgagcgttttggtagacggagagtcatcattaagaagggtcaaaaagggaattctttctactttatttatttgggcacagttgccattacaaaagacgaagacggtagctcagcatttctcgacccacatcctaagctgcttcataagggaagctgctttggggagatggacgttctgcatgcctccgtgaggcgaagcacaatcgtgtgcatggaagagacagagttcctggtggttgatcgggaagatttcttcgcaaataagctcgatcaggaagtgcagaaggacgcccagtatcgttttgagttctttcgcaaaatggagttgtttgcatcatggagcgatgagaaactgtggcaattggtggccatggccaagatcgaaaggttctcttacggccagctgatctctaaggacttcggcgagagtccatttatcatgtttattagtaaaggatcatgtgaagtgcttaggttgctggacctgggcgcatctccatcctaccgccgttggatctggcaacatcttgaattaatcgacgggaggccattgaaaacacacctgagcgagtatagtcctatggagagatttaaagaatttcagattaagtcctatccacttcaggatttctcgagcctgaagctgccacacctgaagaaggcctggggactccagggcacttctttctcccgcaagattaggacctccggtgataccctgccaaagatgctgggaccaaagatccagtcgcgaccagcccagagtatcaagtgcgccatgattaatataaagcccggagaactacccaaagaggccgcagtcggggcttacgtcaaagttcatacagtggaacagggagagatcttatag

SEQ ID NO: 54218 - DNA, 1302 bp, Artificial Sequence
  Description of Artificial Sequence: Synthetic coding sequence
atggagtacgaggttaaaaaaggcaagaaaggcttcgtgtctccgatcaggaggctggtctttccaaaggccggaagaagggccgcatgtaggagttccgtgtccaggagacccctccactcaatgcccctataccctcctgactacttaatcgatccacaaatcctcctgtgcgactatctggagaaagaagtgaagtttctcggacatctgacatgggtaactagctcccttaacccgtcttctagagacgaactgctgcagttactggatactgcaaggcagttgaaagaactaccactgaagaccacggccgagcaggattctattctcagtctctcagctcgctgtttgctcttgacgtggcgtgataatgaggagctcatactgcggattccgactcatgaaatcgcggcagcttcatatcttcaggatgatgctctgcatctgcttgtgctgaagaccggactgggagtggacccggtgcccgctggcgtggatgcaagtccgggtggcgctggacgcgatcctggtcctcccggtggagcacctgagaaaagacgagtaggaaccgccgaacgtagacacaccatctgcagtttggattggcgcatgggttggggcggaggtgccgctgaggcccgagccggagggggaggcggtggtagcctagaacggcagagggctggtgcccgtgcttcagggtcttgggagcgccgacaaacttttagcggaagttgggagagacgacacggaggcggaggcggagggggtggcgctggcaaaccaggcggtagttgggaacgcagacaggctggaagcgggggtgggggttcttgggagcggagacaccctgggccaaatcctctcgatcctcaggatccaagtcccgacgcatactgtaatctggtcattttagccgtagcaaatcgtgacgccgcagaggagagctgcgcgctcatctgtcaagtctttcagatcatttatggcgaccagtcgatagagtgcgtagatcgggctggatatcactatacctccactcccgaacggccttggttgtgctctagaatcatggctcctaggaccccacttaaacatgtgaccgccgcacgccctcacttgctgtctatggcgccaacagctgcagccgctactaccgcagtgtgggcctggagcagttataggattacctggtctcgatgtggtgtcagctggggcccttcccgaagtagttccttgagatgctgttgcggcagtaccggatggggttgtccctcacgtactattgctcaggcatgttag

SEQ ID NO: 54219 - DNA, 1716 bp, Artificial Sequence
  Description of Artificial Sequence: Synthetic coding sequence
atggagtatgaggttaagaaaggaaagaagggatttgtctctccaattcgcagactggtgttccctaaggctggcaggcgggcagcctgtcgctcctctgtatcacggaggcccctccactccatgcccctgtacccacccgactaccttatcgatccacagatcctgctgtgtgattacctggaaaaggaagtgaagtttctcgggcatctcacttgggttacgtccagtctcaacccatccagccgcgatgaactgctgcaactcctggataccgccaggcagttaaaggaactccctttgaagacgacggcagagcaagactcaattctgagcctctcagctcgatgcctgcttctaacctggcgggacaacgaggagctgatccttagaattcctacgcacgagattgccgcagctagctatctccaagacgacgccctgcacctgctagtcctgaaaaccggcctcggagtggatcctgtacccgctggtgtcgacgcaagcccaggcggtgccggacgggatcctggacctccgggaggagcacctgaaaaaagacgtgtaggcacagcagagcgtaggcacaccatttgctccctcgattggagaatgggctggggcggtggtgctgccgaagctcgcgctggcggaggagggggaggcagtttggagagacagcgggcaggcgctagagcctccggaagctgggagcgaaggcaaacattctccggtagttgggagagacgccacggtgggggagggggtggagggggagcagggaagcccggtgggtcctgggagagacgtcaggccggttctgggggaggaggcagttgggagcggagacatccaggacccaatcctctcgacccacaggacccctctcccgacgcatattgcaatctcgttatcttggctgttgccaatcgggacgccgctgaagagtcttgtgcactcatttgccaggtgttccaaataatctacggagaccagtcgattgagtgtgtcgatcgggctggctatcactacaccagcacccccgagcgcccttggttatgcagccggtctgaatcctgccacaccgacggcacgtacgcctatgatgctgatttcagctgctgttccagttttaacggctctcaggacacattcgaggcttgctactctgggactagcaccccttcattccatggcagtcactgcagcggcagtgatcacagcagcctggggctggaacagttacaggattatatggtcactctacgctcgaaactcggaccccttgaaatccagcaattcgcaatgctgctgagagaataccgtctggggttgccaatacaggactactgcacagggctgctgaagctgtacggtgaccgccgtaaattccttctgctgggaatgcgacccttcataccagaccaggacatcggttatttcgaaggatttttggaaggggtcggtatacgcgagggaggtattttgaccgactcatttggcaggatcaaaaggtccatgtctagcaccagtgcttcagctgtgcgctcttacgacggcgctgcccagcgtcctgaggcacaggccttccatagactgctagcagacatcacacacgacattgaagccctcgccccagatgacgatgacgatgacgaagacgaaccccgagggtcccgaggaggatcagatgcagccgaagacaattacttatag

SEQ ID NO: 54220 - DNA, 708 bp, Artificial Sequence
  Description of Artificial Sequence: Synthetic coding sequence
atggagtacgaggtaaagaaaggaaaaaaagggtttgtttcccctatccggcgtctggtatttcccaaagccggacgccgagcagcttgtagaagctctgttagccgcaggcctctccacagtatgcccctttatcccccagactatctcattgatccacaaattcttctctgcgactacctcgaaaaggaagtgaaattcctcggccacctgacctgggttacttccagtctaaatccttcaagccgagacgagctccttcagctgttggacactgcgagacagctgaaggaactgcccctgaaaacgaccgccgaacaggattccatactgagccttagtgcacgctgcctgctgctgacctggcgcgacaacgaagagctgatcctccgcatcccaactcacgagatagcagctgccagctatttacaagatgatgcgttgcatcttctcgtcctcaagacaggactcggtgtggatcccgtccctgcaggtgtcgatgcaagcccagggggagccggaagggatcccggacctccaggtggggcaccagagaaacgtcgggtgggcactgcagaacgaaggcataccatctgcagtctggattggcgcatgggttggggcggaggagctgctgaagccccaacaaggtcaactcggcgtactcccgctccaacgccgacggccacctggtcatcctggctgtag

SEQ ID NO: 54221 - DNA, 975 bp, Artificial Sequence
  Description of Artificial Sequence: Synthetic coding sequence
gagcgcaggcacgggggtgggggtggtggaggcggagctggcaaaccagggggttcatgggaaaggagacaggccggatcaggcggaggcggttcttgggaaagacggcaccccggaccgaacccccttgacccacaggaccccagccccgacgcctactgcaatctagtgatactggctgtcgctaatagagatgccgctgaggaatcatgcgccttgatctgccaggtgtttcagataatatatggggatcagagcatcgaatgtgtggatagagcgggatatcactatacaagtaccccagaacggccttggctgtgtagtcgaagcgaatcttgccacacagacgggacctatgcctatgatgccgatttctcctgctgctcctcatttaacgggtcccaggataccttcgaggcctgctatagcggcacatccacaccttcctttcacggaagtcactgctccggttcggatcatagttcattgggtctggagcagctccaggactacatggttactctccgcagcaaactaggcccactagagatacagcaattcgctatgctgctgcgcgaataccggcttggattgcctattcaggattactgcacaggcttgctgaaactatacggagaccgccgtaagttcctattgttaggtatgcgtccttttatacccgatcaagacatcggatactttgagggctttcttgagggggttgggattagggaaggaggtattttgaccgattcttttggcagaataaagcggtctatgtcatctacgtctgcctccgcggttcggtcctatgatggggcagctcaacgtcccgaagctcaggctttccaccggttgctcgcagacattactcacgatatcgaggcattggcgcctgacgatgacgatgatgatgaggatgagcccaggggatcgaggggaggcagcgatgccgctgaggataactacctctag

SEQ ID NO: 54222 - DNA, 300 bp, Artificial Sequence
  Description of Artificial Sequence: Synthetic coding sequence
atggatactggcagcagggaggccgctttcactagggatctccctcgaaagcctgctgatgcacaagtgtccccagaaatgtccataactcacaaagaaaaagaaaatgcccacctgaaggaaattcttctgtttgttaatgctgaagcatttagccagccccagccacatagcgccccagtctgtgagggccagcagcttacaggaaagttctcgacaagtgtgctgactagagcaggaggagatgccagcccttgtagttgggaaaggctgctttgttatggatggtcacactgctag

SEQ ID NO: 54223 - DNA, 300 bp, Artificial Sequence
  Description of Artificial Sequence: Synthetic coding sequence
atggacaccggctcacgggaggccgcattcacacgcgatttgccacggaagcccgctgacgcacaggtgagtccggagatgagtattacacataaggaaaaggagaacgctcacctgaaagaaatcctgcttttcgttaatgctgaagcgttcagtcagccccagccacactcagctcctgtctgcgaaggtcagcagctcaccggtaagttcagtacatccgtgctcacacgggcagggggagacgcctcgccatgttcctgggaaagacttctttgctatggatggagtcactgctag

SEQ ID NO: 54224 - DNA, 354 bp, Artificial Sequence
  Description of Artificial Sequence: Synthetic coding sequence
atgccctcctgcagctgcgcactcatggcgccatgtggccctgccgctgggcctgccgctgtggagcgaactcagcaggttgcgaggggggagcccggatcagcgagaggccagctccaggtttcccccgaaatgagcatcacccataaagaaaaggaaaatgctcacctgaaggagatcctgctgttcgtgaacgcggaggcctttagccagccccagccgcattccgcacccgtctgcgagggacagcaattgacaggtaaattttccacaagcgttctgactcgcgctggaggcgacgcatccccatgttcctgggaacggttgctgtgttacggttggagtcactgttag

SEQ ID NO: 54225 - DNA, 450 bp, Artificial Sequence
  Description of Artificial Sequence: Synthetic coding sequence
atgctgtccgggccacacccaagccccactttcagaccaaatccttgtccctggccttgtctccattccctgtggatggagataagccctactcagctgtgcttcctctctcccggaccatcgcctcaaagcccgagctgctgttttcagggcatgaactctgggagcgaactggggaagctttggcgcaagttgtttaaagggatcccaagactctctgtgtctcatttcgatttttactgtggcacttgtgttctgttggggagacctcagattccccagggcagcagtcttggaaatgacatagatcagtaccctgtcgtctttagaaacgcgagcgatcaagggtcttggatgcagcttgagatgcttcttaggaaactgagcgacctagtgtggacttctgatgcactctcggataagatcctggaagatggacttgttccctag

SEQ ID NO: 54226 - DNA, 609 bp, Artificial Sequence
  Description of Artificial Sequence: Synthetic coding sequence
atgaaacggtggcagattttcgttctgtgggtgttttgggttctgatactttggctaatgaccccatacttggacctgacacctgaatccgctccgcaggagaaaaggatgtacctcgtccctcagcactgtgattgcccatggttttcctctggcaagtgtgggtgtccaagcgagactctcaattgctcttcctgccatcacactgcagacgagtggaattggctggacgcatgtagccgcaaaacaatgggatacctgatgaggacccgagagagtatgacctcagacaccgtgctctggtggttgggcatgaactccggaagcgagttgggtaagttgtggcgaaagctgtttaaggggattcctcggttatccgttagtcactttgatttttactgcggaacttgcgtgcttctcggtcggccacagattccacagggtagtagcctgggaaacgatatcgatcagtatcccgtcgtatttagaaatgcttctgatcagggctcatggatgcaacttgagatgctgcttcggaaactctctgatctggtgtggacatccgacgctctaagcgataaaatactggaggacggactcgtaccctag

SEQ ID NO: 54227 - DNA, 1152 bp, Artificial Sequence
  Description of Artificial Sequence: Synthetic coding sequence
atgaatgctggcccaagttggaataaagtccaacacagcaaaaatagttcagggaaacggcagagcaagtcacaggtgccccatgcctcctcacagcccaggtccagtctcaccgccgttacccagcccactgaggaaaaattaaaagaaagcatatctccagaggctcgcaggaagcgcaatccgctcgggagcagatgtcagggggcaagcggcaataaactcttcttagactttcaaagcatgaaaatcatcaaggagaatgccgacgaagactccgctagtgacctcagcgactctgagcgaatacctatcccaccttcccctttgacacctcccgatcttaatctgcgagctgaggaaattgatcctgtgtactttgatcttcaccccggacagggtcacacaaaacccgagtactattatccaaactttctaccaagtccattttccagctgggatctgagggacatggctctcctgctcaacgccgaaaataagactgaggcggttccacgcgtaggagggctgctgggcaagtatatcgacagactgatccagcttgaatggttacaggtgcagacagttcaatgtgagaaagctaaagggggaaaagccagacccccaaccgctccgggaacgtcaggggcactgaagagccctggtaggtccaaactcattgcttccgccctgagtaaacccctgccccaccaagagggtgccagcaagtcaggcccttctcgcaaaaaggccttccaccacgaagagattcaccccagccattacgcttttgagacttctccccgaccgatcgacgtcttgggcggtacaagattctgtagccagcgccagacactggaaatgcgaactgaggaaaaaaaaaagaagagttcgaaaagtaccaagttacagagatgggatttgtctggatctggaagttcgtcaaaggtggagacatccggccatatccgtgtgccaaagcaggctgcagttattcttgatagcgctgattcttgcaaggcatcaaaaactcaggctcacgctcaccctcgaaaaaaaggaaaagccgaatcttgtggacatgctacggtgtccagcgagaagaaactgaagaccaacggagttaaacagaatacgtataagctcaagtag

SEQ ID NO: 54228 - DNA, 1152 bp, Artificial Sequence
  Description of Artificial Sequence: Synthetic coding sequence
atgaacgcaggtccaagctggaataaggtgcagcacagcaagaactcgagtggaaagaggcagtccaaatctcaggtgcctcatgccagcagccaacctcggagttccctcacagcagtaactcagcctacagaagaaaagctcaaggagtccatatcgcctgaagcgcgacgcaaacgcaatccgctaggcagcaggtgccagggagcttcgggtaacaagctcttccttgacttccaatcaatgaagataatcaaggagaatgccgacgaggattcagcctctgacctctccgactcagaacgcatacctattcctccttctccactgactccaccggatctgaatctgcgggcagaggaaatcgatcctgtgtacttcgacctccatcccggacagggtcataccaaacctgaatattattatcccaactttctgccatcccccttttctagctgggacctccgcgacatggcgctgttgctcaacgcagagaataaaactgaggctgttcctcgggtggggggattgttgggtaagtatattgatcgcctaatccagcttgaatggctgcaggttcagactgtccagtgcgagaaagcaaagggcggaaaggcgcgacctccgaccgcccctggtaccagtggtgcactcaaaagccccggtcgttcaaagctaatcgcctccgccctttccaaaccgctaccacaccaggagggcgcttccaagagcggaccttcacgcaaaaaggcttttcatcacgaagagattcacccatctcattacgcattcgaaacaagtccgagacccattgacgtgctcggcggtactagattttgttcacagaggcagacccttgaaatgcgtacggaggaaaagaagaagaagtcttccaaaagtacaaagctccagagatgggatttaagtggaagcggctccagctcaaaggtggagacctctggacatatcagagttcctaaacaggctgctgtcattctcgactccgccgattcctgtaaagcttctaaaactcaagcacatgctcaccccagaaagaaagggaaggccgagagctgtggacacgctacagtgagttcagagaagaaactcaagactaacggcgtgaagcagaatacctacaagctaaagtag

SEQ ID NO: 54229 - DNA, 147 bp, Artificial Sequence
  Description of Artificial Sequence: Synthetic coding sequence
atgaacgcagggccatcttggaacaaagttcagcactccaagaactcatccggaaaaagacagtccaagtctcaggtgcctcatgcctccagtcagcctagatctagccttactgcggtgacacaacccacggaagaaaagttatag

SEQ ID NO: 54230 - DNA, 153 bp, Artificial Sequence
  Description of Artificial Sequence: Synthetic coding sequence
atggacatattattagacctgggttggcatttttccaattgcgacgaggataccttttatagtccagttcagaatactgaaggagacctgctcttttttgatcacaacctgaaaacagaccgtggtcatgtggaacgcagcgtgatggactag

SEQ ID NO: 54231 - DNA, 126 bp, Artificial Sequence
  Description of Artificial Sequence: Synthetic coding sequence
gacttagggtggcatttctcaaattgcgacgaggacactttctattcccctgtgcagaacacagaaggcgacctgctgttttttgatcacaaccttaagactgatcgcggacacgtggaacggtag

SEQ ID NO: 54232 - DNA, 957 bp, Artificial Sequence
  Description of Artificial Sequence: Synthetic coding sequence
atgtcaactcacgtggccggtctcgggctggataaaatgaagctggggaatcctcagagctttctggatcaagaggaagctgatgaccagcagctgttggagcccgaggcctggaaaacctacacagaaagaaggaacgccctgcgagagtttctgacatccgacctcagcccccacctcctcaaaagacatcacgctcgcatgcaactcctgagaaaatgcagctactatatcgaagtgctgccaaaacacctcgccctgggtgaccagaatccccttgtgttgccttctgccttgttccagctcatcgacccctggaagttccaaaggatgaaaaaagtgggaaccgcccagaccaaaatccagcttctccttcttggcgatttattggagcagctggaccacgggcgagcagagctcgatgcgctgctgagaagtccagaccctcgcccttttctcgctgattgggctctagtagaacggcgactggctgacgtgagtgccgtaatggactctttcctgacaatgatggtgcctggcaggctgcacgtcaaacacagattagtgtccgatgtatccgccaccaaaatcccacacatatggcttatgctaagcacaaagatgccggtcgtctttgataggaaagctagtgccgctcaccaggattgggctagactgcgctggtttgttaccattcagcccgctacttctgagcagtatgaactccgcttccgtctcctcgaccccagaacccagcaggagtgcgctcaatgcggcgtgatccctgtcgctgcttgcacgttcgatgtgcggaatctgctcccaaataggagttataaatttacaatcaagcgagcagaaacatcaactttggtttatgagccttggagagactctcttacgcttcacactaaaccggagccactggagggtcccgcactgtctcactctgtgtag

SEQ ID NO: 54233 - DNA, 957 bp, Artificial Sequence
  Description of Artificial Sequence: Synthetic coding sequence
atgtctactcatgtagccggactcggcttagataaaatgaagctgggtaatccccaatctttcttggatcaggaagaagcggacgaccaacagcttctggagccagaggcctggaagacatataccgagcgcaggaatgcacttcgagaattcttgacatccgatctttcgccccaccttctgaagaggcaccacgcaagaatgcaacttctgcgcaaatgctcctactatatcgaggtgttgccaaagcatctggccctgggagaccaaaatcctctggtacttccttcggccttatttcagcttatcgacccctggaagtttcagagaatgaaaaaggtcgggacagcccaaacaaagatccagcttcttctcctgggagacttgctggaacagctggatcatggccgagctgaacttgacgctctgctgcgtagtccagatcctagacctttccttgcagattgggcgctggtggagcgacgcctggccgacgttagtgccgtgatggattcatttttaaccatgatggttcctggcagactgcatgtaaaacaccgattagtttcagatgtttcggccaccaagatcccccatatatggctgatgctctccacaaaaatgcccgtggtttttgatcggaaagcatctgccgctcaccaggactgggctaggctgcggtggtttgtcacaatccagcctgccactagcgagcagtacgagcttcgctttaggctccttgaccctagaacccaacaggagtgtgctcagtgtggcgtcatccctgtggctgcctgtacattcgacgtgcgcaatcttctccctaaccgctcctacaaattcaccatcaaacgtgcagaaacttctacattggtctacgagccatggagggattctttgacactccatacaaaaccggagcctctcgaagggcctgccttgagccactctgtgtag

SEQ ID NO: 54234 - DNA, 618 bp, Artificial Sequence
  Description of Artificial Sequence: Synthetic coding sequence
atggctgcacgggatgccacctccggttccctttcggaggaatcctccgccctggatctgcccagcgcttgcgacatccgggattatgtcctgcaaggaccatctcaggaggctaactcagaggctttttcatccctggaatttcattccttcccttactcaagcgatgtcgaccctgatactagtaatctcaatatcgaacaaaacaatagctggaccgcggagaacttttggttagaccctgcagttaaaggccaatcagagaaagaagaggacgacggactgagaaagtccctcgacagattttatgagatgttcgggcacccccagcctggcagcgcaaactcgctgtctgcaagcgtgtgtaaatgcctcagccagaagatcactcaactgaggggccaagagtcccaaaaatatgcactgcggtctttccagatggcccgagtcatattcaaccgtgatggctgttctgtcttacagagacacagccgggacacacatttctatcccctggaagagggtagtactagtctcgatgacgaaaagccaaaccccggattgagcaaggacattactcatttcttgctgcagcagaacgtcatgaaggacctgtag

SEQ ID NO: 54235 - DNA, 456 bp, Artificial Sequence
  Description of Artificial Sequence: Synthetic coding sequence
atggctgccagagacgctacatccggctcactgtcggaggaatcctcggccttggacctgccatctgcctgcgatattagagactacgttctccagggccctagccaggaagccaatagcgaggccttctcttccctagagttccattccttcccctactctagtgatgtggacccagacacctcgaatctgaatattgagcagaataattcatggactgctgaaaatttttggctggatcccgcagtaaagggacaaagcgagaaggaggaagacgacgggttgcgcaagagtttagacaggttttacgagatgttcggacaccctcagcctgggtctgccaacagtttgagcgctagcgtgtgcaaatgcctcagccaaaagataacccaacttcgaggccaagagtcacagaagtatgccctgaggcaacagaacgtgatgaaggacctgtag

SEQ ID NO: 54236 - DNA, 189 bp, Artificial Sequence
  Description of Artificial Sequence: Synthetic coding sequence
atggcagcaagggatgccacttctgggagtttaagtgaggagagcagtgccttggatttgccatctgcctgcgacattcgggactatgtcttgcagggtccttcgcaggaggctaacagtgaggcatttagttcactggagtttcacagctttccctattcttctgatgtggaccccgcagacctgtag

SEQ ID NO: 54237 - DNA, 603 bp, Artificial Sequence
  Description of Artificial Sequence: Synthetic coding sequence
atggaatcacatagctgctcgccaagctggagcactatgaccatcagcgcacactgcaaccttcgcctgccgagtgcaagtcagtccgtgggcatcacaggcgtttcacaccatatctggccacgaattttttatatgaccatggctgcaagggacgccacatccggctccctctctgaggaatcgtccgctctcgatctgccttctgcatgcgacatccgggattacgtgcttcaggggccatcgcaggaggccaacagcgaggccttcagttctctagagtttcatagcttcccgtatagctctgacgttgaccctgacacgtccaacctaaacatcgagcagaataatagctggaccgccgagaacttctggctcgaccccgctgtaaagggccagtctgaaaaggaggaggatgatggactgagaaaatctctcgatcgcttttatgaaatgttcggacacccccagcccggatccgcaaattctctcagtgccagtgtttgcaaatgcttgtcccaaaagatcactcagcttcggggtcaagagagccagaaatacgccttgaggtcctttcaaatggctcgtgtgatcttcaattag

SEQ ID NO: 54238 - DNA, 366 bp, Artificial Sequence
  Description of Artificial Sequence: Synthetic coding sequence
atggccgcaagggatgcgacttcaggtagcctaagcgaggagagtagcgcgttagacttgccctctgcctgtgacataagagactacgtactccagggcccttctcaggaggctaattcagaggcattctcatcacttgagttccactcatttccctatagctcagacgtggaccccgatacatctaatctcaacatcgaacagaacaatagttggacagctgagaacttctggctggaccctgctgtgaaaggacagtccgaaaaggaagaagacgacgggctacggaaaagcctggatagattctatgaaatgtttggccacccacagccaggctctgccaactcgctgagtgcaagcgtatag

SEQ ID NO: 54239 - DNA, 321 bp, Artificial Sequence
  Description of Artificial Sequence: Synthetic coding sequence
atggaagtatgtagctgttgcccaggctggtcggctaccgtaagcgctcactgcaacctgagattcgcatcctcaacctctcagtctgcgggtatcactgggatgtcccagtgcgcctggcctactttcaccttcttgacaatggccgctcgagacgcaacgtccggctctctgagtgaggagagcagcgccctggacctgccaagcgcctgtgacatccgggattacgtccttcaaggcccttctcaggaagccaacagtgaggcatttagctctctggaatttcactctttcccgtattcgagcgatgtagacccatag

SEQ ID NO: 54240 - DNA, 381 bp, Artificial Sequence
  Description of Artificial Sequence: Synthetic coding sequence
atggtggcgctgtttcagcactcaccctattggcaggccgatggttatgggcacagtcataggttaaagtgtcaacacttcaagcagcaccgacagtacaatgacaaattagagatatcatctaatctgggtccacagttcaatgccctcttgaatatcctcctgaatatcgtccaccccacgctgtcccatgacaccaggcgttctaagggccttaagatagaaggtctgctgcaaagtcgagagctaggaaacagttggactgttactatgtgtatctgggtgttgaaggccctgcagagcagcgctcctaataaacctctggactggctggatcccatgccatgttttcaaaaccttctcgccagaggcactccctag

SEQ ID NO: 54241 - DNA, 723 bp, Artificial Sequence
  Description of Artificial Sequence: Synthetic coding sequence
atgcccccaccagcaaaagaaggcggacgaaagggccctagagagcggtcgggcaagtccgcacctggtactgcccaaggagaggagcgggctaaaggcgctcctgcaacagaaccgccaaaacccggatgggcgcttactccccaggggctggcagcaatgctgccggcacagcggcacaggcatcttctgtttggagatttactggaggatgtcggagccgctgcttctacgttcccatgcggatccgttgaacctggataccgtatgccagaccctcggccatggactcagagcctagagctgccagccgagaggcagaacaggctattgggggttcttaaagcggcagaagccaggggccgtgtgagggcactcagactcaggtacactcgcatgcgcgctgaggaaattgctctcctgattcagcgtcagaagtcagccagggcagccattagactcgagctctttttgccgcctcaattgaagccggctcggatccccgatcccctggaccgacaagaagtgcagacaagcccaggtagggggggtgagaggggaggcgcacttcccgctagcgcacacgctgggccacaacccctgagccccgcagcggaagcacgtggcgatcaccctggaggcgaacgcggttggcatcatctgcccgctgttacagccaccgagtccgtgcgaagggcgcctgcttctcacatcaagttatag

SEQ ID NO: 54242 - DNA, 369 bp, Artificial Sequence
  Description of Artificial Sequence: Synthetic coding sequence
atgtacaagtccaagatccccagagctcagaatcaggtatccgttaaagtgacccctaagaacaccgagatgaaaatagctgaggagcctagcccctctctggggcaaacgctggaatggctgaggaaggaactatccgagatgcagatccaggaccagagcttattgcttactcttcgccatctgcactcagtattagaagaactccgcgcagatagtgcccactgggaggatgctaggtcatccgggggaacaagcccgatcagggccagagccggttcagagggacggggttgccaaccggtatgcagccgagggctggcccaactcctgaggggcgaagatagcaggcgctcttcgctgccttag

SEQ ID NO: 54243 - DNA, 3714 bp, Artificial Sequence
  Description of Artificial Sequence: Synthetic coding sequence
atgtccgtacttaccagcccacgtggcaaagtggaagtggttcactgccgtcgcaccgagagtcaagacgtgtattgcattaagagcttgatcaggaagttcacctgcaagctgttcggaaagctgaatatcatctatctccttgaaaaggctaatctggccgtgactctctgcaacgataaggaagagatcatggcgcaagcgacttttctagactacccaaattggaatgtcgccaagcaggacgattgggtaagtgtgttccgcgagttggatagcgatattccatgcacccctcttaacacactgtttatgcacctgtttgtggcagtggatgaatactcagtcggttgctgtaaagaaatactacgtaccgtttacaaagcggtcccagagctgcactttatatttttgattgtgccctcctacatgtccctcggctccaccttgatcacggtattcgatcaggtcgggaacattccctgtctaacatacgaggaagactttgctgtccatatttgtcaccgccatagccactatccccagctgcatgtcagaaaagcccgagtggaggatcacgatgatttaatgccaattttcatgaggtacgacacaatcctgaaagaaacttatggcgagtattttcttgctgagctgatcgaagcccaggatgaagagaaccacgcggttgtgtgcgaggtggaagggactgccgttggctttatgagcgtttgtagtcgtgtgaacatgcagctgttacacgagtgttttgacttagggcctttccacgggctctgcttcccccatcccgacgatgtcttggagagcccccaggatctgtcggtccgccgttcccaagatgctgaattgagatcatcatcccagggaagtcagaagatcgtggaggagcttcaggagccagtcagccctgacactatggagaacattcagggaaacatcgcccgtgaggccgctagtgaagaggcactcacagcagtccagtctggcaatgtgagcgagcctgaagatattgaaaagttatcagatattagtacaggttatgcccagtaccaccacgtctctagccgaagtctggcctcacttgtgctccccgaagagccagtccacttccgacctatctacaggggcgctagcgccgctttttgtatccaacttttttgtattgacgagaaatatgaggctcgcagtttggatttcatgaacttcgtgttcagtctgttcagcgacaaaaatttttgcgtcatcagcctgcctcatcttacgcctgagtttttccttatccaaaacttcgtgaagatggtaccttttaatacctgcactttggaacaggacctctatgttttccacagagcaggcctcctgaaatccatcaacattcgcttcgccacgctccttgacactcctggggtagaaaacctcgtcagcactctgatgctcaataaaagtatcttagaggatctcgaccgttacaataaggcacgcaaagaccccgacggcaccttgttacaggcttttgtggctgaggtggcagagcaaattgtcggtattgccgtgatccgtaatgagatggacatcgagtatatcagaagccattataacatcgaagacttcatttacttcagccaccaccagagagaggagcacggtcatatgcaccattttgccctgaaccccatttttcgccactatacaaagttttttctgaaggaaatactgcgattaggtttcaaatcctgcctatactaccgggtgtaccctaaatcccgggaggggaagttccaaaacccatatgcacactcccttacgagtgctctgcactaccttgttcccgtgcggcctcgtcgccagatcgtgtaccctttggaaaagctggggatcaatgctcctagcaaggcagtgagtaaggaccccatgagctacgctctcaatcacaccaacagaaagcttaccttggaacctaagatcactgtgaacgcgaagattatcgtggttggtgccagcagtgtaggcatctcatttctggagaccctggttttttgcagccacatgaagttcaataacttgaccctgatatctacacacgggctgccgggaaaaaaactattagacacagagcaaaggaaattcctcgcctctgatcactgctttaacgataaggattatgccctcatgtctctttgctcttgggtcaacgtcgtggtcggacgcatgaccggtattgacagggctgccaagcacgtggtgttgtctaccgatgaaatcgttccttacgatcacctgattctgtgtaccggtcagcagtatcaggtgccttgcccgacagaagcagatatctctcaacacttgactaatagagaagtccctaactctagccaacggaggtatacaggcaaggtcccctgtaatcactttaccttaaatgaggaggaagattgctttaaggctctcatttggattaggaataacagtatcactactgagggtaacattatcgtttatgggaacacaatcgacacctacactactgtggagactctcctcaacctgggagtttccggcagcaggattcatctggttcaacctcctcctgcttccaccattacatgtatcaacaattacagcgtagagtccgccgttgccgatgcactcggagcagccggtgtgacgatgtacagagacgcaatcctagcccagtggaatgacggcctgcaccccgatcctatttacagcgcctccttcactactccaaccaaaccattccgcctccagtgttctatgtttttctctttctgcgagaagaatgtggactatgaaacctttaaagctctgaatgatgcatgtctggtgtacgactcaagactcgttattgacactaactttcatactaacgatattgccattcgcgctgcaggaagtctcactaaattctccaaccgttactactcgaatgagtggacccactcaaatttctccagcaaggagattggatttcaactggcagcagccatgctccacctgtttgatccaaccctggagcccgtgaccgagcctcccgctaatctggatcgcctgatccctatgtacaaaggtgccaaaatacagggtgggattctcccaggatcttatcattacttgcacattgctaagcccgctatacctacaccgcttgaagtgcaaatggcccagcccaactacggacttgaactcgtgacaggatctgccaagaatggcacctattttaggattcatattaataaatacaaaatggttgagactatcacttgtctgtcccgggaaccgttcccagcttctaattatattcgactattcggacagcacgagcaactcttgaacaacctttgcgctagatacgatgagaatttaattacagacctgtattcctacttcactgaaccttggtgcctcgctctcttccatgatagattcatcgatctgagaaaggaactccggcagatactggcgtcaaaagaggaggaggacctgcctagtatcgagcagctggcacaccaaatagaggatgaagaaatcaatcccactgagaagccacggcagtacctgaaacgggtattcgaagagtccatctataagacactggttgagaggagcacactcgactacctccattataatcgctatcacctgcctatgtacgcttggcctggcattgtgtag

SEQ ID NO: 54244 - DNA, 765 bp, Artificial Sequence
  Description of Artificial Sequence: Synthetic coding sequence
atgaatttcgtgttcagtttgttttcagacaaaaacttctgtgtaataagccttcctcatctgacgcctgagttcttcctcatccagaattttgttaagatggtgcccttcaacacttgcacgctcgagcaggacctctacgtcttccatcgggcaggccttttgaaatctatcaatataagatttgccaccctcctcgatactcccggagtggaaaacctggtgtccacattgatgctcaataaatctatcctcgaagacttagacaggtataacaaagctcgcaaggacccagatattgaatacattagaagccattataacatcgaagacttcatctattttagtcaccaccagcgagaggaacacggccatatgcaccattttgccctcaacccaatattcaggcactacactaaattcttcctgaaagaaattttgagactaggtttcaagtcctgcctttactaccgggtctatccaaagtctcgcgagggtaagtttcagaacccatacgcgcacagccttacttccgctctccactacctggttcccgtccgtcctagacgccagatcgtttaccctttggaaaaactgggcattaatgctccttctaaggccgtgtcaaaggacccaatgtcttacgcactgaatcacacaaaccgcaagctgacattggagcctaagatcaccgtgaacgcgaagatcattgtggtgggggcaagctcagttggaatctccttccttgaaactctggtgttctag

SEQ ID NO: 54245 - DNA, 3534 bp, Artificial Sequence
  Description of Artificial Sequence: Synthetic coding sequence
atgtccgttctgaccagtccccgaggcaaggttgaagttgtgcactgtcggaggacggaaagtcaagatgtttattgcattaagtccctcattaggaaatttacttgcaagctgttcggcaagctaaacattatctatctcctggagaaagcgaatctggcagtgaccctgtgcaacgataaagaggagataatggcacaggccacatttctggactaccccaattggaacgttgccaagcaggatgactgggtgagtgttttcagagaactagacagcgacattccatgcaccccgctgaacacactcttcatgcacctgtttgtcgcagtggacgagtactctgtgggatgctgtaaagagatattgaggaccgtgtataaggcggttccagaacttcactttatctttctcatcgtcccttcttatatgtctctggggagcaccctgattactgtttttgaccaagtgggcaatattccctgtctcacttacgaggaggatttcgcagtgcatatatgccaccgccattctcattatccccagctgcacgttcggaaggcaagggtagaggatcacgacgatctgatgcccatctttatgcgatatgacacaatactcaaggagacttacggggagtactttctggccgagttgatcgaagcccaggatgaggagaaccacgccgtggtttgcgaggtggaagggactgcggtgggtttcatgtctgtgtgttcccgggtgaatatgcagctcctccacgagtgctttgacttagggccattccatgggttgtgctttccccatcccgacgacgtgctcgaatctccccaggatctgagcgttaggcggtctcaggacgccgagctccggagttcgtcgcaaggtagtcagaaaattgtagaagagcttcaggaacccgtgtcccctgacacaatggagaacatacagggcaacatcgcccgtgaggccgctagtgaggaggcactgactgctgtgcagtcggggaatgtgtccgaacccgagagcctagacttcatgaatttcgtcttctccctcttttccgacaagaacttctgcgtgatttccctgccccatttaactccggaattcttccttatccaaaattttgttaaaatggtcccgtttaatacatgtacactggagcaggacctttacgtgttccatagagccggtctgctcaagtccatcaacattcggttcgccactctgttggacacacctggggttgagaacctcgttagtactctcatgcttaacaaatccattctcgaggatctagacaggtataataaggccagaaaagacccggatggaaccctactgcaggctttcgtggctgaggtggccgagcagattgtaggtattgccgtgatcaggaacgaaatggatattgaatatataagatcccactacaatatcgaggacttcatctacttcagccaccaccagagagaggaacacggccatatgcatcattttgccttgaatcccatattcagacactacacaaaattttttctcaaagaaattctcaggttgggatttaaatcctgcctctactacagggtctatcccaagtcgcgggaaggcaagttccagaatccctatgcgcactcactgactagcgccttacattatctagtgccagtgcgccctagaaggcaaatcgtttatcctttagaaaagctggggattaacgcaccttccaaagccgtctcaaaggacccaatgtcttacgctctgaaccatacaaataggaaattaactctggagccgaagatcaccgtgaacgcaaaaatcattgtggtcggcgcatcctcagttggaatctcatttctcgagactcttgtgttttgctctcacatgaaatttaataacttgacactcattagcacacacggtttacctggaaagaagctcctggatactgaacagcggaagtttttggcgtccgaccactgcttcaacgacaaggactatgccctcatgtctctttgtagttgggtgaatgtggtggttggcaggatgacaggaatcgaccgggcagctaagcacgtggtgctgtcaactgacgaaattgtaccctatgaccacctgatcctgtgcacaggacagcagtatcaggtcccctgtcccacggaggctgacatctctcaacacctcactaaccgcgaggttccaaattccagccagcgcaggtacacgggcaaagtaccgtgcaaccacttcacattaaacgaggaagaggactgcttcaaagcattaatttggatccgaaataacagcattactacagaaggaaacataattgtgtacggtaataccatcgacacctacaccaccgtggaaacactgctgaatctgggggtgtctggaagccggattcatctggtacagcccccacccgctagcactattacatgcatcaataactacagcgtggaatctgctgttgctgacgctcttggcgcagccggtgtaacgatgtacagggacgcaatcctggctcagtggaacgacggcctgcatcctgacccgatctactctgcgagctttaccacacccacaaagcctttccggcttcagtgctctatgttcttcagcttttgtgagaaaaacgtggactacgagacttttaaagcgctaaatgacgcctgtttggtgtacgatagcaggttggttatcgataccaattttcacactaacgacatcgccataagggctgcagggtccctgactaagttctctaaccggtattacagcaacgagtggacacattccaacttttcctcgaaagagatcggtttccagttggcagccgcaatgttacacctgttcgatcccacactcgaacccgtaacagagcctccagcgaacctggaccgactgattcctatgtataaaggtgcaaaaatccaggggggtatcctgccagggtcctaccactacctccacatcgccaagcctgctattccgacaccattggaggttcagatggcccaacccaattatggactcgagttagtcacaggcagcgccaagaacggtacttatttccgaattcatatcaacaagtacaagatggtggagacaataacctgtctttctagggagcccttccctgcttccaattacattcgtttgttcgggcagcatgagcaactgctaaataacctgtgcgcccgatacgatgagaaccttatcacagatctctactcttacttcacagaaccgtggtgcctggccctgttccacgacaggttcatcgatcttaggaaggagcttcggcagatcctggcctcgaaagaggaagaagatctcccctccattgaacagctggctcatcagatcgaagacgaagagattaacccgaccgagaagccacgccagtatcttaagagggtcttcgaggaatcaatctacaaaaccctggtcgaacgctcgactctggattacctgcactataatcgataccatctgccaatgtatgcgtggcctggaatagtgtag

SEQ ID NO: 54246 - DNA, 603 bp, Artificial Sequence
  Description of Artificial Sequence: Synthetic coding sequence
atgtcttacgcactgaaccacacaaaccgcaaactgaccctggagccaaaaatcaccgtaaatgccaaaataatcgtggtgggtgcttcctctgtggggatctctttcctcgaaacactggtcttttgttctcatatgaaatttaacaaccttaccctgatctcgactcacggtctcccagggaagaagctccttgacactgaacagcgcaagttcctggcctcagatcactgctttaacgacaaagattatgcactgatgtcgctgtgcagctgggtcaacgtggttgtggggaggatgaccggaattgacagggccgctaagcatgtggtgctgtcaacagacgagatcgtcccatacgaccacctcattctctgcacaggacagcagtaccaggtcccatgtccaacagaggcggatatctcccagcatttgactaatagggaggtgccaaattccagtcagcgtaggtacacgggtaaagtgccctgtaaccactttaccctgaacgaggaggaagactgcttcaaagcccttatctggatccgtaataatagcataactactgaggatggcggaagagcctcagtgcttttttgctag

SEQ ID NO: 54247 - DNA, 438 bp, Artificial Sequence
  Description of Artificial Sequence: Synthetic coding sequence
ggtctccgagagtcactcttcaggaccccacggttcggatgtttcagcatcttcccgaggcgcatccgcgtggaggtagaaggcacagctgttggttttatgtcagtatgcagccgcgtgaatatgcaattgctgcacgagtgctttgatctcggcccatttcacgggttgtgttttcctcatcccgatgacgttttggagagtcctcaggacctgagtgtccggcgaagccaagatgctgagcttcgctcttcttctcaaggctcacagaaaattgttgaggagttgcaggagccagtgagtccagatactatggaaaacattcagggcaatatcgcacgggaggctgcaagcgaggaggcccttactgccgtccagagcggcaatgtttcagaacctgaagtcgcagggttctatgagttctgcttccagtcttag

SEQ ID NO: 54248 - DNA, 570 bp, Artificial Sequence
  Description of Artificial Sequence: Synthetic coding sequence
atgagcgtactcacctcacccaggggcaaggtcgaagtagtgcactgtcgtcgcacagaatcccaagatgtatactgcatcaaatctttgattaggaagtttacatgtaagctctttggtaaactgaatattatttatctgctcgagaaagccaacctggcggtgaccctgtgtaacgacaaggaggaaatcatggcccaggccacttttcttgattaccccaactggaatgtggctaagcaggatgattgggtctcggtctttcgagagctcgattccgatattccatgtaccccgctgaataccctgttcatgcacctgtttgtcgccgtcgatgagtacagtgtcggatgttgtaaggaaattctgaggaccgtctataaagcggtgcctgaactgcatttcatcttcctgatcgtaccttcatacatgagccttggatccaccctaataacagtatttgaccaggtcggcaatatcccctgcctgacttacgaagaggattttgctgtccacatttgccatcgacactctcattacccccagctccatgtccgcaaggctagatag

SEQ ID NO: 54249 - DNA, 1413 bp, Artificial Sequence
  Description of Artificial Sequence: Synthetic coding sequence
atgtcagtgctgacgagtcctcgtggaaaagttgaagtcgtccactgtaggcggacagaatcacaggatgtatattgcataaagtccctcatcagaaaatttacgtgcaagctcttcggaaaactcaatataatctacctcctggaaaaggcaaacctggccgtgacactgtgtaacgataaagaggaaatcatggcacaggccacatttttagattaccctaactggaacgtggcaaagcaggatgactgggtatccgtcttcagggaactggattccgatattccttgtactcctttaaatacactctttatgcatctcttcgtcgccgtggacgaatactctgtcggatgctgcaaagagatcttaaggaccgtctataaagccgtgcctgaactgcacttcatcttcctgatcgtgccaagttatatgtcactggggagcacattgattacggtgttcgaccaggttggcaatatcccttgtctgacatacgaggaggatttcgcggtacacatatgccaccgccactctcactaccctcagctccacgtgcgcaaggccagagtcgaggaccatgatgaccttatgcccatcttcatgcgctatgatactattcttaaggagacgtacggtgaatactttctggccgaattaattgaagctcaagacgaggaaaaccatgctgtggtttgcgaggtggaaggcaccgctgtgggttttatgtccgtatgtagtcgagtgaacatgcaactgctgcacgagtgctttgatttaggcccttttcacgggctctgttttccgcaccccgatgatgtattagagagcccacaggatttgtcagtgcggaggagccaggacgctgaactgcgttccagttcgcaaggatcacaaaaaattgtggaagaactgcaggaacctgtgtctccagacacaatggaaaacattcagggaaacatcgctcgagaggccgcttccgaggaagccttaaccgccgtccagagtggtaacgtctctgaaccagaggatatcgaaaagctcagtgacattagcaccgggtatgcccagtatcaccacgtaagctcccggtccttagctagtttagtgttgccagaggagcccgtacactttcggcctatataccgtggcgcatcggccgcattctgtatccagctattctgtattgatgagaagtatgaggcacggagcctagatttcatgaattttgtattttccctcttttccgacaagaatttttgtgtaatctcactccctcacctcacccccgagttcttcttgattcagaactttgttaagatggtcccattcaatacatgcaccttagagcaagacttatatgtctttcacagggcaggtcttctgaagaacatatgtcttggcagatcctcttag

SEQ ID NO: 54250 - DNA, 963 bp, Artificial Sequence
  Description of Artificial Sequence: Synthetic coding sequence
atgagctatgctctgaatcatacaaataggaaactgactttggaacccaaaatcaccgtgaacgctaaaataatcgtcgtcggcgcttcaagcgtgggcatctcctttctggagacgctggtattttgttcccacatgaaattcaataatttaacactgataagcacccatggcctccccggaaagaaactactggacacagagcagagaaagtttctggcaagcgatcattgttttaacgataaagactacgccctcatgtcactgtgctcctgggtgaacgtggtcgtgggccgtatgaccggcattgatcgtgcggcaaagcatgtagttctgagcaccgatgagatcgtcccatatgatcacctgattctctgcacagggcagcagtaccaggttccctgtccaacagaagctgatattagtcaacacttgaccaatcgagaagtgcctaattcttcacagcgacgctacacgggaaaagtcccctgtaatcatttcacactcaatgaagaggaagactgtttcaaagctcttatatggatcaggaataactccattacgactgaaggaaacataattgtatacggaaacacaatcgacacttacacaaccgtagagactctcctcaatctgggcgtctcaggttctaggatccatctggtccaacccccacctgcatctaccattacctgtatcaataactatagcgtggagtcagcagttgcggatgcactgggcgcagccggtgtcacaatgtatagagatgccatcctggcgcagtggaacgacggactgcatcctgatccaatttattcagcctcattcaccactcctaccaaaccgttcaggctgcagtgctctggagccttcttcctgggtctgactatcatctgtatcctgccttcccttcccttccagctcccgtggcggtacaagtggcattctctaatcatggtttag

SEQ ID NO: 54251 - DNA, 3612 bp, Artificial Sequence
  Description of Artificial Sequence: Synthetic coding sequence
atgagcgtccttacaagcccaagaggcaaagtggaggttgtccactgtcgcagaaccgagagccaggatgtgtattgcataaaatctcttatcaggaagttcacatgcaagctgtttggaaagctcaacatcatttacctcctggagaaggccaacttagcggtaacactgtgcaatgataaggaagagatcatggctcaagcgaccttcttggactatccgaactggaacgtggccaagcaagacgactgggtgtctgtgtttagagagctggattcagacatcccttgcactcctctcaatacactgtttatgcatctgtttgtagcggtcgacgaatattccgtcggctgttgtaaagagattttgcggacagtctacaaagctgtacctgagttgcacttcatctttctgattgtgcctagctatatgtctctgggctccaccctcattaccgtctttgatcaggtaggcaacataccgtgtctcacatatgaggaggactttgccgtgcatatttgtcatcgccactcacactacccacagcttcacgttagaaaggctcgggtggaggaccatgatgatttaatgcctatatttatgcggtacgacaccattcttaaggagacttatggcgaatactttctggcagaacttatagaagcccaggacgaggagaatcatgcagtcgtatgcgaggttgaaggtaccgcggttggatttatgtccgtctgctccagggtcaatatgcagttattgcacgagtgttttgaccttggcccattccatggcctgtgtttcccccaccccgacgatgtcctggaatccccccaggatcttagtgtcaggcgtagccaggatgctgaactacggtcctccagtcaaggctcacagaagattgtggaggaactgcaagagccagtgagtcctgacaccatggagaacatacaggggaacatcgcccgtgaggctgcctctgaggaggctctgacagccgtgcagagtggtaacgtttcagagcctgaagatatagagaagctgtctgacatctcaacaggatatgcgcagtatcatcatgtgagctccaggtccctggcctcactggtgctcccggaggagcctgtccacttcaggccaatctacagaggcgcttcggccgcattctgcatccagctcttttgcatcgacgagaagtacgaggcccgatcattggattttatgaactttgtctttagcctcttctccaattttgtgaagatggtaccatttaacacttgcaccctggagcaagacctgtatgtgtttcatcgggctgggcttttgaagtcgattaatatacgcttcgcaaccctgctcgacactcctggtgtggaaaatctggtgagcactctcatgttgaataagtctatactggaggacctggatcgatacaataaggcacgaaaagaccccgatggcacactcttgcaggctttcgtcgccgaagtggcggagcaaatagtgggaatcgctgtcattcgcaacgaaatggacatcgagtatattcggagccactacaatatcgaagactttatctacttctcacaccatcagcgcgaggagcacggacacatgcaccatttcgcactgaaccccattttcagacactataccaagttttttctcaaggagattctgcgccttgggttcaaatcgtgtctgtactaccgagtctatcccaagtccagagagggtaagtttcagaacccctatgcacacagcttgacaagcgcacttcactatctggttccagtgcgccctcggcgacagatcgtgtaccccctggagaagctcgggatcaacgctccttccaaggccgtgagcaaggatccaatgagctatgctttgaatcacaccaacaggaagctgaccctggaaccaaagatcactgtgaatgctaaaattatcgtagtcggcgcatcttcagtcggaatttctttcttggagaccctggtgttttgtagtcacatgaaattcaataatcttaccctgatatctacccatggactgccaggcaagaagcttctggacacagagcaaaggaagttcctagcctcggaccattgctttaatgataaagactatgcgctgatgagcctgtgctcttgggtaaatgtcgtggtgggccgaatgactggaatcgacagggccgcaaaacatgtcgtgctgagcactgacgagattgtgccatacgatcacctaatcctgtgtaccggacaacaataccaggttccatgcccaactgaagctgacattagccagcaccttaccaatagagaagtgcccaacagttcccagcggagatataccggtaaggttccctgcaatcatttcacactgaacgaggaagaggattgttttaaagccttgatctggatacgcaacaattcgatcaccaccgagggcaacattatcgtgtacggaaataccattgatacctataccacggtggagactctgctgaatctgggagtaagtggatcacgaatcaacaattacagcgtcgagagtgccgtagccgatgccttaggggctgctggggtaactatgtaccgggatgccatcctggcccagtggaacgatgggctgcacccagaccccatctattctgccagtttcactactcccacaaagcctttccgacttcagtgcagtatgtttttcagtttttgtgagaaaaatgtggactatgaaaccttcaaggccctgaacgatgcctgtttagtatacgactcaaggctagtgatcgacaccaactttcacactaatgatattgccataagagccgcagggtctcttacaaaattctcaaaccggtattacagcaacgagtggacccattcaaactttagtagtaaagagattggattccagctggccgcagcaatgctgcacttgtttgatcccacgcttgaacccgttactgaaccacccgctaatttagatcgcttgatacctatgtataagggtgccaagatccaaggcggaatcctgcctggcagttatcattacctacatatcgcgaagcctgcaattcctacccccctggaagtgcagatggctcagccgaactatggcctcgagctagtgacgggaagtgcaaagaatggaacctatttccgaattcacataaacaagtataagatggtggagactataacctgcctcagccgcgagccatttcccgcatccaactatataaggctgtttgggcagcatgaacagcttctgaataacttatgcgcccgttacgatgagaacctcatcaccgatctgtatagctactttaccgaaccttggtgtctggcactgtttcacgatagatttatcgaccttagaaaagaattgaggcagatcctggccagtaaagaggaggaggatttaccaagtatcgaacagctcgcgcaccagattgaagacgaagagatcaaccccaccgaaaagcctcgtcagtatctgaaaagagtattcgaggaaagcatttataagacactggtcgagcggtcaaccctggactacctgcattataacaggtaccatctacctatgtatgcatggcccggtattgtgtag

SEQ ID NO: 54252 - DNA, 603 bp, Artificial Sequence
  Description of Artificial Sequence: Synthetic coding sequence
atgagctatgccctgaaccacacaaatagaaagctcacgctggagccaaaaatcacagtcaacgccaagattatcgtcgttggtgcctcgagcgtcggaatttccttcttggaaactctggtgttctgttcacacatgaagtttaataatcttacactgatctccacacatggcctcccgggaaagaagcttctggacacagaacaacgtaaatttctggcatctgaccactgtttcaatgacaaagattatgcactgatgtcactgtgctcttgggtgaacgtagtcgtggggagaatgacaggcatagatagggcagctaaacatgtcgtcctcagcactgacgagatagttccttacgatcacctgattctgtgtaccggacagcagtaccaggttccttgtccgacggaagccgatataagtcagcacctaactaatagggaagtgcccaactcctcccagcgccgatacacagggaaggtcccatgtaatcatttcactctcaacgaggaagaggactgtttcaaggcccttatttggatccggaacaatagtataaccaccgaagatgggggacgcgctagtgtcctgttctgttag

SEQ ID NO: 54253 - DNA, 1413 bp, Artificial Sequence
  Description of Artificial Sequence: Synthetic coding sequence
atgtctgtactgacgagtcccagggggaaggtcgaggtcgtacactgtaggaggacggagagccaggacgtctactgtattaagagtctaatccgcaagttcacttgtaaactgttcggcaaactgaatattatatacctcctagaaaaggctaatctcgccgttactctgtgtaatgacaaggaggaaatcatggcccaggccactttcctcgattacccgaactggaatgtggccaagcaggacgattgggttagcgtgttccgtgagctcgattcggacataccgtgtaccccgcttaatactcttttcatgcatctcttcgtcgctgtcgatgaatactctgtcggttgttgcaaggagatcttgcgcacagtctacaaggccgttcctgagctccacttcatttttctgattgtgccaagctacatgagcctcggctctaccctgatcacggtttttgatcaggtggggaatatcccctgtcttacttatgaagaggacttcgcagtgcacatttgccaccgtcattctcactatcctcaattgcacgtccggaaggctagggtggaagatcacgacgatcttatgccgattttcatgcggtacgacactattcttaaggagacctatggcgagtacttcctggcagaactgatcgaagcacaggacgaagaaaaccacgccgtggtctgcgaagtggagggaacagccgtgggtttcatgagcgtctgctcgagagtcaatatgcagttactccatgaatgctttgatctaggtccatttcatggcctctgtttcccacacccggacgacgtgctcgagtctccacaggacttaagtgtacgtcgtagtcaagatgcagagctacgtagcagctctcagggctcgcagaagatcgtggaggagctccaggagcccgttagccctgacaccatggagaacattcaaggcaacatcgctcgcgaggccgcttcagaggaggcattgactgcggtccagtccggcaacgtgtccgagcccgaggacatcgaaaagcttagtgacatctctacaggatacgcacagtaccaccatgtatcatccagatcactggcctcccttgtgctcccagaggagcccgtgcatttccgtccaatttatcgtggcgctagcgccgctttctgtatccagttattttgcatcgatgaaaagtatgaagccaggtccctggactttatgaatttcgtcttttccttgttcagtgacaagaacttctgcgtgataagtctgccacatctcacacctgagtttttccttatccaaaacttcgtgaagatggtgcctttcaatacgtgcacactggagcaggatctgtacgtctttcatcgcgctggcctgttaaagaacatttgtttgggaagatccagctag

SEQ ID NO: 54254 - DNA, 408 bp, Artificial Sequence
  Description of Artificial Sequence: Synthetic coding sequence
atgtcagtcctcacctctccacggggtaaagtggaggtggttcattgcaggcgcactgagtcccaagatgtttactgcataaagtcactgatccgcaaattcacttgcaagcttttcggcaaactgaacataatctatctgctggagaaagcgaaccttgctgtgacgctgtgtaatgacaaagaggagattatggcccaggccaccttcctagactatcccaattggaatgtggccaaacaggatgactgggtcagcgtgtttagggagcttgatagcgacataccgtgcactcctctcaacaccctgttcatgcacctttttgtggctgtggacgaatatagcgtggggtgctgcaaagaaatcttgaggacggtgtataaggctgtgcccgaattgcacttttag

SEQ ID NO: 54255 - DNA, 1467 bp, Artificial Sequence
  Description of Artificial Sequence: Synthetic coding sequence
atggagcccttcttgcgcagacgtctggcgttccttagctttttctgggataagatttggcctgcagggggtgagccagatcatggaaccccaggctctctggaccccaatactgatccagtgccaactctgcctgctgaaccgtgttccccttttccacagttattcctggcgctatacgatttcaccgcaaggtgtggcggagaactgagtgtgcggcgtggtgatcggttatgcgctctggaggaaggaggaggctacatttttgccaggcggttaagcgggcagccatccgcgggacttgtgcccattacacacgtcgcaaaggccagccccgaaaccctttctgatcaaccctggtatttcagtggagtatctcggacgcaggcccaacaacttttattgtctccacctaatgagcccggagcgttcttgatacgcccaagcgaaagctccctgggaggttattccctcagcgtgagagcacaggccaaggtatgccattatagagttagcatggcagccgacggaagtctctacctccagaagggtcgactgtttcctggactcgaagagctccttacatattacaaggctaattggaagctgatacagaaccctctgctacaaccatgcatgccgcagaaggccccacgccaggatgtgtgggagagacctcatagtgagttcgctctaggcaggaagctgggcgagggttactttggtgaggtatgggaaggtttgtggcttgggtcactaccagtcgcaataaaagtcatcaagtcagctaacatgaaactcaccgatctggcgaaagaaatacagaccctgaaggggcttcgccacgagcgcttgattagattgcatgccgtttgcagcggaggtgagccggtgtacatcgtgaccgagctaatgagaaaagggaatctgcaggcatttttggggacgcctgagggccgagctctccgtcttcctccattgctgggtttcgcttgtcaagtggccgagggcatgtcatacctcgaggaacagcgggtggtccaccgggatttagctgctagaaacgtgctcgtcgatgatggccttgcttgcaaggtcgctgattttgggctggcacggctgttgaaggacgacatttacagtcccagttcctcaagtaagatcccagtgaaatggactgcccctgaggcggctaattatcgagtgttttctcagaaaagtgacgtctggagcttcggtgtgctgctccatgaagtgttcacttatggtcaatgcccctacgagggtatgaccaaccatgagaccttgcaacagattatgagaggataccggctgcctaggcccgcagcctgccctgcagaggtctacgttttaatgctggagtgctggcggtcatcgcccgaagagagaccaagctttgctacattgcgggagaagctgcatgcgattcaccggtgtcatccttag

SEQ ID NO: 54256 - DNA, 402 bp, Artificial Sequence
  Description of Artificial Sequence: Synthetic coding sequence
atggctgccgctaacaaaggaaataaaccaagagtacggtctataagattcgccgctggacatgatgcagaggggagccattctcacgtacacttcgatgaaaaactccatgactctgtggtgatggtgactcaagagtctgacagttctttcctcgtgaaagtaggctttctcaaaatccttcacagatatgagattaccttcactctgccccctgtccataggctttctaaagatgttagagaggcccctgtgccctcgctgcatcttaaacttttaagcgtggtcccagtcccagaagatcgccaccacgggacacccatgcttctcgatggcgttaagtgtgttggcgcagagctagagtatgacagtgagcatagtgactggcacgggttcgattag

SEQ ID NO: 54257 - DNA, 525 bp, Artificial Sequence
  Description of Artificial Sequence: Synthetic coding sequence
atggcagcagccaataagggaaacaagcctcgggtgcggtcaattaggtttgcggcaggtcatgacgcagagggctcacatagccacgttcactttgacgagaagctgcacgattctgtggtgatggtgactcaggagagtgactccagcttcttagtcaaggttggcttccttaaaattctgcacaggtatgagatcacttttacactgcccccagtccatcgtctcagtaaggatgttcgggaggcacccgtgccttctcttcatttaaaactactttcagttgtacctgtccctgaaggctatagcgtcaagtgcgagtactcagctcacaaggaaggggtgttaaaagaggagatccttttggcctgcgagggtggaacaggaacttgcgtgcgcgtcaccgtccaggcaagagtcatggacagacatcacggcaccccaatgctcctggacggtgtaaagtgcgtgggagccgaactggagtatgacagtgagcacagcgattggcatggcttcgattag

SEQ ID NO: 54258 - DNA, 525 bp, Artificial Sequence
  Description of Artificial Sequence: Synthetic coding sequence
atggctgctgctaacaaaggcaacaagcctagggtccgatccatccggttcgcagccggacacgatgcagaagggtcccattctcacgtccattttgacgaaaaactgcacgacagcgtggtaatggtcacccaggagtccgattccagcttcttggtcaaggttggctttctgaagatcttgcacagatatgagattactttcacactcccacctgttcacagactcagcaaggatgtgagagaggccccagtcccttctctccatcttaagcttctttcagttgtgccggtccctgaaggatattccgttaagtgcgagtattccgcccacaaggagggagttctgaaagaggagatcctgttagcatgcgaggggggaacaggtacatgtgtgcgcgtgacggtgcaggcgagagtgatggatagacaccatggcacacccatgctgctggacggcgttaaatgtgttggagctgagctggagtatgacagcgagcacagtgactggcacgggttcgactag

SEQ ID NO: 54259 - DNA, 384 bp, Artificial Sequence
  Description of Artificial Sequence: Synthetic coding sequence
tagaataagccgagagttcggtctatccggtttgctgccggacatgatgccgagggctcacacagtcatgtgcatttcgatgaaaagctgcacgactccgtcgtgatggtcacacaagaatccgactcttctttcctggtgaaagttggattcctcaagatccttcacagatatgaaatcactttcacgttgcccccagtgcataggctatctaaagacgtaagggaggcccctgtgccatccttacacctgaagctgctgtccgtggtccccgtgccagaagatcggcatcacggcacaccaatgctgctggatggcgtgaagtgtgttggcgcagagctggaatatgattccgaacatagtgattggcacgggttcgattag

SEQ ID NO: 54260 - DNA, 603 bp, Artificial Sequence
  Description of Artificial Sequence: Synthetic coding sequence
atggtgcacgcctttctaattcataccctccgggcacccaataccgaggataccgggctctgccgggtgctgtactcctgtgtctttggagcggaaaagtctcccgacgatccgagaccacatggcgctgagagagataggctgctcaggaaagaacaaattctggctgtcgctcgtcaagtcgagtctatgtgtaggttgcaacaacaagcctctggacggccaccaatggacctgcaacctcagagcagcgacgagcaagtgcccctccacgaggccccaagaggagccttcaggctggccgctgagaatccctttcaggagccgagaaccgtcgtctggctgggggtattgtcattgggctttgcactggttttggacgctcacgagaatctccttctggcagaaggaaccctgagacttttgacacgactactcctggatcatcttcggctgctagccccaagcacatcattgctgctgcgcgcagacagaatcgaaggcatccttaccagattcctgccgcacggccagttgctcttccttaatgaccagtttgtacagggactggagaaagaatttagtgccgcttggccgcgttag

SEQ ID NO: 54261 - DNA, 603 bp, Artificial Sequence
  Description of Artificial Sequence: Synthetic coding sequence
atggtccacgctttcctaatccatacccttagggccccaaataccgaagatacgggactatgccgggtattatattcatgtgtatttggagccgaaaaaagtccagacgatccccgaccccacggagcagagagagaccgcctgctccggaaggagcagatcctggccgtggccaggcaggtggagtcaatgtgccgcctgcagcaacaggcctcaggccgtcctcctatggaccttcagccccaatcctccgacgagcaggtcccactgcatgaagcaccacgaggggcattccgattagccgctgagaacccttttcaggaacctaggactgtggtgtggcttggcgtgctgtccttgggctttgccctggtgctggacgcccacgaaaaccttctgctggcagagggtaccctacgcttgctgactcgcctcttgctggatcatctgcggttgctggcgccttcaacttccctcctacttagagccgataggattgagggcatattaacacgctttctcccccacggtcaactcctttttctcaatgatcagttcgttcaggggttggaaaaggagttctcagcagcttggcccagatag

SEQ ID NO: 54262 - DNA, 180 bp, Artificial Sequence
  Description of Artificial Sequence: Synthetic coding sequence
atggtgcacgcattcttaatacacaccctcagggccccaaatacagaagacactggcttgtgtcgagtcctgtacagttgtgtatttggagcagaaaagtcgcctgacgatccacgtcctcatggggctgaaagggaccggctcctacgcaaggagcaaattttggcggtggcaaggtag

SEQ ID NO: 54263 - DNA, 261 bp, Artificial Sequence
  Description of Artificial Sequence: Synthetic coding sequence
atggtgcatgcctttctcatccacactctgcgagctcccaataccgaggatactggcctgtgcagagtcttatattcatgcgtgtttggcgcagaaaagagtccagacgatcctagaccccacggtgcagagcgggaccgactgctgaggaaagagcagatactagcagttgccagacaagtggagagtatgtgtcgcctccagcaacaagcctcggggaggccaccgatggacctgcaacctcagagcagcgatgagtag

SEQ ID NO: 54264 - DNA, 1155 bp, Artificial Sequence
  Description of Artificial Sequence: Synthetic coding sequence
atggccgctgttcagatggaccctgaactagcaaaaaggcttttctttgaaggcgctaccgtagtcatcttaaatatgccaaaagggacagaattcggaattgactataacagctgggaggtggggccaaagtttcgcggagtgaagatgatacctccaggcattcactttctacactattcatctgttgacaaggcgaatcctaaggaagtgggcccaagaatgggcttctttctgtccctccaccagcgcggtttgactgtcctgcggtggagcaccttgcgcgaagaagtcgatctcagtcccgctcctgaaagtgaagttgaagcgatgagggcaaacttgcaggaactggatcagttccttggaccttacccctacgccaccctcaagaagtggatttctctgacgaactttatctcagaagcaacggtagaaaaactgcaacctgagaacagacagatctgtgccttcagtgacgtcttgcctgtgttatccatgaaacatactaaggatagggtgggccagaatctgcccaggtgcgggattgaatgcaaatcctatcaggaggggctggctcggctacctgagatgaagcccagagccggtacagaaataaggttcagcgagcttccaactcagatgttccccgaaggggctaccccggcagaaatcacaaagcattctatggatctctcttatgcattagaaacagtgttaaacaaacagtttccgagtagtccccaggatgtacttggcgaactgcagttcgctttcgtgtgcttcctgctgggtaacgtctacgaagcctttgagcactggaaaagactgctgaacctcctttgccggagtgaagccgctatgatgaaacaccacacactgtatataaacctgatttctatcctgtaccaccagcttggggagataccggctgatttcttcgtcgatattgtgtctcaggacaatttcttgacaagcacacttcaggtcttctttagctcggcctgttcaatcgccgtcgacgccacgctgcggaagaaagcggagaagttccaggcccaccttaccaagaagttcagatgggacttcgcggctgaacctgaggactgcgcacccgtggtcgtagagctcccagaaggaattgaaatggggtag

SEQ ID NO: 54265 - DNA, 1155 bp, Artificial Sequence
  Description of Artificial Sequence: Synthetic coding sequence
atggctgccgtccaaatggaccctgaactggcaaagcgcctattttttgaaggggcaacagtcgtgatcctcaacatgcccaaaggcaccgagtttggtattgactacaattcttgggaggtcggcccaaagttcagaggtgttaaaatgattcccccagggatacatttcctgcactattcatcagttgataaagctaaccccaaagaagtcgggcctagaatgggattctttctttccctgcaccagagaggactaaccgttctccggtggagcaccctgagggaggaggtcgatctttctcctgcccctgaaagtgaggttgaagctatgagagctaacctacaggagctcgaccaatttctcggcccatacccatatgccactctcaagaaatggatttctctcacaaactttatctctgaagcaaccgtcgaaaaattgcagccagagaatcgacagatttgtgctttctccgacgttttgcctgtattaagtatgaagcacaccaaagaccgagtcgggcagaaccttcctagatgcggtattgagtgcaaatcataccaggaggggctcgctcgcttgccagagatgaaaccgagggccggtactgagatccggttctcggagttacccacccagatgttcccggaaggtgccactcctgcagaaataaccaagcattctatggacctatcttacgctctggagacggtcttaaataaacagtttccatcttcaccacaggatgtgctgggcgaattgcaatttgcgttcgtctgcttcctgctgggaaatgtgtacgaggctttcgagcattggaagcgcctgctcaatctcctctgccggagcgaagccgctatgatgaagcatcacacgctctacatcaatctgatttctatcctctaccatcagctgggggaaattccagctgatttcttcgtggacattgtgagtcaagacaattttctgaccagcaccctgcaggtcttcttctccagtgcatgcagcattgcggtcgatgccaccctccgaaaaaaggccgagaaatttcaggctcatctgaccaagaagttcagatgggattttgcggctgagcctgaggattgcgcccctgtggtcgtagagctcccagagggcatcgaaatgggctag

SEQ ID NO: 54266 - DNA, 921 bp, Artificial Sequence
  Description of Artificial Sequence: Synthetic coding sequence
atgggctgtgacgggggtacaatccccaaacgccacgaactggtgaaggggcctaagaaggttgaaaaagtggacaaggatgccgaacttgtggcgcagtggaactactgcaccctctctcaggagatcttacgccgtcctattgtggcctgcgaattgggtagattgtacaataaagatgccgtaatcgagtttctcttggacaagtccgctgagaaagccctgggcaaggctgctagccacataaaatctatcaagaatgtgaccgagctgaagctgtccgacaacccagcatgggagggtgacaaggggaacaccaagggggacaagcacgatgatctgcagcgggctcggttcatatgtcccgtggtagggctggagatgaatggtcggcatcgtttctgctttctgcgctgttgtggttgcgtattttctgaacgggcactgaaagaaatcaaggccgaagtgtgccatacgtgcggcgctgcctttcaggaggacgacgtgatcatgttgaatggaaccaaggaagatgttgacgtcttaaaaacaagaatggaggagagacggctgagagcaaagctggagaagaagactaaaaagcctaaggccgcagaatccgtctcaaaacccgatgtgagcgaggaggcacctggcccatctaaggtcaaaactggcaagcctgaggaagccagtctggactcccgggagaagaagacaaacctggcccctaaaagcactgccatgaatgaatcaagctctgggaaggcagggaagcctccttgcggggcaaccaagaggagtattgcggacagcgaagagagtgaggcatacaagagtttattcacgacgcattcatccgctaaaaggagtaaggaagagtccgcacattgggtgactcatacttcctactgcttttag

SEQ ID NO: 54267 - DNA, 1011 bp, Artificial Sequence
  Description of Artificial Sequence: Synthetic coding sequence
atgggctgtgatggcggaactatccccaaacgccacgaactagtgaaagggcctaagaaggtggagaaaatctggcatctgaaaaacgggaaggagtggtgtagtcttcactccgaaggcaaaaataaaaacgggaaagagtgggatatggagtacgacgttgacaaggacgccgaattggttgctcaatggaattactgcactctgagccaggagattctgaggcggccaattgtcgcatgcgaacttggtagactgtataacaaagacgcagtcatcgagtttttgctcgacaaaagcgcggagaaagctcttggcaaagcagcctcccacatcaaaagcatcaagaacgtgactgagctcaagctgagtgataatccagcctgggagggagataaggggaacaccaaaggagacaaacatgatgaccttcagcgcgcacggttcatctgtccagttgttggattagagatgaacggcaggcaccggttctgtttcctccgttgttgtggttgcgtcttctcggagagagcgttaaaggaaatcaaggctgaggtgtgccacacatgcggggcagctttccaggaggacgacgtgattatgctgaacgggaccaaagaagatgtcgacgtgctcaaaactcgaatggaagagagaaggctaagggccaagttagagaagaaaactaagaagcccaaagcggcagagagcgtgtcaaaacctgacgtgtcggaggaggcacccggaccttctaaggtgaaaactggaaagccagaagaagcgtctctcgatagtcgtgaaaaaaagactaaccttgcccctaagagcactgcgatgaacgaatcatcatctgggaaggctggcaaacctccctgcggcgcaaccaaacgttccatcgcggacagcgaagagagtgaggcttataagtcattgtttacaacccacagcagtgccaaacggtctaaggaggagagcgctcattgggtaacacatacaagctactgcttttag

SEQ ID NO: 54268 - DNA, 129 bp, Artificial Sequence
  Description of Artificial Sequence: Synthetic coding sequence
atgggatgcgatggaggcacgatccctaagcgtcacgagcttgtcaagggcccaaaaaaggttgagaaagccatcattgggggtctgctggacggcgcttggtcccccgagacaccttctcaggattag

SEQ ID NO: 54269 - DNA, 456 bp, Artificial Sequence
  Description of Artificial Sequence: Synthetic coding sequence
atgtttcaggtgtttaaaccccacgctggagaggactacaagtatcccagggaaaccgaaacgatatggtcacacccctacgtggtggagggaagccataagagcccactcgagagtctctctcttcacgggtgcctggctgcaatggcgccttctataacaagtagtgaagattcttcaccctcacaaagggataaaaaggatttgtctctcgatctgttacttactaggaagaagaggtctcagggcctacactggagtcactggcaaggtctgaaccacatgtccatcaggatacatactcccgagcagggaagcccttccctgggtcagaattggtcttggggaaataggaaggaaaagggggtggcgcagaggcaggtccctacaaccggcacccattcattttttcactgtacatccgagggcaataaggagaagccccatcacttctag

SEQ ID NO: 54270 - DNA, 471 bp, Artificial Sequence
  Description of Artificial Sequence: Synthetic coding sequence
atgtggaaaagatctgatcaccaacccaagatcaaggccgaggacggccctttagtgggccagttcgaagtgctcgggagcgtgcccgagccggcaatgccccacccactcgaactttcggagtttgagtcctttcctgtgtttcaagacatccggctgcatattcgggaggtgggcgcacaactggtgaaaaaggtcaatgccgtctttcaactggacattaccaaaaatggcaaaactatattacggtggaccattgatctaaagaacggctctggcgatatgtatcctggacccgcacggctgcccgcagataccgtgttcacaatcccggagtctgtatttatggaactcgtcctgggaaagatgaacccccagaaagcgttcctcgccggaaaatttaaagtctccggtaaggtactgctctcctggaaactggagcgagtttttaaagactgggccaaattttag

SEQ ID NO: 54271 - DNA, 414 bp, Artificial Sequence
  Description of Artificial Sequence: Synthetic coding sequence
atggcgcagaaacccctgagcacggctgccgcagaaagaatgaatctggtgggccaggatgaaatctggaagtaccggctcaaagctgaatccgaagccaggcaaaactggccccagaactggggatttctaacaacaccattcgaggaattgatcaaatgtgaagaggacctccccacccccaagccaaagattgagctacctgagcggttcagaatcaggcctgttacacctgtagagaaatatattaaggtgttcccgagccccccagtgccgcaaaccacccaaggcttcattggctggcgctccgcggtccccggtctcaacaaatgtcttgagctggacgacgccattcgttcttgcaagggcgcatttgctagagaactatgttggcctaagcagggtgtgcactag

SEQ ID NO: 54272 - DNA, 1227 bp, Artificial Sequence
  Description of Artificial Sequence: Synthetic coding sequence
atggcgagcaagaagttcgccgtcaaatgtggaaactttgcagtcctggtcgatctgcatatcctgcctcagggcagcaataaggatacttcttggttctccgagcagaagaaagaagaggtctgtctgctgctgaaagagacaatcgactctagagtgcaagaataccttgaggtgaggaagcagcaccggccatcgaacgcagaatttactaggagcaatcccctatctctgaaaggctacggattccagatcaccgcatattttctcaagaggggaatccgactgcgctgcatacgcagtactcagaacgccgagctctgtgtattccccgaccggtttgtggtttgcgttagccagttagcctttagtagggacctgctagcttctcaaaatgaagacctgactgaacgcgtgctgcacggggtgtctgactactttgcagagtgcgctgagagctctctgcccccttccgctaagttgcgtagaaacgccctcaaggagattgtgaagagaacagaaactaagagttcagttacttcgaaaagccagaccaggcgagataccgtggagacttcctccgattcagtaatcgctgagatagcaagaaggcgcaacgacggtcaggccagctcttcgcccccatccgagtccatggggcaagccaaagattcgataaaagccgcagagtcacactggggcctaccagtacaaaagctcgaaaaggtcaaccagacccagcccgaagatacgagcggacagcagaagccacatccaggagagagattaaaaactggtctgctttcgcgatcccccgtatgcagttgcgaaagcgctagcccctgccccaaacagagcccccgagtggccaagacccaacagaaaagacgaaattgttctagcgccgaggatttcgatcaccatggcagagtgtctctcggctccgaccgtctcgtgccacgcgagatcattgtggaaaaaagcaaagcggtcagagttctgccagctagcgagctgtctgaccccggtttactcctcaaacaggatctggccaagacaacgagcaaagaggagttgcacgttcttgagtccctctcttcccggcatcttatgaagaataatcccggacaggcacagcagacgggcctcgctactaacacagagagactgagcactattcaaaatagtcccaccaagaaacgcaaaaaatatgagcggggtcactag

SEQ ID NO: 54273 - DNA, 1092 bp, Artificial Sequence
  Description of Artificial Sequence: Synthetic coding sequence
atggcccacgtcttacaaaagccgaagcactcaggtacacactctattgttcaggaattccaagtacccgattatgtaccttggcagcagtctaagcaggagactaagccttccactctgcctcccgtgcaacaggctaattccttgcacacttccaagatgaagacattgacgcgcgttcaacctgtgttccacttcaagccgacgacagtagttacatcctgccagccgaagaacccacgggagcttcaccgtagacgaaaactggatcctggcaagatgcacgcaaagatctggctcatgaaaacctctctgcgctcaggacgtgccgctttgagggagctgagatcgcgagagaacttcctttctaagcttaatagagaacttatagaaacaatacaggagatggagaactccaccactctgcatgtccgggcactcctgcagcagcaggacaccctggccactatcattgacatcctcgaatacagtaataaaaagagattacagcagctgaagagcgaactgcaagagtgggaggaaaagaagaaatgtaaaatgtcttatctagaacagcaggccgaacaactgaatgcaaagattgaaaagacacaggaggaagtaaattttttgtcgacatacatggaccatgagtactcaatcaagtctgttcagatctcaaccctgatgaggcaactccagcaggtgaaagactctcagcaggacgagcttgacgacctcggagagatgcgtcgtaaggtactggagagtctatctgataagatccagaaaaaaaaaaaaaaaatcctgtcgagcgttgttgctgagacacagcggccttacgaggaggcgctcttgcagaagatgtgggagtcacaggactttctgaagtgcatgcaacgatttcgtgagattattgaccagttcgaggagaatatgccagtgctgcgcgctgaagtcgaagagttgcaggctcaaacccgtgagccacgcgaggtgatctttgaggatgtccttctgcgcaggcccaagtgtaccccagatatggacgtgatcctgaacatccccgtggaggagccgcttccgttctag

SEQ ID NO: 54274 - DNA, 987 bp, Artificial Sequence
  Description of Artificial Sequence: Synthetic coding sequence
atggaagtcctatctcttcccaactccttccaaacccaggcgctgtgggatagcctgcattcccctggggtgcctggtagtgtcttccacttcaaacctaccaccgtggttacgtcctgccagcctaaaaacccccgtgagctgcaccgccgaaggaaactggatccagggaagatgcatgccaaaatctggctcatgaaaaccagtcttagaagtggcagggccgcactgagagagcttcgatctcgcgagaacttcctgagcaagctgaatagagaattaatcgaaacaattcaagaaatggaaaactccacaaccctccacgtccgagctctcttacagcaacaggacacactggccaccataatcgatatcctggagtattccaataagaagcgtctccagcagctgaagtctgaactccaggagtgggaagagaagaaaaagtgcaaaatgagttacttggagcagcaagcagaacagctcaatgccaagatagagaaaacacaggaagaagttaactttctctccacatacatggatcacgagtatagcattaagagcgttcaaatctccacattgatgcgacagctgcaacaagttaaagattcacagcaagatgagctggacgatctgggggagatgagaagaaaagtcttagagtctcttagtgacaaaattcagaagaaaaaaaagaaaatactcagctccgtggtggcagaaactcagcgcccttacgaagaggcgctgctccaaaaaatgtgggaaagccaagattttctgaagtgtatgcagagatttagagagatcatcgatcagttcgaggaaaacatgccggtgctgcgcgcagaagtagaagagctgcaggcccagacacgggagccacgtgaggtgatctttgaagacgttttgctgcgccgaccaaaatgtacccctgatatggatgtgattctgaacatacccgtggaggaaccgctacccttttag

SEQ ID NO: 54275 - DNA, 771 bp, Artificial Sequence
  Description of Artificial Sequence: Synthetic coding sequence
atgagctacaagatgtttcatttcaaacccaccacagttgtcaccagctgtcagcctaaaaacccacgggaactgcatcgaaggcggaagctggatcccggaaagatgcacgccaagatctggctgatgaaaaccagtctcagatccggaagggcagctttgcgggaattgcggtcaagagagaattttctgagcaagttgaaccgcgaattgatcgagacaatccaagaaatggaaaattctaccaccttacatgtccgcgctctgctgcaacagcaggacacgttggcgacaattatcgacatcctagagtactccaataagaaacggctacagcaattgaagtcagagctgcaggagtgggaggagaaaaaaaagtgtaaaatgtcctatttggaacaacaggcggagcagctcaacgccaagatcgaaaaaactcaggaggaggtgaacttcttgtccacctatatggaccatgagtattccattaagtctgttcagatcagtacactgatgcgccagttgcagcaggttaaggacagccagcaggacgaactggacgacttaggggaaatgcgaaggaaagtgcttgaatccctttccgacaaaattcagaagaagaaaaagaaaatcctttctagtgtcgtcgccgagacccagcggccatacgaggaagctttgttgcagaagatgtgggagagccaggacttcctcaagtgcatgcagagattcagggaagtcagaggccagggtaggtggtggagtctctag

SEQ ID NO: 54276 - DNA, 186 bp, Artificial Sequence
  Description of Artificial Sequence: Synthetic coding sequence
atgggcagggcagatacgccgcgtcacccccctccccctgccgcaggctttggtgtgcatagaggtgcttttttaattcctgtggcactaagggtgctgctggctgggcgaacacctcgcccatttacccccggacttgcagacccaaggcgtttggggccacgcagggttcaggccgctcagtag

SEQ ID NO: 54277 - DNA, 225 bp, Artificial Sequence
  Description of Artificial Sequence: Synthetic coding sequence
atggaaagagctcagtgcctccgtaaggggatactctctttcgaacgcagtcttgaacagcgttcgctgattttgtcacctcggctggaatattcaggggcaattactgcacactgtagcttagacctgctggattctacaaaccctcctgcttcagctttttgggtggtggagaccaccgacaccgaggatgagcgggagaagaagagagagatcaccgagtag

SEQ ID NO: 54278 - DNA, 240 bp, Artificial Sequence
  Description of Artificial Sequence: Synthetic coding sequence
atgcaccatgtccggcagctgatgatgccgatttgtccaatggccttaaattctaccacgagctcatcaacaactttcggggcttttcgaatcatgaccctgaatgtcgaggagtgggcgacagcctggaaggttctgattctgctcgaagccgctgtggaagaagagaaacgatcagaagaaaagaggatactggtgtgtggcacttgtggcacccgcagctctcaaaagaacttatag

SEQ ID NO: 54279 - DNA, 240 bp, Artificial Sequence
  Description of Artificial Sequence: Synthetic coding sequence
atgcatcacgtgcgacaactcatgatgccaatttgcccgatggcccttaattccaccacatcatcaagcactacattcggagcatttcgtatcatgaccctgaatgtcgaggagtgggccacagcttggaaggttttaattctacttgaggcggctgtggaggaggagaagaggagcgaagaaaagcggattctcgtgtgtggaacgtgtggcacccgttcctcccaaaagaacctttag

SEQ ID NO: 54280 - DNA, 327 bp, Artificial Sequence
  Description of Artificial Sequence: Synthetic coding sequence
atgctcgctaagggagccgaagagggcagaagcggcggtccacgccctgccataacactgcccggatccttacactttacctgcgacctgaagacatccccttactgtcttactcgggcagagctgatggaacatttgcccctgcgcgtggcagtccatagcatgtccccctgccataggtcttgtttctgcggggagctcaaacgcggacacccctggaacacccctcaggtgagttctttcccctcctctaccacctcactctcccactcttgcaccacgtcacacttggattgctcccaacaagtggagtcaggatcaaagtag

SEQ ID NO: 54281 - DNA, 327 bp, Artificial Sequence
  Description of Artificial Sequence: Synthetic coding sequence
atgctggcgaaaggcgcagaggagggtagaagcggaggacctcggccagcaattacccttcctggtagtcttcacttcacatgcgatctgaagacctccccttactgcctgacccgcgcagaactgatggaacatctgccgctgcgcgttgcggtacacagtatgagcccttgccacagaagctgcttctgcggagaacttaaaaggggtcacccttggaacaccccccaggtgagctcttttccgtcgtcgactacttccctgagccactcatgcacaacatcacatttggattgcagtcaacaagttgagtcaggttctaagtag

SEQ ID NO: 54282 - DNA, 969 bp, Artificial Sequence
  Description of Artificial Sequence: Synthetic coding sequence
atggccaggtcccggttgccagctaccagcttgaggaaaccttggaagttggatagacagaaactgccctcacctgatagtggacattccctgttgtgtggctggtctcctggcggtaaggccaggcctgcaggaaatactggggcttgggcacctgccgaacaattttttcctgcctcgaatcgaacgagagagggcggtggactatggcccccactgcctcttcagagctctccggcagccccaacaatgctcgactcaagcgcagccgagcaggtcactagacttaccctgaaactactgggtcagaaactggaacaggagaggcagaatgtagaaggaggccctgagggcctccacctggaaccaggaaacgaagataggcctgacgacgccttgcagactgccctcaagaggaggcgcgacttgctgcagcggctgagagagcaacaccttttggatgaactaagtcgagctcaagcctggagcggaccctcccggggtgcgcttgggagtgctttaccccctgagttgccccctacaggcatccttcctaccgccagtcctagcccactggcacccgaccctccacggatcattctgcccacagtgcctcagccccctgcgacaataatccagcagctgccgcagcagccacttatcgctcagatcccccctcctcaggccttccccacacagcgttcagggtcgattaaagaggatatggttgaattgctgctcctgcaaaatgcacaagtgcaccagctggttctacagaactggatgttgaaggcattaccgcctgcgttgcaggacccccctcatgtaccaccgagggtcccacgtgcagctcggcctaggctcccagctgttcaccaccaccatcatcatcaccatgccgtctggccgccaggggcagctactgtcttgcagccggctccgtctttgtggacaccagggcctccctag

SEQ ID NO: 54283 - DNA, 288 bp, Artificial Sequence
  Description of Artificial Sequence: Synthetic coding sequence
atgctggacagcagtgccgcagaacaggtaactcggctgacattgaaactgctgggtcaaaaactagagcaggagaggcagaacgttgagggtggccctgaggggctccacctcgagcccggaaatgaggataggcccgatgacgctctgcagactgctctgaagagacgacgagaccttctgcagcggctccgcgaggccacactcatgcacattacgttggaaggatctagcagtcatggacatcctgcacgccgaggtgcctgcacctggccacggctagcctag

SEQ ID NO: 54284 - DNA, 855 bp, Artificial Sequence
  Description of Artificial Sequence: Synthetic coding sequence
ggtaaggctcggccagccggaaacactggagcctgggccccagcagaacagttctttccagccagtaatcgcaccagggaagggggtgggctttggccacctctccccttgcagagcagtcccgctgccccaacaatgctggatagctctgcggctgagcaggtgactcgcctgaccctcaaacttttaggtcagaagctggagcaagagagacagaatgtggagggcggacctgaagggttgcaccttgaacccggtaatgaggatcgccctgatgatgctctacagactgcactgaaacggaggcgggatcttcttcagaggttgcgcgaacagcatctgcttgatgagctttctagagcccaggcctggtcaggaccaagcaggggcgcactgggaagcgcccttccacctgaacttcctccaaccggaattcttcccacagccagcccttcaccgctcgcaccggatcccccacgcataattttgccaactgtccctcaacccccagctacaatcattcaacagctcccccaacagcccctaattgctcagattcctccccctcaggccttccctacccagcgtagcgggtcgattaaggaggatatggtcgagctgcttctgcttcagaatgctcaagtacaccagttagtgctccaaaactggatgctgaaagcgctgccacctgccctgcaggacccgcctcacgttccacccagagtccctcgtgccgcaaggccccgactccccgctgtgcaccatcatcatcatcatcatcacgcagtgtggcctcccggagctgctacagtcttacagccagctccctctctctggaccccaggccctccttag

SEQ ID NO: 54285 - DNA, 660 bp, Artificial Sequence
  Description of Artificial Sequence: Synthetic coding sequence
atggccccacctagccggcactgcctgttgctgattagcacattgggagtgttcgccctcaactgtttcactaagggacaaaaaaacagcaccctcattttcacccgcgaaaataccatcagaaactgtagctgttccgctgatatccgcgactgtgattactccctcgccaatctgatgtgtaactgcaagaccgtcttgcccctggccgtggagaggacgagctacaacgggcatttgacaatctggtttaccgataccagcgcccttggccatctcctaaattttaccctggtccaggacctgaagttaagtctctgcagtactaatactctgccaactgagtacctggcaatatgtggccttaagagactgagaattaatatggaagcaaagcatccattccccgagcagagtttgctcatccactctggcggagattctgactccagagagaagcctatgtggctccacaagggttggcagccctgcatgtacatctcatttctggatatggcactttttaaccgcgattccgctttcaaaagttacagtatcgaaaatgtgacttccatcgcaaacaatttccccgatttttcctactttcggacctttccaatgcccagtaataagagctatgtggtcacattcatatattag

SEQ ID NO: 54286 - DNA, 660 bp, Artificial Sequence
  Description of Artificial Sequence: Synthetic coding sequence
atggctcccccaagccgccactgtctgttattaatcagtaccctgggtgtgtttgctctcaattgtttcacaaaaggccaaaagaacagcacacttatcttcactcgtgagaacactattcggaactgcagctgttccgcagatatcagggactgtgattatagtcttgcaaacctcatgtgcaattgcaaaactgtgcttccacttgcggtggaacgaacaagttacaatgggcatctgacaatctggtttaccgatacctccgcacttggccacctgctgaactttaccttagtgcaagacctcaagttgagcttatgctccacaaacacattgcccacggaatatctcgccatctgtggcttgaagaggctgagaataaacatggaggcaaaacatcctttccctgagcagagcttgctgattcattcgggcggtgactccgatagtagagagaagccaatgtggttacataagggttggcagccatgtatgtacatttcatttctcgacatggctctctttaaccgagatagcgccttcaagtcttatagtattgagaacgtcacttccattgccaacaactttcctgacttcagctattttcggacatttccaatgccctccaataagagctatgtggtgactttcatttactag

SEQ ID NO: 54287 - DNA, 660 bp, Artificial Sequence
  Description of Artificial Sequence: Synthetic coding sequence
atggccccaccctctaggcattgtcttctgttaatctctaccctgggggtattcgccctgaattgctttacaaaaggacagaagaattccactttgatattcacaagagagaacacaatccgtaattgttcttgcagcgcggacatcagagactgcgattacagcctggcaaatttgatgtgtaactgtaagacagtgctgcctcttgcagtggagcgtacctcctacaatggtcatctgacaatctggtttactgacacttccgcactgggacacctgctgaattttacactcgtgcaggacctgaaactcagcctgtgtagcacaaacactttacccaccgaatatttagctatatgcggtctcaagcggctccggatcaatatggaggccaagcatccctttccagaacaatcattgcttatccatagcggtggagatagcgatagtagggaaaaaccaatgtggctgcacaagggctggcaaccctgcatgtatatctctttcctggatatggccctcttcaatcgcgactcggcatttaaaagctactcaatcgagaatgtgacaagcatcgctaataatttcccagacttttcctatttccgaacttttccaatgcctagcaataagtcatacgtcgtaacctttatttactag

SEQ ID NO: 54288 - DNA, 660 bp, Artificial Sequence
  Description of Artificial Sequence: Synthetic coding sequence
atggctcccccatcacgccactgtctcctgctgatctctaccttaggcgtattcgcgctcaactgttttactaaaggacaaaagaattctactctaatttttacgcgcgagaacacaattcggaattgtagttgctccgctgacattcgcgattgcgactactctctggctaatttgatgtgcaactgtaagactgtacttccactcgcagtggagcgcacctcctataacggacacctaactatttggtttaccgacacatcggcccttggccaccttctcaatttcaccctggttcaagacctgaagcttagcctgtgttcaaccaatacactgccaactgagtacctcgccatctgtggattgaagaggttgagaattaacatggaagcgaaacatcctttccccgagcaaagcttgttgatccactctggaggggacagcgattctcgcgaaaaacccatgtggctgcacaagggctggcagccctgcatgtacatttcatttctggacatggctcttttcaatcgggactctgcattcaaaagttattctattgaaaacgtcactagtattgctaacaacttcccggactttagttacttccgcacttttcccatgccttccaataagagctacgtggtcaccttcatatattag

SEQ ID NO: 54289 - DNA, 198 bp, Artificial Sequence
  Description of Artificial Sequence: Synthetic coding sequence
atgggaaatcctaggctgcctagactgctttgtgctctgaagttcagcggttttctatccaatatccggggacccctggctggagaggatggtatgggtgatacacagctggctcgagtgcgggattcggccctgaagacaccctggaggcccgctccctgccctcctccagcacattctctagacgattggaaatag

SEQ ID NO: 54290 - DNA, 894 bp, Artificial Sequence
  Description of Artificial Sequence: Synthetic coding sequence
atgaatgaggaggagcagtttgtgaatatcgaccttaatgatgataacatctgctccgtttgcaagctgggcacagataaggagacgctgagtttctgccacatttgctttgaactgaatatcgaaggggttccaaagagtgacctccttcacacaaaatcattgcgcggacataaggattgcttcgaaaagtaccatctaatagctaaccaggggtgtcctcgctccaagctctcaaagtctacatacgaggaggtaaaaactatcctgtctaagaaaatcaactggatagtccaatacgcgcagaacaaagatcttgatagcgactctgaatgcagcaagaacccccagcaccatctgttcaatttccggcacaaacccgaggaaaagctcctgcctcagtttgattcacaagtacccaaatattcagcgaagtggatcgatggatccgcgggaggcatctctaattgcacccagaggattctggaacaacgtgagaacaccgattttggactgagcatgctccaggactcaggagctacattgtgcagaaacagcgtcctgtggccccatagccacaatcaggcacaaaagaaggaggaaacgatctcctctcctgaggccaatgtacagacacagcacccccattatagccgggaagagttaaacagtatgaccctgggcgaagtggagcagctgaacgctaaactcctgcaacagatccaagaagtgttcgaagaattgacacatcaggttcaagagaaagatagtctggcttcacaactccacgtgcgtcatgtggcgatagagcagctgttaaagaattgctccaagttaccctgtcttcaggtgggcaggaccggaatgaagtcccacctcccgatcaacaattag

SEQ ID NO: 54291 - DNA, 891 bp, Artificial Sequence
  Description of Artificial Sequence: Synthetic coding sequence
atgaacgaagaagagcagtttgtaaatatagacctgaatgatgacaacatatgttccgtctgtaagttgggcactgataaagagacgctgtccttttgtcacatctgctttgagttgaacattgaaggcgtccccaagtctgacctcctgcataccaaatctctgagaggtcacaaggattgtttcgagaagtatcacctgatcgcaaatcagggttgcccacgctcaaagctcagtaagtctacgtacgaggaggtcaagactatcttgagcaagaagattaattggatagttcaatatgctcagaataaggacttggatagtgattcagagtgtagtaaaaatcctcaacaccacctgtttaacttccggcacaagcctgaagaaaaattgctgccccagttcgatagccaggtcccgaagtattccgccaagtggattgatggaagtgctggcggtatctctaactgcacacaacgtattcttgaacaaagggagaacacagactttgggttaagtatgctgcaggactcaggggcaaccctttgccgaaactcagtgctttggccccattcacataatcaagcccagaagaaggaagagactatttcaagcccagaagcaaacgtacaaacacaacatccgcattactcccgtgaggagctgaactctatgactttgggcgaggttgagcagttgaacgctaaactgttacagcagatacaggtgtttgaggagctcacacaccaggtgcaggagaaggattccctggcctcccagttacacgtgcgacatgttgcgatcgagcagttactgaagaactgctctaaattaccgtgcctccaggtgggcagaacggggatgaagtcacaccttcctattaataattag

SEQ ID NO: 54292 - DNA, 729 bp, Artificial Sequence
  Description of Artificial Sequence: Synthetic coding sequence
atgaatgaagaggagcaatttgtgaacattgacctgaacgatgataacatctgttctgtgtgtaagttgggtacggataaggaaaccttgtctttttgccacatctgctttgagttgaatattgagggcgtgccgaagtctgacttactccacactaaaagccttagaggacataaggactgcttcgagaaatatcacctgattgccaaccaggggtgtccgaggtccaagttgtctaagtcgacctacgaggaggtcaaaactatcctatccaaaaagatcaactggatcgtccagtacgctcagaataaggacctggattccgactctgaatgttcgaaaaacccccagcaccatctgttcaactttcggcacaagcccgaagaaaagctgcttcctcagttcgattctcaggtgccaaaatattctgccaagtggatcgatgggtctgccggaggcataagcaattgtacccagaggatcctggagcagcgggagaacacggactttgggctcagcatgctgcaggattctggggcaaccctgtgtcggaacagcgtcctctggcctcattcccataaccaggcccagaagaaagaagaaactatcagttccccagaagctaacgtccagacccaacacccacactatagccgcgaagagctcaattcaatgactctgggagaggtggagcagctcaacgctaaactcttgcaacagattcaatag

SEQ ID NO: 54293 - DNA, 666 bp, Artificial Sequence
  Description of Artificial Sequence: Synthetic coding sequence
atgaatgaggaagagcaattcgtgaatatcgatctgaacgatgacaacatatgtagcgtctgtaaactgggtacggataaagagactctctcgttttgccacatatgctttgaactcaatatcgaaggagtgcctaagtcagacctgcttcacacgaagtctttacgcggtcataaggattgtttcgagaagtaccacctgatcgcaaatcaaggctgccctcggtcaaagctgagcaagagcacgtatgaagaggtcaagacaattctgagcaagaaaattaattggatagtgcaatatgcacaaaataaggatttagatagcgactccgagtgcagcaagaatccccagcatcaccttttcaacttccgccataagccagaagaaaaacttttgccccaatttgactctcaagtgccgaaatatagcgccaagtggatcgacggcagcgccggaggaatttccaactgcactcaacgtattctggaacaaagggagaacaccgactttggcttgtccatgcttcaggactccggagctacattatgtaggaatagtgttctgtggccacattctcataaccaggcccagaaaaaggaggagacaatctccagtccggaggcaaatgtgcagactcagcatccccactatagtagagaagagtag

SEQ ID NO: 54294 - DNA, 723 bp, Artificial Sequence
  Description of Artificial Sequence: Synthetic coding sequence
atgcgcaccgaggcagaggccgctgggcctcctttagagcctggggatttcgtgcagctgccagtgcccgtgatccagcagttgtaccattgggattgtgggttggcatgctctagaatggttttgcgttatctggggcagctggacgattcagaatttgagcgcgcattgcaaaaacttcagctgactagaagcatttggaccatagatcttgcttacctgatgcatcacttcggtgttcgccataggttttgcacgcagaccttgggtgttgacaaaggctacaagaatcagtccttttaccgcaaacactttgatacagaggagacccgggtcaatcaactgttcgcacaggcaaaggcctgtaaagtccttgttgagaagtgtacggtctcagtgaaggatattcaggctcacctggctcaagggcacgtggcaatcgtcttggttaattcgggtgtcctgcattgtgacttatgctctagccctgtcaagtattgttgttttacgccgtccggtcaccattgcttttgccggacaccggattaccagggccacttcattgttttgcgcggatataaccgtgcaaccggctgcattttctataataaccctgcttatgccgaccccggaatgtgctcaacatctatttccaactttgaggaggccagaacttcttacggcaccgatgaggacatcctgtttgtatacttggatagctag

SEQ ID NO: 54295 - DNA, 384 bp, Artificial Sequence
  Description of Artificial Sequence: Synthetic coding sequence
atgagaacagaggccgaagctgccggtcccccactggagcctggtgactttgttcagctcccagttccagtcatccagcagttataccattgggattgtggattagcttgctcacgcatggtgctgcgataccttggacagctggacgattccgaatttgaacgcgctctacaaaagctgcagttgacccggtcaatctggaccatcgatttggcgtacttaatgcaccattttggagtacgtcacagattttgtactcagaccctcggggtcgataaggggtataagaaccagtcattttaccggaagcactttgacactgaggagacccgcgtcaaccagctgttcgcacaagctaaagcctgtaaggtccttgtggaatag

SEQ ID NO: 54296 - DNA, 429 bp, Artificial Sequence
  Description of Artificial Sequence: Synthetic coding sequence
atgttcataaaggtgatgtttggagctggttgttctgtattggtgaacacgtcatgcagactggtaaatctgacagcccatctcagacaaaaggcaggtctccccccagacgccacaatagccctgctcgccgaggacggcaacctcgtgtctctcgaagaagacctgaaggaaggggcttctagagctcagacaatgggcaattctttgcttaaggaacgagcaatctacgtactagtgcggataatctcgaaggttgcacaagagggggaggatatggcttctaccaggtatgagagcctgctggaaaatctggacgaccactatcccgaactggctggcgcaaaccgtcagcagccctctcgcacaccgttggccgagagtggtatagccgagaagcttcatcagcaggaggggcaagggcagtag

SEQ ID NO: 54297 - DNA, 429 bp, Artificial Sequence
  Description of Artificial Sequence: Synthetic coding sequence
atgtttatcaaggtcatgtttggcgcagggtgctcagtcctcgtgaatacaagctgtagattagtcaatctgacagcccatctgcggcaaaaagctggacttccaccagatgctactattgcccttctcgccgaagacgggaatttggtgagtctggaggaggaccttaaggagggagctagccgcgcacagacaatgggaaactctctcctaaaggagagagcaatctacgtgctcgttcggatcatatcaaaggtggcccaggagggggaggacatggccagtacacgatacgagagtctcctggagaacctcgacgaccattacccagagttggccggagccaatagacagcagccatctagaaccccgttggccgaaagtggaattgcagaaaagctgcatcagcaggaaggccaagggccttag

SEQ ID NO: 54298 - DNA, 447 bp, Artificial Sequence
  Description of Artificial Sequence: Synthetic coding sequence
atgtttattaaagtgatgtttggcgctggatgctcagtgctggtgaatacgagttgcaggctggtgaatctgaccgctcacctgaggcagaaggcgggtcttcctccagatgccactatagctctactcgccgaagacggaaacctcgtttcccttgaagaagacctgaaggagggtgctagtcgggcacagaccatggggaattctctactgaaggaaagagccatttacgttctggtgagaatcataaagggagaggacatggcatctacccgctacgagagtttactcgagaacctggacgaccactaccccgagctggctgaggagttgagaagattgtccggactctcttccgtgggacataattggaggaaacgcatgggaactcgcaggggcagacatgaacaatcgcccaccagccggcctagaaaaggccctgactag

SEQ ID NO: 54299 - DNA, 654 bp, Artificial Sequence
  Description of Artificial Sequence: Synthetic coding sequence
atggcaagccagaagcagatggaagtagttacaaaggggaccggattcaggaggcgccctaagactattacatatacccctgggacatgcgagctgctgcgcgtgatgatgaaggaaagcaagctaacgaacatacaacaacggcacattatggacatcatgaagcggggtgacgccctgccgctgcaatgctctccaacctcgtcacaaagagtcctgcctagcaagcagattgcttcaccaatttacttgccgccaatccttgctgcgcgtccgcaccttcgtccagccaatatgtgccaggcaaatggtgcctatagcagggagcagtttaaaccccaagccacaagagatctggagaaggagaagcagagattgcagaacatctttgccaccggaaaggacatggaagagagaaaacgcaaggcgccaccagctagacaaaaggctccagcgccagaattggacagatttgaagagctcgttaaggagatccaagagcggaaagaattcctggccgacatggaagccctgggccagggcaagcaatataggggcattatcttggcagagatatctcaaaagctgagggagatggaagatattgatcaccggaggagcgaggaactgcgtaaggggttagcaactacatag

SEQ ID NO: 54300 - DNA, 654 bp, Artificial Sequence
  Description of Artificial Sequence: Synthetic coding sequence
atggcctctcagaaacaaatggaggtggtgaccaagggtactggattccgacggcgtccaaagacaatcacatatacccccggtacgtgtgagctcctgagagtgatgatgaaggaatccaaactcactaatattcagcagcgccacatcatggatatcatgaaaaggggagacgctctgccactgcagtgcagtccgactagttcccaacgagtgctccctagcaagcagattgcatcaccaatctatctaccacctatcctggctgctcgcccacacctgaggcctgcaaacatgtgtcaagccaatggtgcttacagccgtgagcagttcaaacctcaggctactcgtgacctggagaaagagaagcaaagactgcagaacatctttgccacaggcaaagatatggaggaacgcaaaagaaaggcccctcctgccaggcagaaagcgccagccccagagctcgaccgcttcgaagagcttgttaaggaaatacaggagaggaaggagtttctggctgacatggaggcgctaggacagggcaagcagtatagaggcataattctggctgaaataagccagaaacttagagaaatggaggatatagaccatcggaggagtgaggaactcaggaagggactggcgactacctag

SEQ ID NO: 54301 - DNA, 654 bp, Artificial Sequence
  Description of Artificial Sequence: Synthetic coding sequence
atggcctctcagaagcaaatggaggttgttactaagggcacaggattcaggaggcgtcctaagacgatcacctatactcccggtacctgcgagctgctgcgtgtgatgatgaaggagagcaaactgactaacattcagcagaggcacattatggacattatgaagcgtggggatgcccttccactgcaatgtagcccaaccagttcgcagagagtcctgcctagtaagcagatcgcttcgcccatatacctgcccccaatattagctgcgaggccacatctgcgaccagcgaatatgtgccaggcaaatggcgcttactctagggagcagttcaaacctcaagcaacgcgggacttggagaaggaaaagcagagactgcagaacattttcgccactggaaaagatatggaggagcgaaagcggaaagccccaccagctaggcaaaaggctcccgcacccgagcttgaccgctttgaggagctggtcaaggagattcaggagagaaaggagttcttggccgatatggaggccctcggacagggcaaacagtaccgcggaattatcttggctgagattagccagaagttgcgggagatggaagatattgatcaccgacgaagtgaagaactgagaaagggactggccacaacgtag

SEQ ID NO: 54302 - DNA, 489 bp, Artificial Sequence
  Description of Artificial Sequence: Synthetic coding sequence
atggccagccaaaagcagatggaggtagtgacaaagggcaccggcttccgcaggagacctaaaactataacctacacacccggtacttgtgaactgctcagggtaatgatgaaagaaagtaaattgaccaatattcagcagcggcatatcatggacatcatgaaacgcggagacgctctgcctctccagtgcagtcctaccagttcccagcgcgtgctgccatccaagcagatcgcctcacctatctacctgccaccaattctcgccgcacgtccacaccttcggcctgcaaacatgtgccaggctaatggagcctactcccgagagcagtttaagccacaggcgactagggacctggagaaggagaaacagaggctccagaatattttcgcaaccggcaaggatatggaggagcgcaaaaggaaggccccaccagctcgacagaaagcacctgccccagagctggaccgcttcgaagagctggtgtag

SEQ ID NO: 54303 - DNA, 363 bp, Artificial Sequence
  Description of Artificial Sequence: Synthetic coding sequence
atggcaagtcagaaacagatggaagttgtgaccaaggggacgggcttccgcaggcgacccaagaccatcacatatacaccaggcacctgtgaactgttgagggtaatgatgaaagaaagcaaattaactaatattcagcagcgccatatcatggacattatgaaaaggggagatgccctccctctccagtgctccccaacctcaagccagcgggtgctgccttccaagcagatcgcatctccaatctacctgcccccaatcctggcagccagaccacacctgagacccgcaaacatgtgccaggcaaacggcgcttactctagggagcagttcaagcctcaggcgacacgcgacttggaatag

SEQ ID NO: 54304 - DNA, 417 bp, Artificial Sequence
  Description of Artificial Sequence: Synthetic coding sequence
atgccggcatccgcaaccgcggcttggcactgcccaccattgtgtctcccgcctctcccagcgtctgctccaacaagtcctcccaatcccgctacgcggcctgcacccggtccaggacggagagcccgttgcccccagagtgctcaccctgctcctacacggggagccctgacattttgggccccaggctcctggcctcgggtcctgcttgtgcctcgcagcccgggacctgtcttgagggctccaagactgccacatcccgcagcaagggctcgcagacgagcctggcacggcgcacgcctgccaggctccccagcgcgagctgggagaacgtttcaaaggggcctcgtttccaactcttgggctcacgccatttttctgcctcggccacctaacgttctcgagctccaagtgtag

SEQ ID NO: 54305 - DNA, 417 bp, Artificial Sequence
  Description of Artificial Sequence: Synthetic coding sequence
atgccagccagtgctaccgcggcttggcactgtcctcccctttgcctcccccctttgccagcatcagcccctaccagcccccctaacccagcaacacgcccagcccctggccctgggcgacgggctcggtgcccacaatcagctcatccggctcctactagaggagccctaacattctgggccccaggcagctggccacgcgttctgctggtaccacgcagcccgggaccagtgttaagggctcctcggctccctcaccccgctgcccgagctagacggagggcctggcacggcgctcgtctgccaggatccccggctagggcaggcagaacctttcaacgcggtctagtcagcaacagctgggcacacgcaatctttttgcctaggccaccgaacgtgctggaattgcaggtgtag

SEQ ID NO: 54306 - DNA, 1095 bp, Artificial Sequence
  Description of Artificial Sequence: Synthetic coding sequence
atgccacgaggaaggtgccgccagcagggtcccagaatccctatttgggcggctgctaactatgccaacgctcatccctggcagcagatggacaaggctagtcctggagttgcttatacacccctggtagatccttggatcgaacgtccttgctgtggtgacaccgtgtgtgtcaggaccacaatggaacaaaagtccactgcatcaggaacatgcggaggaaaacctgccgagcgcggacccctggccggtcatatgccatcttcccggcctcatcgcgttgatttttgctgggtgcccggttcagaccccggaacctttgatgggtccccatggctgctggatcgatttctcgcacagctcggcgactatatgtctttccattttgagcattaccaggataacatctcaagggtatgtgagattctcagacgtctcactggtcgcgctcaggcctgggccgctccatacctggacggagatctgcccctgcccgatgattatgaactgttttgccaggatctgaaagaggtggttcaggacccaaactctttcgctgagtaccacgcagttgtgacctgtcccctgcccctggcttccagccagctgccggtggcccctcaactgcccgttgtccgacagtatttagcgagattcctagaaggcctagcactggacatgggaacagcacccagatctctccccgcagcgatggccactcccgctgttagcggttctaactccgtgagcagatcagcgttgttcgagcagcagctcactaaggaatcaaccccagggcctaaagaaccacctgtattaccttcttctacctgcagttccaagccaggacctgtagaacctgcatcatcacagcccgaggaggccgctcctacacctgtgccccgtctgtctgagtcagcgaaccccccagctcagcgtcctgaccctgctcatcccggtggtccaaaacctcaaaagaccgaggaagaggtgctcgaaaccgagggtgatcaggaagtgtccttggggaccccacaggaagtggtggaggctcctgaaacccctggggagcctcctttatctccagggttctag

SEQ ID NO: 54307 - DNA, 1095 bp, Artificial Sequence
  Description of Artificial Sequence: Synthetic coding sequence
atgcctcgcggtcggtgccgccaacaaggacctcgcattccgatatgggccgctgccaattacgcgaatgcccacccctggcagcagatggacaaggcatcacctggggtagcatacacaccactggtcgacccatggattgaacggccttgctgcggagatactgtctgcgtgagaactactatggaacagaaaagtacagcatccgggacttgcggagggaagcccgcagaacggggacctctcgccggacacatgccaagtagcagaccacaccgcgtggacttttgctgggtgccaggctcagaccctggcacctttgacggctcaccatggttgctggaccggtttctggcacaattgggagactacatgtccttccatttcgagcactaccaggataacattagccgagtttgcgagattcttaggaggcttaccgggagggcgcaggcttgggctgctccataccttgacggcgacttgcctcttcccgatgattatgagttgttctgtcaggatctgaaggaggtcgtacaagaccctaactctttcgccgagtaccatgcagtagtcacttgccccctccccctagccagtagccagctgcccgttgcaccccagttgcccgtggttagacagtacctggcacggtttttagagggccttgccttagatatggggaccgctccccgaagcctccctgctgccatggccacacctgccgttagcggatcaaattccgttagcagatccgcgctgttcgagcagcagctcaccaaggaaagcacgccgggaccgaaagagcctcccgtgctgccctcatccacttgtagcagcaagcccggaccggtggagcctgccagctcccagcctgaggaagcagcacctaccccagttcctaggctcagcgagtcggctaatcctcccgcacagcgtcctgaccccgctcatccgggaggcccaaaaccccagaaaacggaagaggaagttttagagacggagggggaccaggaagtatccttgggcacaccccaggaggtggtagaggctcctgaaacccccggagagcctcctttgtcgcccggtttttag

SEQ ID NO: 54308 - DNA, 1095 bp, Artificial Sequence
  Description of Artificial Sequence: Synthetic coding sequence
atgccacgcggaagatgtcggcagcaggggcctcgcatacctatttgggctgctgccaattatgctaacgcccatccctggcagcagatggataaagcatcgccaggggtggcctacactccactagtggatccctggattgagaggccttgttgcggagacacagtctgcgtccgcaccactatggaacagaagtcaactgcatcaggcacctgcgggggaaaacccgctgagcgtgggccacttgctgggcacatgcctagcagccgtcctcacagagtggacttttgctgggtgccaggatcagacccgggtaccttcgacggatctccctggctgctggacaggttcctcgctcagctcggggactacatgtcattccacttcgaacactaccaggataatatcagcagggtctgcgagattctcagacgcctgacaggaagagcccaggcttgggcggcaccctatctagacggagacttacctctgcctgacgactatgagctgttctgccaagacttaaaggaggtggtccaagacccaaacagcttcgcggagtatcacgctgtcgtgacttgtccactgccactagcctcctcacaactcccagtggcacctcaactgcctgtcgtgcggcagtacctagctagatttctggaaggactcgccctagacatgggtaccgctcctcggtctctcccagctgcaatggccacacctgccgtttctggctcaaactcggtgtcacgcagcgctctttttgaacaacagttgactaaggagagcacgcccggtcctaaagagccacctgtgcttccttcctctacttgcagctcgaaacccggacccgtggaacccgcttcatctcagccagaggaagcggcacccacacctgtaccccgactcagtgaatccgccaatcctccagcacagaggcccgaccccgcacatcccggtgggccaaaacctcaaaagactgaagaggaagtactcgaaactgaaggggaccaggaggtctcactggggacacctcaggaagtggttgaggcgccagaaacaccgggagaaccgcctttgagcccaggcttctag

SEQ ID NO: 54309 - DNA, 318 bp, Artificial Sequence
  Description of Artificial Sequence: Synthetic coding sequence
atgggagaaactgagggcaagaaggacgaagccgactataagcggctgcaaacattccctctggttcgacacagcgatatgcctgaggagatgcgcgtggaaaccatggaactatgcgtcactgcttgtgagaaattttccaacaacaatgagagtgcggctaaaatgatcaaagaaaccatggataagaagtttggttccagctggcatgtggtcattggcgagggctttggattcgagatcacacacgaagttaagaaccttctttatctgtacttcggcggaacacttgcagtctgtgtctggaaatgctcttag

SEQ ID NO: 54310 - DNA, 843 bp, Artificial Sequence
  Description of Artificial Sequence: Synthetic coding sequence
atggagctcggacatggcgctgggaccactactttcactagagcccatctgaatgataaggagggtcagcaggatctcgacccatggaaagctgcgtactcttctcttgacacctctaagtttaagaaccagggactgtcctctccacagcccttacccctgggggcaagtgcccagggaagttctctgggccagtgccatctgaaggagattccgccaccacctcctactgccgctagcagagactcgcttggaatggatccacagtcccgctcactgaagaatgcaggatcccgctcctcttcccgggagaatcgcgctacttctggagagggagcgcagccctgtcaggggactgacgatggaccatctttaggggcacaagatcagcgttccactcccacaaatcagaagggctcaatcatccccaacaatattcgacacaagtttggttctaatgtggtggatcagctagtttccgaggagcaggcgcagaaagctatcgacgaagtgtttgaaggacaaaaaagagccagctcatggccctctcgcactcagaacccagtcgaaatctcctctgtgtttagcgattactacgatctagggtataacatgaggagtaatctgtttcgcggtgcagccgaagagaccaagagcttaatgaaggcttcttacactcccgaagttatcgagaagtccgttagagatctggagcattggcatgggaggaagaccgatgatctgggccgttggcaccaaaaaaatgctatgaatcttaatctgcagaaagcactggaagaaaagtacggtgaaaacagtaagagtaaaagttccaaatattag

SEQ ID NO: 54311 - DNA, 588 bp, Artificial Sequence
  Description of Artificial Sequence: Synthetic coding sequence
atggatccacaatcccggtcgctaaagaacgccggttcaagatctagctccagggagaatcgagctacatccggtgaaggtgcgcagccttgtcagggaactgacgacggaccatcactgggggcacaggatcagagatctacacccactaatcagaagggcagtataatacccaataatatacgccacaaatttggaagtaacgtcgtagaccagctggtgtccgaagaacaagcccagaaggccattgacgaggtcttcgaaggacagaaacgcgcttccagctggccatctaggacacaaaaccccgtcgaaatcagttcggtcttctcagattattacgatctcggctataatatgcggagcaacctctttcgaggtgccgctgaggagaccaaaagcttaatgaaagcttcgtatactcctgaggttatagaaaagtcggtccgcgatctggaacactggcacggcaggaagacagacgacctgggcaggtggcaccagaaaaacgcaatgaatctcaacttgcaaaaggcattggaagagaagtatggtgagaactctaaaagcaagtcatctaagtactag

SEQ ID NO: 54312 - DNA, 843 bp, Artificial Sequence
  Description of Artificial Sequence: Synthetic coding sequence
atggagctgggccacggtgctggcaccacaactttcacaagggcccatttaaatgacaaggagggacagcaggacctcgacccatggaaggctgcctactcttctctggatacatcaaaattcaagaaccagggtcttagttccccgcagccacttcctcttggagctagcgcgcagggctcatcgcttggccagtgtcatctgaaagagattccacctccaccccctactgctgccagccgagactctttaggcatggaccctcaatccaggtctctgaaaaacgcaggttctcgatcctctagcagagagaatcgcgctactagtggagaaggtgcccaaccatgccagggcacggacgatggaccatcactgggcgcacaggaccagcggagcacgcctactaaccaaaagggatccataatcccaaataatattaggcataagttcggttctaacgtggtcgaccaactcgtttcagaagaacaagcccagaaagctatcgatgaggtgttcgaaggccaaaaacgtgcctctagctggccgtcccgcacgcagaacccagttgaaatctcatcagtgttctccgactattacgatctcggctataacatgcgttccaatctctttagaggggcagcagaggagactaagagtcttatgaaagcttcttacactcctgaggtgatcgaaaagtctgttagggacctggagcactggcacggcaggaagacagatgatcttggccgttggcatcaaaaaaatgctatgaacctgaacctgcagaaagctctcgaggagaaatacggcgagaattccaagtccaaaagtagcaagtactag

SEQ ID NO: 54313 - DNA, 552 bp, Artificial Sequence
  Description of Artificial Sequence: Synthetic coding sequence
atgatcgtgtttccagaaacgagccagcctcggttcctctactcactgcagaactacgccgtcagggatggtttggggacgatcctgcgcggaggtgccgaggaggggagctatgacaactggcctcataccagaaaaagttggggcccattgtctccaggccatcagagggagctttggactcagcccgacccctggactgaagttttgtccggtcacaagggagatgcaggtgcctgcggctgctgctgtttctgctcacagttcataaacgcgaggtgcgctcatccactctgtctcgcacggggactggatcggcgtgcgtccgaggagatgcccattctgcaggccctatgccttctgcctaaggaaaatctacatgacgcctcccgcagggtgcatcgcggtaggggggaggaaaacgttgaatggacgggtgatcttcatcctgctcagctgggcagggggggaagaccagagatctgccatagtctcgaagccattgcactggtcactaaggctcggcatcgaaagacaaacaccacattctag

SEQ ID NO: 54314 - DNA, 1089 bp, Artificial Sequence
  Description of Artificial Sequence: Synthetic coding sequence
atgtgcacagttgatgtggagggatttgatgatgtgggggagacgttgagcgacgctgttcgagacgggctgggcactatcctgcgaggcggagccgaagaaggcagttacgataactggcctcacacccgtaagtcatgggggccactctccccaggccaccagcgggagctctggacgcagcctgatccatggactgaggtattgtctgggcacaaaggggatgcgggagcttgtggttgctgctgcttttgctcccagttcattaacgctcggtgcgctcaccctctgtgtcttgctcggggattagatcgcagggcttctgaggaaatgcccattctgcaagcactctgtctcctgcccaaggtgagcaccccttcaattacagtgctaagtccccagagaagcgccgctccaagcataactgtcccatccccacaacgaagtgccgctccttctattactgttccatctccccagcgcagtgcaccccgtgcatctctgtgcccccctcataaaggccagcaccctgagcaccactgtgcccttccacccaagggacagcaccccgaacaccactgcgcgcttccaacaaaggtctccaccccctcaatcacagtccccagcccccagcgatcccctcagatgagcctctcctcagcggctcgaggaagcaacaccgacgtagcaggcctttccgtgggggagtggcctggctggcagctttggggcgaaggacaggacggtgctcaacagagacctcatctcccatcgggcggaagtggcgctggagtcgcaccccagcgcctccctaagtcccgggcttgcatcctgtgctcccgacacggagcacagggtccttgggtgacgggacgtagcgtcagccatagccattgccctatccagggcctgctggatttacagcggcctgacctaggcaccgattggggtaggacgaggcccctttgcactccccaggacctctgtggcggaagacccttgccttctacgtggggcgtgacaatgcatctcatccattgtctctcagtatcattatcattgtgtctcagccttagccattgtgtgtag

SEQ ID NO: 54315 - DNA, 429 bp, Artificial Sequence
  Description of Artificial Sequence: Synthetic coding sequence
atgtgccggtgctctctggtgctcctctccgtagaccatgaggtgcccttcagctcattctttattgggtggagaacagaagggagagcatggagagcgggaagacccgacatggcggacggatcaggctggcagccccctaggccgtgtgaggcctaccgggcagaatggaagctctgccggtcagccaggcattttctgcaccactactacgtccacggggagcgccctgcttgcgaacagtggcagagagatctggcatcttgtcgtgactgggaggagcgcagaaacgcggaagcccagcagagcctttgtgaatcagaacgggcacgggttcgcgcagcgaggaagcacattctagtctgggccccaagacagtccccaccgcctgattggcatctgcccctgccgcaggaaaaggacgagtag

SEQ ID NO: 54316 - DNA, 318 bp, Artificial Sequence
  Description of Artificial Sequence: Synthetic coding sequence
atggccgatggctctggatggcaacctcctcggccatgcgaggcctatcgggctgaatggaagctttgccggtctgctcggcatttcctgcatcactactatgtacatggagagcgtccagcctgtgaacagtggcaacgggatctcgctagttgtcgcgattgggaggaaagaaggaacgcagaggcgcagcagtcactttgtgagtcagaacgggcacgcgtgcgtgccgcaaggaagcacattctagtttgggcgccaagacaatctcccccacctgactggcacctgccgctcccgcaggagaaagacgagtag

SEQ ID NO: 54317 - DNA, 354 bp, Artificial Sequence
  Description of Artificial Sequence: Synthetic coding sequence
atgtgtaggtgcagcctcgtgctgttaagcgtggatcacgaggtcccgttttcctcgttcttcattgggtggcgcacagaagggagggcatggcgtgccggaagacccgatatggcggatgggtccggatggcagccacccaggccctgcgaggcctaccgcgctgaatggaagctatgtcgttctgccagacatttcctgcaccattactacgtgcacggggagaggccagcctgcgagcagtggcaaagggatctcgcatcgtgcagggactgggaggagcggaggaacgcagaggcccaggtactcagtgtggttgcccatacctgtaacctctcttacttgggcggttag

SEQ ID NO: 54318 - DNA, 756 bp, Artificial Sequence
  Description of Artificial Sequence: Synthetic coding sequence
atggggtcaaaactgacttgctgtctggggccttccggagggttgaactgtgactgttgtcgcccagacgtcggcccatgccatgaatgcgagatcccagagaccgttgctgctaccgccccagcaagcacaaccgccaagcctgccaaacttgacctcaaggcaaagaaggctcagctcatgcagtatctgagcctgccaaagacacctaaaatgttgaagatgagcaagggactcgatgctaggagcaaacggtggctgaagattatctggcggaggcatggtatctggcctctcgagaatatcgggcctacagaagatgtgcaagcctcagcacacgggggtgtggaggagaacatgacgtctgatattgagattcctgaggccaagcacgaccaccggccaactgaagacgtccaggtgtccgcacacggcggagtggaggaaaacattaccagcgacatagagattagcgaagccaagcacgaccatcaccttgtcgaggacctgagtgagagtttgagcgtctgtctcgaagacttcatgacgagtgatttaagtgagagtctgagcgtgtccttggaagacttcatgacctccggcttatccgagtcactgagtgtgagtttagaagatctgatgacccctgagatggccaaggaaaggtacgaagactatctgtgttgggtgaaaatggccagatcacggcttaatgaaccaataagtagccaggtactgggactgcttaggttatag

SEQ ID NO: 54319 - DNA, 690 bp, Artificial Sequence
  Description of Artificial Sequence: Synthetic coding sequence
atgggcaacatccttacatgttgcataaacagccattgtggctggcccagaggtaaggacgccccatgctacgagtccgacacagacatctatgagactgtggcagctgctacatccgagtccaccactgttgaaccgggtaaactagatgtgggggcaacggaaggacaggacctgcagcatatcagtaatcagaagatgccaaccggacctcccgaggatcgcttatccctgaaatttctcccctcttcagaggaagataacgatgatgcaaaaattctgccttcaccagtgcaaggttcttctgaggacaatcttagtttagtgtgtttacctcgtagcgaggatgacgactgcgatgatgacgacgatgatgacgcacagattctccccagccgagtccaggggggatgctatagatttgatagctctagttgctcttctgaagacaacctgtccctcgtatgtctcccaaggtctgaagacgatgactgcgatgatgacgatgacgacgcccagatcctcccatcacctgtacaggcttgtagcgaagattctctctttctgcgctgctcattaaggcataaagacgaggaggaagaagacgatgatgacattcatattaccgccagaatagagagcgatctgactttggaatcgctctccgacgaggaaatacatcctggatag

SEQ ID NO: 54320 - DNA, 480 bp, Artificial Sequence
  Description of Artificial Sequence: Synthetic coding sequence
atggagcaagattggcaaccaggagaggaagtgaccccagggcctgaaccctgcagcaagggacaggctcccctgtacccaattgtgcacgtcaccgagctcaaacacactgacccaaactttccgtctaattctaatgctgtgggtacatccagtggatggaatcgcatcggaaccggatgctcccacacctgggattggagattttcctgtactcagcaggctttgttgcccctcctgggtgcctgggaatggagtattgatactgaagcaggagggggaagacgggagcaaagtcagaagccatgttcaaacggagggcctgcggcagctggtgagggccgtgtactaccaagtccctgcttcccctggtcaacgtgtcaagcagctatccacaaggtttgtaggtggcagggctgcactcgtcccgctctgctcgccccttcacttgctactctgaaagaacactcttatccctag

SEQ ID NO: 54321 - DNA, 480 bp, Artificial Sequence
  Description of Artificial Sequence: Synthetic coding sequence
atggagcaggactggcagccaggcgaagaagtaacccccggtccagagccttgctcaaaaggacaagccccactctaccccatcgtgcacgtaactgaactgaagcacactgatcccaattttccatctaattcgaacgcagtggggacttcctctggttggaaccgcatcgggaccgggtgttcacatacctgggactggcggtttagctgcacacaacaggccctcctgccactgcttggggcttgggagtggtccatcgataccgaagctggcggaggcagaagagaacaatcacagaaaccatgttctaacgggggaccagccgcagcgggagaaggaagggtgctgccctccccttgctttccatggagcacgtgtcaggccgcaatccacaaggtctgccggtggcaggggtgcacccgtcctgcactgttagctcccagtctcgccacgctgaaggagcacagctatccgtag

SEQ ID NO: 54322 - DNA, 669 bp, Artificial Sequence
  Description of Artificial Sequence: Synthetic coding sequence
atggcactgtcggcagagacagaatcccatatctaccgagccctgcgcaccgcttctggggcagccgctcacctggtcgctctcggttttactatctttgtcgccgtcctggcgaggccaggcagcagcttattctcgtggcaccctgtgctcatgtcactggctttctccttcctgatgactgaggctttgctggtctttagcccagaatccagcttgcttcactcactgtccaggaaaggacgggctcggtgtcactgggtcctacagttgttggcactgctgtgtgccttgctggggctgggactggtgatcctacataaggagcagttggggaaagcccatctcgtgacgcggcacggtcaggccggattgctcgcagtactttgggcgggacttcagtgcagcggcggagtggggttattataccctaagctgctccctcgttggccccttgcgaagttaaagctgtaccatgccacctctggcctcgtgggctatttacttggaagcgcgagcctgctgctggggatgtgttcactatggttcactgcttctgtgactggcgcagcctggtatcttgccgtgctatgcccagtgctgaccagtctcgttatcatgaaccaggtgtctaatgcctacctttatcgaaagagaatccaaccatag

SEQ ID NO: 54323 - DNA, 387 bp, Artificial Sequence
  Description of Artificial Sequence: Synthetic coding sequence
atgacctccctgttcgcacaagagataagattatccaagcgccacgaagaaattgtgagccagcgcctgatgttattgcagcagatggagaataaactcggagaccagcacaccgaaaaagcctcccagctgcaaaccgtcgaaacagcctttaagagaaatctaagcctgctcaaggacattgaagctgcggagaaaagcttgcaaacaaggattcatcctctaccaaggcctgaggtggttagcctagaaaccagatactgggcatccgtagaggaatacattccgaaatgggaacagtttctgctcggccgtgccccatatccattcgccgtagaaaatcagaacgaggccgagaacacaatccaaaacgaggcccagcgctag

SEQ ID NO: 54324 - DNA, 192 bp, Artificial Sequence
  Description of Artificial Sequence: Synthetic coding sequence
atgacatcactctttgcacaagagatccggctgtccaagcgccatgaagagattgtgtcacagaggctcatgctgctgcaacaaatggaaaacaaacttggcgaccagcacacagagaaagcatctcagcttcagaccgtggagactgcattcaagagaaatcttagcctgctcaaggacatcgaggcctag

SEQ ID NO: 54325 - DNA, 387 bp, Artificial Sequence
  Description of Artificial Sequence: Synthetic coding sequence
atgaccagcctgttcgcccaggaaatccgactctctaaacgccacgaagaaatagtgtcccagcgattaatgcttttgcagcagatggaaaacaaactgggggaccagcatacggaaaaagccagtcagctacagacagtggagacagccttcaaaagaaacctcagcctgctgaaagacatcgaggccgctgaaaagtccttgcagactaggatccacccactgccaaggcccgaggtggtcagcctggagacccggtactgggcctctgtggaagagtatattcctaaatgggagcagttccttctgggtagggccccttatcctttcgctgttgaaaatcaaaatgaagctgaaaatacaattcagaatgaggcacagcgctag

SEQ ID NO: 54326 - DNA, 387 bp, Artificial Sequence
  Description of Artificial Sequence: Synthetic coding sequence
atgacatcactgttcgcccaggaaataagactcagcaaaagacacgaggagatcgtttcacagcggctcatgttactccagcagatggagaataagttgggcgaccaacacacagagaaagcatcccagctccaaacagtggaaaccgcttttaaacggaatctgtcccttctgaaagatattgaggctgctgagaaatctctgcaaactcgtattcatccactcccaagaccagaggtggtctccctggagactcgctattgggcaagtgtcgaagaatacatcccaaagtgggagcaattcctgctcggtagggcaccttaccctttcgctgtggaaaatcaaaatgaggccgagaataccattcagaatgaggcccaaaggtag

SEQ ID NO: 54327 - DNA, 885 bp, Artificial Sequence
  Description of Artificial Sequence: Synthetic coding sequence
atgactaagggcgacttcatcgatgaggaggtggaagatatgtacttggtcgactttacacaaaaaattattgacaaacgtaaagaaatggaggcctctggcgcacatcgggattctcagaaggcgggagagggcaccaccatgaggaaaacctttctgagggagcggtcacttctgcctaaaaccccagtcaagaatggttggattacttggaccctctggggtgtccccggattgtacgagaaggatctgccagacctgctcgaaatggacaaaaatctccaaggcaggttgttcatctctcttctgatgaagacactcctcagcgaggacatgagaaaggagctgcagaggcagcaatgggaggaggaggaaagggaagcacttaagcggcctatgggccctgtccattacgaagatatcagagagaacgacggggatgtgatcggccctctccctcctgagcccgaggctgtgcctacgccccgtcctgctgcgcaaagcagcaaagtggaggtcatagtgcaggagcgcaaggacaccaagcctggcgttccccacattagagaatgggatagagggaaggaattctcgttcggatactggtccaaacgccaaagcgacctgcgggcagaacgagacccagagttcgcccctccatcggattacttcgttgggcagaaaagaaccggcttcagctctagccaggcctggtctcgccctggaccagcgcagagcgacccaggccagtgcccagatcagtcacatgggccatctcctgaacatacatctccgactccggctcctgacaaccccccacaggccccaactgtgacattcaagactcttgatgacatgatctcatactacaagcaggtcacttag

SEQ ID NO: 54328 - DNA, 1404 bp, Artificial Sequence
  Description of Artificial Sequence: Synthetic coding sequence
atggatagacggaagaaacctttagacgtaaccgcaagtagcttggtggaccttaaagcagaactctttcggaagcaagaggagttcaaacaagaaaaactgttaaaggattctggagtattcggaaaacctaagacaaccaacaagaagccttccatctggtccaagcaaaacgtgggagtgagtaaccgcgctgagaaggatgccgagcagaaaatcgaggagcagaaaacactcgacaaagccagagaaaagcttgaagagaaggccaagctttacgaaaaaatgacaaaaggagatttcattgatgaggaggttgaggacatgtatctcgtagactttacgcagaaaattatcgacaaaagaaaagagatggaggctagtggtgctcaccgagattcccaaaaggctggagagcgagacgacgatgaggaaaacctgccagagggtgagatcccacctccccaggacccgagtgaggaatgggtggattacgtggacagtctcggcagatcccgcagatgcatgagaaaagatctgcccgatctccttgaaatggacaagaatcttcagggaaggctgttcatcagccctgccaacgaaaaaaccctgttatctgaggacatgaggaaggaacttcaacgccagcagtgggaggaagaagagcgtgaagccctgaaacggccaatggggccagtacactacgaggacatccgggagaacgaggcccgtcaactaggcgtcgggtacttcgccttcgcccgtgacaaggagttgaggaataagcaaatgaagaccctcgagatgctgcgagagcaaaccaccgatcagcggactaaacgagaaaatattaaggaaaaacggaaggccattctcgaggcccgtctggctaaactccgccagaagaagatgaagaagtcaaaggagggaggaaccgaggaggaaaatcgagatggcgatgtaataggtcccctgcccccagagccggaagcagtcccaacccctagacctgctgcccaatcttcaaaggtcgaagtcattgtgcaggagcggaaagacacaaagcccggagtgccccacatccgcgagtgggataggggtaaagagttcagttttggttattggagtaaacggcaatccgacctgcgggctgagagagatcctgagttcgcaccaccaagtgactactttgtgggccagaagaggacaggcttttcatccagccaggcgtggagccgtcctgggcctgcccagtccgatccaggccagtgccctgatcagagtcacggaccatctcccgagcacacttcacccactccagcccctgacaaccctccccaggccccaacggtcactttcaagaccctggacgatatgatctcttattacaagcaggtgacatag

SEQ ID NO: 54329 - DNA, 426 bp, Artificial Sequence
  Description of Artificial Sequence: Synthetic coding sequence
atggattccagtgcttgcaagaaatcacatcagagtaagaaatggcggattcaggcgcaggagaatttcgcgaagaaatttccctatcggctctcttggctgaccgagcctgatccagaacctctgcagccctgggaagtgaccaatgactctaatacagtgcagttgcctcttcaaaaacgactggtgcctacacgatccattcccgtgagaggtctcggagcccctgatttcacctctcctagtggctcttgtccagcccctctgccagccccaagcccaccccctctgtgtaatctgtgggagcttaaattgctcagtagacggtttcctagacagctggctttcctgttgtcaacccgccataccgaggccgcatgcccccaaacttccaaagctgcaggactgtctcgaggactgtcctag

SEQ ID NO: 54330 - DNA, 534 bp, Artificial Sequence
  Description of Artificial Sequence: Synthetic coding sequence
atggcgggatatcaactctggtctccttggacgccactagacgaaagctttcagtggttaaggcacaccacaccaacacctagctcaaagcacccctttaaggctagcccttgtttccctcataccccatcagatctggaagtgcagctctgctttcaggaagtgacactggttctagacagtccattcttggagtccggagtgagccccaagctgccctgtcatacaagtgagctcaggacaatgaacaacaagggtctggtgagaaaacctcaacccattcggctgagtggcgtagatagcgtgtttggccgagtcattaccgctcagcctcccaagtggacaggcaccttcagagtgtccgacaagtcagccttctgcaaaataatctcacgagaacatcagtggccaataggcctgaaggaaccacagatccagatgaccgtcaccatgtgtaagcaaatgcttcggagcattctccttctctatgctacctacaaaaaatgcacattcgcattacagcattccaaatag

SEQ ID NO: 54331 - DNA, 534 bp, Artificial Sequence
  Description of Artificial Sequence: Synthetic coding sequence
atggctggatatcagctgtggagcccttggacacccctagatgaaagtttccaatggctacgccacacgacgcctaccccttcaagtaagcatccctttaaggcctccccatgctttccgcacaccccctctgacttagaagtgcaactctgttttcaggaggtaacgctggtgctcgactctccatttctcgaatcaggcgtctctccaaaactgccctgtcacacctccgaattgagaactatgaacaataagggacttgtcagaaagccccaacccatcagactgtctggagttgactccgtatttgggagggtcatcaccgcacagccccctaaatggacgggcacatttagagtgtccgacaaatcagccttctgtaagatcatcagccgcgagcaccagtggccgattggtctgaaggagcctcagattcaaatgaccgtcacaatgtgcaagcagatgctcagaagcatcctcttgctctacgccacctacaaaaaatgtacctttgctcttcagcactctaagtag

SEQ ID NO: 54332 - DNA, 1719 bp, Artificial Sequence
  Description of Artificial Sequence: Synthetic coding sequence
atggacgatgactacgaggcataccattccttgttcctgtcactgttgggactctgtccctctaagaccccgattaacgaaaacgccccagtttttgacccagaacctgtaatcgcacattgctttaaacaatttcagcaaaaggacttccgtctaccacagactcggcgaagaatcattatggtcccaaggaaggaggaccagactcccttaaaccccgcttctcagcctcaggctcccccaaagccaatcccttcctttaaggtattggaagctcgcgatatccaggaacagcctgaagacagaaaaacctggttgtctcagcgcagtaaactgcggcaggaactggaatccttcggcgacgtgaagcgatggcttgagaacaaaccatctattaccccgtctgaagccaaggttctgcacatgattcatgaagaacagagcgcgcaaccaaacgcgtcgcaagccactacgcggaccacaaggaaaaaggctcccaggttgagccgattgagtcgccagatggtaccccagctgcagcttccagaacctccggcactctcagtgatgtactcttacctgcactcccgcaaaatcaaaatccttgagatcttccataaagtggggcaaggtgaaaaccaacgcatcactagagaggagtttatcgccgcagtaaaagctgtcggcgtaccattaaaaaatcaggaagttgaggatatcgtcatctatctgtctagtcttggtaaacacaacaccattacaatggacattttggccaatacttacaagcagtggagtatggcccagcaacgatcgtctttggcaaccgcccgtgaacactacatcctggcaaagcaccgtgacagccttaaggggccactgaagaagcaggaagtggacagtgcaccccagctccctaaggtcgatctcctgacggtccctgccgtggatacgcagatggagacacggcctatgacactagaggaaatggaggaggtcgggaagcggtacagggagcgccagaggcagcataagttaacaatcccatcaatccagtataccgaacaatgccatttagtgagatgcggtaacagacactttgacgagcactgccttccgtcaaccatacacggcgatatgagggagctcatcgacagtgctcgccgacataacttcctggtctatcttcagtgctggaagctgtgcaagtcatatggtttgcccctcaccgaagacattctcatgaaagctctgctgtatcctggagacaagataatttttcaaatggacaaggtgtgcccaattaggcagcccggtggctattactccgattggaaggttttttcccccaatctggctctgcttaggtctcagggccctggcaaatctaagcggacagacaagaaaacacccaaaaaaagtaagaagatgaggtttaaggagttcgaggaattcactcgcaaactgaaggtgaagcgttcgtccggcctgcagcagacccacccaaactccttttggccaggacacctgttggacaagttacagctatacctgccaactgtagccacggaccgcagccttgccctcttcagttgcgtccagcaccaaccacacgtctatcccgcaacctatcatcctgaccactggtggcctctcagaaataaaaactacatgacacacgcacactacgacgccgctaaagtgtattatatcaattag

SEQ ID NO: 54333 - DNA, 1719 bp, Artificial Sequence
  Description of Artificial Sequence: Synthetic coding sequence
atggacgatgactacgaggcttatcacagcctcttcctcagccttctagggctgtgccctagcaagacccctatcaatgagaacgcacccgtgtttgaccccgagcccgtgattgcgcattgtttcaagcagtttcagcagaaggatttcaggcttccgcaaactcgcagaagaataatcatggtgcctcggaaggaagaccagacgccccttaacccggcttctcagcctcaggcacctcctaagcctattccttctttcaaagtactggaggcccgagacatccaagaacaacctgaggatcgaaagacctggctcagtcagcgctctaagcttcggcaggagctggaatcatttggcgatgtaaaaaggtggctcgagaataaaccgagtatcaccccatctgaagccaaagtgctacacatgatccatgaagaacaaagcgctcagcctaatgcctctcaggctactactaggactactcggaagaaggcaccacgcctttcacgtctcagcaggcaaatggtgccccagctccagcttcctgaacctccagccctcagtgtcatgtactcttacctacactctcgaaagattaaaatcttagagatcttccataaggtgggccaaggcgagaaccaacgcatcactagagaagaatttatcgctgccgttaaagctgtgggtgtcccgttaaaaaaccaggaggtggaggacatcgttatttacctatcatctctgggcaaacacaataccataactatggatattctcgcaaacacctataagcagtggtctatggcccagcagaggtcatcattggctactgcacgggaacactatattctcgctaaacatagggattcattgaagggcccactcaagaaacaggaagtggactccgccccacaactccccaaggtggatctcttaactgtgccagccgtagacacacagatggagacgcggccaatgaccctggaagaaatggaagaggtgggtaagcgttatcgggagaggcagagacagcataaactgaccatcccatctatccagtataccgagcagtgccatcttgtgaggtgtggtaataggcacttcgacgagcactgcttaccctcgacaattcatggggatatgcgggaactgatcgatagcgctagacggcacaactttctcgtttatctacagtgttggaagctatgcaaatcatacggccttccactcacagaagacattttgatgaaagcactcttgtacccaggagataaaatcatcttccagatggacaaggtctgtcccatacgccaacccggaggttactactcagattggaaggttttctctcccaatctggccctcctgaggtcgcaggggccagggaagagcaaaagaactgataagaaaacgcctaagaaatccaagaaaatgaggttcaaggagttcgaggagttcactcggaagctcaaggttaaaagatcctccggattgcagcaaactcatcctaatagcttttggccaggacacttgctggataagctccaactctacctacccacggtcgccactgataggagtttggcactcttcagttgtgtgcagcatcaaccacacgtttatcccgctacatatcacccggatcactggtggccccttaggaacaagaactatatgacccacgctcattacgacgccgcaaaggtgtattacatcaactag

SEQ ID NO: 54334 - DNA, 840 bp, Artificial Sequence
  Description of Artificial Sequence: Synthetic coding sequence
atggccgatgacctcggcgatgagtggtgggaaaaccagccaactggagcaggcagctctccagaagcaagcgacggcgagggagagggtgataccgaggttatgcagcaggagacagttccggtccccgttccctcagagaagacaaagcagcccaaagagtgctttctgattcaaccaaaggagcgtaaggaaaacaccacaaaaacccgcaagcggaggaaaaagaagatcacggacgttttggccaagagcgagcctaagccaggcttacccgaggaccttcagaagctgatgaaggactattatagttctcgccgactggtgatcgagctcgaggaacttaacctaccagacagttgcttcctgaaggcaaatgatctaacccactccttgagcagctacctgaaggagatttgcccgaaatgggtgaaactgagaaaaaaccactcagagaagaagtctgttctgatgcttattatttgtagttccgcagtgcgggctttggaattgataagatctatgacggcattccgaggcgacggaaaggtgattaagctgttcgccaaacacatcaaggtgcaggcacaggtgaaactactggaaaaaagggtggtgcacctaggagttggtactcccggacgaataaaagagctggtcaaacagggaggtctaaaccttagcccgctcaagttcttagtgttcgactggaattggcgtgaccagaaactgcgccgaatgatggatataccagaaatcaggaaggaagtctttgagctgctagagatgggcgttctcagcctgtgcaaaagcgagtccttaaagctgggtctgttttag

SEQ ID NO: 54335 - DNA, 450 bp, Artificial Sequence
  Description of Artificial Sequence: Synthetic coding sequence
atgaaagaagcactgcaccagatcgtggtcaggtgcagtgaactggttagcagcacatcattgcccaggctgtctgttagtcgcctgcaaggaccccctgactctcagccactcggcacgcttggccagggaggctggaaattgttagggatcgttgggagcctggcacctgaaaccctgggaggcctgggcactgagtttggtccttgtacccatccactcccattcgatatggttcgcgagcgtgaaagggacgatgaactgcggcaggggtggctgctgcagtgccctcagtgtgccagaaccctgttgtgccattgcggtcccttcttaactcccccatcccaaacctctagctcaggttttcaactatgttctctaaagccatcaggcagtttagtcaccgcgacagagccattgagtaacttcgcattctcatattttccgtag

SEQ ID NO: 54336 - DNA, 1611 bp, Artificial Sequence
  Description of Artificial Sequence: Synthetic coding sequence
atggaggaacctccccaggaggccttggctgaaccattgaagcatgaaagccccgctgcaccaagcagcgctggacataccaaagggcaagaggaagatgaccagaagaatcaggccgagaggaaagctgataaccacactgcacacaggatcgcagaccagactgctcttagagtgccttcacaggctgagagctcaattttctcccaggccacaaacggagtcgccgaacagaacgggcatagtactcctggacaggctggcagacgggcatccaaccccgcagatgtgagcgacttaagggccgacgaccaagtgaatcagacaccttcagaacaaacaaagggaaaagccagttctcaggctaacaacgtgcagcacgagcaatcggacggtcaggtgagcgggcttactgaagaaagaaccgccgagcagaccgagcgaaggctccctacacaggccgaaagaaggaccagtgggcaaattgatgggcgactcgcgatgccctcagatcagagagggtctaggcagacggatcacaggatggctgggcagtccgaacgcagggccagtgagcagatggaccggagaatgtccggggaggcagaaaggcgcacgtctgaacagatcacacatcgactaagcaagctctctgagagaagaccctctgttcagatcgattctggctctagcgtcccgagcgaccagagtccctctgtccagatagatagtggctcctccgtgccaagcgaccagaggccttctgtgcagatcgaccgccgaatgtccggaaaagttcgacggcgatcatcggaaaagaccgattacaggctggctggactggccgatcccggaacctcagaacagacagacctcaggctctatggactggtggatcacaaaaccagcgtcaagacccaccaccaagtttacggccaagccaccgagctggccgagcatcaagctattgatcaagctcattctaatgctgaccagccacctgttgataacgcccactatacagagagcgatcagaccgaccatctcgcagataggcaggctaatcacaaggatcaacttagctactatgagacgcgcggtcaatctgaagaccggatctttccacaacttggcaattccaaggaggataaggaggctgactaccgggtgcaaccttgcaaattcgaggatagtcaggtggacttgaattcaaagccctcagttgagatggaaacacaaaacgccacgaccatcccgccttacaaccccgtcgatgcaaggttcacgagtaatttccaggccaaagaccaggccttgtttccgaggctgccgtctatttcatccaaattaaactacacgtcaagccaagagaaaactcaggccattgtgaccaaatccgacgagttctccgagatcgaccagggaaagggataccatattagaaaccagacctatagaagatttccttctatagtgtatgaagacccctatcaggtaagtctgcaatatatggaaaagcaccatatacttcagatttttcagcagatcaccgagaaccttgtttatgagaaacccgaggatccgctgaacttcatgctgtgtcaggtgtag

SEQ ID NO: 54337 - DNA, 1062 bp, Artificial Sequence
  Description of Artificial Sequence: Synthetic coding sequence
atgccctctcctgtcggtctgctccgcgctttaccattgccgtggccacaattcctagcatgcaccctgaggaggttggccggtcccagggagtccaccggaccctcccagaagccacccccactctgctctgtcccctgtagagtgcctgctatgactgaggaggtcgccagggaagctctgctgtcgtttgtggattccaagtgctgttacagtagcaccgtagcaggagatctggtgatacaggaactgaagaggcagaccctgtgccgttaccgacttgagaccttcagtgagtcaaggatttcagagtggaccttccagccctttacgaatcactctgtggacggcccacagagaggtgcatctcctaggctatgggacattaaagtgcagggacctcctatgtttcaggaagacactcgaaaattccaggttccccacagctctttagtaaaagagtgtcataagtgtcacgggagagggcgttataaatgctcgggatgccacggcgctggcacagtgcgatgtccatcgtgttgcggcgcaaagagaaaagccaaacagtcacgacggtgtcagctttgcgccggaagtggacggaggaggtgttcaacttgcagtggcagggggaacaagacttgtgccacgtgtaagggtgaaaagaaattgctccattttatccaattggtcatcatgtggaaaaatagtttgtttgaattcgtgagtgaacacagactcaactgcccccgagagctgctcgcgaaggctaagggtgaaaacctctttaaagatgaaaattccgtcgtctatcccatcgttgactttcctctaagggatatctctctggctagccaaagagggatagccgagcacagcgcagcactggcctctcgggcacgtgtgttgcagcagcggcagacaatcgaacttatccctcttacggaagttcactactggtaccaaggcaaaacttacgtatactacatctacgggaccgaccatcaagtctacgccgtagactaccctgagcggtattgttgtggatgtactatcgtatag

SEQ ID NO: 54338 - DNA, 1062 bp, Artificial Sequence
  Description of Artificial Sequence: Synthetic coding sequence
atgccttcacccgtcggacttctgagagccttgcctctgccatggcctcagttccttgcgtgcacactgaggcgcctggcaggtcctcgggagtctacgggaccgagtcagaaacccccacccctgtgttcagtgccttgccgggtcccagccatgactgaggaggtcgctcgggaggcgctgctgtccttcgtggatagtaaatgttgctacagctctaccgtcgccggagacctcgttattcaggagttaaagagacaaaccctctgcaggtatcgattagagacattcagcgagtctcggatcagcgagtggacgtttcaacccttcacgaatcactcagttgacggtcctcagagaggcgcttctcctagactttgggacattaaggtgcaaggaccgccaatgttccaggaggatacgagaaagtttcaggtcccacattccagtctcgtgaaagagtgccacaagtgtcatggcagaggacgttacaaatgctcaggctgccacggtgccggaacagttagatgtccctcatgctgtggcgcaaaaaggaaggccaaacaaagccgtcgctgccagctgtgcgccggttctggacggagacggtgctcaacctgctctgggcgaggaaataaaacctgcgctacttgtaaaggtgagaaaaaacttctacacttcattcagctcgttatcatgtggaagaactccctatttgaattcgtgagtgagcatcgtctgaactgcccgagggagctgcttgccaaggccaagggcgaaaatctgtttaaagacgagaatagcgtcgtgtatcccattgtagattttcctctgagagatatatcattagcatcccaacgcggtattgcagaacacagcgccgctctggcgtcacgcgcacgtgtgcttcagcaaagacaaacaattgaattgatcccactgactgaggtacattattggtatcagggtaagacatacgtctactatatttatgggactgaccatcaggtgtacgcagtggattatccagaaagatactgttgcggctgtaccatcgtgtag

SEQ ID NO: 54339 - DNA, 948 bp, Artificial Sequence
  Description of Artificial Sequence: Synthetic coding sequence
atgccaagtccagtgggtctgcttagagcacttcctctcccctggccccagtttttagcctgtacactccggagactagccggacccagggagagcaccggtccttctcaaaaacctcccccactgtgttccgtgccctgccgagttccagccatgactgaagaagtggctagagaagcgcttctctccttcgtcgactccaagtgttgttacagttctactgtagccggtgatctcgttatccaggaactgaaacggcaaacattatgcagataccgcctggagaccttctcagaatctcgtatatcggagtggaccttccagccttttaccaaccatagtgtggacggaccccagaggggcgcaagcccgagactatgggacattaaggtgcaagggccacctatgttccaggaagacacccgcaagtttcaggtaccgcacagttccctagtgaaagaatgtcataagtgtcatggcagaggccgatataagtgttcgggatgccatggggctggcactgtgcgatgcccatcctgttgtggggctaagcgcaaagccaaacagtcccgaagatgtcagctttgtgccggaagtggcagaagacgctgcagcacctgtagcggcaggggaaacaagacttgcgccacttgcaaaggtgagaagaagttgctccacttcattcaactagttattatgtggaagaactcgttgtttgaattcgtctccgagcatagactcaattgtcctagggaactgctggccaaggcgaagggagagaacctgttcaaagatgaaaactctgtagtgtatccgattgtggatttcccgttgagggacatatctttagcaagccagagggggatagccgaacactcggccgctctggcaagccgggcaagggttctgcagcaggtctctcaggggggtggcgcaatctggttatag

SEQ ID NO: 54340 - DNA, 1128 bp, Artificial Sequence
  Description of Artificial Sequence: Synthetic coding sequence
atggatagagaccttaatgaggacgacagcgtcgtggacctcagtttcgaagctgagtccccgttggcccctcctaccgagttgctcgagcgcctacccagttacgattggctgctgcaggggggaaggggccagatatttttccctccgctggaggccccaggtcgcccacaggagcagcgctcctggccaagctttttggagcatcgagtgcccgcaatgactgaggaggtagcacgggaagctctgctaagcttcgtagactctaagtgttgctatagctcaacagtagctggagacctggtgatccaggagttaaagcgccagacgctgtgcagatacagacttgaaaccttttccgaatcccgcattagcgaatggacctttcagccttttacaaatcacagtgtggacgggcctcagagaggcgcatcaccaaggttgtgggatattaaggttcagggcccaccaatgtttcaagaagacacacggaaattccaggttccacattcctcccttgtgaaggaatgccacaaatgtcatggcagggggcgttacaagtgctcaggctgtcacggcgcaggcactgtacgctgccctagctgctgcggtgccaaaaggaaggcgaagcagagtagaaggtgtcagctgtgcgcgggatccggacgcaggaggtgcagcacatgctctggtcgagggaataaaacttgtgctacatgcaaaggtgagaagaagctactgcactttatacagttggtcatcatgtggaagaattccctgtttgaattcgtgagcgagcataggctaaactgccctagggagttattggccaaggccaagggagaaaacctgtttaaagatgagaactcagtcgtttaccctattgtggactttccactacgggacatctctctggcatctcaacggggaattgcagagcactcagccgctctcgcatctcgggcaagggtgttgcaacagcggcagaccatcgaactcatcccactgacagaggtgcattactggtaccaaggcaaaacttacgtttattatatatacggcaccgaccaccaggtgtatgctgtggactatccagaaagatactgttgtggttgcactatagtttag

SEQ ID NO: 54341 - DNA, 498 bp, Artificial Sequence
  Description of Artificial Sequence: Synthetic coding sequence
atgcaggcagagaccatattggaaggccttgaggctggactcccacaggctgtgagctctggactgtcactggttccagcacctggtctcgtcctaacctgcctgtccgccccttcaggacccggtggaatggccctggagccacctcctaccactcttcgcaaggccttcttagcgcaaagtactttactggaatccaccctcgagggtgcgcctgagtgggccgctccacaccccgaagagcagaggaggagtccacccgcatgttcccagcacactcccccacttccctcgactcccactgggcctccaccctgctctccaggaggaaaccatccactatgcgccctgagcggacgtgggggtgggcgttgctctattccaagcctctcctcttctagtacgtttagcctattttcctcaggctgctggaaccctcgggtaaaattgcgggtaaggaagagtcagagccaggggagagccggtcagctcatatag

SEQ ID NO: 54342 - DNA, 1065 bp, Artificial Sequence
  Description of Artificial Sequence: Synthetic coding sequence
atgtgtggcagaacttcttgtcacctccccagggacgtcctgacaagagcgtgcgcctaccaggaccggcgtggccagcaaagacttccagagtggcgggaccctgacaaatattgcccgtcatacaataagtctccgcagtccaattcgcctgtgttactaagtagacttcatttcgagaaggacgccgattccagtgagcgaatcattgccccaatgcggtggggcctggtaccgagttggttcaaagagtctgatcctagtaaactacagttcaacaccacaaattgccgatctgacaccgttatggaaaaacgctcattcaaagtgccccttggcaaaggtcggagatgcgtggtactcgccgatgggttttatgagtggcagagatgtcagggcactaatcagcggcaaccctatttcatctacttcccccagataaagactgagaagagtggatccatcggcgctgccgactctccggagaattgggaaaaggtgtgggataactggagactgctgaccatggctggtatttttgactgttgggaaccccctgagggcggagacgtgctgtactcgtataccattattaccgtggatagctgcaaaggcctaagtgacatccaccacagaatgcccgctatcctcgacggagaagaggcagtgtctaaatggctggactttggtgaggtcagtacacaggaggccctgaagctcattcacccgacagagaacattactttccacgcggtgagcagcgttgtgaacaacagccggaacaatacacctgaatgcttggcgccagtggatttagtagtgaaaaaggaattaagggcatccgggtcttctcagagaatgctccaatggctcgcgacgaagagcccgaaaaaggaggatagtaagacaccacagaaagaggaaagtgatgtgccacagtggtcctcccagtttttgcagaaatctccccttcctacaaaaagggggactgccggtctacttgaacagtggctgaaacgagaaaaagaggaggaaccggtcgccaagcggccatattctcagtag

SEQ ID NO: 54343 - DNA, 1065 bp, Artificial Sequence
  Description of Artificial Sequence: Synthetic coding sequence
atgtgcggaagaacatcatgtcatctgcctcgagatgttcttaccagggcgtgcgcttatcaggacagacgcggacaacaaagactccccgaatggagggacccagacaagtattgtccatcatacaacaagagtccacagagcaactccccagttctgctcagtcgcttgcactttgaaaaagatgcagatagttcagaacggattattgctcctatgcgctggggtttggtgccaagctggtttaaggagagtgaccccagtaaactgcagttcaatactacgaactgtaggagtgacactgtgatggaaaagaggtcattcaaggtgccgctgggcaaaggtagaaggtgtgtggttctcgccgatgggttctatgaatggcagcgatgccaggggactaaccaacggcagccgtatttcatttattttcctcagattaaaaccgagaagagcggatcaatcggtgccgcagatagtccggagaattgggagaaagtctgggataattggcggcttctcacaatggcagggatctttgattgttgggagccacctgagggaggggacgtactgtattcatacactatcataacggtggattcttgtaagggtctatccgacattcaccatcgaatgcctgctatcttggacggcgaagaggcagtgtctaagtggctcgactttggcgaggtcagtacccaggaggctctgaagctgatccaccccacagaaaatataaccttccatgccgtctccagcgttgtgaataattcccgcaacaatacacccgagtgcctggcaccggtggacttggtagtgaagaaggagctgcgcgctagcggatcaagccagagaatgctgcagtggctggcaaccaagtcgcctaagaaagaagactcaaagactccccagaaagaagagtctgacgtcccccagtggagtagccagtttctgcaaaagtcacctctgccaactaaacgtggcacagcaggattgctcgagcaatggctgaaaagagagaaggaggaagaacccgtggcaaaaagaccctactcccagtag

SEQ ID NO: 54344 - DNA, 1065 bp, Artificial Sequence
  Description of Artificial Sequence: Synthetic coding sequence
atgtgcggccgaacaagttgtcatctgccacgggacgtgctgacccgggcatgcgcctaccaagacaggagaggtcagcaacgattacccgaatggagagaccccgacaagtactgcccgtcctataacaagagtccccagagtaactctcccgtcctgttgtcacgccttcatttcgaaaaagacgcagactctagcgagcggatcatcgccccaatgcgctggggcctggttcccagttggtttaaagagagcgaccctagtaaactgcagttcaacactactaactgtcgctccgacacagtgatggagaaaagatcctttaaggtccctttaggcaagggaaggagatgcgtagtacttgcagacggtttctacgagtggcagagatgtcagggtaccaatcagcggcagccttatttcatctattttcctcaaattaaaacagagaagtctggctctatcggcgcagctgattcccccgaaaactgggagaaggtttgggacaattggcgtcttctgaccatggctggaatcttcgactgctgggagcccccagagggcggtgacgtcctctactcctacacaattattacagttgactcgtgtaaagggcttagcgacatccaccatagaatgccggcaatcttggacggcgaggaggccgtgtccaagtggttggattttggcgaagtctcaactcaggaggctcttaagctgatccaccctactgaaaacatcaccttccacgccgtttcttccgtggttaacaacagccggaacaacactccagaatgtctggcccctgtcgacttggtggtaaagaaggagctccgggcttcgggatcatcccagaggatgctccagtggttagctacgaagtcacccaaaaaggaggacagcaaaacccctcagaaggaggagtctgatgtgcctcagtggtcctcgcagttcctccagaagtctcccttgcctaccaagagaggaaccgccggtctgctagaacagtggctgaagcgggaaaaagaagaggaaccagtggccaaacgcccttactcacagtag

SEQ ID NO: 54345 - DNA, 990 bp, Artificial Sequence
  Description of Artificial Sequence: Synthetic coding sequence
atggaaatgtcaggtctgtccttctccgagatggaggggtgtaggaacctgttaggtcttctcgataacgacgaaattatggcactatgcgacactgtcactaaccggcttgtacaaccacaggaccgtcaggatgcggtgcacgccatcttagcctactcccagtctgctgaagaactgctccggaggaggaaggtgcaccgagaagtgattttcaaatacttagcaacacaggggatagttatcccccctgcaacagaaaaacacaatctcatccagcacgctaaggactattggcaaaagcaacctcagctgaaattgaaagagacgcccgagccagtcacaaagacagaagacatacacctgttccagcagcaagtaaaagaggacaaaaaggccgagaaggtagatttcaggcggttaggagaggagttttgccactggttcttcggactgctaaattcacagaaccctttcctgggtcctccccaggacgagtggggtccccagcatttttggcacgatgtaaagctgagattttattacaatacgagcgagcagaacgttatggactatcacggggcagaaatcgtcagcctcagactgctgtcactagttaaggaagagtttctcttcctttcacccaacctggattcgcatggacttaaatgcgcgagttcaccgcacgggcttgtgatggtcggggtggccggaaccgtacatagggggaatacctgcttgggcatttttgaacagatcttcggattaatccgctgccccttcgtagagaatacgtggaagattaagtttattaatctgaaaattatgggcgagagtagtctcgcacccggaacgctgcctaagccctccgtcaagttcgagcaatcagatctcgaggcattctacaacgttattacagtgtgtggcaccaacgaagtgcggcacaacgtaaagcaagctagcgatagcgggaccggagatcaggtgtag

SEQ ID NO: 54346 - DNA, 879 bp, Artificial Sequence
  Description of Artificial Sequence: Synthetic coding sequence
atggcccagccccaattatatctcccggagcctttcaagatcgcatataggaaggtcggacagtgccgcaggtttcagcaattgaaaaaaaagaatggaagtttcaagcgcaaaggaatagaaagatggcatcgtgccgtgtcaactaatttgctaaagcagaatgtgctggtaccgaaggaggagtcctcctctgattctgatatgggtttccatgaatcacagcagaaccagaagagcaatctgaaaactaaggtgaaaactgcattcggcagaatgctgtcttacaaatacagaagtaagcctgcctgcgcctcacaggaagggtcaaccgaccacaaagaagctctgttatccaatacgcagagtctactgccacgcattgtgaaagagttttctagccccaagctgttcacagccaaaatgcggaagctgagtgaaaatgcaaccatacagctggacgtagtcgaggcagagactgaggaaattacccagggtaatactctgctgagagcacgaaggactacaaagagactgtcggttacctcgctccctagcggtcttcaaaaggggccttatagtcctaagaagagacctcacttcccggctttgaaaaagaaaaaaagaggtatggagaacatcctgagaaagtcggacctcacggtcggtaagcttcaaatgcaggtggatgaccttattgaaacagtcaccgacaagtccatgaagttgctggcccaacgccacgctgagctgcagcaatgtgagtttcttggcgatgagattctgcaatcttcgaagcagttccaacgtatttctaagcgcaccatgaggaaatacaagctcaagaatatgaccaccaagggacccggagatagctag

SEQ ID NO: 54347 - DNA, 357 bp, Artificial Sequence
  Description of Artificial Sequence: Synthetic coding sequence
atgaaggtggttgggaactatcgggtcaacactgcaaactcttccacggacacttccggcgaacatcttacctgtttgcgcagccagttgttcgtggcttaccggaatggtcgggtggatgaagcagtcagtctcggattcctggactgttggattggaggtgaccttaccaatttcaagggttgctatttgaccaaccagttgcccattcagattttcactgccatcttcgacatgaacactgacgtgattatccttagtcagttcatgtactatcggcttaagaatcaaaagaagaagatctcagaggaagatctcagaaaggagctgcacttctgttgcttgcactggccctag

SEQ ID NO: 54348 - DNA, 402 bp, Artificial Sequence
  Description of Artificial Sequence: Synthetic coding sequence
atgaaggttgtcggtaattaccgcgtgaatacggccaacagttccacagataccagtggtgaacaccttacatgtctcaggagccagctgtttgtcgcttatcggaatggcagggtagacgaggcagtatcactggggtttctggactgctggatcgggggagatctgactaactttaagggctgctacctgacgaaccagttacctatacaagacattcccacgtctgtcattcagcggctgcaccaccaacgtgagtcccaaatcgtgacattgggatctccactgccatgcatctatcccatttttttccagatctcagagatcagcatgcctggatattattcatgcttgtgtcatacaaccatcaacactagcaagaggcggttcattctaacttag

SEQ ID NO: 54349 - DNA, 408 bp, Artificial Sequence
  Description of Artificial Sequence: Synthetic coding sequence
atgaaggtagtgggaaactatcgcgtgaacacggccaattcttccactgacacctcaggggagcatttgacttgtctgagatcccaattgtttgtggcataccgtaacggaagagttgatgaagccgtgagcttaggtttcctcgactgttggataggtggcgatctaacaaacttcaaaggatgttatctgacaaatcagctacccattcagatttttaccgcaattttcgatatgaataccgacgtcatcattctgagccaattcatgtactataggctcaagaatcaaaaaaaaaagatgattttccaaccacagctctttaaggacagcatcacccgcgaaaaagtcagactcagtctttggggggtactctgtccggtctatataccatactcatttcggtag

SEQ ID NO: 54350 - DNA, 729 bp, Artificial Sequence
  Description of Artificial Sequence: Synthetic coding sequence
atggggacaggggcaagcgaaaaacaggcagaacagaaagtccgtagagcctttgaagcatcagaggaggcccacggaacactggctgcgtcaacgccatgggtcgcaatgggtagcgcatacggatcttgcacgtgtctgggcgctcagcctgtaacagacttagctctatggcctgtaatatacagttgtatgggtttttccccacaggcctatccagctttttgggcatacccttgggtcctgtacgggggttatctttggatgggatatccgccacctgctgctctggtgccgtctgtctggctgtattggcgtggcgcttcctcatttgatccccttatcggtagcccctaccttgccgctctggccccaaacctcttccccttcccaatgaaatttcccccaacctacagtctggcctcacctacactgggaggcgcaaccagcagccattgcccccaggtagggtgctggaccccagcgagctcagcgccacgcgctgctgtagaaggtccctcccgcggtgccccttatttgaaaacctgcaaagcgccacccagtgaatgggcaagtcgcttcggcatctgggcccctctgccttgctgcagctccgagctgagaccacttcctccgtcaccgatcgaagatagccaactggacccaggatgcagcaggagcagctcccgatctccttgccgggctaggcgaagactttttgaatgctag

SEQ ID NO: 54351 - DNA, 804 bp, Artificial Sequence
  Description of Artificial Sequence: Synthetic coding sequence
atgcattacattaaaacctggagtctcctgggggaaatgtcagagaagcttagacggtgtaggaaggaattgaccgccgctatcgatcgcgctttcgaaggagtgtcttatagtcaagagtgcacaggtcaacagcgcctggaactcagcgccgcacccttgagctttagcttgccagttcaccggctcctctgcaggcgacatccacttgcggcatgctcctcagccgctcccttcgcagccgtgccctgcgcccctgagaacgagaaccccgctttcgcaactaatcacgcacctgtaaatgccaaaccccatgccttgtgtccggagcgaaaaccactgacttccaaagagaacgtactaatgcattcttccatcttggcgccagaacgagaatcttggcgcaccgctggggagggtgaaaattggaggaaggaaaacctgaggaaagacatggaacgcgatctgaaagccgatagcaatatgccgcttaacaacagctcacaggaagtgaccaaagatctgttagatatgattgatcacacatctatcagaaccatcgaagagctggctggaaagatcgagttcgagaacgaactgaatcacatgtgcggtcattgtcaggactctcccttcaaggaagaagcgtgggctctgttaatggataaaagcccccagaaggcaaccgatgccgaccccggttctctgaagcaggccttcgatgaccacaatatcgttgaaaccgtgctggacctggaagaggactataacgtgatgacttcctttaaataccagatcgaatag

SEQ ID NO: 54352 - DNA, 432 bp, Artificial Sequence
  Description of Artificial Sequence: Synthetic coding sequence
atggccacgccactcgataattgcctcaggcccttccctgaccctatggtcaaggtcacagctgaaacgaagaagattagtgaggtgtcctcttatgtgtcagctaacaataaaaaaaacagcttttggggatcaggactgttatatcccgtcgccctgcttaggtgccaggattgttgggccggacaccagacgcacgtcctctccaaggaattcacctcatacttctcttctggcgcaggtcgtgaggcacagcaccagcctagtgccgttcttggctctcttatttggttgaggcgcgtgtacctgttacgtgccatggttgtccatggaggatctcagccctgtcagagatggctcgtgattcggatggaagtagggggacatccaagttttcccggtcacgcctggctgacctttcacttgaattag

SEQ ID NO: 54353 - DNA, 1692 bp, Artificial Sequence
  Description of Artificial Sequence: Synthetic coding sequence
atgataaagcgaaagatttggtgtaatctctgtattgacctcgtggcattcacctccgagatcttcaagggcgctgtttttcaatcccttgacggcattgtcgtctcagcgaactgcaagctgaggaagatttttactttaaagtccaaaccgcaggacactgctgacaaggatgcagtgtacggtgtgccattttcaacagacgaacccaccgacatcattcctaggagctgtcagctcatgaccgacgtgccacatgtgacccaactcctgaacatgacgaagctacggcagaccgagattaaattcggaggccaccctctccgcagcgccgagagcgaccaatttataaatcggggtaccagcatcacgcggaatagtaagaaccaggatgtctgccacatcgcttttgggagcaaggtgctgggtccaccccctctctccgggcgaagaaacaacatgaagatcagctccgagaccgtgagatcagtgggctccaagaacaatcggtcttgccagccctctaccgtggagaaatgcgtcaacggcaccgagatgtccgcactcttaatacccgagtccgaggaacaaggaaataaggaaaacattcaccagataaaacaaacggtgccaattcacgcagctaacctccacatcatgcatccccacccaccgcaggagccctcggccgataagaacaacaaccgaagacgactaaggctgaagagtacctcacgggaaagaacggagaccccttcaggcagcagctccggcaacaacagaatcgaagacaaagccagcaccattctgactaccgtgtcacagcagggcgctgagctcttgaactcgggcactttaggtccccagagtccagaccaatctgacgagtggatctttccagagaacgctgaccacatctcctacctcgcctctagccgtcagagtctactgctgggcgacgacagttgtaaccccagccatctgtggctggaggcgtctaaggaaagcgaacatgaccagcaggctgaggagtcccagtccgttcccaaggatatattcacattctcctcccgaccgaggagcgctccacatggtaagactcagacaatgagccccgaggagctgagttttattctagatctcaaggaggataatagcgtcacttctcgggatactcagtcggaagatgacttttacgggggagactcctccgaagaagaatacgattggagaaactatcagccaagtcaaatgagcgagtcggagctgcagatgctggcttcgctccgatggcaacagaacgaagagctggaggacgcaggaaccagccacggcctgtcagcttctcaggtcgacaactgtaacgttagtatttctacatcttctgacgacacaaccacttggaatagttgcctaccaccaccggtgaaccagggcaggcactatcaaaaagagatgaacccaccttccccaagcaaccccagagattggctcaatatgctgtctccacctatcgtccctccaagccagcaaccagcagagcagcgcccagatagctgcgaaagcttatctgtgcaaggcgaggaagacttgtcggtggaggaggatgaagaagtgctgactctgctgtacgatccctgtctcaactgttatttcgaccctcagactggcaaatattatgagctggtatag

SEQ ID NO: 54354 - DNA, 717 bp, Artificial Sequence
  Description of Artificial Sequence: Synthetic coding sequence
atgtctggattcccggaaaacgccgatcacatcagttatcttgccagctctaggcagtctcttttgctcggagatgatagttgcaacccctcccacctttggctagaggcctccaaagagtcagagcatgatcagcaagccgaggagtcgcagtctgtgccgaaggatatattcaccttttcttctagaccacggtctgcaccccatgggaaaacacaaacaatgtcgcctgaagaattatctttcatactcgacctaaaagaggacaacagtgtaacaagccgagacacacagagtgaggacgacttctacggaggtgactcttctgaagaaggaaaccattcaatccaggggagccggggacccaccacgggtccatctgaattgactcagttaacattagagagcctgctcggcaaagcagctaaaaggactagcaaggagtatctgaggtcagcatacaccgaagctggcgcaaccgagtcccaggactcaagcatggagcagatcgatagaaacaatttcgagatgtctctgctcccaacaacctgcctcagtcccactggtaggaggtgcggaagctgccagaaaacccccgagccagtcattaaagctaaggatctatcagcacagcaagtcccagcatctcttaataaaacatctcttaaggagatttccggggaaagactgtcgtctattccagaggcatctgaatag

SEQ ID NO: 54355 - DNA, 2070 bp, Artificial Sequence
  Description of Artificial Sequence: Synthetic coding sequence
atgatcaaaagaaagatctggtgcaacctttgtatcgatttggtggcattcacgtctgagatatttaaaggggctgtctttcagtctctcgacgggattgtcgtgtctgctaactgcaaactgcgcaagatattcacactcaagtccaagccccaggatacagctgacaaggacgcagtgtatggtgtgcctttcagcactgacgaaccaacagacattattccccgttcatgccagctcatgacagacgtgcctcacgtgacgcaactgctgaacatgaccaaattaagacagaccgaaatcaagttcggcggtcatccattgagaagtgccgagtccgaccagttcatcaatagggggactagcatcacccggaattctaaaaatcaggacgtctgtcatatcgcctttggatcgaaggttcttgggcctcccccactgtcagggaggcgcaacaatatgaaaatatcctccgagacagtgcggtcagtcggatctaagaataatagatcttgccagccgtcgacagtggagaagtgtgtaaatggtacggagatgagcgctctgttaatacccgagtctgaagaacaagggaacaaggagaacatccatcagattaaacagaccgttcctatccacgcggctaatttgcacattatgcatccgcaccctcctcaggaaccctccgcagacaagaataacaacagaagacgcttgaggctgaagagcacctctcgcgagcggaccgagacccccagcggttctagctcagggaataacaggatcgaggataaagcatctaccatcctgacaactgtcagccaacagggggctgagctgctcaattcaggcacacttggtcctcagagtccagaccagagtgatgaatggatattcccggaaaatgccgatcatatatcttatctggccagttcacgccaaagtttattactgggagacgacagttgcaacccaagtcacctttggttggaagcttcgaaggagagtgaacacgatcagcaggcagaggagtcgcagtcagtccccaaggacatttttacgttcagttcccggcctagaagcgcccctcacggtaagactcagactatgagcccagaggaactatccttcatccttgatctcaaagaggacaattctgtcacttcccgagatacccagtcagaggacgatttctacggaggcgacagctctgaggaggggaaccatagcattcagggatcaaggggtcccaccactgggcctagcgagctgacccagctaacattggaaagtctactggggaaggcagcgaagcgtacctcaaaagaatacctcaggtccgcttataccgaggccggagcgacagaatcgcaggatagtagcatggaacagattgaccgcaataactttgagatgagtttactgcctaccacttgtctgtcgccaacaggccgaaggtgcgggtcttgccagaagacgccagagccagtcattaaagctaaagatctgtccgcccaacaagtccccgctagcctgaataagacttcactgaaagaaatttccggcgaaaggctcagcagcattcccgaggcttcagaatacgactggcgcaactatcaaccgtcccagatgtccgaatcagagctccagatgctcgcttcactgcgatggcagcaaaacgaggaacttgaggacgccggaacctctcacggcttgagcgcttcgcaagtcgataattgtaacgtcagtatctcaacttcctctgatgatacaacaacatggaacagctgcctaccccctcctgtcaaccaagggagacactatcaaaaagaaatgaaccctcctagcccctctaacccaagagactggttgaatatgctgagccccccaatcgtgcctcccagccagcagcccgctgagcagcggcctgacagctgtgagtctttatcagtccaaggtgaggaagacctgtccgtggaagaggacgaggaggtgctgacactgctgtacgatccatgtttaaactgttactttgaccctcagactggcaagtattacgaattagtctag

SEQ ID NO: 54356 - DNA, 753 bp, Artificial Sequence
  Description of Artificial Sequence: Synthetic coding sequence
atgtccgccgctgccagccctgcctccgagaggggatggaaatctgagaaactggacgaagcacaggctctggcccgtagttgcgccgctcgcagaccagattttcagccatgtgacgggctctctatctgtgctacccactctcacggcaagtgtttcaagctgcactggtgctgtcatcttggatggtgccactgtaaatatatgtaccagcccatgacaccagtcgaacagttgccttctaccgagatccccgcaagaccccgtgagccgacaaacacgatacagattagcgtgtctctgactgagcactttctgaaatttgcaagcgtatttcagcccccacttcccccagacagtccacgatattgcatgatttcagacttgtttattgataattaccaggtgaagtgtattaatgggaagatgtgctacgtgcaaaagcagccagcgccacactcccatagaatgtcccctgaggaggtgtccgctcacgacgcactgatttcaaaggagagtaatacaccaaaaattgatcattgtagttccccatccagcagtgaggatagtggaatcaacgccatcggagcccactacgttgaatcttgcgatgaggatactgaggagggagccgagttgagctccgaagaagactatagccccgagtcctcctgggagccagacgagtgtacgctcctgtctccgtctcagagcgacttagaagtcatcgaaaccatagagaccaccgtgtag

SEQ ID NO: 54357 - DNA, 528 bp, Artificial Sequence
  Description of Artificial Sequence: Synthetic coding sequence
atgactcgtacaccagttggcagcgccaggaccaggccgaagccccgaaagttagggcctcagagagggaaagcgctgcaggcatcctcaaggctctccgagtcccctgcgctcgtgaagaagcgcatgccggacgcttgtaccctggggagggccggaataggtctccctaagatgtgtctgcatatggccgtgcgacatagtaaggcgcagaagaccgggccaggaatattgcaacagcgacagaagccacctgcccctagggcgtctggtggtcccgcactcctcggcaaaagacgcggatgtagcgaagccggttctgcgtccctagaaccactgtcaagtagccgtgccgcagcgggttgcctgaaccaagtgccactaagccccttcctggccggaccacggaatactcgtaggctgcccgctccagagcgcgaaagaattgaactggctgcaaccttatgcctggaagggtggcccttgaggtgtcttgcaagtaagggaaaactccattgtgtgtactag

SEQ ID NO: 54358 - DNA, 492 bp, Artificial Sequence
  Description of Artificial Sequence: Synthetic coding sequence
atgcagtcggtcgactccatgctgggcactgtcggaggctgcggaggtggggaggctgcctccactttctccaaagaccccagcggctgctgcgtcggaaacgattgccgcgatggagggaggggcctggagcgaaggcatggcagatggtcccgtggggaaggcggagagagcgggctgtgttccggaggacaaatggcttcagagatcgaatactgggacggcttagctattagtgtcatggaagtcgagaaggccttcggctccacaaacgtgttgtggaaaacagagcccttcagtctgtgggcatgtaccgcagcatgcccccctagcctgtccccaacactattggctcttggtttacctagagatggtaaagagctcgccgagcagggatctttatggactgtcctggagcctgggggagattggtcacactcacagagtcagctggggactcccggacgaggcaaaggcgctctgggattctag

SEQ ID NO: 54359 - DNA, 801 bp, Artificial Sequence
  Description of Artificial Sequence: Synthetic coding sequence
atgtttgtcgaactgaataatttattgaatacaacacccgacagagcagaacagggtaagctgaccctcctgtgtgatgcgaagacagacggatcttttttggtgcatcacttcttgagtttttatttaaaggccaactgtaaggtatgcttcgtagctctgatccagtcattcagtcattatagcattgtgggccaaaagctgggcgtatcccttactatggccagggagcgagggcagcttgtgttccttgagggtttaaagagcgctgtggatgtggtgttccaggcacaaaaagagccccatccactgcagttcttaagagaggcaaatgctggcaatctgaaaccgctgttcgagttcgtccgagaggccctgaagccggtcgattccggtgaggcacgctggacctacccagtcctgcttgtggatgacctgagtgtgttattgtccttggggatgggcgcagtggccgtgctggactttatccattactgtagggccacagtctgctgggagctgaagggcaacatggtcgtgttggttcacgatagcggtgacgccgaggacgaggagaacgatatccttctgaacggactgagccaccagtcccacctgatcctgagggcagagggtctcgcaaccgggttctgtcgtgacgtccatggacagctgaggatcctgtggaggcgtccctcgcagccagccgttcatagagaccagtccttcacctatcagtacaagattcaggataagagtgttagcttttttgcaaaaggcatgagccccgctgtgctgtag

SEQ ID NO: 54360 - DNA, 729 bp, Artificial Sequence
  Description of Artificial Sequence: Synthetic coding sequence
atgtttgtggagctgaataatctcctgaacaccaccccggacagggccgagcagggcaaactcactttgttatgtgacgccaagaccgatgggagctttttggttcatcactttttatccttctacttaaaaggagtgtccctcaccatggcccgagagcgagggcaactggttttccttgaggggctgaagtccgcagtcgatgtggtgtttcaggcccaaaaggagccacatccccttcagtttctgcgggaagccaacgccggtaacctgaaacccctgtttgaatttgtcagagaagcattgaagcccgttgatagtggagaggctcggtggacataccctgttctgctcgtggatgacctgagcgttctcctgtctctgggaatgggggcagtagcggtgctcgactttattcactattgtagggctactgtgtgttgggagctcaaagggaatatggttgtgttggtgcacgattcaggtgacgccgaagacgaggagaatgacatattgctaaatggcttatctcaccagtctcacctgattctgagagcggaaggcctggccacaggcttttgtcgtgacgtgcatggccagcttagaatcctgtggagaaggccatctcagccagcagtgcatagggatcagtcatttacctatcagtacaaaattcaggataaaagcgtatccttctttgccaaagggatgagtcctgccgtcctgtag

SEQ ID NO: 54361 - DNA, 303 bp, Artificial Sequence
  Description of Artificial Sequence: Synthetic coding sequence
atgcacgtttgtgatctgcagaagctggtccgaatccaactggcttttacaaccttcccctggatgttttcgtgtcatctgttgcctactcccgagctaagcagcaaaaggaatcaatgcctgctctacaagacatctgggtgtttgacacagatgcctatcttgtacggtcatcctgcgaccctactaaaagattatatcttgcaggccatactgcagcctggtaaaaaaattcaggggggaaccgaaattcagagaggcagctttgcgaaccagtaccagaccgacgccagccatttgtag

SEQ ID NO: 54362 - DNA, 744 bp, Artificial Sequence
  Description of Artificial Sequence: Synthetic coding sequence
atgtgggggccaggcgtaactgccgaaggactgtccgtagcgcctgcacctccgccactgctgcccctactgctgctcttagctctggcactcgttgctccgtctcgcggtggcggaggatgcgccgagctggcctgtggcgagcgagagcgttgctgtgatgccaccaacgcaactgctgtgcgctgctgcaagctgccgctccatgcttttctcgacaacgtgggatggttcgtgcgcaaactgagcggtctgttgattttgcttgtcctcttcgcaatcggatatttcttgcagaggataatctgtccttcaccacggaggtacccgagagggcaggccagaccaggccagcgtcccggaccacccggaggtgccggaccactgggtggggcaggaccaccagatgatgacgacgacagtcccgctcttctgcgcgacgaagctgccgctggtagccaagactctctcttggattctggtggaggcggacgcggacgcggaggaggtggcaggtctgacccatcttgcgccagcgagcatgagatgcgggtagtatcacccgtttttctgcagctgcccagctacgaggaggtgaaatacctaccgacttacgaagaaagtatgcgcctgcagcaactgtcccccggagaagtcgttctgccagtgtcagtgctggggcgaccacggggaggagtggctgccgagccagatggcggagagggcagataccctctgatctag

SEQ ID NO: 54363 - DNA, 1080 bp, Artificial Sequence
  Description of Artificial Sequence: Synthetic coding sequence
atgaacctgaatccacctacatccgctcttcagatcgagggcaagggtagccacataatggccaggaatgtctcttgtttcctggtccgccacacaccccaccccaggcgggtctgtcacattaagggtctgaacaacataccgatctgcacggtgaacgatgacgaaaacgcatttgggacactgtggggagtgggccagagcaattacctggagaaaaacaggattccgtttgcgaattgttcatatccttctagtacagccgttcaggagtctcccgtgcgaggaatgagccctgccccaaacggcgcaaaagtcccaccgcgtccccactccgagccctctcgcaagattaaggagtgttttaagaccagtagtgaaaaccctcttgtcattaagaaggaggaaatcaaagctaagcggccaccctctcctccaaaagcatgctccacaccaggttcatgcagctcaggaatgacatccacaaagaacgatgtcaaagcgaataccatctgtatccccaactacctcgaccaggaaatcaagatcttagccaagctgtgttcaattctgcacactgacagcttagcagaggttctgcagtggctgctgcatgcaacctctaaagagaaagagtgggtgtctgcccttatacactccgagctcgccgaaattaatctgctgactcaccaccggaggaacacctccatggagcctgccgctgagacaggaaaaccccctaccgtgaagtcacctccaaccgtgaaactgcctcccaatttcactgcgaaatcaaaggtcttgaccagggacactgaaggagaccaacctacccgggtgagctcacaggggagcgaggagaacaaggaagttccaaaagaggccgaacataaaccaccgctgctgatacgacgaaacaatatgaagatccccgttgctgagtacttctcaaaaccaaattcccccccacgtcccaatactcaagagtctggtagcgctaaaccagtgtcagccagatctatccaagaatacaatttatgtccacagcgggcatgttacccttccacccaccgcagatag

SEQ ID NO: 54364 - DNA, 945 bp, Artificial Sequence
  Description of Artificial Sequence: Synthetic coding sequence
atggggtgtagatgttgcaaaataattcagtcctacctattcgatccagtgcaggtaccatcgccagggtacgtcaacgaagtgaattcctgcaagctggacgaggacgatacagataagttgaaagggaaatggtcatcagaagtattagtccagaagaatgatccacagagacaaggctccaaaaaaacagaatcatcaagcagaacagccgatccatgggaaccctgctggcctcaccagggacctctgcctcagggtgatgcgggaggtgagcatcatgcctgtggcgttaacgggatcggaccggcagctacaccacagcccaccggcaactcttctccgacacaggacgaccggggttcctgggcatcaaccgctaatacagtgccccctacccagccattcctcgaggggggagggaccaggaaacaggattgcgtactgctggccagtgagggaacacaggttatgagaaacggcgattctagggctccatccgaagccgagtcctttgcgttagaagtgcaggatcacgtctttcagatccccgctccagattacctgcagcattgggggcctgcaggtgataacgtcgaccataacgagaaggattgcgtgttcaaaaaccatactgaggacgagtctctggaaggcattcagcctccggtgggtgagcacggcctcaatacacccttcagcgtaaggcggtcctgggatagtcttaacgaagacgttgagaccgaagtactctcgatttgctttaacgagaaaggacctgtgcacgccatgccagtggtagactcaggtaataggcaggaggacactcacggatccgatggtgatggagacggcgagattgtggacgaagatgccgctgtggccgaggctttggctgcccttgaggccgcaaccgcaggcgaagacctcgatgaaacggattag

SEQ ID NO: 54365 - DNA, 945 bp, Artificial Sequence
  Description of Artificial Sequence: Synthetic coding sequence
atgggatgccgctgttgtaaaatcattcagtcttacctgtttgaccccgtgcaggtgccatccccgggttatgtaaacgaagtgaactcgtgcaagctcgacgaagatgacactgacaaactcaaaggcaagtggtcaagtgaggtgcttgtgcaaaagaacgacccgcagcgtcaaggatctaaaaagacggaatccagctcgaggaccgctgatccatgggaaccctgctggccgcaccagggacctctgccccagggggacgccggaggtgaacaccatgcctgtggggtaaacggaatcggacccgcagccactccgcagccaactgggaacagttccccgacacaagacgatcggggatcctgggcgagcaccgcaaacacggtgccccctacacaaccgttccttgagggaggagggacccgtaaacaagactgtgtgcttctagctagtgaggggactcaggtgatgagaaacggagactcccgagcgccaagcgaggcagagtccttcgcactggaagtgcaagatcacgtattccagatcccggctccggactatctgcaacattggggcccagctggcgacaatgtcgaccacaatgagaaggattgcgtttttaaaaaccacaccgaggatgagtccttggaaggcattcagcctccggtgggcgaacacggcctgaacactccattctcagtgcgcaggagctgggactcactgaatgaggacgtggaaaccgaggttctgtccatatgcttcaatgagaaaggcccagttcacgcaatgccagtagtcgactccggcaacaggcaagaggatacccacggctccgacggggacggagatggcgaaattgtcgatgaggacgccgcagtggctgaggccctggccgctctggaggccgcaacagcaggggaagacctggatgagacagattag

SEQ ID NO: 54366 - DNA, 702 bp, Artificial Sequence
  Description of Artificial Sequence: Synthetic coding sequence
atggaccaggaagagggactcaaagctctggacaacatcgtgactcagtttaatgcttacgaagactttctggacagtcagattaccaccgtcgatttgtattacctggaggacgaaaccctcgccaggcagctggtggagttggggtatcgcggtaccggagagcgagtgaaacgcgaagattttgaagccagaaaagctgccattgaaattgctcgcctggcagaacgggcacagcagaaaactcttaccagtgcaggtaaggacctgcaagataatttcctgactgcacttgccatgagagaagaagataacagaagcggtaagctcagtagtgtgatcttcattagagatcggaactcgcatgggcaggagatctccgggtatatagattacgcacatcgtctgaagactgaggacttcgaggtgtattttacaggtaagaaacgcctgctgccacggccaactgatatttccttttacaattgggacgccgacattgccgtcagcaattccagccctaattatcaggtcatcgctgacaatcctgaaggcctgctgtttagatataaacgggaccggaagatcctgaatgttgaccccaaagcgcagccaggcgataatagtactcggatcactatcctgactgagctgtatgttcaggccgtgatttttgaccacataagtaggcgcaagacctag

SEQ ID NO: 54367 - DNA, 753 bp, Artificial Sequence
  Description of Artificial Sequence: Synthetic coding sequence
atggaccaggaggaagggcttaaagcactggataacatcgtaacacagttcaatgcctacgaagacttcctggactcacagataacaaccgtggacctctactatctggaggatgaaacgttggcacgacagctcgttgagctgggctatcggggaactggcgagagagtcaagcgggaagatttcgaagcccgtaaagcagcgatcgaaatcgccagattagcggagcgggcacaacagaaaactctgacttctgccggtaaggaccttcaggacaactttctgacggctttggcaatgagggaggaagacaatcgttccggaaaactatcgctcaatcagcaggaaaccgatgccgctcatattctgaagaagcagttggcttctgtcattttcattagagatcgtaattcccacggacaggaaatttctgggtatatcgattatgcacacagacttaagaccgaggattttgaggtatattttaccggaaagaaaaggttgctaccacgacccaccgatatttctttttataactgggatgctgacattgctgtgtccaacagttcaccaaactaccaggtgattgccgacaaccccgaagggttgttattcaggtataaacgggatagaaaaatcctcaacgtggaccctaaggcccagccgggtgataattctacacggattacaattttgaccgaactgtatgtccaggccgtgatattcgatcacatctcaaggcggaaaacatag

SEQ ID NO: 54368 - DNA, 600 bp, Artificial Sequence
  Description of Artificial Sequence: Synthetic coding sequence
atggacttcaaaatcgaacatacatgggacggctttcccgtgaaacatgaaccggtcttcatacggctgaatccaggagacaggggcgtcatgatggatatcagtgcgccatttttccgcgacccccctgcccctctgggcgaacctgggaagcccttcaacgaactctgggactatgaggtggttgaggccttttttttaaatgacattactgagcagtatctcgaggtggagctatgtccacatgggcaacacctggtgttgcttttgagcggtagacggaacgtctggaagcaggaactgcctctgtcatttcgaatgtcacgcggtgagacgaaatgggaggggaaggcttatctaccctggtcatacttcccacctaatgtgaccaagttcaacagctttgccattcatggcagtaaagacaagcgcagttatgaggcactctacccagtgccgcagcacgagctgcagcaaggtcagaaacctgactttcactgcctggagtattttaagtcctttaactttaacaccttgctgggagaggagtggaagcagcctgagtcagacctgtggctaatcgagaaatgcgatatttag

SEQ ID NO: 54369 - DNA, 600 bp, Artificial Sequence
  Description of Artificial Sequence: Synthetic coding sequence
atggattttaagatagagcatacatgggacggcttccccgtcaagcacgaacctgtgttcatccgtctgaatcctggcgatcgcggagtaatgatggatatcagtgcgcctttcttccgcgatcccccagctcctttgggcgagcccggaaaacccttcaatgaactttgggattatgaggtggtagaagccttttttctgaacgatatcaccgagcaatacttagaggtggaattgtgcccccatggccagcatttggtcctgctgctctctggcagacgaaacgtatggaaacaggagttgccactatctttccgcatgagtagaggtgagactaagtgggaagggaaggcatatctcccttggagctattttcctcccaacgttactaaatttaactctttcgccattcacggcagcaaagacaaacggtcttatgaggctctatatcctgttccccagcatgagctgcagcaaggacagaagcccgacttccattgcctggagtactttaaatcgttcaattttaacacgttactgggcgaggaatggaagcagcccgaaagtgatctatggctgattgagaaatgcgatatctag

SEQ ID NO: 54370 - DNA, 195 bp, Artificial Sequence
  Description of Artificial Sequence: Synthetic coding sequence
atggactttaaaatcgaacatacctgggacggttttccagttaagcatgaacctgtgttcattcggctgaatcccggagaccggggagtaatgatggacatctcagccccttttttcagagacccacccgctccattgggcgaacctggcaagccatttaacgaactatgggactatgaggtcgtggaagcgtag

SEQ ID NO: 54371 - DNA, 354 bp, Artificial Sequence
  Description of Artificial Sequence: Synthetic coding sequence
atggcttatggcgttccaaggaaaaataccgttaaaacaattctcaggggttcctgttataatgttcaggagccgtgggacatcgccttactcgctaagacctggtctacaaatctcgccaatattaaattgccttttctcgaggaaatttcatttgggggatctgtccaattaactaaatgcacaacaatcaaagacggtttgctgccaagcgcggagagcattaagctggagcgcgagtatgaggtcaaaaggttgtgtaaactgaagtgccaagagaatacaagtaaggagatacagttgctgttaagagaaaggcccgcaggtctgcggagaccattgcccagtaagtag

SEQ ID NO: 54372 - DNA, 354 bp, Artificial Sequence
  Description of Artificial Sequence: Synthetic coding sequence
atggcctacggcgtgccaaggaagaacaccgtcaaaacgatcctgagagggtcctgctacaacgtccaggaaccatgggatatagctctcctagccaaaacatggtccaccaacctagccaatattaagctcccttttctggaggagatttcgttcggtggcagtgtccagctgaccaaatgtaccactataaaggatggcttactgcccagcgccgagagcatcaaattggagagggagtatgaggtaaagagactatgtaagttaaagtgccaggaaaacacaagtaaggaaattcagctgctcctgcgggagaggcctgcaggcctaaggcggccactcccaagcaagtag

SEQ ID NO: 54373 - DNA, 246 bp, Artificial Sequence
  Description of Artificial Sequence: Synthetic coding sequence
atggcgtacggcgtgccgagaaaaaacacagttaagactattctaaggggttcgtgctacaacgttcaggagccttgggacattgcattgcttgccaaaacctggagcaccaatctcgcgaacattaaattgcccttccttgaggagatttctttcggaggctccgtgcagctgaccaagtgtacgactatcaaagacggattgctccctagcgccgagtcaattaaactagagagagagtattag

SEQ ID NO: 54374 - DNA, 342 bp, Artificial Sequence
  Description of Artificial Sequence: Synthetic coding sequence
atggcttacggtgtacctagaaaaaatactgtaaagaccatactgcgaggctcatgttacaatgtgcaggagccctgggacatagcactgctggcaaagacatggtctacaaatctggcaaacatcaaattgcccttcctcgaggagatcagctttggagggtccgtccagctaactaaatgtacgactatcaaggacggtctactcccctccgccgagagtatcaaactggaaagagagtatgaagtgaagaggctctgcaagttgaagtgtcaggagaatacttcaaaggaaattcagttgctcctgagagagaggcccgctggcctgagacgtccttag

SEQ ID NO: 54375 - DNA, 1380 bp, Artificial Sequence
  Description of Artificial Sequence: Synthetic coding sequence
atgtatgaccgggctccccgactgctgaagctggctgagggagggagtacagaagcccacgtgggaccaggatcgtaccaggtgccgtttctcaagcaacaggccacaggaagtaacgccccattcctgtctctcacagctagggagtccacttttaccattgcctcaagtatcgagaaggctgtaccgggtccagggcactataatgtaagcgaggcacagaaaatctctcgctcacccactctcactaggtccgtggatgtgccaagtatccctagctgcggcaagagctatgggtatcatattaacgatgacggaagtatcattaaatgcttcccccctgcttgcgacagtaccctggggcctgcatactacaaaccacagtttgacgtctccaacgcaacactgaagtacaagggcatccattttgggaactcaagcggcagacaagagctgccgaagaagagtgggccagggcctgggcagtatgacattgtgcagaagaagactagctattacgagaacgttaacatcaagcgcgatcagcagcagaattactgctccttcatccctcgcctgtatgagatcatagtactacaggaaaaaaaaaagcgtttcctgcctatgaagagtatcacacctgcccctggcacctataatgaacctcggaccgcactgaagtcccttaaaaagaccagtggcctgaagaacattccattcggtcagagcgccgttcgctttacccaggacatcagaactgaagagatgcccggaccaggattttataatgttcttaataacacaataattgctagcgtaaggaatatttgtagcaagaagcagaagaaatctgcatttgggagttcggttccacggacatttttttcagtgcaaaaagaggcctgcgcaacccctggaccggctgattaccaggaattctggcacagccaaggggttgggattagtgacgaattacccaacctcaccaataagtacgccgcattcctgtccagggcaaagcggactatgaaagtgccagatatggtcatacccgcaccaggctcatacgacgtccacaaatcgtacgaaatgagccaggtcaaacacaaatatatgccccctaggtcattggtggccaagcgaaagcacgcctcttttctcagtgccacaccgagatgcctggaaaaagtcacagacggccctggccctgccgcttacaatcctgtccttcgaaaaagttgtccaatccccctgtttgtgaaggctagtaaaaggttcgaagagtcaaaggagatcacacccggacccgcaacttatgaaatttcccaggaaaagaagaaaggaaacctcatcggcgaaatggctgcggacataatgtag

SEQ ID NO: 54376 - DNA, 603 bp, Artificial Sequence
  Description of Artificial Sequence: Synthetic coding sequence
atgacttctgcagagaccgcgtcaagggcagcagagtctggcggaacccccgtgcgaccgtgctcccgcccacatcgagcaccctctcccgctgcgccatcccgacccggagcaccagcagctggccctaggaagctgctggtgcccggactcccctgtctggtgcggggaggctggccatggacaaggccggatagctcaccttttcggcctgctgctcgcccaagaatgtcacctcacagatccccggctgtcgctcggcgatgtggacggccacggaggagggatccacgccgtaggcgtacacccgctttgcccaggccctggccgggtagaggaggaccaggacgttctctgctccatcgccatctcttcatccaacaacttctgcggacgtgttggcccgcacttccacgggatcggacccccgctcctggaggcacaatgcccggtgcggcactggctggcccaggaagacaagctagtgggagcccagctcctcagagcgaaggggctccaccacgtccctggacaccactgcagccgggactgcatcatcggccacccagctcaagtagcgggctcctgtcctcttttttctag

SEQ ID NO: 54377 - DNA, 474 bp, Artificial Sequence
  Description of Artificial Sequence: Synthetic coding sequence
atggaaggttgtgccgtgcgacggggttcttgtcctctcctgccaggccctagcgcttggagagctagtcccgcaggttgggctgggagagcaaagttgagaagctggtgccgggcttcgggcctgccaaaccggccatacacacttacagggggaagacacggcagtgtatctctcttgcgacacccaggaactactacgtttgtccagcagagatcacttcaccaaagctgggaaaagaggattgtcttctctgcttgcccagtgagtaggtcgtggtgccctgagcgtaatttcagcggtagcattccagcagtcacaccgcctaagctccccggacactctaagtccgaggggcctcctggcaaagtgcggaagcgaactacgatcagatcacagcccttgttcgtgacgagaaccagaggctttgggagcgcagtgggatggttacctctgggcagccccgtcctgtag

SEQ ID NO: 54378 - DNA, 561 bp, Artificial Sequence
  Description of Artificial Sequence: Synthetic coding sequence
atgtggcttgtcgagtgtacaggcagggatctcactggcctttcttgcctcttatctatggatcgccaacccaggcgcaggcagcacgttgcaggatgtagagatgtgcccccacccctacctcagggatcttggggccaaacttcccctcgtcacagcatcctatgtagtaagtcaggttgtgatctgcttggcggaggggagtataatggggagaccagcggggaagagtttctcgcacctgcttggacatgcagagcgcagcaggctgcaacatggctgtccgtgcagcagacgtcacacaaagcgctgggtcctgcgggtggcgctgcaatgagttccaaattatcccctgaagagcagttcttaagcaggatccattttctgagaacctttatgtgcagcgtggcaggagccgagctacccggaatcccgcaggccacagagaatggcgagggatgccggccagccagagacccagccagctctccatcatcgctgagcatggccagcgtgtatacacagtgctctagtgctcaactggtctcagctttatcatag

SEQ ID NO: 54379 - DNA, 612 bp, Artificial Sequence
  Description of Artificial Sequence: Synthetic coding sequence
atgcccaaggccccaaaaggcaagagcgccggtcgtgaaaagaaagtcattcacccctatagtcgcaaagcagctcaaattactcgcgaggctcataaacaagaaaaaaaagaaaaactgaaaaatgagaaagctctgaggctcaatctcgtcggagaaaagctccagtggttccagaatcatctcgatcctcagaagaaaaggtacagcaagaaagacgcttgcgaactcatcgagagatacctgaatagattcagcagcgagttagaacagattgagctgcacaactcaatccgagatcggcagggtcgcaggcactgctctcgcgagaccgtgataaaacagaccatggagagagagcgacagcagttcgaaggatatggcttagaaatccctgacatacttaacgcctcaaatctaaaaacattccgtgagtgggactttgacctgaaaaagctgccgaatatcaagatgcggaagatctgtgccaacgatgctattccaaagacatgtaagcgaaagactattatcaccgtcgaccaggaccttggagagttggaactcaacgacgagagctccgattccgacgaggagatgacagccgtggcgtag

SEQ ID NO: 54380 - DNA, 837 bp, Artificial Sequence
  Description of Artificial Sequence: Synthetic coding sequence
atggtacgcggtgccggtccaggccctagcctgtccgcattgagccacccgaccggggcaagtggtatggctgctgcagaagggccaggctaccttgtatctccccaagccgagaagcatagacgggctagaaactggaccgatgctgagatgaggggactcatgttggtttgggaagagttttttgacgaattgaagcagaccaaacgcaatgccaaagtttatgagaagatggcctctaaactgttcgagatgacaggggagcggcgtttaggagaggaaattaagataaaaataactaatatgaccttccagtaccgaaaacttaaatgtatgactgattcggagagtgcaccccctgattggccctactacttggcaatagatgggattctagccaaagtacctgaaagctgtgacggtaaactgccagactctcaacccccaggcccttccactagtcagacagaggcgagtttgtcaccccctgcaaaaagcacacccctgtattttccatataatcagtgctcctatgagggcaggtttgaggacgacaggagtgattcctcttcttctcttttgagcctgaagtttagaagcgaagagcgtccagtgaagaaacgcaaggttcaatcttgccatctgcaaaagaagcagctcagactactggaggccatggtggaagagcaacggcgattgtctcgggcagtcgaagagacttgcagagaggtgcgacgtgttctcgatcagcagcacattctgcaggtgcagtccctgcaactgcaagagcggatgatgtcactgctggaacgaatcatcaccaagtccagtgtttag

SEQ ID NO: 54381 - DNA, 561 bp, Artificial Sequence
  Description of Artificial Sequence: Synthetic coding sequence
atggcctccgtttcctatcagaagcctacctccactacggttggcaaacagatgatttttaccggaccggactatataaaagactatctgccaaagatccaccagcacacttcctatgttggcgagcagcatcttgcactggagaaaaccggcgaccttcgatacctgtggagaccagctagcaatcgttcccttcccgctaagtacaagcacgagtacgtgagtgaaatcggatggcgaatcccgcagtacaacttcatcaataaatccagactcggaagcggtttccacatcaagtatgaagagctgtcgcaagcgagcctagattccatcacacacagatatcagaatccctggcagcccaaaccccatgtgctggacatgcagggcaagcagagtcgagccagctttgcatggcacatgagcgcctttgaagataccgatcagaggaactcaaaatgggcaatcctggtacggcagtgcaagtccagtctgcctcgtgcttcaaagcctccaaaactgcctaaacttcccaagaaagaaaagaaacgaaaacactag

SEQ ID NO: 54382 - DNA, 342 bp, Artificial Sequence
  Description of Artificial Sequence: Synthetic coding sequence
atggcggatccagaggagctgcaggtcagctcccctccccctccaccgccttcatctccttcttcttccgatgctagcgccgcatcctcgccaggcggaccagtgagcctgggatggcctgtcccttctcggagttccggaccaaccgtggatcaactggaggaagtcgaactccagattggggatgcagccttttcattgaccaagcttctcgaggccacaagcgccgtaagtgctcaggtcgaggagctggctttcaagtgtaccgagaatgcgcgatttctcaagacatggagggatctcctgaaagaaggatacgattcacttaagcccgatgactag

SEQ ID NO: 54383 - DNA, 930 bp, Artificial Sequence
  Description of Artificial Sequence: Synthetic coding sequence
atgccagcggagggaggtaagacagacatggagcgaattggtctcttctcagaaatggagtacatcactgtgggcgacaagtatgtcagccagtttaacagaccctttaatgaggccgcttccaaaaacaagcagatgttacctggaggatcaaaagaaatgtcggaccttcaggccggatactttgacccccatttcgtgcggatctttgagggggagggatatatcaacctcaaccaggttagaagacgggatatggtagaggcagcgaagaagaaccttggtaaggctttcctcccctcaaatggcgagaagaaaccgtgtggtctgggctcatactatggtacaatcggcggtcccgttccattcttcagtgcccagagtaagcctagagagaagtacaaagcccctggcaagaatctgtatactaatcctgggaagaagggaaccggatatggatacgccaatataacaatcggaaaacagttctctcacagcgccgatttctatgacgctgccaagctgaagtacaagaaggctaatgaggaacaccatcggctgctgaaaggagccccatttaaattgaatcttcaccctagggactacttcgacgctaatccttactttagtgaggaaagcctgccccctattaaaaaagaggaaaagaaaaagaccataagcaacacctttaagcccagtagcccagggaaaaaaccagggggaatgaaggctggaacgttcgatccctatcctagtcacagtgcggacccatacgtggcgaagcttgcaaacataagcgggaaagacgataaaatatttcatccacccagcggtccaaaatctcgtcccgtagaatcaattatgacattgaatgttagaagagcccttaacagcaagaactataagacgtcgtccgtgccgtcctactag

SEQ ID NO: 54384 - DNA, 486 bp, Artificial Sequence
  Description of Artificial Sequence: Synthetic coding sequence
atgcctgcagaagggggtaagacggacatggagcggatcggcctgttctccgagatggagtacataaccgtgggggacaagtacgtgtcccaattcaaccgtccattcaacgaagccgctagcaaaaacaaacagatgctccccggagggagcaaggagatgtcagacttacaagctggatacttcgacccacacttcgtgagaatattcgaaggagaaggctatatcaacctgaaccaggttagaagacgagatatggtggaggcagcaaaaaagaacctcgggaaggccttccttccgtcaaacggcgagaagaagccctgcggactaggttcttactacgggacaatcggaggccctgtgccatttttctcagctcagtccaaaccacgggaaaagtataaggcgcctggtaaaaacctttacactaacccaggaaaaaagggaacaggttacggctacgctaatataacaataggaaaatag

SEQ ID NO: 54385 - DNA, 537 bp, Artificial Sequence
  Description of Artificial Sequence: Synthetic coding sequence
atgcccgcagaaggcggaaagactgatatggagcgcataggcctgtttagcgagatggagtatatcactgtcggggataagtacgttagccaatttaaccgtccgtttaacgaggccgcaagtaagaacaagcaaatgcttccgggaggcagtaaagaaatgtctgatttacaagccggttatttcgacccccatttcgtcagaatattcgagggtgagggttacattaacttaaatcaagtccgtagacgcgatatggtcgaagccgctaagaagaatctgggcaaggcctttctcccttctaacggagagaagaagccctgtggtctcggcagctactatgggaccatagggggacctgtccccttcttttctgctcagtctaaacctagggaaaaatataaagcccctggcaagaatctctatacaaacccaggaaaaaaaggaacagggtatggatacgctaatattacaataggcaaacagtttagtcattctgccgacttctacgatgcagctaagctgaaatataagtag

SEQ ID NO: 54386 - DNA, 831 bp, Artificial Sequence
  Description of Artificial Sequence: Synthetic coding sequence
atgctgagagattccgaggccgaggtgactgaagaggacccacgccttcgtgcgcagcaactgcatcatagggttttgaccttacaatgccagctccgcgaccaaggtgctgcacaccaagcctcactcgatgaggccactcgcttacaggaagaactccaggccaaattggaagagctgcagaagaaacagcatgaggctaagctggccgtgactcccctaaaggctaagatcgcgagcctcgtcagaaaatgtcgggagcgcaatagattgatcacgcacttgctgcaggagttgcatcgacatggcctaggaaatttgctcttaagcgagcttgctcagaatatgctgaacgatgtggctctggctgagtacacagccacgttcctggctcccggagtgccagagacctcccaccaccttgatgttaagagtgagatgaccgcagctctgcgcgctcagacctacttattgaatccagaaatggacagtgtcctgcaatccagcctgagctccgagtcgtggccaataccagaacctgagtggcccgctcagaccgcacagctagactcacttaagctgccgctgtctctggtttccaccttagatccaggcacttgccttgccgcagtgaccgtagagccaggtctccccgcacagagacttcaggaaaagggcggtatgccgtgtccagccctgcaggtggacaatgttccagcgccttcagaactgttgtcccctgccagaatcttagccttccaccaggaactgagacagagcatctgttccaacagccaggtgcataaatcacccctggagctcgaaatgtag

SEQ ID NO: 54387 - DNA, 2253 bp, Artificial Sequence
  Description of Artificial Sequence: Synthetic coding sequence
atgctgttcttcgcgggagagacaggtttacctctgttcccgagattcgccctgtccgtggagggagcagagccaaccgaccacggccacccccaagccgttagtaaagggcataatcgctgcgccctgactatagacgagttagcacaggacgtggaggcatgtttccagcagctatccacattgcaacccggttctcggggatggcaatgctcagcaagcgcatgtaggggagagaactggagtttcgcccagaaatggcattccggttgggagcgcgctcacagtcagcaggtctggggcaactgggggatctgtagcaatgaggaagccaagtctaaagaaagtggggagggcgacaagccagggaagacgacagccctggggacatcagaggtgcctggtaaccctggtaccttgccacactgggatgaagcaagccccaaccccccacaaggacccgctgaaccatggggcgctctggaacgtgttagatctaggtttcatcagctcatctctggtctcaaaaaacaaagatctcaaattctgcacgacaatacgaagctgcatggtgatcaggagagattccacgagcgggtatgcgcgctggaacgtgagcgcgagcgcgaggttacaaagatcagtaggttggagcgtgacaaccaccggctggttggggatatctcccagctgaagaaagagttggatcagtacctacaagctatcagtgacttggaagactgcaatgggaagtcatactgtaagatcttggaactcgaggaggagaacgagaccctgaagggtaatcttggacagttgcagaaggcaacaagcgagagcgtgcgaaagtccaaagataccatggagcaggtaactttagagaactggaaacttcaaacccttatcagcgagctcggcgttagttataaggagcttattaaggatatcgtactgggcattgaagacatgattagagcattatctggggagaacgaacacttactgcggcgtgttcacgtactggagcgcgaagtgaccttgcaacgcagcactgaccagggcagactcgtccggggtcgcgaacacctgcaaggaaaagctaagatgcacgccctggacaaggaggtacaggtcacacctctgactgggcagcttctgagtagggcctgtgggcctcctttagaagaagagatgtcgttggccgcaggccagacgggacccagcacaggaacaggcaattctaggcgtggtgctgattctcctcctccttcactcgtatggaggaacactggggtcgcaaatgccttacaggggaatgtcagcggagctgaggttaaggaagctcatctcgagaaggaggaaaagcgcccacggtgcagtgtggcgcaggggcaggccctatccagtctgtctaatggaccgatgctgcgggattcagaagcagaggtcaccgaggaggatcccagactgcgagcccagcagcttcaccatcgagtcctgacgctgcagtgtcagctgagagatcagggtgctgcacatcaggcttccttggatgaagcaactaggctgcaggaggagcttcaagctaagctagaagagttgcagaaaaaacaacatgaggctaagctggccgttaccccactgaaggcaaaaatagcctctttagtgagaaagtgccgcgagcggaaccgccttattacccaccttctgcaagaactgcacaggcacggcctcggcaatctacttctctccgagctcgctcagaatatgctcaacgacgttgcactggccgagtacactgccacgttcctcgcccctggggtcccagaaacgtcccaccacctggacgtgaagtccgaaatgacagctgccctgcgcgctcagacctatctactgaatccggaaatggattcagtgctgcaatcaagcctgagtagcgagtcatggcccatacctgagccagagtggccggctcaaacggcgcaattggactccttgaagctgcctttgagtctggtttctacgctggaccctggcacttgcttagccgcagtgaccgttgagcctgggctccccgcacagcgattgcaagagaagggtggcatgccatgtcccgcactgcaggtggacaacgttccagcgcctagtgaacttctgtctccagcaagaattctggcattccatcaggaactgcggcagagcatttgctccaactctcaagttcataaatctcctctcgagctggagatgtag

SEQ ID NO: 54388 - DNA, 609 bp, Artificial Sequence
  Description of Artificial Sequence: Synthetic coding sequence
atgtctcattatttctacctcacgccccagattctactgcctttctcacctctgacttcccaggagttcgatcttatcagaaggaaggcaggagcctcctggcaagacgaaactcggtggagcgactcatcagtgacaacttacaccggtagttatcggaagaaacagctggacaagtccatgtgttctcagtttagttttcgcgctggccagcatgaaccggagtgtaagcaaatgtcattgacgaacagtagcgcgtgtcacctcctctgttgggccggaacacaggagaccacagacatcaagggcttgtttccagacatcactagaccctttaagaaaagctttgacgttaagcatggtgtcgcgcatcaaatctgggatttcggtgattgttttcctacccccccaaattacggcaaatactgcgtcaggcctaagaaacctgcccaggaggcactaatcaactactctcgcaggggaaaaggtgtgctgaaacatctgcatgggagatgcgattctgaatcgaaagtgtgtagcagcgaggactcggaggcagacagatactctgactatggatgggggggtccctcctcgccattcaattag

SEQ ID NO: 54389 - DNA, 489 bp, Artificial Sequence
  Description of Artificial Sequence: Synthetic coding sequence
taagactcatcagtcaccacttataccggctcataccggaaaaagcaactcgataagtcaatgtgcagtcagttctcgttccgggctggacagcatgaacccgaatgcaagcagatgtcccttacgaattcatctgcctgtcacctcttatgttgggcgggaacccaggagacaaccgacatcaaagggctcttcccagacattactcggccttttaagaagagctttgatgttaagcacggcgtcgctcatcagatctgggactttggcgactgcttccctacacctccgaattatggcaagtactgcgtcaggcctaaaaagcccgcacaggaggccctgatcaactacagccgacgaggcaaaggggtgttaaagcatttacatggaagatgtgacagtgaatctaaggtgtgctcttccgaggactccgaggcagacagatattcagactatggttgggggggtcctagttccccttttaactag

SEQ ID NO: 54390 - DNA, 507 bp, Artificial Sequence
  Description of Artificial Sequence: Synthetic coding sequence
atggtgaaggaggtgtggagggtgctccgagaggagcctggccgtcggaaagaatccaggcaaaatcgggctaggggcaatcgggtccagcagaattcctcgaatctgaatcccacacccgctccgggaccccattctactgagagccgaggcagacggcgtgctggctctgaggcccctccggtgcctggatcagagtcattgtctacaagtagtgaaagaggacatggccctgccgtaggtaacttagtgagcgagagcgccggaaggtcggccggacagggctctccaggtcccgacgccatgtcacggaacctgagaacagctctgattttcgggggattcatctctctgatcggagccgctttctatccaatctactttcgcccactgatgcgattggaagagtataaaaaggaacaagccatcaacagagccggaattgtgcaagaggacgtgcagccacccggattgaaggtgtggtctgaccccttcgggcgtaagtag

SEQ ID NO: 54391 - DNA, 204 bp, Artificial Sequence
  Description of Artificial Sequence: Synthetic coding sequence
atgtcgcggaacctgagaaccgctctgatcttcggcggttttatctcattgatcggagccgcattttacccaatatattttcgacctctgatgagactggaagagtataagaaggaacaggcaatcaaccgagccggaattgtacaggaagacgtccagccaccaggtctcaaagtctggagcgatccattcggaagaaagtag

SEQ ID NO: 54392 - DNA, 282 bp, Artificial Sequence
  Description of Artificial Sequence: Synthetic coding sequence
atggacacacagaaacagatccataaaacccacaacagtaagaaccagttctttactatcttcttttttttaagtgtagaatttggcaaggagggtacgagaaagaacttctaccttttactgtcaattggtcactacggtagaaaaagtaggcgcgctgacctggggaccgccgacactgcagacaagaccgagccagagtgcttcgctgcaagttggacgtttgacccgaatcctagtgtaaccgtttccggagcccatagcaccgctgtccaccagtag

SEQ ID NO: 54393 - DNA, 477 bp, Artificial Sequence
  Description of Artificial Sequence: Synthetic coding sequence
atgccggagccccctaccccgagcgtcggcagctgcgcggcaagagcatcccgtatgagcgccgctccatgctctagagccccatcacccatagaccatccaagagctgaagagtgtgggagggcggcacgggattggcaggcagcccctccggctgcgccagtccgggaccccctgggggaagccagctgggctcctgaaagcggggaagatatggagaatctctacgtgcaattaaaactccaatccgtgggtacctgctttaaccgagaagagctgccctccgttctgcagggcgaggaactcggggcaaccagcgtcacaaataaacctgggttgagcgctatgcggaaggaaacagaccagcaggtgggtgaacgtaaactcacatattgtggcgatcaggtgacactgttcacggaccaggctctttcccaaatactaagcagcgaggaaggtcgaatcaaagtcatgtag

SEQ ID NO: 54394 - DNA, 1329 bp, Artificial Sequence
  Description of Artificial Sequence: Synthetic coding sequence
atgagcgatagcgctgggggacgggctggactccggcgataccccaagctcccagtctgggtggttgaagaccaccaggaggtgcttccctttatttatcgagccattgggagtaagcatctcccagcctctaatgtgtctttcctgcatttcgattctcacccggacctcttaatccccgtgaacatgccagctgatactgtgtttgacaaagaaacacttttcggtgagttaagcattgaaaactggatcatgccagctgtctatgctggccatttctctcacgtgatatggttccatcccacttgggcacagcagatccgcgaaggccgtcatcattttctggttggtaaggatactagcactaccacaattcgggtcacaagtactgatcactattttctctctgacggtctgtacgttcccgaggaccagctggaaaatcagaagccactgcagcttgatgtgattatggtgaagccttacaagttgtgtaacaatcaggaagagaacgacgcagtgagtagtgctaagaagcccaaattggctctggaagatagtgagaacactgcgtccacaaactgcgacagctcctcagagggcctagagaaggatactgccacacaacggtctgaccagacatgtctggagcctagctgctcttgttcctcggaaaatcaggagtgccagacagcagccagcactggggagatactggagatcctcaagaaaggtaaagccttcgtgctggacatcgatctggacttcttctcagtgaagaacccttttaaggagatgttcactcaggaggagtacaaaatcctccaagagttgtaccagttcaagaaaccgggtaccaatctgaccgaagaagacctagtcgatattgtggacacaagaatccatcagctcgaggatctggaggctacatttgctgatctgtgtgacggcgatgatgaagagacagtgcagaggtgggccagcaacccaggtatggagagtctggtgccactcgtgcagtccctgaagaagaggatggaggtccctgattacgagatggtccaccaggccggtttaacttgtgattacagtgaactgcctcaccacatatctaccgaacaggaaattgagtgtctgattcagtcagtgcactatctcttaaaaaatcttccgaatcctacattggttactattgcacggagcagcctcgatgattattgtccttcagaccaggttgatactatccaggagaaggtcctcaacatgttaagggctctgtatggcaatctcgatctgcaggtgtacgccgcagagtcaccgccttcctag

SEQ ID NO: 54395 - DNA, 492 bp, Artificial Sequence
  Description of Artificial Sequence: Synthetic coding sequence
atggaagtgccagactatgaaatgtttcctgcgagctcatcttctccttcagagacaacgagcgcctggatcagcttatctatgtctctgtccgccttttggtccaaaccattcaataagtcactgggaagtagcaagctgtccaacatctcactgccgtcaagcgagcctagcaagctctttcaacccctgcccgtgcctaagctgttaccacatttccaagtccatcaggcgggactaacatgcgactattccgagctcccccaccacatctcgaccgagcaagagatcgagtgtttgatacagagcgtgcactacctactcaagaacctaccgaatccaaccttagttaccatagccaggtcttctttagatgattactgtccttccgatcaggtcgataccatacaggaaaaagtactgaacatgctccgcgctttgtacgggaacctcgacctgcaagtgtatgccgctgagagtcctccctcatag

SEQ ID NO: 54396 - DNA, 534 bp, Artificial Sequence
  Description of Artificial Sequence: Synthetic coding sequence
ctggtgtcccaagaagagtataagattctgcaagaactatatcagttcaagaagccgggaactaatctgactgaagaggatctggtcgacattgtggataccaggatccaccagctggaggacttggaagcaaccttcgccgacttatgtgacggtgacgatgaggaaacagtgcagcggtgggctagcaacccaggcatggaatcattggtgccacttgtccaaagcttgaaaaagcggatggaggtaccagattacgaaatggtgcatcaggcagggctaacttgcgattactccgaactgccacatcacatatctaccgagcaggagattgagtgcctgatccaaagtgtccactacctcctgaaaaacttgcctaatcctaccctcgtcacaatcgctagaagttctctagacgactattgcccttccgatcaagtggacacgatccaggaaaaagtactcaatatgttgcgggctctatacggcaatcttgatctacaggtgtacgccgcagagagtccaccatcctag

SEQ ID NO: 54397 - DNA, 567 bp, Artificial Sequence
  Description of Artificial Sequence: Synthetic coding sequence
atgatgcatccagtggcctccagcaatccagcgttctgcggccctgggaagccatcatgcttgaacgaagacgcaatgagggctgccgaccagttcgacatctacagctctcagcagtcaaagtactcacacactgtgaaccacaaaccaatggtatgtcagaggcaggaccctctcaacgagacccacctgcagacaacatcaggtcggtctatcgagatcaaggatgaattgaagaaaaagaaaaatctcaacagaagtggcaagagaggtagaccatctggaacgaccaaatctgccggatatagaacctcaactggtcgccctctggggaccaccaaagcagcgggttttaaaaccagccccggtaggcctctcggaactaccaaggccgcagggtacaaggtcagccccggtaggccccctggttcaataaaggctctcagccgcttagctgacttgggctatgggtgtgggaccgccgcatttccttatccaatgatgcacgggcgtgcagttcatggtgtcgaggagactagcagtgaggtgaagccacccaatgaatag

SEQ ID NO: 54398 - DNA, 567 bp, Artificial Sequence
  Description of Artificial Sequence: Synthetic coding sequence
atgatgcacccggtggcctcatctaaccctgctttctgtggcccaggcaagccgtcttgcttgaacgaagacgccatgagagctgctgatcagttcgatatctactcttctcagcagtccaagtactcacacacagtgaaccataaacctatggtctgccagaggcaagaccctctgaacgagacacacctgcagacgacatctggcaggtcaatagagatcaaagatgagctaaaaaaaaagaagaacctgaaccggtctggtaaacgagggcgtccttcaggaaccacgaagagtgctggatacagaactagcacaggtcgcccactcggcacaacaaaagctgccggtttcaaaacctctccaggtaggccccttggcacgacaaaagctgcaggctataaagtgagtcctggacggcctcccggatctatcaaggccctgagtagattggctgaccttgggtatggttgtggcaccgccgcatttccatacccaatgatgcatggcagagcagtacacggtgtggaagagactagttcagaagtaaagcccccaaatgaatag

SEQ ID NO: 54399 - DNA, 567 bp, Artificial Sequence
  Description of Artificial Sequence: Synthetic coding sequence
atgatgcacccagtagccagttccaatccagctttctgcgggcctggtaagcctagctgcttaaacgaggacgccatgcgcgcagcagaccaatttgatatctacagcagtcagcaatctaaatatagccacacagtgaatcataagcctatggtgtgccagcggcaggacccactcaacgagacccacctccagactacatctggaagatctatcgagataaaagacgaattgaaaaaaaagaagaatctgaatcgctctggaaaaaggggccgacccagcggcaccactaagtctgcgggttacaggacctctacaggtaggccgctgggtaccaccaaagccgcaggctttaaaaccagcccgggacggcctcttggcacgactaaggctgccggttacaaagttagtcctggtagacctcccggaagcattaaagctttatctcggctggcagatttgggatacggatgtggtactgccgctttcccttaccccatgatgcatggccgtgcggtccacggggttgaagagacttcctccgaagtcaagccccctaatgagtag

SEQ ID NO: 54400 - DNA, 24 bp, Artificial Sequence
  Description of Artificial Sequence: Synthetic coding sequence
atgatgcatccggtcgctagctag

SEQ ID NO: 54401 - DNA, 1002 bp, Artificial Sequence
  Description of Artificial Sequence: Synthetic coding sequence
atgccccgttcattcgaacaagtcatcattcttaaaaagtggttcctgaagccttacaagggccaaactctgcctggtcgggtcttgttcttgaggtatgttgtgcagacgctagaggatgactttcaacagacgttaagacggcaacggcagcacctgcagcaatccattgccaacatggttctgtcatgtgacaagcaaccccataacgtgagagacgtgattaaatggctggtaaaagcggtcactgaagacggtttgacacagccgcctaacggcaaccagacctcaagcggcactggaattctgaaagcatcttccagtcatccttcttctcagccaaatctgacaaagaatactaaccagctgatcgtgtgtcaactgcagagaatgctgtcaatcgccgtggaggttgataggactcctacttgttcttccaataaaattgcggagatgatgtttggcttcgtgctagacatacccgaacggtctcagcgggagatgttcttcacaaccatggaatcccatcttctgcggtgtaaggtgctggagatcatctttctacacagctgcgagacaccaacaaggttgccactgtctttagcccaggccttgtactttctgaacaatagtactagcttgctgaagtgccagagtgataagtctcaatggcagacatgggacgagctggttgagcaccttcaattcctgctctcgtcctatcagcacgtgcttcgggagcacctgaggtcctctgtgatcgacagaaaggacctgataatcaaaaggatcaaaccaaaaccacagcagggggacgacatcactgtagttgacgtcgagaaacagatagaagccttccgctccaggcttattcaaatgctgggcgaacctctcgtacctcagctgcaagacaaagtccatctgcttaagctcttactgttctacgccgctgatttgaacccagatgctgaacctttccagaaaggttggtctgggagctag

SEQ ID NO: 54402 - DNA, 1374 bp, Artificial Sequence
  Description of Artificial Sequence: Synthetic coding sequence
atggaggacttcattgtgattagcgacgactcgggctcagagagttcaggcggagccaggccaggtagatctcggagacccaggcgcgctttgtctcggacttctggcgcactcccaagacgtaccgtgaacaaaggacagaagctcgaacctatccctcataggcggctaaggatggtcaccaatacgatcgaagagaacttcccactcggcaccgttcagtttttgatggactttgtgtctccccaacattacccccctagagagattgtggctcacatcatacagaagatccttctgtctggctctgaaactgtagatgttctgaaagaggcatacatgctgctgatgaagattcaacagctccatccagccaacgcaaagactgtggagtgggattggaagcttcttacctatgtgatggaggaagaggggcagactctgccaggaagagtgctcttcttgcggtacgttgtgcagacactcgaagatgacttccagcaaacacttagaaggcagagacagcacttacagcaatccatagccaatatggtactgtcttgcgacaagcagccgcacaatgtgcgcgacgtgatcaaatggcttgtaaaagccgtcacagaagacggcctaacacagcctcccaatggcaaccaaacaagtagtggtacagggattctgaaagcctcttcatcacatccgtctagccagcctaatctgacaaagaatactaaccagctcatcgtgtgtcaattgcagcgcatgctgagtatcgcagttgaggtcgatagaactcctacatgctcctcgaacaaaattgctgaaatgatgttcggctttgttctcgatattccagagcggagccaacgcgagatgtttttcactaccatggaatcccatcttctgcggtgtaaggtgctagagatcattttcctacacagttgcgaaacaccaactcggcttccgcttagtctagcccaggctctgtatttcctgaacaacagtacttctctactaaagtgccaaagtgacaagagtcaatggcaaacctgggatgagctggtcgaacacctgcaattcctcttgtcctcataccagcacgtgcttagagagcacctcagatcaagcgtcattgatcgcaaagatcttatcataaaacgtattaagcctaagcctcaacagggcgatgacataactgttgtggacgtggaaaagcaaatcgaggctttcaggtccaggttgatccaaatgctgggggagcctttagtgcctcagctccaggataaggttcacctgttaaagctgttgctcttctatgccgctgacttaaatccagacgccgaaccgtttcagaagggttggtctggaagctag

SEQ ID NO: 54403 - DNA, 978 bp, Artificial Sequence
  Description of Artificial Sequence: Synthetic coding sequence
atggaaggacatgtcgatcgttcgtcgcagccaactgccagaagaatcattaactcggaccctgttgacctcgacctggtcgaagaaaacaccttcgtaggtccccctccggctacttctatttcaggaggctccgtttatcctactgaacccaattgctcctccgcaacttttactggaaacctgtccttcctcgcgagcctacagctgtcctctgacgtgagctccctctccccaacctctaataactcacggtccagctcatcgtccagtaaccagaaagcccctctaccctgtccccaacaagacgtctcgagaccccctcaggcccttccttgcccacttaggcctctgccttgcccaccgcgtgctagcccttgtcctcccagagcctcgtcctgcccaccaagagctctttcttgtccaagtcagactatgcagtgccaacttcccgcactgacccacccgccacaggaagtgccttgccctaggcagaacattcctggaccccctcaagattcgctcggacttccccaggatgtccccggactcccccagtcaatcttgcacccacaggatgtggcttatctacaggacatgccgagatcgccaggagatgtccctcaaagcccctccgacgtgtcaccttcccccgacgcacctcagtcgcctggaggcatgccacacctgcccggagatgtgctccatagccccggagatatgcctcattcgtccggcgatgtgacgcattcaccgcgtgatattccccacctgcctggggaccgacctgactttacccagaacgatgtgcaaaatcgtgatatgcccatggatatttcagccctatcatccccttcatgctctcctacatggggcactgaacaggactctgtcaaaaagaaaaaaaaaaaaaagcgaaaggagatcccccctaattttctcctttttaatttatacagaacgagggttaagaattag

SEQ ID NO: 54404 - DNA, 1836 bp, Artificial Sequence
  Description of Artificial Sequence: Synthetic coding sequence
atggaagattttatcgtcatctctgacgatagcggatctgaaagtagcgggggtgctcgacctggccgtagtaggcgacctcgcagagcgctctcgcggacttccggtgctctgcctcggaggaccgtggatttcattgacttaacaagggagacgcgcccaaggaccaaggatcgatccggcttatatgtcatcgacttaacgagagccgaaggggagaacagacccatcgctacactggacctgacactggaaccggttaccccctcacagaaagaacctacttcacttcagacatgtgctagcctcagcggtaaggcggttatggagggccacgtggaccgttcatcacagccgaccgcacggcgaataatcaatagcgatccggtggatctggacctggtcgaggagaacacttttgtcggaccaccacccgctacgtcaattagcggcggttccgtctacccaacagaacctaactgcagctctgcgactttcactggcaatctgtcttttctggcatcactgcaactttcaagtgatgtcagttcgctgtcaccgacatccaacaattcacgtagttcctcctcttcctccaaccaaaaagcccctctgccgtgcccgcagcaggatgtgagccggcctccacaagcattgccctgtccacttcgtccattgccctgcccacctcgggcttccccttgtcctcctcgggcttctagttgcccccctagagcgttgtcatgcccttcacagacaatgcagtgtcaactgcccgctctcacccaccctccccaagaggtgccttgccctcgccagaacatccctggaccccctcaggacagtctgggcttgcctcaggatgtgcccggtttgccacagtctattttgcacccccaggacgtggcatacctgcaagatatgcccagatcccctggagatgttccgcagtctcccagcgacgtctctccgagtcctgacgccccacagtcacctggcggaatgccgcatctgcccggtgacgtgcttcactctcctggagacatgccccattccagtggcgacgtgacgcactcccctcgtgatatcccacatctacctggtgataggcccgattttacacaaaacgacgtacaaaatcgagatatgccaatggatataagcgcattaagctctccaagttgtagcccctcgcctcagtcagagacacccctggaaaaagtgccctggctgagcgtgatggaaacacctgcccgaaaggagataagtctctcagagccagcgaagccaggttccgcccacgtgcaatcgaggacacctcaagggggactgtataaccggccttgcctgcatcgtttgaaatattttctgcgacctccggtccaccacctttttttccagactctgatccctgataaggacacgcgggaaaataaaggccagaagctcgagcctatccctcatcgacggttgagaatggtgactaatacaattgaggaaaactttcccctgggcaccgtgcagtttctcatggatttcgtgtcccctcagcattacccccctagagaaatcgtagcacacatcatccagaaaattcttttgtcaggtagcgaaaccgtcgacgtgttgaaagaggcttatatgctcctcatgaagatccagcagctccatcccgctaacgctaagacggtggaatgggactggaagttactgacatacgtcatggaggaggagccagcagaatgcctgcgactgcaggccagggccactacaccagattggttctggtggagaagaggttttgcagtcctggccggacctgtttctagtccatag

SEQ ID NO: 54405 - DNA, 1374 bp, Artificial Sequence
  Description of Artificial Sequence: Synthetic coding sequence
atggaggatttcatcgtgatctccgacgattccgggagcgaatctagcggcggagctagacctggccgttcccgtagaccacggagagccctttctagaacatcaggggcactacctagacggaccgtgaacaagggtcagaagttagaaccaattccgcacaggcgtttacggatggtgacaaataccatcgaggaaaattttcctcttgggacagtgcagtttctgatggattttgtttccccccaacattatccccctcgagagattgttgcacacatcatccagaaaattctgctgtctggctccgaaaccgtagatgtgctcaaggaggcctacatgcttctgatgaagatccagcagctacaccccgcaaatgcaaagacagtcgagtgggactggaagttgctgacctacgtgatggaggaggaaggacaaaccttgcccggacgggtgctcttccttagatatgttgtgcaaaccctggaggatgactttcaacagacgttgcgaagacagagacagcatcttcaacaatccatcgccaacatggtactctcgtgtgacaaacagccccataatgttcgcgacgttattaagtggcttgtcaaggccgtcactgaggacggactgacacaacccccaaacggcaaccaaaccagctctgggaccgggattctaaaggccagcagcagccacccatcatcacagccaaacctgaccaagaatactaatcagctcatagtatgccagttgcagcgaatgctaagtattgctgtggaagtagatcggacgcccacatgcagcagtaacaaaattgctgaaatgatgttcggcttcgtgctggacattcccgagaggtctcagagggagatgttcttcaccacgatggaatcacatctcttacgatgtaaagtgctggagattatattccttcacagctgtgagacacccacccggctccccctgagtctggcccaggccctctactttctgaataacagcacctccctgctgaagtgccagagcgataagtcacagtggcagacttgggacgaattggtggaacacctccagtttctgctgagttcttatcagcatgttctccgtgagcatctccggtcaagtgtgattgataggaaggatctaattattaagcgaataaagcctaaacctcaacagggcgacgacattacagtcgtagacgtggagaaacaaatagaagcttttcgaagcaggcttatccaaatgctgggtgagcccctggtaccacagctgcaagataaggtgcatctccttaaactcttgctgttttacgccgctgatcttaatccagatgcggagccatttcagaaagggtggtcgggaagctag

SEQ ID NO: 54406 - DNA, 2619 bp, Artificial Sequence
  Description of Artificial Sequence: Synthetic coding sequence
atggcacctgcctctgcctcaggcgaagatctgcggaagctccccactatggctgaagtgaatggcgaacaagattttattgatctcaccagagaaacacgccctcgcacgaaggaccggagcggcctgtacgtgattgatctcacgcgcgctgagggcgaaaatcgaccgatcgcaaccttggacttaacactagagccagtgacccccagtcaaaaagagcccactagccttcagacctgcgcttctttgagtggtaaagccgtaatggaaggccatgttgacaggtcttctcagcccactgcgcgtcggataatcaattcggaccccgtggatctggaccttgtggaagaaaatacgttcgttggccctccccctgctacaagcatttccggaggatccgtttatccaaccgaacctaactgcagttccgctacattcacaggcaacctgagtttcctcgcttcattgcaactctctagcgatgtgtcaagcctgtctccgacctccaacaatagcaggagttcttcttccagttctaaccagaaggcacctctcccatgcccccagcaggacgtctctagaccccctcaggcgctcccctgccctctcaggccgcttccatgcccgccaagggctagcccctgtccgccaagggcttcatcttgcccacccagagccttatcatgtccatctcaaacgatgcagtgtcaactgccagccctcacccacccaccccaggaagtgccatgcccaagacagaatatccccggaccaccccaggactctctgggccttccccaggacgtgccagggttaccccagagtatactacatccacaagatgtggcttatctccaggacatgccacgctctccgggagacgtgcctcagtccccctccgatgtctcccctagccctgacgccccacagtccccaggcggaatgccccacctcccaggagacgtgctgcattctcctggagatatgcctcattcaagtggtgacgtgacacattctccgagggatatcccccatttgccaggtgacaggccggattttacgcagaacgacgtccagaatcgcgatatgccgatggacatctcggccctcagctccccctcatgttctccttctccacagagcgagacgcctctcgaaaaagtaccttggctctccgtaatggagacgccggctaggaaagagataagtttgtctgagccggctaaacccggttcagctcatgtgcagtctagaaccccacaaggaggcctttataacaggccctgcctccatcggttgaaatacttcctcaggccacccgtccaccacctcttctttcagaccctgatacctgataaggacacacgggaaaataaggggcagaagctggagcctataccccacagaaggcttaggatggtcacaaataccatcgaggagaattttccccttggcaccgtgcagtttctgatggactttgttagccctcagcactatccaccaagagagatcgtagctcacattatacaaaaaattctgctttccggatctgagaccgttgacgtcttaaaggaggcatacatgctgcttatgaaaatccaacaactgcacccggcaaatgcgaaaactgtcgaatgggactggaaactactcacttacgtcatggaagaggagggtcagactcttcccggacgggtactgtttctgcggtacgtggtgcaaacacttgaagatgacttccagcagacgctacgtcgccagagacagcacctgcagcaatcaatagcaaacatggtgttatcttgcgacaaacagcctcataacgtgcgggatgtcatcaaatggctcgtgaaggccgtaacggaggatggcttaacacagccgcctaatgggaatcagaccagtagcggtacaggtatcttgaaagcgtccagctcgcacccctccagtcagcccaatctgaccaagaatacaaatcagttgatcgtgtgtcagttacagagaatgctgtcgatcgccgtagaggtggaccgtaccccaacctgcagcagtaacaagattgctgaaatgatgttcggcttcgtcttggacatccccgagagaagccagcgagaaatgttctttaccactatggaatcccatctcctccggtgtaaggtgctggagataattttcctgcactcttgcgaaactccaactagacttcccctgtctctcgcacaggcactgtactttctgaataactcaacctctcttttaaaatgccagtccgacaaaagtcaatggcagacatgggacgaactggttgagcacctgcagtttttattaagctcctaccagcacgttctgcgggagcacctgagatctagcgtaatcgacaggaaagacctcattattaaaagaataaagcctaagccccagcaaggtgatgacatcacagtagtagatgtggaaaaacagatcgaagcctttcgcagcaggctgatccaaatgttgggcgagccactggtcccccagctgcaagataaggtgcatctgctgaaactgctcctgttttacgctgcggaccttaatcccgacgccgaaccctttcagaagggatggagtggaagttag

SEQ ID NO: 54407 - DNA, 291 bp, Artificial Sequence
  Description of Artificial Sequence: Synthetic coding sequence
atgaccccctgtctggagagtttttgccaacgtgctaaggactgcaagcagaacatccctctgccctttcttattcaggattggccactgagtgagagtaagccgcaaggacaagacttttggactccacagcctctccaagcagcggctccaagccatgaattccagcaggtcgccctgcatcccgctcgtactaggcttgccagcagaccacaaggcggtcgtctgatgtccagccgggaggtcgggctcagagcccctcggtgttcatgcggaaagaggaaaaggtag

SEQ ID NO: 54408 - DNA, 291 bp, Artificial Sequence
  Description of Artificial Sequence: Synthetic coding sequence
atgactccgtgcctggaatccttttgtcaaagagcaaaggattgcaagcaaaatattcctcttcccttccttatccaggattggccattatccgagtctaagcctcagggacaggacttctggacacctcagcccctacaggcagccgcaccttctcacgagttccaacaggtggctctccatcccgcaaggacacggcttgcctcaagaccgcagggtgggagactgatgtctagtagagaggtaggtctccgtgcccctcgctgctcctgcggcaagcgtaagaggtag

SEQ ID NO: 54409 - DNA, 621 bp, Artificial Sequence
  Description of Artificial Sequence: Synthetic coding sequence
atggaggtggacattaatggagaatcgaggagcaccctgacaactctgccattccccggagcagaggccaactctcccggtaaggccgaggctgaaaagccacgctgctcctccactccgtgttctccaatgagaagaactgtttccggctatcaaatcctgcatatggatagcaattatcttgtggggtttaccactggagaggagctactcaaactagcccagaagtgtacaggcggtgaggaatccaaggcagaggctatgccttctctgcggagcaaacagcttgacgccggtctcgccaggagctccaggttgtacaagaccagaagcaggtattatcagccctatgagatccctgccgttaatggacggaggagaagacgcatgcctagctcaggggataaatgcacaaagagccttccatacgagccatacaaagctcttcacggccctttacccctttgcttgctgaagggtaagagagcccactcaaaaagtctggattatctgaatttagataagatgatcaaagagcccgctgatacagaagtgttgcaatatcagcttcaacacctcacgctgcgaggggacagggtattcgcccgtaataatacatag

SEQ ID NO: 54410 - DNA, 621 bp, Artificial Sequence
  Description of Artificial Sequence: Synthetic coding sequence
atggaggtggatatcaacggagagagtagatctaccctaactacactgccctttccgggtgccgaggccaattctcctggcaaagccgaggcagagaaacccagatgcagctcaactccgtgcagccccatgcgtcgaacagtcagcggctatcagatattgcatatggattcgaattatcttgtcggcttcactactggcgaagagttgctgaaactggctcagaaatgtaccgggggtgaggagagtaaggctgaagctatgccttctttacgaagtaaacagttggatgccggactcgcccgaagttctaggttatataagaccagatcccggtactaccagccgtacgagattcctgcggttaatggaaggcgacggaggaggatgccgtcctcaggcgacaaatgcacaaagagtttgccctatgaaccatacaaggcgttacatggacccctcccattatgcttgttaaaaggcaagagggcccacagcaagagcctcgactacctgaatttggataaaatgatcaaggagcccgctgatacagaggtgcttcagtatcagttacaacacctaacactgcggggagaccgggtgttcgccagaaataacacttag

SEQ ID NO: 54411 - DNA, 621 bp, Artificial Sequence
  Description of Artificial Sequence: Synthetic coding sequence
atggaagttgatattaacggcgagagccgttccaccctgaccaccctgccttttccaggcgcagaagctaactctcctggcaaggctgaagccgaaaagccacgatgctcgtccaccccttgcagtccaatgagaagaactgtaagcgggtatcagatactgcacatggacagtaactatctggttggattcaccacaggagaagagctgctgaagctggcccaaaaatgcaccggcggagaagaaagcaaggccgaggccatgccttcccttagatccaagcagttagatgctggcctagccagatcttcaaggctgtacaagacaaggtccaggtactatcagccttacgagatcccggctgtgaacggtcggcgaagaaggagaatgccaagtagtggcgataaatgcacaaagtccttaccctacgagccctacaaggccctccacgggccactccccctgtgtctgcttaaaggaaaacgcgctcattccaaaagcttagactaccttaatcttgataaaatgatcaaagagcccgcagataccgaggtcctacagtaccagctgcaacacctgacccttaggggggaccgtgtgtttgcccgaaataacacttag

SEQ ID NO: 54412 - DNA, 621 bp, Artificial Sequence
  Description of Artificial Sequence: Synthetic coding sequence
atggaagtcgatatcaatggagaaagccgcagcaccctcaccaccctaccttttcctggtgcagaggccaattcccctggtaaagcagaagccgagaagccccgatgtagctcgaccccttgcagccctatgagaagaaccgtgagcggataccagattctacacatggactccaactacttggtgggctttactactggggaagaattgctgaaacttgctcagaagtgcactggcggtgaagagtctaaagctgaggccatgccaagcctgcggagcaaacaactggacgcagggctcgctagaagctcaaggctgtacaaaaccaggtctcggtattatcagccctacgaaattcctgccgtcaatggaaggaggcgaaggaggatgccatcatccggcgacaaatgtaccaagagtctgccttacgaaccctacaaagcactccacggacctctcccactctgcctcctgaaagggaaaagagcccactctaagagccttgattatttgaacctcgataaaatgataaaggagcccgctgatactgaggtgttgcagtaccagctacagcatctcacacttaggggcgaccgcgttttcgctcgcaacaatacctag

SEQ ID NO: 54413 - DNA, 294 bp, Artificial Sequence
  Description of Artificial Sequence: Synthetic coding sequence
atgaatcaggagaacccccctccgtatccaggaccagggcctaccgctccttatcctccctacccaccccagcctatgggacctgggccaatgggaggcccatatcctcctccccaaggatacccctaccaggggtaccctcagtacgggtggcaaggtggccctcaagagccacccaaaaccactgtctacgtcgtggaggaccaacgtcgggacgaactcggcccatcaacatgcttgaccgcctgctggacagctttatgttgctgctgcctgtgggacatgctaacttag

SEQ ID NO: 54414 - DNA, 1917 bp, Artificial Sequence
  Description of Artificial Sequence: Synthetic coding sequence
atggccgctgaattgcgcatgatattgtacgaagatgactctgtgcaggtgcagtacgtggacggatcaactttacagctgtctccatgtgggaccgaattcctgttcgagaagtcaccacccgtaagcgcccaccctctggaacaacctgaacgcatacggcagcgtactcacttcgtgatctctacctacagagagcagctccagagagcgttggacttcaggaactcatccgccacctgccctttcctgagcgagactataataccatcggagcgaaagaaacatattttcatcgatattacagaagttcgatggcccagtctagacaccgacggtaccatgatttatatggagtcaggtattgtcaagatcaccagcttagatggccacgcctacttatgtctgcctcgatcccagcatgaatttacggtgcattttctgtgcaaagtgagtcaaaaatcagacagtagtgctgttctctcagagaccaataataaagcacccaaggataagcttgtggagaaaacaggcaagatctgcattaggggcaatctcccagggcagaggttgaaaaataaggagaacgagttccattgtcagatcatgaagagtaaggagacgcttaaaaagatgagttgcgtgaatgggactgagggccgtgaagagctgccttcacccggaacaaagcatacgtgcgtgtacacctgggtcaagcagtgttggtcggtagccgcttgccctgaggaatggaaatatccactgagcttagcactgcatttccataacaaaatttcaaacatgtcaaagattgacgcccacattactcagagcagattcctgacttctgacatcagtgaggaaaggggtaaagtagtctccgttctgcccagggccctgagtctgtcatgcccggtgcctcatctccacagatggaatttctgtgatagcttgctgcaacgtcagtccgatgaatatagctaccccgagctggtgaagatggtttggtataaaggggtcacttacagactcacccatcagaatatgaacagcatcgaaatttattccggagacggatccgtgttcaaatccgaaggcgcatatttcgggaattacttcacgtactattccatacaggagggttccggcaaacgcgaggaaaagacatattcagttaataatctccccccagaccgcccagggtcgccatttaccgttggttctctcattaaacaggccaccagaatcttgcagcattgtgtgaaaatgaggctttcactgtctcataattatcggatttgttgctggaagatggtgcctggcattaatgatagcaatattctgccactggtcttgaaggagtccttgatcccaagcgttgggcgtttcctcgcctattcggatgacaaagtacatgctattttcttggatggaatcaccctgacgctgaattggaatttctctagccctattgagaagcgacaggtgaaccagggtcttaacctcggatggtgcaagttgactttcccagatggacaagagcagctcattcagatcgaacaccccgaaccttacgagcggtacgtcaccaccgtgacatcttggtgcaggagactcactcaaacctcccctagggaaatgcctacccactcctcttcgtccgtcttgcaggagaattggtctgtagcctctgagctggaaaagattcagaagttcaatctgctactggagaattccggtattttaaatcagatctctaataaaaagaacgagcagcagtcatttgaccattataagcctggaagctcagaaactctgctaggggaggttaatgagaacagagtctctattgccctgaagaagaccagtgagatattgcatgatattgactgtctcctctcaaattcgaagaaatag

SEQ ID NO: 54415 - DNA, 900 bp, Artificial Sequence
  Description of Artificial Sequence: Synthetic coding sequence
atgcctggtcgcctgctgcgagggttgtggcagcgctggcgaagatataagtaccgattcgtgccctggatagcattaaatctaagtcacaaccccagaaccttacggtatgttcccgaagaaagcaaagacaaggtgatttcggatgaggacgtcctgggtaccctgttgaaggtgtttcaggccttatttctaaacgattttaataagcaaagtgagattctttccatgctcccagagagtgtcaagagtaagtaccaggatctgctggctgtggagcaccagggtgtgaaactgctcgagaatcgccaccagcaacaaagcacttttaaacccgaagaaatcttatacaaaacactgggattctccgttgcacaggcgactagcagcttgatttccgccggtaaaggagtctttgttaccaaggggttggtgcctaagggggcagtggtcagcatgtaccccggtactgtataccagaagtatgaaccgattttctttcagtccataggcaatccattcatctttcgttgtctggatggcgtgctcattgacggtaatgacaaagggatttccaaagttgtctaccgcagctgcaacggacgcgatcggctgggacctttaaaaatgtcagacagcacttggctgacttcagaaattcataatcccctcgcagtcgggcagtacgttaataattgcagcaacgatcgggctgctaatgtgtgctatcaggagttcgacgtacctgccgtgttcccaattgaattgaaacagtatctcccgaatatcgcatactcgtatgacaaacagtcccccctaaggtgtgttgtgctggtcgccctgcgcgacattaaccagggagaagagctgtttagcaactactacaccatcgtcagttag

SEQ ID NO: 54416 - DNA, 816 bp, Artificial Sequence
  Description of Artificial Sequence: Synthetic coding sequence
atgcccggacggctgctcagaggactgtggcaaagatggcgacgctacaaatacagattcgtaccctggattgccctgaatctgagccataaccctcggactttgaggtacgttcctgaggaaagcaaggacaaggtgatatcagacgaagacgtactgggtacgctactgaaggttttccaggccctgttcctcaacgatttcaacaagcagagtgaaatactgtctatgctgcctgaatctgttaagagcaagtatcaggacctgttggctgtcgagcatcagggggtcaagcttctggagaataggcaccaacagcaaagcacttttaaacctgaggagattctttacaaaacactggggttctcagtggcccaggccactagctccctcatctcagccggaaagggcgtgtttgttactaagggcctggtgccaaagggtgcggttgtctcgatgtacccaggcacagtgtaccagaagtacgagcccatttttttccagtccatcgggaacccttttatttttaggtgcttagatggagtcctgattgacggaaacgataagggcatctcaaaagttgtgtaccgctcgtgcaatggtcgggatagactaggcccactgaaaatgtccgacagcacttggctcacaagcgagatccataatcccctggcagtgggtcagtacgtgaataactgcagtaacgatcgcgctgcaaatgtatgttatcaggagtttgatgttcctgccgtatttccaattgagctcaaacagtaccttcccaacatagcgtattcatatgacaaacaacggtag

SEQ ID NO: 54417 - DNA, 582 bp, Artificial Sequence
  Description of Artificial Sequence: Synthetic coding sequence
atggaacagcatttccttggttgcgtcaaaagggcttgggattcagctgaggtggcacccgaacctcagcctccacccatcgtatcttcggaggaccgcggaccttggccactgcctctgtaccctgtactcggggagtactccttggacagctgtgacctcgggctcctcagttcaccgtgctggcgtctgcccggtgtctattggcagaatggtctgtctccaggtgtacagtccactctggaaccttccaccgctaagcccaccgaattttcttggcctgggacacagaagcaacaggaagcacccgtagaggaggttgggcaagccgaggagccagataggcttcggcttcagcagttgccttggagcagcccattacacccctgggaccgtcagcaggatacggaggtttgcgactctggatgcctgcttgagcggaggcacccacccgctctgcaaccttggaggcacctgcctggcttttcagattgccttgagtggatactgcgggtcgggtttgctgccttttcggtgctttgggcatgttgctctcgcatttgcggcgcaaagcagccatag

SEQ ID NO: 54418 - DNA, 1920 bp, Artificial Sequence
  Description of Artificial Sequence: Synthetic coding sequence
atgccacagccgtccgtgtctgggatggatcccccttttggggacgcattccgttcacatactttttcagagcaaaccctgatgtcaactgacctgctggccaactcttcagaccctgatttcatgtacgaactggaccgcgagatgaattaccagcagaaccccagagataatttcctgtcactggaggactgcaaggacattgagaatctggaatctttcaccgacgtgctggacaacgagggtgccctgacctcaaactgggaacagtgggatacatattgcgaagatctgacaaagtataccaaactcacctcctgtgacatctgggggacaaaggaagtggactacctgggactggacgattttagtagcccttaccaagatgaggaagttatctcgaaaactcctaccctggcccagttgaattccgaggactcccagtccgtgagcgattccttatactatcctgattcccttttcagcgtgaaacagaatccactgcccagctcctttcctgggaagaagatcacctcccgcgcagccgcacccgtgtgctcttccaagacccttcaggcagaggtgcccctgagcgactgcgtccagaaggcttccaaaccaacttcatccacacagatcatggtaaaaaccaatatgtaccacaatgagaaggtgaattttcacgttgagtgtaaagattacgtaaagaaagcgaaagtgaagataaatccagtccagcagtccagacccctgttgtcacaaattcacactgatgcagctaaagaaaacacgtgttactgcggggctgttgcaaagagacaggaaaagaagggaatggaaccactgcaggggcatgctacgcctgcccttcccttcaaagaaacacaagagctgttactgagtcccctgcctcaggagggccctggatcgctggctgccggtgagtctagcagtctgtctgcatctacttccgtttcagacagctcccagaagaaggaagagcacaattatagtcttttcgtgtcagacaacttgggcgagcagcctacaaagtgttctcccgaggaggacgaggaagacgaggaagacgtggatgacgaagaccacgacgagggattcggctctgagcacgaattgtctgaaaatgaggaggaagaggaagaggaagaagactatgaagatgataaagatgatgacatctctgataccttcagcgaacctgggtacgaaaacgatagcgttgaagatctgaaagaagtcacatctataagctctcggaagaggggaaagcggagatacttttgggagtacagtgagcaactcacaccttcgcagcaggaaaggatgttacgcccttcagaatggaaccgtgatactctcccttccaacatgtaccagaaaaacgggttgcatcacggcaaatatgcagtaaagaaaagtagacgcaccgatgtcgaggacctgactcccaatcccaagaagctccttcagattggaaatgagctgcgaaaactcaataaggtcattagcgacctaaccccagtgtcggaactgccactgactgcccgaccacgaagtcgcaaagagaaaaataagctggctagcagggcttgccgactgaaaaagaaggctcagtacgaggccaacaaggtgaaattgtgggggctgaacaccgagtacgacaacttgctgttcgtcataaactccatcaagcaggagattgtgaacagagtccagaatccaagggacgaacggggtccaaatatgggccaaaaactcgagatccttattaaggataccctgggactgcccgttgccggtcagaccagcgaattcgtgaatcaagtcctggaaaaaacagctgagggtaatcctacaggtgggctggtcggacttaggatccctactagcaaagtctag

SEQ ID NO: 54419 - DNA, 1920 bp, Artificial Sequence
  Description of Artificial Sequence: Synthetic coding sequence
attcctaaaccttctgtgtctgggatggatcccccatttggcgatgcttttaggtctcacaccttctcagagcagaccctgatgtctacggacctcttggctaactcaagtgatccagatttcatgtacgaactcgacagggagatgaactaccagcagaacccccgagataattttctgtcattagaagactgcaaggatatcgaaaacctggaatctttcacagacgtgctagacaacgagggcgcactcacgagcaactgggaacagtgggatacatattgcgaggacttaactaaatacaccaaactgacgtcctgcgatatctggggcactaaggaagtagactatctgggcctagacgacttttcctccccctaccaggatgaggaagtaatctcaaagacgcctactctcgcccagctgaactccgaggactcacagagcgtttcagattcgctctattaccccgacagcttattctctgttaagcagaatccactgcccagttccttcccagggaagaagataacatctcgcgcagctgctccagtgtgttctagcaagaccctgcaagccgaagttcccttgagcgattgtgtgcagaaggcaagcaaaccgacctcgtccacgcagattatggtcaaaactaatatgtatcacaatgaaaaagtcaatttccatgtcgaatgcaaggattatgttaagaaagcgaaagttaaaataaaccccgttcaacaaagtagacctttgcttagtcaaattcacaccgacgccgctaaagagaacacctgttattgcggggcagtagcaaagcggcaggagaagaaaggcatggaacctcttcagggtcacgcaacgcctgctctcccctttaaggagacgcaggaactccttttgtctccactcccccaggaaggtcccggatcgctcgctgccggagagtccagtagcctttcggcctcgacaagcgtttccgattcttctcagaaaaaagaggagcacaattatagtttgttcgtgtccgacaacttgggggagcagcccaccaaatgttctcccgaggaagatgaggaggatgaggaagatgtggatgatgaggatcacgacgaaggatttggcagcgagcacgaactctccgagaacgaggaagaggaggaggaggaggaggattacgaggacgataaagacgacgatatcagcgacactttctcagagccgggttacgagaacgatagcgttgaggatcttaaagaagtgaccagtattagctctaggaagcgcggtaagcgcagatatttttgggagtactccgagcagcttactccgtctcagcaggagcggatgcttcggccaagcgagtggaatagggatacacttcccagcaatatgtatcaaaagaacggcctgcaccacggtaagtatgccgttaaaaagagccggagaaccgacgtggaggatcttacgccaaaccccaaaaagttactccaaattggcaacgaattacgaaaacttaataaggtgatttcagacttgacacctgtgtccgagctgcctctgacagcacgaccccgaagtcgaaaggagaagaacaagcttgcctcccgggcatgcagattgaagaaaaaagcgcaatatgaggctaataaggttaagctgtggggactaaacactgaatatgacaacctactctttgtgataaattccatcaagcaggaaattgttaaccgggtgcaaaacccccgagatgagaggggtcctaatatgggacagaagctggagatattgattaaggacacactgggattgccagtcgccggacagacatctgagtttgtgaatcaggtcttagaaaaaacagccgaaggcaatcccaccggcggacttgtgggattgcgtataccaactagcaaagtttag

SEQ ID NO: 54420 - DNA, 1254 bp, Artificial Sequence
  Description of Artificial Sequence: Synthetic coding sequence
atgccgcaaccgtcagttagcggtatggatcccccattcggtgatgcctttcgcagtcacacctttagtgagcagacactcatgtcaaccgatctcctagctaattctagcgatccggatttcatgtacgaattagatcgagaaatgaactaccagcaaaatccccgtgataattttctgagcctagaggactgtaaggatatagaaaatctcgagagcttcacagacgtattggacaacgagggggcattgactagcaattgggaacagtgggatacatactgcgaagatctgaccaagtatacaaagctgacctcttgcgatatatggggtacaaaggaagttgactatttgggcctcgatgatttcagcagtccttaccaggacgaggaagtaatatccaagaccccaaccctggcacagctgaactccgaagattctcagtctgtcagcgatagcctctactatcctgactctttgttcagtgtaaagcagaacccactaccaagcagcttccctgggaaaaagatcacgtctagagccgcagcgccagtttgtagtagcaagactcttcaagctgaagtgcctctctccgattgtgtacagaaggcctctaaacctacttcgtctacccagataatggtgaagacgaacatgtatcacaatgaaaaggttaatttccatgtcgagtgtaaagattacgtcaagaaggccaaggttaaaataaatcctgtccagcaaagtcggccactgctaagccagatacacaccgatgctgctaaggaaaacacatgctattgtggcgctgtggccaagagacaggaaaagaaggggatggagccactacagggacacgccacccccgctctgccctttaaagagacacaagagttgctcctttcaccactgccgcaggaagggccagggtccctcgcagctggagaaagctctagcctgagcgcctcaacatccgtgagcgattcctcacagaagaaggaagaacacaactacagtctctttgtgtcggacaacctgggggaacagcccaccaagtgctccccggaagaagacgaggaagatgaggaggacgttgacgatgaagaccacgatgagggcttcgggtccgaacatgaattgtccgagaacgaggaggaggaggaagaggaagaggactatgaggacgacaaagatgatgacatttcagataccttctctgaacccggtatcatcatgctagcaagtctgcctgattag

SEQ ID NO: 54421 - DNA, 1254 bp, Artificial Sequence
  Description of Artificial Sequence: Synthetic coding sequence
atgcctcaacccagcgtctcagggatggatccaccatttggcgacgccttccgttctcacaccttctccgagcagacactgatgtccaccgatttgctggccaactcctctgaccctgattttatgtacgaactggaccgggagatgaattaccagcagaatcctcgtgataactttctgtctctggaggattgcaaagacattgaaaatctggagtctttcaccgacgtgctggacaatgagggggcattgacaagtaactgggaacagtgggatacctactgcgaggaccttaccaaatatacgaagctgacaagctgtgacatttgggggaccaaagaggtggattatctaggcctggatgattttagctccccatatcaagacgaagaggttatctcgaagacgcccaccctggcccagctaaatagcgaggacagtcagtcagtgagcgattcactctactacccagacagtcttttcagcgttaagcaaaaccctctccctagttccttcccagggaaaaagatcactagtcgtgccgctgctccagtttgcagttctaaaaccctccaggcggaggtgcccctgagtgattgtgttcagaaggcttctaagccaacatcctccacccaaatcatggttaaaaccaatatgtatcacaacgaaaaagtgaacttccatgttgagtgcaaagattatgttaaaaaggccaaagtgaaaatcaaccctgtgcagcagagccgaccgctcctgtcacagattcatactgatgccgctaaggaaaatacatgctactgcggtgcggtcgcgaagcggcaggagaagaaaggtatggaacccctccagggccacgccacccccgctctgccttttaaagaaacacaagaacttcttctgtcaccccttccccaggaggggccaggcagcctcgccgcaggggaatccagctctctttccgctagtactagtgtgtcggattcaagtcaaaagaaggaagagcacaactattctctcttcgtgagcgataatttgggggagcagcctaccaagtgcagccccgaggaggatgaagaggacgaagaagacgtggatgatgaggatcacgatgaaggattcggaagtgaacacgagctatcggaaaatgaagaggaggaagaagaggaggaagattatgaggacgataaagatgacgacatttcggacaccttcagcgagcctggaataataatgctcgcatctcttcctgactag

SEQ ID NO: 54422 - DNA, 81 bp, Artificial Sequence
  Description of Artificial Sequence: Synthetic coding sequence
atgcctcagcctagtgtgtctggaatggatcctccattcggcgacgctttccggtcccacacctttagcgagcagacatag

SEQ ID NO: 54423 - DNA, 1962 bp, Artificial Sequence
  Description of Artificial Sequence: Synthetic coding sequence
atgccccagccttctgtgtccgggatggacccgcctttcggagacgcatttagatcccacactttctctgagcagactctgatgtctacggatctgctcgcaaactcaagcgatcccgatttcatgtatgagctggatcgggagatgaattatcaacaaaaccccagggataactttctcagcctggaggactgcaaggacattgagaatttggagagctttacagacgttctcgataatgagggagccctgacttccaattgggaacagtgggatacatactgtgaggacctgaccaaatacaccaagctgacgagctgtgacatctggggcacgaaggaggtggactatttaggcctggacgacttcagcagcccttaccaagacgaggaggtgatctcaaaaacaccaactctagctcaactcaactcagaggactcccagagcgtgagcgactccctgtactacccagattcactgtttagcgttaaacagaatccgctcccgtcctcattccccggtaagaagattacctctagagccgctgctccggtctgctcatccaagaccttacaggccgaagtgcccctctctgactgcgtccagaaggcgtctaagccaacttcttcaacacaaatcatggttaagacaaacatgtaccacaatgagaaagtgaactttcacgtcgaatgtaaggattatgtgaaaaaggctaaagtgaagatcaatcccgtgcaacaatctcgcccactactttcacagatccacactgatgctgccaaagagaacacttgctattgcggtgccgtcgctaaacgccaagaaaagaagggtatggagcctctccagggtcacgcgacccccgctttacccttcaaggagacgcaggaacttctgttaagcccactgccccaggagggcccaggcagtctggctgctggtgaaagctccagcttaagcgcctccacatctgtgagcgactcctcccagaaaaaagaggaacacaattacagcctgttcgtttcagacaatctaggcgagcagcctacaaagtgctcccccgaagaggatgaagaggacgaggaggatgtggatgatgaagatcatgatgaaggttttgggagcgagcacgagctctccgagaacgaagaggaagaagaagaggaggaggactacgaagacgataaagacgatgatataagtgacacgttcagtgagccaggctacgagaacgatagcgtggaggacctgaaagaagtgacatccatctcctcacgcaaacgtggaaaaagacggtacttctgggaatactcagagcagctcaccccaagtcagcaggagagaatgctgaggccgtccgagtggaaccgggatacgcttcctagcaacatgtaccaaaagaatggcctgcaccacgggaaatacgcagtcaagaagtcccgccgtactgacgtggaggacctcacccccaatccaaagaagctgctgcagataggaaatgagctgcgcaagttaaacaaagtcatctccgatctgacccctgtgagcgagcttcccctgactgccagacctcgctctcgcaaggaaaaaaacaagctggcgtctcgggcatgcagactgaaaaaaaaagcgcagtatgaagcaaataaggtgaagctgtgggggctgaacaccgagtatgacaacttactctttgtgatcaattctattaagcaggaaatagtgaatagggtccaaaatccccgagatgagaggggccctaacatgggccaaaagcttgagatcctgattaaagacactctcggccttccagtggcaggacagacgagtgagtttgtcaatcaggtgctagaaaagactgccgaagggaacccaaccggcggactggttttctggggaaacagcaaaactggcaacatcctttacgacgagaacccgaacgagaaaaagcaggatatttag

SEQ ID NO: 54424 - DNA, 1926 bp, Artificial Sequence
  Description of Artificial Sequence: Synthetic coding sequence
atgcctcagcctagtgtgtctgggatggatccacccttcggcgacgctttcaggagtcatacctttagtgagcagacactgatgagtaccgatctgcttgcaaattctagcgatccagactttatgtacgagctggaccgcgaaatgaactatcaacaaaatccacgtgacaatttcttgtcactggaagactgtaaggatatcgagaacctagagtcctttacagatgtcttggataacgagggggcactgacttccaactgggagcaatgggatacctattgtgaagacctcaccaagtatacaaaacttacatcctgcgatatttggggcaccaaggaggttgattatttgggactggatgatttttctagcccgtaccaggacgaagaggtcataagcaagacccctacactggctcagctgaactctgaggactctcagtccgtcagcgattcgctgtactatcccgacagtctgttcagcgtgaaacaaaaccctctcccgtcctcttttcctggtaagaagattacctcgcgcgctgccgcacctgtgtgtagttcaaaaaccctacaggctgaagttcccctgtcagactgtgtgcagaaggcctcaaaaccgacttcgtccactcagattatggtgaagaccaacatgtatcacaacgagaaagttaattttcacgtagagtgcaaggactatgtcaagaaggctaaggtgaaaatcaaccccgtgcagcaatctcgcccattgctcagccaaatccataccgacgccgcaaaagaaaacacttgttactgcggagcagtcgcgaagcggcaagaaaagaagggcatggaacctctccagggtcacgccactcccgctctaccatttaaggaaacccaggagttgcttctctcaccactcccacaagagggcccaggcagcctcgctgctggagagtcaagcagtcttagtgcatctacttcagtgtccgatagctcccaaaagaaagaggaacacaactacagcctgttcgtgagcgacaacctgggcgagcagccgaccaaatgcagtcctgaggaggatgaggaggatgaggaggacgttgatgacgaggatcacgacgagggattcggtagcgagcatgaattatcggaaaacgaagaggaagaggaggaggaggaggattacgaggatgacaaggacgacgatatctctgacaccttctcagaaccaggctatgagaatgattctgtcgaggacctgaaggaggtcacatcgatttcgagccgaaagaggggcaaacgcagatacttctgggaatattccgaacagttgactcctagccagcaggaacggatgctgagaccatcagagtggaatagagacacacttccttctaatatgtaccagaagaacgggctccatcacgggtcaggaaaatacgctgtgaaaaagagccgcaggaccgatgtggaggacctgacacccaaccctaaaaaactgctgcagatcggaaatgagctgaggaagctgaataaggtgattagcgatctgacccctgtgagcgagttgcctcttacagccagaccacggtctagaaaggagaaaaacaagttggctagtcgtgcctgccgtctcaaaaagaaggcacagtatgaggccaacaaagtaaaactctggggattgaacactgagtatgataatctgttgttcgtcattaattctattaagcaggaaattgtcaaccgggtgcagaaccctcgggacgagcgcggtccaaatatgggccagaagctggaaatactcattaaagatacgttgggtctgccagtcgctggccagacgtccgaatttgtgaaccaagtgctggagaaaaccgccgagggaaaccccactgggggattagtgggtctgaggattcctacgtcaaaagtgtag

SEQ ID NO: 54425 - DNA, 6288 bp, Artificial Sequence
  Description of Artificial Sequence: Synthetic coding sequence
atggcggacgccgacatcctgtcagaaacctttcagctattgatcgactctgccaaggatttcagcaagaggctttgggggttagtgccttttgggctgtatctccccgctccgccactctattgtccccagccagccatcttaagcgaggaagacggagatgatctcttacttaaagcagagaaaaataaccgccagaaggtttctggaatcctccagagagtgctgttgctgttcagggccgctcagtgcagtttcccagtggcccagtggtatattctacagttgcggtgggccaggaaggtgatgcagaagataagaatgaagggctctctgccaagcttaagtcccttcccacaatcactcctcaattattgtaaaggtggcatcgcctttttcagacctggggctgctggagaccataagctggacgaggttagcatcagagctattggatgctttcgcgagctctgtgctctctgctggatgctgcacgttagagacaagttgagctactcctgtaggcaataccaaaaggccagagagaacgtgaaaggggagaaggacctggaggtggagttcgatagttgcatgatcgagcattgcctgtccgctgtggagtgggcctaccggatgcttccattcagcagattctttaatatggaagagttgattcaggatattattttaagcctgataggggaactgccccctatccggaaagtggccgagatttttgtaaaggcatttccatatccagaggacgtgagagttcctctgagagataaataccattccctgcaccagcggctccgccactgcgtggtgaagggccctcaaactgaggagatgatgagtgttgtgatgcactcgattcagaaggtaagggttaaggcacttaagcgggtgcagaggaacatcgggtctttcgaagtaaatatctgggagccaattgaggaagagaagcccgatgaggcgccaggagttgatcggtactctctcggaacgtccctgtctcgatcaacactgacagaactgggggatagcgtggtgcattccgatgcagatacattcagcgaggccctgtccgtggaagagaagagcaggatcaacatataccagcgcaatgcaccaaatcatatggagcttaccagcatccacaaaccaacagacaagagaaagatgtgcaatcagaaggagaatcctactaagaaagaagatcacgaaaaactgagccagaataccttgccagtaatcggcgtttgggagttcgaacgcgatgatgatgaatatataaagtttctggacctgtttctgtcttacattctggaacgggatttgccatattcgcgggacgctgatatccctttcctaactagcttttctggcaaacttagggagcacgagctaaactctctgctatttgacgtgcacacaaccttgaagcggcatcagtccaagaccaagtcccagaatgtgtttcgcgcagggtcttgttttgtggtcgccccagagagctatgagtctgaaaagagcagttcattaaatgacgagtacggcatgcacctcgaaaaccagaagttgtcatccagtgttctggttaatcagggcattaaaccttttctacagtatccctctaacgaggttaataagaatgaaggcatgtcagggctgttcggactgaaacaacgctcgatatacaagattcaggacgacaccagggagaagtgtctaatacagcggtcttctaaccacatcttttggactcccaaatctatcaagactcgtaggtgcatctttaaagctatacagtgtaacgatatcaatccacaggaggacttgcccctggcattgaatacttttggatccataggcaggctgcttgaatggatgattcggtggagtaaccgcagactcttatgtgacagcgggatcaccgaatcttcttctgaatactctccagtgattcgggtgaagacctctaccgccgctatcctgactagcctgtggctcttagagcagccgtacttcgccacgtacaaagccaaaaacgctattataaagatggtcgagaatagagacactggatgtcaaatcggaccaaacattgaaagggaatccaagtccgacgccggaggctccgtcgccgtagctacacccggaggcacggaggagagaaatggacaaaacaagtcatgccagaatatactgaagatgccgactgaagctaagaatccagatattaaagagatcaatgacgatatcatctcaatcacacacaacactaaaaaggaatttatagatatcgacgagaaccttttggaggtcgaggccttcactgaggaggaaatggacatgcacattagcgattatgaggaggatatcgaggagtctgtgggcggttttcgaagcccttctctggctatttgcatgatgacactcccccagcagctcgaagaggaattcactgaagaagtgcagtgtcagagagaagaaccactcgaaacaataatggaggagaagtcaactgaacagaagggcatgatagaggccttcagtcaccctggccacacaacaccacaatctatgcaagtagacactagcagcgaaattagctccgcccagatctccacgtacaaagagaaatcctctagcgtgccgcttctcatttcgaacggcgtcaacgtggcgagccaacccccagcgccaacaccgcagaaaacccagagaaacgaattcaccgcccagcttccagattgttcggaatcggtgcgccagatgctgcaggacgaaatgtttaaattagtacagctgcagcagattaatttcatgtctttgatgcagatcgtcggaagcagcttcgcaaatctccccgatacccaacaactggtgcaacagagccaatccgtgcatttgggcgaatcgcaagagtcaaatttgagggggtgcggagatgtcgaggattccaataagaatctcaaggagcggttcttcattaaacctcagagtatgggcgagaatgctcgggaaccccgaaaaaatagccctcactgccatgaggggactattccatctggccagaattctaccgggaacgtgcaaaatgtcccacacggcagcattcccctctgccagttgaatggacaacctagaaagaagggcccaattccctcctctcagaatctcccttcaacgagtttctaccctgcccctgctgggaatacacacctttacttactctccaccccctccgttgtgcagaaggccccaaggctcattccacacgctaagactttttctcctggcgacggctttcccctccttcagtttaagtccaagcaagaattccagcctttgtttttgcatacggggtcgatcccacaggtgccattcagacccctgccacagcccagagaggcttggggtctatcagattcctttcagccggctctgccgcagcgtgctgcacagaccactcccgcttcccatctcaatgtgagccagtataacactgaggccaggaagaaggaggtggaacagaagacatgggccgaaaccgtcattaccgagatcccaaaccatgtaaatctggaccagtatgtgggacaagagaacttgacaccccagcaggacagctctgttttcattaaacccgagaagttgttcgacgtcaaaccgggaaccctggaaatcagtccgcaccacagtttcggattgccactgctttatttgcccctgaagccacccaatatgtttccctccactagtcgcgctagcatcacagtgcctagcacccctattcagccgattgcagaggagcgaaaatatccccgactgagtctgctccattcccatctgtcacccgaaaatcgctgtaaaaaaacgcaacttattccactggagaatctcatagcgttcaagcagagtcaacaaaaattgacgcataacttatttgaacagggcgacgcagggcacctgcagttgttaaaggttaagatcgagccaccggaggtgagacaggggaaggatagtaagaaacgccagcggaggcgggcagaaaaggagctgcaagagaaacgatgtgagaagttgcggagaaagcccaacgtgacctttcgtcctgaaaactcgatcatcaataacgatgacagtgagattataaaaaaacctaaggagcaacaggagcattgcgggagtcaccccttggatgactttgatgtaccatttgaaatgcttcaggacgataatacatccgcagggctgcacttcatggctagtgtaaaaaaaaaggccattggctcacaggatgcctcgacgaatacagatcctgagcacgaacctttgacagccccacaactcctagtcccagatgtgtaccttaacctgaagctgtcaagcgaaatgtctgaaaaaccttggagcccaagcattccccatacggtgactaatctggttggacacacctatataaatgtgatcgacatcgaagcaaatgacctactgcaggagttaccagttagggaggagccaagtaacgataatgtgataaagcagcagagcgaccacctggcggtcccatcgtctgctgagctgcactacatggcagcatccgtcactaacgctgtgcctccccataacttcaagagccaagggcttccaaaacccgagttccggtttaaaggccagtcaaccaagtcagacagcgccgaagactacctactctggaagaggctgcagggcgtgagtgcggcttgtccagcaccaagctccgctgcgcaccagttggaacatctttcagcaaagttacagaaaatcgacgagcagcttttagccattcagaacattgcggaaaacatagagcaggacttcccaaaacctgaaatgctggacctccactgtgataaaatcgggccagtcgaccatatcgagttcagcagcggacccgagttcaagaaaacactggcatccaaaaccatttccatatccgaagaagttcggtttcttacccatatggacgaagaagatcagtctgacaaaaaggaaacaagtgaacccgaattttccatcacggaaaactattcaggtcagaagacatgtgtgtttcctaccgcggattccgctgtatctctttcttcatcttctgaccaaaacaccacgtcccctggcatgaatagcagcgacgagctctgcgagtctgttagcgtgcaccccctgcagatgaccggcctcaccgatatcgccgacattattgatgatctaatcattaaggacggagtgagttctgaggaactgggactgactgagcaggccatgggcacatctcgcatccaacactattccggaagacacagtcagcgtacagacaaagagaggcgcgagatccaggcgtggatgaagcgcaagagaaaagagcggatggcaaagtacctcaacgagctcgctgagaagcggggacaggagcacgatcctttctgtccacgctctaacccattgtatatgacgagtcgggagatccgacttcgccagaagatgaaacatgaaaaagaccggctgctgttgagcgaacattactctaggcgtatatcacaggcttatggactgatgaacgagttactgtccgaatcagtgcagttgcctacacttccacaaaaaccactgcccaataaaccgtccccaacccagagctctagctgccagcattgtccttcccctcgcggtgaaaaccagcatggccatagctttcttattaatcgtcccggaaaggtcaaatatatgtcaaagccttcttacattcataagaggaaaagcttcggtcaaccgcagggcagtccctggccccatgggactgccaccttcacaatccagaagaaggccggaggtgctaaggctgctgttagaaaagcgacacagtctcccgtcacattccagaagggatcaaatgccccatgtcacagcctgcagcatacaaagaagcatggaagcgcagggttagctccacagaccaaacaggtatgtgtcgagtacgagagggaggagactgtagtgtctccttggactatcccttccgagatccacaagatcctgcatgaatcccataactccttgcttcaagatttatcgcccaccgaagaggaggaacctgaacacccctttggagtgggaggcgtggatagcgtaagcgagtctaccggctccatactgtccaaactagattggaacgctatcgaagatatggtggccagtgtcgaggaccaaggcctgagcgtgcactgggctcttgatctgtac

SEQ ID NO: 54426 - DNA, 5441 bp, Artificial Sequence
  Description of Artificial Sequence: Synthetic coding sequence
atggctgatgcggacatactgtctgaaactttccagctgctcattgactccgctaaagatttctcgaagcgcttgtggggccttgtgccatttggtctgtatctgccagcgcctcccctctactgccctcagcctgccatcttatcagaagaagacggagacgacctgctgcttaaagctgaaaagaacaaccggcaaaaggtctcaggtatcttacagagagtattgcttctgttccgtgctgcgcaatgcagctttccagtggcacaatggtacattcttcaacttcggtgggccaggaaggtgatgcagaagataaggatgaaaggttccctgccttcactaagcccattcccccagagtctactgaattactgcaagggcggtatcgccttcttcaggccgggtgctgccggagaccacaagctcgacgaagtttccattcgcgcaatcggttgttttcgagaactgtgcgccttgtgttggatgctgcatgtacgggacaagctgagttattcatgccgtcagtatcagaaagctcgagagaacgttaaaggggagaaagatctggaagtggaatttgacagctgtatgatagagcactgtctgtccgctgtcgagtgggcttatcgcatgctcccatttagcaggtttttcaatatggaggaattaatacaagacatcattttatctctgattggtgagctgcctcctatcagaaaggtggccgaaatatttgttaaagcgttcccttaccccgaagacgttcgtgtgccattgcgggacaagtaccacagcctgcatcagcgactgcgacactgcgtggtgaaagggccacaaacagaggagatgatgtctgttgtgatgcacagcatacaaaaggtcagggtgaaggctctaaagcgtgtccagcggaacattggcagcttcgaggtgaatatctgggaacctattgaggaggagaaacctgacgaagcaccgggtgttgacagatactcattgggcacatctctgtctagaagcacactaacggaattgggagatagtgtcgtgcattctgacgccgatactttctcagaggccttgagtgtcgaggagaagtccagaattaacatataccagcgaaatgcgcctaaccacatggagttgactagtatccacaagcctaccgacaaacgaaagatgtgcaaccagaaagagaaccccaccaagaaagaggaccatgagaaactctcccaaaacacattgccagtgatcggggtgtgggagtttgaacgcgacgacgatgaatacatcaagtttctcgacctatttttgagctatattctagaacgggacctcccctactcaagggacgccgatattccatttttaacatcgttctcaggaaaattgcgagaacatgagctaaactcactgctctttgacgtgcacactacactcaaacgccaccagagcaagacgaagagtcagaacgtcttcagagccggatcatgtttcgtggttgctcctgaatcctatgaaagcgaaaagagctcatcactgaacgatgagtatggcatgcatttggaaaaccagaagctgtcttccagtgtgttggtgaaccagggcattaagccattccttcagtatccctctaatgaagtgaacaagaacgagggaatgtcgggtttgttcggactcaaacagagatcaatttacaagatccaggatgacacaagagaaaagtgtctgatccagcggagttctaatcacatcttttggacccccaagtccataaagacccgacgttgtatcttcaaggctattcagtgcaacgatatcaaccctcaagaagatttaccgctggctctgaatactttcggatcaatcgggcgactgctggaatggatgataagatggtcaaatcgtcgtctactctgcgattccgggatcacggagtcttcgtcggagtatagccctgtcattcgggtgaaaacatctacagcagctatcctcacgagcctctggctgcttgaacagccctattttgcaacgtacaaagcaaagaacgccatcatcaaaatggtcgagaaccgcgataccggctgtcagattggaccgaacatcgagcgcgaaagcaagtccgacgctggagggtctgtcgctgtagcaacccctgggggaacagaagagagaaacgggcagaacaaatcctgccaaaacattctaaaaatgcccacagaggccaagaacccggatatcaaggaaattaacgatgacatcattagtatcactcataacaccaaaaaggaatttattgatatcgacgagaatttgcttgaggtggaggcctttaccgaggaagagatggacatgcatatttccgattacgaagaagacattgaggaatctgttggcggtttcaggtcaccaagtctcgccatttgcatgatgacattgccgcagcagctggaagaggagtttactgaagaagtgcaatgccaacgggaggaaccactggagacgatcatggaagagaaatccacagaacagaagggaatgatagaagctttctcccatcctggccatacgactccccagagcatgcaggtggacacgtcctcggagatctcgtctgcgcaaatctccacatacaaagaaaaatctagtagcgtacctctgctcatcagcaatggcgtaaacgttgcctcccagcctccggcaccaaccccccagaagacacagcggaatgaatttaccgctcagctgccggactgttctgagagcgtgcgtcagatgctgcaggacgagatgttcaagctcgtgcaattacagcagatcaatttcatgagcttgatgcagattgtcgggtcaagctttgccaacctcccagatacgcaacagctcgtgcaacaatctcagtctgtgcatctgggagaatctcaggagtccaacctccgaggttgtggcgatgtcgaagactcaaacaaaaatctcaaagaaagattttttatcaagcctcagagtatgggggagaacgctagagaaccaagaaagaactcccctcactgtcacgagggcacaataccttccggacagaactccacggggaacgtacagaacgtgccacacgggagtatacccctgtgtcagctgaacggtcagccccgtaagaaaggtccaattcctagtagccagaatctgcccagtacctctttctatcctgcacccgctggaaatacacacctgtatctactgagcacgcctagcgtagtgcagaaggccccaaggctaattccgcacgctaagactttctctcccggtgatggtttcccgttgctccagttcaagtcaaaacaggaatttcaaccactattcctgcatacgggtagtatcccgcaggtgccctttagaccgttgccacaacctcgagaggcatggggcctgagcgatagcttccaacccgcactgcctcagagggccgctcaaacgaccccagcgagccacctgaacgtctcacagtacaatactgaggccaggaagaaagaggtggagcagaagacttgggccgagactgtgattacggaaataccaaatcacgtcaatctggaccaatatgtcgggcaggagaaccttaccccacaacaggactcttccgtgtttataaaacctgagaagctgtttgacgtaaagccagggacactggaaatcagcccacatcacagcttcggtctgcccctgctgtacctcccactgaagcctcctaacatgttcccgtccaccagccgcgcaagcatcacagtccccagcacgccgatacagcccatcgctgaagaaagaaaatacccaagactgtcattattgcatagccatctgagccccgaaaacaggtgcaaaaaaacgcagctgatacccctggagaatctcattgcctttaagcagtcacagcagaagttgacacataacttgttcgagcaaggggacgctggccaccttcaactccttaaggtgaagatcgagccaccagaggtacgacaggggaaagactctaagaaacgacagcggagaagggcagaaaaagagttgcaagagaagcggtgcgaaaaactgaggaggaaacccaatgtgacattccgtccagagaattcgattatcaacaacgacgattcagagattatcaagaagccaaaggagcagcaggagcactgcgggagccaccccctggacgacttcgatgtgccattcgagatgctgcaggacgacaatacgtcagctggcctgcactttatggcgagtgtaaaaaaaaaagctatagggtcgcaggacgcaagcacaaatacagatcccgagcacgaacctctgactgccccacagctcctggtccctgatgtgtacctcaacctgaaacttagtagtgagatgtccgaaaaaccctggtctccgtcaataccccacacggttaccaatctggtgggacatacctacatcaatgtgatcgatatcgaggccaatgatttattacaagagctccccgttcgagaagagcctagtaacgacaatgttattaaacagcagtcagaccatctggcagtccctagctcggccgaattacattatatggctgcaagtgttaccaatgcagtacccccacacaattttaagagccaggaagttacccccgcatgcttagatggcaagagcctaagagctgggatcaccgaggtgaaagagccaagtgtaactagcccaactccgagtgacattcagcagaacaaaggtctccctaagccggaatttagatttaagggacagtcaacgaagagcgattctgctgaggactacctcctgtggaagcgactacagggagtgtcagccgcatgtccagccccttcctccgctgcgcaccaactggaacatctgagcgctaaattgcaaaaaatcgacgaacagctcttggccattcagaatattgccgaaaacatcgagcaggatttccccaaacctgagatgctcgatctgcattgcgataaaattggaccagttgaccacatagaatttagttccggacctgagttcaagaaaactttggcatccaaaacaattagcatttctgaggaagttaggtttctgactcacatggatgaggaggatcagtctgacaagaaggagacttccgaacccgagttctccatcaccgagaattacagcggccaaaagacctgtgtcttcccaacagctgattccgctgtgtctttgagtagtagctctgatcagaacactactagccctggtatgaatagctcagacgagctgtgtgaaagcgtgtctgtacaccctctccagatgaccgggctcaccgacattgctgatattattgatgacctgatcattaaagacggggtttcaagcgaggaattgggcctcactgaacaggcaatgggaacaagtcggttcagtta

SEQ ID NO: 54427 - DNA, 9593 bp, Artificial Sequence
  Description of Artificial Sequence: Synthetic coding sequence
atggagatccggttagagattctgacttctacgggcattaagcaaaagaaaccttggcctagagtaagctggttggggaaggaaaaagaagccgtgttccttctcgatgacaagttcatcaatgagattaatttactttcaggtaaaatcaagaagaaaattccgtcgctacagccatttctgaaggacgtcatcgtcctgacgactagcagcaatgatgcctggctggctggagtgctcacgactggtgaactatttctctggaataaggatcaggactgccttaaaacaatcccaatcaccgagaagcctaaggaaatgataaaagcaactgtggctagttctctgcgactctatctgtacgtaagcggaaacggtaagcggatcgtcctcatcacaccaagtggatgcatcttcttatgggagtatctggagttgaaaaatattctgtccagcaagagtttaagcctggcgggtcgatggagtcaggtaatcccagaggaagctgtcctcctcccctccaccgaggataaggaagctgtggtcaatgcagtgttcattaagaacgagctctttggagactgctgtttgtgttcttttaccttctatagtggcgagtgtctgaaactgacatttctggctatccgatggcatgagaatgtgttcaccagtgtcagaagcctcccttaccatgtgcactgggctcagcaggactgccatctgtgcagtcttattccaaaatgcgaaagcgtcaagagcaggggcgcattaatctcggccttttccagagatggcctaactttggccgtgactctgaaccagaaagatcctaaggctacccaggtgctgttcatcaacaccctaaacttcgtgacactgtgcgggtcactcaagggatgttctaataagtcaccggtggttcctgctacactgattcggtcttactgggtgggcgacatatcctggacccacgactcactgtttcttgcctgcatgctgaagcgcggtagtcttgtcctactaacctgccagggcgaattgctgaccctcatcacctttggctgcagtattgagttcgggccagctgaattcattcctctgcaccccctgatcacctatcggcctcagcaattcacctttcaggattctaataattccgttgattcctccgcctcagatagtgaccctatgcggcagagattctccattaaagctcattctcgcctgccctatctcgtgatttcagacggctatatggtaaccaccctgcgattcctggatagcctctcaccatccgtgcacatgcgaagtctgttactggacagtacccagcgattggaaaagatctaccaatccgttatactgtcaaaacctaagggaaaggggcttaatcttcggtcactcaactccctgcggtcgagccttctggagcaccagggaaacgagagctcagccgatttcacagtaccaaagttcctgcaagcggaggagaccataaacgagaacgcagctgatttccaagattttgaagccgaggagaccaacgagggcaggcacttccctgataacctgtgcccattttggaacaagagagacgacgtgctctgtagctctatgaaagagggcagattggagttcgccagcatgttcgacactatacacgccaaggacgacagcgaagaaaccgaccgtactatcaccgaactgcactcaattcagaagtccctactagcggcttggacgattggcatcagcaagactgtaactgaaaagaaccttatgctgaattatatagtggtgtgtattacccactttttctacatcctgcagttcattaagtgcccgttcccgaagctggatctggtgctatcaaagtcgagtcgccacaacgcctggatactttgcatttttcaactcttccaccagtgtctaagtatccactattgggatattcggtacaaacaggacgtgggccatctgattaagcttaccagcaatacagtgaaattattgcttactcaacagcagaaaggccagctgttttccgagaagctccttgcgtgcttctatctactgaagatggtggccgataatcttaatggcgtgtacatcctccagcccgaggtcatcagcgcttcagcggacggaagcaagattacagcccaggattccctggtcgtaccaattttccagatgtttcaggacagcgggttccagaaaaactggtcctggaattcatttttcaagatacacccccaagttgtgaatcccgtgcaacagcctggtcaccgcctcctcatcttgtggcgcatactttacaaaaagaccctgtggtaccaggcccagctcaaccgaagggtccctgaggccgattctcaattgactgagaagatgacacatgaggcctcgactgtgaaatctttattgtgtcatctgcaagcgaatctccagagtaccggggactgcctgaatcaaactctcgagctgaagtccattaacggcgaggagtgttttctcctgggtagttacgagaagtccgtgcagctgtggaaaaaggccctccaggaaatcgaggagaaggggggaaggaggacttacttcttacagatacggtattatctgagtttgctgtactgtcatctgtactcgtacaatctgaacgacgcccaaggcctgtgtgatcagctcgctcgcgagattctccgctggagccagctgcccgtgaaagaaaacaaggactttagcggcgctgcaaagagccactttgagtgtggaatggtgggaggtgtgcatccggaggccgctgtgcgagtagtgcagagcatggccaggttcatggcggcttattttacgaaccagcagctgtgcattctgccaccacaccacgttaacgtgctccccccacttcatataaagactgagcagagcttccgtctcatccctcttcagcatagcaaagtcgcctcagtagtcagggaccagaacctctctaacgtgtggacagtcgaatatgcactggaactgctgtttatcggcggactcgttcccgaagccgtgtggctcgcttacaagctcggtgattggaaaacgtctgtgtccattggagtggcctttcaattattctgcaagcgggacagcaactttatgcgaagcaagaagaagtctctcaatctaccacttaggatgacaccggcacagatcttccaggagaagctgcagtgcgtgttaggccaaccagcctcccttgaagcgaagaatgagatggggagtaagtacaagcaatttactgatccaattgaggaggaggatgcaaatctgctgttcggatcggtgcaggaggtcctgaaggcttctgtgatggctgacgccgacatcttgtcggagacttttcaactcttgatcgactccgccaaggattttagcaagcgcttgtgggggctcgtgccctttggcttataccttcctgctcccccactttactgcccccagccagcgatcctgtctgaagaagatggagacgatctcctcctgaaggctgaaaaaaacaatcgacagaaggtgtcggggatacttcagagggtgctccttctgttccgggcagcccagtgttctttcccggtggcccagtggtatatcttacagctacgctgggccagaaaggtaatgcagaagatccgaatgaagggttcactgccatcactgagtccatttccacaatcactcttgaactactgtaaaggcggtatcgcattcttccgccctggcgcagctggcgaccacaaactggatgaagtctccatccgtgccattggctgcttcagggaactatgtgccctgtgctggatgctccatgtgagggacaagttgagttactcgtgcaggcagtaccagaaagccagagaaaacgttaaaggcgagaaggacctggaggtggaatttgactcatgtatgatcgagcactgcttgtccgctgtggagtgggcataccggatgctcccattttcccgattctttaacatggaggagctgatccaggatatcatcctgagcctcatcggcgaacttcctcccatccggaaggtcgcagaaatttttgtgaaggccttcccatatcccgaagacgtcagggtccccctgagggacaagtatcatagcctccaccaacggttaagacattgcgtcgtgaagggcccacaaacagaggagatgatgtccgtagtgatgcacagcatccaaaaagtccgcgtgaaggccctcaaaagggttcaaagaaatattggctcctttgaggtgaacatctgggagccaatcgaagaagaaaagcccgacgaggccccaggggtggatagatattctttaggtacaagtctctcaagatcaacgctcacagagctgggggactcagtggttcatagtgacgctgatacattcagcgaggcgttatcggtggaggagaaatcacggatcaatatatatcaacgaaacgcacccaatcacatggaattaacctcgattcacaagcctacagataagagaaagatgtgcaaccaaaaggagaaccccacaaaaaaagaagaccacgagaagttatctcaaaataccctccctgtcataggcgtgtgggagtttgagagagacgacgacgaatacatcaaatttctggatctctttcttagctatatactggagagagacctgccttactctagggacgcagacatcccctttcttacaagcttcagcgggaagttacgcgaacacgaactgaattccctcttgtttgacgttcacacaaccttgaaaaggcaccagtctaaaaccaagtcacagaatgtgtttcgggcaggttcctgcttcgtggtagcccctgaatcctacgagtcggaaaaatccagtagcctgaacgacgagtacgggatgcatctcgagaatcagaagttatcctcctctgtactcgtcaatcagggtataaaacctttccttcaatatccgtctaacgaagttaacaaaaacgagggcatgagcggcttgttcggacttaaacaacgcagtatttacaaaatccaggatgacacacgcgagaaatgtctgatccagcggtccagtaaccacatattttggacacctaagagtatcaagactcgcagatgcatcttcaaggccatccagtgtaatgatatcaatccccaggaggacctgcctcttgctctcaataccttcggaagtattggcagactgctcgaatggatgattcggtggtccaacagacggctgctgtgtgactccggcattactgagtcttcatcagaatacagccccgttatccgggtcaaaaccagcacagctgccattctgacatctttgtggctactcgagcaaccctacttcgctacatataaagcaaagaatgccattatcaagatggtggaaaacagagatactgggtgccaaattggcccaaacatcgagagggaatctaagagcgatgccggagggagtgtagctgtggccactccgggaggcacagaggagagaaatgggcagaataagtcttgccaaaacattctgaatcggatgccaaccgaagctaagaacccagatattaaggagattaacgacgacatcatctcgattacacataataccaaaaaggaatttatcgacatcgacgagaatctactcgaggtggaggcctttactgaagaggaaatggacatgcatatctctgactacgaggaggatatcgaggagagtgtaggtggatttagatcgccaagtctcgccatttgtatgatgactcttccacagcagctggaggaagaattcacggaggaagtgcaatgccaacgtgaagaaccgcttgaaacaatcatggaggaaaagtcaaccgagcaaaagggtatgattgaagccttcagtcatccagggcataccacacctcagtctatgcaggtggacacctccagcgagatctcttcagcccagatcagcacatacaaggagaagagttcctccgtgcccctgctgatcagcaatggcgtcaatgtcgcatctcaaccgccagcacctaccccacagaagactcagaggaacgagttcacagcccagctgccagattgtagcgagagtgtgcgacagatgcttcaggacgaaatgtttaaactggtgcagctacaacagattaattttatgtctttgatgcagattgtcgggagcagcttcgcaaatttgcccgatacgcagcaattagtgcaacagtcccagagtgtccacctgggcgagtcccaggagtcaaatctgcgtggatgtggcgacgtcgaagactcaaacaaaaacctcaaagagagatttttcataaagccacagagcatgggtgaaaatgccagggagcccagaaaaaatagcccgcattgccacgaaggtaccatcccaagcggtcagaacagtacgggcaatgtgcagaacgtgccccacggatctatccctttgtgccaactgaatggtcagcccaggaaaaagggcccaatcccttcctcacagaacctgccaagcacaagcttctatccagctccggcagggaacactcatctctacctgctctctactcctagtgtggtgcagaaggcgccaagactcattccacacgctaaaaccttctcccccggtgatggttttcctttgctacagtttaaaagtaagcaggagtttcagcccctgtttctgcatacgggtagcattcctcaggtgccttttcgaccactaccgcagccaagagaagcctggggattatcagattccttccagcctgccctgccccaaagagcagcacagacaacacctgccagtcatctgaacgtgagccagtacaacacagaggccagaaagaaagaagttgagcagaaaacgtgggctgaaacagtaattactgagattcctaaccatgtgaacctggaccaatatgtcggccaagaaaacctcaccccccagcaggatagctccgtcttcatcaagcccgaaaaactgttcgacgtaaaacctggcacccttgaaatttcgcctcatcattcttttggtctccccctgctgtacttgcccctaaagcctcccaacatgttcccctcaacttcgcgggcaagtatcaccgtaccaagcacgcccattcagcccatagccgaagagagaaagtatccacgactgtcactgctgcattcccacctgtcacccgaaaaccggtgtaaaaagacccagctaatacctctcgagaatctgattgctttcaaacaatcccagcagaaattgacgcacaatctcttcgagcagggcgatgccggtcacctccaactgctgaaggtgaaaattgagcctcctgaagtcagacaagggaaagatagtaaaaagagacagcggaggcgggcagagaaagaactgcaggaaaagcgctgtgaaaagctgcgaaggaaacccaacgtgacctttcgtcccgaaaattctattataaacaacgacgacagcgagatcataaaaaaacccaaagagcagcaggagcattgcggatctcatcccctggacgatttcgacgtgccctttgagatgctgcaggatgataacacaagtgcagggctgcattttatggcctccgtaaaaaaaaaggcaataggctcgcaggacgcctctaccaacaccgatcccgaacacgagcccctgacagcccctcaattgctcgtccccgatgtttatctcaatttaaagctgagctccgagatgtccgagaaaccgtggagcccttcaattccccataccgtgaccaaccttgagctgcctgtgcgagaggaaccctcaaatgacaacgtgatcaaacagcaatctgatcacttggcagtcccgagtagcgcagaactccattatatggctgctagcgttaccaatgctgttccgccacacaatttcaagagtcagggcctacctaaacccgagttcagatttaaggggcaatccacaaaatctgattccgcggaagattatctcctttggaagaggctccagggagttagtgcagcttgccctgcgcctagctccgccgctcatcagctcgaacacttgtccgctaaattgcagaaaattgatgaacaactcctcgcgattcaaaacatcgcagaaaatatagaacaggatttcccaaagccggagatgttggaccttcactgcgataagattggacccgtggaccacattgaattttcaagtggcccagagttcaaaaagactcttgcttctaagacaatctctatcagtgaggaggtccggttcctgacccatatggatgaggaagaccaaagcgataagaaggaaaccagtgaacccgaatttagcatcaccgagaattattccggccaaaagacctgcgtgtttcctaccgcagactcagcagtcagcctgagtagcagctcggatcaaaacactacatctcccggaatgaattccagcgacgagctctgtgaaagtgtttcagtgcaccctctccagatgaccggtctgactgacattgcggatatcatcgatgatctcatcatcaaagatggggtgtccagcgaggagcttggacttactgaacaagccatgggcactagcagaatccagcactactccgggaggcacagtcaacgcacggacaaagaaaggcgagagatccaggcttggatgaaacggaaacggaaagaacgaatggccaagtatctgaatgagctcgcagagaaacgtggacaggaacatgaccccttttgtcctagaagtaacccactgtacatgacgagccgggaaattaggctccgacagaagatgaaacacgaaaaggacagactccttcttagtgagcactactcacgccgtatatctcaagcatacggcctgatgaatgaacttctttcggaaagcgtgcaactccctacgcttccccagaaaccactcccaaataagccgtcccccacacagtcctcatcatgccagcactgcccatccccacgcggagaaaatcagcatggacacagtttcttgataaaccggcctgggaaggtaaagtacatgtctaaaccttcctatatacataaacgcaagagcttcggacagccccagggatctccatggccacacgggacggccacatttacaatccagaagaaggccggtggggctaaagctgccgttaggaaggcgacgcagtctccagttacctttcagaaaggcagtaacgctccatgccactcactgcaacacacaaagaagcacgggagcgccggactcgcaccccagacaaagcaggtgtgtgtggaatatgagagagaggaaaccgttgttagtccttggaccatccctagcgagatccacaagatccttcacgaatcgcataactccctattacaggatctgagcccgaccgaagaagaggagcccgaacacccctttggcgttggaggagtggattctgtctcggagagcacgggctctattctttctaaactcgactggaatgccatcgaggatatggtggccagcgtagaggatcaaggactgagcgttcattgggcgctcgatctcta

SEQ ID NO: 54428 - DNA, 9593 bp, Artificial Sequence
  Description of Artificial Sequence: Synthetic coding sequence
atggaaatcagactggagatactgactagcaccggcataaagcagaagaaaccgtggcctagagtgagttggctgggcaaggaaaaagaggccgtcttcctcttagatgacaagtttattaacgagatcaacctgcttagcggcaagattaaaaagaaaatcccgtctcttcagccgttcctgaaagatgtaatcgtgcttacaaccagttctaacgacgcctggctcgcaggtgttctgaccaccggtgagttgtttctgtggaataaggatcaagactgcttgaagacgatccctatcaccgagaaaccgaaggagatgatcaaagccacagtagcttcgtcactgcggctttatctgtacgttagcggaaacggcaagcgcatcgtgctcattaccccttccggatgtatctttctttgggagtacctggaattaaagaatattctgtcctcaaaatcgctgagcttagctggcagatggagccaggtaatcccagaagaagccgtgttattgccctcaactgaggacaaggaagccgttgttaacgccgtctttatcaaaaacgaactttttggtgattgttgtctatgcagcttcacattctactccggagagtgcctaaagttaacattcctggccattaggtggcatgagaatgtattcactagtgtgagatcgttgccttaccatgtccactgggcccagcaagactgccacctatgcagtttaattcctaagtgtgagtccgtgaagtctcgaggcgctctcattagcgccttcagtagagacgggcttacgctggcggtgacccttaaccagaaggatcccaaagcgacgcaggtgttgttcattaacaccttaaacttcgtcacactgtgcggaagtctcaaagggtgctcgaacaaaagccctgtggttcctgcaactctcatccgctcatactgggtcggggatatctcatggacgcacgattctttgttcctggcgtgtatgctgaaacgcggatctttagtgctattaacctgccagggtgagctgctgaccttgatcacttttggctgctccatcgaatttgggcctgctgagtttattcctctccatcctttaattacctatcgtccccagcagttcacattccaggactccaacaactcagtggacagttctgcttccgactctgatcccatgaggcagagattttccatcaaggcacatagccgcctcccatacctggtgatcagcgacggatacatggtgaccacgctgcgattccttgactcactatcaccgtccgtccatatgaggagcttacttcttgactcgacccagcggctggagaaaatttaccagtctgtgatactgtctaaaccaaaaggcaaaggcctcaatctgcgaagcctgaatagcctgcgaagctccttgcttgagcaccagggcaacgagagcagtgctgattttaccgtgcccaagtttctccaggccgaagaaacaattaacgaaaacgccgctgattttcaggatttcgaggccgaggagacgaacgaagggagacattttccagataatctttgccctttttggaataaaagagatgacgtcttgtgcagctccatgaaagagggaaggttggagttcgcatccatgttcgataccatccacgccaaggacgactccgaagaaaccgaccgcactatcacggaactgcactcaattcagaagtcccttctcgccgcatggacaataggcatctccaaaactgtgactgagaaaaaccttatgctgaattacatcgtcgtttgcatcacacactttttctacatcctgcagttcattaagtgcccattccctaaactagatttggttctgtctaaatcttctaggcacaacgcatggatcctctgtatctttcagttgtttcaccaatgcctctcaatccactactgggacattcgatacaagcaggatgtggggcacctgattaagttgacctctaatacagtaaaacttctcctcacccaacaacagaaagggcagcttttttccgaaaaactcctggcctgcttctacctccttaagatggttgcagacaatctcaatggcgtctacatcctccagcctgaggtgatcagtgcttcagcagacggttcgaagattaccgctcaggatagtctggttgtcccgatatttcaaatgttccaggacagtggcttccagaagaactggtcatggaactctttctttaagatacatcctcaggtggtaaatcctgtacagcaacctggacatagactactgattctgtggaggattctgtataaaaagaccctctggtaccaagcacagttgaataggcgcgttcccgaagccgatagtcagctaaccgagaaaatgacacacgaggcctcgactgtgaagtctcttctttgccaccttcaggctaaccttcaaagtaccggggattgtctgaatcagaccttggagctgaaaagcattaatggcgaggagtgcttcctgctggggtcctacgaaaaatccgtacagctctggaagaaagcactgcaggaaatagaggagaaaggcggacggaggacctactttctccaaatcagatattacctgagcctgctgtactgtcacctgtatagctacaatctgaatgacgcccagggcttgtgcgatcaactcgcgcgagagattctgcgctggagccagttacctgtgaaggagaacaaagattttagcggagcggcaaaatcacattttgagtgtggcatggtcgggggagtgcatcctgaggccgctgtgagggtggttcaaagcatggccagattcatggccgcatattttactaaccagcagctgtgcatcctgcctccacatcacgtgaacgtcctccctccactccatattaagacggaacagtcatttcggctgatccccctccagcacagtaaggtcgccagcgttgttcgggaccagaatctgagtaatgtctggacagttgagtacgccttggagctcctattcatcggcggactggtgccagaagccgtctggctagcttataagctcggtgactggaaaacctccgtgtctatcggcgtcgctttccagttgttctgtaaacgtgactccaactttatgcgatccaagaagaaatcattgaatctccctctcagaatgacaccggctcagatttttcaggagaagttgcagtgcgttctgggtcagcctgcaagtctggaagcgaagaacgaaatgggctccaaatataaacagttcaccgatcctatcgaggaggaggatgccaacctgctgtttggctcggtgcaggaggtactgaaggcatctgtgatggccgatgccgacatcctctcagagacttttcagctgctgattgactcagcaaaggacttcagcaagaggttgtggggccttgtgccttttggcctgtacttgcccgctcctcctctgtactgccctcagccggcaatattgagcgaagaagatggcgatgacttattactcaaagcagaaaaaaacaataggcagaaggttagtgggatcctccagcgggttctcctcctgttccgtgcggctcagtgttcctttccagttgcgcaatggtacatactgcagctccgctgggcacggaaagttatgcagaagatccgcatgaaaggatctttaccatcactgagcccgtttccacaatcattattgaactactgcaagggaggaatcgcttttttccgccctggagccgctggggaccataagctggatgaagtcagcatccgagcaattgggtgcttcagggagctgtgtgcactctgctggatgctgcacgtgagagacaaactctcctattcctgccgacagtatcagaaagcacgtgagaacgtgaaaggggaaaaggatctggaagtggagtttgattcctgcatgatcgagcattgcctgagtgctgtggaatgggcttatcggatgttgcctttttcaagattcttcaatatggaagagcttatacaggatatcatccttagccttattggcgaacttccccctatccgtaaggtagcagagatatttgtgaaagccttcccttatccagaggatgttcgggtacccctgagagataagtaccattcgctgcaccagagactgagacactgcgtggtgaaaggccctcagacagaagaaatgatgtctgtggtaatgcatagtatacaaaaggtgagggtgaaggcactgaagagagtgcagcgcaacatcgggtcttttgaggtgaacatttgggagcctattgaagaggaaaagccagatgaggccccaggggtagacaggtatagtctgggcaccagtcttagtaggtcaactctgactgagttgggagattcagtcgtgcactcggatgccgacactttttccgaagctctatctgtcgaagagaagagtaggattaatatttaccaaagaaacgcacccaaccatatggaattgacgtcaattcacaagcccactgataaacgtaagatgtgcaatcagaaagaaaacccaacaaagaaggaagatcacgagaagctgtctcagaataccctccctgtaattggtgtgtgggagtttgaacgcgatgacgatgagtatataaagtttctggacctgttcctctcatacatcttggaacgagatctcccatacagtagggacgctgacatcccatttctgacctcatttagcggaaaattgagggagcacgagctgaatagccttttgttcgatgttcacactacacttaagcgccatcagtccaagacaaaatcccagaatgttttcagagctgggtcttgctttgttgtggctccagaatcatatgagagcgagaagtcttccagccttaatgatgaatatggaatgcacctggagaatcagaaattatcgtcatccgtgttggtaaaccaggggattaaaccatttttgcaatacccttccaatgaagtgaacaaaaatgagggtatgagcggattgtttggtctcaaacagaggtctatctacaagattcaggacgacaccagggaaaaatgtctgattcagcgctcatccaaccacatcttctggacaccaaagtccattaagaccaggaggtgcatcttcaaagcaatccagtgcaacgacatcaacccacaagaggacttgcccctggccctcaacacttttggtagtattggcaggttactggaatggatgattaggtggagcaaccggagactactgtgtgacagtggcatcacggagagctcatcagaatactctccagtgatacgtgtcaaaacttccacagccgctattctgacaagcctgtggctcctcgagcagccctacttcgcaacctataaggcaaagaacgctatcatcaaaatggtggaaaaccgagatactggctgccagatcggaccgaacatagaacgggaatctaaatcagacgccggaggctctgtggccgtcgcaaccccgggagggaccgaagagagaaatgggcagaacaagagctgccagaacatcctgaaccgaatgccaacagaggccaaaaatcccgatattaaagagataaatgacgacatcatctcgattactcacaacactaaaaaggagttcatcgatattgatgaaaacctgctggaagttgaagcttttacagaggaagaaatggatatgcacatctctgattacgaggaggacattgaggagagcgttggcggtttccgaagcccgagtctagcaatatgtatgatgacactgccccagcagctggaagaggagtttacagaggaggtgcagtgccagcgggaggaacctctggagaccattatggaagaaaaatcgaccgaacagaaagggatgatcgaagcctttagccaccctggccacaccacccctcagagtatgcaagtggatacttccagcgagatatcaagtgcccagatatccacatacaaagagaagtccagctcggtgccactgctgatatcgaacggcgttaatgtggcttcgcagcctcccgctcccactcctcagaagacgcagagaaatgagtttaccgctcagctgcccgactgctcagagtcagtcagacagatgcttcaagatgagatgttcaagttagtgcagcttcagcagattaattttatgtccctcatgcagatcgtggggtcaagcttcgctaatcttcctgacacacagcagctcgttcagcaaagccaatcagtgcacttgggcgagtctcaagaatcaaatcttagaggctgtggggatgtggaagatagtaacaaaaacctgaaggagaggttctttatcaagccccagtcaatgggagagaatgccagggagcctagaaaaaacagccctcactgccatgagggcacaatcccctctgggcagaattccacaggtaacgtgcagaatgtgccacatgggtccattccactgtgccagctgaatggacaaccacggaagaaaggaccaattccatcgtcccaaaatctgcctagcaccagcttttatcccgctccagcagggaatacacacttgtaccttctgagtacaccatccgtagtacagaaggccccaagacttatccctcatgccaagaccttttccccaggggatggttttccactgctgcaattcaaatcaaaacaggagttccagcctctgtttctccatacaggaagcattccgcaagtgccgttcaggcccctaccccagcctcgggaggcgtggggcctcagcgactcctttcagcctgctttacctcagcgagccgctcagaccacgccggcttcacacctcaacgtgtctcagtataacacagaagcaagaaaaaaggaggtcgaacagaagacgtgggcagagacagtaattacggagattcctaaccacgtcaacctggatcagtacgtcgggcaagagaacctcaccccccagcaggacagtagtgtgttcatcaaaccagaaaaactgttcgacgtcaagccaggaacgctggagatctctccccaccatagctttgggcttcctctgctctaccttcctctcaaacccccaaacatgtttccctccacctctagggcgtcaatcaccgtgccttccactcccatccagcctatagctgaagagcggaagtatcccagactgtctctcctccattctcatttaagcccagaaaaccggtgtaagaaaacacagctcatcccattagagaacttgatcgcattcaagcagtcgcagcagaagcttacccacaatctgttcgaacagggcgacgcgggacatctgcaattgttaaaggtcaagattgaacccccagaggtccgacagggcaaagatagcaaaaagcgtcagcggaggagagccgagaaggagctgcaggagaagcgctgcgaaaaattaagacgcaagcccaatgtgacttttaggccggaaaattctatcattaacaatgatgactcagagataataaagaagcctaaggagcagcaagagcactgtgggtctcatcctctggacgattttgacgtgccctttgagatgcttcaggatgataatacttcagcaggactacacttcatggcgtcagtcaagaaaaaggcaatagggtcgcaggatgcctcaactaacaccgatcccgagcacgaaccactgaccgcaccgcagctactggtccctgatgtctatctgaacctgaaactgagtagcgagatgtcagaaaaaccatggtcaccatccataccacacactgtaacaaacctggagctcccagttcgggaggagccttcaaacgataatgtaatcaagcagcagtcggaccaccttgccgtgcccagttcggccgaactccactatatggctgccagcgtcaccaatgccgtgcctccacataacttcaaaagccaaggcctgccaaagcctgagtttcggtttaaaggtcagtcgacaaagtccgattctgctgaagattatctgttatggaagagactacagggcgtctccgctgcctgccctgcccctagtagcgccgctcatcagctggaacacctgtcagcgaaactgcaaaaaatcgacgaacagctcttggctattcagaacatcgccgagaatattgaacaggactttcctaagccagagatgctggatttgcattgcgataagattggtccagtggatcacatagagttttcctctggaccagagttcaagaagacgctggcaagtaagacaatttcgatttctgaagaagtccggttcctgacccacatggacgaggaggatcagtccgacaagaaagagacatcagaacccgagtttagtattactgagaactattctggtcaaaaaacatgtgtttttccgacagcggactccgctgtgtccctgagctcgtctagcgatcaaaatacaacttctcctggcatgaattcctccgatgaactgtgtgagagtgtgtcagtgcatccgttgcagatgacagggctaaccgacatcgcagacatcatagacgacctgatcatcaaggacggtgtgtcatccgaggagcttggtcttaccgaacaggcaatgggcacctccaggatccagcattattccggaaggcatagtcagcgcaccgacaaagaaagaagggaaattcaagcttggatgaaaagaaagcgcaaagaaagaatggctaagtatttaaacgagctagctgaaaaacgtggccaggagcatgatcctttttgcccacgctcgaaccccctttacatgacttcgcgagaaatccggctacgccagaagatgaaacacgagaaagaccgattgctgctgtcagaacactactcaaggagaatttcacaggcctatggcctgatgaacgagttactttcagaaagcgtgcagctgcctacactcccacagaaacccctgccgaataagccatcccccacgcagagcagctcctgtcaacactgcccatcacccagaggagagaatcaacatggacacagctttctgatcaaccgtcctgggaaggtcaaatacatgagcaaacccagctatattcataaacggaaaagctttggacagccccaggggagcccttggccgcatggtaccgcgacatttaccatccagaaaaaggctggcggagcgaaggccgcagtcaggaaggcaacccagtccccggtcacttttcaaaagggctctaacgctccatgccatagcctgcagcacactaaaaaacacggctctgccggtttagccccacagaccaagcaggtgtgcgtggaatacgagagggaagagaccgtagtctcaccatggaccatccctagcgagatccataaaatcctgcacgagagccacaattccctcttgcaagatctgagcccaacagaggaagaggagcccgaacatcccttcggggtcggtggcgttgacagcgtgagcgagtctacaggatcgatcctcagtaagctggattggaatgctatcgaggatatggtggcatctgtcgaagaccagggactgagtgttcactgggccctcgatcttta

SEQ ID NO: 54429 - DNA, 1725 bp, Artificial Sequence
  Description of Artificial Sequence: Synthetic coding sequence
atggccacccttgtagtgaataaattgggagcaggtgtggacagtgggaggcaggggtcaagggggactgccgtagtaaaagtgttagagtgcggggtctgtgaagatgtgttcagcctccagggagataaggtgccaagactcttgctgtgcggccatacagtgtgtcatgactgcctgacaaggctccccctgcatgggagagccatacgctgtccctttgacagacaggtcacagacctaggagattccggcgtgtgggggttgaagaagaactttgccttgctggaactgctggagaggttgcagaacggaccgattggtcagtatggggcagctgaggaatccatcggtattagtggcgagtccattattcggtgcgatgaagatgaagcacacctggcatcagtctactgcaccgtgtgtgccacccacctctgtagtgaatgttcccaggtgacccactcaaccaaaacattggcaaaacacagacgcgtcccacttgctgacaaaccccacgaaaagacaatgtgttcccagcatcaggtccacgccatcgaatttgtgtgcctggaagaaggctgccagacgtctccgctgatgtgctgtgtctgtaaggaatatggtaaacaccagggccataagcactcagtgctggagcctgaggctaaccagatacgggcttcaatcctggacatggcccattgcattagaacatttacagaggaaatcagcgactacagtcgcaagctggtgggtatcgttcagcatatcgaggggggtgaacagattgtcgaagatggaatcggtatggcacatactgaacacgtgccaggaaccgcagagaatgctaggagttgtatcagggcttacttctatgacctgcacgagactctgtgccggcaggaagagatggcgctgagtgtagtggacgctcacgtgagggaaaagctgatttggcttcgccagcaacaggaagatatgaccattctgctcagcgaggtgtccgctgcctgtctgcactgcgagaaaactctacagcaggatgactgcagggtagtattagcaaaacaagagattactaggctcctcgagaccttgcagaaacaacagcagcagtttaccgaagtggcagatcacatccagctagatgcctccattcccgtcacctttacaaaggataatagggtacatatcggtcccaaaatggagatccgagtggtcaccctcggccttgacggggcagggaagaccacaatcctctttaagctgaagcaggacgagttcatgcaacccattccaaccatcggctttaatgtggagaccgtggagtataaaaacctcaaattcacaatatgggatgtcggtgggaaacacaagctgaggcctctctggaagcattattacctgaacacacaagccgtcgtgttcgtagtggattcatctcacagggatagaatcagcgaggctcattccgaattagccaaactcctgactgagaaagaactgcgggatgccctgctcctcatcttcgccaacaagcaggatgtggctggcgcactgtcagtagaagaaatcaccgagctcctctccctccacaaactgtgctgcggcagatcatggtatatccagggttgtgatgctagaagcggaatgggcctctatgaaggactggattggttaagccgccaattagtagcggctggagtgctagatgttgcctag

SEQ ID NO: 54430 - DNA, 1254 bp, Artificial Sequence
  Description of Artificial Sequence: Synthetic coding sequence
atggaagttaacccgcctaagcaggagcatttgctggcacttaaggtgatgaggctgaccaaaccgactctgttcactaacattccggtgacttgtgaggagaaagatcttccgggagatctgtttaatcagctcatgagggatgacccaagcaccgtaaacggagccgaggttttgatgctgggcgagatgcttacattgcctcagaacttcggaaatatttttctgggcgaaacattctcatcctatataagcgtacacaacgattccaatcaagtggtcaaggacatattggtaaaagcggatttgcagacaagtagccaacgactgaatctctcagcttcaaacgccgctgtggccgagctgaaacccgattgttgtatagatgatgtgattcaccacgaagtcaaggaaataggcacccatattttggtctgcgctgtctcttacaccactcaggccggtgagaaaatgtacttcaggaagttctttaagttccaggtcctgaagccactcgatgtcaagacgaagttctataatgccgagtccgatctgagttcagtgacagatgaggtatttctggaggcacagatccaaaatatgacaaccagccctatgttcatggaaaaggtttctctcgagccatccattatgtacaacgtcaccgaattgaattccgtgagccaggctggcgagtgtgtcagcactttcggtagccgcgcatatttgcagccgatggatacaagacagtacctctactgtctgaaaccaaaaaacgagtttgcagagaaagctgggatcatcaaaggcgtaaccgttataggtaagctggacatcgtgtggaaaactaacctgggtgaacgagggagactgcagacatctcaactgcaaaggatggcccctggttatggagatgtgagactgtcgttggaggccattcctgataccgtcaatctggaggagccctttcatatcacatgtaagattactaattgtagtgagcggaccatggatctcgtccttgagatgtgtaatacaaattcaatacactggtgcggtatctccggcaggcagctaggaaagctgcaccccagttcaagtttgtgcctcgcccttaccctgctttcctctgtgcaagggctccagagcatctcaggactgagactcaccgacacctttctcaagcgaacttacgaatatgacgacatcgcacaagtctgtgtcgtgtctagcgctatcaaagtggagtcatag

SEQ ID NO: 54431 - DNA, 1239 bp, Artificial Sequence
  Description of Artificial Sequence: Synthetic coding sequence
atggaggtgaacccccctaagcaagaacacctcctagccctgaaagtgatgaggctgacaaagcccaccttgttcacaaacatccctgtcacttgcgaggagaaagaccttccaggggatctctttaaccagctgatgagagatgatccctcaactgtgaatggcgctgaggtcctgatgctcggtgagatgttgaccttgcctcagaattttggcaacatcttcctcggagaaaccttctcctcttacatatcggtccacaatgacagcaaccaagtagtgaaggacattcttgtaaaggccgacctacaaacaagctcacaaaggctgaatctgtccgcatcgaatgctgccgtcgctgaactgaagcccgattgctgtatcgatgacgtgatccatcacgaagtcaaagaaatcggaacacatatcctggtttgtgccgtgtcctacacaacccaggctggcgagaagatgtattttcggaaattcttcaagtttcaagtgctgaaacctttggacgtgaaaaccaaattttacaacgctgaaaccgacgaggtttttcttgaagctcaaattcaaaacatgaccacctcccccatgtttatggagaaggttagtctcgagcctagcattatgtacaacgttacggaattgaatagcgtgtcccaggcaggcgagtgtgttagtactttcggatcacgtgcctacttgcaacccatggacacgcgccagtatctctactgcctgaaaccgaagaatgagtttgcggagaaagctgggataatcaaaggggtaactgtgattggcaaattagatatcgtttggaagacaaacctgggagagagaggtcggctgcagaccagtcaattacagcgcatggcaccaggttacggcgatgtgcggttgagtcttgaggccattccagataccgtgaatctggaggagcccttccacataacctgtaagattacaaactgttctagtgagcgtaccatggatttggtgctggagatgtgcaatacgaacagtattcactggtgtggaatctcaggtagacagctcgggaaactacacccctccagctctctgtgtctggccctcaccctgctgtcatccgtgcaagggctgcagtcgatcagcggactgagactgaccgacacgttcttgaaacgcacatacgagtatgacgatattgctcaggtatgtgtggtgtcgagtgccatcaaagtggagagctag

SEQ ID NO: 54432 - DNA, 1260 bp, Artificial Sequence
  Description of Artificial Sequence: Synthetic coding sequence
atggaggtgaatccgccaaagcaagagcatctcctcgccctgaaggtgatgaggttgacaaaacccactctgttcaccaacatcccagtcacttgtgaggaaaaagaccttcctggagacctgttcaatcagctcatgcgtgatgacccaagcacggttaatggagccgaggtgctgatgcttggggaaatgctgacgctgcctcagaactttgggaacatattcctcggagagacattttcttcttatattagtgtgcacaacgacagtaatcaggttgttaaggacattttagtgaaagcagatcttcagacctccagccagcgactgaatctgtctgccagtaatgctgctgtcgctgaactgaagcctgactgttgtattgatgacgtgattcaccatgaggtgaaggagattggcacacacattctggtttgcgccgtttcctacacaacacaggccggtgaaaagatgtactttcgcaagtttttcaagtttcaggtgctgaagccactcgatgttaaaactaagttctacaatgcagagaaacagatcgccaatgtgactaccgacgaagtcttcctggaggcacagattcagaacatgacaacgtcaccaatgttcatggaaaaagtgagtttagagcctagcatcatgtacaatgtgacagagctgaacagcgtgtcccaggcaggggaatgcgtctccactttcgggtctcgcgcttatctgcaacctatggacacacgtcaatacttgtactgcttgaagcctaagaacgaatttgccgagaaagctgggattattaagggcgtgacagtaattggaaaactcgacattgtgtggaagacaaacctcggcgaaagaggcaggttgcaaacatctcagcttcagaggatggctccgggttacggcgatgttaggctcagtctggaagccatcccagataccgttaacctcgaagagcctttccacattacatgtaagatcacgaattgttcctctgagcgaactatggatctggtcttggagatgtgcaacactaactctatccactggtgcggtatatcaggccgacaactgggtaaactgcatccatcaagcagtttgtgcctggctctaacgctcctctccagcgtgcagggccttcaaagcatctcaggcctgagattaactgatactttcctgaagcggacctacgaatacgacgatattgcacaggtgtgtgtggtcagtagcgctattaaggtcgagtcttag

SEQ ID NO: 54433 - DNA, 1257 bp, Artificial Sequence
  Description of Artificial Sequence: Synthetic coding sequence
atggaggtaaacccccctaaacaggaacatctgcttgcactgaaagtcatgcgcttaactaaacctacgctgtttaccaatatccccgtcacatgcgaggaaaaggacctcccgggagatctgtttaatcaactgatgcgggacgaccccagcaccgtgaacggagcagaagttctcatgcttggcgagatgctgactctgccccagaactttgggaacatcttcctgggcgagacattttcttcctatatctcagttcataatgatagtaatcaggtggtaaaagacatcctggtaaaagcagacctccagacaagctcgcagaggttaaacttgtcagcatccaacgctgccgtggccgaactgaagccggattgttgtatcgatgacgtcatccatcatgaggtaaaagagataggtacgcatattctcgtatgcgccgtctcttataccactcaagctggtgagaagatgtattttaggaagttttttaaattccaggtgttaaaaccacttgatgtcaaaactaagttttataatgccgagagcgacttaagcagcgtaacggacgaagtattccttgaggcccaaatacagaacatgactacgagccctatgtttatggaaaaggtctccctggagccgagcatcatgtataatgttaccgagctgaactcagtgtcccaggcgggagagtgcgttagcacattcggatcaagagcgtacctccagccaatggacactaggcagtatttgtactgcctgaagcccaagaacgaatttgccgagaaagccggaattatcaaaggcgtgactgtcatcgggaaactggacattgtatggaagactaatttaggtgaaagaggccgacttcagacatcccagctgcaaaggatggccccagggtacggggatgtgcgcttatcgttggaggcgattcccgataccgtaaaccttgaggagcccttccacataacttgtaaaatcacaaattgttcttctgagagaacaatggatttagtgctcgaaatgtgcaacacaaacagtatccattggtgcgggatctcagggaggcagctggggaagctgcatcccagcagttctctatgcctggcgctgacattgctgtccagcgtccagggacttcagtctatcagtgggctacgccttacagatacattcctgaagaggacttatgagtacgacgatatcgctcaggtgtgtgtcgtgtcgtctgcgataaaggtggagagttag

SEQ ID NO: 54434 - DNA, 1032 bp, Artificial Sequence
  Description of Artificial Sequence: Synthetic coding sequence
atggccagccttcaacggtctagagttctcaggtgctgtagctgcagacttttccaggcccatcaggtaaagaaatccgtgaaatggacttgcaaggcttgtggcgaaaaacagtcattccttcaggcgtatggagaaggctctggcgctgactgtcggcgtcacgtccagaagctcaatctgctgcaaggccaggtgagcgagctcccactccgcagcctcgaagaaacagtcagcgcctccgaggaagagaatgttggccaccagcaggcgggtaatgttaagcagcaggaaaagtcccagccatccgagtctcggtggctcaaatatttggagaaagactcccaggaactggaactggagggcaccggcgtctgcttctccaagcagccttcgtcgaagatggaagagcctggccctagattcagccaagatctgccaagaaaacggaagtggagccggagcacggtgcagcccccttgtagccgaggcgtccaggactcaggtggctccgaggtggcctggggaccccaaaagggtcaggcagggcttacctggaaggtcaagcagggatcgtcaccatgcctgcaggaaaatagtgctgactgttcagccggtgagctgagaggccctggcaaggaattatggagtcccatacaacaagtcacagcaacatcctcaaagtgggcccaatttgtgctccctcctcgcaaaagctctcacgtggactcggagcaacccaggagcctgcagcgggatcccagacctgcaggacctgctcaggccaagcagggcacccccagagcccaggcgagtagggagggcctgtctcgtcccacagctgccgtgcagttgccacgagctacccatcccgttaccagtggttcggagagaccttgtggaaagacatcgtgggacgctcgaaccccatgggccgagggcggacctcttgtcctggaagcacaaaacccccgtcctacacgtttgtgtgacctgtttattacaggggaagattttgatgacgatgtatag

SEQ ID NO: 54435 - DNA, 867 bp, Artificial Sequence
  Description of Artificial Sequence: Synthetic coding sequence
atggcatctttacaaaggtcgcgggtcttacgttgctgcagctgtcggctgttccaagctcaccaggttaaaaaatcggtgaaatggacgtgcaaagcctgtggcgagaagcagagctttctacaggagaagtcccaaccgtccgagtctcgctggctcaaatacctggagaaggacagccaggaactggaactggagggaaccggggtgtgctttagcaaacagccaagttccaaaatggaggagccaggccctagattctcacaggatctgccccgtaagagaaagtggagtagatccaccgtccagcctccgtgtagccgcggtgttcaggacagcggtggatcggaggtggcttgggggcctcagaaaggacaggccggtttgacttggaaggttaaacaggggtcctctccatgtctacaggaaaattctgcagattgctcagccggagagctacgaggccctggcaaagagttgtggagtcccatccagcaagtgaccgcaacttcttccaagtgggcccagtttgttctgcctccaaggaagtcctcccacgtggacagtgagcaacctcgctccctgcagagggatccacggcctgcgggaccagcacaggcaaagcaagggacgccaagagcccaagcgagcagggaaggtctatccaggcccaccgccgcagtccagctccccagggcgacccatcctgtaacctcagggtcagagcgtccctgtggcaagactagttgggatgccagaaccccctgggctgaagggggtcccctggtgctggaggcccaaaatcctcggcctacccggctttgtgatctgtttatcacaggggaagacttcgacgacgacgtttag

SEQ ID NO: 54436 - DNA, 816 bp, Artificial Sequence
  Description of Artificial Sequence: Synthetic coding sequence
atgcagtcagcacgcgcttggctgccgggtgattgtaccagccgggacggcgtcgcctctgctttcagcggtgctactctgctgcagcttccgccactcccaggggctcccggaaagaaagagtgtcaagtggacatgcaatccttgtggagagaggcggtgttattcgctgaatttcctcggcatggagcaccagccagcgagctgcccgtgccaagcggcagcgagatggatggagcggagagtgggaaagcttacggggaggggtccggagcggactgccggagacatgtccagaagttaaatctgttgcagggacaagtgtctgagcttcccctgcgctcactcgaggagacagtgagtgcgagcgaagaagaaaatgttggccatcagcaggcaggcaatgtgaagcagcaggagaaatctcagccaagcgagtcacgctggctaaagtacctggagaaggacagccaagaattggaattggagggcaccggtgtgtgtttctcaaaacagccgagcagcaagatggaagaaccaggtcccaggttttcacaggacctgcctaggaaacggaagtggagcagaagcaccgtccagcctccttgtagcaggggagtgcaggacagcggcggttccgaagtggcctgggggcctcagaaaggccaagcaggactgacctggaaggttaaacaaggcagctcaccatgtctgcaggagaactctgccgactgttctgccggagaattacgcggacctggcaaagagctttggagtcccatccagcaggacgggtataaggagatacttttttag

SEQ ID NO: 54437 - DNA, 531 bp, Artificial Sequence
  Description of Artificial Sequence: Synthetic coding sequence
atggccgcagccggtcgcggaagagagcaggacagcgctaggtttgtctacgtgacccggttcggcagtcaccaatgctctggtgttcttcagctcggcggtaggggggctcagggcctgtggggtcagggtccaggtgctggttgccggcaggagaaaccacgcgaggcaatggccgtggcgggagtgcagggcggttcggagttgccactcggctcccagctgagggtcccaaccacacctggcgttgaggctgctgcttccgcgtcatcccagttaagggcaagtcgcgtccagagcgggactcggcagtctgcacgggctggcctgatccagaaagatgccgcaaagaaatacgactttcccattcccctcaacgaagccagcaagatcatgaaaaagaagaaaaaggtgctggtttggaacagagtgtacaaagtcatatcaagaatgttagaagaaaacgagaaatatcgtcatcgcctgaagtgccagcgcctcagctcagagagctctaattacactcgatag

SEQ ID NO: 54438 - DNA, 405 bp, Artificial Sequence
  Description of Artificial Sequence: Synthetic coding sequence
atggcttccgggaaggatacatgccctactcttccaaagcttactaacaattgttcagacgaaagcttgtacaagtcggcaaacaaatatgaagagatccacctgccacggttcagcctcaaacagggcatgatcccaagaaggtacgttatgccttggaaggaaaatatgattttccgaaacgtgaatctgaaacaagcggaagtctgcggcatccacactggcccactagaggattccctttttttgaaccactccgagcgtctttgccacggtgaggacagaaaggtggtcttccagaagggtccaccagagatcaaaatcgcggatatgcccttgcattcaccactgagccggtaccagagcaccgttatctctcatggatttagacggagactggtgtag

SEQ ID NO: 54439 - DNA, 444 bp, Artificial Sequence
  Description of Artificial Sequence: Synthetic coding sequence
atggaggacgacgaggaggaaactaccgctagcacgctgcgcggaaaaccacgaccacccccagtttcagctcaaagtgctttctcctacattcctccgaggcgcttagatcccaaggaacacagctattattataggccagcgagaacaggtatcataagcctgtacgactgtattttcaagcgccgactggattatgaccagaaacttcatcgcgatgatcgtgaacatgccaaatccctgggactgcatgtgaatgaagaggagcaggaacggccagttggagtgttgactagcagtgtgtatggaaagaggattaaccagcccattgagcccctcaacagggattttggaagggcgaatcacgtccaagccgacttttataggaaaaacgacattccatctctgaaagaacctggatttggacatatcgcaccgtcgtag

SEQ ID NO: 54440 - DNA, 471 bp, Artificial Sequence
  Description of Artificial Sequence: Synthetic coding sequence
atggctacacagcaggtcgattcacggcgacaggtggccgcagagcaggtcgccgcacagctgctggaaaggagacgcggttcacactgtgatgacgagaagcaaacgctgctggccctcctgatccttgtgctctatttgagcaccgaaatctggggcagttcttgggaagtgagcgagcggatcagagaatgcaactactaccaaaacctggcagtgccccaggggttggagtaccagaccaacgaaccgagcgaagaacctatcaaaactataaggaactggctgaaagagaagcttcacgtgttctctgagaagttagaggaggaggtgcagcaactggagcagcttgcctgggatctggaactctggttagatgctctcttaggcgagccacaccaagaggaacactgtagcacctacaagtcccatctgcatcttgagcatgaagtgagcatccgagaccactag

SEQ ID NO: 54441 - DNA, 885 bp, Artificial Sequence
  Description of Artificial Sequence: Synthetic coding sequence
atggccgctgcagtgtcatctgtggtccgacgcgtagaagagctgggcgatctagcccaggcccacatccagcagctgagcgaagctgcgggagaagatgatcactttctcattcgcgcaagcgcagccttggagaaactgaagttgttgtgcggcgaagaaaaggaatgttctaacccttctaacctcctcgaattgtatacccaggctatccttgatatgacctacttcgaggagaacaagctagttgatgaggattttcctgaggattccagcagccagaaagtgaaagagctgatctcttttctctccgagcccgaaatcctggtaaaggagaacaacatgcatcccaagcactgtaatttgctaggcgatgagctgctagagtgtctctcttggagacggggagccttactgtacatgtactgtcattcactgacaaaacggcgtgagtggctgctccggaagagctcattgctgaagaaatacctcttagatgggatcagctacctgctccagatgttaaactacagatgtccaatccagttgaacgagggggtgagcttccaggacctggacacagccaaacttctgagcgccggtatcttctccgatattcacttactcgccatgatgtacagcggggagatgtgctactggggcagcaaatactgtgctgaccaacaacccgagaaccacgaagtggatactagtgtgagtggcgctggatgcactacatacaaagagccactggactttcgtgaggtgggtgaaaaaatcctcaaaaagtatgtctcagtttgtgagggccctctgaaggaacaggagtggaatacaacgaatgccaagcagatactcaacttcttccatcacagatgcaattag

SEQ ID NO: 54442 - DNA, 480 bp, Artificial Sequence
  Description of Artificial Sequence: Synthetic coding sequence
atgacccagccaacccggccatcagtcacctgcgatcaaggctcttctacaatcgggggtaccgccgctcaagccacaacatcttcttctgccacctccgggtcaaactatcagcgcgaccggctgggaagacggccagagataggtgtgggcggacagccccagatctgttttcctcgccctcgctctgcccagcagccagtgctgttctcactgatgaactcttcagaagcagctatgaagaaaacactgcctaagtcccacctttctagagtgattattcatgacaacaggatcactcagagaatctatgaaatggaagtttccgccctggaaaaaaccaagaaaaaaatctcacattactacgaacatctcaagaagaagtttatgaccgagcaactgcgcaaactcggacggtggagggaggaaagtgtgaacagcaaccggtatctgaccttcggtattcctccccctgtctag

SEQ ID NO: 54443 - DNA, 1785 bp, Artificial Sequence
  Description of Artificial Sequence: Synthetic coding sequence
atgagtaaaaagagaaagtgggacgacgactacgttcgttactggtttacatgtaccacagaagtggacgggacacaacgccctcaatgtgttctttgcaactccgtattttccaacgcagacctgcgaccgagtaagctgagcgaccatttcaaccggcagcacgggggagtggcaggacacgacttgaattccctcaagcatatgcccgcaccttccgatcagagcgaaactctcaaagcgttcggcgtggcttcccatgaagacacactgctgcaggcatcataccagttcgcatatctgtgtgctaaagaaaagaatcctcatactgtggcagaaaagctggtaaagccctgcgccctcgagatcgcgcagatcgtgctcggaccagacgcccagaagaaactccagcaagtcccactgtccgacgacgtgatccatagccgaattgatgaaatgtcgcaggacatactgcagcaagtgctggaggatatcaaggccagcccactcaaggtgggcatccaactggctgaaaccacagacatggatgattgttcccagctgatggcttttgtgcgatatatcaaagagcgggagattgttgaggagtttctgttctgcgagcctctgcagctgtctatgaagggcatcgacgttttcaatttgtttcgcgacttttttctgaagcacaagatcgcgctggacgtgtgcggcagcgtgtgtacagacggcgcatcaagtatgctgggcgaaaactcagaattcgtggcgtatgtgaaaaaagaaataccccatatcgtggtgacacactgtcttctaaatccacacgcgcttgttatcaagacactccctacaaaactgcgagacgccctgttcaccgtcgtgagggtaataaatttcatcaagggtcgtgcccctaaccacagactcttccaggcgttcttcgaagagattggaattgaatactcagtgttactgttccataccgagatgcgttggcttagtcggggacaaatcctgacacatatctttgaaatgtatgaagagattaaccaattcttgcatcacaaaagctccaatctggtggatggcttcgagaataaggagtttaagattcacctagcctacctcgccgacctgtttaaacacctcaatgagttgtctgccagcatgcagcgcacaggcatgaacaccgtatctgctagggaaaagctgtcggcattcgtgaggaagtttccattttggcaaaaaagaattgaaaagagaaacttcacgaatttccctttcctggaagagataattgtgagcgacaatgaagggatttttatagcagccgagattactctgcatttgcagcaactgagcaatttcttccatggctacttttccatcggcgacctcaatgaggcttcaaagtggatcctcgatccctttctttttaatatcgacttcgtagatgacagctacctcatgaagaatgatctagcggagctccgtgcctcagggcagatcttgatggaatttgagacaatgaaactagaggacttctggtgcgctcagttcactgcttttccaaacttggccaagacagcgctcgaaatcctcatgcccttcgccactacctatctgtgtgagttagggttcagtagcctgctgcatttcaagacgaaaagcaggagctgtttcaatctttccgacgatattcgggtagccatctccaaaaaagtgccaaggttttcagacattatcgagcaaaaactgcagttgcagcaaaagtcactgtag

SEQ ID NO: 54444 - DNA, 1785 bp, Artificial Sequence
  Description of Artificial Sequence: Synthetic coding sequence
atgagtaaaaagcgtaaatgggatgacgactacgtgagatactggttcacatgtaccacggaggtagacgggacgcagcgcccacagtgtgtgctgtgcaattcagtattcagtaacgccgaccttagaccttcgaagctgagtgaccacttcaacaggcagcatgggggagtcgccggtcatgatctgaactcgttgaaacacatgccagccccatcggaccagtccgaaaccttaaaggctttcggggtggctagccacgaggacaccctattgcaggccagctaccagttcgcgtacctttgcgccaaagagaagaacccacacactgtagcggagaaattggtgaaaccttgcgccctggagatagcccaaattgtgttgggccctgatgctcagaaaaaactgcagcaggtgcctctatctgacgatgtgatacactctcgaatcgatgaaatgagtcaggatattctccagcaggtccttgaggatattaaggcgagcccgctgaaggttggcatccaactggcggagacaacggacatggacgactgttctcaactgatggccttcgtgcgttacattaaggagagggaaatcgttgaggagttcctgttttgcgaacccctccaactgtctatgaaggggatcgacgtcttcaacctctttcgggatttttttctcaagcacaagatcgcgcttgacgtgtgtggttcagtctgtaccgatggggcatctagtatgttaggtgagaattctgaatttgtggcctacgtgaaaaaggagattccccatatcgtggtaactcattgcctgctgaacccgcacgccctggtgataaagaccttaccaaccaaattgcgtgatgctctattcactgtagtcagagtgatcaactttattaaaggtcgggctccaaatcataggctgttccaagcattttttgaggaaattggtatagaatatagcgtgttgctgttccataccgagatgagatggctatctcgcggtcagattctgacgcatatctttgagatgtacgaggaaatcaaccagtttctgcatcataaatctagcaatctggtcgacgggtttgaaaataaggagttcaagatccatcttgcgtacttagcagacttgttcaagcacctgaatgaattgagtgcaagcatgcagaggaccggtatgaatactgtaagcgcccgtgaaaaactgtccgcatttgtcaggaaatttcccttttggcagaagcgcatagagaaacgaaatttcactaactttcctttcctcgaggagataattgtatcagacaacgaggggatctttatcgcagcggaaatcacacttcacctgcaacagctgagcaactttttccatggctatttcagcataggggacctcaatgaagcctccaaatggattctggacccatttctgtttaatattgatttcgttgatgattcatacctaatgaaaaacgacctcgccgaactccgcgcttctggtcagatcctcatggagttcgagacgatgaaactcgaagacttctggtgcgcacagttcaccgcctttcccaaccttgctaagacagctctagagattctgatgccctttgcaactacttatctctgtgaactgggcttctcaagtcttctccacttcaaaactaagagtcgtagctgcttcaaccttagtgatgacattcgcgttgcaatttcaaaaaaagtgcccagatttagcgatatcattgagcagaaattgcaattgcagcaaaaaagtttgtag

SEQ ID NO: 54445 - DNA, 309 bp, Artificial Sequence
  Description of Artificial Sequence: Synthetic coding sequence
atgagggaaatcgccgaaatcttaccagctcaggagaaagtcgaggccagaatcgatctgaaaatgggcaagaaacgggttactgatcacaaactgaacgtagacaaggttatcaagaacattaacactataagctccgagttaaaaaagataaaggagctatctcagctgctgctctgtgacctcattttgcactttaatcaccctatcaaaacggagaacctagccgaggctgaaagaaataaccctctgttcgaagagtcgaaaatatcagacgtatcattagtgtctaactccttcagcatctag

SEQ ID NO: 54446 - DNA, 309 bp, Artificial Sequence
  Description of Artificial Sequence: Synthetic coding sequence
atgcgggagatagccgaaatactaccagctcaagagaaggtggaagctaggatcgacctgaagatgggcaagaagcgagtgaccgatcataaacttaacgttgacaaagtgataaaaaacatcaacaccatctcatctgaactgaaaaagattaaggaactgtcccagcttctgctgtgcgatctgatcttgcacttcaaccaccctatcaagaccgaaaacttggcagaagcagaacgtaataaccccctgttcgaggagagtaaaatatcggacgtcagcctggtgagtaactcattttcgatttag

SEQ ID NO: 54447 - DNA, 834 bp, Artificial Sequence
  Description of Artificial Sequence: Synthetic coding sequence
atgccacgggctcagctgcccgaggatagctcagccgtggatatggacatcctctttcccttagattcagtaatcggcacagagttgtgtccgtcaccgattccccagatcatacactttgtgttattcgtggttttcagcctggttatcttaatcatcttacgtctatatatcccccgagagccatcaagcgtgcccccaagggaagaggattccgagaatgatcaggccgaggtcggagaatggctcaggatcggaaacaagtacatcactctgaaggattaccgaatacttttaaaggaactggaaaacctggagatatacacttttctttcaaagaagtgccttaaaaagttgtctcgggaggggtcatcccatcatcttccacgccaggtgcgacctgggcctgtgtataaacccgctcccgcaagaaaccataggccgcgaggcggaagaggtaaggctagccctacgtccttccatgtgtcaccacgagccccacttgcacctctggcttctatgccaagtagcgttccaaaaacctctgtcgagtcattgggcagcccatcatctctgtcctcatccaagcccagggagccactgtgcccgctaaagcacccttcccaccaaccaccagcctcaactctttcccctaatcccacaagttccacggaatcattgggcgaaaccccccacgcaggcaggtggcgtcagggcagccgcttccctcagcctggctgcgccaatgccgcagggcgaattaggcatcagaatcccaggcacagtcacggccacagaataagtgacatacatgagcagctcggaatctcctag

SEQ ID NO: 54448 - DNA, 348 bp, Artificial Sequence
  Description of Artificial Sequence: Synthetic coding sequence
atgctgtggtttcagggaaactccatgcagctggcacgatcttcatttggcctgttcctcaggaactgcagtgcttccaagaccacactgcccgtcctcactttgtttacaaaggatccctgccccctgtgtgatgaggccaaggaagtgctgaagccatacgaaaatcgcttcattctgcaggaggtgaacattacgcttcctgagaactccgtatggtacgaacgttataagtttgacattcctgttttccatctgaacggccagttcctgatgatgcacagggtgaacacatccaaattggagaagcagttactgaaacttgagcaacagagtacaggcggatag

SEQ ID NO: 54449 - DNA, 417 bp, Artificial Sequence
  Description of Artificial Sequence: Synthetic coding sequence
atgctgtggtttcagggcaactctatgcagctggccaggtcttcttttggcctttttttacggaactgtagtgccagtaaaacgacactcccggtgctgaccctgttcacaaaagacccctgtcctctgtgtgacgaagcaaaggaagttctcaaaccctacgagaaccggcagccctataaagatcagaagcttccaggaacaagacggcgtagatcaccctcctctcccagtcatccgcatatggcatctcaaagtggcaagcggtataacctgaccctcaatcaagtgctgagttttgactatgacatgggtttggatgctcccaaaaccatctctagcgactgtggagccttttactgtctccggatgttcaaaagccctgacatgacatgttgcttttacccaaagcagtag

SEQ ID NO: 54450 - DNA, 3048 bp, Artificial Sequence
  Description of Artificial Sequence: Synthetic coding sequence
atgctgacagccctggcaccacccgcacttccagggatccccaggcagctccctactgctcctgcccgtagacaggactcctcggggtctagcggttcgtactataccgcccctggctcaccagagcccccagacgtagggcctgacgcaaagggacccgctaactggccatgggttgcccctggcaggggggctggagcccagccgcgactgagcgtgtcagctcaaaattctagacagcgacatggacctggttccggtttcccgagaggccctggttcgggccctcggccaccccagccacaactgcggaccctacctagtggcgaaatggaggttatcttcggcgttggacctttatttggctgtagtggagcggacgacagggaggcccagcagcaattcacggaaccggcatttatttctccgcttccaccaggaccagcatcaccggcagctgtgccaagacagtctcaggtacccgatgggggatctaggtgggctacttacctggagctgaggcctcgaggccctagcccagccgcacctgcgcaatttgagtgtgtggaggttgctctggaggaaggtgcagctcccgctagacccaggaccgtgcccaagcggcagatcgagctgcgtccaagaccccaaagtccacccagagccgctggggctcccagaccgaggttgttgctcaggacaggcagtttggacgagtcactgggccctcttcaggcggctgcgggattcgtgcaaactgctctggcacggaagctgtcgcccgaagccccagctccctcaagcgcgacttttgggtccacaggcaggtcggaaccagagaccagagagaccgctaggtccacacacgtcgtgttggagaaagcaaagtcacggcctctgcgtgtgagagataattcagccccagctaaggctccaaggccatggccctcacttagggaaagagccattagacgcgataagcctgcccctggaaccgagccacttggtccagtgtcctcgagcatatttctgcaatctgaagagaagatccaggaggcccgaaaaaccagatttcctagggaagcccctgacaggaccgttcaaagggcgcgttccccccctttcgagtgcaggattccgtcagaagtcccctctagggctgtgcggcctcggtctccatcccctccacgtcagacaccaaatggagccgtccgcggacccagatgccctagcccacaaaatctgtccccctgggatcgaaccactaggagggtctcttcaccactcttcccggaggcaagtagcgaatgggagaaccaaaacccagctgtggaagagaccgtctcccgcagatcacccagtccaccaattctgagtcaatggaatcagtgcgtggctggagaacgtagccccagtctcgaggccccttcactttgggaaattccacatagcgcggtggccgacgccgtagagcctcgctcctcaccttcacctcccgctttcttcccttgggaggcgcctgatcgacctattggtacgtgggggccatcccctcaggagacttgggatcccatgggacccggtagttccatcgccttcacgcaggaggctcagaacggactgactcaggaggagttagccccacccacaccctccgcccctgggacacccgaacctactgagatgcaatcccccagtactagggagatatctgatttggcgtttggtggctcccagcagtccccagaagttgctgcccctgaacctcctggctctcatcctgtgggaaccctcgatgccgacaagtgccccgaggttctgggccctggcgaagcagctagtggcagacctaggatggccatacccaggcccagagatgtacgtaagctcgtgaagactacctatgcccctggattccctgctggagcacaaggatcaggcctgcccgctcctccagcagatccgtgcggcgaggaaggtggtgagtcgaaaacccaggaacctcctgctctaggacctcccgcacccgctcactacacatccgttttcattaaagacttcctcccagttgtaccccatccctacgagccaccagagcccagcttcgataccgtggccagagatgcctcacagcctaacggggtgttacgacggcgagctgaaaatagtaccgctaagccatttaaacggacggaaatccggctccccggagccctggccctgggtcggaggccagaagttaccagccgtgtgcgcgcacgcggacctggcggtgagaacagggacgtcgaagctcagaggctcgtccctgatggcgacggccgaacttcacctttagggggagctaggagctctagccagaggtccccagtcggacccgctggggtgcggtctcccaggcccggatcaccccagatgcaggctagccctagtcccggtatcgcgcctaagccaaaaacgcccccaacagcccctgagcctgccgcagctgtgcaggctccactccctagagaaccacttgccctggccggaaggactgcacccgcacagccacgcgctgcatccgccccacctactgaccggtcacctcagtctccctcccagggggcacgcaggcaaccgggagctgctccgctaggtaaagtgctcgtggaccctgagagcggcaggtactacttcgtggaagctcctagacagccacgactgcgtgttctgtttgatcctgagtctggacagtatgttgaggtgctgctgccacccagttcgcctggaccccctcaccgagtgtacactcccctggctcttgggcttggcctatatcctccagcctacgggccaattccctcactgtccttgcccccaagtcccggaccgcaagctctggggagcccacagctgccctgggtctctgaagccggtcctctggacgggacttactacttacccgtgtcaggaacaccaaatccggctccccctcttctcctgtgcgcccctccctcctcttctggcccaacccagcccggaaaaggaagcctctttccactttag

SEQ ID NO: 54451 - DNA, 1689 bp, Artificial Sequence
  Description of Artificial Sequence: Synthetic coding sequence
atgaccgtgttagagatcactcttgcggttatactgacgctgctcgggctggccatcctggctatactccttactcgctgggccagacggaagcagtccgaaatgtacattagtcgatatagctctgagcagagcgcacgactgctggactatgaggatgggagagggagccgccacgcttattctacacagtctgacaccagctatgataaccgggagcggtccaagagagattacaccccttctacaaattcactggcgctctcccgatccagtatcgcactaccacaggggtctatgagttcaataaagtgtctccaaacgaccgaggaaccccctagcagaacagccggtgcgatgatgcaattcaccgctccaatccccggagccacaggtcccattaagctctcgcaaaagaccatcgtccagactctagggcctatcgtgcagtatccgggaagcaacgtgcgcagccatccccacaccatcactggacccccaagcgcgcctcgtgggccaccgatggctcctattatcatttcacaaagaacagcaagccagctcgcagccccaattcgcattccccaggtgcacactatggactcctctgggaagatcacgctgacccccgtcgtaatccttacaggttacatggatgaggagctggcaaaaaaatcatgttccaagatccagatcctcaagtgcggcggtaccgccaggtcgcagaatagccgggaagaaaataaagaagcgttaaagaacgatatcatctttacaaattctgtggagagcctgaagtccgcacacattaaagaacctgagcgggaaggaaagggcacagatctcgaaaaggataaaatcggcatggaggtgaaggtggatagcgacgctggtattcctaaacgacaggagacgcagctcaaaatatcagaaatgtcgatcccccaagggcagggcgctcagattaaaaaatctgtttctgacgtgccaaggggccaggaaagccaggtgaagaagtccgaatctggagtccctaaaggccaagaagctcaggtcacaaaaagcggactggtagtgttaaaaggccaagaagctcaagtcgagaaatctgagatgggggtacctagaagacaggaatcacaggttaagaaaagccaaagcggagtgagcaaaggccaggaagcccaagtgaaaaaacgcgaatctgtggttttgaagggccaagaagcgcaagtcgagaaatcagagctcaaagttccgaaaggacaagagggtcaggtggagaagaccgaagcggacgtccctaaggaacaagaggtgcaggaaaagaagtccgaggctggggtgctgaaaggccctgaatctcaggtcaaaaatactgaagtctccgtccccgaaactctggagtcccaggtgaaaaaaagcgagagtggcgttctcaagggccaggaggctcaggaaaagaaggagagtttcgaggacaagggaaataacgacaaagagaaggaacgtgacgccgagaaggaccccaataaaaaggaaaaaggtgacaaaaacacaaaaggtgataaaggcaaagacaaggtgaagggaaagagggaatctgaaattaacggcgagaaaagcaaagggagcaaaagggcgaaggcgaacactggtcgcaagtacaataagaaggtggaggaatag

SEQ ID NO: 54452 - DNA, 1692 bp, Artificial Sequence
  Description of Artificial Sequence: Synthetic coding sequence
atgactgtgctcgaaatcacacttgctgtgatactgaccctccttggccttgctatccttgctattctcctgaccagatgggcaagaagaaaacagtctgagatgtacatctcccgatattcgtccgaacagtctgctaggctgttggactatgaggacggaagagggagtcgacatgcctactctactcaatcagacacctcttacgacaatcgcgaacgatctaaacgggattatacaccttctaccaattctttagtttctatggcaagcaaattttcccttggccaaacagagcttattctcctgctcatgtgcttcatcctcgctctatccagatctagcatagggtccattaagtgtctgcagactacagaagagccgccatcccgcactgccggagcaatgatgcagttcaccgctcctatccccggtgccacaggccctataaaattatctcagaagaccattgtgcagactctcggacccattgtacagtaccccggaagtaacgccggtccaccttctgctccaaggggccctcctatggcacccatcatcatctcacagagaactgcacgaattcctcaagtgcataccatggacagtagcggcaagatcacactcaccccagtggtgatcttaactggctacatggatgaagaactggcaaaaaaatcctgctctaaaatacagattctgaaatgtggtggtacagccagaagtcagaatagccgggaagagaataaagaagctctgaaaaacgacattattttcacgaactcagtggaaagcttgaaaagcgcacacataaaggaacccgaaagagaaggcaagggcaccgacctggaaaaggataaaatcggaatggaggtgaaagtcgattctgacgcgggaatccccaagcggcaggagacccagctaaagatcagcgagatgagcatcccccagggacagggagcccagattaagaaatcagtgtctgacgtgcccagagggcaggaaagtcaggttaagaaaagcgagtctggtgtgcccaaaggacaggaggcacaggtaactaagtcaggattggtggtgctgaaggggcaggaggcccaggtggagaagagcgaaatgggggttcctcggaggcaggaaagccaggtgaagaagagtcagtcaggggtgtcaaaggggcaagaggctcaggtaaaaaaaagagaatctgttgtgctgaaaggacaagaggcccaggtcgaaaaatccgagctcaaagtgcccaaaggccaagaaggccaagtggaaaagactgaagccgacgttcctaaagaacaggaagtgcaggagaaaaagtcagaagccggagtgctcaagggtcctgaatcccaggtaaaaaacacagaagtcagcgtgccagaaaccttggagtctcaagttaaaaaaagtgagagtggagtgctgaagggacaggaagctcaggagaaaaaggagtccttcgaggacaaggggaataacgataaggagaaagaacgggatgcagagaaggaccccaataaaaaggagaagggcgataaaaatactaagggggataagggcaaggataaagttaaggggaagcgggagtcagaaatcaatggagaaaaaagtaagggttcaaaacgtgccaaagctaatacaggaaggaaatataacaagaaagtagaagaatag

SEQ ID NO: 54453 - DNA, 582 bp, Artificial Sequence
  Description of Artificial Sequence: Synthetic coding sequence
atgactgtgctggagatcaccctggcggtgattctgactctgctgggactcgccatactcgcaattttgctgacgcgatgggctcgcaggaagcagagcgagatgcacatcagccgttacagttccgaacaatccgccagactgctcgattacgaggacggcagagggagtcgacacgcttattccacccagtccgatacatcatgtgataaccgtgaacgcagtaagagagactatacgccctcgaccaacagccttgtatccatggccagcaagtttagtctcgggcagaccgaattgatccttcttcttatgtgcttcatattagctctgtccaggtcgagtattggcagtatcaagtgtctccagactacggaggagctgccatcccgcaccgcgggtgctatgatgcagtttaccgcacctataccaggcgctaccgggccaatcaagctaagccaaaaaactattgtgcagacacctgggcctatcgttcagtatcccggtcccaacgctggaccaccctccgccccacggggtccgcctatggcacccatcatcatatctcagcggactgcttag

SEQ ID NO: 54454 - DNA, 579 bp, Artificial Sequence
  Description of Artificial Sequence: Synthetic coding sequence
atgacagttctagaaattacattggccgtgattttgacgcttctcggacttgcgatcctcgccatcctgttgacaaggtgggccagacgaaagcagtcagagatgcacatctccagatattctagcgaacaaagtgcccgactgcttgattatgaggatggtcggggttctcggcatgcctatagtacccagtctgatacttcatgtgataatcgcgagagaagcaagagagattacacgcccagcaccaacagcctcgccctaagtagatcgtcaattgccctgccacagggttccatgtcaagcatcaaatgccttcagacgaccgaggagctccccagcaggacagcaggcgctatgatgcagttcaccgcccctatcccaggtgccaccggacccattaagttgtcccagaaaacgatagtgcagactcctggccctattgtccagtatccaggccctaacgttaggagtcatccacataccattactggtccgccttccgcacccaggggacctcccatggccccaattattatctcccaacgaactgcgtcccaacttgcagcgccaatatag

SEQ ID NO: 54455 - DNA, 579 bp, Artificial Sequence
  Description of Artificial Sequence: Synthetic coding sequence
atgacggtgctggagatcaccttagccgttattctgaccttgttgggactggcaattctggccattctgctgactcgctgggctcggagaaagcagtctgagatgcacatctctcggtattcttccgagcagagtgcccgtctgttggactacgaggatgggcgtggtagtaggcatgcgtactctacccaatctgatacctcttgcgataatcgagaacgctcaaagcgcgactacacccccagtaccaactctttagcgctgtctcggtcttcgattgcattgccccagggcagcatgtcctccataaagtgcttgcagacaactgaagagctgcccagcagaacagcaggagccatgatgcagtttacggccccaattcctggtgccactggcccaatcaaactgagccaaaagacaatagtccagacaccaggccctatcgtgcagtaccccggtcccaacgttagatcccatccacacactatcactggcccaccctccgcccctagaggacctccaatggcacctatcataatatctcagaggacagcctcgcagctcgctgctcctatttag

SEQ ID NO: 54456 - DNA, 1689 bp, Artificial Sequence
  Description of Artificial Sequence: Synthetic coding sequence
atgaccgtgttggaaatcacactcgccgtgattctgacgctgctcggccttgctatcctcgctatcctgctgacacgttgggcccgacgcaaacagagcgagatgtatatttcccgctattccagcgagcagtcagcgcgattactcgattacgaggatggcagggggtctagacacgcctatagtacacaatccgacaccagttatgacaatcgggagagaagcaagagagattataccccctcaaccaactcacttgcgctgagcagaagtagtatcgcattgccgcagggttctatgtccagtatcaaatgcctgcagactacggaggagccaccctcaaggacagctggcgctatgatgcaattcaccgcccctatccccggagctaccggtcccattaagctgagccagaagactatcgtgcaaactttggggcctatcgtgcagtatcctgggtctaacgtccggtcacatccacatacaattaccggacccccatctgccccaagaggccctcctatggcccctatcataatttcacagcgaaccgcatcccagttggccgctccaatccggattccccaggtgcacaccatggattcatccggcaaaatcacgcttacacccgtcgtaattctaaccgggtacatggatgaagaactagcgaaaaagagctgcagtaagatccagatcctgaagtgcggcggtaccgcacgcagccagaacagccgggaagagaacaaggaggccctgaagaacgatattatctttactaacagtgtggaatccctcaagtccgctcacattaaggagccagagcgcgagggaaagggtactgacctcgaaaaagataagattggaatggaggtcaaagtggactccgatgctggaattcccaagcgccaggagacgcagctgaagatctccgaaatgagcgtaccccaaggtcagggcgcacagataaagaaatcggtgtcagatgtcccgaggggacaagaatcacaagtcaagaagtcggaatccggcgtgcctaaaggtcaggaagcacaggtgactaaatccgggctggtcgtcctcaaggggcaagaagcccaagttgagaagtccgaaatgggagtgccaaggagacaggaatcccaggttaaaaaaagccagtctggggtttctaagggtcaagaagcccaagtgaaaaaacgtgaaagcgttgtgttgaagggccaggaggcccaagttgagaaaagcgagctgaaagtgccaaaaggacaggaagggcaagtagagaaaactgaagccgacgttcccaaagagcaagaggtgcaagagaaaaaatccgaagctggggttctgaagggacctgaaagccaggtcaagaatacagaagtgagtgtcccagagacactcgaaagccaggtgaaaaagtctgagtccggcgtgctgaaaggtcaggaggcccaggaaaagaaagaatcattcgaggataagggaaataacgataaagaaaaggaaagggatgccgagaaggaccccaacaaaaaggagaaaggcgacaaaaatacaaaaggcgacaagggcaaagataaagtcaagggcaaacgggaatcagaaataaacggtgagaaatccaaaggctctaaacgggcaaaagcgaacactggcagaaagtataacaaaaaggtggaggagtag

SEQ ID NO: 54457 - DNA, 582 bp, Artificial Sequence
  Description of Artificial Sequence: Synthetic coding sequence
atgacggtgctcgaaatcaccctagctgtaattcttacattactggggctagctattctagccatcctgttaactcgctgggccagacgcaagcagagcgagatgcatataagtcgatattcgagtgagcagtccgcacgtctgcttgactacgaagacggaagagggagtcgacacgcctattcaactcagtctgacacaagttgtgacaaccgcgagcgaagtaaaagggattatacccccagcacaaattctctcgtctctatggctagcaaattttcactgggacagaccgaactgatcttactgcttatgtgctttatcctggcactgagccgtagctccatcggcagcataaagtgcctgcagaccacggaagaactgcccagccggacagctggcgctatgatgcagttcaccgcgccaatcccaggcgctactggtcccatcaaacttagccagaaaactatagttcagactccaggcccaatagttcagtacccagggccaaatgcaggacccccatcagcgccaagaggccctcccatggcacccatcattatatctcagaggaccgcgtag

SEQ ID NO: 54458 - DNA, 1689 bp, Artificial Sequence
  Description of Artificial Sequence: Synthetic coding sequence
atgacagtcctggagatcaccctagcggtcatcctaacactcctgggcctcgctatactcgccatcctcctaacccggtgggccagacgtaagcaatcagaaatgtacatctcccgctactccagcgagcagtctgctcgcttattggactacgaggacggcaggggcagccggcacgcttactccacgcagtctgacacttcttacgacaaccgcgagcggagtaagcgggactacaccccttctaccaactcactcgctctcagccgaagcagcattgctctccctcaggggtctatgtcaagcataaagtgtctccagaccaccgaggagcctccttccagaaccgccggtgctatgatgcaatttacagcgccaataccgggagccactggccctttcaagttgagccaaaaaacgatcgtgcagactctcggccctattgtgcagtatcctgggtccaatgtgaggagccatccccatacaatcacaggtccaccctcagccccaagaggtcccccaatggccccaataattatcagccagcggactgcttctcagctcgcagcccctatccggattccgcaggtacataccatggactcctccgggaaaatcacactgactcccgtggtgattctcaccgggtatatggatgaggagttagcaaaaaagtcatgttctaagattcagatcctgaaatgtggaggcaccgcaagatcccagaattcacgcgaggaaaacaaggaggccctgaaaaatgacattatctttaccaatagtgtggagagcttgaagagtgcccacatcaaggagccagaaagagaaggcaaagggacggacctggagaaggataagatcggcatggaagtgaaagtggattccgatgcgggtatacccaagaggcaggagacgcagcttaagatcagtgagatgtctgtgcctcagggccaaggtgcgcagattaagaagtcggtatctgacgtaccaagggggcaggaatctcaggtaaagaaaagtgaatctggagtgcccaaaggccaggaagcccaggtgactaagtctggcctggtcgtgttgaaaggtcaagaggcccaggtcgagaagagcgagatgggcgtgccacggcgtcaagagtcgcaggtgaagaagagccagtctggtgttagcaagggccaggaggctcaggtgaaacagagggagtcagtggtgctaaaggggcaggaggctcaagtagaaaaatccgagctcaaagtcccgaaggggcaggaggggcaggttgaaaagacagaggctgacgttccgaaggagcaggaagttcaagagaaaaaatccgaggccggagtgctcaagggccctgaaagtcaagtgaaaaacaccgaggtatctgtgcccgaaaccttagagtcccaggtgaaaaagtccgagagtggggtgcttaaggggcaggaagcacaagagaaaaaggaatctttcgaggataagggaaacaacgacaaggagaaggaacgcgacgccgagaaagacccgaacaaaaaggaaaaaggtgataaaaacacgaaaggagacaaaggcaaagacaaggttaaaggcaagagagagagcgagatcaacggggagaaatcaaagggttctaaacgagctaaggccaataccgggagaaagtacaacaagaaagttgaagagtag

SEQ ID NO: 54459 - DNA, 1692 bp, Artificial Sequence
  Description of Artificial Sequence: Synthetic coding sequence
atgaccgttctggagatcacactggccgtgattctcacactgctgggcttggccattctggcaatacttttgactcgctgggctagaagaaagcaaagtgaaatgtacatatccagatactcttccgagcagtccgccagactgttggactacgaagatggcagaggcagcagacacgcctactcaacccaatcagatacatcgtatgacaaccgagagcgcagtaagagagactacacgccatccactaactctcttgtgtcaatggccagcaaattcagcctggggcagactgagctgattctgttgcttatgtgcttcatcctggctctgagccgttcctcaatcgggtccattaagtgtttgcagacgaccgaggagcccccatcgagaacggccggagcgatgatgcagtttactgccccaattccaggagccaccggaccgattaagctctcccaaaaaaccattgtccagaccctcggaccaattgtgcaataccctggttccaacgcaggtccacccagcgctcccagggggccacccatggcaccaatcatcatatcccagcgaacggccagaatccctcaagtgcacaccatggacagcagcgggaagattactctgacccctgtggttattttaactggatacatggatgaggagctcgctaagaagagctgtagtaaaatccaaattctcaaatgcggcggtacagccagatcccaaaactctagggaggagaacaaagaagcccttaagaacgacataatcttcaccaatagcgtggaaagtctaaaaagcgctcatataaaagagcccgagcgtgaaggtaaagggacagatctggagaaggataaaatcgggatggaggtcaaggtggactcagatgccggaatccccaaacgccaggagacacagcttaagatctccgagatgagcgttcctcagggacagggagcccagattaagaaatctgtgtctgatgtgccgagaggtcaagaaagccaagtgaagaagtccgagagcggggtgccaaagggacaggaagctcaagtaacaaagagcggcctggtggtgttaaagggacaagaggcccaggtcgagaagtctgagatgggcgtgccacggcgtcaggagtcacaggtcaagaagtctcagtctggggtttccaaaggacaggaggcccaggtgaaaaagagagaaagtgtggtcctgaaagggcaggaagctcaggttgagaaatctgagcttaaggttcccaaagggcaggagggccaggtcgagaaaacggaggccgatgtgcccaaggagcaggaagtacaggagaaaaagtcggaagccggtgttctgaagggccctgagtcccaggtgaagaatactgaagtttcagttcccgaaaccttggaatcccaggtgaagaagtctgaaagtggtgtcctcaagggacaagaagcccaagagaaaaaggagtcattcgaagacaaagggaacaacgacaaagaaaaggagcgagatgccgagaaggaccccaacaaaaaggagaagggggacaagaacaccaaaggtgacaagggaaaggataaagtgaagggcaagcgggaatccgagattaacggtgagaagtctaagggatcgaaacgggctaaggccaacactggacgaaaatacaataaaaaagtggaagagtag

SEQ ID NO: 54460 - DNA, 1692 bp, Artificial Sequence
  Description of Artificial Sequence: Synthetic coding sequence
atgaccgtgttggaaatcacactagccgtgatcctcacattactaggcctggccatcttggcgattctccttactaggtgggcacggcgtaagcagagtgaaatgtacatcagtcggtactcgagcgaacaaagtgctagactcctcgattatgaagacgggagaggctctcgccatgcatacagtacccagtcagacacatcctatgataatcgtgagcgatctaagcgggactataccccgtcaacaaactcattggttagcatggccagcaagttttccttgggccagacagagcttattctgctgctgatgtgcttcatcctggccttatctaggtccagtatcggttcaataaagtgcctgcagaccacagaagagcccccttccaggactgctggcgcaatgatgcagtttaccgccccaatcccaggggcaacaggaccattcaagctgtcgcaaaagacgattgtccagacacttggccctatcgtccagtaccctgggtctaatgccggacctcccagtgcgcctagggggccacccatggcccctattattataagtcaaaggacagctcgcatccctcaggtgcacacaatggactcctctggcaagattacactgacacctgttgttatcctgacagggtacatggacgaggaattggccaagaagagctgctccaaaattcaaatactgaaatgcgggggaaccgccaggtcacaaaattcccgcgaagaaaacaaagaagcccttaaaaatgacatcatctttacaaacagcgttgagagcctgaaatccgctcacattaaggagcctgagagagagggcaagggtacagacctagagaaggataagattggcatggaagtaaaggtggattccgacgcaggcatccccaagaggcaagaaacacagctcaagatctccgagatgtcagtgccgcagggacaaggcgctcagattaagaaatcggtgagtgatgtgcctagaggccaggaatcacaggttaaaaaaagcgaatcaggggtgccgaaaggtcaggaggctcaagtgaccaaatccgggcttgtcgttctgaagggtcaagaagctcaggtcgagaaatcagagatgggagtgccccgtcgccaggagagtcaggtcaagaagtctcaatcaggcgtttctaagggtcaggaggcccaggttaagcagcgggagtctgtagtgttaaagggacaggaagcccaggtcgaaaagagtgagctgaaggttccaaaaggccaagagggtcaggttgagaagaccgaggcagatgtcccaaaggagcaagaagttcaagagaaaaagagcgaagcaggtgtcctcaaggggccagagagccaagtcaagaatacagaagtgtcagtgcctgaaactctggagtctcaggtgaagaaatctgagagtggcgtactgaagggacaggaggcccaggaaaaaaaagagtcctttgaggacaaaggaaataacgataaggagaaagaacgagacgcggaaaaagatccaaacaaaaaggaaaaaggagacaagaacactaagggggacaaagggaaagacaaggttaagggcaaacgcgaaagcgaaattaatggggaaaaatctaagggaagtaagcgggctaaggctaataccggtagaaaatacaataagaaggtggaggagtag

SEQ ID NO: 54461 - DNA, 1689 bp, Artificial Sequence
  Description of Artificial Sequence: Synthetic coding sequence
atgactgtgctggaaatcacattagctgttatccttacattacttggcctggccatcttggcgatccttcttaccagatgggcgagaaggaagcaaagtgagatgcacataagcaggtattcctcagagcaatctgcaaggctgctggattacgaggacgggaggggaagtcggcacgcttactccactcagagcgatacctcgtgtgacaatagggaacggtcgaagcgagattatactccatctaccaatagccttgcactgtctaggtccagcattgcactgccacagggctctatgagcagcattaaatgcttacagactaccgaagaactcccgagtcgtactgccggtgccatgatgcagtttaccgccccaattcccggtgctacaggcccaattaaactttctcagaagacgatcgtgcagactccaggcccaatcgtccagtacccaggcccaaatgtaagatcccacccccacacaatcacaggccctccctctgccccaaggggtccccctatggcgcctatcatcatatctcagagaactgcatcgcagctggcggcacctattaggattcctcaagtccacaccatggattccagtggtaagatcaccctgaccccagttgtgattctcactggctacatggacgaggagcttgccaaaaagccatgctccaaaatccaaattctaaaatgtggtggaaccgcccgaagtcagaactcgcgcgaagagaataaggaggcattgaagaacgacattatctttaccaattcagtagaatcactgaaatccgctcacatcaaagagccagagcgcgagggcaaaggcaccgacctggaaaaggataagataggaatggaagtgaaagtcgattcagatgcaggaattcccaaaaggcaggagactcagctgaagatatcggaaatgtctattcctcagggccagggtgcccagatcaagaagagcgtctctgacgttccacgtggccaggaaagccaagtgaagaagagcgagagcggcgtccctaagggacaggaggcccaggttactaaaagtgggctggtggtgcttaagggccaagaagcccaggttgaaaagtcagagatgggcgtcccaagacgccaggagtctcaagtgaagaaaagccagtctggagtcagtaaggggcaggaggctcaggtaaaaaaaagagagagcgttgtgttgaaggggcaggaggcacaagtggagaagtccgaattaaaagttccaaaaggccaggaagggcaggtggaaaaaactgaggcggatgtgcctaaggagcaagaagttcaagagaaaaagtctgaggcaggtgttctgaaagggcctgaaagtcaagtcaagaacaccgaggtgtctgtgcccgagacactggaaagtcaggtcaaaaaaagtgagagcggcgtcctaaaaggacaggaggctcaggaaaaaaaggagtcctttgaagacaaaggcaacaacgataaggagaaggagcgtgacgccgagaaagacccaaacaagaaagaaaagggcgacaagaacacaaagggagacaagggaaaggataaggtcaaaggaaaaagagaaagcgaaattaacggagagaagtctaagggaagtaaaagggccaaagctaatacgggccgaaaatataataagaaggtggaggagtag

SEQ ID NO: 54462 - DNA, 1692 bp, Artificial Sequence
  Description of Artificial Sequence: Synthetic coding sequence
atgactgtgctggaaattaccctcgcagtgatcctaacgctgctgggtttggccatactggcaatactgctaactcggtgggcacgcagaaagcagagtgagatgcacatatcacgatactcttctgagcagtctgctcgcctactcgactacgaagacggcaggggatcaaggcacgcatactcgacccaaagtgatacttcctgtgacaatcgcgaaaggtcgaagcgcgactacacgcccagcacgaactctcttgtttcaatggccagtaagttctcgttgggccagaccgaacttattctgctgttgatgtgctttatcttggccttgtcccgatcatccatcggtagcattaaatgtctacaaactaccgaggagttgccctctagaaccgccggtgcaatgatgcagttcactgcccctattcccggtgcgaccggacctattaagctgagtcagaagaccatagtgcagacccctggccctattgtacaataccccggacccaatgcagggccaccttccgcaccacgaggacccccaatggctcctattattatctcccagcggacggccagaatcccacaagttcacacgatggactccagcggtaaaattactctgaccccagttgtgatactgacaggttacatggatgaagaattggccaagaagccttgttccaaaatccagattttaaagtgcggtggaacagcacgtagtcagaactcccgcgaagagaacaaagaggcgctaaagaacgacatcattttcacaaacagtgtggagtctcttaagagcgcccatatcaaagaacctgaaagggaaggcaagggtaccgatcttgaaaaggataagataggaatggaggtgaaagtggattccgatgccggaattccaaaacggcaggaaactcagctaaaaatttccgagatgagtatccctcaggggcagggcgctcagatcaagaagagcgtgagcgacgttccccgaggtcaggaatctcaagtgaagaagtccgaatctggagtgcccaaagggcaagaggctcaggtgacaaagtcagggctggtcgtgctgaagggacaggaggcgcaggtggagaagtccgaaatgggggtgccaagacgccaggaatctcaagtaaaaaagagccagagcggagtctcaaaggggcaggaagcccaagtgaaaaagcgtgagagtgttgtgttgaaggggcaagaagcccaagtggaaaagtccgagctgaaagttcctaaagggcaggagggccaggtggaaaagacagaggccgatgtcccgaaggaacaagaggtacaggagaagaagtcggaggcgggtgtgctaaaaggtcccgagtctcaggtgaagaatactgaggtctccgttcctgaaaccctggaatctcaagtgaagaaatccgaatctggagtcctcaaaggacaggaggcgcaggagaaaaaggagtctttcgaggataagggcaacaacgataaagagaaagagcgagatgcagagaaggaccccaacaaaaaggaaaaaggcgataagaacacgaaaggggataaaggtaaagacaaggtaaagggaaaacgcgagagcgagatcaatggagagaaatctaagggaagcaaacgggctaaggctaatactgggaggaagtacaataagaaggttgaggagtag

SEQ ID NO: 54463 - DNA, 1644 bp, Artificial Sequence
  Description of Artificial Sequence: Synthetic coding sequence
atgaccgttctcgagatcacactggccgtcatactgaccctcctcggtttggcgatcctggccattctcctcacacgctgggccaggcgcaaacagtctgaaatgcacatcagccggtacagcagtgagcagagcgcgaggctgttggattatgaggatggcagagggagtcgtcacgcatactctactcaaagcgaacgaagtaagagagactataccccgagtactaattctctcgcattgtcaaggagctctatagcccttccacagggatcaatgtctagtataaagtgtctgcagacgaccgaggaactcccttctcgcacagctggagctatgatgcagttcaccgcgccaatcccaggtgcaacagggccaattaaactgagtcaaaaaaccatcgtgcagactccaggaccaatcgtgcagtacccaggacctaacgctggcccaccaagcgcgccacgcggtcctcccatggcaccgattatcatcagccagcgaacagcaagccagttggcagcgcctattaggatcccgcaggtgcacactatggactctagcggcaagatcacactgacccccgtggtcatcttaacggggtatatggacgaggagctggccaagaaaccatgctctaaaatccaaattctcaaatgcggaggcactgccaggtcccagaactctcgggaagagaacaaagaggctttgaagaatgatatcatttttacaaattcagttgagagtctaaaaagtgctcatattaaagaaccagaaagggagggtaaaggcaccgatctggagaaggataagattgggatggaggttaaggtcgactctgacgctgggatcccaaagcgtcaagaaactcagctgaaaatttccgagatgtccatcccacagggtcagggcgcacagatcaagaagagtgttagtgacgtcccccgaggacaagaatcgcaggtgaaaaagtctgaaagcggggtgccgaaggggcaagaggctcaggtgaccaaatctggactcgtagtcctgaagggacaggaggcccaagtcgagaagtcagaaatgggtgtcccgcgtaggcaggaaagtcaagtcaaaaaatcgcagtccggcgtgagtaaaggccaggaagctcaggtcaaaaaacgtgagtccgtggttctcaaaggccaggaggcccaggttgaaaaatctgagctgaaggttcccaagggtcaggaagggcaggtggagaaaaccgaggcggatgtgcccaaagagcaagaagtgcaggagaagaaaagcgaggctggagtgttgaagggtcctgaaagtcaagttaagaacaccgaagtgagcgttccagaaaccttggaaagccaggttaaaaaatctgagagcggcgtgcttaaggggcaggaggcccaagagaaaaaggagtctttcgaagataaaggcaataatgacaaagagaaagaaagggatgctgaaaaagacccaaataagaaagagaaaggggataagaataccaagggagataaaggcaaagacaaagtgaaggggaaacgggagagtgagattaatggtgaaaagtctaaaggcagtaaaagggctaaggcaaacaccggcagaaagtacaataagaaagttgaagagtag

SEQ ID NO: 54464 - DNA, 189 bp, Artificial Sequence
  Description of Artificial Sequence: Synthetic coding sequence
atgctgcaggtggtgcaggaaggcaatcctgctccatttataatcaataccgttaagcgcggtcggagggacagggagagacagcgcactccttgggcccctcaccccttagggttccaaggtagaaggtatatctacgagtctcccaatcatcgtgggaaggactcttctttcttagcccagaaatag

SEQ ID NO: 54465 - DNA, 189 bp, Artificial Sequence
  Description of Artificial Sequence: Synthetic coding sequence
atgttgcaggtcgtacaggaaggaaatccagcaccattcatcattaataccgtgaagcggggtcggagagatagggagcgccagagaacaccatgggcccctcaccctctgggatttcaggggcgaagatatatttacgaatccccaaatcacagagggaaggatagctctttcctggctcagaagtag

SEQ ID NO: 54466 - DNA, 189 bp, Artificial Sequence
  Description of Artificial Sequence: Synthetic coding sequence
atgctgcaggtagtccaggaaggcaaccccgcaccctttatcatcaatactgttaagcggggacgtagggatcgtgagcggcaacgtacaccatgggcccctcatcctcttggcttccagggacgccgttacatctatgaatcaccaaaccaccggggaaaggactccagttttctggcccagaagtag

SEQ ID NO: 54467 - DNA, 189 bp, Artificial Sequence
  Description of Artificial Sequence: Synthetic coding sequence
atgctgcaggtcgtccaggagggaaacccagctccatttataatcaacactgtgaagaggggccgacgcgaccgggagcggcagaggaccccttgggctccccaccctttggggttccaggaacggagatacatttatgagtctcctaaccacaggggtaaagactcctcctttctggctcagaagtag

SEQ ID NO: 54468 - DNA, 189 bp, Artificial Sequence
  Description of Artificial Sequence: Synthetic coding sequence
atgctccaggtcgtccaggaaggtaatccagcgccattcatcattaacaccgtgaaaagaggcagaagggaccgtgagcgtcagaggacaccatgggcccctcatccattaggctttcaggaacggaggtacatttacgagtcccccaatcacagggggaaggacagctccttccttgcccagaagtag

SEQ ID NO: 54469 - DNA, 189 bp, Artificial Sequence
  Description of Artificial Sequence: Synthetic coding sequence
atgctgcaggtggttcaggaaggcaacccggcaccatttatcatcaacaccgttaagcgcggtcggcgagatcgggagaggcaaagaactccctgggctcctcacccacttggatttcaggagagaagatacatttacgaatcccccaaccaccgcggaaaagatagtagcttcctggcacagaagtag

SEQ ID NO: 54470 - DNA, 708 bp, Artificial Sequence
  Description of Artificial Sequence: Synthetic coding sequence
atgcacgaacatgcaacccccgtgaccagcgcttatggcgaaaggcacgaagaactcataaaccttgggagccccgacagtcacactattagcgagggccagaaatcaagcgtgacctccaagaccactcgaaaaggcaaggaaaaatcttccgagaaggagaaaaccgccaaagaaaagcaggccccacggtttgaaccacaaatctccacggttcaccctcagcaggaggaccctaacaaaccttactggatcctacggctcgtaaccgaacacaatgaatccgaactgtttgaggtgaagaaggatactgagcgggctgacgaaattagggccatgaagcaggcatgggaaaccactgagcccggaagagcaattaaagcaagccaagccaggctacactacctctccggatttatcaagaagacatccgatgccgagtctcccccaatttcagagtctcagacgaagcccaaagaagaagtcgagacagccgctcggggagtgaaagagcccaacagtaagaattcagcagggagtgaatccaaagagatgacccagaccgggagtgggagtgccgtatggaagaagtggcagctcactaaagggctgagggacgtagcaaagtcaacttcatcggagtctggtggtgtgtcttcacccggaaaggaagaacgggaacagtccactcgaaaggagaatatctag

SEQ ID NO: 54471 - DNA, 2142 bp, Artificial Sequence
  Description of Artificial Sequence: Synthetic coding sequence
accgacgaacagaccgactttggcctgggcgatgcccaccaatccgatggcctgaacctggaacgggagatcgtttcgcagaccaccgccacccaggaaaagagccaggaggagttgcctactactaacaattcagtgagtaaggagatctggctcgatttcgaggacttttgcgtttgttttcaaaacatctacattttccataagccatcttcctactgcctcaattttcagaagagcgagttcaagttctccgaggaacgcgtgagctattatctcttcgtggacagtctgaaacccatcgagctcctcgtttgcttttcagcactcgtgaggtggggggagtacggtgcactaactaaggattcccctccgattgagcctggcttgcttacagctgaaacatttagctggaagagcctgaagcccggttctctcgtcctgaagatccacacctatgcgactaaggcgactgtagtgcggctgccggtaggccgacacatgctgctgtttaatgcttactctcccgtcggacactcgatccacatctgcagcatggtatcctttgtgattggagacgagcatgtggtattaccaaacttcgagcctgaatcgtgtcggtttacggagcagagtttgctgatcatgaaggcaattggcaatgtgatcgctaactttaaagataaaggcaagctctccgccgcactcaaggatctgcagacagctcactaccccgttccatttcatgacaaagagctcacagcacagcatttcagggtgtttcacctgtccctgtggcgactaatgaaaaaggtgcagatcacaaaaccccctcctaactttaaattcgcttttcgcgcaatggtgcttgacctcgagctccttaatagcagtttagaggaagtttctctcgttgaatggctagatgtgaagtactgcatgccaacctccgacaaggagtattctgcggaagaagttgctgcggcaatcaaaattcaagctatgtggagaggaacttacgttaggcttctcatgaaagctcggattcccgatactaaggaaaacatctctgttgcagacactctacagaaggtgtgggccgtgctggagatgaatcttgaacagtacgctgtaagtctgctgcgcctgatgttcaagtcgaaatgtaaaagcctcgagtcttatccctgctaccaggacgaggagacaaagattgcttttgctgattataccgtaacctaccaggaacagcctccaaacagttggttcatagtttttcgggagaccttcctggtccaccaggatatgatactcgtgcccaaagtatatactacgctcccaatctgtattttgcacatagtgaataatgacaccatggagcaagtgccgaaggttttccagaaggtggtgccatacctgtacactaagaataagaagggatacaccttcgtcgcggaagctttcactggcgacacttacgtagccgcaagcagatggaagttacgactgatcggatcatctgccccactaccttgtttgtccagagatagcccctgcaattctttcgcaattaaggagatcagagattactacatcccaaacgacaaaaaaatcttgttccggtactccgtcaaggtcttgaccccacaaccggctaccatccaagtcagaacctccaaacccgatgcatttatcaagctccaggtcctggaaaatgaagagaccatggtctccagtaccggcaaaggacaggctattatccccgctttccactttttgaagtccgagaaaggactgtcatcacagtcctacggagagcgccatgaggagcttatcaatctggggagccctgatagtcacaccatcagcgagggccagaagagcagcgtgactagtaagacgactaggaaaggcaaggaaaagagtagtgagaaagaaaagacagcaaaggaaaaacaggctccccgattcgaacctcagattagcacagtgcacccacagcaagaggacccaaataagccgtattggattctgcggctcctgcggcttgtgtgtattacacttgcaggaagtctgcggaaacatctcatgttgcgagtgcggctgtacctgaaggctaagctgaatcagaagaagaaatag

SEQ ID NO: 54472 - DNA, 5004 bp, Artificial Sequence
  Description of Artificial Sequence: Synthetic coding sequence
atggccagtaagcagaccaaaaaaaaagaggtccaccgcatcaacagcgcccacgggagtgataaatccaaggatttctacccattcggctcaaatgtgcagagtggttcaactgagcagaaaaaggggaaattccctttgtggcctgaatggtctgaggcagatattaactctgagaaatgggatgcaggtaagggggcaaaggagaaggataaaacagggaaatcgcccgtttttcactttttcgaggaccccgaggggaagatagaactccccccaagcctgaaaatctacagttggaagaggcctcaagacatccttttctcccagacaccagtggtcgtgaagaatgaaattacttttgacttgttctcagccaatgagcacctcttgtgtagtgaactgatgcgttggatcatcagcgagatttatgctgtgtggaaaatcttcaacggcggaatactttctaactatttcaaaggcactagcggcgaaccgccactgctgccgtggaaaccctgggagcatatctactccttgtgtaaagccgtgaaaggtcacatgccactatttaattcctacggaaaatatgtggtgaagctctactggatgggttgttggagaaagattacaattgacgactttctcccattcgacgaagataataacttgctgcttcctgcaactacatatgagtttgaactatggccaatgttactcagtaaagccattattaaattggccaacatagatatccacgttgctgatagaagagaactcggagagtttaccgttatacacgctcttaccggttggctgccagaggtgatttcccttcaccctggctacatggacaaagtgtgggaattactgaaagaaattctccctgaatttaaattgtcagatgaggcctcgtctgagtccaaaattgcagttttagatagcaaactgaaggagccgggaaaggagggtaaggaaggtaaggaaatcaaagatggaaaagaggtaaaagacgttaaggaatttaagccagagtcatccctgaccactcttaaggctcctgagaaatcagataaggtcccaaaggagaaagctgacgccagggacattggtaagaaaagaagcaaagatggtgagaaggagaagtttaagttcagcctacacggaagtaggccttcctctgaagttcagtacagtgtccagtctctgtcggactgctcgagtgcgatccaaacctcccatatggtggtgtacgctaccttcactcctctctatttgttcgagaataagatcttcagcctggaaaagatggcagattccgccgagaaacttagagaatacggactatcacacatatgctcccaccctgtgttggtgacccgaagtcggagctgtcctctcgtggcaccacctaagcccccaccgttacctccttggaagctcatccgccagaagaaggagactgtgataaccgatgaagctcaagagttgatcgtcaagaagcccgaacggttcctggagatatcttcacctttcctgaactaccggatgactccctttaccatccctacagagatgcatttcgtaagatcactgattaagaagggcattccacccggaagtgatctgccttctgtctccgagacggatgagacggcaacacattctcagaccgacttgtcccagattacgaaagcaactagccagggcaacaccgcatcccaggtgatattgggcaagggtacagacgagcagaccgatttcgggctcggggatgcccaccagagcgacggtctcaatcttgagcgcgagatagtcagccagaccaccgccacacaggagaagagccaggaggaactccccacaaccaacaattccgtttctaaggaaatctggctggacttcgaagacttctgcgtgtgtttccagaatatctacatattccacaaacctagttcctactgtcttaatttccagaagtctgagtttaagttctcagaggaacgggtgtcgtactacttattcgtagactctctgaagcccatcgaactgctggtttgcttctcagctcttgtaagatggggcgaatacggagcgcttacgaaggacagcccacctatcgaaccagggttgctgactgccgagaccttcagttggaaaagcctgaagcccggttccctggttctgaagatccacacgtatgctacaaaagcgacagtggtgcgcctcccagtcggacgacacatgttgctatttaatgcctactctcccgtggggcattcgattcatatctgctccatggttagctttgtcatcggggacgaacatgtagtcctgcctaacttcgagcccgaatcctgtcggttcaccgagcaatctctccttattatgaaggcaattggtaatgtgatagcaaactttaaagataaaggaaagctctccgccgctctgaaagacctccagacggcccattaccctgtgcccttccatgacaaagagctgacagctcaacactttagagtgtttcacctaagtttgtggcgcttgatgaagaaagtgcagatcactaagccacctcccaatttcaaattcgcctttagggctatggttctggatctggaactgctgaactcgagcttggaagaggtgtccctcgtggagtggctcgacgtgaagtattgtatgcctacctctgacaaagaatattccgctgaagaggtcgccgcagcaattaagatccaggcaatgtggaggggaacttacgtgaggctgctaatgaaagctaggattcccgatactaaagagaacatttcggttgctgacacattgcaaaaggtctgggcggtgctggaaatgaacctagagcagtatgcagtgagcctgctccgcttgatgtttaagtctaaatgcaaatccctggagtcctacccctgttatcaggatgaagaaaccaaaatagctttcgcagattacactgtcacgtatcaggaacaacctcccaactcctggttcattgtgttccgtgaaacctttttagtccatcaggacatgatcctggtccccaaagtgtacaccaccctcccaatttgtattcttcatattgttaacaatgatactatggagcaggttccgaaggtattccagaaggtggtaccctacctgtacactaagaataagaagggatatacgttcgtggccgaagccttcacgggagacacttacgtcgccgcttcccgctggaaattgcggcttatcggaagtagcgcccctctcccctgcctgtctagagacagtccatgcaatagtttcgccatcaaagaaatacgggactattacataccgaacgataaaaaaattctcttcaggtactcagtgaaggtcctgactccacagcccgctacgattcaggttcggacgtcgaagcccgatgcattcataaaactgcaagtcctggagaatgaggaaaccatggtttccagcaccggtaaaggccaggcaatcatccccgctttccatttcctcaaatccgaaaaaggtctttcaagtcagtccagcaagcacattctttccttccacagcgctagtaaaaaagaacaggaagtttacgtaaagaagaaagcagcccagggtattcaaaaaagccccaaaggaagagctgtttcagccatccaggacattggactgcccctggtcgaggaggagactacatctacccctactcgtgaggattcatcatctacgcccctccaaaactataagtacattatacaatgcagcgtgctgtataattcctggcccctgactgagtcccagttaacctttgtgcaggctctgaaagacctgaaaaaatcgaataccaaggcttacggagagcggcacgaagagctaattaacctcgggtcaccagatagccatacaatttctgaaggccaaaagagcagcgtgaccagtaagactacacggaaaggaaaagaaaagtcctccgagaaggagaaaaccgccaaagaaaaacaggccccaagatttgagccacagatatcaacagttcaccctcagcaggaagatccaaacaagccctattggatcctgagactggtgaccgagcacaatgagtccgagttatttgaggtgaaaaaggacactgagcgggctgacgagataagagctatgaagcaagcgtgggaaaccacagaaccaggcagggcaatcaaggctagccaggcacggcttcactacctgtctggatttatcaagaagacctctgatgccgagagtccccctatcagcgaatcccagacaaaacctaaggaggaagtcgaaaccgcagctaggggggtaaaagagcccaactctaagaactctgctgggtccgaatcgaaggagatgacacaaaccggctctgggagcgctgtctggaaaaagtggcagctcaccaaggggctccgggacgtcgcaaagagcacgtcttccgaaagcgggggtgtgagctctcctggaaaggaggagcgggagcagagtaccaggaaggaaaacatacagaccggccctcggacacggagcccaacaatcctcgagacctctccccgactgattcgaaaggccctagagtttatggacctgtctcagtatgtgagaaagactgataccgaccccttgcttcagactgatgagctcaatcagcagcaggcgatgcaaaaggccgaggaaatacaccagttccgccaacaccggactcgggtcctgagcatccgaaatatagaccaagaggagcgcctgaaactgaaagatgaggtcctggatatgtacaaggagatgcaagacagcctcgatgaagcgcgtcagaaaatcttcgatatccgagaggaataccgcaacaaactgctcgaagccgaacaccttaaactcgagacactcgccgcacaagaagcggctatgaaattagagaccgaaaaaatgactccagctcccgacacccagaagaaaaagaaggggaagaaaaagtag

SEQ ID NO: 54473 - DNA, 153 bp, Artificial Sequence
  Description of Artificial Sequence: Synthetic coding sequence
atgctgcgaagcactttcacagtgcactggacaacaattttgggtatatgcaggcctatcaaacctatctacaagagccaagcgtgtcctctgtcagaaaagcgaaatgcggacaatcatctggtaagtgaagacaatacatttaaggtctag

SEQ ID NO: 54474 - DNA, 297 bp, Artificial Sequence
  Description of Artificial Sequence: Synthetic coding sequence
atgctgagatccaccttcaccgtgcattggactacaatccttgggatatgcagacccatcaagccaatttataagagccaggcttgtcctctgagtgagaagcgcaatgcagacaatcatctcgtatcagaagacaacacgttcaaggaaccggaaaggtacatttcaagttcctgtgtgctcacatcaatcctgtacctgggggagaagacctttagttttagaactctaattagtccaagaggcatgaagctggtggaaatccttcagcagccaagtctgaccatggtggcttag

SEQ ID NO: 54475 - DNA, 246 bp, Artificial Sequence
  Description of Artificial Sequence: Synthetic coding sequence
atgaacgtggaccatgaagttaatcttctcgtggaggagatacatagactgggatctaaaaacgccgacggcaaactctccgtaaaatttggagtgctgttcagagacgacaagtgtgcgaatctttttgaagctttggttggcaccttgaaggccgcaaaaagaaggaaaatcgttacttaccctggggagttgctgctgcagggcgtgcatgatgacgtagacatcatcctcttacaggattag

SEQ ID NO: 54476 - DNA, 204 bp, Artificial Sequence
  Description of Artificial Sequence: Synthetic coding sequence
atgaatgtcgatcacgaagtgaatctgctcgtcgaggagattcatcggctggggtcaaagagcaagtacttgacagagatcgaatacttcagttggctctatctaggtaccggcgagacgggaatgctagagaaacctatgaaggggtctcccagggcctccggtcacagatcaggttctagtgcccatagccccagactgtag

SEQ ID NO: 54477 - DNA, 1374 bp, Artificial Sequence
  Description of Artificial Sequence: Synthetic coding sequence
atggataggtccctgcgaaacgttctcgtcgtgtcgtttggattcctgctcctgttcaccgcctatgggggattgcagagccttcagtcctctctctatagtgaagaagggctaggcgtgacagccctgagtacactgtatgggggaatgcttttgtcttctatgttcctcccccctctgctgattgagaggctcggctgcaaaggaaccatcattctgtctatgtgtggctatgtggccttctcagtggggaatttcttcgcttcctggtacacccttatacctacttccatcctgctggggttgggggctgcaccgttgtggagtgcccagtgtacctacctcactattaccgggaatactcacgctgaaaaagccggtaaacgcggaaaggatatggtcaatcaatatttcggtatatttttcctaatttttcagtccagtggcgtgtggggtaatcttatcagcagcttagtgtttggacaaactccatcacaagaaactttgccagaggagcagctgacctcctgtggggcaagcgactgcttgatggccacgactactaccaattcaacacaaaggccctcacagcagcttgtctacactctcctgggaatctacactgggtctggcgtgctcgccgttctgatgatagcagcctttttgcaaccgatccgggacgtgcaaagggaatcggaaggggagaaaaagagcgtgcctttttggagtactctactgagcacgttcaagctgtatcgcgacaaacggctatgcttactgatcctcttaccactatactccggattgcagcagggttttctgagcagcgagtacacaaggagttacgtcacatgtaccctcggcatccagtttgttgggtacgtcatgatctgcttctccgcaaccgacgcgctgtgttccgtgctatatggtaaagtttctcagtacaccggcagagccgtgttatatgtgctaggagctgtgacacacgtatcctgtatgatcgcgttgctgctttggcgtcccagggccgatcacctcgctgtctttttcgtcttttcaggcttgtggggtgttgcagatgcggtttggcaaacccagaacaatgctctatatggggtcctgtttgagaaatcaaaagaggcagcttttgccaattatcgcctgtgggaagccttaggttttgtaatcgctttcggatactcaatgtttctttgcgtgcacgtgaagctttacattttgctgggggtactttccctgactatggtcgcatatggcctggtcgaatgcgtcgagtccaaaaatcccatacgacctcacgcgccagggcaggtaaaccaagctgaagacgaggagatccagactaagatgtag

SEQ ID NO: 54478 - DNA, 912 bp, Artificial Sequence
  Description of Artificial Sequence: Synthetic coding sequence
atgaaggaggcactcgctcactttactatccacactgccctagtgcccagcgaggcccaagacacacccctgttccgatacctaaacccacaggcctcactgagtcacacttcagaggaggactttctcccggtggaagcagttcgagaaggaaaggaagagaagaaaggcggtcctcctgggcgtggtccccctgggtggcggagaagagaagagttgagactccccgatctgaaagtgctgtgctaccaggaagctggtagccggggtaccagagatagacaccattacgtttcgtcctatttggctggtgctaccagcgccgatcggtatcggatgtttctgagattccagaaagaagttctcgctaaacaggatttgctgaagaatgattttaccggcagcaaggccgctgctggacacgagcggaagttacagcaggagctccagaagatttgcacgtgctccccccagcaattcaacagactccacgtgttcgggaaggtctttgaagacatctgcaattcttccttgatcttcggggacctgctcaaaaaagttaaggacgagtacgagctgtacatggccacgctgctggagtcccaacccgcagcacagtatgaggccttgttagcgcagctcaaagccctgggccaaaggcccgtcaagaccgcagatatggatttagctagagaagagcttagaatgctggtgacagcaacaaaggctgctcttgaacagaacgatcggctgcggagtgaactcgagatggaggtcgcgctcttacagtcagcgaaggaaaggtccgggaggtgcctgtgcgatgtgcttccctacgggtgttttgccgttacatttatcatttcggccgcagccgtctggctgcccgtgtgtcagctaggtaggtgttag

SEQ ID NO: 54479 - DNA, 174 bp, Artificial Sequence
  Description of Artificial Sequence: Synthetic coding sequence
atgggaacagcagtggggccacatcatagccctgccccacatgattctgccctcccagccaggctgctgacctcagactttccttacgggaggtcttgtcagatcgaacaggttaaatatagtgtgcctgataccggccttttccagcattgggagggctctattccaacatag

SEQ ID NO: 54480 - DNA, 174 bp, Artificial Sequence
  Description of Artificial Sequence: Synthetic coding sequence
atgggaaccgccgtcggtccgcaccactcaccagctccccacgactcagccctgcccgctaggttgctgacctctgattttccgtatggtaggagttgtcaaatcgaacaggtgaaatactcggtccccgacaccggcctcttccagcattgggagggttcaatcccaacttag

SEQ ID NO: 54481 - DNA, 462 bp, Artificial Sequence
  Description of Artificial Sequence: Synthetic coding sequence
atggccgctgcactggccctcgtcgcaggggtcctatccggcgctgttctccctttatggtctgcgttgccacaatataaaaaaaaaataaccgatagatgctttcatcacagtgaatgctacagtggatgctgtctgatggacctggattcgggcggagctttctgcgccccaagagcccgtattactatgatttgcctgccacagtggctcgagttgttcaagggaagagaccgtatcattttcatctatgaggctcccacaccatcactcgttagtgcacataaccagggctcctatcagcaccacctgccgctgcccgacggtttggatgtgcatatccagggtcttgatgtctttccgccagtcccttacgacctggaagaggacgctggatggagcctgttgccttggggacacaggccttggctgcctccgacttgcagcaagtctagctcttag

SEQ ID NO: 54482 - DNA, 546 bp, Artificial Sequence
  Description of Artificial Sequence: Synthetic coding sequence
atgtaccagccttcacgaggcgctgcaaggcggctgggaccttgcctccgcgcttatcaggcgagaccacaactgccgaaactgttcctacaaagccatgattatagcctctactctttggacgtcgagtttattaacgaaatccttaacattaggacaaagggcagaacgtggtacattttatcgttgactttgtgtcgcttcttggcttggaattatttcgctcatctgcgattggaagtactgcaacttacacgtcatcctgagaattggacccttcaggcacgctggaggctggtcgggctgccagtccatctgctgtttctgcgcttctacaaacgcgataaggacgagcattatcgaacctatgacgcctactccacattctatctcaattcaagtggcctgatctgtcggcatcgcctggacaagcttatgccttctcacagcccaccaacccccgtgaaaaaactgttagtcggggctctggtggccctcggcctgtctgagcccgaacccgacctgaacctctgctcaaagccttag

SEQ ID NO: 54483 - DNA, 948 bp, Artificial Sequence
  Description of Artificial Sequence: Synthetic coding sequence
atgtatcagcccagccgcggagctgcacgacggcttggtccgtgtctcagagcttatcaggctcgtccgcaagatcagctttatcccggaacactaccttttccacccctctggccccactccaccactactacctccccctcttccccactgttttggtccccgttacctccccgtttgcccacacaaagactgcctcaggttcccccactgcctttgccacagatccaggccctgagttctgcatgggtggtcctaccacccggtaaaggagaggaggggcctgggccagaactacatagtggctgtttggacggactgcggagcctgtttgaaggtcccccatgcccgtacccgggtgcgtggattccatttcaggtgcccggaacagctcatccctcacccgctacaccatcaggcgatccgagtatggaggaacacctttcagttatgtatgagagattacgacaggaactgcctaaactgtttttgcagtctcacgactactctctgtacagccttgatgtcgagtttatcaacgagattctgaacatccggacaaagggcagaacatggtacatcctgagtctgaccctctgtagattcctggcctggaattactttgctcacctcagattagaggttttacagctgaccagacatcccgaaaattggactctgcaggcgcgatggcgcctggttggcctgccagtgcacctgttgtttttaaggttctataagagggataaagatgagcactataggacttatgatgcatattccacattttatttgaacagctctggattaatctgcaggcataggctcgacaagctgatgccctcacacagcccgccaactccggtaaaaaaacttctcgtaggtgccctggtggcactcggcttgtcggaaccagagccagaccttaacctttgcagcaagccgtag

SEQ ID NO: 54484 - DNA, 1302 bp, Artificial Sequence
  Description of Artificial Sequence: Synthetic coding sequence
cttccaacctgcgcacttcaacgggtggataggcttggggtggcaggcgctggaggtcgtcggtgcagggcatgcagggcccgtacgagcgtactgccgggactgcgtgcggttaggagagggcagggacaggccgctggccgtgtctgtgtggcccctgactcaccacgcctgccagtgcccaggggggatctgaagggcagggggcgagagatccgttctcctgccgcagcaccaagcagatcatcacctgctcagacacgcccagcaggacggccacaacagccggcacgcctcgccttgggcgaaagatcttggcaagagggaagacctgtgtgcactcgattcgggccactcagaccgggttggcaggacggccacgctcccagcagggacggcgctagccgtaccccctccgggactgaagatcagctttatccaggcaccctcccttttccaccactctggccacactcaacaaccacaacgtcgccatcttcacccctgttctggagccccctgcccccacgcctgcccactcagcggttgcctcaggtacccccattaccgttaccccaaatacaggccctctccagcgcttgggtcgtactgcctccaggtaagggggaggagggaccaggacccgagcttcactcagggtgcctggacgggctcagaagcctgtttgaaggcccaccatgtccatatccaggcgcttggattccatttcaggtgccaggtacagcacatccttcccccgctacgccctcaggcgacccctcaatggaagagcatctctcagttatgtacgaacgactgagacaagagctgcccaagttgtttctccagtcgcatgattactcgctgtattccctggatgtcgagtttatcaatgagatccttaatattcgaaccaaaggtcgaacctggtatatcctgtcactgactttatgtagatttcttgcttggaactactttgcacatctgaggctggaggtcctgcagttgacgcgacacccggaaaattggacacttcaggcccgttggagactggtaggattaccagtgcaccttctgttcctccggttttacaaaagagataaggatgagcactacaggacatacgacgcttactccactttttacctcaatagttccgggctcatctgcagacatcgcctggacaagctgatgcccagtcattcccctcccacacctgtgaagaaattattagtcggagccctcgtggctctcggcctttccgaacccgagccagacctcaatttatgctccaaaccttag

SEQ ID NO: 54485 - DNA, 546 bp, Artificial Sequence
  Description of Artificial Sequence: Synthetic coding sequence
atgtaccagccatcaagaggggctgctcggagattaggcccatgcctgagagcgtaccaagcaaggccacaattacccaagcttttcctgcaatcacacgattacagtctgtacagccttgacgtggaattcattaacgaaatactgaatatcaggactaaggggcgaacctggtacatcttgtcacttacgctgtgtaggttcctcgcatggaattacttcgcccatctgcggcttgaagtgctccagctgacccgacatccagagaattggactctgcaggctagatggcggctggtaggattacctgtccatttactattcttacggttctacaaaagagacaaggatgagcattataggacttacgatgcctatagcacgttctatctgaacagctccggcctgatctgccggcaccgattggacaagctgatgccaagccattctcctcccactcctgtcaagaaattgctcgtgggcgcactggttgctctgggtctgtctgaaccggagcccgatttgaatctttgtagcaaaccttag

SEQ ID NO: 54486 - DNA, 546 bp, Artificial Sequence
  Description of Artificial Sequence: Synthetic coding sequence
atgtaccaacccagccgcggtgccgcaagaagactggggccttgtctgagggcttaccaggcacggccacagctgcccaaattatttcttcagtcgcacgactacagcctctactccctggatgttgaattcatcaatgagatcttaaacatacgcacaaaaggtcggacatggtatattctaagcctaacattgtgtcgattccttgcctggaactacttcgctcacctcaggctagaggtgctgcaacttactcgtcatcccgaaaactggacccttcaggccaggtggcggctggtgggcctgcccgttcaccttctgtttctgaggttctacaaacgggataaagatgagcactacagaacttacgatgcctattctacattctacctcaacagttccgggctcatttgtcgtcatagattagacaaattaatgccatcccatagtcctcctacaccagtcaagaaactacttgttggggctctggtggccctggggttgagcgagcccgagcccgacctgaacttgtgttccaaaccttag

SEQ ID NO: 54487 - DNA, 546 bp, Artificial Sequence
  Description of Artificial Sequence: Synthetic coding sequence
atgtatcagccatctagaggtgcagcgagacgcctcggtccttgcctgagggcctaccaggccaggccacagctcccaaagctcttcctccaatctcacgattattctctgtattccctggatgttgaattcatcaatgagattctgaatataaggactaagggcagaacctggtacatcttgtcccttaccctgtgtcgcttcttggcctggaattatttcgcacatctgcgactggaagtgctacagttgacccggcaccctgaaaattggactttgcaggccagatggcgtctggtcgggctacccgtgcaccttcttttcctgcgcttttataagagggataaagatgaacactacaggacctacgatgcctattcaaccttttacctgaactcctccggtttgatctgcagacatagacttgataagttaatgcctagtcattccccaccaacccccgttaagaagctgctggttggggcacttgtggctctcgggctgtcggaacctgaaccagacctgaatctgtgttctaaaccctag

SEQ ID NO: 54488 - DNA, 948 bp, Artificial Sequence
  Description of Artificial Sequence: Synthetic coding sequence
atgtaccagccatctagaggggctgcccgtcggctgggaccttgtctcagagcatatcaagcccgaccacaagaccagctctatcctgggacactccctttcccaccgctctggcctcatagcacgactaccaccagtcctagctcgcccctgttctggagccctctgccccctcggcttcctactcaacgccttccccaagtgccccctctgcctctcccgcagatccaggcattgagtagtgcttgggttgtgctcccacctggaaaaggagaggagggcccaggacccgagttacatagtggctgtttagacggtctcagatctttgtttgagggacctccttgtccctatcccggtgcgtggattccctttcaggtacctggcactgctcacccttcacctgctactccaagcggggatccaagtatggaagagcacctctccgtcatgtatgagagactgagacaggaactcccgaagctgttccttcaaagtcacgattactcactatactccctggacgtcgagtttataaacgagatcctcaatatcagaactaaaggcagaacctggtatatactgtccttgacactgtgccgattcctagcatggaactactttgcacacctgcggctcgaggtcctgcagctgacacgccatcctgagaattggaccctacaggcgagatggcgtctggttggattgcccgtccatctgctttttttacgcttctacaagagagacaaggacgagcactatcggacatacgatgcttactctactttttacctgaactcttctggtcttatatgcaggcaccgtctggacaagttaatgcccagccattcccctcccactccagtaaagaagctgctagtcggcgctctcgtggccctgggcctgtcggagcctgaacccgaccttaacctctgtagcaagccctag

SEQ ID NO: 54489 - DNA, 948 bp, Artificial Sequence
  Description of Artificial Sequence: Synthetic coding sequence
atgtatcagcccagtagaggggcagcacgaagactgggaccctgcctcagagcttaccaggcccgaccccaagaccagctgtatcccggaacacttcccttcccaccactctggcctcattccactacaacgacctccccttcatcaccccttttctggagtccgttgcctcctaggctgcccacacagcgtttgccccaggtccccccacttcccttgccccagattcaggccttatcctccgcttgggttgtgctccccccagggaagggcgaggagggcccaggaccagaactgcattcggggtgtctggatgggctcaggtctctcttcgagggcccaccatgcccttacccaggcgcttggataccattccaagtaccaggaacagcacatccatccccagcgaccccaagtggagatccaagtatggaagagcacctttcagttatgtacgaacgactaaggcaggagctgcccaagttatttctgcaatcacatgattattcactatacagcttagatgtagagttcatcaatgagattcttaacatccgcaccaaaggcaggacttggtatattttgtctctgacattgtgcagatttctggcttggaattatttcgcccacttaagactcgaggtgctgcaattaacacgccacccagagaattggacgctgcaggcacgctggagactggtaggtctgcccgttcacctgttattcctccggttctacaaaagggataaggacgaacactatcgcacatatgacgcgtactctactttctatctcaactccagcggcttgatttgtagacacaggctggataagctgatgccatcacactctccaccgacccccgtaaaaaaactgcttgtgggtgcgttggtggcccttggcctgagcgaacccgagcccgatttgaacctctgctccaaaccctag

SEQ ID NO: 54490 - DNA, 1302 bp, Artificial Sequence
  Description of Artificial Sequence: Synthetic coding sequence
ctacccacctgcgccctgcagcgggtcgatcgacttggggtggccggtgcgggaggtagacggtgccgcgcatgtcgcgctcgaacatctgtcctgccaggacttagagcagtacggagaggtcaagggcaggccgctggtcgcgtttgtgtcgctcctgacagtcctcggctgccagtccccagaggagatctgaaaggtcggggaagggagatccgcagtcctgccgctgccccttcccgatcatcaccagctcagacacggcctgccggaagaccacagcaacccgctagactggcactcggtgagcggagttggcaggagggtagacctgtttgcacgcgtttcggccctttgcggcctggatggcaggacggccacgccccatctagggatggagcctcccgaactccatccggcacagaggatcaactgtaccctggcaccctgcctttcccccctctgtggccccatagtaccaccacaacatcaccttcatcgcccctgttctggtctccattgccacctagactgccgacccagcgtcttccccaagtcccacccctcccgcttcctcagattcaggccttatcttcagcttgggtcgtgctccccccaggcaagggtgaagaaggtcctgggcctgagctgcacagcggatgcctggacgggttaaggtctctctttgagggaccaccctgcccttatcccggagcgtggattcctttccaagtgcctggcacagcccaccctagcccagctactcccagcggcgacccttcaatggaagagcacttgtcagtgatgtatgaacgactcagacaggaactgccaaaactgttcttgcagtcccatgattatagtttatactcccttgacgtggaatttattaatgaaatactcaatattaggaccaagggaaggacgtggtacatactgagtctgacgctgtgtcgcttcctggcctggaattattttgcacatctccggttggaagttctgcagctgactcgccacccagaaaactggacactgcaagcccgatggcgcctcgtggggctgcccgtccatctacttttcttgaggttttacaagcgggataaagacgagcattacagaacctacgacgcttacagtaccttctacctgaactccagtggcctgatttgtcgtcaccgtctcgataagctgatgccgagccactccccgccaaccccggtcaagaagctgctggtgggagcccttgtcgctctcggactttcggagcctgaaccagatcttaacctgtgctcgaagccgtag

SEQ ID NO: 54491 - DNA, 948 bp, Artificial Sequence
  Description of Artificial Sequence: Synthetic coding sequence
atgtaccagccatccagaggtgccgctcgccgacttgggccatgtctgcgggcttatcaagccagaccacaggaccagctgtatccaggaacgcttccttttcctcctctgtggccacacagcactacaacgacctcaccatcttctcctctcttctggagcccattgccacctagactgcctactcagcgtttaccccaggtaccccctctgccgttgcctcagatccaggctctcagcagcgcttgggtagtgctcccccctggtaaaggggaagaaggtccaggtccagaacttcacagcggctgtctggacgggctccggtcgttgtttgaaggacccccatgtccatatcccggagcttggatccccttccaagtccccggaaccgctcacccgtcaccagctacccccagcggtgacccaagtatggaagaacacttatccgttatgtatgaaagactgcgtcaggagctccccaaattgtttttgcaaagccacgattattctctatatagcctggatgttgagttcattaacgaaatcctgaatattagaactaagggacgtacatggtatatcttgtccttaaccctctgtcgcttcctggcatggaattattttgctcacttgagattagaagtgctccagttaactagacatcctgagaactggacactgcaggcgcgatggagactggtgggcctgcccgttcacctcttattcctgagattttacaaacgtgataaagacgagcattacaggacttacgatgcatatagtaccttctatctgaactctagcggtctcatctgccgccacagactggacaaattgatgcccagccactcaccgccaacacctgtgaagaagctgctcgtgggagccttggtggccctcggattgagcgagcccgagcccgatttgaacctttgcagtaagccttag

SEQ ID NO: 54492 - DNA, 948 bp, Artificial Sequence
  Description of Artificial Sequence: Synthetic coding sequence
atgtatcagccctcccggggtgccgctcgcagattagggccttgtctccgcgcatatcaggcccgtccacaggatcagttgtatcccggaacactcccgttccctcccctctggccccacagtacgacaacaactagcccatcttcacccctgttctggtctccccttcccccaagattaccgacccaacgcttaccgcaagtgccgccattgccgttgccccagatccaggcactgtctagcgcttgggtggtcctcccaccagggaaaggagaagagggacctggaccagagcttcactcagggtgcctcgatgggttgcgctcactctttgaagggcctccctgtccatatccaggcgcttggatccctttccaagtgccaggcacggcgcacccctccccggctactccgtctggagacccctccatggaggaacatctttccgtgatgtatgagcgtctacggcaggaattaccaaagttatttttgcagtctcacgactattcgctttatagccttgacgtggaatttatcaatgagattctaaatatacgaactaagggacggacatggtatatcttaagtctgacactgtgtcggttcctggcctggaattactttgcgcatcttcgcctcgaagtcttgcaacttacaaggcacccagaaaactggactttgcaggccagatggagactggtcgggcttccagttcatctgttatttttgagattttacaagcgcgataaggacgagcattacaggacttatgacgcctattctaccttctacctgaactccagcgggttaatttgtagacatcgtctggataagttgatgccctcgcacagcccgccaaccccggtgaaaaagttattagtgggagccttagtggctctaggcctcagcgagcccgagcctgacctgaacctctgcagtaaaccctag

SEQ ID NO: 54493 - DNA, 1302 bp, Artificial Sequence
  Description of Artificial Sequence: Synthetic coding sequence
cttccaacgtgcgcccttcagagggtcgatcgcctgggtgtcgccggagccggtggcaggcgctgtcgagcttgccgggcacggacttctgtgctgccaggtctccgagctgtgagacgcggacaggggcaggccgcaggacgagtgtgtgtggctcccgattccccaagattgccagtgccgcgtggagacctgaaaggcagggggagagagatcaggtctcccgcagcagccccaagcagaagctcccccgcacagactcgacccgcaggccgacctcagcaacccgctagactggccttgggagaacgatcctggcaggaaggtcggcctgtttgcacacgtttcggtcctctcagaccaggttggcaggacgggcatgctccttcacgggacggcgcttccagaacaccgtccggaacagaagatcagctctaccccggtaccttgccgttccccccactgtggccgcactctaccacaaccaccagtccaagcagcccgctgttttggtccccattgccaccgaggttgcctactcaacgtctcccccaggtacctccgttgccactgcctcagatacaggctctgagctccgcttgggttgtcttgccacctggcaagggagaggaaggaccgggaccagagctgcattccgggtgtttggatgggctgagaagcctgttcgaaggtccgccttgtccatatccaggagcctggatacctttccaggtgccaggtaccgcccatcctagtcccgcaacaccatccggggatccatccatggaggaacacttatccgtgatgtacgagagactgcgacaggaactgcccaagctttttctgcagtctcatgactatagcctgtacagccttgatgtcgaattcatcaatgagatccttaacatacgcacaaaggggagaacatggtatatccttagccttacattgtgtcgcttcttggcatggaattattttgcccatctgcgcctggaggtcctacagctgacacgccaccccgaaaattggacactgcaggctaggtggcggctggtcgggctgcctgttcacctcctcttcctgcgcttttacaaaagggacaaagatgaacactacaggacctacgatgcctattccacattttacttaaatagttccggactgatctgtcggcatcgcctggacaagctcatgccatcacattcccccccaacacccgttaaaaagttacttgttggcgctctcgtggctttagggctgtctgagccggagccagacctgaatctctgctctaagccatag

SEQ ID NO: 54494 - DNA, 1302 bp, Artificial Sequence
  Description of Artificial Sequence: Synthetic coding sequence
ctgcccacctgcgctctccagcgcgtggaccgacttggtgtggctggagccggaggtcggaggtgccgcgcttgccgagccagaacaagcgtgctgcccggactgagagcagttaggagaggacagggacaggccgctggccgagtctgcgttgcccctgatagtcccaggctgcccgtgccgagaggtgacctcaagggtagaggcagggagatcaggagtccagccgctgcgccttctcgatcatcacctgctcaaacacgccctgctggtcggccacagcagccagcaagactggccctaggcgagcggtcctggcaggaaggacgccctgtctgtactcggttcggaccgttgcggccaggctggcaggatggtcatgctccctcacgtgatggcgctagcaggacccccagcggcactgaagatcagctgtatcctggcaccttgccgtttcccccactttggccccattccaccactactacatctccatcaagtccattgttctggtcaccccttccgccaaggttacctacacagcggctgccacaagtgcccccacttccccttccacagatacaggcactttcctcagcatgggtcgtactcccacctggtaagggagaagagggaccaggccctgagttacactccggatgcctggacggtctgaggagcctgttcgaaggtccaccctgtccataccccggagcctggattccatttcaggtccccggaacagctcatccttcccccgctaccccctctggagatccgtctatggaggagcacctgtctgtcatgtacgaaagattaaggcaagagctgccaaagctgtttcttcagtcacatgactatagcttgtattctttggacgtagagtttatcaatgagattttaaatattcgcacaaagggtagaacctggtatatattgagcctgaccttgtgccgcttcctggcctggaattactttgctcatctacgcctcgaggttttgcagctcacacggcatcccgagaactggactctgcaggcacggtggcgactggtcggcttaccagtgcacctactctttctacgattttataaacgagacaaggacgagcactataggacatacgacgcttacagcactttctaccttaatagctctggactgatctgtaggcacagactcgacaagctcatgccatctcacagccccccaacccctgtaaaaaaactgctagttggagccctggtggctctgggcctctctgaaccagagcccgatctgaatctctgctcaaagccctag

SEQ ID NO: 54495 - DNA, 948 bp, Artificial Sequence
  Description of Artificial Sequence: Synthetic coding sequence
atgtatcagcctagtaggggcgcagcaagacgcctggggccatgcttgagagcataccaggctaggccccaggatcagctgtatcccggtaccctgccatttccgcctttgtggccgcactcaaccactacaacctcaccatcatcacccttgttttggtccccattgccccctagactgcctactcagagactacctcaggtgcctcctctgccgctgcctcagattcaggccctgagcagcgcctgggtagtgctcccgcctggcaagggggaggagggtccgggacccgagcttcatagcggctgcttagacgggctgcgctccttatttgaaggccctccctgcccttatccaggcgcttggattcctttccaggtgcctggcacggctcatccatcaccggctacaccgtcaggtgacccctccatggaagagcacttgtctgtgatgtatgaaaggctgaggcaggagctcccgaaattgttcctccagtcccacgactattcgctgtactcacttgacgtggagtttatcaatgagatcctgaacatccgtaccaagggtcgaacttggtacatcctgtccttgaccttgtgcagatttctagcttggaactactttgctcatttgagactggaggttcttcaactgacaaggcatcctgaaaattggacccttcaggctagatggaggctggtgggtttaccggtccacctgctcttcctgagattctacaaacgggacaaggatgagcactataggacctacgacgcctactccacattctatctcaattcatcagggctgatttgtaggcaccgcctcgacaaactgatgccgagccactccccacccacgccagtgaagaaactgcttgtgggcgcactggtggcactgggtctttccgaaccagagcctgacttgaatctgtgctctaagccctag

SEQ ID NO: 54496 - DNA, 1302 bp, Artificial Sequence
  Description of Artificial Sequence: Synthetic coding sequence
ttgcctacgtgtgccttgcagagagtcgaccgcctcggcgtggccgaagcgggaggaaggcggtgtagagcctgcagggcgcgtaccagtgtgcttcctggcttgagggcagtccgccgaggccaggggcaggcagccggacgggtgtgtgtcgccccagatagccccagactacctgttcctaggggcgacctgaaagggcgaggtcgggaaatcagaagtccagctgcagcaccctccaggagctccccagcccagacgcgaccggctggacgcccacagcagcccgctcggctggcactaggggaaagaagctggcaggaaggccgacccgtgtgcacccgcttcggccctctgagacccggttggcaggacggccacgccccaagtagagatggggcttcccgcactccaagtggaacagaggaccagctgtatcccggtacactgccgtttccacctctctggccccattccacaacgactacgagcccaagcagccctcttttttggagcccgttgccacctaggctccctacacaacgactccctcaggttcccccactgccactgccgcagattcaagcactaagctcagcctgggtcgtgcttcctcctggcaagggggaagaagggcctggccctgagctgcactcgggatgtctggatggtctgcgctccctgttcgaaggccctccctgtccttaccctggtgcatggatcccgtttcaggttcctggcaccgcacatccctcccccgcaaccccaagtggagatccatcaatggaggaacatctctctgtcatgtacgagcgcctcagacaggagctcccaaagcttttcctgcagtctcacgactactccttatactctttggatgtggagtttattaacgagatcctcaatattaggacaaagggcagaacttggtatatactgagccttaccctgtgtagattcctcgcttggaactactttgcacatctgagattagaggtgcttcagctcacacggcatcccgaaaactggactctgcaggcacggtggaggcttgtcggtctgcctgtgcacttgttgtttctacggttttataaacgggataaagatgagcattaccgaacatatgatgcctactctaccttctacctgaactcttcggggcttatctgtcgccatcgtctcgacaagctgatgcctagtcactccccccctacaccagtcaagaagcttctggtcggagcgctggtggccctggggctgagtgaaccagagcctgatctgaacttatgttctaaaccctag

SEQ ID NO: 54497 - DNA, 1302 bp, Artificial Sequence
  Description of Artificial Sequence: Synthetic coding sequence
ctgcccacctgcgccctccagcgcgtggatcggctgggagtagccggagccggtgggagacggtgccgcgcttgtagagccagaacttcagtgctgccaggattgcgggctgtgagaagaggtcagggacaggctgccggacgggtgtgcgtggcaccagatagcccacgactccctgtgccacgaggcgacctcaagggccgaggtcgggagatccggtcacccgcagccgcaccgtcgcggagctctcccgcacagactcggccagcaggtagaccccagcagcctgcgagattggctctaggggaaaggtcctggcaggaggggaggccagtctgcactagatttgggcctttgaggcctgggtggcaggacggacacgccccaagcagagacggcgctagcaggacacccagcgggaccgaagaccagctctaccccggtactctgccattcccgccattatggccacattccacaacaacaacatcccctagctcaccgctgttctggtctcccttgcctcctaggctgcccactcaacggttaccacaagtgcccccactgccccttccccagattcaggccctgtcgtccgcgtgggtggtcttaccccctggcaagggtgaggaaggccctggaccagaacttcattctggctgtttggatggactccgctcacttttcgaggggccaccttgcccctacccaggcgcttggatcccctttcaggttccaggcacagcacacccctcacctgccacaccaagtggagatccatctatggaggagcatctgtccgttatgtatgagcggctacgccaagaattgcccaaactgttcctgcagagccatgactatagcctgtactctctggatgtggaatttatcaacgagattctaaatattagaacaaaggggaggacttggtacatcttgagtctgacactgtgccgctttctcgcctggaactactttgcccacctacgacttgaggtcttgcaacttaccagacatcccgaaaattggacgctgcaagctcggtggaggctggtgggcctgcccgtgcacctgctttttctgagattctataagagggacaaagatgaacattacaggacgtatgacgcctattctaccttctatcttaattcaagtggcctgatctgccgccaccgcctcgacaaactcatgccaagccatagcccacctacacctgtgaagaagctgctcgtgggtgccctggtcgcattgggattgagtgaacctgagcccgatctgaatttgtgctccaaaccatag

SEQ ID NO: 54498 - DNA, 546 bp, Artificial Sequence
  Description of Artificial Sequence: Synthetic coding sequence
atgtatcagccatctaggggcgcagcccgaaggctgggaccgtgccttagagcttaccaggccaggcctcagcttcctaaactctttttacaaagccacgactattccttgtactctctggacgtcgaatttataaacgagatcttaaacatcaggactaaaggacgcacatggtacatcctgtccttaacactctgtaggtttctggcatggaactatttcgcccatctacgcctcgaggtgttgcagcttacccgacacccagagaactggaccctacaggctcggtggaggctggtggggctacctgtccacctcctcttcctgaggttctataagagggacaaggatgagcattaccgcacatacgacgcctatagcacattctacctgaacagctcgggactcatttgccgtcaccggttagacaagcttatgccaagtcacagtccgccaacacctgtaaagaaattgctcgtgggtgctttagtagccttgggcctctcagaacccgaaccagatctgaacctgtgttcgaaaccatag

SEQ ID NO: 54499 - DNA, 546 bp, Artificial Sequence
  Description of Artificial Sequence: Synthetic coding sequence
atgtatcagccatcaaggggagcagcaagacgcctcggcccatgtctgagagcataccaggccaggccccagctgcctaagctgtttttgcagagtcacgactattccctttactccctggacgtggagttcattaatgaaatcctcaatatccgtacaaaaggccgtacctggtacattctgagcctgactttatgcagatttttggcttggaattattttgcacatctaagactggaagtgctgcaactgacccgtcacccagagaattggaccctgcaagcacgctggaggcttgtgggcctacctgtgcacctgcttttcctccgtttctataagagggataaggacgagcattatcgcacctatgatgcctattcgacattttatttaaacagttcaggcctgatttgccgccaccggttagacaagctaatgccttctcactcaccacccacccccgttaagaagctgctggtgggggctctggttgcactgggactgtctgaacccgagcccgacctgaatctttgctctaagccttag

SEQ ID NO: 54500 - DNA, 1491 bp, Artificial Sequence
  Description of Artificial Sequence: Synthetic coding sequence
atgtatcagccgtcaagaggagctgcgaggaggctgggaccatgtttgagagcataccaagccagacctcaggtcagtggcggtgaagaaggtggaaggcggggtggcggtgaaaggcccagctcaaaacccgtaagaggagccgagcgcgctctgggcagtgcccaagctcagagacatccaccgcctctccccacatgcgcgcttcagcgagtggacagactaggtgtggctggtgccggagggagacggtgcagagcttgtagggccagaactagtgtgctacccggattgcgggctgttaggcgcggacagggccaagcagcaggccgagtgtgcgtggcaccagactcacctagacttccggtcccacggggtgatttgaaggggagaggaagagaaatccgcagtcctgctgccgcaccgtcacgatcatcccccgcacagactagacccgctggaaggccccaacagcctgcgaggcttgcgctgggggagaggtcttggcaggagggcagaccagtgtgtaccaggtttggtccattacggcctggttggcaagacggccacgccccatcccgtgatggtgcctcccgcaccccttccggtacggaggaccagttgtatccgggtacactgccattcccacctttgtggcctcacagtaccactacgacatcgccaagcagccctctgttttggtcccctctgcccccaagactgccaactcagaggctgccccaggtcccgcctttgccactgcctcagatccaggccctgagctctgcttgggtagtactgccacctggcaaaggagaggagggtcccggacctgagttgcactctggctgccttgatgggttacggtccttgtttgaaggaccaccctgtccatatcccggtgcatggataccttttcaggtaccaggaaccgctcatcccagtcccgcaactccttcaggagatccctccatggaagagcatctttccgtaatgtatgagcgcctgagacaagagctgcccaaactgtttctgcagagccatgattacagtttgtactccctggacgttgaatttattaacgaaatcttgaacatccgcacaaaggggagaacttggtatattctgagcctgactctttgtcgctttcttgcttggaattattttgcccacctcaggctggaagtcctgcagttgactagacacccggaaaattggaccctacaggcccgttggaggctggtgggattgccagttcatctgctgtttctgcggttctacaaaagggacaaggatgagcactacagaacttacgatgcctatagtacattctacctgaacagcagcggccttatttgcaggcatcgactcgacaaactcatgccttcacacagccccccaactcccgtgaagaaactcctcgtgggagccctcgtggctctggggctctccgagcctgagcctgatttaaacctgtgtagtaagccatag

SEQ ID NO: 54501 - DNA, 1491 bp, Artificial Sequence
  Description of Artificial Sequence: Synthetic coding sequence
atgtaccagcctagccgcggagccgcacgcaggcttggaccctgcctgcgcgcatatcaggctcgacctcaggttagtgggggagaggaaggtggtagaagaggaggaggagaacgcccttcgagtaaacctgtcagaggggctgagcgtgctctgggatcagcccaagcccagaggcacccaccaccactccccacctgtgctctgcagcgagtcgatcgccttggagtcgcaggtgccggtggccgtagatgccgagcctgtagggccagaaccagcgttctgcccggtctgagagccgtgcgcagaggccagggacaagcagctggcagagtctgcgttgctcccgatagcccccgtcttccagtacccagaggcgatctgaagggtcggggtcgagaaatccggagccccgcagctgcgccaagccgctcgtcacccgcacagactcgccctgccggtcgccctcagcagcccgctcgcctggctttgggtgagaggagctggcaggaaggaagaccagtgtgcactaggtttggccctcttagaccgggttggcaggacggccatgcgccatccagagacggggcaagtaggactccttcaggtacagaagaccagctgtaccccggaacactcccctttcccccactgtggccccactcaacgactaccacgtcaccctcatcaccattattttggtccccactgcctcccaggcttccaactcagaggttaccacaagtcccaccgctccccctcccccagatccaggcactttcctctgcctgggtggtactgcctccagggaagggggaagaagggcctggccctgagttgcatagcggctgcttggatggccttcggagcctgttcgaggggcctccttgcccatatcccggtgcttggatcccattccaagtcccaggcacggcccacccctcgcctgctacaccgtctggtgatccctctatggaggagcatttatcagtgatgtacgagcgtctccgacaggaacttcctaagcttttcttacagagtcatgactacagtctgtattctcttgatgtggagttcattaatgaaattctgaatatccgcactaagggtagaacctggtacattttgtctctgaccttgtgtagattcctagcatggaactactttgcccatttgcggcttgaggtcttgcagctcaccagacatcccgagaattggaccctgcaggcacggtggcggttggtgggactgcccgtgcatctgctctttctccggttctataagagggataaagatgaacactaccgcacttacgacgcctactccacattttacctgaactctagcggcttaatttgcagacaccgcctcgacaaactcatgcctagtcactccccacccactcccgttaaaaagcttctggtgggtgcactcgtggctctggggctgtctgagcccgagcccgatctgaatctctgctctaagccctag

SEQ ID NO: 54502 - DNA, 1491 bp, Artificial Sequence
  Description of Artificial Sequence: Synthetic coding sequence
atgtatcaaccaagtcgcggtgccgcaagaaggcttggaccatgtcttcgcgcataccaggcccgaccccaggtatcggggggagaagaaggtgggcgaagagggggtggtgagcgccctagttccaaacccgtcagaggcgctgaacgcgctctcggtagcgcccaggcccagaggcacccccctcccctccccacctgtgcccttcaaagggtggataggctgggagtggcaggggcagggggaagacgatgccgagcctgcagggcacgaactagcgtgctgcctggcctgcgggcagtcagaaggggacaaggacaggccgcagggagggtgtgcgttgcacctgactcaccacgtcttcccgtgccacggggagacctcaaagggaggggaagagagatccgctctcccgctgcagcccctagcaggtcgtcccctgcccagacccggccagctgggcgaccccagcaaccggcacgcctggctctaggcgagaggtcctggcaggagggaagacccgtttgcaccaggtttggacccctcaggcccggttggcaggatggtcatgccccatcccgagacggcgcttccaggacccctagcggcactgaggatcagctgtaccccggaacccttcccttcccccctttgtggccacacagtaccaccaccacatctccctcatctccgctgttttggtcgcctctaccgcctagactccctacccagcggcttccacaggtgccacctctgcccctcccacaaattcaggcactgagtagcgcatgggtcgtgctccctccaggtaagggcgaagagggccctggaccagagcttcattccgggtgtctggacggccttcggtcattgttcgagggccctccgtgcccataccccggagcttggatcccatttcaggtgccaggaacggctcacccctcccccgctacacccagcggcgaccctagtatggaggagcatctctcagtaatgtacgagagactaaggcaggagctgcccaaattatttcttcagtcacacgattacagtctgtacagcttagatgtggagtttatcaatgagatattaaacattagaaccaagggacggacctggtatattctctctctgacgctctgccgctttctggcatggaattattttgcacacctgcgcctagaagtcctccagctcactcgacaccctgaaaattggacactacaggcgagatggcggctcgttggactccctgtacacctgctgttcctgcgcttttacaaacgtgataaggacgagcattaccgaacatacgacgcctatagcactttctacctaaactctagtgggctgatctgccgccatagactggataagctgatgccaagccactcgccccctacccccgtaaagaaactgctggtgggcgcactggtggccttgggcttgtccgagcctgaaccggatctgaacctgtgtagcaaaccatag

SEQ ID NO: 54503 - DNA, 1491 bp, Artificial Sequence
  Description of Artificial Sequence: Synthetic coding sequence
atgtatcagccatcccgcggtgctgctcggaggctgggaccctgtctgagagcctaccaggctcggccacaggtgtccggaggggaggagggtgggagacgcggtggtggtgagcggccaagctctaagcctgtgagaggcgctgaacgagccttaggctctgcccaagcccaaagacaccctccacctctgcctacctgtgccttacagagggtcgacaggttgggggtcgccggagcgggagggcgtaggtgccgggcatgtcgggctcgcacgagcgtgctgcccggtcttagggcagtgaggcgcggacaggggcaggctgcaggccgagtatgtgtcgcaccagactcccctagactgccagttccaagaggcgatcttaagggacgaggcagagagattcgtagccctgcagcagccccatcacgttctagcccagcacaaacaaggccggcaggacggcctcaacaacctgcacggctggccttgggcgaacgtagctggcaggaaggtcgaccagtatgtactcgattcggcccacttcgtccgggatggcaggacggacatgcaccctctcgggacggagcgtctcgcaccccatctggaaccgaggatcagctttacccgggaacgctaccattccctccactgtggcctcattcaaccacaacgacctccccctcctcgccattgttttggagcccacttcctccacgcctgcctacgcagaggctgcctcaagtgcccccactgcctctgccccagattcaggctctgtccagcgcctgggtcgttctgccccctggcaagggggaggagggacccggacccgaactgcactctggttgcctggacggtctacgcagtctgtttgagggccctccatgcccatatcccggtgcttggatccctttccaggtccctggtacagctcatccctcaccggctactccctcgggcgatcccagtatggaggagcacttgtcagtgatgtacgagcgcttaagacaggagctgcctaaactgttccttcagtctcatgactacagcctgtactcacttgacgtggagttcattaacgagatcctgaatattcgcactaagggcaggacatggtacatcctgagtttaacattatgccgatttctcgcatggaactattttgcacatcttaggttggaagtcctacagctgacacgccacccagagaactggaccctgcaggcccgatggcgcctggtggggctgcccgtgcatctcctgttcctgcgcttttataagagagacaaagacgagcattaccgtacttacgatgcgtatagcaccttctacctgaatagctcgggcctgatctgtaggcacagacttgataaactaatgccttctcacagtcctcctacgcccgttaagaaacttctcgtgggcgctctagttgctctaggattgtccgagccggagcctgacctgaacctgtgttcaaaaccgtag

SEQ ID NO: 54504 - DNA, 1491 bp, Artificial Sequence
  Description of Artificial Sequence: Synthetic coding sequence
atgtaccagccctccagaggagcagcgaggcgtttaggtccgtgtttgcgcgcttaccaggctagaccacaggtatcgggaggtgaggaaggcggtagaagagggggtggtgaacgaccatcctctaagccagtgagaggtgctgagagagcgctaggttccgctcaggcgcagcggcacccacccccactgccaacctgcgcactgcagcgggtcgaccggctgggagtagccgaggctggaggacgacgatgtcgcgcatgtcgcgctcgaacttctgttttgcctgggctgagagctgtacgcaggggccagggccaggctgcgggtagagtgtgtgtcgcgccagactcccctcgattgccagttccaaggggagacctcaaagggcgtggtcgtgaaatccgcagtcccgctgccgctccttcccgaagttctccagcgcaaacgaggcccgctggccgtccccagcagccagcacggctggcattaggtgaaaggtcatggcaggaaggcaggcctgtctgtacccgcttcggtcctctgaggcccggatggcaggatgggcatgccccttctcgcgatggcgcatcaagaacgccaagcggtactgaggaccaactttatccgggaacgctgccgtttccaccactgtggcctcatagcaccaccacgacgagtccgagcagcccactgttctggagcccactccctcctcgcctgccaactcaacgactgccccaggttccacccctgcctctgccgcagatccaggcactgtctagtgcctgggtggtgcttccgccaggaaagggtgaagaagggccaggccctgagttgcactccggatgccttgacggcttgagatctctgtttgagggccctccttgcccctacccaggggcatggattccatttcaggtgcccggtactgctcacccaagtcccgcaacaccctcgggcgacccctctatggaggagcacttaagtgtgatgtatgaaagactgagacaggaattgccgaagctcttcctccagtcgcatgattattcactgtactcactggacgtagaatttatcaatgagattctaaatatccgtaccaaaggccgaacatggtatatactgagcctgacgctttgcaggttcctagcctggaattatttcgctcatctgcgattggaggtgcttcagttgacacgacaccccgagaattggaccctacaggctcgttggcgtcttgtaggtctacccgtgcatctcctattcctacggttctataagagggacaaagacgaacactatcgaacttacgacgcctattccactttctatctgaattctagcggtctgatctgtcggcacaggctagataaactgatgccctcacactctcctccaacaccagtgaagaagctgttagttggggcactcgtggctctgggcctttctgagcccgaacccgacctcaatctctgctcaaagccttag

SEQ ID NO: 54505 - DNA, 1491 bp, Artificial Sequence
  Description of Artificial Sequence: Synthetic coding sequence
atgtatcaaccttcacgtggcgctgccaggcgcctcggcccttgtttacgagcctaccaggcccgtccccaggttagcggaggggaggagggcggaagacgtggcggtggcgaacggccatcgagcaaacctgttcggggagcggaacgcgcactcggctctgcccaggctcagaggcacccaccacccctgcccacgtgcgcactgcagagagtggatcgtctcggagtggcaggcgcaggcggaaggcggtgcagagcttgtcgcgctagaacatcagttctgcctgggctccgggcagtgcgcagaggacagggccaagcagccggtcgcgtgtgcgtggccccagattcaccgaggctgccagtcccccgtggcgatctcaaaggcagaggaagagaaattcgctctccggcagcagcaccatctagatcctcccctgcccagactcgcccagccggtcgccctcagcaaccggcacggctcgcattgggcgaaaggtcatggcaggagggcagacccgtctgtaccaggttcggcccactaagaccgggttggcaagacgggcacgcgccaagtagagatggagcgagcagaaccccctccggcacggaagaccagctatatcctggaactctgccctttccaccactgtggccccacagtactacaactaccagtccctccagccctttgttctggtctccattaccgcctcgactgcctactcaacggcttccccaggttccacccctacccctcccccagattcaggcgctgtccagcgcgtgggtcgtccttcctccgggtaagggagaagaggggcctggacccgagctgcattccggatgcctggacggactacggagtctttttgaaggaccaccttgcccttatccaggcgcttggataccattccaggtacctggaaccgctcacccctctcctgctacgccctcaggcgatccgagtatggaggagcatttaagcgttatgtacgaacgtcttcggcaggagctgccaaaattatttctgcagagtcacgattactctctgtactccctggacgttgaattcattaacgaaatcctcaacatccggacgaaaggaagaacctggtacattctatcactgactttgtgcaggtttctcgcatggaactactttgcacacttgaggttggaggttttgcagctcacccgccaccctgagaactggacactgcaggcacgctggcgcctggtgggattgcccgtacaccttttgttcctgcgattttacaagcgggacaaggacgagcactaccggacctacgatgcttactccaccttctacctaaactcatctgggctcatctgcaggcatcggctcgacaaactgatgccaagtcacagcccacccacgccggttaagaaactgctggtgggagcattagttgccttaggactatcggagcccgagccggacttgaacctgtgtagcaagccttag

SEQ ID NO: 54506 - DNA, 735 bp, Artificial Sequence
  Description of Artificial Sequence: Synthetic coding sequence
atgaatgatccgttcgctcgtatggagacgcggggtccgcagggggctgctaatcccatggactcatctaggtccttgggcgatttaggcccattccctcgggaggttgggaggggtgcacccctggcccctggagcccgtaatcctgccacagcgggagcaagcagaagtcagggcggaggccatgaggatcgcaccgccgacagggcgttgggccctagagcaggcgaagagttagaccgagagtcctgggtacgggaaaaggtgctgtttcttctgcaccctgaacggtggcttggaacccggggtgatcccgcaagagaagaggttgccggagccgaagacctgccacacgcaggcggagaggatcatggcgaggaaccaaactacccctcagtcttccagcgacagaagcgaatcagtgggagaagggtcgcaccaccgagggacgcggctgacccccctaaatacgtactggttcgagtggaggactaccaggtgactcaagaggtactgcagacatcttgggcaaaaggaaggatgactaccaggacagaagagcacttcgtcaccgctttgacttttaggtcgagccgggagggacagcccggtgaacgctggggcccagccgagagcagagctcttcaggcccgaactggggcaagcagggttcacgccgctgggcgtagagtctccccatctccaggcacatggctggaggaaatcaagctgtag

SEQ ID NO: 54507 - DNA, 1527 bp, Artificial Sequence
  Description of Artificial Sequence: Synthetic coding sequence
atggggaggcggaatgagaactgtgctaattcccttcgcgtaagcaatatctctcaggaaaacctgtcgcattggaatctggattccgaggtccccgtgtctgagaataagaatctgcccgcaggcagagatggagccgctggaggaaagatcaacaaaaactacctcgagattcccgtcgagcagctgatgctagagccaaacctgtctgtccacagccagaagagcacgcagaatagtaaacagggaatcttccagctctggaactgcccactcaacgaaggcagtaccatagaaaagagggagtttaaaaaatcttcagtggagacaggcttcaacgtgataaatcaccctattcgcgtattcacattgaatcacccactgacaatagcaagcgtggacaagcaggtagggccttaccctgggcttcctatgcctctgggcctgtgctggccttatgccgacggcgatttcttcaagaatcgaaatgagatacatgtgtcctcctgcagcaccatcgaaaacaatgatggggagacccttcctgcacctaactggaacctgaaacacggaaattctagcgtagaggaaaacttcaccgatgaatctgacctgtccgagaatgaaaagacaaatgatactttgcttagctacttcaagaaggttgatttaaatctgaagcctgagacaatcaaaaatgtcgaagagccgttcactgaggagccaaacgaggtatttccttaccctgactttttgccccctccattttccgctctggacctgcataatctggcactgtccaaatcagacaactggaaagttactgtcgatccagcagagacatcagtcgagcacctcattacgagactactcgagttggagcgcctgcagcacatgactatccagaaggagagacctcgcctccaaactaccttctgcactcctgccgtgactgaaaggccttcctcctccaaggcaacgcctaaagtaagacaaccaaagctgtgtgactccctgagcctgcaaattccttgcgtggacaaatcccaggagaagtcaaaaaataactccgggtcttgtaagctcgagcagaatgctcttaaacgcaactggtcaaatgccggaaagtaccggtggaacagccggcctctgagcctgaaatccagctcaacgcccaaacagctgatagaaacatacgataagaaccccaaaagttctatcctgagcccttgccaggagttgtctttcaagcccactatcggtcacactaatcagagcatggtgaagatggtgtcgacgcgctgcctgccgtggcgatcccctatgcccgtctctccaatcccactcacttttcccgagaaccagaaggaggagattaaagcaccaaaacggaacttcggcaccaagaagaagttgtaccggcagaatattgttctcaaccggccattcagtatccagaaacttaattgtctgtccccatcattgattgccaaggataaatgctgcagccctatcgaacagaagtag

SEQ ID NO: 54508 - DNA, 1068 bp, Artificial Sequence
  Description of Artificial Sequence: Synthetic coding sequence
atgttgatggagttttttaaaaatagaaacgagatccacgtgagtagctgctcaaccattgagaacaacgatggggagacactacctgctcccaactggaatttaaagcatggcaatagttcagtcgaggagaattttaccgatgaatctgatcttagcgagaatgagaagacaaatgacaccctgttaagctacttcaaaaaagtggatctcaacctcaagccagaaacaatcaagaacgtggaggaacccttcactgaagagcctaatgaggtgttcccctatccagacttccttcctcccccattctccgccctggatctgcacaatctggcactcagtaagagcgacaattggaaggttacagttgaccccgctgagacaagcgtggaacacctcatcacaaggctgttggagctcgagaggttacaacacatgactattcaaaaggagagacctcggctccagaccacattctgtacccccgcagtaacagagcggccaagctcatccaaagctacccccaaggtcaggcagcccaagctgtgtgactccctgagcctgcagattccctgtgtggacaagtcccaagagaaatcaaagaataatagcgggtcgtgtaagctcgagcagaatgctttaaagcggaattggagcaacgccggaaaataccgctggaactcccgtcctttgtcattgaagtcaagctctaccccaaagcagctgatcgagacttacgacaagaatcctaagtcctccattctcagtccttgtcaggaattgtccttcaagccaaccataggccacactaaccagtccatggtgaaaatggtatccacgcgctgcttgccgtggaggtccccgatgcctgtctcaccaatccccttgaccttcccggagaatcagaaggaagagattaaagcccctaagaggaactttggaaccaaaaagaagctctatagacagaatatcgtgctcaacagaccattcagcattcaaaagctgaactgtctgagcccctccctgatcgcgaaagataagtgctgctctccgatcgagcagaagtag

SEQ ID NO: 54509 - DNA, 978 bp, Artificial Sequence
  Description of Artificial Sequence: Synthetic coding sequence
atgcagggtagggttgcgggtagttgcgcaccactcggactgctccttgtgtgtctccacctgccgggattattcgctcgctctatcggagtcgtagaagagaaggtgagccaaaattttgggaccgacctgcctcagctcggccaaccttcatctacaggaccttctaattccgaacatcctcagccagccctcgaccccagatccaatgacctagctcgtgtgcctctcaaacttagcgtccctccaagcgacggctttccccctgccggaggaagtgccgtgcagaggtggccgcctagttggggactgcctgctatggacagctggccacctgaggatccctggcaaatgatggccgctgccgctgaagataggttaggagaggcattacccgaagaattgtcatacttgtccagtgccgctgccctggctcccggaagcgggcctctgccaggggaatcatctccagacgccacgggtttaagtcctgaagcatctttgctccatcaggatagcgaatcccgccgtctacccagatccaactctctgggcgctggaggcaaaatcctatcccagcggccaccttggtccttaatccaccgcgtgctacctgatcacccatgggggactctcaaccctagtgtgtcttggggcggaggcggtcccggaactgggtgggggacaagacctatgcctcaccccgaaggaatttggggcataaacaatcagcctcccggaacatcttggggtaacataaaccgctaccccggtggttcctggggtaacattaatcggtaccccggtgggagctggggaaatataaaccgttatccaggtgggtcctggggtaatatccacttgtatcctggcattaataatccattccctcccggtgtgctgcgcccaccgggttcaagttggaacatcccagccggatttccaaacccgccatctcccagattgcagtggggatag

SEQ ID NO: 54510 - DNA, 978 bp, Artificial Sequence
  Description of Artificial Sequence: Synthetic coding sequence
atgcagggacgtgtagcgggatcatgcgctcccctggggttgttgctggtctgcctgcatttaccaggcctcttcgctcgaagcatcggtgtcgttgaggaaaaagtcagccagaacttcggaactaacctcccccagttgggtcagcctagcagtaccggcccaagcaactccgaacatccccagcctgcgttggacccccgatcaaatgatttggcacgtgtgccgttaaagctgagtgtgccaccttctgacggttttccgccagccggaggctcagcagtccagcgttggcctcctagctggggcctccccgctatggactcctggcctccagaagatccttggcagatgatggctgcggctgctgaggacagactgggtgaggcattgcctgaggagctgtcctatctgtcgtccgccgctgcactggccccaggttctggacccctgccaggtgaatcctctcccgatgccactggactgagtcccgaggccagtttactgcaccaggattccgaatcccggagactgcctcgttccaacagtctaggcgcaggcggtaagatcctgtcccagcggcctccttggagtttgattcatagggtcttaccggaccatccttggggtacgctcaacccaagcgtatcctggggcggtggcggtccagggaccggctggggcactcggccaatgcctcatcctgaaggcatttggggcatcaataaccagccaccaggcactagctgggggaatatcaaccggtatccgggaggttcctgggggaacatcaacaggtatcccggagggtcatgggggaacatcaatcggtatccaggcggtagctggggaaacatccacctgtaccccggaattaataatccattccctcccggagtgcttaggcctcccggatcatcttggaacattccggcaggcttcccaaaccctcccagtccacgactgcagtgggggtag

SEQ ID NO: 54511 - DNA, 612 bp, Artificial Sequence
  Description of Artificial Sequence: Synthetic coding sequence
atgtaccaaaacatggatgatgagatgaaacgagagcacttagctgccgagcaacgaatggttcatcggatccagcggattatgatggagtgccatcgggagaaagtggaggcagttgagaaggcacgagccgaggaacggcacattgcccaagaggcaatccaggcccagaaatcaaaggcagtcgaagagatcgtcaacaccggcgtgaccgtgatcaaagatgagaagacttcagtagctcggcttatgcgagaaaaagagcacgagatgtccatcctgtacggcattgcccaaagacagcggcaggaagaagtgcaggaagtgcttcaggaagcggagaagacccatcaggccactctcggcaacatgatggataagctggccaatacccagggtgaattactgtccatcgccaagcagctcggcatcatgacaaactggaaggatttcctggaggaagaactccaagaaacgcgtatggcctttcagaaatatataaattacaccttccccaaattaagtccgggacacgcagacttcattctgccggaacgaaaaaaaacaccatcaaacctggtgattaaagaaaataagacaacccttgattag

SEQ ID NO: 54512 - DNA, 990 bp, Artificial Sequence
  Description of Artificial Sequence: Synthetic coding sequence
atgatccgcaacagcgactataagaatttcgtgtgctgcgctgtatgcaacaaaataatcccgccagccccttttggaaaaactttcaaaagaatccacgaatataaaccactgaaaaccaggttttatactcacaaggatatccttgacataggagcgaatatcctcaaaaaagaggagcagtttcaggaggatattctgcgggaacacatcgcgaaggcagaagctgaagtctgggcgcaggccaatgagcgccagaaacaagccgtcgagaaggccctcgaggaagccaatgaccgtcacaaaatagagatacagatactaaaggaagaacaccagaaagacctgcaggaagtcacagccaagactaagaccgagatgtatcagaatatggacgacgagatgaagcgcgagcatctggccgctgagcaacggatggtccatcgtattcagcgaatcatgatggaatgtcaccgcgaaaaggttgaagccgtggagaaagccagggccgaggaaagacatattgcccaggaagccatacaggctcagaaatccaaagctgtggaggaaatcgtaaataccggggttactgtcattaaggatgagaagacctcagtggctcgcctgatgcgggaaaaggagcacgagatgtccattctttacggcattgcccaaaggcagcgccaagaggaagtgcaggaagtgctccaagaggctgaaaaaacccaccaggcaaccttgggaaatatgatggataaactggccaatacccagggggaactgctcagcatagctaagcagctcggaataatgaccaactggaaggacttcttagaagaggagcttcaggagactagaatggcattccagaaatacatcaactacacgttccccaaactgtcccccggacacgccgatttcattctgcctgagcgcaaaaagaccccgtcaaatctcgtgataaaagagaataagacgacattggactag

SEQ ID NO: 54513 - DNA, 231 bp, Artificial Sequence
  Description of Artificial Sequence: Synthetic coding sequence
atgtctcatcttcctgcggtcagccccgttttctttcagctgcctgccccacacccccctaccgtcctccggccacagcttgggctccatccaaatcctgagtgcgatcgcgaaaagatgtctgtgcgagatcacgacccggaagtgctcacacgcaactctgcctgtaaaccgcgaggccagctgtctggacacctcttgaagccacgcgctcctctagaggcagcatag

SEQ ID NO: 54514 - DNA, 180 bp, Artificial Sequence
  Description of Artificial Sequence: Synthetic coding sequence
atgtcccacctgcccgctgtaagtccagttttcttccagcttcccgctcctcatcctccaaccgtacttaggcctcagttgggtctgcatccaaaccctgagtgcgacagagagaaaatgtctgtccgcgaccatgacccagaagtcctgactcgtaactccggctccctccaggcttag

SEQ ID NO: 54515 - DNA, 1869 bp, Artificial Sequence
  Description of Artificial Sequence: Synthetic coding sequence
atgccacccacgcaggccgagtcagtgattcggtcaattatccgcgagatagggcaagagtgcgccgctcacggtgaaatagtgtctgaaactctgattgcgtttatggtcaaagccgttgtgctagacccttccaacggatttaatatggatcgcaccctgatgaagtccgacgtacagaacctggtcaagctgtgtatgacacggctcctggacaccaaaaacccaagtttggacacgattaaaatgcaggtgtattttgatatgaattacaccaacagagtggagtttctcgaggagcaccaccgagtgcttgaatcccgccttgggagcgttacccgggaaatcaccgacaatcgcgcttgcgcgaaggaggagctggaatccctatacaggaaaatcatctcctatgtgctgctgagaagcggcctcggatctccaacagatataaagacggtgcgagaggtcaccgctgcgttgcaaagcgtctttccccaagccgagctggggacgtttctgaccctgtctaaaaaggataaagagcggcagctcaaggagctcactatgatcgtgacagggatccggttgtttaatcgggattgcggcaagggcggtgaaggcattgacgacctccctgccgtgttgcatgtagctatccccgctacaatgcagcacatagactaccagcttgagacggcacggtcccaggtttacagatacaccgcaattctggaaaaagcagcaaacgatcccctcatgcgggcagaacttcagccatatatgctcaaagaagctctgtacaacataaggcaatatgaggtgttccttcagattattctctcagatatcattactggggctcaggaagtcgaaatgatgaccaagcaactgggagcccaccttgaacagctgaagatgactattaagtcaaagattgcggttcctacatcccaggtatttcctatatttattgctctgtccacattatggacttcacttcaagacgaaaccatcgtcgtgggtgtgctgtccaacctcttcactcacatccagccctttctgggtgctcatgagttatatttccccgaacgggttatgcagtgccacttgaatggcgcaaccgtcaagactgatgtctgtagaatgaaggaacatatggaagatcgcgtgaacgtcgcagattttaggaagctagaatggttgttcccagaaaccaccgcaaactttgataagctgctaatccagtaccggggtttttgcgcctacacctttgcggctaccgacgggctgctgctcccgggaaatccagccatcggaatcctgaagtacaaggaaaagtattacacattcaactctaaagacgccgcatactcttttgcggagaaccccgagcattacatcgacatagttcgcgagaaggccaagaagaacaccgagctgattcagctcctggagcttcaccaacagttcgaaactttcatcccatactcccagatgcgtgacgcagacaaacattatattaaaccaattactaaatgcgagtcgagcacccagacaaatacccatatacttcctccgaccatcgtgagaagctatgaatggaacgagtgggagttaaggagaaaggctatcaaattggccaacctacgccagaaggtaacacattctgtccagacagatttaagtcatctgcggagggaaaattgctcacaagtgtacccgccaaaggacacatccactcaatcaatgcgagaagacagtaccggcgtgccccgaccccaaatttacctcgcgggactgaggggcggtaaaagtgagattacggacgaagttaaggtcaatctaacacgcgatgtagacgaaacctag

SEQ ID NO: 54516 - DNA, 759 bp, Artificial Sequence
  Description of Artificial Sequence: Synthetic coding sequence
atgcctccgactcaggcagaatctgtgataaggtctatcatacgcgaaatcggtcaggaatgcgcagctcacggagagattgtttctgagacactgatcgctttcatggtgaaagcggtggtacttgatccctctaacggattcaatatggaccggactttaatgaaatccgatgtccagaatctcgtgaagctatgtatgactcgcctcttggacacgaagaacccttcactggacactatcaagatgcaggtctatttcgatatgaattacactaatcgcgtggagttcctagaggaacaccatcgcgttctggaatcgcggctcggctcagtgactagagaaatcaccgacaatagagcctgcgccaaggaggagcttgagtctctgtacagaaagattatttcttacgtccttctccgatctggacttggtagccccacagatatcaaaacggtgagagaggttaccgccgctctgcaaagcgtgttcccgcaggctgaactggggacgtttctgactctttccaagaaggacaaggagaggcaactgaaggagctgaccatgatagtgactggaatccgtctcttcaatcgggactgtgggaaggggggagaaggtattgatgatcttcccgcagtcttacacgttgcaatccccgcaaccatgcaacacatagactaccaactggagacagctagatcacaggtgtatcgttatactgctatccttgaaaaagctgcaaacgatccactctag

SEQ ID NO: 54517 - DNA, 1230 bp, Artificial Sequence
  Description of Artificial Sequence: Synthetic coding sequence
atgcattggggcgtgggctttgcctccagccgcccatgcgtggttgatctgtcatggaatcagagtatatccttttttggctggtgggctggcagcgaggagccgttttccttttatggcgatattatcgccttcccactgcaggactacggcggtattatggccggacttggctcggatccttggtggaagaagactttgtatcttacaggtggtgcactgttggctgccgcagcttacctgctgcacgaattgttggtcatccggaagcagcaggagatagactccaaagacgcaatcatccttcaccaattcgctcggccaaataatggggtgcctagcctaagcccattttgtctcaaaatggaaacctatctccgcatggccgacctgccctaccaaaactacttcgggggaaaactgagcgctcagggcaaaatgccttggattgaatacaaccacgagaaggtgagcggaaccgaattcattattgattttctcgaggaaaaattgggggtcaatctgaataaaaatttggggcctcacgagcgggcaatcagcagggccgtgactaagatggtggaagagcacttttactggaccctggcgtattgccaatgggttgacaacctaaatgagacgcgcaaaatgctgtcactctcaggtggcggacccttcagcaatttattgaggtgggtagtgtgtcatatcaccaagggtatcgttaaaagggaaatgcacggtcacggcataggacgattttcagaggaggaaatctacatgctcatggagaaggacatgcgcagcctagccggattacttggagataaaaagtacattatgggcccaaaactgtccactttggatgcgacggtgttcggccacttagcccaagcaatgtggaccctgcccggaactaggcctgagagactcattaagggtgagctgatcaatctagcaatgtattgcgagagaattagacggaagttctggcctgagtggcaccacgacgatgacaacaccatctacgaatccgaggaaagctctgaaggctctaagactcacacacctctgctggacttctctttctatagtaggaccgaaacctttgaggacgagggagccgaaaactctttcagccgtactcccgacaccgatttcaccggacactctctgttcgacagcgacgtggacatggacgactacactgatcatgagcagtgcaaatag

SEQ ID NO: 54518 - DNA, 390 bp, Artificial Sequence
  Description of Artificial Sequence: Synthetic coding sequence
atgggcccaaagctcagtacactggatgccacagtcttcggacatttggcacaggctatgtggaccttgcctggtacaaggcctgagcgcctgatcaagggcgagttaataaacctagccatgtattgcgagagaatacggagaaaattctggcctgaatggcaccatgacgatgataatactatctacgagagtgaagagtcgagcgaggggtctaagactcacaccccactgctggattttagcttctactcacggactgaaactttcgaagatgagggagccgagaactcgttttcaagaactccagatacagactttaccggccacagtctgtttgactcagacgttgacatggacgactacacagaccatgagcagtgcaagtag

SEQ ID NO: 54519 - DNA, 384 bp, Artificial Sequence
  Description of Artificial Sequence: Synthetic coding sequence
atgatttacccattggaccttttcaggaatataccatggaagcagggtaagtgtttcgcaagcttaagcccagagggtgaaagggcatttgacggtatggaaccactgtgtcaaccgggagctagaccggcactcaggggtctgcagcatgcatctgactgctacagattactatccccgccaggctctggcttggtgggtacaaacccatccgtaccagccccatctcctcattgcggatgttgccaggcatggagcatctcatcctttacttttactggccctacaccattcaagataaattccgatcaggcaactccatgtcacctgcgtagtccagaaacaatattccgacagagggaaatcagcaacgaagcattctag

SEQ ID NO: 54520 - DNA, 432 bp, Artificial Sequence
  Description of Artificial Sequence: Synthetic coding sequence
atggcaagcggtccactggggcctggcgcaagaccaacccgtttgcacccccctttccccccaccagctcacattaagcctggtgctccgcctggagaaaaccctgagctgtctggcctggaaagaatactggccagacaccagctgcccaaggagatcaacctcacccctaaacccaaccgaatgccgccatggaaacggaagatcatcaacaatgtgaccgacggatggaaaaaatgccacttgctcaagcgaaacacaaaagaaccccctatgtccaccattgtcgtgagaaaattaatccagaagaatgtacctcgaagacacagtttgaggaatactagtaggaagctgcggaacctgcctaccaccgccaaaggcacccaaacaggtaaaagccagtgtttgctgggtatctcggagcccacatag

SEQ ID NO: 54521 - DNA, 387 bp, Artificial Sequence
  Description of Artificial Sequence: Synthetic coding sequence
atgctttcaaacttgcatgagctgcttcccaaccacctgatggaaacgctctatagcagaaagtctgaggaagacaaaaaaaaatgcgaaaaccctgaactgtcagggctagaaagaatccttgccaggcatcagttacctaaggagatcaacctcacacctaagccgaatagaatgcccccttggaaacgcaagattattaataacgtgacagatggctggaaaaagtgtcacctgttaaaacgcaatactaaagagccacctatgtctacaattgtcgtcagaaagctgatacaaaagaatgtgcctcggagacactcattaagaaatacgtccagaaagctgcggaatctgcctacaacagcaaagggaacacaaaccgaatag

SEQ ID NO: 54522 - DNA, 591 bp, Artificial Sequence
  Description of Artificial Sequence: Synthetic coding sequence
atgctgtccaacttgcatgagttgttacctaaccacctgatggaaacactgtactctagaaagagcgaggaagataaaaaaaagtgtgaaaatcctgagctcagcggcctcgaaaggattctggctcggcatcagctgccaaaagagatcaatctgacaccaaagcccaaccggatgccgccttggaagcggaaaatcattaacaacgtcacggacggctggaagaaatgccatctgctgaaaagaaacacgaaggaaccaccaatgagtactatcgtcgttcggtggctcaaaaagaatatgcagccaacagaagatttgaaaagtgttatctgtcgcctgagcgccttcggacccatccagtcagctaccgtgtgcggtagacagagcgccatcgtagcctttaaggatatgacgtcagcatgcaacgccgtcagtgccttccagagcaggactccgggaaccatgttccagtgttcttggcagcagcgattcatgagcaaagataaaacctatagtaagaagtgcacccaaaagacccagcccaaagaatacaagcaggagactgagaaacccgctaacaattcatag

SEQ ID NO: 54523 - DNA, 423 bp, Artificial Sequence
  Description of Artificial Sequence: Synthetic coding sequence
atgttgagcaatttgcacgaactattgccaaatcacctcatggagactctgtactctagaaagtccgaggaggataagaaaaaatgtgaaaacccagaactctcaggccttgagcgcatactggccaggcatcagctgccgaaggagataaatctaactcccaaacccaatcggatgcctccgtggaagcggaagattattaataacgtgacagacgggtggaaaaaatgtcatcttttgaagaggaacacaaaggaaccccctatgtcgactatagtcgtccgcaagttgatacaaaagaacgttcccaggcgccactcgctccggaacacatcccgaaagctgcggaaccttcctaccactgccaaaggcacgcagactggtaagagccagtgtctgctggggataagcgaacccacctag

SEQ ID NO: 54524 - DNA, 1326 bp, Artificial Sequence
  Description of Artificial Sequence: Synthetic coding sequence
atggctgttgtccccgctagcctgtccggacaggacgtgggcagctttgcctacctgaccatcaaagacaggatcccccagatcctgactaaggtgatcgacacactgcatcgtcataaatccgaatttttcgaaaagcatggggaggaaggcgttgaggccgagaagaaagccatctccctgctgtccaaactgaggaacgagcttcaaaccgataagcctttcataccactggtagagaaatttgtggatacagacatctggaatcagtatctggagtaccagcagtcacttctgaatgagtcagatggcaagtcacgatggttttacagcccttggcttctcgttgagtgttatatgtatagacgtatacatgaagcgattatccagtctcccccaatagactattttgatgtcttcaaagaaagcaaggagcagaacttctacggctcgcaggaaagcattatcgcactgtgcacccacttgcagcagctaattaggacaattgaggacttagacgagaatcaattgaaggatgagttcttcaagctgctgcagatcagcttatggggaaataagtgtgaccttagtctctctggcggagagtcctcatcccagaataccaacgtgctaaactccctggaagacctgaagcccttcatcttgttaaatgacatggagcacctttggtcactgctaagcaactgtaaaaagactcgggagaaggcgtccgcgactagggtgtatatcgtgctggacaattccggatttgagctggtcactgatctgatcctggccgatttcctgctttcttcggaacttgccacagaagttcacttttacggcaagactatcccttggtttgtctctgacaccacaatacacgacttcaactggctcatcgagcaggtcaaacattccaatcacaagtggatgtctaaatgcggcgcagactgggaagagtacatcaagatgggtaagtgggtgtaccacaatcatatcttttggaccctgccacacgagtattgcgccatgcctcaagttgccccagacctgtatgccgaactgcagaaggctcacctgatcctattcaaaggagaccttaattacaggaaactcacgggagaccgaaagtgggaattcagtgtgccttttcaccaggcactgaacggctttcaccctgcccctctatgtacaatacgaactctgaaggctgaaatccaggtggggttacagccgggacagggggagcagctgcttgcttcagagcctagctggtggacaaccggaaaatacggtatattccaatacgatggacccctatag

SEQ ID NO: 54525 - DNA, 969 bp, Artificial Sequence
  Description of Artificial Sequence: Synthetic coding sequence
atgtatcggaggatccacgaggccattattcaatccccccctattgactatttcgacgtgtttaaggaatcaaaagaacagaacttttacgggtcacaagaaagtattattgccctctgtacccatctgcagcaactaatcagaaccattgaggacctggatgagaaccagctcaaagacgagttttttaaactcctgcagatttctttatggggaaataaatgcgatctctctctgtccgggggtgagagtagttcccagaacacaaacgtgctgaacagcctggaagatctcaagccatttatcctgcttaacgatatggagcatctctggagcctgcttagtaattgtaaaaagacaagagaaaaagcaagcgcgacaagagtttacatcgtgctcgacaacagtggattcgagctggtgacagacttgatccttgcagattttctgttaagctccgagctagcaacggaggtccacttctatggcaaaaccataccctggtttgtctcagacaccaccatccacgactttaactggcttatcgagcaagtaaagcacagcaatcacaaatggatgagcaagtgtggcgctgattgggaggagtacatcaagatgggtaaatgggtttaccacaatcatatcttctggaccctcccacatgagtactgtgccatgcctcaagttgcgcctgacttgtatgctgaactgcaaaaggcccatctgatacttttcaaaggcgacctcaattacaggaagctgacaggcgaccgcaaatgggaattctctgtgccattccatcaggcacttaatggattccaccccgcacctctttgcaccattagaactcttaaagcagaaattcaggtgggccttcagccgggtcagggggaacagctcctggctagtgagccctcttggtggaccacagggaaatacggcattttccaatatgacggccctttatag

SEQ ID NO: 54526 - DNA, 1959 bp, Artificial Sequence
  Description of Artificial Sequence: Synthetic coding sequence
atggagaacccccgatgtcctcgacgcccacttgccgaaaagaaggctagatctctggatcgcccacaggccccaggaaaaggttcagagtcctgggattgtcactggcttagcttaccaaccgctcccagtagaaaagctcttcattggacaacctcagactgggcgaggcattctgacagtcctgcacctagcgccgaagctcactgtaccactgcagcggctccaactcccgaggagaccggtgatttcctgccctcggagcaacggcctagtcaggatactaaaaaggggtggttgaagactatgcttaacttcttcgtgcgtaccggcccagaggaaccacgcgaaaaggccagtagacggcctaggggaaaagaaggaatctctcaacatccagaaccactcgaagccgctggcgaacccgctctaaggaagaaggcgcatcatgataaaaagcctagtcgcaaaaaacaggggcacaaaaagcacgcagcggaggtcacaaaagctgctcaggaccaagaagccagaggacgcgaagagggactcagcaaggcggcagctgcattgaggagcggagaagccgatctaggtccggctcgacggggaggcgaagattcagatcaccagtcattcttgattaaagtcgacggcactggagctctggacgtttctccccacgctaccggacaccagcaggaggaagaactaaaaaagcccgaccaagacgccatcattcagatgatcgttgagttgttgaagcgggttggcgatcagtgggaggaagagcaaagcctagcctctcagttgggagtcgccctccccaaccccgctccagctgtgcggaaaaaaagtcaagagaagaaaaccagccttaaacgaaccagtaagacgaaccccaaaaaacacggcagcgaagaggcaaagcgaggggcagccgacgtgagttccccagaagcctggccacccaagaagtcatcctttcttccgctgtgtgtaagcggtcaccgtccgtccattagtagttcatatggactcgaggagcctaaggttcaggaggcccctagcacagaggctggagcaccgggaccctcagttcttccgacccccagcgagagccaggagcctggtgaggaactgcccctggacagagcgtccgagtacaaagagtttattcaaaagattatctctatgcttcaagacgctgaagaacagcaaggtgaagaacaaccgcaggtacagcaggaggaggtgggggtggaaaacccagcaccccattgtcgcagaaagtcccaggaaaagcggtctagcttccgtagggcattctatcacaagaagcataccagcaaggaacccaggcgcgcaggagctgcgggagccgcaagcccggaagcacggaggccaaagcgcccatcttttcttcctctctgcgtgggtggccacagacctagcacaagcagctctctcgacccagaagatctggagtgtagggagcctctccccgcagaaggggagccagttgtcataagtgaggctcccagccaggcgagaggtcatacccccgaaggtgcaccccaactgtcaggcgcttgcgaatccaaggagatcataatccaaaaactcgtggctctgctgcaggaagtggatggccagctgggacagcagatccgcaggcatccatccttcaaaagattcttttatgaattttctgactcttcgctcagtaagctggtggccacccttcgtagccaggtggcgcactcctccaagttggatagaaaccgcgcacgacgcctttaccagttcgacgtgtcactagccaacaagttcgctggaagcaactctcacgctatgtgtatcctcatggggcttcgagatcattacaattgcactcagtttccatatcgagaggatcaaccaaatataactagccctaaggtggagtcccccgattag

SEQ ID NO: 54527 - DNA, 729 bp, Artificial Sequence
  Description of Artificial Sequence: Synthetic coding sequence
atgatgccgctcgcagaagcgggtgccctggcccaaggcggaggaccttcagcaaccgagtgggcttgcatcctgaggagaaaaacaccacgacataagcaacccactcttttaatggtgcgcgcatcccggagatccggaaaaacatcagcagtccttaaggctggcagacagagcgtctccggcaggaagaattcaacaagcaaagatcttgttaccctgggcgctagcagcctgcgggaagagcgaggacaccccctccatcccaggcatcgcaaggctgtacatctgcggacccggggtagaacccgcggatgggtgcagaccctggctagaatgtcacggcgaactcggggacccgtcgaaagagcggcagctgccgctgccgctgcagctggtggggatgccggacatgccccatttcctcctccacccgcagccgatggtgcacgagcacctcggagtccgggacaagtaacaccgcgagggctgcggctgagactccccaggcgcgagtctctgctcagaggtttatgtagacccttgcggcctttgctgggatttcgggaatcagattccgccaaacctgcaagcttgcgcctactgcagcataccccctctgcacgcagaaactaccgcattgccggtgccagactcatgcggtccaattatccaccaccccttagttcagccgctctcaggggggctggtcctactcggcgaaattag

SEQ ID NO: 54528 - DNA, 318 bp, Artificial Sequence
  Description of Artificial Sequence: Synthetic coding sequence
atgatgcccctggccgaagccggagctttggcgcaggggggtggacctagcgcaaccgaatgggcatgtattttgcggaggcttcttagaaaagagggagtggacggcggtctgttcagccccgaagatcctcaagcacaagctgcccatctgacagacggacagtccatccagaaaaagtggcaggatttctcatgccctcaaagcagaaaaaccgaatgcttctggcaaaaggagcagcacaagcagcggtctggaaacccgaggtgcctgcagttcgaggggggagagagaacccccccaccccctcagacgtag

SEQ ID NO: 54529 - DNA, 243 bp, Artificial Sequence
  Description of Artificial Sequence: Synthetic coding sequence
atgccttttcagttcggaactcagcctcgccgattccccgtggaaggcggagactcctctatagagctggagcccggattgtctagcagcgcagcttgcaatggaaaggagatgagtccaactcgccaactcagaagatgccccggttcgcactgcctaacaatcacagacgtgcccgtcacagtttacgctacgactcggaagcccccagcccagagttccaaagagatgcatccaaagtag

SEQ ID NO: 54530 - DNA, 306 bp, Artificial Sequence
  Description of Artificial Sequence: Synthetic coding sequence
atggagcgcccacggtcccctcagtgctccgctccggcatccgcatccgcatctgttacactcgcccagttgctgcagcttgttcagcaggggcaggagctgcctgggctcgaaaagcggcacatagcagccatacacggagagcctaccgccagcaggctacccaggcgacctaaaccatgggaggcggctgctcttgccgaatcgctgcctcctccgacactgcgaatcgggaccgctcccgctgagcctggcctggtcgaagctgccactgccccatcttcatggcacacggtgggtccctag

SEQ ID NO: 54531 - DNA, 276 bp, Artificial Sequence
  Description of Artificial Sequence: Synthetic coding sequence
atgtggcacagtgtggggctcaccctcctcgtcttcgtagccaccctgctgattgtcctcctgctgatggtctgtggttggtacttcgtatggcacctcttcctgagtaagttcaagtttttacgggaactggtgggggatactggatcacaggaaggcgatcacgaaccctctgggtcagagaccgaagaggataccagtagcagtccccatcgcattcgcagcgctcgtcaacgtagggcaccagctgacgagggacaccgtcctctgacctag

SEQ ID NO: 54532 - DNA, 582 bp, Artificial Sequence
  Description of Artificial Sequence: Synthetic coding sequence
atggccgttttcctgcagttactgcccctgctgttatcaagggcgcaaggaaatccaggggcatcattggatggccgtcctggggaccgggtgaacctctcctgcgggggagtgagccatcccatacgctgggtttgggctccttcgtttcccgcatgtaaaggcctgtccaaaggtcggaggccaatactttgggcgagcagttccggtaccccgaccgtcccccctctgcaaccctttgtcggtagattgcgatctctcgactctgggattaggcgtctggagcttctcctgtctgccggagatagcggcacattcttttgcaaaggcaggcacgaggatgagtcccgtaccgttctccatgttctgggcgacaggacctattgcaaagcgcctgggcctacccacgctctgtcccccccacacagttctacttgtgaaaaccgggctcccgaggccagcaaaggcggacgcgctcaggatagccggggacctggcccaggtacggagcccgcactgtgtggatccggaccttcctccccccaacaagcaccgcctgccgtccacagcggtccctgctag

SEQ ID NO: 54533 - DNA, 594 bp, Artificial Sequence
  Description of Artificial Sequence: Synthetic coding sequence
atggctgtctttctgcaattattgcctctactactgtccagagcccagggtaaccctggcgcttcactggatggcagaccaggcgacagggtgaacctgtcctgcggaggggtgagccatccaattcgctgggtgtgggccccaagcttcccagcctgtaagggactctccaagggcagacgaccaatactctgggccagctctagcggaacccccactgttccacccttacaacctttcgtgggcagactgcggtctctggacagtgggatacggcgactcgagctgctcttatctgcgggagactccggcactttcttctgcaaaggccgtcatgaagatgagagcagaaccgtacttcacgtgctgggggacagaacatactgtaaggctccaggacctacacacgctcctttggttaagacagaaccccaacgcccagtaaaagaagaagagccaaagatacctggcgatctcgaccaggagccttcgcttttatacgcagatctggaccaccttgcactgtctagaccaagaagattgtctactgctgaccccgcagacgcatctactatctacgccgtggtggtatag

SEQ ID NO: 54534 - DNA, 714 bp, Artificial Sequence
  Description of Artificial Sequence: Synthetic coding sequence
atggccgttttcctacagctcctgcccctgctgctttctagggcacagggtaatcctggagcttctctggatgggcgacccggtgaccgagttaatctgagctgtggcggagtgtctcacccaataagatgggtgtgggccccttcgttcccggcatgtaagggactgagcaaagggaggaggcccattttgtgggcctcctctagtggtacaccgaccgtgccccctctccaaccttttgttgggaggctgcgcagtttggactcaggaattcggagattagagctgctgttgtcggcaggggattctggcacattcttttgcaagggcaggcacgaggatgagagcagaacggttcttcatgtcctcggggatcgcacctactgtaaagccccaggccctacacacggatccgtgtatccccagctgctcatcccacttcttggggctggcttagtcctgggtttgggggctctcggcctggtgtggtggctgcacaggagactccctccccagcctattggacccttacccaggttcgccctcagccccccacacagcagcacttgcgagaatagggctccggaagcgagtaagggtggcagagcacaggactctcggggacccggaccgggtactgaacctgcgctatgtggttcagggccatcgtcccctcaacaggccccacctgccgtccatagtggcccatgttag

SEQ ID NO: 54535 - DNA, 726 bp, Artificial Sequence
  Description of Artificial Sequence: Synthetic coding sequence
atggctgtcttcctgcagttactcccactgctcctgagtcgcgcacagggaaatcccggagcctctctcgacggccgtcccggagacagagtcaacctaagctgcggaggcgtaagccatccgattaggtgggtctgggcgccttcatttcctgcttgtaaaggacttagcaagggtagaagaccaatcctgtgggccagttcctccggaactccaactgttcctcctcttcaacccttcgtgggacgccttcggtcactagactctggcatccgacggctggagctcctgctgtctgccggtgactcaggtaccttcttttgtaagggaagacacgaagacgagtctcgcactgtgctgcatgtgttaggcgacagaacgtactgcaaagcaccgggtcctacccatggaagtgtgtaccctcagctgctgatcccacttttgggcgcaggcctcgtattaggcctgggagctctcggcctggtgtggtggctgcaccggagattgcccccacagccaataggccctctcccccgattcgctcctttggtgaaaactgaaccccagagacctgtaaaagaagaggaacctaagattcccggtgatttggaccaggaacctagccttctctatgccgacctggaccacctggcactcagccggccaagacgcctttcaacagccgatccggctgatgcctccaccatctatgcagttgtggtctag

SEQ ID NO: 54536 - DNA, 654 bp, Artificial Sequence
  Description of Artificial Sequence: Synthetic coding sequence
atggccgtgtttcttcagttgctccctcttctgctcagtagggctcagggaaaccctggggctagtctggatggcaggccgggagatcgcgtgaacctcagctgcggaggcgtttcccaccctattcgatgggtctgggctccatcctttccagcttgcaaaggccttagcaaagggagacgcccaattttgtgggcgtcctcctctggaaccccgacggtgcctccacttcagccatttgtgggcaggttgagatccctggacagtggaatacggagattggagttactcttgtctgcgggtgactcagggacatttttctgtaaggggaggcacgaggacgagtcaaggaccgtgctccacgtcctcggtgatagaacttactgtaaggccccagggccaactcatggcgcatgtcctcgtaaccgcttagaccactctctggacctgctttgtccaccacacatagctcccctcgtgaaaactgagccacagcggcctgtcaaggaggaggaacctaagatcccgggagatttagaccaggaaccgtctttgctttatgccgacttggatcatctggccctgtcccggccacggcgacttagcaccgcggatcccgctgatgcctccaccatatatgcggtcgtggtgtag

SEQ ID NO: 54537 - DNA, 885 bp, Artificial Sequence
  Description of Artificial Sequence: Synthetic coding sequence
atgttcttgcgtaggcttggaggctggctgcccaggccatggggacgtcggaaacctatgaggcccgacccaccttaccccgaaccgagacgcgtggattcctctagcgaaaatagcggctccgattgggactccgcccctgaaactatggaggatgtcggccacccaaagaccaaggattccggcgctctacgggtatcacgcgcagcatccgagccatcaaaggaagagccccaggtagaacaactgggtagcaagcggatggattctctgaagtgggatcagccgatctcatcgactcaagagtcaggccgtctggaagccggaggcgctagtcctaagttgcggtgggatcatgttgactctgggggtaccagacggcctggtgtatctccggaggggggattgtccgtcccgggaccaggggctcccctggaaaagcccggtcgtcgggaaaaactgctgggatggttacggggtgaaccaggcgctccgtctcggtacttgggagggccagaggagtgcctgcaaatatccaccaacttgaccctccaccttcttgaactcctcgcatcagcgctccttgccttgtgctcgcgccctttacgtgccgcattggatactctggggctacggggaccattggggctgtggctgcatggacttctgtcattcctcgcggcactgcacggcctgcatgccgttttaagcctcctgacagctcacccccttcattttgcatgtttattcggactcctacaggctctagtcttggccgtctccctacgggagcccaatggggatgaggcggcaacagattgggagtccgagggtctggagagagaaggagaggagcagagaggcgaccctggtaagggcttgtag

SEQ ID NO: 54538 - DNA, 885 bp, Artificial Sequence
  Description of Artificial Sequence: Synthetic coding sequence
atgtttctgcgaagattaggcggatggctgccccgaccttgggggaggagaaagccaatgcgccctgaccccccttacccagagccacgtagagtggattcatcatccgagaattccggtagcgactgggactctgctcctgagacaatggaagacgtggggcaccctaagactaaagacagcggagcccttagggttagtagggccgcatcggagccttcaaaagaggagcctcaggtcgaacagcttggcagcaaacgaatggattcccttaagtgggatcaacccattagcagcactcaggaatcaggacgcctggaagccggaggtgcatccccaaaactgcggtgggaccacgtagacagtggcggtactcgcagaccaggcgtctcacctgaagggggtctgtccgtgccaggcccaggagccccactagaaaagccgggtcgcagggaaaagttgctgggatggttacgcggagagcctggggcaccctcaagatatctgggaggcccagaagaatgccttcagatttcaacaaatctgacccttcatctcttagagctcttagccagcgccctgctcgcgctgtgctctcgcccattacgggcagccttggatactctcggccttagagggcctctcggtctgtggctccacggtctgctctccttcctcgctgcgctccacggcttgcatgcagtcctgtcactgctcactgctcacccactgcactttgcttgcctgtttggcctcctgcaggcattggtgttggcggtttctttgcgagaacctaatggagatgaggccgctactgactgggaatccgaaggtctggaaagagagggagaggagcaacggggagaccctggaaagggattgtag

SEQ ID NO: 54539 - DNA, 885 bp, Artificial Sequence
  Description of Artificial Sequence: Synthetic coding sequence
atgtttcttcgaaggctcggcggatggctaccccgaccatggggacgcagaaagcctatgagaccagatcccccttaccccgagccaaggagagtggactcaagcagcgaaaactctgggtcagattgggactcagcacccgaaaccatggaggacgtgggccaccctaagacgaaagatagcggcgctttacgtgtctctggtgccgctagcgaaccttccaaagaggaaccgcaggttgagcagctcgggagtaagaggatggattccctgaagtgggaccagccaatttcctccactcaggagtctggtcggcttgaggctggcggagccagcccaaaattaagatgggatcacgtagactccgggggtacaaggcgccctggcgtgagtcccgagggtggcctgtctgtccccggaccaggagcaccgctcgagaagcctggacgcagggaaaaactcctgggctggttacggggagagcctggagcgcctagccgatatctgggaggaccggaagagtgtctacagatctccacaaatctcacactgcacctgttagagctcctggccagcgccctactggctctgtgctcccggccactgagggccgctttggatacattaggactaagagggcctcttgggctgtggctccacggcctgttgtctttcctggctgcgcttcatggactccacgctgtgctctccctgctgactgcccaccctttgcatttcgcatgtctctttggcctgctgcaggcacttgtcctggccgtatccctgagagagccaaacggagatgaagcagcaaccgattgggaaagcgaaggtctggagagggaaggagaggagcaacgcggtgacccagggaagggtctgtag

SEQ ID NO: 54540 - DNA, 885 bp, Artificial Sequence
  Description of Artificial Sequence: Synthetic coding sequence
atgttcttacggagactgggaggttggctgccgagaccatggggcagacggaagcccatgagacccgatcctccctatcctgaaccccgtcgcgtcgatagtagtagcgaaaactccggatctgactgggattccgctcctgaaaccatggaagatgtggggcatcctaaaactaaggatagcggggctctgcgggttagccgagccgcatccgaaccttctaaagaggagcctcaggtggagcagctgggttcaaagcggatggattctctgaagtgggaccagccgatatcgtcaacacaggaatccggaagactcgaggccggtggcgctagcccaaaactccggtgggaccacgtcgatagtggcggaacccgaaggcccggagtgtcacctgaagggggactgtcagtgccgggtcctggcgctcccttggagaagccaggcagacgggagaagctgttaggctggctccggggagaacctggggcaccttcaagatacttggggggtcccgaggagtgcctccaaatcagcacgaacctgacactgcacctcctggagctgctggcgtccgcattactagctctgtgctcacggcctctgagggcagcactggacacactcggccttcgcggaccactggggttatggctgcacggcctgctcagttttttggctgcactgcatggcctgcatgctgttctgtccttgctgacggcacaccccttgcatttcgcttgtttgttcggcctgctgcaggcactagtcttagccgtatcactccgggagccgaatggcgatgaggcggctacagactgggaatcagaaggcttagagagagagggcgaagagcagagaggagaccctgggaaggggctctag

SEQ ID NO: 54541 - DNA, 885 bp, Artificial Sequence
  Description of Artificial Sequence: Synthetic coding sequence
atgttcctgcgccgattaggaggatggcttcccaggccttgggggagacgtaaacccatgcggccagatcccccttatcctgagcccagaagagtggatagttcaagtgaaaactcaggatctgattgggacagcgcccctgaaacaatggaagacgtgggtcaccctaaaacaaaggacagcggcgcacttcgggtgagcagggccgcatccgaaccctctaaggaggaaccgcaagttgagcagttggggtccaaaaggatggacagccttaaatgggatcagcccatctctagcacccaagaatcgggaagactggaggccggaggggcttcacccaaactgcggtgggaccacgtggatagtggcggtaccaggagacctggggtgtcacccgaagggggtctttccgtccccggacccggagcaccgctggagaaacccggtagacgcgagaagcttctgggatggctgcgcggtgagccaggagcacccagtaggtaccttgggggacctgaagaatgcctccagatatccactaatctgaccctacacttactggaactgcttgcttcagctctgctggccctatgctctcgccctctgcgtgcggcactggatacactgggacttcgtggtccgctgggtctgtggctacatggattactgtctttcctggcagctctgcatggtttacacgccgtgctgtcactgttaactgcacaccctctgcacttcgcttgcctgttcggcttgctccaggccttagtgctggccgttagcctgcgtgagcctaacggggacgaggccgctacggattgggagtcagaaggactcgagcgggagggcgaagagcagcggggtgaccctgggaagggactgtag

SEQ ID NO: 54542 - DNA, 885 bp, Artificial Sequence
  Description of Artificial Sequence: Synthetic coding sequence
atgttcctgagaaggctgggcggttggctcccaaggccatggggcagaagaaagccgatgcggccagaccctccttaccctgaacctagacgtgtagatagttcaagcgaaaactccgggtcagactgggattccgcacccgaaacaatggaggacgtaggacaccccaaaactaaggattccggcgctttaagggtaagtcgcgctgccagtgaacctagcaaagaggaacctcaggtagagcaactgggcagcaagaggatggactccctgaaatgggaccagcccatctcctccacacaggaatccggccgactcgaagccggtggcgcatctcctaagctgcgatgggatcacgtcgatagcggagggacccgcaggccaggcgtatcacctgaggggggactatccgtccctggacctggcgctcccctggaaaaacctgggagacgggagaaactactgggctggctcaggggcgaacccggagctccaagtcggtatctgggaggaccagaggaatgtctgcagatcagcactaatcttacactgcatcttctggaacttctggcctcagccttgttggctctctgctcacgccctcttagggcagctcttgacaccctgggactgcgaggccctctggggctgtggctgcatggactactgtcattcctggcggctttacacggtctacacgcagtgctttcactcctcactgcccaccccctgcatttcgcctgccttttcggcctcctccaggcgttagtgctggccgtttcactgagggagcccaacggcgacgaagcagccacagactgggagtctgagggcctggagcgtgaaggggaggaacaacggggagatcctggtaaaggactgtag

SEQ ID NO: 54543 - DNA, 885 bp, Artificial Sequence
  Description of Artificial Sequence: Synthetic coding sequence
atgttcctgcggaggctgggtggctggctgccacgcccatgggggaggcggaaaccaatgaggccagatccgccatatcctgagccgcgacgcgtagactccagcagtgagaacagcggaagtgattgggattcagccccagaaactatggaagatgtgggacatcccaaaaccaaagacagcggggctctccgcgttagcggagcggcaagtgagccttccaaggaggagcctcaggtggaacagcttggaagtaagaggatggatagtttaaagtgggaccagccaatctcatctacacaggagtccggacgcctcgaagccggtggtgcttcccctaaactcagatgggaccacgtcgacagcgggggaacaaggagacctggagtttctccagagggaggcctttccgtaccaggacccggtgcacccctcgaaaaacccggaagacgcgaaaaattactcggctggctcaggggcgagcccggagcaccctcacgatatctaggcggtcccgaggagtgcttacagatctcgaccaacctgacattacatttgcttgagctgctggcaagcgctttactagcactgtgcagcagacccctacgggctgcgctggataccctgggtttgcggggacccctgggtctgtggctgcacggcctcctgtcctttttggcagcactgcacggcctgcatgctgtgctttccctactgacagcgcacccattacatttcgcctgtctgttcggactgctgcaggccctggtgttggccgtgagcttgcgcgaacctaatggggatgaggctgcaaccgactgggaatctgaagggctcgaaagagagggagaagaacagcgcggagatccaggaaagggcctgtag

SEQ ID NO: 54544 - DNA, 936 bp, Artificial Sequence
  Description of Artificial Sequence: Synthetic coding sequence
atgttcctgaggagactcggcggatggctgcctcgaccttggggtaggcgcaaaccaatgaggcctgaccctccctacccagagccccgtcgagtagattcttcttctgaaaactccgggagcgactgggacagtgccccagaaacaatggaggacgtggggcatcccaagactaaggattctggcgcactaagggtttccggagcggcttctgagccaagcaaagaggaaccccaagtggagcagctggggtctaagagaatggatagcctgaagtgggatcagccaattagttctactcaggagagcggcagactcgaggctggaggcgcatcccctaagcttaggtgggaccacgtggatagcggcggaacccgcagaccaggcgtgtctcccgagggagggctatccgtgcctggacctggagcacctttggagaagcctgggagacgggaaaaactcctgggctggcttaggggggagcctggggctccatccagatacctcgggggtccggaggagtgcttacagatatcaacaaatctcacactgcatctactcgagctccttgcatcggcactattggcactctgttcacggccactgagggctgcactggataccctgggcctgcgcggtcccctggggttatggctgcacggcctgctgtcttttctcgccgcactgcacgggttacacgccgtcctgtcgcttctgaccgctcatccactacattttgcgtgcctgttcggcctgcttcaggcgctcgtcctcgccgttagtggttcacccatgggtatgagaagaccactgactggcagagtgcgtggatggaggggtaaagtgcgatcaagaggagaaacccgcgagaggggctgcgataggggcgtgggtgccaaaggagaggaaagcgtggggttcagacgaaaggtatag

SEQ ID NO: 54545 - DNA, 228 bp, Artificial Sequence
  Description of Artificial Sequence: Synthetic coding sequence
atggagaggtcattcgtttggctgagttgtcttgactccgatagttgtaatttgacatttcggttgggggaagtcgagagccacgcttgctccccatctctgctgtggaacctgttgactcagtatctccccccaggtgcgggacacattctgcgtacctataatttcccggtgttaagctgcgtgtcttcctgccatttgatcgggggaaagatgccagaaaattag

SEQ ID NO: 54546 - DNA, 228 bp, Artificial Sequence
  Description of Artificial Sequence: Synthetic coding sequence
atggaacgttcatttgtctggctttcttgcctggattcagattcgtgtaatctgactttccgtctcggagaggttgagtcccacgcgtgcagcccatcactgctgtggaatctgctcactcagtatttgccacctggtgccggacacatactgcgaacatataattttcccgtcctgtcgtgcgtctcctcttgccatctgatcggaggaaagatgcctgagaactag

SEQ ID NO: 54547 - DNA, 378 bp, Artificial Sequence
  Description of Artificial Sequence: Synthetic coding sequence
atgcgcgtggtgatggcacgcctgctgtcggaaggcgaacaggggattcccacagcctgtgctgcttttgcacagcagcccgctggaccccgacgaggacttgctggggtgggggagggcggaccacagtgcagttgggtcaactaccgatgtactctggagtttctagtgtctctgctaggaaccgatctagccaggggcagaggaaatagcgcctctgggcctactgccccagccgattctaagcagcttatgaacagcggtagccccgctcgggataacgccccatcacagcggttctgcaccaacttatccgagggactgcggtttggtatttcacctagctggcgcgaggcactgtacggatgccatgcttag

SEQ ID NO: 54548 - DNA, 228 bp, Artificial Sequence
  Description of Artificial Sequence: Synthetic coding sequence
atggaacgtagcttcgtgtggctgtcctgtctagacagcgactcgtgcaatcttacatttagactaggcgaagtggagtcacacgcctgcagtccctcactcctctggaacttgttaactcaatatttgcctcccggagctggacacattctgcggacttacaactttcccgtcctatcgtgcgtctcctcgtgccatttgatcgggggtaaaatgccagaaaactag

SEQ ID NO: 54549 - DNA, 228 bp, Artificial Sequence
  Description of Artificial Sequence: Synthetic coding sequence
atggagcggagtttcgtgtggcttagttgccttgacagtgatagctgtaacctcacgtttagactgggggaggtcgagagccacgcctgttcaccttcgctgctgtggaacttgctcactcaataccttccacctggcgctggacacatcttgcgaacatataatttcccagtactctcctgcgtctcttcctgtcacctgatcgggggtaaaatgccagagaactag

SEQ ID NO: 54550 - DNA, 228 bp, Artificial Sequence
  Description of Artificial Sequence: Synthetic coding sequence
atggagagaagtttcgtgtggctgagctgtcttgattcagattcctgcaatttgacttttcggctaggggaggtcgaaagccatgcgtgttccccatctctattgtggaatctgctgacacagtatctgcccccaggcgcaggccacatactccgtacttataattttccggtgctgtcttgtgtgtcctcatgccatctcataggtggaaagatgcccgagaactag

SEQ ID NO: 54551 - DNA, 228 bp, Artificial Sequence
  Description of Artificial Sequence: Synthetic coding sequence
atggagagatcgttcgtgtggctgagctgtctcgactctgactcttgcaacctgacatttcgccttggagaggtggaatcgcatgcttgcagtcctagcctgctttggaatttgctgacccagtacttaccacctggtgcaggtcatatcctccgtacatataacttccctgtcctcagctgcgtatcttcttgtcatttgattggaggcaagatgcccgaaaattag

SEQ ID NO: 54552 - DNA, 228 bp, Artificial Sequence
  Description of Artificial Sequence: Synthetic coding sequence
atggaacgtagcttcgtgtggctgtcctgcctcgattccgattcatgcaacctaacatttaggcttggagaggtggagtctcacgcatgttccccttcattgctgtggaatctccttactcagtatctccctccaggggctgggcatatactgagaacgtataactttcctgtcctgtcgtgtgtgagtagctgccacctgatcggaggcaagatgccagaaaactag

SEQ ID NO: 54553 - DNA, 228 bp, Artificial Sequence
  Description of Artificial Sequence: Synthetic coding sequence
atggaaagatcgtttgtttggctgagttgtttggattccgatagctgcaatctgacattcaggttaggagaagtggaatcccacgcttgctcacctagcttactttggaaccttttgacgcagtatctaccacctggtgcaggccacatcctcaggacctacaactttcctgtcctcagttgtgtcagctcgtgccacctcattggcggtaaaatgcccgagaactag

SEQ ID NO: 54554 - DNA, 228 bp, Artificial Sequence
  Description of Artificial Sequence: Synthetic coding sequence
atggagcgttcattcgtctggctgtcatgtcttgattccgactcatgcaatctgactttccgcttgggagaagtagaaagccacgcctgttccccctcactcctgtggaacctgttgactcaatatctgccaccaggcgctggccatatcttaagaacttacaactttccagtgctgtcatgtgtgtccagctgtcacctgattggcggtaagatgccagagaattag

SEQ ID NO: 54555 - DNA, 228 bp, Artificial Sequence
  Description of Artificial Sequence: Synthetic coding sequence
atggagcgctcctttgtgtggctgtcctgtctggattcagatagctgtaatcttaccttcaggctgggcgaggtggaatctcatgcctgctctccttcccttctatggaaccttctcacacagtacctgcctcccggagccggtcacattcttcgtacctataactttccagtccttagttgtgtgtcatcatgccatctgatcggaggaaagatgccggagaactag

SEQ ID NO: 54556 - DNA, 228 bp, Artificial Sequence
  Description of Artificial Sequence: Synthetic coding sequence
atggaacgtagcttcgtgtggcttagctgtctcgactctgatagctgtaacctcacattccggctcggggaggtggagagtcatgcatgcagcccttcccttctgtggaacctcttaacacagtatcttccacctggcgctggacacattcttcggacttacaactttcctgtattgtcttgtgtgtcctcgtgccatctaataggcggtaagatgccggagaactag

SEQ ID NO: 54557 - DNA, 228 bp, Artificial Sequence
  Description of Artificial Sequence: Synthetic coding sequence
atggagcgctccttcgtgtggctcagttgcctcgacagcgatagctgcaacttgacattccgattgggagaggtggaatcccatgcctgttctccttccctgctctggaatctgctgacccagtacttaccccctggggcaggtcatatcctaaggacttacaatttccccgtgctgagttgcgtatcatcatgccacctcattggtgggaaaatgccagagaattag

SEQ ID NO: 54558 - DNA, 228 bp, Artificial Sequence
  Description of Artificial Sequence: Synthetic coding sequence
atggagaggtcgttcgtgtggctctcatgcctggacagcgatagctgtaatttgacatttcggttgggtgaagtcgagtcccacgcctgtagcccgagcttgctgtggaacctgttaacgcagtacttgcctcccggtgctggccacattctacgaacctacaactttcctgtcttgtcctgcgtgtcatcttgccacttgatcggtgggaagatgcccgagaattag

SEQ ID NO: 54559 - DNA, 228 bp, Artificial Sequence
  Description of Artificial Sequence: Synthetic coding sequence
atggagaggtccttcgtctggctatcttgcctggacagtgattcctgtaacctcacatttagattgggagaggtcgagtctcacgcttgctccccgagtcttctgtggaatctcctcacccaataccttcccccaggagcaggacatattctgcgaacctacaacttcccggtgctgagctgcgtgagctcgtgtcacttgattggtggaaaaatgcctgagaactag

SEQ ID NO: 54560 - DNA, 228 bp, Artificial Sequence
  Description of Artificial Sequence: Synthetic coding sequence
atggagcgtagttttgtatggctgtcttgcctggactctgactcttgcaaccttacctttcgcctgggggaagtggagtcacatgcctgttcccccagcctgctgtggaacctgctaactcagtatttaccacccggagcgggacacattttacgcacttacaatttcccagttctctcatgtgttagttcatgtcacttgatcggcggaaaaatgcccgagaactag

SEQ ID NO: 54561 - DNA, 228 bp, Artificial Sequence
  Description of Artificial Sequence: Synthetic coding sequence
atggagcggagcttcgtatggctaagctgcctggacagcgatagctgcaatctgactttcaggctgggagaagtagaaagtcacgcctgtagcccatccctgttgtggaatctgctcactcagtatctgccacccggagccggacatattctgcgtacctacaactttccagtcctgtcctgtgtttcaagctgccacctgatcggtggcaagatgccagagaactag

SEQ ID NO: 54562 - DNA, 228 bp, Artificial Sequence
  Description of Artificial Sequence: Synthetic coding sequence
atggaacggtcttttgtgtggctgtcctgtctcgacagcgattcgtgcaacctcacgtttcgtttgggagaagtcgaatcccacgcttgcagcccaagtttgctttggaatctgctaacacagtacctgccacctggagcaggccacatcctgagaacttacaacttcccagttttgagctgcgtgtcttcatgtcatctcattgggggaaagatgcccgagaactag

SEQ ID NO: 54563 - DNA, 228 bp, Artificial Sequence
  Description of Artificial Sequence: Synthetic coding sequence
atggaacgcagtttcgtttggctttcatgtctggactccgacagttgtaatctgaccttccgattaggggaggtagagtcccacgcatgcagccccagtctactgtggaacctcctgacgcagtacctccccccaggagctggccacattttgcgtacctataactttcctgttctaagttgtgtctccagttgtcaccttattggcggaaagatgcccgaaaactag

SEQ ID NO: 54564 - DNA, 228 bp, Artificial Sequence
  Description of Artificial Sequence: Synthetic coding sequence
atggaacgcagctttgtgtggctctcttgtttggattccgactcctgcaatctgacattccgcttaggagaggttgagtcgcacgcttgttctcccagcctgttgtggaacctgctgacccagtatctgccacccggagcagggcatattctacgcacgtacaacttcccagtgctgtcttgtgtttcaagttgtcaccttatcgggggaaagatgccggaaaactag

SEQ ID NO: 54565 - DNA, 228 bp, Artificial Sequence
  Description of Artificial Sequence: Synthetic coding sequence
atggaaagatcttttgtgtggctatcgtgcctggatagcgactcatgcaatctgacattccgactgggagaagtggagtctcatgcctgctctccttcgctcctctggaacttgcttacccagtatttacccccaggcgcaggacacattctcaggacctataatttcccagtgctgagctgtgtttctagttgccatctgatcggcggaaaaatgccggagaactag

SEQ ID NO: 54566 - DNA, 228 bp, Artificial Sequence
  Description of Artificial Sequence: Synthetic coding sequence
atggagcgctccttcgtgtggctctcttgtttggatagcgattcgtgtaatctgacattccgcctgggtgaggtggaaagtcacgcatgctctccatcgctcctttggaatctgctgacacagtatttaccacccggtgcaggccatatcctgagaacttataatttccctgtgctgtcatgtgtcagtagctgtcaccttattggcggaaagatgccggagaactag

SEQ ID NO: 54567 - DNA, 228 bp, Artificial Sequence
  Description of Artificial Sequence: Synthetic coding sequence
atggaacgttccttcgtttggctgagttgcctagatagtgattcctgcaacctcactttcaggctgggcgaggttgagtcacacgcttgttcgcccagcctgctgtggaatcttctgacccaatacttgcctccaggcgctgggcatatacttcggacatataactttccagtgctgtcatgtgtgtcctcctgccatttaatcggaggcaagatgcccgagaattag

SEQ ID NO: 54568 - DNA, 228 bp, Artificial Sequence
  Description of Artificial Sequence: Synthetic coding sequence
atggaacggtcctttgtttggctttcttgcttggattcagattcgtgcaatctgacattccggctaggcgaagtagaaagccacgcttgttccccgtctcttctttggaacctgctaactcagtatcttccacccggtgctggccatatccttcggacttataacttcccggtcttgtcctgcgtctctagctgccacctaataggcggaaagatgcccgaaaactag

SEQ ID NO: 54569 - DNA, 228 bp, Artificial Sequence
  Description of Artificial Sequence: Synthetic coding sequence
atggagcggtctttcgtgtggctgagttgcttggactctgattcgtgcaatttgacatttaggttgggagaagtcgaaagccacgcctgctcgccgtcgctgctgtggaatcttttaacccagtacctacctcctggagccggacacatcctgaggacctacaattttccagtgctgtcgtgcgtgtcctcctgtcacttgattgggggaaagatgcccgagaattag

SEQ ID NO: 54570 - DNA, 228 bp, Artificial Sequence
  Description of Artificial Sequence: Synthetic coding sequence
atggagcgctcctttgtgtggttaagttgccttgacagcgacagctgcaacctgactttcaggctcggggaggttgagtctcacgcctgcagtcctagtctcctttggaatctgctgactcagtacctacctccaggcgctggccacattcttcgcacgtataatttccccgtactttcctgtgtctccagttgtcacctcatcggcggaaagatgcccgagaattag

SEQ ID NO: 54571 - DNA, 228 bp, Artificial Sequence
  Description of Artificial Sequence: Synthetic coding sequence
atggaaagatcattcgtgtggctctcctgtctggacagtgactcctgtaacttaaccttccgactgggggaggtcgagagccacgcttgtagcccgtctctgctgtggaacctcctgacacagtaccttccacccggagcaggccacattttgaggacctataactttccagtcctgtcatgcgtctcatcctgtcatctgatcggaggtaagatgcctgagaactag

SEQ ID NO: 54572 - DNA, 228 bp, Artificial Sequence
  Description of Artificial Sequence: Synthetic coding sequence
atggaaaggtcttttgtgtggttgtcttgcctagactcagactcatgcaatctgacattccgtttgggcgaggtggagtctcacgcatgcagtccctccctgctgtggaatctgctgacccagtacctacccccaggagcgggacacatattgaggacctacaattttcccgtcctgagctgcgtttcctcctgccacctgataggagggaaaatgcccgaaaattag

SEQ ID NO: 54573 - DNA, 228 bp, Artificial Sequence
  Description of Artificial Sequence: Synthetic coding sequence
atggagagatctttcgtgtggctttcttgtctggatagtgattcttgcaacttgacgtttcgcctaggagaggtcgagagccacgcctgttctccttctctgctctggaatctcctgactcaatatctccctcccggagctgggcacatactgcgcacttataactttcccgtcttaagctgcgtgagctcatgtcatctgatcggaggaaaaatgcccgagaattag

SEQ ID NO: 54574 - DNA, 228 bp, Artificial Sequence
  Description of Artificial Sequence: Synthetic coding sequence
atggaacgttcattcgtgtggctgagttgtctagacagtgatagctgcaatctcacgttcaggctcggcgaagtcgaatcacatgcgtgctctccctctttactctggaatcttctgactcagtatctgccccctggcgcaggtcacatcctgaggacttataatttccccgtgttgagctgtgtctcctcatgtcacctgattggaggaaagatgcctgagaattag

SEQ ID NO: 54575 - DNA, 228 bp, Artificial Sequence
  Description of Artificial Sequence: Synthetic coding sequence
atggagaggagttttgtgtggttgagctgtctggatagcgacagctgcaatctaacattcagactgggggaggtggagtcgcatgcttgctcccccagccttctttggaatttacttacccagtacctgccaccgggtgccggacacattctgcggacttataactttcctgtgctctcatgtgtgagctcttgtcacctgataggaggaaagatgcctgagaattag

SEQ ID NO: 54576 - DNA, 228 bp, Artificial Sequence
  Description of Artificial Sequence: Synthetic coding sequence
atggagcggtcatttgtgtggctttcctgtcttgacagtgatagctgtaatctgacatttcgtttgggcgaggtagaatcccacgcatgtagtccatccctattatggaacctgctgactcagtatctcccccctggcgctggacacatccttaggacttataacttccctgtactgtcttgtgtctcttcatgccacttgataggcggaaaaatgcctgagaattag

SEQ ID NO: 54577 - DNA, 228 bp, Artificial Sequence
  Description of Artificial Sequence: Synthetic coding sequence
atggaacggtccttcgtgtggctctcttgcttggacagcgactcttgcaacctaaccttcaggctaggcgaagtggagtctcacgcctgctctccttcgctactttggaatctcctaacacagtacctgccccctggggcaggccacattctccgaacgtacaacttccctgtgctgtcctgcgtgtcatcgtgtcacctgatcggcggtaagatgccggagaactag

SEQ ID NO: 54578 - DNA, 228 bp, Artificial Sequence
  Description of Artificial Sequence: Synthetic coding sequence
atggaacgtagctttgtctggctctcatgtttggactcagactcctgcaacctcacttttcggctcggagaggtcgagtctcacgcctgctccccctcactgctgtggaatctcttgacacagtacttaccacctggagcaggccacatcctgagaacgtacaactttcccgtgctgtcctgcgtgtcctcttgtcacttaatcggcggaaagatgcctgaaaattag

SEQ ID NO: 54579 - DNA, 228 bp, Artificial Sequence
  Description of Artificial Sequence: Synthetic coding sequence
atggagcgttcatttgtgtggctgagctgccttgatagtgacagctgcaacctcactttcagacttggagaggtggaaagtcacgcttgtagccccagcttgttgtggaatctccttacccagtacctgcctccgggtgctggccacattctgcgtacctacaacttcccagtcctttcatgcgtgtcttcctgtcacctgattggcggaaaaatgccagaaaactag

SEQ ID NO: 54580 - DNA, 228 bp, Artificial Sequence
  Description of Artificial Sequence: Synthetic coding sequence
atggaacgcagctttgtttggctgtcgtgcctagattctgactcatgcaatttaacctttaggctcggcgaggtcgagtcacacgcctgttctccctcgctcctgtggaacctactcactcaatacctaccgcctggagcaggacatatcctgcgaacatacaatttcccagttttatcctgcgtatccagttgtcatctgatcggaggtaaaatgcccgagaactag

SEQ ID NO: 54581 - DNA, 228 bp, Artificial Sequence
  Description of Artificial Sequence: Synthetic coding sequence
atggagcggtccttcgtgtggctctcatgtttggatagcgactcatgcaacttgaccttccgcctgggcgaggtggagtcgcacgcttgcagccctagtttgctgtggaacctgctcactcaatatctgcccccaggcgctggacacattctccgcacgtataattttcccgtactgagttgcgtgagcagctgccatttaatcggtggaaagatgcccgagaactag

SEQ ID NO: 54582 - DNA, 228 bp, Artificial Sequence
  Description of Artificial Sequence: Synthetic coding sequence
atggagcgcagctttgtttggctcagttgcctagattccgactcttgtaacttgactttcaggctgggagaagtcgagagtcacgcctgctcaccttccctgttgtggaacctcctgacgcaatatctgcccccaggtgcaggccatattcttcggacatataattttcccgtattgtcgtgtgtgagctcttgccatttaataggtggcaagatgcctgagaattag

SEQ ID NO: 54583 - DNA, 228 bp, Artificial Sequence
  Description of Artificial Sequence: Synthetic coding sequence
atggagaggtcatttgtgtggctgagctgtctagacagcgactcctgtaacctcaccttcagactaggcgaggtagagtcacacgcttgcagcccctcactgctgtggaatcttttgacccagtacctgccgcctggcgcaggccatattttaagaacttataacttcccagtacttagctgtgtgagctcatgccacctcattggagggaaaatgcccgagaattag

SEQ ID NO: 54584 - DNA, 228 bp, Artificial Sequence
  Description of Artificial Sequence: Synthetic coding sequence
atggaacgaagcttcgtgtggctgagctgtctcgactcagattcatgcaatctgacattccggctgggagaggtggaaagccacgcatgctctccttccctgctgtggaacctgctaacacagtatctccccccaggggcaggccacattttgcggacttacaatttccctgttctctcctgtgtaagctcttgtcacctgatcggaggaaagatgcccgagaattag

SEQ ID NO: 54585 - DNA, 228 bp, Artificial Sequence
  Description of Artificial Sequence: Synthetic coding sequence
atggagcggagctttgtatggctgtcgtgcctcgattccgatagctgtaacctgacattccggttaggcgaagtggagagccacgcttgcagcccttccctgttgtggaatctcctgacacagtatctgccccctggcgctggacacatcctgcggacctacaatttccctgtgctatcctgtgtgtcctcctgtcatctcatcggcggaaaaatgccagaaaactag

SEQ ID NO: 54586 - DNA, 228 bp, Artificial Sequence
  Description of Artificial Sequence: Synthetic coding sequence
atggagcggagttttgtatggctgtcgtgtttagatagcgatagctgcaatttaacattcagactgggggaggtcgaatcacacgcttgttctccttcattactctggaacctgttgactcaatatctacctccgggtgccggtcacattttgagaacttataacttccccgtgttgtcatgtgttagcagctgtcatttgatcgggggtaagatgcccgagaattag

SEQ ID NO: 54587 - DNA, 228 bp, Artificial Sequence
  Description of Artificial Sequence: Synthetic coding sequence
atggagcgcagcttcgtttggttgtcgtgtctggacagtgattcatgcaatcttacttttagattaggagaagtggaaagtcacgcttgctccccaagcttgctgtggaacctgctgacccagtacctgcccccaggggctggccatattcttagaacatacaacttccccgtgctgtcctgcgtttcatcatgccacctaattggtggcaaaatgccagagaactag

SEQ ID NO: 54588 - DNA, 228 bp, Artificial Sequence
  Description of Artificial Sequence: Synthetic coding sequence
atggagcggagttttgtgtggctgtcctgtcttgacagtgactcctgcaaccttactttccgcttaggagaggtggagagtcacgcctgtagccccagcttattatggaacttactaacacaatatctgccccctggagctggtcacatactgagaacgtataactttccagtcctcagttgtgtaagcagctgtcacctaattggaggaaagatgccggaaaattag

SEQ ID NO: 54589 - DNA, 228 bp, Artificial Sequence
  Description of Artificial Sequence: Synthetic coding sequence
atggagcgatctttcgtgtggctgtcctgcctggatagcgactcgtgtaacttgaccttcaggctgggagaggtggagtcacacgcatgctccccttcactgctttggaatttgctgactcagtacttgcctccgggagccggtcacatccttcgcacctacaacttcccggtgctcagctgcgtctccagttgccacctgatcggcggaaagatgccagagaattag

SEQ ID NO: 54590 - DNA, 228 bp, Artificial Sequence
  Description of Artificial Sequence: Synthetic coding sequence
atggagcgatccttcgtatggctgtcctgcttggatagtgattcctgtaacctgacttttcgcctcggagaagttgagtcccacgcttgcagtcccagcttgctctggaacctgttgactcagtaccttcctcctggggctgggcatattctgcgcacctacaattttccagtactgagttgcgtcagtagctgccatctgattgggggtaagatgcccgaaaactag

SEQ ID NO: 54591 - DNA, 297 bp, Artificial Sequence
  Description of Artificial Sequence: Synthetic coding sequence
atgcgggtcgtcatggctcggctgctaagtgagggcgaacagggcatccccaccgcatgtgccgcttttgcgcagcagcctgcagggccaagaaggggtctggccggagtgggagaaggtggtccacagtgttcatgggtgaactatcgctgcacgctggaattcctggtgagtctcctggggacggatctcgccagagggagaggtaattctgctagtgggcctactgcacctgcagattccaaacaactgtcctgcaaaacattcatcgccgtgctgtccctgtccaaagagtag

SEQ ID NO: 54592 - DNA, 378 bp, Artificial Sequence
  Description of Artificial Sequence: Synthetic coding sequence
atgcgcgtagtaatggcgcgactgctgagtgagggggaacagggcatccctaccgcctgcgctgcctttgcacagcagcccgctgggccacgtcgcggattggccggagtgggcgagggaggccctcagtgtagctgggtgaattaccgttgtacattggagtttctggttagcctgcttggaacagacctcgcgagagggcgaggtaatagcgcctccggcccaacagcccctgctgactccaagcagttgatgaacagtggctctccagctagggataacgcacctagtcagcgcttctgcactaatctctcagaggggctcagatttggaatatccccttcctggcgggaagcattgtatgggtgccacgcctag

SEQ ID NO: 54593 - DNA, 297 bp, Artificial Sequence
  Description of Artificial Sequence: Synthetic coding sequence
atgcgggtagttatggccaggctcctgagcgagggagaacagggtattcctactgcgtgcgccgcttttgcacaacagccagccggtccaaggagaggattggccggagttggggagggcggaccacagtgctcctgggtaaactacagatgcactttggaattcctggtctcactgctcggaaccgacctggctcgtggacggggaaacagcgcctctggacccaccgctccggcagattctaagcagctgtcatgtaaaacatttattgccgtgttgtcacttagcaaagagtag

SEQ ID NO: 54594 - DNA, 378 bp, Artificial Sequence
  Description of Artificial Sequence: Synthetic coding sequence
atgcgagttgttatggccagactgctgagcgagggagaacagggcatacccactgcgtgcgctgccttcgctcagcagcccgctggacccagacgcggactcgcaggcgtgggagaaggtgggcctcagtgtagctgggtgaattaccggtgtacgctcgagttcctggtgtcccttctgggaacagatttggccaggggcagggggaattcagctagcggcccaacggccccagccgactctaagcagctcatgaacagcggcagccccgctagggataatgccccttcccaacgtttctgtaccaatctgtctgaaggattgcggttcggtattagcccaagctggcgggaggccctgtacgggtgccatgcttag

SEQ ID NO: 54595 - DNA, 297 bp, Artificial Sequence
  Description of Artificial Sequence: Synthetic coding sequence
atgcgcgtggttatggctagattgctcagcgaaggggaacagggaatccccaccgcatgcgcagcttttgcgcaacagcctgctggaccccgtaggggcctggctggagtgggcgaaggcggtcctcagtgctcttgggtgaactataggtgtaccttagaatttcttgtcagcttactgggtaccgatctggcacgcggaagaggcaattcagccagtggccctaccgcaccagcagacagtaagcagttgagttgcaagacgttcattgctgtcttgtctctttccaaggaatag

SEQ ID NO: 54596 - DNA, 297 bp, Artificial Sequence
  Description of Artificial Sequence: Synthetic coding sequence
atgcgagtcgttatggcccgactactgagtgagggggaacaaggcatcccaactgcttgtgccgcattcgcccaacaacctgctggcccacgcaggggtctggccggagtgggggaaggaggccctcaatgttcctgggtgaattatcgctgcaccctcgagtttttagtctccctactggggactgacctggcgaggggacggggtaatagcgcctccggacctaccgccccagctgatagtaaacagctgtcttgtaagacttttatcgctgtgctaagtctcagtaaggaatag

SEQ ID NO: 54597 - DNA, 378 bp, Artificial Sequence
  Description of Artificial Sequence: Synthetic coding sequence
atgagagtcgttatggcccgactgctgagcgaaggcgaacaaggcatccccacagcatgcgccgcttttgcccagcagcccgcaggaccacgcagagggctagctggcgttggggaaggcggacctcagtgtagttgggttaattataggtgcactttggagttcctggttagcctcctgggaactgatctagcacgcggaagagggaactcagcctctggcccaaccgccccagccgattcaaagcaactcatgaactctggttctcccgcaagggacaacgccccttctcaaagattctgtacgaacctgtctgagggattacgctttgggatctctccttcctggcgtgaggcactgtacggatgccacgcctag

SEQ ID NO: 54598 - DNA, 378 bp, Artificial Sequence
  Description of Artificial Sequence: Synthetic coding sequence
atgcgggtggtgatggcacgcctccttagcgaaggggaacagggtatcccaaccgcttgcgccgctttcgcccagcagccagccggacctcggagaggtcttgcaggagttggggagggagggccacagtgttcctgggtgaattacagatgcaccttggaatttctcgtgtccctccttggtacagatctggccaggggcagggggaattccgcatccggccctactgctccggcagactcaaagcaactgatgaattcgggtagcccagcacgggacaatgctccgagccagcgattctgtaccaatttgtctgagggtctcagattcgggatcagcccatcttggagagaggccctttacggctgccacgcttag

SEQ ID NO: 54599 - DNA, 297 bp, Artificial Sequence
  Description of Artificial Sequence: Synthetic coding sequence
atgcgcgtggttatggccaggctgctgagcgagggggaacagggcatccctactgcttgtgccgcttttgcccagcaacccgcaggcccacggcgtggtctcgctggggtcggggaggggggtccacagtgtagctgggtaaattatcggtgcaccttggaattcctggtcagtctgctgggaaccgaccttgccaggggccgaggaaattcagccagtgggcctactgcccctgctgattcgaaacagctctcctgtaaaaccttcatcgccgttctgagcctgtctaaggaatag

SEQ ID NO: 54600 - DNA, 459 bp, Artificial Sequence
  Description of Artificial Sequence: Synthetic coding sequence
atggcacaaccggaaagctcagcagactttggcatcgctcagcaaaataattactactgctattggcagtccctgccatccgcgatcagggtcaagcaggagttccagcccagccagagctatcggtacggcaactggtatgcccgacaacatggatcttaccttctgagcggttattcatacggttgtgctgtagacggaaacgggaaggactgcttcagcgcccacgagactccagaacatacagcaggaactcttgtaatgcccaaggaaaccacaccactcgcagaaaaccaggatgaagaccctctggaggaccctcatttacatcttaatatcgaagagagtaaccaggaatttatggtcaagagcgaggaactctacgatagcctcatgaattgccactggcaacccctggataccgtccacagtgaaattccagatgagacaccaaaatag

SEQ ID NO: 54601 - DNA, 198 bp, Artificial Sequence
  Description of Artificial Sequence: Synthetic coding sequence
atgcccaaagagacgacccctctggcagagaatcaggatgaagaccctctggaggaccctcacctgcacttgaacatcgaggagtcgaatcaggagttcatggtgaaaagcgaggagctctacgatagcttgatgaattgccattggcaacctcttgacaccgtgcactccgagatccccgacgagaccccaaagtag

SEQ ID NO: 54602 - DNA, 603 bp, Artificial Sequence
  Description of Artificial Sequence: Synthetic coding sequence
atgtcagagaatttgagcgaccccgtgagcccggtggtgcgtaagaagaagtccgccctttttgaggtcagtgaggttatacctgtcatgacaaacaactacgaagaaaacatactaaagggtgtgcgggactcaagctatagtctggaaagctcactggaactactgcaaaaagacgttgttcagctgcatgcaccaaggtatcagagcatgagaagggacgtcatcggctgtacccaggagatggatttcatcttgtggcctcggaatgacatcgagaagattgtctgccttttgttttcacgttggaaggaaagcgatgagccattccggcctgtgcaggcgaagtttgagtttcatcatggtgactacgagaaacagtttctgcatgtgttgtctagaaaggataagaccggcatcgttgttaacaacccgaaccagagtgtctttctgtttattgatagacagcaccttcagaccccaaaaaacaaggccacgattttcaagctttgttcaatctgtctctacctgcctcaggaacagctcacccattgggctgtcggaaccattgaagaccacctccgaccttacatgcctgagtag

SEQ ID NO: 54603 - DNA, 690 bp, Artificial Sequence
  Description of Artificial Sequence: Synthetic coding sequence
atgggagatccgaacagtagaaaaaaacaggccctcaaccgtctgcgcgctcagctgcgaaagaagaaagagagcctggctgaccagttcgacttcaagatgtacatagctttcgtgtttaaagagaagaaaaagaaatcagctttgtttgaagtttcagaagtgattccagtgatgacaaacaattatgaggagaacattttgaagggcgtccgagacagctcttactctctggagtcgagcctggagctacttcaaaaagacgtggtccaactgcacgcacctaggtatcagagcatgcgccgagacgttataggctgcacacaggagatggatttcatactttggccaaggaatgatatcgagaaaattgtctgtctgttattttcaaggtggaaagagtctgatgagccttttcgacccgtacaggccaaattcgagttccaccatggcgattacgagaaacagttcctgcatgtcctttcccggaaagataaaacagggattgtcgtaaacaaccccaatcagtcagttttcctgtttattgaccgccagcatctccaaacaccaaagaataaggccactatattcaaattgtgttcaatctgcttgtatctgcctcaagagcagttaacgcattgggcagtggggacaattgaagaccacctgcgaccctatatgccagagtag

SEQ ID NO: 54604 - DNA, 516 bp, Artificial Sequence
  Description of Artificial Sequence: Synthetic coding sequence
atgaccaataattatgaagagaacattttgaaaggagtgcgcgattctagctatagcctcgagtcctcactggaattgctgcagaaggacgtggtgcagctacacgcacccaggtatcaatctatgcgacgggacgtaatcggatgcacacaggagatggacttcatactttggcctcgaaacgacatcgagaaaatcgtgtgtctgttgttttcacgttggaaggagtcggacgagccctttcgtccagtccaagccaaatttgaattccaccacggcgattacgagaagcagtttttgcatgtactgtctaggaaggataagactgggattgtcgtgaataatccgaatcagagcgtgttcctcttcatcgataggcagcatctgcagactcctaagaacaaagccaccatttttaaattgtgcagtatctgcctctatttaccccaagagcaactgactcattgggctgtgggtaccatcgaagatcatctgcggccttatatgccagagtag

SEQ ID NO: 54605 - DNA, 669 bp, Artificial Sequence
  Description of Artificial Sequence: Synthetic coding sequence
atggctggcgctgaaccattcctcgctgacggtaaccaagaactattcccctgcgaagtgtgtgggaggcgattcgccgctgatgtgctggaaagacacggccctatttgcaagaaactgttcaataggaaacgaaagcccttttctagtctcaaacaaaggctgcaggggaccgacatccccaccgtgaagaagacgccacagtcaaaaagcccacccgtccgcaaatctaattggcgccagcagcacgaggattttatcaacgctatcaggagtgccaagcagtgcatgttggccattaaggagggcagaccactgccacctcctccccctccgtctctcaaccccgattatatccagcgtccgtactgtatgcggcgattcaacgaatcagctgcagaacggcacacaaatttttgtaaggaccagtcaagccgtagagtcttcaacccagcccagacggccgcaaagctggcgtctagagctcagggcagggcccaaatgggacctaagaaggaaccaaccgtgacatctgctgtaggcgctctgctgcagaatcgagtgctggtcgcgactaacgaggtgccaaccaaaagcggactggctatggatccagcgtctggcgctaagttgcggcagggattctctaagagctccaagaaagactag

SEQ ID NO: 54606 - DNA, 465 bp, Artificial Sequence
  Description of Artificial Sequence: Synthetic coding sequence
tagggcaaccaggaattgtttccctgcgaggtgtgtggcaggcggtttgctgcagatgtgttagaaaggcatgggccaatttgtaagaagctcttcaatagaaagaggaagccattctcaagtctgaagcaaagacttcaaggaaccgacattccgacagtgaaaaaaacccctcagtcaaaatcgccgccagtacggaaatccaactggcgacagcaacacgaagactttattaacgcaatcaggtccgccaagcaatgcatgcttgccatcaaggaaggtagacccctacctcctcccccacctccaagcctaaatcctgactacatacagcgtccatattgcatgagacgttttaacgaatccgctgcagaaagacacacaaacttctgcaaagaccagagtagtagacgcgtctttaatcccgcacaaacagccgctaaactggcctcccgtgctcagtag

SEQ ID NO: 54607 - DNA, 348 bp, Artificial Sequence
  Description of Artificial Sequence: Synthetic coding sequence
ccgccaccgcctccaagtctgaatcccgactacatccagcggccttactgcatgcgcaggtttaacgaatccgcggctgagaggcacacaaacttctgcaaagaccaatcatctcggagagtttttaaccccgctcagaccgcagcaaagctcgcttcgagagctcagggaagggcccagatgggtccgaagaaggagcccaccgtgacttccgctgtaggtgctctgttgcagaacagggtgctagtcgcaactaatgaggtgcccaccaaatccgggcttgccatggatccggcttccggcgcaaagttgagacaagggttttccaaaagttctaaaaaggattag

SEQ ID NO: 54608 - DNA, 381 bp, Artificial Sequence
  Description of Artificial Sequence: Synthetic coding sequence
atgcttgctataaaagagggtagaccactcccacctccgccacctccatctctgaaccccgattacattcaaaggccatactgcatgcggaggtttaacgaaagcgctgcagagcgccataccaatttttgcaaagaccagagttcccgacgagttttcaatcctgctcaaacagccgcaaaactagcttcaagagctcagggcagggctcaaatgggccctaaaaaggaaccaacagtcacatccgcagtcggcgctctgctccagaatagagtcctggtcgccactaacgaagtgccgaccaaatccggcctagctatggaccccgcttccggggctaagctgcgccagggtttttctaagtctagtaaaaaagactag

SEQ ID NO: 54609 - DNA, 2148 bp, Artificial Sequence
  Description of Artificial Sequence: Synthetic coding sequence
atgagcctcgattgcacgtcgcatatagcattgggagcggcatcgcccgcacctgaggaaacctatgatcacctgtcagaagtccccgttacccgggagcagctgaatcattaccggaacgtagcgcagaacgcacggtccgaactggccgctactcttgttaagttcgaatgcgcccagtcagaactccaggacctgaggagtaaaatgttgtcaaaggaggtgtcttgtcaggagctcaaggccgagatggagtcatataaagaaaataacgcccgaaaatctagtctgctcacttccctccgagatagggtccaggaactagaggaggaaagcgcggcactatccacaagtaaaattcgtactgaaatcaccgcacatgcagccatcaaggaaaaccaggagctcaagaagaaagttgtggaactgaatgagaagctacaaaaatgcagtaaggaaaatgaggagaacaaaaagcaggtgagcaaaaactgtcgcaagcacgaagagttccttacccagcttcgggattgcctggaccctgacgaaagaaacgataaagcctctgacgaggatcttatcttaaaactgcgtgacctccgcaaggagaatgaattcgtaaagggtcagatcgtcattctggaagaaacgatcaatgtacacgagatggaagccaaagcatcccgggaaaccatcatgcggttggcatctgaggttaaccgcgagcagaagaaggctgcttcttgtaccgaggaaaaagaaaagctcaaccaggacctcttaagtgcagtggaagctaaagaggcactagagagggaagtgaagattttccaagagaggctattggccggacagcaagtctgggacgcttccaaacaagaagtgtctctccttaagaagtcctcgtccgagttggagaagtccctgaaagcctctcaggacgccgtcacgacctcacagtctcaatatttcagctttagggaaaagattgcagccctgctgcgaggacgcctgagcatgacaggctctacagaggacaccattctagagaaaatccgggagatggacagccgcgaagaaagcagggacaggatggtgagccagctggaggctcaaataagcgaactggtggagcagctgggaaaggagtcaggctttcatcaaaaggcgcttcagagagctcagaaggcagaaaacatgctggaaacactgcaaggtcagctgactcatctagaggccgaactggtttcaggaggcgtcttgcgagataacctgaactttgagaaacagaagtacctgaagttcctggaccagttgtcccagaaaatgaagctggatcaaatggcagctgaacttggttttgacatgcgcctggatgtcgtacttgctagaacagagcagctcgttaggctagagtccaacgctgttatcgagaacaagaccattgctcacaatctgcaacggaaactgaagacgcaaaaagagcgactggaatcgaaggagctgcacatgagcctgctccgccagaaaatcgcacagctggaggaagagaaacaggcccgtactgcccttgtggtcgaacgcgacaatgcacatcttacaatccgcaacttacagaagaaagtagagaggctacagaaagagcttaacacctgcagagatttgcatacggagctcaaagccaagttagcagataccaacgaacttaaaatcaagaccctcgagcagaccaaggccattgaggatttgaacaagtcccgagatcagctagagaaaatgaaggaaaaggctgaaaagaaactcatgtctgtgaaatccgaactagataccacagaacatgaggctaaagagaacaaggaaagagccagaaacatgatcgaagtggtaacctcagaaatgaagaccctgaagaagtcccttgaagaggctgagaaaagggagaaacagctggccgattttcgggaagtggtcagccagatgttaggtctcaacgtgacaagcctcgcgttgcctgactatgaaattatcaagtgccttgagcggctggtgcacagccatcaacaccacttcgtaacctgcgcgtgcttgaaggatgtaaccaccggtcaggagcgtcacccgcaaggtcaccttcagctcctccattag

SEQ ID NO: 54610 - DNA, 2169 bp, Artificial Sequence
  Description of Artificial Sequence: Synthetic coding sequence
atgagcctagattgcacctcccacatcgccttgggcgctgcatccccagcccctgaggaaacctatgaccatctatcagaagtgcctgtaactcgagaacagctgaatcactatagaaacgtagctcagaatgctcggagcgagctggccgctactctcgtcaagttcgaatgcgcccagagcgagttacaggacctgcgctcgaaaatgttgagcaaagaagtttcatgccaggagctgaaagccgaaatggagtcgtataaagaaaataacgcgcgtaagtccagcctgttaactagcttgagggatcgggtgcaggagctggaggaggaatcagcagcgctctctacctccaaaatcaggaccgagattacagcccacgccgcaattaaagaaaaccaggaattaaaaaaaaaagtggttgagttgaatgaaaaacttcagaagtgctcaaaggagaacgaagaaaacaaaaaacaggtcagtaaaaattgcaggaagcatgaggaatttctcacacaattacgagactgcctggatcctgatgagcgcaatgataaagccagtgacgaggacctgattctcaagttgcgcgacctccgtaaggaaaacgaattcgtgaaaggacaaattgtaatactagaggaaactatcaacgttcacgagatggaggctaaggcatcacgggaaaccatcatgcgcctcgccagcgaagttaatagagagcagaagaaggcagcctcttgtaccgaggagaaggaaaagctgaatcaagacctgctgagcgccgtcgaggctaaggaggctctcgaaagggaagtgaaaatctttcaggagaggttgttagccggtcagcaagtttgggatgcctctaaacaggaagtgtcactactgaaaaaatcttcttccgagctggagaagtccttgaaggcaagccaggacgcagtcacgacatctcagtctcagtacttcagcttcagggaaaagattgctgctcttcttcgagggcgactatctatgaccggcagcaccgaggacaccattttagaaaaaataagggagatggattctagagaggagtcacgcgatagaatggtaagccaactggaggcacaaatctcagagctggttgagcagctaggaaaggagtcagggtttcatcagaaggctctgcagcgcgcacaaaaggccgagaacatgctcgaaacactacaggggcagctgacgcacttggaggctgagctcgtgtctggaggcgttttgcgggacaacttaaactttgagaagcaaaagtatcttaaattcctggaccagctcagccagaagatgaagctagaccaaatggccgctgagctgggatttgacatgcgtcttgacgtagttttggcccgtaccgagcagctggtgcggctggaatcaaacgcagtcattgaaaataaaaccatcgcccacaatctgcagcgcaaattaaagacacagaaggagagacttgagtcaaaggaactgcacatgtccttgctccgacagaaaatcgcccagctggaagaggagaaacaggctcgcacagctcttgtggtcgaacgggacaatgcacatctcactattcgaaacctgcagaaaaaagtggaacgcctacagaaagagctgaatacatgcagggaccttcatacggagctcaaggcaaagctcgccgatacgaatgaattgaaggcgtcggcctggctgcattttatcaagacacttgaacagacaaaggcaatagaggatctcaacaaatccagggaccaactagaaaagatgaaggaaaaggctgaaaaaaagctgatgtcagtgaaaagcgagttggacacaactgagcatgaagcaaaggaaaataaggagcgggcacggaacatgattgaagtcgtcacaagcgaaatgaaaacgcttaaaaagtccctggaggaggcagagaaacgtgagaaacagttggctgattttcgcgaggtggtaagccagatgctgggcctgaatgtgacctctttggccctccccgattatgaaatcatcaaatgcttggagcggctcgtccatagtcaccagcatcatttcgtgacatgcgcatgtcttaaggacgtgactaccggccaagaaagacacccacagggtcaccttcagctactccattag

SEQ ID NO: 54611 - DNA, 378 bp, Artificial Sequence
  Description of Artificial Sequence: Synthetic coding sequence
atgaaaaatgaagagcattgccccggatcctttttcctgtgcaagatccgtgagtgtgttctaaactacagattccagctgcagcacccgggtttccaacactacctgcagagctcaggcagaagagaccggggtcggtcggaggacaagaaacctctagaggcaggggtgtggtgctgggacaggggcggatgggatgggtcaagccgggcagtccacctgctgtttaggggagtggcacatccgtcactctacctgttcccgagggaggatccccctaggctgctttttccacgcctcagcctgctggtatgcgagcagttttggtgctactcagctacactcctgctggctccactcccggcttcaacttgctag

SEQ ID NO: 54612 - DNA, 609 bp, Artificial Sequence
  Description of Artificial Sequence: Synthetic coding sequence
atgaatgctgcagtgccccctgagcaggcccactcttgcgggtggggcaccgaggggtgcccatgtctcagaagcacagccattcggcagactttctttccaggcggagaccagtttcaaagagatggtggtttagctatgctcccaatcctggtgagtaagttcttggcgtcctcagatcctcccgtctcggtgccagagatgctaggcctgcagaaccggtggagaggtatgaagaatgaggagcattgtcccggttcatttttcctttgcaaaattagggaatgtgttcttaactatcggttccaattgcagcatcccggtttccagcactacctgcagtcatccggtagacgggacagggggaggagtgaagacaaaaaacctctggaagcgggtgtttggtgttgggaccggggaggatgggacggatcgagcagagcagtacacctgttgtttcgcggtgttgcacaccccagcctgtatctgtttccaagggaagatccaccaaggctgctgttcccccgactctctctgttagtctgtgagcaattttggtgctatagtgccaccttgctgctggccccactccccgcaagcacatgctag

SEQ ID NO: 54613 - DNA, 1266 bp, Artificial Sequence
  Description of Artificial Sequence: Synthetic coding sequence
atgtcagctcattctatgctgtgcgagagaattgcaattgccaaggagctgatcaaacgcgcagaatcactgagcaggtctcgcaagggagggattgagggaggcgcaaaattatgtagtaaacttaaagcagaactgaagtttctgcagaaggtcgaggccggtaaggttgcgattaaggaatcccacctgcagtccaccaacctgacccatctgagagctatagtggaaagtgctgagaacttagaggaggttgtgtctgtactgcatgtgttcggttacacagacactctgggcgaaaagcagacacttgtggttgatgtcgtggctaatgggggacacacgtgggtgaaagcgatcgggaggaaagccgaagctctacataatatttggctagggagaggacaatacggcgacaaaagcattatcgaacaagcagaggattttctccaagcatcccaccaacagcccgtacagtactccaatccccacatcattttcgcattttacaacagtgtgtccagccccatggccgagaagctgaaagagatgggtatctctgtaaggggcgatatcgtcgcggtcaatgccttgctggatcaccccgaggagctgcaaccatcggaatccgagtccgatgatgagggcccagaattgctgcaggtaacgagggtcgatcgcgagaatatactggcctctgttgctttccctacagaaatcaaggtggacgtctgcaaaagagtcaatctcgacatcacgacactcatcacttatgtgagcgccttgtcatatggtggatgtcatttcatctttaaagagaaggtacttactgagcaggccgagcaggaacgtaaggaacaggtcctgccacagctggaagcctttatgaaggataaagagttgttcgcatgtgagagcgctgtgaaagacttccagagtatcctggatacgcttggaggtccaggcgaacgcgagcgagccacagtgctgataaaacgtatcaatgtggtgccagatcagccatcggagcgcgcattgcgacttgtcgctagcagcaaaattaactccagaagcctgactatttttggcacgggtgatacactgaaagcgataacaatgaccgccaattccggtttcgtccgtgccgcaaacaaccaaggggtcaagtttagcgtatttatacaccagccccgagcccttacggagtcaaaggaggcactagccactcctctccccaaggactacacaaccgattctgagcattag

SEQ ID NO: 54614 - DNA, 537 bp, Artificial Sequence
  Description of Artificial Sequence: Synthetic coding sequence
atgtccgctcattccatgctgtgtgagcgcatcgctatagcaaaagagttaattaaacgggctgagagtcttagccgctctcggaaggggggaatcgaagggggagctaaactgtgctctaagttgaaggcagagttgaaatttctgcagaaagtcgaggccggaaaggtagcgatcaaagaatcacacctgcagagcacaaacttaacccatttgcgagcaatagtggaatcagccgagaacctggaagaagttgtgtcagtcctgcatgtcttcggctacacagataccttaggagagaaacagacactcgtggtggacgtggtggccaacggaggccatacatgggtgaaggccatcggcaggaaggccgaggccctgcacaatatatggctgggaagagggcagtatggagacaagtcaattatcgagcaagctgaggacttcttgcaggcctcccaccagcagccagtgcagtactctaaccctcacattattttcgctttctataactcggtatcgagtccaatggcctag

SEQ ID NO: 54615 - DNA, 1440 bp, Artificial Sequence
  Description of Artificial Sequence: Synthetic coding sequence
atgcaggaagtgcccgaagccgcaggcttggctagggtggagccccctcgcagaagctccggcgtgggcgcagccagattgagattccccggtggatcccgccctttgagggcgcgagcctgtgtcctcgcccttgctgtactcgctctccctgaacgcaacaatgccgattctatgtcagcccactctatgctctgtgaaagaattgcgatcgccaaggagcttataaaacgggcagagagcctttctcggagccgcaagggaggcattgaagggggagcaaaactatgttctaagctcaaggccgagctgaaatttttacaaaaggtggaggccggaaaagtggctatcaaggaatcacatctgcagagtaccaatctgacccaccttagggccatcgtagaatctgccgagaatctggaagaggtcgtcagcgttctccacgtcttcggatacactgacaccctcggggagaagcaaactctggtcgtggatgtcgtggccaacggcggtcacacatgggtgaaggccatcggcagaaaggcggaggctctccacaatatttggttgggaaggggacagtacggagataagtctatcatcgagcaggctgaggactttctgcaggccagtcaccagcaaccggtacaatactcaaatcctcacattatattcgccttctacaacagcgtctccagtccaatggcggagaaactgaaggaaatgggtattagcgttcgcggagacattgtggcggtaaatgcactgctggaccacccagaggaacttcagccctccgaatccgagtctgacgacgaaggtccagaactgctgcaggtgacacgcgtggacagagaaaatatcctcgcttccgtcgcttttcctacagaaatcaaagtcgatgtatgtaagagagtaaacctcgatatcaccacactcattacttacgtgtcggccctgtcttacggaggatgtcatttcatattcaaagaaaaagtgttaacagagcaagctgagcaggaacgcaaagaacaggtgttaccacagttagaagcctttatgaaggacaaggaactgttcgcttgtgagtctgcggtcaaggatttccagagcatcctggataccctgggtggaccgggagaacgagagagagcaaccgtgcttattaaacggatcaatgtggtccctgatcagcccagcgagcgtgccctccgactcgtggcttccagcaaaattaatagccgttctctgaccattttcggaactggcgacacgctgaaagcaatcacaatgacagctaactccggcttcgtcagagccgcaaataaccagggggtgaagttcagcgtcttcatccaccagccacgtgctctaaccgaaagtaaggaggctctggcaacccctctgccgaaggattataccactgattcggaacactag

SEQ ID NO: 54616 - DNA, 258 bp, Artificial Sequence
  Description of Artificial Sequence: Synthetic coding sequence
atgtccgctcactccatgctctgcgaaagaatcgccattgctaaggaactaataaagagagccgagagcttgagtcgatcaagaaagggtggcatcgaagggggagcgaaactgtgttcgaagttgaaagcagagcttaagttcttacagaaggttgaagctgggaaagtggctatcaaggagtctcaccttcaatcaactaacctgacacacctccgtgccatagttgagagtgctgaaaatctagaggaggtgtag

SEQ ID NO: 54617 - DNA, 1266 bp, Artificial Sequence
  Description of Artificial Sequence: Synthetic coding sequence
atgtcggctcattccatgctctgcgagagaattgccatcgccaaagaacttattaaacgggctgagagcctgtcacgttctcggaaaggagggattgagggcggagcaaaattatgctcaaagcttaaggcggaactgaaatttttacagaaggtggaagccggaaaagtcgccattaaagaaagtcacctccagagtacgaacctcacccatttgcgagccatcgttgagtcagcagagaatctggaggaagtggtctcagtgcttcacgtttttgggtacactgacaccctgggggagaagcagacactagtggtggacgtagtcgccaatggtggacacacttgggtcaaggccatcggacggaaggcagaagctctgcacaatatctggctcggcaggggccagtatggcgacaagtctataatcgaacaggccgaggatttcctgcaggccagccatcaacagcctgtccagtattccaatcctcatatcatttttgccttctacaatagtgtgagctctcccatggctgaaaaactgaaagagatgggtatttcagtacgcggagacattgtggccgtgaacgcactgctggaccatccggaggagcttcagccctctgaatctgagtctgacgatgaaggccctgagcttctgcaggtgaccagggttgaccgggagaatatcttagcatccgtagctttccctacagagatcaaggtcgacgtttgtaaacgggtcaacttagatattactaccctgatcacctacgtgagtgctctgtcttacggaggctgccactttatcttcaaagaaaaagttctgacagaacaggccgaacaggagaggaaagaacaggtgcttcctcagctagaagcttttatgaaagacaaagagcttttcgcctgtgagtccgctgtcaaggactttcaatcaatcctggataccctcggtgggcctggagagcgcgaacgcgcaacggtgctcatcaaacggatcaacgtggtccctgaccagccctccgagcgcgctctgagactggtcgcgtcctccaagattaactctcggagcctcacaatttttgggacaggggatacgcttaaagcaatcacgatgacagcaaacagcggcttcgtccgagctgctaataatcagggcgtcaaatttagtgtcttcatccatcagccacgggcactgacagaaagtaaagaggccctcgcaacaccactccccaaagactatactacagattctgaacactag

SEQ ID NO: 54618 - DNA, 1266 bp, Artificial Sequence
  Description of Artificial Sequence: Synthetic coding sequence
atgtctgcccactcaatgctatgtgaaagaattgccattgccaaggagctgatcaagcgggcagaatctctctcaaggtccagaaaggggggaattgagggtggagcaaagctctgttccaaacttaaggccgagctcaaatttctgcagaaagtcgaagctggcaaagtggcgatcaaggagtcacatctgcagagcacaaacctgacacacttacgcgctatagtcgagagtgccgagaatctggaagaggtggttagcgtgttgcacgtttttggctataccgacacactgggggaaaagcagactctggtggttgatgttgtggctaatggtggccatacctgggtgaaggctatcggcaggaaagctgaggcactgcataacatctggctcggaagagggcagtacggggacaaatccataatcgagcaagctgaagacttcctccaggccagtcaccagcagccagttcagtattctaacccacatattatcttcgccttttacaacagtgtcagctccccgatggcggaaaagctgaaggaaatggggatatccgtgcgtggcgatatcgttgccgtcaacgcactgctcgaccatcccgaggaactccaaccaagcgagtccgaatccgatgatgaaggccctgagctcctgcaagtgacaagagttgaccgggagaatatcctggcatcagtggcttttcccactgagatcaaagtcgatgtgtgtaagcgagtcaatctggatattacaacacttattacatacgtttccgccctttcatatggaggctgccatttcatcttcaaggagaaagttctgactgaacaagctgagcaggagaggaaagagcaagtccttcctcagctcgaagctttcatgaaagacaaagagttattcgcatgtgaatctgccgtgaaagattttcaaagcattctggatactctgggcggtcccggtgagcgcgagagagctacagtgttgattaagagaatcaatgtggtaccggaccagccatcggagcgggcactccggttggtagcgtccagcaagattaacagccgaagcttgaccatatttgggacaggggatacccttaaagccatcactatgactgccaattctgggtttgtgcgcgctgcaaataatcagggcgtaaagttttccgtcttcatccaccagccacgagccttgaccgaatcgaaagaggccctggccacccccctacccaaagattatactacggattcagaacactag

SEQ ID NO: 54619 - DNA, 1350 bp, Artificial Sequence
  Description of Artificial Sequence: Synthetic coding sequence
atgagcgacatccggcatagcctactacggagggacgcactgtctgctgccaaagaagtgctgtaccacctggacatttatttttctagtcagctacaatcagcccctttaccaatagttgataaggggcctgtggagttgctggaagaattcgtttttcaggttcccaaagaaaggtccgcccagccaaagaggctcaacagcctacaggagctgcaattgttggaaatcatgtgtaactactttcaggaacaaaccaaggatagtgttcggcagattatcttttcctccttatttagcccccaggggaataaggctgacgactcacgaatgtctctacttggcaagctggtgtcaatggctgtggcagtgtgtcgcatcccggtgttagaatgcgctgcttcttggctgcagcgtactcctgtcgtatactgtgtccgcttggcaaaggcgttggttgacgattattgctgcctcgtgccaggatccatccagactctgaaacaaatctttagtgcctccccaagattttgctgtcagtttatcacgtctgtgactgctttgtatgaccttagctctgatgatttgattccgcctatggacctgctcgagatgattgttacctggatcttcgaagatcctcggctcatcctgattacattcctcaatactccgatcgccgctaatctccctatcgggtttctagaattgacaccactcgtcgggctgatcagatggtgtgtcaaggccccactggcctacaaacgcaagaaaaagccgcctctgtctaacggtcatgtgagtaacaaggttaccaaggatccaggtgtgggcatggaccgtgactcccatcttttgtattcaaagctccatctgtccgtgttacaggtcctgatgacgttgcagctgcatcttactgagaagaatttgtatggtagattgggcctgatcctgttcgatcatatggtgcccctggtcgaggagatcaacagactggcagatgagctgaatcctctgaacgcatcacaggaaatcgagctgtcattagaccgccttgcgcaggcgctgcaggtcgccatggcctctggggcactgttgtgtaccagagacgatctgagaactctttgctcacggctgccccacaataacctgttgcaactagtgatctctggacccgtacagcaaagccctcacgcagctctgcctccaggtttttaccctcacatccacaccccccctctggggtatggcgcagtgcccgctcaccctgctgcccacccagctctgcccacccaccctggacacacattcattagcggcgtgacctttccttttagacctattaggtag

SEQ ID NO: 54620 - DNA, 1059 bp, Artificial Sequence
  Description of Artificial Sequence: Synthetic coding sequence
atgtcagatattcgtcatagcctgctaaggagggatgccctgtccgcagccaaagaagtgctgtaccacttggatatctatttcagctcacagctccagagcgcccctctgcctatagtagataaaggccctgtggagcttcttgaagagttcgttttccaggtgccaaaggaacgcagcgcccagccaaaagagcagacaaaggactccgtgagacagattattttctcatccctcttttcccctcagggcaataaagctgacgactcccgcatgagcctgctggggaagttagtctctatggccgtggcggtttgcaggataccagttctcgagtgcgcagcctcttggctgcagaggaccccggtggtctactgcgtgcggcttgcaaaagccttggtggatgactactgttgtctcgtgccgggtagtattcaaacactgaagcagatattcagtgctagccctagattctgttgtcagttcattacttctgtgactgctctgtacgaccttagttccgacgacttgatcccgccaatggatctactcgaaatgatcgttacgtggattttcgaggatccgtccgtgttgcaagttcttatgactttgcaattgcacctgacagagaagaatctttacgggagactgggcctcatcctctttgaccacatggtgcctctcgtggaagagatcaacaggttggccgatgagctgaatccactcaatgcctcccaagaaatagagctgtccttggacaggttagcacaggccctgcaggtggcaatggcttccggtgccctgctttgtactcgggatgaccttcgcacactctgtagtagattgccccataacaatctgcttcagttggtaatttccggtccagtgcagcagagcccacacgctgccctaccaccagggttttatccccacattcatacgcccccactcgggtacggagccgttcccgctcaccctgcggcacatcctgcccttcctacccatccagggcacactttcataagtggcgtgacctttccatttcgcccaattagatag

SEQ ID NO: 54621 - DNA, 711 bp, Artificial Sequence
  Description of Artificial Sequence: Synthetic coding sequence
atggtggtccgagaggcttctgccgcacaggcctccctgagtcaggtgctgcctcagctgagatatctgcacatttttttggagcaggtccatacacacttccaggaacaatccgtgggagaacggggagcagcgatccagctcgctgaggggctggccagacagttgtgtacggattgtcagctgaacaagctgttttatcgagaggagttcgtactggccaccctcctcgacccttgtttcaagggaaagatagaggctattctgccttgggggccaactgatatcgaccactggaagcaagtgctggtttacaaagtaaaggagataagagtcagtgaatactctctgaatagcccttcacctttacagtcacctaggggattgtgtgtagaccctacacgagtggctaaaagctccggcgtggaaggtaggagccagggcgaaccacttcagagttcttcccactccggggcattcctgctggcccagcgggaaaaaggtctgcttgagtctatgggccttctggcctctgaaagatcgggaggctccctgagcaccaagagccactgggcgtcgataatcgtaaagaagtatctgtgggagaatgaaactgttggagcacaagatgaccccctggcatactgggagaagaagagggaggcttggccgccatctatttgcttgactccccacagaagtctactttag

SEQ ID NO: 54622 - DNA, 1773 bp, Artificial Sequence
  Description of Artificial Sequence: Synthetic coding sequence
atggaggtcatccacggacggccttattgttgtagagagctcgaaggcgctgatatccttagtaacacattttattcaaatgaactgcataatcctttgcagacagttaccagacctaccgccagtgaggatcgatatcaggagctcagagagagtctgcagcagtgtagactgccatggggagccgaaagggaatacgggggaatcatccctatcagcttgcctgaggatcatcgcccaaagtatgaaccccctcgagttatgggaaaagggcaccagcattatgggtttggaggggaaacgtggcccagaaaactgcctgtggaacaattttattatcttacacaaaataaaaaatccgatgtctatggaaacgattcattaatccccaaaccacccaactccacggttggtgaaatatgtctgccgtaccctatcgagcacccataccatacccatatctgccgaggagcgatgttcccaaccttcacatcccctgaggatctgtacactggtattaaagcacggacccagcagccttttccccctaccgtccccactaaagcctacgacagcaccgtgttgaaaacacgcggtaacccctaccgttatgaactgatcgacatccccatggactctaagaaaaaagctcttacctggcctggccagggcgtgtattacgatttcccacggggtgtggagaagaataagcccgtgttctatccgaagcccccaaagaccttcgccccaaatacatcgttgaatagctgggaccctatatgttccgccaaagaggctaatattcagcgcaacttggagcggtctcattggctgacgtcttatacacacgacttcacagggctgggtcccatggatcctttggaactggacgactaccatgagaagatggtagccgagctgactcggaagataggcttcgatcccgaacctcaggaaaagttccatccagtcttcaaacctcctaggcccctggaaggccgaatagcgagactcatccagaacaggaggtcactcgaagcaattgtgcagcagcgtcctcggagctgccctgattgcacccctcgagtgttatgtaactttcatacttttgtcccctcgagcaaagaaatggtggcactctctgataatatccctgccggagtgactcacaaaaaccaggatatagaggagaagattatagaagagcagtctctcctttctacatacgaactcccaagttgctatcccaccaaagacttgaccagtatctacgacatcaagccttttccaaagattactgacacaaagaaaaccgaggacctatactggcgtcaacagagcctgaaaacccagcctaccccctactgcaagcccgaccattggattcattatgaaaatctaaaatcccctctgcgggaccagtataatatgtgccctgatccagtgagcctctcaaagcccagtgttttgcagaacaaacaggacactgaggccttcacccttgaacacttcctaagcaaacccgaggaagaattgtttcttaacatggaaaacaacgaggagactcgcccagtgctgggatggatccccagagctggcgttacgaagccccagaccaatttgctcgagctcaagaattcctttagcaagacaggcgctcaaaagcggttccacaaatctattttggaagatcataaagacttgcgcgataatgagcatagcgggatgaagcaccagttttacggccacaatagctactacttctacaattag

SEQ ID NO: 54623 - DNA, 1773 bp, Artificial Sequence
  Description of Artificial Sequence: Synthetic coding sequence
atggaggtgatacatggacgaccttactgctgcagggagctggaaggtgccgacattctctctaataccttctatagcaatgagctgcacaacccgctccagaccgtgacccggcctaccgcctcagaggacagataccaggagttacgcgaatcccttcagcagtgcagattgccttggggggctgagcgcgagtatggcggaataattcctatatccctccctgaagaccacagacccaagtacgaacctccccgtgtgatgggcaaaggacaccagcattatggcttcggcggtgagacctggcccaggaagctcccggtggaacaattctactaccttacacaaaacaagaaatcggacgtttacggtaacgactcactgatacctaaaccaccaaattctactgtcggtgaaatctgtctcccctatcccatcgaacacccataccacactcacatctgtagaggggctatgttccccacttttacctcccccgaagatttatacactggcatcaaggccaggactcagcagccgttcccgccaaccgtgcccacaaaggcttacgactctacagtattaaaaacccggggaaatccatacaggtatgagctgatagacatccctatggatagtaaaaaaaaggctttgacctggccaggacaaggggtctattatgactttcccaggggcgtggagaagaacaagcccgtattttatccgaaaccgccaaagacatttgcgccaaacacctcattgaacagctgggatcccatctgttcggcaaaagaggcaaacattcagagaaatttggaaagaagtcattggttaacatcgtatacccacgactttaccggcctgggccctatggaccctctggaacttgacgactatcatgagaaaatggtcgctgaattgactcgcaaaatcggatttgacccagagcctcaggagaagtttcaccctgtgtttaaaccaccaagacccctcgaggggagaatcgctagactgattcaaaacaggcgcagtttggaggctatcgtacagcagcgcccacgttcctgtcccgattgtacccctagggtcctttgcaatttccacacctttgtcccatcatccaaagaaatggtcgctctctcggataatattccagctggcgtgacgcacaagaaccaagacatagaagagaagatcatagaggagcagagtctccttagtacctacgaactgccctcctgttaccccacgaaggatctgacttccatatatgacattaaacctttcccaaagatcactgacacaaagaaaaccgaggatctgtactggagacagcagagcctgaaaactcagcctaccccatactgcaagcccgaccactggatccactacgaaaacttaaagtctccgctacgggatcaatacaatatgtgccctgaccctgtgagtttgtcaaagcccagcgtgctacagaataagcaggatacggaagcattcacccttgagcactttttaagcaaaccagaggaagagctgttcctgaacatggagaataacgaggagacaagacctgtcttgggttggattccaagggctggtgtgaccaagccgcagaccaacttgcttgagctaaaaaactctttctctaagacgggcgctcagaagcgattccataaaagcatccttgaggatcacaaagacttgcgagataatgaacacagtgggatgaagcatcagttctatggacacaattcttattacttttataattag

SEQ ID NO: 54624 - DNA, 348 bp, Artificial Sequence
  Description of Artificial Sequence: Synthetic coding sequence
atggaggtgattcacggtcggccttactgttgtagagagcttgaaggtgctgatattctttcaaacaccttttatagcaatgagctgcataaccccctgcagaccgttaccaggcctacggcctctgaggaccgatatcaggaattgcgggagtctctgcagcaatgccgactgccgtggggggctgaaagagaatacggcggaattataccaatcagcttgcccgaagatcacaggcccaaatacgagcctcctcgagtaatgggtaaagggcaccagcactacggtttcggaggtgagacatggccaaggaaacttcctgttgaacagttttactatttaacctag

SEQ ID NO: 54625 - DNA, 462 bp, Artificial Sequence
  Description of Artificial Sequence: Synthetic coding sequence
atggaggttatccacggtcgcccatactgttgcagagagcttgaaggggcagatatcctatcaaacaccttctattctaacgaactgcacaaccccttacagacagttacaaggccgactgcctccgaggaccgctatcaagaattgagagagtctctgcaacaatgcaggctgccatggggagctgagcgcgagtatgggggaattatccccatcagcctgcctgaggaccacagacctaaatatgaacctccaagggtcatgggaaagggtcatcagcattatggatttggcggagagacctggccaaggaagctcccagtggagcagttctactatttgactcagaacaagaaaagtgacgtgtatggaaatgatagtttaatcccaaagcctcctaactccactgttggtgaaatttgcctaccgtacccaattgagcacccctatcacactcactag

SEQ ID NO: 54626 - DNA, 279 bp, Artificial Sequence
  Description of Artificial Sequence: Synthetic coding sequence
atggaggttattcatggacgcccttactgctgcagggagctggaaggggcagacattcttagcaacacgttttattcgaacgaattacacaatccgcttcagaccgttaccaggcctactgcctccgaggaccggtatcaggaacttcgcgagtctctgcaacagtgccgcctcccttggggagctgaacgggaatatggcggtattatccccatcagcttgccagaagatcacagaccaaagtatgaaccccctcgcgtcatgggcaaagggcattag

SEQ ID NO: 54627 - DNA, 534 bp, Artificial Sequence
  Description of Artificial Sequence: Synthetic coding sequence
atgcaggtcgaagtgcagagtctgagtctggaagagtgtccgtggcgcctgcccggaccacaatgtgaatgcgaggcattattaccaagtggggctcggcgtcgcatcgatctaaggttgtcaggtagggcagttgcagtctgggttcacgtgcgtggaggccctggacagtttaatctctcttacgcaaccgggcgacacaaaaaacccaatccacatcaaaacatgaatcgcggtatggaattcatcgcgccagtctcagcacccaccaagagtggcgctccctggcactttctgagccagggtcccacggatgcccagagagcagtacgtattcgacctggaactagaatggggctgagctccgaccccgtcgttgggaccctgagctcctcataccttgacctgctgaccctgtcatataagcctggaaggaccgtgacttctagctatctgaacgttcggggacacgaagttaggaagctgcagaacagcgtggaagccactaggataagccgtaccgattccagctag

SEQ ID NO: 54628 - DNA, 396 bp, Artificial Sequence
  Description of Artificial Sequence: Synthetic coding sequence
atggactttcagcaactggccgatgtcgcagagaagtggtgctccaacaccccattcgagctgatcgcaacagaggagactgagcgcaggatggacttttacgcagatccaggcgtatctttttacgtgctctgtcccgataacggctgtggcgacaacttccacgtgtggagcgagtcagaggactgtctgccgtttctgcagctggcacaggattacatctcttcctgcggaaagaagacactacacgaagtcttagagaaggtttttaaaagcttccggcctttgctgggattgcctgatgcggacgacgacgcttttgaggagtattccgcagacgtagaggaggaggagccagaggccgatcacccgcagatgggggtgagccagcagtag

SEQ ID NO: 54629 - DNA, 297 bp, Artificial Sequence
  Description of Artificial Sequence: Synthetic coding sequence
atggccacacattgccctctctactgtgtgggagctgacttaatgatgaatcgcgctggtgagcatgtttggtccgagtcagaagattgcctcccattcctacagctggcccaggactatatatcaagttgcggcaaaaagactttacatgaggtcctggaaaaggtttttaaaagttttaggcccttgctaggcttgccagatgctgatgatgatgccttcgaggagtatagcgcagacgtagaggaggaagagcccgaggccgaccacccccagatgggcgtgtcccaacagtag

SEQ ID NO: 54630 - DNA, 396 bp, Artificial Sequence
  Description of Artificial Sequence: Synthetic coding sequence
atggatttccagcaattggccgatgttgccgaaaagtggtgctccaacaccccgttcgaacttatcgccactgaggagacagaacgtcgaatggacttctatgccgatccaggagtcagtttttatgtcctgtgccccgacaatggctgtggggacaactttcacgtatggtctgagagtgaagactgtttaccattcttacaattggcccaagattacatatcaagctgcggaaagaagactttgcatgaagttttggagaaagttttcaaatctttcagacctcttctgggacttcctgatgccgacgacgacgcatttgaagagtactccgcagacgttgaggaagaagaaccggaagccgatcacccgcagatgggtgtgagtcagcagtag

SEQ ID NO: 54631 - DNA, 297 bp, Artificial Sequence
  Description of Artificial Sequence: Synthetic coding sequence
atggctacacactgcccactgtactgcgtgggggctgatctaatgatgaatagagccggtgaacatgtgtggtcagagagtgaagactgcttgccttttttacagctggctcaggactacattagttcttgcgggaagaagactttgcatgaagtgttagagaaagtctttaaatctttccgaccactgctaggactgccagatgctgacgacgacgcgttcgaagagtactccgcggacgtggaagaagaggagcctgaggccgatcacccccagatgggcgtaagtcagcagtag

SEQ ID NO: 54632 - DNA, 600 bp, Artificial Sequence
  Description of Artificial Sequence: Synthetic coding sequence
atgcataagaagtcgggatttgaaaaccagatgcgcctttgctggcggcgaccctgtgggaacgaagagagatgctctgtgtgctggtccttgtttctgccgcctgggaaacaactctgtgaggaagaacgacgcgctatgcaggccgctcttgatagtgttgtctgtcacacacccctcaataacctggggttctctcgtaaggggtcagcgctcaccttctccgtagctttccaagccctcaggacaggtctgttcgagcacatgaagctgaagctacagttcaccgccagcgtgtctcatccacctccagaggctaggcctttgagccgcaaatcctcaccaagctcgcctgcggtgcgcgacctcgtagaacgccatcaggcctcattgggcaggtcacaatccttcagccatcaacagccttctaggtcacacttgatgcggagtgggtccgtgatggagcggagggctataacgccgcctgtcgcaagtcccgtgggcagacccctgtatttgccaccagacaaggcggtcctcagcttagacaagattgctaaacgggagtgtaaagtgctcgtggtggaacctgtgaaatag

SEQ ID NO: 54633 - DNA, 1743 bp, Artificial Sequence
  Description of Artificial Sequence: Synthetic coding sequence
atggaatcccagtgcgactattcaatgtactttcctgccgtccctctgcccccacgcgctgaattggcaggggaccccggaagatacagggcattgcccaggcgaaatcacctttatctcggagagaccgtccgcttcctgttggtactgcgctgtagaggtggagccggaagcgggacagggggaggacctgggcttgggtcacggggtgcctgggcggaactggccacagctttggccgctcttgcttctgtgtccgccggaggcggtatgccaggtggtgggggagcaggggaccaggatagcgaacccccagggggtggggatcccggtgggggagggctttttagggggtgctcacccttgttgacccacgggcctggccctgctacatccggcggagccacgacactccccgttgaggaacccattgtgtcaaccgatgaggtaattttcccactaactgtttcacttgatcgcctgccacctggcacccccaaagcaaagattgtggtcacggtgtggaagcgcgaaattgaagcacccgaggttagagatcaagggtatctccgcctcctgcagaccagatcccccggagagacgtttagaggcgagcagtctgcattcaaggcacaggtttcgacattgttgaccttactgcctccacctgtccttagatgcagacaattcacggtggccggaaagcatctgactgttttgaaagtcctgaatagcagttcccaagaagaaatttcaatctgggacattaggattcttcctaatttcaatgcctcttacctccctgttatgcccgacggctccgtactcctggtagataatgtctgccaccagagtggggaggtgtcaatgggcagcttttgtcgtctgcccggaacctctggatgtttcccgtgtccgctgaatgccctggaggaacacaacttcctctttcagttgagaggaggggagcaacccccaccaggcgctaaggagggcctggaagttcctctcatcgcggtggtccagtggtccactcccaagctcccattcacccagagcatctatactcactataggctccctagcgtccggctagaccgaccctgctttgttatgacagcatcctgtaaaagcccagtgaggacttatgagcgattcacagtaacatacacccttcttaacaatctgcaagacttcctggccgtccggctggtctggacccccgagcacgcgcaagcaggaaagcagctgtgcgaggaagaacggagggccatgcaggccgcacttgatagcgtcgtttgccacacaccactgaataacttggggtttagccgaaaaggatccgcactgacgtttagcgtggcttttcaggcccttcgaacaggtctgttcgagctttctcagcatatgaagctaaagctgcaatttactgcctctgtgtcacaccccccacctgaggctaggccgctgagtaggaaaagctcgccgtccagtccagccgtgcgggacctcgtggagcggcaccaggcttcattaggccgaagccaatcctttagccaccaacagccttcccgctcgcacctcatgcggtcaggttccgtgatggagagacgggctatcactcctcctgtggccagcccggtcggaagaccactttaccttccccctgataaggccgtactgagcctcgacaaaatcgcgaagcgggagtgtaaggtgttggttgtagaacccgtgaagtag

SEQ ID NO: 54634 - DNA, 897 bp, Artificial Sequence
  Description of Artificial Sequence: Synthetic coding sequence
atggaacgcctgacactgccccttggtggagctgcagctgtagacgagtacctcgagtaccgtcgaattgtgggcgaggatgatgggggaaagctttttacacccgaggaatacgaagaatacaaacgcaaagtgcttcccctgcggttacagaaccgcttgtttgtgtcctggagaagcccaaccggtatggattgtaagcttgttggaccagaaactctgtgcttctgtactcaccggtacaagcagcacaaaaccgacctggaagctattcctcagcagtgcccaatcgacctcccatgccaggttaccggttgccagtgcagagcctacctgtatgtacctttgaacggttcccagcctattcgctgtaggtgtaaacacttcgccgaccaacattccgccgctccaggatttacttgcaacacctgtagtaaatgctccgggtttcattcctgcttcacttgtgcctgcgggcagccagcatacgcacatgacacagtggtggaaacaaagcaggaacgtttagcccaggaaaaaccggtggggcaagatatcccgtatgccgctatggggggattgactgggtttagtagcctggccgagggatacatgcgcttggacgactccggtattggcgtcccatccgttgagtttttggagagtccaatcacagccgtcgacagcccctttctgaaagctttccaggcaagcagttccagctctccagaaacactcaccgacgtgggtacctccagccaggtctcctcactgaggagaccagaagaggacgacatggccttttttgagcggagatatcaggagagaatgaaaatggagaaggctgcaaagtggaagggcaaagcaccactcccgagcgcgaccaagccctcctag

SEQ ID NO: 54635 - DNA, 789 bp, Artificial Sequence
  Description of Artificial Sequence: Synthetic coding sequence
atggaaagactgactctccccctgggcggtgctgccgcagttgatgaatacttggaatacaggcgcattgttggcgaagacgatgggggtaaattattcactcctgaagaatatgaagaatacaagcgaaaggtgttacccctgcgcctgcagaaccgactttttgtcagctggcgtagtcctacgggcatggattgtaaactcgttggacctgaaactctctgtttctgtacgcatcggtacaaacagcataaaaccgatttggaggctatcccacagcagtgtccaatcgacctcccctgtcaggtgacaggctgccagtgtagggcatatctttacgtgcccctaaacggttctcagccaattcgttgccgctgtaagcactttgctgaccagcatagcgctgccccaggcttcacttgcaatacttgctcgaaatgttctggctttcactcatgctttacttgtgcctgcgggcagcccgcttacgcacacgatacggtcgtagaaaccaagcaggagagactggcccaggagaagcctgtgggacaggacatcccttatgcggctatgggtggcctcactggtttctcaagtctggcagaggggtacatgcggctcgatgacagtgggatcgtgggcaccagtagtcaagtttctagcttgcgtcgaccggaggaagatgacatggcgttcttcgagcggagatatcaggaacggatgaagatggaaaaggccgctaaatggaagggaaaggctccactcccttctgcaacaaaaccctcttag

SEQ ID NO: 54636 - DNA, 615 bp, Artificial Sequence
  Description of Artificial Sequence: Synthetic coding sequence
atggagcggctcactctgccactcggtggagcggctgctgttgacgagtacctggaataccgcagatataagcagcacaagaccgacctggaggccatcccccagcagtgcccgattgatctgccgtgtcaggtaaccggctgtcagtgcagagcttatctgtatgtgccgttgaatggtagccaacccatacgatgtcggtgtaaacatttcgctgatcagcattccgccgctcccggttttacctgtaacacatgcagcaaatgtagtgggtttcacagctgctttacatgcgcctgcggccaacccgcttatgcccatgacaccgtggtagagacgaagcaagagagactggctcaggaaaagccggtgggtcaggacattccttacgccgctatgggcggactgactggtttctcatccctggcagagggctacatgaggctggacgactctggcattgtcggaacttctagccaagtcagcagtctccggagacccgaggaggatgacatggcctttttcgaacgcagataccaggagagaatgaagatggaaaaagcagccaaatggaagggcaaggcgcctctgccctctgccaccaagcccagctag

SEQ ID NO: 54637 - DNA, 585 bp, Artificial Sequence
  Description of Artificial Sequence: Synthetic coding sequence
atggcaaaacagaaaagaaaagtacccgaggttacagaaaaaaaaaacaagaagttgaaaaaggctagtgctgagggccctctcctcggaccagaagcagctccctccggggagggagctgggtccaagggtgaggcagtgcttaggcctggtctcgatgcggaaccagagcttagccccgaagaacagcgggtcctggagcggaaactgaaaaaggagcgcaagaaggaggagcgtcagcgcctaagagaggcaggcttggtcgctcaacatcctcctgcaaggagatcaggagccgagctcgcccttgattatttatgccgctgggcccagaagcataagaactggaggtttcagaaaactagacagacctggctgctccttcacatgtacgatagtgacaaggtccctgatgaacacttcagcacgctcctggcctacctagagggcttacaaggaagagccagagagctgactgtccagaaggccgaagcactgatgcgagaactagacgaggaagggtctgatccgcctctgccagggagggcgcaacggattcgacaggtactgcagcttctgagttag

SEQ ID NO: 54638 - DNA, 585 bp, Artificial Sequence
  Description of Artificial Sequence: Synthetic coding sequence
atggccaagcagaagaggaaggtgccagaagtgacagagaaaaaaaataagaaacttaagaaggctagcgccgaagggccacttctcggccctgaggcggcaccgtcaggagagggggcaggtagcaaaggcgaggctgtcctccgacccggactggatgccgagccagaattgtcacctgaggagcagagggtgctggagcggaaactgaagaaagagaggaagaaggaggaacgccagagactcagagaggctggattggtcgctcaacatcctccagctcgcaggtctggggcagagctagccctcgattacctgtgccgctgggcgcagaagcataaaaattggaggtttcaaaagaccagacaaacgtggttgctgttacacatgtacgactcggacaaagtgcccgatgagcacttcagcacattattggcctacctggagggcttgcagggtagagcgagagagttgaccgttcaaaaagctgaagctttgatgcgagagctcgacgaggagggatcggatccgccacttcctggacgcgctcaaaggatcagacaggttttacagctattaagttag

SEQ ID NO: 54639 - DNA, 585 bp, Artificial Sequence
  Description of Artificial Sequence: Synthetic coding sequence
atggccaagcagaagcggaaagtgccagaagtgacagagaaaaaaaacaaaaaactcaaaaaggctagcgccgaggggcctctcctaggccctgaggcggctcctagcggagaaggtgccggatcaaaaggcgaagctgtgctgcggcctggcttggacgctgaaccagagctttcacctgaggagcagagagtgctcgagcgcaaactgaagaaagaaagaaaaaaagaggagaggcagaggctacgtgaggcaggactggtggcacagcatcccccagctcgccgatctggcgctgagctcgccctggattacctttgccggtgggcccagaagcataaaaattggcgctttcagaaaaccaggcagacatggctccttctacatatgtatgactccgacaaagtcccggatgaacacttctccactctgctggcttacctcgaagggctgcagggacgtgcccgtgagcttacagtgcagaaggctgaggccctcatgcgcgaactggacgaggagggatcagatccccctctcccaggcagggcccaaaggattcgccaggttctccagctgctgagctag

SEQ ID NO: 54640 - DNA, 579 bp, Artificial Sequence
  Description of Artificial Sequence: Synthetic coding sequence
atggcaaaacagaagcggaaggtgcccgaagttaccgagaaaaagaataagaaacttaagaaggcatcggcggaggggcctctgctcggaccggaagcagctccttctggcgaaggggcaggcagcaaaggagaggcagtgctgcgccctggcctggatgccgagcctgagctcagccccgaagaacagagagtcctagaaagaaaactcaaaaaagagaggaaaaaggaagagagacaacgcttacgcgaagcaggccttgttgctcagcatcctccagccaggcgatctggcgctgagttggctctggactacctgtgcaggtgggcccagaaacacaagaactggaggtttcagaagacacgccagacatggttgctgctccatatgtatgactcggacaaggtgcccgatgaacacttcagcacactgctggcctacctggagggacttcagggacgtgcacgagaactgactgtgcagaaggccgaggccctgatgagggaactcgatgaggagggttccgatccacccctgccgggtagagcccagaggatccggcaagtgctccagctgtag

SEQ ID NO: 54641 - DNA, 888 bp, Artificial Sequence
  Description of Artificial Sequence: Synthetic coding sequence
atgagaaacacttccaaagagctccagggtgcaacacacagatacgccccatgcgattggtattatcacgtccctgtgaagcgttccgaaaaagctgttgacgcacccccagcatcccagattccaggtttatccaacctgggtgacagccactccgaaaacctgcccggaacaaggaggtattggatcaaagaaactgattcggagtatgtgaaactggcaaagcagggagggaggccagatctgttgaagcattttgcaccgggtacccgtaagggatccccagtggcctattctcttccagactggtacatccaccacagcaaacctccaaccgccagtcagcaagaggtgcgggcagttagcatgcccgattacatggttcacgaagaatttaacccagaccaggcaaatggtagctatgcgtctaggcgtggccctttcgacttcgatatgaaaaccgtgtggcagcgtgaggctgaagagctagaaaaggagaagaaaaagcttaggctaccagcaattgacagcaagtatttgtccaaggccggaacacccttgggtcctaaaaaccctgccggaagccgcctctcatttccaccagtccccggacaaaaaaattcctcaccaacaaatttttccaaactgataagtaacggctacaaagatgagtggctgcagcagcagcaacgcgcagatagcgataaacggaccccaaagacctccagagcaagtgttctgagccagtcgcccagagaccttgaggggccacaggacgcagctcggctgcaggacgccgaagcttctgagggtcctgaggatacaccagagtcctcccagagccccgaggagtcagtgtctgcatctacaccagcagagttaaagtag

SEQ ID NO: 54642 - DNA, 888 bp, Artificial Sequence
  Description of Artificial Sequence: Synthetic coding sequence
atgagaaatacctccaaggaactacaaggggcaactcacaggtacgctccatgcgattggtactaccatgttcctgtgaagagatccgagaaggctgtcgatgcaccccctgcttcacagattcctggccttagcaatttaggagattcccattctgaaaacctgccagggacacggcgatactggataaaagaaactgactcggagtatgttaagttagctaaacaaggcggtagacctgacttgctaaaacacttcgcccctgggactagaaagggcagcccggtagcctactctttgcctgattggtacatccatcattctaaacctcctactgcatcccagcaggaagtcagagccgtttctatgcctgactatatggtccatgaagaatttaaccctgatcaggccaatgggagttatgcttctagacgagggcctttcgattttgacatgaaaacagtttggcagcgggaggctgaggaattagagaaggagaaaaagaaattgcgcttgccggcaatcgactccaaatatttatccaaagcaggcacgcccctcggccctaagaatcccgcaggctcacgattgagctttccccctgtgcccggacagaaaaactcctcccctaccaacttttctaaactcatatctaatggctataaagatgagtggttgcagcagcaacagagggccgattcagataagaggactcccaagacatctcgggcatctgtcctgagtcagagcccacgcgatcttgaagggcctcaagacgccgcacgcctgcaggatgctgaggcaagtgagggacccgaggacactcccgagagcaatacgtgtcctgaggaaagtgtaagcgcctctacaccagctgagctcaagtag

SEQ ID NO: 54643 - DNA, 462 bp, Artificial Sequence
  Description of Artificial Sequence: Synthetic coding sequence
atgccagattatatggtgcatgaagagttcaatcctgatcaagcaaacggatcatatgcctctcgcagagggccatttgatttcgacatgaagactgtatggcagcgcgaagccgaagagctggaaaaagagaagaaaaaacttcgcctccccgcaattgatagtaagtacttgagtaaggccggaacccccctcgggccaaagaacccagccggttctaggctcagctttccgcctgtgaatggctataaggatgaatggctgcaacaacagcagagagccgattccgataagaggaccccgaagacctccagggcatctgtcttgagccaatctccaagagatctggaaggtccccaggatgccgctcggctccaggacgccgaggccagcgaagggcctgaagacacacccggacctgaggagtcagtgagcgcgagcacgcccgctgagcttaagtag

SEQ ID NO: 54644 - DNA, 300 bp, Artificial Sequence
  Description of Artificial Sequence: Synthetic coding sequence
atgacaagtgcccttacccagggtcttgagcgcattcctgaccagctgggatatctcgttctatctgaaggcgcagttttagcgagcagtggggacctggagaatgacgagcaggctgcttccgcaatcagtgaacttgtgtcaacagcatgcgggtttaggctgcaccggggtatgaatgtgccattcaaaaggctgagcgtcgtctttggtgaacataccctccttgtaaccgtctctggacagcgagtgtttgtagttaagcggcagaatcggggacgagaaccaatcgacgtttag

SEQ ID NO: 54645 - DNA, 1218 bp, Artificial Sequence
  Description of Artificial Sequence: Synthetic coding sequence
atggagcctggcgctggtgggcgtaacactgctagggcccaaagagcgggaagtcctaacacaccacctcccagagaacaagaacgaaagctcgaacaagagaagctttctggagtcgtcaagagcgtgcatagaagactgcggaagaaatatcgtgaggtaggggatttcgacaagatttggagagaacactgcgaagatgaagagacactgtgcgagtacgcagtggcaatgaaaaacttggctgataatcactgggccaaaacctgtgagggagaagggaggatcgagtggtgttgctccgtgtgtcgggagtactttcagaatggaggaaaaaggaaagcactggaaaaggatgaaaagagagccgtgcttgctaccaagacaacacccgcattgaatatgcacgaatcgtcccagttagaagggcacctgacgaatctgtcctttaccaatcccgaatttatcactgagcttctccaagccagtggcaagataagactcctcgacgtgggatcttgttttaacccatttttgaaattcgaggagtttctgacagtcggaatcgatattgtacccgctgtcgagagcgtctataagtgtgacttcttgaacctgcagttacagcagccgctccagcttgcacaggacgccattgacgcattcctgaagcagctaaaaaacccaatcgatagcctgcccggagagctgtttcacgtggtagtgttctctctgctgctatcatattttccgtccccatatcaaaggtggatatgttgcaagaaggcccatgagctcctggttctgaacggcttactcctgatcataactcccgattcatcccaccagaacaggcacgccatgatgatgaagagctggaaaattgcaattgaaagtttgggattcaagagattcaaatattccaagttctcacacatgcacttgatggctttccgcaagatcagcctaaagacgactagcgacctggtgagccggaactatcctgggatgctatacattcctcaggatttcaacagcatagaggacgaggaatactccaatccatcatgctatgtcagaagcgatattgaggacgaacagcttgcttatggatttaccgagctcccggatgccccatacgacagcgactctggggaatcacaggcctcctccatccccttttatgagctggaggacccgatcctattattaagctag

SEQ ID NO: 54646 - DNA, 1059 bp, Artificial Sequence
  Description of Artificial Sequence: Synthetic coding sequence
atgggcgacttcgataagatttggagagagcactgcgaggatgaggagactctctgtgagtacgccgtagccatgaaaaatctggccgacaatcattgggcaaagacatgtgagggcgagggaaggattgaatggtgctgttccgtgtgcagagaatatttccagaacggtggtaaacggaaagcactcgagaaagatgagaaacgcgcagtactcgctaccaaaacgacccctgctctgaatatgcatgagtcctcccagttggagggacatctcaccaacctctctttcacaaacccagagttcataacagagctgcttcaagcctcagggaaaattagactgttagatgttgggagctgctttaacccattcctgaagttcgaggaattcctgactgttggtatcgacatcgtgccagccgtggagtcagtgtacaaatgtgattttctgaatctgcagctccagcaacctctgcagcttgcacaagatgcgatcgatgcttttctcaagcaattgaaaaatcccatcgattctctcccgggtgagctgttccacgttgttgtcttcagtttgctgctgtcttattttccttcaccataccagcggtggatatgttgtaagaaggcacacgaactgttggtccttaacgggttgcttcttatcataacccctgatagctcccatcagaaccgccacgctatgatgatgaaatcctggaaaattgccattgaatctcttggtttcaaaaggttcaagtactccaaattcagccatatgcacctcatggcttttcggaaaatctcccttaaaaccaccagcgacctggttagtaggaactaccctgggatgctgtatatccctcaggactttaactctatagaagatgaggagtacagtaatccaagttgctacgtcagatccgatattgaggacgagcaactagcatatggcttcacggagcttcctgatgctccatatgactcggacagtggagagtcgcaggcttccagcattcccttttatgaattggaagacccgattctcctcctaagttag

SEQ ID NO: 54647 - DNA, 621 bp, Artificial Sequence
  Description of Artificial Sequence: Synthetic coding sequence
atggtggttgtgatgaaatttttccgctgggttcgtagagcttggcagaggattatttcctgggtgtttttctggcgacagaaaattaaacccactatctcgggccatccagactctaagaaacactctctgaagaagatggaaaagacacttcaggtggtggaaaccctgcggctcgtggagctccctaaagaagcaaaacctaaactcggagagtcccctgagctagctgacccgtgcgttctggctaaaaccactgaggagaccgaagtggagctcgggcagcaaggccagtctctacttcagttaccaaggacagcagtcaagtcagtctccaccctgatggtgagtgcacttcaaagcggctggcaaatgtgtagctggaaatcaagtgtgagctcagcaagtgtatcatctcaggtcagaacgcagagccctcttaagacgcccgaggctgagctgttgtgggaagtttatctggttttgtgggctgtgaggaagcatttaagacgattatacaggagacaggagaggcaccgcaggcaccatgtccggtgccatgccgctccaaggccgaaccccgcacagagtctgaaactcgacgcccagagcccgttgtag

SEQ ID NO: 54648 - DNA, 762 bp, Artificial Sequence
  Description of Artificial Sequence: Synthetic coding sequence
atgagcttcagtgtgcacaatcaaaagggatcaaaacggcctctgcccctggagcccttgttgtttctacaggtgccacgatcaaattaccttcactttcaggaagagaaacagcggttacacctgaagaaatttctacttgacaggatgtttttggttgccaaaattcaggccaatgtcgagcgtaaggacgtggctgattattatgaacaaatgttccaatcagtcctgaagcatcacttgggggaggcggtgactggacttctgttgatttaccctacctcgatcctccatatcctcgaaagcagctccgacacgctatacaaagtgctgctggattacattggccatgtcaaggacgagacggtcttttttatccagcaaatgaagatcattgtgatctcgcataatattcccatgcggctgttcatgcagtggcacgtgagtgtcattaaggttcccgtcatgtacctcgatgatgtgacacagtctcagtcgttgaaagaagtgatcactgatttccttacacaaacgcacaagttgtcactgtatctgtgccagacaatgaaagttgggaccaaaggtcctggcgacaatttacaccaggtcgcccctgatctcctgctgccagagcagattataaagtatctgtgcaagagcgaagagttcatggaccccgcaacttttattaatatgtacaataggcctatccacattacactcgatagcgaggtggtgtggcctgctccgagtaggttttag

SEQ ID NO: 54649 - DNA, 2688 bp, Artificial Sequence
  Description of Artificial Sequence: Synthetic coding sequence
atgtggacggaggaggcaggtgccacggccgaggcacaggagagcgggatccgcaacaagtcatcatcttctagccaaatcccagtcgtgggcgtagtgacggaggatgacgaagcacaggacgtctttaagccgatggacttgaacagggtcattaaactgcttgaagagaccgacaaagacggtcttgaagagaagcagcttaaattcgttaagaaactggtccagtgttaccagaacggtctgcctctgcgggacctggctcagatcttcaagatcctcaatctgtgtagtggcaagattaagaatcagccgcgattcatcgagtcggcttacgacattatcaagttatgtggacttccttttttgaagaaaaaggtgagcgatgagattacttacgccgaggatacagcaaacagcattgcactgctcggcgacctgatgaagatcccttcttctgaacttagaatccagatctgtaagtgtattgtcgatttttaccacgctgaacccccaaagaaacatatccccggatatcaacaggcctccagctcttacaaaatccagatggccgaggtgggcggactagcgaaaacaatggtacagtccatgactcttttggaaaaccagttggttgagaagctatgggttctgaaggtgctgcagcatctcagcacttcagaagtgaattgcactatcatgatgaaggctcaggcagctagcggaatctgtacacatctgaacgatccagatccctctgggcagttgctcttcaggtcatccgagattctctggaacttgctcgaaaaaagtagtaaggaggaagttattcagcagttatcaaatctcgagtgtctcctcgctctcaaagaagtattcaagaacttgttcatgagaggcttctcccattacgataggcagctgaggaatgatatacttgtaataaccacgatcatcgctcaaaatcctgaagcacccatgattgagtgtggctttaccaaagatctcatactgttcgctacctttaacgaagtgaaatcccagaatcttctggttaagggactgaagctcagtaacagttacgaggattttgagctcaagaagctgctctttaacgtgattgtgattttgtgcaaggacctgcctacagtgcaactgcttatcgatggcaaggtgatcttggcactatttacttacgtaaaaaaacctgaaaaacaaaagatcatcgactggtctgctgcccagcacgaagagcttcagctgcatgccatcgcaaccttatcgtccgtcgcaccactccttatagaggagtatatgagttgtcagggtaacgctcgagtgctggcatttctggagtggtgcgaatctgaggacccatttttcagccacggcaatagcttccacggcacaggtggcaggggcaacaaattcgcccagatgcgctactctttacggctgctgagagctgtcgtatatctagaggacgagacggtgaataaagatttgtgtgagaaaggaaccatccaacagatgatcggcatcttcaagaacatcataagcaagcctaacgagaaggaggaggccatcgtactggaaatacagtcggacatactgctcatcctgagcggcctttgcgaaaaccatatccagcgtaaagaaatcttcggcactgagggtgtggacatcgtgctgcacgtgatgaaaaccgaccctaggaagctgcaatctggcctgggctataacgttctcctgttcagcaccctggattccatatggtgttgtattcttggctgttaccccagcgaagattacttcctggagaaggaaggcatctttctcttgctagaccttctggccttgaatcaaaaaaaattttgtaatctcatcctcggtataatggtggagttttgcgacaatccaaaaactgctgcccacgtcaacgcttggcagggtaaaaaggatcagactgcggctagcctattaatcaaactgtggaggaaggaggaaaaagagctgggggtgaaacgcgataaaaatgggaagattatagactttgaaaacttgcccggactgtctgccgaagacttcgtgaccctctgcatcattcatagatacctcgacttcaagatcggagagatatggaatgagatatatgaagagatcaagctagaaaagcttcggccagtgaccactgacaaaaaggcccttgaagcaatcactacggccagtgaaaacattggtaaaatggtggccagcctccagagcgacattatcgagtcccaggcctgccaagacatgcaaaatgaacagaaagtgtacgccaagatccaagccacccataaacagagggaacttgcgaacaaaagttgggaagatttcctcgcacgtacaagtaatgccaagacactcaagaaagctaaaagtctgcaggagaaggcaattgaggcctccaggtaccacaaacggccacagaatgcgatctttcaccagacgcatatcaaggggctcaacacaactgtcccctccggaggcgtagtgacagtggagtcaacacctgcccgactggttggaggtcctctcgtggatacagatatagccctcaagaagctgcctatccgcggaggcgcactgcagagggtgaaggcggttaagattgtggatgctccaaagaaatctattcctacatag

SEQ ID NO: 54650 - DNA, 2826 bp, Artificial Sequence
  Description of Artificial Sequence: Synthetic coding sequence
atgtggaccgaggaggccggagcaaccgctgaggcccaggagtccggcatcaggaacaagagttcctcttctagccaaattccagttgttggagtggtgactgaagatgacgaagcacaggatgttttcaaaccaatggatctcaatagggtgattaagctgctcgaggaaactgacaaggatgggctagaggagaagcagctcaaattcgtcaagaagctggtacagtgttaccagaacggcctccccctgcgcgacctcgctcagatcttcaaaatactgaacctgtgttccgggaagattaagaaccaaccaagatttattgaatcagcatatgacattattaaactatgtggattgcccttcctcaaaaagaaagtgagtgatgagatcacatatgcagaagacacggccaattcaattgcactgctcggggatcttatgaaaatcccttcctctgagttgagaatccagatctgtaagtgcattgtggacttctatcacgcggagcctccaaaaaaacacattcctggctaccaacaggcatccagctcctacaagatccagatggctgaggtcgggggtctcgccaaaaccatggtgcaatcgatgaccctgttagagaaccagctggttgagaaattgtgggtactgaaagtgcttcagcacctgtccacttccgaggtgaactgtaccatcatgatgaaggcccaggcggcatccggaatctgtacgcaccttaacgatcctgatccgagtggacagctgctgttcagaagttctgaaatcttgtggaatcttctcgaaaagtcatctaaagaggaggtgattcagcagctcagcaacctggagtgtttgctcgcactaaaggaagtgtttaagaatctcttcatgcgtgggttcagccattatgaccgccagctccgcaacgacatccttgtgattacgaccatcattgctcagaaccctgaggcacctatgatcgaatgtggatttactaaagatctgatcctgttcgcaacattcaacgaggtgaaatctcagaacctgctggtgaagggtctcaaattgtctaactcgtatgaggactttgaactgaagaaactgcttttcaatgtaatcgtcatcctctgtaaagatctaccaaccgtgcagctcctgatcgacggtaaggtaatcttggctctcttcacatacgtgaaaaaacctgagaagcagaaaattatagattggtccgccgcacagcacgaggagcttcagctgcatgcgatcgctacgctgtccagtgtggcgcctcttctaatcgaagagtacatgtcttgccaaggcaacgcgcgagttctcgcatttctcgagtggtgcgaaagcgaagaccctttctttagccacggcaactccttccacggcactggtggaaggggaaataaattcgcccaaatgaggtactctcttagattgctgcgggcagtggtttacctcgaggatgagactgtgaataaggacctgtgcgaaaagggcacgatccaacaaatgatcgggatcttcaaaaatatcatatccaaaccaaacgagaaagaggaggccattgttcttgagatacaatccgacatcttgctgatcctctctggcctatgcgaaaaccacattcagaggaaagagatcttcggcacagagggcgtggacattgtattgcatgtcatgaaaaccgacccgaggaaattacagtcggggctcggctacaacgtgttactgttctccacattggactcaatctggtgttgcatcttggggtgttatccctcagaggattactttttggagaaggaaggaatcttcctgttactagatctgctggctttaaatcagaagaaattctgcaacttaatacttggaattatggtagagttctgtgacaacccaaaaaccgccgctcacgtcaatgcctggcaagggaaaaaggaccaaaccgcagcttccctccttatcaagctgtggcgcaaggaggagaaggaactgggagttaagagagataaaaacgggaagattatcgatactaaaaagccattattcacatcatttcaggaagaacagaaaataatcccgctgccagccaattgcccgagcatcgctgttatggacgtatccgagaacattcgggcaaagatttatgccatcctggggaagctggacttcgaaaatttgccaggcctgtccgcggaagatttcgtcaccttgtgcataatacaccggtatcttgattttaaaattggtgagatatggaacgaaatctatgaggaaatcaagttggaaaaactgcgccctgttaccacagacaagaaagccctggaggcaattaccaccgcttcagaaaatataggcaaaatggtggcatcactgcagagcgatattatcgagagccaggcttgccaggacatgcaaaatgagcagaaagtatacgcaaaaatacaggccacgcacaaacaaagagaattggccaataagtcttgggaggactttctggcgaggactagtaatgctaaaacactgaagaaggccaaatctttacaagagaaggccatcgaagctagccgttatcataaacgaccccagaacgcaatcttccaccaaacccacattaaggggcttaacactacagtgccctccgggggagtagttacagttgagtctacacccgcaagattggtggggggaccattggtggacaccgacatcgctctgaagaagctgcctataagggggggtgcactgcagcgggttaaagccgttaagatcgtggatgcacccaagaagagcattcccacatag

SEQ ID NO: 54651 - DNA, 1437 bp, Artificial Sequence
  Description of Artificial Sequence: Synthetic coding sequence
gaattacagctccacgcaatagctactctgtcctctgtggctccgcttctgattgaagaatacatgagctgccaggggaacgccagggtgttggccttcctcgagtggtgcgaatcagaagatccttttttctcccacggcaattccttccacgggaccggcggtagaggaaacaagtttgcccagatgagatactcccttaggctgctcagagcagtggtatatctcgaggacgagactgtaaataaggatctgtgcgaaaagggcaccatccagcagatgataggcatcttcaagaacatcattagcaagcctaacgagaaggaagaggccatagtgctcgaaattcaaagcgacatcctgctgatcttgagcggactttgcgaaaaccacattcagcggaaagagattttcggcaccgagggagtggacatcgtccttcatgtgatgaagaccgaccccaggaagttgcaaagcggcctgggctataatgtgctgctgttcagcactctggactccatctggtgctgtattctgggctgttatcccagcgaggattacttcctggagaaggaaggcatattcctgctgctggatcttttggccctgaatcaaaagaagttctgtaacctgattctgggcatcatggttgagttttgtgataaccctaagactgccgcacacgttaacgcttggcaggggaaaaaagaccagaccgccgcttctctgctgatcaagttatggagaaaagaagaaaaagaactgggggtcaaacgcgataaaaacgggaagatcattgatttcgaaaatctccccggactttccgccgaagatttcgtgaccttatgtattattcacaggtaccttgactttaaaatcggggaaatctggaacgagatttatgaggaaatcaagctggaaaaattgagacccgtgacaaccgacaaaaaggctctagaagccattacaactgcaagtgagaacattggcaagatggttgcatccctgcagagcgacattatcgaaagccaggcttgccaggacatgcaaaacgagcagaaggtgtatgccaagattcaggctacacataagcagagagagctagctaacaaatcatgggaggatttcttggctcgtacctctaatgccaagacccttaaaaaagctaaaagcctacaggaaaaggccatagaagcaagtcggtaccataaaagacctcagaacgccatcttccaccaaactcatattaaggggctgaacaccacagtaccttcaggaggtgtggttacagtggagagcacgcctgcgcgtcttgttggcggtccgctggtggacaccgacatcgctctaaagaaattacctatccgcggaggagcattacagcgcgttaaggctgtgaagattgttgacgcacccaagaagagcatcccaacctag

SEQ ID NO: 54652 - DNA, 2772 bp, Artificial Sequence
  Description of Artificial Sequence: Synthetic coding sequence
atgtggacggaagaggctggcgcaactgcggaagcccaggagtccgggatcaggaataagagctcaagcagcagtcaaattcccgtcgttggagtagtgaccgaggatgacgaagcacaagacgtgttcaaaccaatggacctgaaccgcgtgattaaacttcttgaagaaacggacaaggacgggttggaggaaaagcagctgaagttcgtcaagaaactggtccagtgttaccagaacggacttccactcagagatctagcccagatttttaagatactgaatctatgttccgggaagataaaaaaccaaccacggttcatcgaatccgcttacgatattattaagctgtgtgggttacccttcctcaaaaagaaggtgagtgacgagatcacctacgccgaggatacagctaatagcattgcactgctcggagatcttatgaaaattccatcctccgaactccgtatccagatttgctaccagcaagcgtcctcaagttataagatccagatggctgaggtggggggacttgcaaaaacaatggtacagtccatgacacttctcgagaatcaacttgtcgaaaagttgtgggttctgaaggtcctccagcatctgagcacatccgaagttaactgtacaataatgatgaaggcccaagctgcttccggcatttgcacacatcttaatgaccccgatccctctggacagctgctgttccgatcttccgagatcctttggaatcttctagagaaatcctctaaagaggaggtgatacagcagctgtctaatctggagtgtctgctcgcgttgaaggaagttttcaaaaatcttttcatgcgcggatttagccactacgaccgacagctgcgaaacgacatcctggttattactaccatcatcgcccagaatcctgaagcgccaatgatagagtgtggattcactaaagatcttatcttgtttgcaactttcaatgaggtgaagtctcagaaccttctagtcaaaggcctgaaactgtctaacagctacgaggacttcgagctgaaaaagctcctgtttaacgttatcgtcatcttgtgtaaggatctcccaacagttcagctgctcatagacgggaaagtaattttggctttgtttacttacgtgaagaaacctgaaaaacagaaaattatcgattggagcgctgctcagcatgaagagttgcagcttcatgccatcgccactctgtcctctgttgcgccacttctgatcgaagagtatatgtcctgccaaggcaacgcacgggtgctggcctttctggaatggtgtgagagtgaagatcccttttttagccacggcaacagtttccacgggacaggaggcagaggcaataagtttgcacagatgagatacagtctgcgattactgcgtgcagttgtgtatctggaagatgagacggtaaacaaggacctttgcgagaagggtactatccaacagatgatcggaatcttcaaaaacattattagcaagcccaacgagaaggaagaggcaattgtcctggagattcagagtgacatactcctcatcctcagcggcctgtgtgaaaaccatatccagaggaaagagatcttcgggacggagggcgtagatatcgtgctgcatgtgatgaagaccgatccacgcaagctccaaagtggccttggctacaatgtgttattattttctaccctggattctatctggtgttgcatactcggctgctatccgtccgaggattatttcctggagaaagagggaatcttcctccttcttgacctgctggcattgaatcagaaaaaattctgtaatctgatcctcggtattatggtggagttctgcgacaaccctaaaaccgcggcacatgtgaacgcctggcagggaaagaaagatcaaaccgcggcatctttactgattaaactctggaggaaagaggagaaagaactcggcgtgaaaagagacaagaacgggaagattatagacacaaaaaagcctctgttcactagttttcaagaagagcagaagataatacctttgccagctaactgtccatctattgctgtgatggacgtttccgagaacatccgggcaaagatttacgcaattctgggaaagctggatttcgagaaccttcctggcttatctgccgaggattttgtaacgttatgcatcattcatcggtatttggacttcaagatcggggagatctggaacgagatatacgaagagattaagttggagaaactgcgtccggttactacagacaaaaaagccctggaggccataacaaccgcttccgagaatattggaaaaatggtagccagccttcagtccgatataatcgagtcacaggcatgtcaagatatgcaaaatgagcaaaaggtgtatgccaaaatccaggcgacccacaagcagcgggaactcgctaataagtcatgggaggattttctggctagaacctcaaacgctaagacactgaagaaagccaaaagtctgcaggaaaaagctattgaggcctctcgctaccacaagcgccctcagaatgctattttccatcagacacacatcaagggactcaacaccaccgtgccctccggcggtgtcgtaaccgtcgagtctacacccgctcgcctggtgggcggaccactggtagatactgatattgccctcaagaagctgccgatcagagggggagctctgcagagagtgaaggctgtaaaaattgtagacgccccaaagaagtctatacctacgtag

SEQ ID NO: 54653 - DNA, 456 bp, Artificial Sequence
  Description of Artificial Sequence: Synthetic coding sequence
atgagaatggccccaaccgagagtacagaggggcgacgcctttggccaggtcctcgagaaggcggatctggcaaggagaccacttcggaaaaactctctaatctgccacggccacacagttattcccctaaacgagccgacgccgaatcctttcgaggggtccccgctgcctttaagaaatgtagggaggtctttagagcctgctgggggtcccgtgaactgctgttcctgttcaaagcaatcagcgaggcaggacccgctcagaattcttgcggaattaccttggagaaggccggaggcttagaggacactggctcacattggctgagctgggcccgttgtaaagttctgtatataaatggtttcactgacccttggaaggatgcccaagcttggatccttatcgtctcatgcaaaaagggcaaaggaacgcctgaaagagaagggaggaattag

SEQ ID NO: 54654 - DNA, 510 bp, Artificial Sequence
  Description of Artificial Sequence: Synthetic coding sequence
atgggatcctgtgggtgggctctgacccaaagcgactggtgcccctttaagaaacggaaaaggcatcagagatgcgctcacagcgagacaaggcatatgcggacacagaggcagggcggatatctccaagcccgtgaaaggggactcggcgaagctaatcctgcttatgcactcattctcgactttcagccacccgaacttcagaacctgagtgaaatgggcattaatcacgaactaggatattcatctatcatccccatgatgaagcgtgccttttccgcctgtggtactttaggtttgatcatgagcggcatttttgataatcctggacctatcaaaaacacactgaagaaggcttttaccatgctgtggagttttaccgtctacacaagacttgagtctctgcgagtggccctttctaatgaagagatggtgccctttatcttccaccttaagacgcagactgcaaacatgctgagcggacccattagtacccctatgctgttatag

SEQ ID NO: 54655 - DNA, 1317 bp, Artificial Sequence
  Description of Artificial Sequence: Synthetic coding sequence
atggacgtggagatccaggatactcccggtaagatcagtattagcaaacgatctatcctctccggcacagtggaaaacatcgactatccacattattgcgatcttctgcgaaaaatgaatatgcccttcgtgaaaggcttggagaatcgtcataactatggtcgcttcgagaagaagtgtaaccctgcattcctcaagtttcatccttacccacctagcgtccttccggattaccatctgcacgatccttaccctcctccctacggaccccattatccactgttccctctgcgcgatgacgttactctgggagattcatgctctggctttatgtcccctggtggggatgccgatctgaacccaggcatcgggaggaccatccctactttggtggacttttccgatgtcaagccgcaacatcgtgtcccgaggcctgatactggcttccagaccaccatcaaaaggcaaaagattttgtctgaagaattacagcagaatcgcaggtggaattcccgggaagttccagatattagtatcagggctagattgggaggatggaccagtccactgaaggtgacacctctgcagccccaccacgaaggaaggtctctgtctcatatttttactttcgatgaggaagctacatgcactgatgagggggaacctctggtgcaaaccaataagaagtgcaacgccaaggattctttttataagagctcaactcagaaggcctacgaggatgtgccgtgggacaaaatgctgccccctaaattggtcccagaagaaaccactctggaaaaaaccgccgaccccatttcgcaatgcttcacactgaaaagatataagggagtgcccgcaatcacccaaatggtaggcgagctttgggataggtttcagacgaggtccttcctggcgccagtgaagcccattaactttgtgagctctagttccagaagcaaatatatcccactgtatacgggacacgtgcagtctaccaatgccgacgacgtcgataaccctctcggagatatagccagtctggcaaagcaacgatactcgaagccactgtacacaaatacgagccgcgcagccaatattcctggctataccgggaaggtgcacttcacggcgacccatcccgctaatagcaatattccttcaactacaccaagcccagattccgagctccaccgggtgtttcagaaggaaatggcagtcgatctttttaggcatcaagcaccgctctcaagactggtgaccactgtacggccttacaatcccttcaacaagaaggacaaagagacaatcgattactag

SEQ ID NO: 54656 - DNA, 144 bp, Artificial Sequence
  Description of Artificial Sequence: Synthetic coding sequence
atgctccagtttcttctcgggttcacattaggcaacgtggtggggatgtatctggcccagaattacgacattccgaacctggctaagaaattggaggaaatcaaaaaagatcttgacgctaagaaaaaaccccctagcgcctag

SEQ ID NO: 54657 - DNA, 315 bp, Artificial Sequence
  Description of Artificial Sequence: Synthetic coding sequence
atgggacggtcaccctgctttttcaagtcattcaagggtaagctgcacaaagacagaagccccgacccctctaccctggcatccccacatccaagcaccgaagctaggaggcctgttgaagcagggtccgcagaatggacctggggatggatgaagaggctccctcccgcatctctgtctcccggtattgccatgtcttgttatagcggagattctatgcttcagaagtacaaagtgaaaaacgcctacaggctccattggcaggggcgagaggagcctggagcatcgacgttcgcctcattagtgtttcagtag

SEQ ID NO: 54658 - DNA, 315 bp, Artificial Sequence
  Description of Artificial Sequence: Synthetic coding sequence
atgggccgttccccttgcttctttaagagcttcaaaggcaagttacacaaagaccggtcacctgacccctccacactcgcatctccccatccaagtaccgaggcccgtaggcccgttgaggccggtagtgctgagtggacctggggctggatgaagaggcttccccctgcatccctgagccctggtattgccatgagctgctattccggggatagcatgctgcagaaatataaggtcaaaaatgcatatcgactgcattggcagggccgagaggagcccggtgcatctacattcgcttcactggtgtttcagtag

SEQ ID NO: 54659 - DNA, 255 bp, Artificial Sequence
  Description of Artificial Sequence: Synthetic coding sequence
atggcaagcgttcctagcatcgggtgcctcttggccagaaaccaatactatcgcaagagcagcgtgagctcggtgtcctcacttacttcttctgactctgtaaattttattgatgacgataaaccccagcagggcctgcccgaggtagccgaatctacatggtggtttaagagttttttccacagcgaacctgtcctgagcaatgttagaataaaggatctcagtgccactggctcgctttctggccgttcctag

SEQ ID NO: 54660 - DNA, 246 bp, Artificial Sequence
  Description of Artificial Sequence: Synthetic coding sequence
atggcctcagtacccagcataggatgtttacttgccaggaatcagtattatagaaaaagctctgtatcctccgtgtcatccctgactagtagcgactccgtgaactttatcgacgacgacaaaccacagcagggcctgcctgaagttgccgagagtacttggtggtttaagtctttctttcattccgaaccagtattgtccaatgtccgcatcaaagacctgtctgccacagggatgaattcttag

SEQ ID NO: 54661 - DNA, 399 bp, Artificial Sequence
  Description of Artificial Sequence: Synthetic coding sequence
atggctgagaagccacatcagaatagctgcaactcagtcaggcagctcttcaaaacaaagcaactcgtaacccaccgggacagagggagctgcacccacagggcacagggacttctggccgctcggaccacagctttgcaacgtagcccacttcagcaagagatatgggaatctaccactgccctcaacctgcccagtgccctggctccccaggggttaacggccaaagacgcgcacttcctgggagatactgatcctattcaggaaggcgcaagggatcatgccgctggaggcccttttcaggaccgacaagcatctgtcgctgcccagaccttgtcctgggaaaggggtcaggggtttagccgacaccacggtaaccacctgctgtacagccactag

SEQ ID NO: 54662 - DNA, 690 bp, Artificial Sequence
  Description of Artificial Sequence: Synthetic coding sequence
atggccgcactggggcacttagctggcgaagccgcagcggctccaggacctgggactccctgcgcaagtcggggagcgcgacttcctgggcctgttagcagcgccagaaatccgtccactgtctgcttgtgtccagagcagcccacatgttctaatgccgacagtcgggcacatccactgggtgatgaaggcggtacagctagcaagaagcaaaagaacaagaaaaaaacacgcaaccgggcttctgtcgcaaacggcggtgagaaggcgtctgagaagttagcccctgaggaagtgccgctcagtgccgaggctcaggctcagcagctggctcaagaactggcttggtgtgttgaacagctggagctcggcctgaaacggcagaaaccaacccccaaacagaaagaacaggcgattggagcgatccgcaccctccggagcaagagaaccccccttccccgtaagcggcagctgatgcatagtctgttcggggattacagggctcaaatggaagccgagtggcgagaggctttgcgcgctctgcgcgcagccgcatactccgcacaggtacaaccagtcgacggagcaacgcgcaagaaatcccagcgcgtgtgccgccctcggtctatctggcgcgctaaggccaccctcgatatgcctgacgaggagtttcgcttcaacttcttttag

SEQ ID NO: 54663 - DNA, 606 bp, Artificial Sequence
  Description of Artificial Sequence: Synthetic coding sequence
atggaaaacgggtttaccatgtgccaaactggcagacagcaccctgttgcatgcggtctgcatctgagcggaggcaaggaggacctcaatgatctccgaatggagggagtgaccaccttggtaccgtctggttcaaaattcaatcagggaagacccacctaccctgccgaaccccaggctaaggtaacgctgaatatttgctctaggtgtgccagactccagggcgataatctcgaggagagaacagaggaatctctgcccatactgcactctcccgatgaaaaaataccagattctttcgattctcttccaggtacggaggaggctcttatggaggagggggacgagtttgaaaaagcgagcaaactgaccggcccaggggaagctagttccggcgtgggacatagcctcaaaaactatatggaggaggatgagagtttgaaacagctacaggtagtccaccagccctggattttgcccagcgacactgaaagtgaaggggtggaggccgagcaggagaaacatctgctgaatcagaatctgtgtggatgggattccgaattctgtattttccacactcttgccagctttctgatctataagtag

SEQ ID NO: 54664 - DNA, 1284 bp, Artificial Sequence
  Description of Artificial Sequence: Synthetic coding sequence
atgactaagctaatcaccgagacaccagatcagccaataccgttcctcattgaccacctacagagcaagcagggtaataggggccagttacagcgcacgctttcaggaagtgccgcactgtgggcggagagcgaaaaaagcgaatccaaggggacccgtcgtgatttccggagctatgacaagccgtggcagcttaatgcaaagaagccaaagaaatcaaagagcgacctggctgtgtccaatatttcccccccaagtcctgactccaaatcactgcccaggtcggtcgaacaccctaagtggaattggcggacaaaaccccaaagccgggacttcgacgaattgaaccacattctccaggaatcgaagaagttgggcaaagcccttgagaacctctcccgatcaatcgctatctcagatgaattggacaaagaaaccgtcacttttaattctagtcttctgcgcccacgagttattggcgaatggatcggaagggaagagaacgatgctgatccactcgctgccgagatgcttcagccaccaatccccagaagcaaaaacgaccagtgggagtcagaggatagcgggagctcaccagccggatctctgaaaatggaacctaaaaataaggggctgaaacagcagcagcagcagcataaaaaactcttggctgcaatgttatcccaggatagcttcgaatctattcattcaccaacccctagcgtcactgaagaggatattgacaatgaagacgacgctatggagctcttggaagatctgaatgacctgcgcatggaaggagtaacaacactggtcccatctgggagcaagttcaaccagggtaggcccacctatcctgcagaaccgcaggccaaggttactctgaacatttgctccagatgcgccagactacagggcgacaacctggaagagcggacggaagagagcctcccaatactccatagtcctgatgaaaagatccccgacagctttgatagtttgcccggtactgaggaagcccttatggaggaaggagacgagtttgaaaaggcctccaaactgacaggtcccggagaggcctcatccggagtcggccacagccttaaaaattatatggaggaagatgaatctttgaaacagttgcaagttgtgcaccaaccttggatcctgccatccgacacagagtccgaaggtgttgaggccgaacaggagaaacgaagcgccgaccttctcctctgcgttccttgctcctcgtgcccgactctggtatattctggcctttag

SEQ ID NO: 54665 - DNA, 864 bp, Artificial Sequence
  Description of Artificial Sequence: Synthetic coding sequence
atggcatcacatccgcagactcgaattcaggcgtacttagaaaagaacaaaattggacccctgtttgaggagctcatgacaaaactgatcacggagactcccgatcagcctatcccattcctgattgatcatttacagtctaagcagggaaacagaggccagttgcagcggacattatccggcagtgctgcgttgtgggccgaatccgaaaaatccgagtctaagggaacccgaagagatttcagaagttacgataagccttggcaactcaacgcaaaaaagcccaagaaatctaagagcgatctggccgtgtctaatatctccccacctagcccagacagcaaaagcttgccccgtagcgtggagcatcccaaatggaattggcggacaaaaccccaatccagggacttcgatgagcttaatcacatcctccaggagtcaaaaaagctggggaaggccttagaaaacctaagtagaagcatcgccatatctgatgaactggataaggagacggtgacctttaatagttcactgctccgcccaagagttattggcgagtggatcggacgggaggaaaacgacgctgatcccctggcagctgagatgctacagcccccaatacccaggtccaagaatgaccagtgggagagtgaggattcaggctcctctccagccggatcccttaagatggaaccaaaaaacaaagggctgaaacagcaacagcagcaacacaagaagttgctcgccgctatgcttagtcaggactcttttgaatccattcacagtcccacgccctctgtgacagaagaagacatagataatgaggacgatgcgatggagctgttggggaacttcaagaactag

SEQ ID NO: 54666 - DNA, 1617 bp, Artificial Sequence
  Description of Artificial Sequence: Synthetic coding sequence
atgtcttcacctctcgcatccgaactctcagagctcgcagccttgcgccctggatttaggcttagtgccccacacgcccgagtggcgcctagggcggctacgcatgcacgtggccgtgggagagcttcccacgccggacagcccagactgcgtagctcttgcccagggccatcccctggcaagcggcgagtggtgcctagcggcggagcccagccccgagttcttcctgccctatcttcaagatcgcatctgtttccaatggcctcccacccccagacacgcattcaggcatatttagaaaaaaacaaaatcgggccactgttcgaggagttgatgactaaacttattacagagactccggaccagccgatacctttcctcatcgatcacctccaatctaaacaggggaaccgcggacaactgcagagaaccctttcgggaagtgccgctctgtgggccgagagcgagaaatctgagtccaagggcaccagacgggactttaggagctacgataagccgtggcagctgaacgccaaaaagcccaagaaaagcaaaagcgatttggccgtctccaatatttcaccgccatcacctgactctaagtcgttgccccgaagcgttgaacatcctaagtggaactggcgcaccaagccccaatctagggacttcgacgagctaaatcatattttacaggaatcaaaaaagctggggaaagcgctcgaaaatctgtccagatctatcgccatcagcgatgagctggacaaggagaccgttaccttcaactcatcacttctacgtcccagagtgatcggtgaatggatagggagggaagagaatgatgccgatcccctggcagcagagatgctccagccccctatacccaggagcaagaatgaccagtgggaaagcgaagactcaggcagctcacccgcaggctcgctgaagatggaaccaaaaaacaaaggactgaagcagcagcagcagcagcataaaaaactgctggcagcgatgctgagccaagacagctttgaaagcatccactccccaaccccctccgtaacagaagaggacatagacaatgaagatgatgctatggaactgctggaggacttaaacgatcttaggatggaaggcgtgaccacacttgtgccttctggctccaaatttaaccagggtaggcctacctatccagcggaacctcaagctaaggtgacacttaacatttgttcaagatgtgcacggcttcagggcgacaacttggaggagcgcactgaagagtctctgccgatcctgcactctcccgacgagaaaatcccagacagcttcgactcactgccaggcacagaggaggctctgatggaggaaggcgacgaatttgagaaagcaagtaagctcactggaccaggcgaagccagctccggtgtgggccatagtctgaagaactacatggaggaggatgaaagcttaaagcagttgcaagtcgtgcaccagccatggattctgccttctgacaccgagagcgagggcgttgaagccgaacaggagaagcggtcagctgatctgcttctctgtgtcccatgctcgagctgtccaaccctcgtgtactccggactgtag

SEQ ID NO: 54667 - DNA, 390 bp, Artificial Sequence
  Description of Artificial Sequence: Synthetic coding sequence
atggccagccatcctcaaaccagaatccaagcttacctcgagaagaacaaaataggtcccctctttgaagaactgatgacaaaactcattacagaaactccggatcagccaatcccgttcctaatcgatcacttgcaatcaaaacaggggaatagaggacagctgcaacgaactctgagcggctcagcagcactttgggctgagtcagaaaaatctgagtccaaagggaccagaagagactttcgctcatacgacaagccctggcagttgaatgctaagaaaccaaagaaatcgaaatccgatttggccgtatcgaatattagccccccttcgcctgattcaaaatcctgtaaggaagtgagctactctaacgcaattcagtctatgtag

SEQ ID NO: 54668 - DNA, 1359 bp, Artificial Sequence
  Description of Artificial Sequence: Synthetic coding sequence
atggcttcccatccgcagacccggattcaggcctacctcgagaaaaataaaattggccctctctttgaggaattgatgactaagctgattaccgagactccagatcagcccatcccctttctgatagaccacctccaaagtaaacagggaaacagaggccagctccagcgcaccctgtcaggcagtgctgcgctgtgggccgagtccgagaaatccgagtccaagggaaccagacgggatttccgcagttacgacaaaccgtggcagctgaatgccaaaaagccgaagaagtcaaagagcgacttggccgtcagcaacatcagccctcccagccccgacagcaaaagtctgccgaggtccgtggagcacccaaaatggaactggaggactaagccccagtccagagacttcgacgagctgaaccacattttgcaagagtcaaagaagctaggtaaagctttggaaaacctatcccgctccattgctattagtgacgagttggataaggagactgttaccttcaactctagtttactcagacctagggtaatcggcgaatggatcggacgggaagaaaacgatgcagatcccctcgccgcagaaatgctgcagccacccatcccacgctcaaagaacgaccaatgggagtcggaggattcaggttccagtccggcagggagtctaaagatggagccgaagaataaagggctgaaacaacagcagcagcaacacaaaaaattgctggcagcaatgctttcccaggatagcttcgagagtattcatagcccaacaccaagcgtaaccgaagaagacatcgacaatgaagatgacgccatggagcttctcgaagacttgaacgatctgaggatggagggtgtgactacactggtaccttctgggtcgaagttcaatcaaggcaggcctacataccccgctgagcctcaagcaaaggtgacgctgaatatctgctcgagatgcgccagactgcaaggggataatctggaggaaagaacagaggagtccctgcccattttacactcccctgacgagaagattcccgattccttcgacagcctccccggaaccgaggaggcgctcatggaggagggggatgagtttgaaaaggcttctaaactgacgggccctggtgaggcgtcctctggagtgggccattccctcaagaactacatggaggaggatgaaagtctgaaacaattacaggttgtacatcaaccatggatcttgccttctgataccgaatccgagggagtggaggctgaacaggaaaagcggtcagcggaccttctgctgtgcgtgccctgcagcagctgccctaccttggtctatagcgggctgtag

SEQ ID NO: 54669 - DNA, 624 bp, Artificial Sequence
  Description of Artificial Sequence: Synthetic coding sequence
atggcggaagatctggacgaactgctcgacgaggtcgaatctaaattttgcacccctgaccttctccgcagaggtatggttgaacagccaaaagggtgcgggggaggcacccactccagtgatcgaaaccaggccaaggcaaaagagaccctgcggtccaccgagaccttcaagaaggaggacgacctggattctcttatcaacgagatcctggaggagccaaacctagacaagaaaccaagtaaactgaagagtaagtcttcaggcaatacttctgttagggcctccatcgagggcctgggaaagagctgcagtcccgtctatctgggtggcagctcaattccttgcgggattgggaccaatatttcgtggagggcttgcgatcatctgagatgtatagcctgcgacttcctcgtggtgtcgtacgatgattacatgtgggataagagctgcgattacctgttcttccggaataacatgccagagttccacaagctcaaggctaagctcattaagaaaaaagggacgagagcatacgcatgccagtgtagctggcggacaatcgaggaagtgacagacctccagaccgatcaccagctacggtgggtctgtgggaaacactag

SEQ ID NO: 54670 - DNA, 309 bp, Artificial Sequence
  Description of Artificial Sequence: Synthetic coding sequence
atggctcaggacttctcgcagcatccccagactggaatcataagaagacacagattttattccccaaaacccttgtcaacaactccacgaggccaatcatttctgctgtcaagacaagccaaggtcgccacctgggatcccatgctctctccagacttccagcctaaaagcgctttcaagctgacctggacagctcagcctccatgcctgtcagtgactcccagccagggtcagacttttcaccccaactcccctgagggggaactgccaccagatttaaccgaaaatacttgcccctctcaggcttag

SEQ ID NO: 54671 - DNA, 558 bp, Artificial Sequence
  Description of Artificial Sequence: Synthetic coding sequence
atgtggaagttagggagaggcagagtcctgctggacgagcctccagaggaagaggatgggctgcgaggaggaccacctcccgctgcagccgcagcagcccaagcacaggtgcagggggcttctttccgtggatggaaagaggtcaccagcctgtttaacaaagacgatgaacagcatctattagagaggtgtaagtccccaaagagcaagggtacgaacttgaggctcaaggaggagctgaaagccgaaaagaagtcgggcttctgggataatctcgtgcttaaacagaacatccagtctaaaaagccagatgaaatagagggttgggagccccctaaattagctttagaagatatatcagctgatccggaagacacagtgggaggccatcccagctggagcgggtgggaagatgatgccaaaggctcaacaaagtatacaagcctggcatcatccgccaattcctctagatggtcactccgggcagcagggcgacttgtgtctatccgacggcagagcaaaggccatcttacagacagcccagaagaggctgagtag

SEQ ID NO: 54672 - DNA, 597 bp, Artificial Sequence
  Description of Artificial Sequence: Synthetic coding sequence
atgtggaagctgggtcgcggaagagttctgctggacgagcccccagaggaagaagacggcctccgcggaggcccaccacccgcagctgcagccgctgcccaggcccaagtgcaaggtgcctcctttcgcggatggaaagaggtcacttccctttttaataaagacgacgagcaacatcttctcgaaagatgtaaatcccctaaaagcaagggaaccaacctgcgcttaaaagaggagttgaaggccgagaagaaatctggtttttgggacaatctggttctgaagcagaatatccaatccaaaaaaccagatgagatcgaaggttgggagcccccaaaactggccttggaggacatctccgccgaccctgaggatacagtgggcggtcaccctagttggtcaggctgggaagatgacgctaaagggagcaccaaatacaccagtctggcttcgtctgcaaattcttcccgttggagtctgcgggctgccggtaggctgatcaaggaggtgtggattaacttctcccagctcatcatctcttttaggaagcactgcttagcccattaccgcgagcttaggctgtgcatcaaatattag

SEQ ID NO: 54673 - DNA, 597 bp, Artificial Sequence
  Description of Artificial Sequence: Synthetic coding sequence
atgtggaagctaggccgtggtcgtgttttgctggacgaacctcctgaggaagaagacggtttaaggggcggacccccacccgcagccgcagccgcagctcaggctcaagtgcagggggcatcgtttcggggatggaaggaggttacgagtctgtttaataaggatgacgagcagcacctgctggagagatgcaaaagccccaagagcaagggtaccaacctgcgactcaaagaggaactgaaggcagagaaaaaaagcggcttctgggacaatcttgtgctgaagcagaatatacagtcgaagaaaccagacgagattgagggctgggaaccgcctaagttggctctggaggatattagcgccgaccctgaggataccgtcggcggacatccgtcctggtccgggtgggaagacgacgccaagggctctacaaagtatacttcccttgcctcaagcgcaaatagctctcgctggagtctccgagctgcaggcagactcatcaaggaggtttggattaacttttcgcaactcataatctcctttagaaaacattgcctcgcacattaccgagagctgcgcctttgcatcaagtattag

SEQ ID NO: 54674 - DNA, 480 bp, Artificial Sequence
  Description of Artificial Sequence: Synthetic coding sequence
atgaggaagaatgaaagttatttgaatcagcccgcaccacccattccaatcccaacattgtcgcttatggggggatgtcgtgaacatttcgagaatcattggaaggggagggcccgttggctaatgcccgttattccagcactgtgggaagccaaggcaggtagatctcctgaagtccggagttctaagcccgcatggcccacatggcgcaacccaatttttactaaaaacacgaaaatttctcaggtacttgaattgttcctgaactatcagtctctgatttgcgccctggaaaaacagaagcggcagaaagggtctcttgcgatcttttgctggagcttccaaggtgggtgtgtgtccaaacgcccagatgtcccatctctgaagagtcaaaagcctaaaaggaagagaattacaggacggaaacggctctccaagggcttttggagtctcttgttctctaaccttggtagattttag

SEQ ID NO: 54675 - DNA, 480 bp, Artificial Sequence
  Description of Artificial Sequence: Synthetic coding sequence
atgcggaagaatgagagctaccttaaccagccggctcctcccatccctatccccacactctcactgatggggggatgccgcgagcatttcgagaatcactggaaaggacgtgcgaggtggctgatgcccgtgatccccgctctgtgggaggctaaggccggacgatccccggaggtgaggagttcaaagccagcttggcccacgtggagaaaccctatcttcactaagaatacaaagatatctcaggtgctggaactgttcctgaactatcagtcattaatttgtgctcttgaaaagcagaagagacaaaagggatctctagccatattctgctggagttttcaaggcggatgcgtgagcaagagacccgacgtcccatctctgaagtcacagaagccaaagaggaagagaattactggcaggaagcggttgtctaagggcttttggtcattgctgttttctaatttggggaggttttag

SEQ ID NO: 54676 - DNA, 1899 bp, Artificial Sequence
  Description of Artificial Sequence: Synthetic coding sequence
atgtccaacctgaagatgaaagaggctgcactcatctatctggacagaagcggagggttacagaagttcatcgacgattgtaagtattataacgacagcaaacagtcctatgctgtgtaccggtttaaaatactcatcaatccttccgatgttgtcgagttagatgccgaactcgggaaccacatcctgcaccagcccctgaaagctgcggaggtgttccagtccgtatgttttatcgcggtaaaaacattgtcattgattggccagctgcagacagagactcagattaatatcgttctgaaactcacccatctgccacccctgccctcctatggtctcgatctgtgcgagtttccccttgattatactagccagagattttatatgatgcagggcatagtcatcgccatgactacgattacgaagtacacccagggagcaaggttcctgtgcagcgatgaagcgtgccccctcagcaagggctttcaatatattagagtccatgtgccaggggctacggaatccgccactatcagaaatgactttttgtgtaatttgtgtgcttccagcttgcaggaggacagaaagttccgcgttcttggtgataaacagatcgtagagatcatcgctacgaaggcactgagagcctttcagggttattcaaacaatcagccatttcgatttcagagcctgactatcttcctacgcgacgagtccgttaataaaatgaacatagggaatgaatataaaatcatcgggatcccaacgtgcgttaaaacctcccagacagccgtgtgcattgaagctaacagcatcactttctgcaattcaaaagtcccctccggcattagtgacaattttaggtgtctgctttcgttgacaagcagctcctgctggaaatttacagctattctggcaaacatattcgcctctcagatcacaccacctgggacatacaacctgctgaaactgtgcctccttatgtcactagtacagaccactgatcgaaataaagaactggaagattgcctggatattcttatcatcaccagcgatacactcctgatagacaggctgctgaacttttccatcaacctggtgcccagagggatccgacacctcgtctccaccgaaattttccccacactgtcgcggaacaagtatgggactggagcagtgagcattcaggctggctcagcgctgctggctaaaggaggtatttgctttataggcgatctcgcctcgcataaaaaggacaagctagagcagctgcagaccgtgctggagagtaggtcgattactgtgtacatcccaggcaagaagttcggagaggatatagaccagcaaatgacctttccggttcagtgttcgttttggtctttcgtagatgtggattcatcctcccgccgtaacgcacaaaaaataaatacactcattggccagatggactgttctctcatccctgctaacctggttgaagcgttcggactgctgattaactgcaacgagtcctcgccgtgccacccatttctgcccactgtacagcacaccctgaataaagccatcaatcccgagggtctgttttatgccgcttctcggcagtttacgaccgaagatttcgaaaaactgttggcttttgccaaaaatctgaacgtggagttttctcttgaggcggaaaggatgacccacggatattatctggcctctaggcgtattcgcacaggttccgtgtgcgggtctaagctgtccgcatccgcactgaagtacctggtgtttctctccgaggcccatgcacgtctgaacctgcgcaataaggtcctcaaggaagacgtactaatcgccgctctgctctttgaaacctccttgacactgaagtacggcaacgaactgaattattag

SEQ ID NO: 54677 - DNA, 1002 bp, Artificial Sequence
  Description of Artificial Sequence: Synthetic coding sequence
atgatgcagggtattgtgatagctatgacaacaatcaccaaatacactcaaggggcacgctttctctgttctgatgaagcatgcccactgagcaagggcttccagtacatccgcgtgcacgtacccggagccaccgaatcagctacgattcggaatgattttctgtgcaatttgtgcgcaagctctctccaggaggaccgaaaatttcgcgtgctgggggataagcaaatcgtggaaatcatcgctactaaggcattgcgagcatttcagggatattccaataatcagccttttcgcttccagagtcttaccatttttctgagggatgagtctgtcaacaagatgaatattggtaatgaatataagattatcggcattccaacgtgtgttaaaaccagccaaacagcagtgtgcatcgaagccaactccataaccttctgtaatagcaaggtgccgtccggcatttctgataattttcgatgcttattaagcctaaccagttcctcgtgctggaagttcacagctattcttgcgaacatctttgccagtcagatcaccccgcctggtacttacaacctccttaaactgtgtctgcttatgagcctggttcagactactgatagaaacaaggaactggaggactgtctggatatacttatcatcaccagcgatacactactcatcgacaggctgcttaatttcagtatcaatctcgtaccaagaggcatccgtcatctggtatctacggagatcttccccactctcagccgaaataagtacgggactggcgctgtttccattcaggctggcagcgcactcctcgccaaggggggaatttgtttcatcggggatctggcctctcacaaaaaggacaaactggagcagttgcagacagtgctggaatcccggagcatcaccgtatacatccccggaaaaaagttcggtgaagatattgatcagcagatgacatttccttccgtccaatttctagtcttttgctag

SEQ ID NO: 54678 - DNA, 1773 bp, Artificial Sequence
  Description of Artificial Sequence: Synthetic coding sequence
atgagcaatctcaagatgaaggaagccgctctgatatacttagaccgctccggcggtctgcaaaagttcatcgatgactgtaagtactacaacgactcaaaacagtcctatgctgtgtaccggttcaagatactgataaatcccagcgacgtcgtggaactcgacgccgagttgggaaatcacatccttcaccagcccctcaaggctgctgaggtattccagtcagtgtgcttcatagccgtcaagacactgagcctcatcgggcaactgcaaaccgagacgcagatcaacatagtgctaaagcttactcacctgccccctctgcccagttatggtctggatctctgtgaatttcccctggactacacttctcagcgtttctatatgatgcagggtatagtgatcgccatgaccacaattacgaaatacacccagggtgccagatttctctgtagcgacgaggcctgcccacttagcaaggggtttcaatatattagagttcacgttcccggtgctacagagtcggcaacgatccggaacgattttctctgcaatctgtgtgctagttcccttcaggaggatcgcaagtttagggtgttaggcgacaaacagatagtggaaattattgctacaaaggctctccgcgcattccagggctactctaataatcagccgtttcgattccagagccttaccattttcctccgagacgagagcgtcaataagatgaacatcggcaacgagtataaaattatagggatcccaacttgtgtgaagaccagtcagactgccgtctgcatcgaggccaatagcatcacattctgtaattccaaggtcccttccggaatctcggataacttccggtgcttgctgtcacttacttcttccagctgttggaaattcaccgctatcctggccaacatctttgctagccagatcactccacctggaacctacaacctcttgaagctgtgcttactcatgagtttggtgcagactacagatcgaaataaggagctagaggattgtctcgacatcctgattataacctcagacaccttgctgattgataggcttttgaatttctccatcaaccttgtacccaggggcatacggcatctggttagcaccgagatcttcccaacactgagtagaaataagtatgggactggtgcggtgagcatacaagcaggtagtgccttgcttgccaaggggggtatctgtttcattggcgacttagcctcccacaagaaggacaaattggagcaactccagaccgttcttgagagcagaagcatcactgtctatattcctgggaaaaaatttggagaggacattgaccaacagatgaccttcccggtccaatgcagcttttggagcttcgtcgacgtagactcatcatctcgccgaaacgcacagaagattaatacgctgatcggccagatggattgcagcctaatccctgcgaatcttgttgaagccttcgggttactcatcaactgtaatgaaagttctccgtgccatccattccttccaactgtacagcatacactgaacaaggccattaaccctgagggattgttttatgctgcatcgcgccaatttacgaccgaggactttgaaaaactgctggccttcgccaaaaatttaaatgttgaattctccctagaagcagaaagaatgacacatggctactacctcgccagcaggaggatcagaacggggtctgtctgtgggagcaaactgtccgcctctgcactaaaatatctctag

SEQ ID NO: 54679 - DNA, 2046 bp, Artificial Sequence
  Description of Artificial Sequence: Synthetic coding sequence
atgagcaacctaaagatgaaggaggcggctttaatctatttagatagatccggtggcctgcagaaattcattgatgactgcaaatactataatgacagtaagcaatcctacgctgtataccgcttcaagatcctcataaatccttcggatgtggtggaactagatgccgagctgggtaatcatatcctgcaccagcccctcaaggccgcagaggtatttcagtccgtgtgcttcattgcagtcaagacattaagcctgataggccagctgcagactgagacccagatcaacatcgtgctgaaactgacgcatctgcctccactcccatcgtacggacttgatctttgtgagttccctctggactatacaagccaaaggttttacatgatgcagggaatcgtaatagccatgacaactatcactaaatatacacagggcgcaaggtttctctgctctgatgaagcctgccctcttagcaagggcttccaatatatacgagtgcatgtaccgggagctactgaatccgcaacgattcgcaacgactttctctgtaatctgtgtgcatctagccttcaggaagatcggaaatttcgagtgcttggagacaaacagatagtcgaaatcatcgccacaaaggccctacgcgcatttcaagggtactccaataatcagccttttcgctttcagagcctgaccatcttcctgagggacgagagcgtcaataagatgaatataggcaatgaatataaaatcattggaatccccacatgtgttaagacttcccagaccgctgtatgcattgaggccaactccattaccttctgcaattctaaggttccatcgggaatttcggataactttcgctgcttgctgtcactcacctccagctcatgctggaaattcaccgcaattttggccaatatatttgccagtcagatcacccctcctggtacctacaacctgcttaagctatgtctactcatgagcctcgtccagacaactgatcgtaataaagagctggaggattgtctggacatccttataatcacatctgacacgctgctgattgatcgtctacttaacttttctattaatttagtgccgcgaggcattcgtcacctggtcagcacagagattttccccacactgtcacgcaacaagtacggaacaggtgctgtgtctattcaagcagggtccgcactgctagctaaagggggaatttgttttataggagacctcgcttctcataaaaaggataagctggaacagctgcaaactgttctggaatcacgaagtataaccgtctatattccagggaagaagtttggtgaggatattgaccagcagatgacgtttcctgtgcagtgtagtttttggagcttcgtagatgttgactcatcttccaggagaaacgcacaaaaaatcaacacgctgatagggcagatggactgttccttaatcccggctaatctagtggaggcctttggactcctgatcaactgcaatgagagctctccttgtcatcctttcctccctacagtgcaacatacactcaacaaggcgattaatcctgaaggacttttttacgcagcctcgagacaattcaccacggaggacttcgagaagcttctggcttttgccaaaaacttaaacgtggagttcagcctagaggccgagaggatgacacacgggtactacctggcttctcgtcgtattaggacaggctcggtgtgcggcagtaaacttagcgcctcggctctgaaatatcttgtgtttctgtccgaagcccatgccagattgaacctcagaaacaaggtgctgaaggaagacgtacttattgcggctttgctgtttgagacttccctgactctgaaatacggggctactgtgttttgtgttgcacctaatgccgtgtttccattcgagctttataacgaggagtacctggaacagcgagacctctaccttactcagtgtcagcagcagctggagcaattcatcgctacttacggaccagggactaccattttctccagcgacgaatag

SEQ ID NO: 54680 - DNA, 1857 bp, Artificial Sequence
  Description of Artificial Sequence: Synthetic coding sequence
atgatcgcttcaacaaccatggtaagatcagcgaaggtttgcttcatcgcggttaagactctctcgttgattggacagctgcagaccgagacccagattaacatcgtactgaagttgacccacctgccgccattgcctagctacggcctggatctgtgcgagtttcccttggactatacaagtcagcgtttttatatgatgcaggggattgtgatagccatgacgactatcaccaaatatacacaaggcgctcgcttcctttgttctgacgaggcctgtcctctgtcaaaggggtttcagtacataagagtgcatgttccaggagctactgaatcggccactattagaaatgattttctgtgtaacctgtgcgcttcatctctacaagaagatcggaaatttcgagtcctaggcgataagcagatagtggagatcatagccacaaaagcgctgcgtgcctttcaggggtattctaataaccagccttttcgttttcaaagtcttacaatttttctccgagacgagtctgtgaataaaatgaatattggcaatgaatataagattatcggcatcccaacttgcgtcaaaacatcccaaactgccgtgtgcatcgaagcaaacagtataaccttctgtaacagtaaggtgccaagcggaatctctgataattttcgctgtcttctgtcactgaccagctcttcctgttggaagttcacagcaattcttgccaacatctttgcttcccagattacacctccgggaacctataacctgcttaagctgtgccttctgatgagccttgtgcagacgactgacagaaacaaagagctcgaggattgcctggacattctaatcatcacttccgacaccctactaatcgacaggctactgaactttagcatcaacctggtgccgagggggatcagacatttagtgagtaccgaaatattcccgactctctcccgaaacaaatacggcacaggtgccgtttccattcaggcgggatccgccctcttggctaaggggggtatctgcttcattggcgacctcgcttcgcacaagaaggacaagctcgagcagctgcagactgtcctggaaagcagatctatcaccgtttatattccaggcaaaaagttcggggaagacatcgatcagcagatgaccttcccagtccagtgctctttctggagcttcgtggatgtggacagttcctcaaggagaaacgcccagaaaattaacacccttatcgggcaaatggattgttccctgatacctgcaaatttagtcgaagcatttgggctgcttattaactgtaatgagtcctctccatgtcacccatttctgccgacagtgcagcacactctgaacaaggctataaatcccgaggggctgttctatgccgcatccaggcagttcactacagaagacttcgagaaactgctggcatttgctaagaatttaaacgtggaattttctctggaggccgagagaatgactcatggctattacctggcctctcgcagaatcaggaccgggagcgtgtgcgggtccaaactgtccgcttctgcgcttaaatatttggtcttcctcagtgaggcgcacgctaggcttaatcttaggaataaagtcctcaaggaagacgtattgattgcagctctgttgtttgagaccagtcttacactgaaatatggggctacggtgttttgcgtggctccaaacgcagtatttcccttcgagctgtacaacgaagaatacctcgaacagagggatctctacctcacacagtgtcagcagcagctcgagcaattcattgccacctacggtcccggaacaactatattctcctcagacgagtag

SEQ ID NO: 54681 - DNA, 624 bp, Artificial Sequence
  Description of Artificial Sequence: Synthetic coding sequence
atgatgcaccaaatctactcctgcagcgacgaaaacattgaggtgtttacgacagtgatcccaagtaaagtgtctagcccagcaagacggagagcaaaatcctcccagcacctcctgacaaagaatgtggttatcgaaagcgatctgtatacccaccagcccctcgagctcctgcctcacagaggcgatcgccgtgaccccggtgacaggcggaggtttggcagactgcaaaccgcaagacccccaactgcccacccggctaaagctagtgcacgacctgtcgggatttctgagcccaaaacttccaatttatgtggaaacagggcttacggaaagtccttgatcccacccgtgccgcgaatcagtgtgaaaacctctgcgtccgcctctttggaggccaccgcgatggggacagagaagggggctgtgctgatgcgtggttcccgacacctgaaaaaaatgacggaggaatatccagctctgccgcagggcgctgaggcatctctgcccctgaccgggagtgcaagttgtggcgtccctgggattctgagaaagatgtggactaggcacaaaaagaaaagcgagtacgtgggggcaacgaattccgcttttgaggccgactag

SEQ ID NO: 54682 - DNA, 1125 bp, Artificial Sequence
  Description of Artificial Sequence: Synthetic coding sequence
atgggctgcagttcatcggccctcaataaggcaggggactcttcccgcttcccaagcgtgacgtccaacgagcatttctccacagctgaagaatctgaatcctgctttgctcagccaaaaccccatgccctgggaagagaatctaccgtggacgggaatgttcagcgggaaagtcggccaccgttgcagaagctcaaggtgtctgccgaacctacggccaatggggttaagcccctccaggagcagcccctggccaaagacgttgcaccgggtcgcgatgccacagaccagtcaggctccaccgagaagacgcaacccggagagggcctggaggagtctggaccgcctcagcccggaggtaaggaagatgccccagccgctgaaggtaaaaaaaaagatgccggtgccggaactgaggcggaatcgctgaagggcaacgccgaggcccagcctctcggccctgaagcaaaaggccagcccctgcaggctgctgttgaaaaagactctttgcgggcagtggaagtgacagagaatcctcaaaccgctgcagagatgaaacccctggggactacggagaatgtgctcactctgcaaatcgctggtgaactgcaaccacagggcacggtgggcaaggatgaacaggcccctctgctggaaactataagcaaggagaacgaatcgccagaaatcctggaagggtcccagtttgtggagaccgccgaagagcagcagcttcaggccaccctcggaaaagaagaacagccccagttattagaacggatcccgaaggagaatgtaacgcccgaggtgcttgatcggtctcagttggtcgagaaacccgtaatgaacgatccattccacaaaacacccgagggtccgggtaatatggaacagattcagccggaagggatcgtaggaagcatggagcatccggctcgaaatgtggaagctggtgcttacgtggaaatgatcagaaacatccacacaaatgaggaagaccaaaggatagagggcgaaaccggggagaaggtggagaccgatatggagaacgaaaaggtctccgaaggtgcggagactaaggaagaggaaacaggagaggtagtcgatttatccgccgcaacttag

SEQ ID NO: 54683 - DNA, 171 bp, Artificial Sequence
  Description of Artificial Sequence: Synthetic coding sequence
atgggctgttcttcatctgccttgaataaggcaggtgacagttcacgctttccgagcggtgaaacgggagaaaaggtggaaacagatatggagaatgagaaggtgagcgaaggggcagaaacgaaagaggaggaaacgggtgaagtggtcgacttgtccgccgctacctag

SEQ ID NO: 54684 - DNA, 960 bp, Artificial Sequence
  Description of Artificial Sequence: Synthetic coding sequence
atggctatttgcccagagctggcacaaacagataagagtgcattggcgaacctctctgacgaaaccgaaactttgaagaacagcacagatgaagtgcaaacttcaagtagcttttcatcttcaggaggccgacagagcagccctctcaccagcggatcaaagctggaacgagagaagcagacaccctccctcgaacagggagacacccagagcgagctccttgactataaaaactacgagaagaagttatctaaaaagtggattaactatctcaaattaaaagacagcaattttgagaggcaccagccagacacaaagctgcctaccgaaatcacaagggtgagcgacgaggagctcaacgcgctccagagctattgcaccatgaagatcaacctcattcacagacgcggtgactccaaaaagaaaaccagctcaagacataagaaacttcatttgggactggatgtggaagcgagcgaacgggatgcctttagctgcacagtgccagacgagctgttgaaccgcatctactttaaaaacatgaggactacgccaaaacaggaagccgctgccaagcagcatatctcttaccaatgtccttattgcaacaggaagcgcgctgagctcgcactgagcgcctttcttaagcagaagaaaacactgcttgagtcatttttgttgcaagaaaggatcgatgaacacctgcacactaaagactttctcactcgtatcggggaagctcatcaagatttccctaggctgtccgacgaccctcgcatcatctggaaacgactgaccgagaagagccacatccgttacagcggttttgaacgctctgagacggagcagaagctccaacgggacggaaattccgcctgccatctgccgttcagcctgcccttcctaaagaggttaacactcattaaacccgagttagtgatcgtgaatgataatgtgtag

SEQ ID NO: 54685 - DNA, 693 bp, Artificial Sequence
  Description of Artificial Sequence: Synthetic coding sequence
atggagaaacctagactctaccagaaatataagatcagccgagtttggtggcgattgcctgtgatacctgcaaccggagaggccgaggacaaccgcctaaacccagaaggcagggggtgtggggaacccagaagccgtcactgcacaccggcttggacaaccacagccaagctacacctcaaaactatcatttcactccaacccctgaacatgtatcaaatggaaccaggagtgggaagtattcgcactagcccggctttacagagtccacccgctctgacacgtggaccctcagcctgggacaccgccattcgtaaggctctttcttttggtgtggggttgggtgttttggtgcttgtgtgtctgttttatcattttgtgaccctcgcgccaatcctgcagtttgctagtcttccatgtttattagaggccggagctcagatgtcaagacaccccgtcacaacgcaagtgtgcgtgatgccagctcgcttaagcctggggagcgggatctctaggaacctgctgcggttatctgtgtgtcattttacactgttgctgccattcagaagcctaagaccctgtcccctcagttcgcgcgacatggtgctgtcatacgagctatggcttctctgtgatttttatattgctcctccagacagctctggatcaggtatttgcaagaaggctatttag

SEQ ID NO: 54686 - DNA, 318 bp, Artificial Sequence
  Description of Artificial Sequence: Synthetic coding sequence
atgtctctgaaatcttggcatccccagtcgaaaactaagagagtgggcgcaagtgagggtaacccccagtgggggagtgggagcatggaggcacccttgttgagcagcttcctgccacctctggcgagtgaggccgaactgactggtaatacctggttcctgcaccgctgttcctgtatcctgaaccttgaagaaagcatggactcagactggggagcctggtggggagtgagccttcccagacgagctccctttctgatttacggaagcgacggcccttggtgcactcaggctggatttccgggatggggtcactag

SEQ ID NO: 54687 - DNA, 318 bp, Artificial Sequence
  Description of Artificial Sequence: Synthetic coding sequence
atgtctcttaaaagctggcatccgcagtctaaaaccaagagagtaggcgcttcggaaggtaaccctcaatggggatccgggtctatggaggcaccgctgctctcatcattcctgccacccctggcgtcggaggccgaactgacaggaaacacctggttcctacaccgatgcagttgcatccttaacctcgaagagagcatggactctgactggggcgcttggtggggcgtgagcctgcctaggcgagccccattcctcatatacggtagtgatggaccatggtgtacgcaggctggcttccctgggtgggggcattag

SEQ ID NO: 54688 - DNA, 1098 bp, Artificial Sequence
  Description of Artificial Sequence: Synthetic coding sequence
atgatggggagaaggcgggcatttgccgttgacggtcgggacggggcaggcgagggcctggcacgcggttgtattgtccccggtgtaactagcacgtaccggaggatcccagacgctgcgcacgggtgttcgtcttgggagcgcggtgataagttccggggtgttggaagggaggcattattcttaaagctcgcaagccgggactccggcgtggagatggcagtcggggattcaccgctcgctgccctgccaggcttgagccaggatagtctcgatttcgaatcgtctgggtcttctgagccaccggctcaggtgggcagactcctcgctagccagaaattgggggaagtgttagagcggtctcgcagattacccactgctccaactagcttgtctggtcagcaccgctcccttaggctcgcctctaagcccgaaagagaggtacccctgggtgcaggccaacaggagagcatggaggccgacaccgatcttgaggcgggtctcgaggaggaagccgtcgggggtcttggccctggggcatgggcgtgtttgcctggacagggactgcgttacctggaacatctctgcctcgttttagaacagatggccagactccagcagctgtacctccagctgcggattcagcgcccacccggagaccctggcgaagaggagagcactcgagcccctctgccaagccctctccataccccaggcaaccgcggacaagggccatgggaattactgagccagaccgaacacaccggggctaaagctgccagccccccaaaggtggaggtcccttcagccaatcctcccaggctgcccgagacccctgtggagcccacttaccacctgcccagcagtcaggggcataaacgggacattagccactgggacaaggtgaaggttctgttaaaccggatctgccggaggtctcatcatcaccccgagccccctgctccccctgatggatcagatccacggatcgagtctagggatttacccgagcgccctcaatgtagacctcacaggaagacattcatgccaagtctcgttgtcaaaaagcagcgagccaaaaatctcagtgtggggtag

SEQ ID NO: 54689 - DNA, 987 bp, Artificial Sequence
  Description of Artificial Sequence: Synthetic coding sequence
atggccgtgggcgatagtcctctagctgcattgcccggactttcacaggattctttggactttgagagcagtggtagctctgagccccctgcacaggttgggcgactgctggcatcacagaagcttggagaagtgctggaaagatcaaggcgccttcctaccgccccaacctccctgtcagggcagcatcgcagcctgcgactcgcatctaagcctgagcgggaggtccctctgggggcaggccaacaggagtcgatggaagccgatacagatctggaggccggtttggaggaagaagccgtgggtgggctgggtcccggagcctgggcgtgtctgccgggtcaggggttgagataccttgagcatctgtgcctggttctggagcagatggccaggttgcagcagctgtatctccaattgagaatccaaagacctcctggtgatccgggagaggaagagagcacacgcgctcctcttccctctccactgcacaccccagggaataggggccaagggccatgggaactgctgtcacagactgagcatacaggcgcaaaagctgcatcaccacctaaggtagaagtgccctctgctaatcctcctagattgccagagaccccagttgagcctacatatcatctaccttcgtcccaaggacataaacgcgatatcagccactgggataaagtgaaggtgttgctgaaccggatttgcagacgcagccaccatcatcccgagcccccagctccacccgacggttctgacccgaggatcgagtctcgggacctccccgagagaccccagtgccggccacacaggaagacattcatgccttccctggttgtcaaaaaacagagaaagaagcctttctgtcggctgagaccgcttggggctcccggagatcctgggtggagagggctagcagtgaagtcatcatcccctagcgccttactgcttctgttgcacattgcccgtaaaagttgctag

SEQ ID NO: 54690 - DNA, 1074 bp, Artificial Sequence
  Description of Artificial Sequence: Synthetic coding sequence
atgatggggcgtcgacgtgccttcgccgtagatggacgcgacggtgccggagaaggcctggcacgaggctgcatcgtgccaggcgttacttctacctacaggcgcatcccagatgcggctcacgggtgtagttcctgggaacgcggtgacaaatttcgtggtgtgggtcgggaggccctttttctgaaactcgccagccgtgattccggagtggagatggccgtcggggacagtcctttagcagccctgcctggtttgtcccaggactcattggactttgagagtagcgggtcttccgagccccctgcccaggtggggagactactggcctctcagaagctgggcgaagttttagagagaagtaggcgactgcccacggcacctactagcctgtctggccagcaccgctctctcaggctggcgagcaagccagagagagaagtccccctgggcgctggtcagcaggaatccatggaggctgacaccgacctggaagcaggacttgaagaagaggctgtgggtggacttggcccaggggcttgggcttgtctaccaggccaagggctgaggtaccttgagcacttgtgtctggtgctggagcaaatggccaggctccagcagctgtatctacaattgaggatacaacggccacctggagacccgggtgaggaagagtcaacccgggctccactgccttctcctctccatacaccgggtaatagaggccagggcccttgggagctgttaagccaaacggagcacaccggcgcaaaagccgcttctccacccaaagtggaggtccctagcgccaaccctccacgactgccagagactcccgtggaacctacctaccatcttccatccagccaaggccataaagtgaaggtgctactcaatcggatctgtagaagaagtcaccatcacccagagccgcctgccccaccagacggctcagacccgaggatagagagcagagacctgccggagagaccgcagtgccgccctcaccgtaagactttcatgccgtccctggtggttaagaaacaaagggccaagaacctgagcgtcggttag

SEQ ID NO: 54691 - DNA, 132 bp, Artificial Sequence
  Description of Artificial Sequence: Synthetic coding sequence
atggcgaaaaacaagctccgaggcccaaagtctaggaatgtgttccatatcgcatcacagaaaaatttcaaagctaaaaataaagctaagcccgtaaccactaatctcaagaaggtgctgcattttagctag

SEQ ID NO: 54692 - DNA, 297 bp, Artificial Sequence
  Description of Artificial Sequence: Synthetic coding sequence
atggccaaaaacaagctgaggggcccaaagtcaagaaatgtgtttcatatagcttctcagaagaattttaaagcaaaaaacaaggccaagcccgtgaccactaacctcaaaaagattaacattatgaacgaggagaaagtgaatagggtcaataaagcatttgtcaacgtgcagaaggagctcgcccatttcgcaaagtctatctcgcttgagcccctccagaaagaacttatcccccagcagcgccatgaatctaaaccagttgatgaggctaccagacttatggcactgctgtag

SEQ ID NO: 54693 - DNA, 297 bp, Artificial Sequence
  Description of Artificial Sequence: Synthetic coding sequence
atggctaaaaacaagttgaggggccctaaatctaggaacgtcttccacattgctagccagaagaacttcaaagcaaaaaacaaggctaagcccgtcaccacaaacttgaagaaaatcaacataatgaacgaggaaaaggtcaacagagtgaacaaagcatttgtcaacgtgcagaaggagttagctcactttgctaagagtatttccctggagcctttgcagaaagaactgatccctcagcagagacatgagtccaagccggtggatgaagccactagactgatggcactcctatag

SEQ ID NO: 54694 - DNA, 297 bp, Artificial Sequence
  Description of Artificial Sequence: Synthetic coding sequence
atggctaagaacaaacttcggggacctaagagtcggaacgtgtttcatatagcaagccaaaagaacttcaaggcgaaaaataaagcgaaacccgttaccaccaatctcaagaaaatcaatatcatgaacgaggagaaagtcaatcgagtgaataaagcttttgtaaatgtgcagaaggaactggcccatttcgccaagagcatctccctcgagcccctacagaaagaattgattcctcaacagcggcacgaatccaagccagtagatgaagctacccgtctgatggccctgttgtag

SEQ ID NO: 54695 - DNA, 297 bp, Artificial Sequence
  Description of Artificial Sequence: Synthetic coding sequence
atggcaaaaaacaaacttcggggtccgaagagtcgtaatgtgtttcacatcgcatcccaaaaaaattttaaggccaaaaacaaagctaaaccagtgactacaaatcttaaaaaaatcaacatcatgaacgaggagaaggtcaatagagtcaataaagcattcgtaaacgtgcagaaagaattagcacattttgcaaaatccatcagccttgagcctcttcaaaaggagcttatcccccaacagaggcacgagtcaaagccagtcgatgaggctaccaggcttatggccctgttatag

SEQ ID NO: 54696 - DNA, 138 bp, Artificial Sequence
  Description of Artificial Sequence: Synthetic coding sequence
atggctaagaacaaacttagagggcctaagagtaggaatgtatttcacatagcctcccagaaaaacttcaaagctaaaaataaagctaaacccgtcaccaccaacttgaagaaaatcaacataatgaacgaagagtag

SEQ ID NO: 54697 - DNA, 297 bp, Artificial Sequence
  Description of Artificial Sequence: Synthetic coding sequence
atggccaagaataagttgcgaggccctaagtctcggaacgtttttcacatcgccagtcagaagaatttcaaggctaagaacaaggcaaagcctgtgacaaccaatctgaaaaaaattaacatcatgaacgaggaaaaggtaaaccgggtgaacaaagccttcgtgaacgtgcagaaggagctggcgcacttcgcgaaatctatttcactcgagccgctgcagaaagaactgatcccccagcagcgccatgagtccaagcccgtggacgaggcaacgcgtcttatggcgctgctgtag

SEQ ID NO: 54698 - DNA, 132 bp, Artificial Sequence
  Description of Artificial Sequence: Synthetic coding sequence
atggccaagaacaagctccggggtccaaagagtcggaacgtgttccacattgccagtcagaagaattttaaagccaaaaacaaggcgaaacctgtcaccaccaatctaaagaaggtgctgcacttcagttag

SEQ ID NO: 54699 - DNA, 2160 bp, Artificial Sequence
  Description of Artificial Sequence: Synthetic coding sequence
atggctggtggggtctgggggaggtcaagagcaagggaagccccagttggcgctttaacgcttacagccctgaccgaggggatcagagccagacagggacagcctcaaggtccgccatctgctgggccacagccgaaaagttgggaagtcaagcccgaggccgagccccagactcaagccctgaccgccccttccgaagcggagccaggacgcggagccacagtgcccgaagccggaagcgagccatgttcactgaattccgcgctggagccagctcccgaagggcctcaccaggtgccacagtcaagctgggaggaaggcgtgctggcagatctggctctctatacagccgcatgtctcgaggaagccggatttgcgggaacgcaagccaccgtgctgacccttagctcagccttggaggcgagaggcgagcgcctggaagatcaggtgcacgcccttgtacgtgggttactggcccaggtgcccagcttggctgaaggcaggccctggagggccgctctcagagtgctgtccgccctggccctggagcacgcccgtgatgttgtgtgtgcgctactgcccaggtccttacctgcagaccgcgtggccgcagagctgtggagatccttatctaggaatcagcgcgtgaatggccaagtcctggttcagttactgtgggccctaaagggagccagcggtcccgagccccaagccctagcggctacccgcgctttgggagaaatgctggctgtgtcgggctgcgttggggctacacggggtttctacccgcacttacttctggcactcgtcacccagctccacaagcttgcaagatcaccatgttctccagatatgcctaagatctgggttctgtcacacagaggcccaccccacagccatgcctcatgtgctgtcgaagcgttaaaggcactcttgacaggggatggcggaaggatggttgtcacgtgcatggagcaggccggagggtggaggagactggtgggagctcacacccacctcgagggtgtactgttactcgcctccgcaatggtcgcacacgccgatcatcacctgaggggtctttttgctgacctgctcccccgtttacgctcagccgacgatccccagcgcctgaccgcaatggccttttttacaggtttactccagagtcgtcctacggctcggctgctccgagaagaggtcatccttgaacgattgctgacttggcagggcgatccagagcccaccgtgcggtggctgggactgctgggtctgggtcatttagctttgaacaggcgaaaggttagacatgtctcgacgctgctccctgccctgcttggtgcattgggagagggcgacgcgagactggtgggcgctgcactgggggcattacgtcggctgctcctaaggcctcgggctccggtgcgcctgctctccgcggaactggggccacgactgccccctctgctggacgacaccagggactcaatacgggcatccgccgtcggtttactgggcaccctggtgagaagaggtcgcggtggcttgcgactaggacttcggggaccccttaggaagttggtgctgcagtcactggtccctctgctcctgcggctccacgatccgtcccgggatgctgccgaaagttccgaatggaccctcgcacgttgcgatcacgcattttgctggggactgcttgaagagctggtgacagtcgcccattacgatagccctgaggccttgagtcatctgtgttgtcgcctcgtccagcgctacccaggtcacgtcccaaatttcctctctcagacccagggatatcttcggtcaccccaagacccattgagacgggctgccgctgtacttattggtttcctcgtacatcatgcctctccaggatgcgtaaatcaggatctactggactctctatttcaggacctgggtagactccaatccgaccccaaacccgcagttgccgctgcagcacatgttagtgcacagcaagtcgccatgcttgcacgagctagggggtgtcctcgcggacctagactattgcggattgcaccccgacccgcacggcctcccccagtgtttgcagacagtccctttcagaggcgttctgtcgcgggacggtggggatgcagtggccctcgaagggcatag

SEQ ID NO: 54700 - DNA, 885 bp, Artificial Sequence
  Description of Artificial Sequence: Synthetic coding sequence
atggctctattgactcctcagggggtaaaagaagtttttcagctccagagacctcagggtcgggagaggctgaggagactcttgaattgggaagagtttgacgagcagagggacagcagacggtcgatactccttgacacactttatgagagcattatcttcgccgtcggcaaggggtttccgtgggtagaggttgcccaagtagtgaagttcaccgaggaactacttagagaaacaaagggatgttcaattaccgaggcagtaaccatcttagggaataaactccgcgattaccgtggacattttaatacaactcacttgcttgccctgtgcgactacttccatcacacctttatccgccactataagctgtaccaatacgtgctcggccaggatcagcaggtggatttgacagtcgcccaccttgaggtctgcatgccaccacacccgctacccctggctgaaggaatggacagggacctttggattcacgagcagcaggtggcaaccctgaccgaggctgaagcacagaagcgggcagatgtcctcttactcaaagaggccctccggcttgagagagaaaacagccttcagaaggcctttgcggctgccgctccagcccagcctgggcaagtgctagagagacaggagttagagagcctgatctgtcaagcagttcatactcaaatggagttactgcaggagctgctccagcgccaaattcagaacacgtttgccattctggaccttaagctgcagaaaaaaacactgaatctgaatgccccaacccctatccctcctccgatcacctcgcacgcagggcaagaagaagcactgaagccccaaagagcctctaaaggcaagaaagcaaaggccagaaaatag

SEQ ID NO: 54701 - DNA, 1143 bp, Artificial Sequence
  Description of Artificial Sequence: Synthetic coding sequence
atggatagcggctgttggctgttcggcggtgagttcgaagacagtgtattcgaggaaagacccgagcgtagatctgggcctcctgccagctactgcgcaaagctctgcgagcctcagtggttctacgaggagaccgaatctagcgatgatgtagaggtgttgacgctaaagaagttcaagggggatctcgcgtatcgcagacaggagtatcaaaaggctctccaagagtattcttccatcagcgagaagttgagctccacaaacttcgctatgaagcgggacgtacaagaaggacaagctcgctgcctggcccacctgggacgccatatggaggccctcgagatcgccgcaaacttagaaaataaggccaccaacaccgatcacctgactaccgttctctacctgcaactggctatttgctcgagcttgcagaatctggagaaaaccatattttgcctgcaaaaactgatatctcttcaccccttcaatccttggaactggggcaagcttgccgaggcatatctcaacctgggccctgcgctttctgctgccctggcctcttctcagaagcagcatagtttcacctcatcagacaaaacgataaagtcattttttccacactctggcaaagactgtctgctctgcttcccggagactctgccggaatcttctctcttcagtgttgaggccaatagcagcaattctcaaaagaacgaaaaagccctgaccaatatccagaactgtatggctgagaaacgtgagacagtactgatcgagactcagctgaaggcatgtgccagtttcatccggactagactgcttctgcaattcacccagcctcagcagacctccttcgcactggaacgtaacttgcgtacacagcaggaaattgaagataagatgaaaggattcagtttcaaagaagatacactcttgttaatagcggaagtcatgggtgaggatatcccggaaaagatcaaggatgaggtgcatccagaagtgaagtgtgtgggtagcgtcgccctgaccgcgttggtcaccgttagtagtgaagagtttgaggacaagtggtttcgcaagattaaagaccacttctgtccgttcgaaaaccagttccacaccgaaattcagatcctcgcctag

SEQ ID NO: 54702 - DNA, 636 bp, Artificial Sequence
  Description of Artificial Sequence: Synthetic coding sequence
atgctaaggcagtcatgctcatttccagtgacatcactgccggctcttggcggtgtctgcggcagggagggcgctggtgccgaggttcctccagccgcatgtggatgcgaggggcgagacccagacaccgagcggagctgcggcagatcttctaccgggggttgtagcccctgctccggacccggacccagttctcctaggacctccagaggagcccttagcccctccctggggagactgtttcctcatctgcaagttgtgatcaagcttcggatccagctcgctccagctgtgcacctcgcactccctacttgttctctgttgaccagcagccccccattggagggctgttgccataggctgaatgaagaggcagaggtacagaggggttttcgccctatcgctgtggaattggagtttgagaaccaaccccttggcgcagagacgcggctgcggaatggtaggcgggctggtgtcaagaggagtgagggcaggggccaagtacgccctgggcaggtcagatctacgggacccgagggaggtctcacaagaatggagcgaaaagccgcaaggttgcagtgggattctggcagcatcaagatgtctgagaacgagcagctttgggaagagccttag

SEQ ID NO: 54703 - DNA, 261 bp, Artificial Sequence
  Description of Artificial Sequence: Synthetic coding sequence
atgtggcctccttgcggaacactaagaaccttggcactcgcaaggagtcgaggtgccagagcctgctcaggggacgggggtgtttcgtatacacagggccaatccccagaaccgagaacccgggagtacttttactacgtcgaccaccaggggcagttgttcttggacgactccaaaatgaagaacttcatcacgtgcttcaagggtaacgctgtgccacccagccccgctccatcctttagcctccctggatctccttag

SEQ ID NO: 54704 - DNA, 468 bp, Artificial Sequence
  Description of Artificial Sequence: Synthetic coding sequence
atggggccaggcgactttagaagatgcagggaacgcatatctcaaggcttgcagggcttaccaggcagagctgaactgtggtttccgccaaggcctgcctgcgacttcttcggggacggtaggagtaccgacattcaggaggaggcattggcagccagtccactgctcgaggatttacgcaggcgcctcaccagggctttccagtgggccgtccagcgcgctattagtcggcgagtgcaagaggctgccgctgccgctgcagccagagaggaacagtcatggacaggggtcgaagccacgctggcgcgactcagggcagaactggtggaaatgcacttccagaatcatcagctggcacgaaccctcctggacctaaatatgaaggtacagcagcttaagaaagaatacgaactggagatcacctccgatagccagagccccaaagatgacgccgctaatccagagtag

SEQ ID NO: 54705 - DNA, 672 bp, Artificial Sequence
  Description of Artificial Sequence: Synthetic coding sequence
atgcgcccattggggaaaggtctgctgcctgcagaggagctgatccgcagtaacttaggtgtgggtagaagcctcagggactgtttgtctcagtcaggaaagcttgccgaagaattaggcagcaagcgcctcaagccagccaagttcggaaccgagggaaaagagcgggtggagcaacgtactgagaggcagaggaccgggagttctaaggaaccccgaatgcagattatctgccgtcgcaggtggagggagcctcccccaagattgctttggggctgtctcatgcccagggcccagcctttgcttcatgtgactgcttacgagaatactggtcactgggagcggctggcctctgttgtatccagcaagacccagcaacccacggtgatttcacacagttctattagcatcactttttcgcactaccctccggctacattggactctttcctcgtcttggagcccattaaattgtttcctgtgtcctctctgcggtctcctttgtgcttgaattgtggctcctgccgtgaatcaatcaggatttccggggagctcatcggcaacgcccatagcccagctcctccgcgaactcctgaacttgagacactggggtgggataaacaggcagtgttgagcggggcacaggttattctggtgtgcgcagaggtttag

SEQ ID NO: 54706 - DNA, 306 bp, Artificial Sequence
  Description of Artificial Sequence: Synthetic coding sequence
atgcgcacccccaagcgcacgcggagcccaaagaccaaagtctccctgcgaggagagactctgacacttcagttgaccacagtatccctggatacacggcatatggtcaaacggtgcgacgagaggcatggccgtcccctgccacacagccaggaaagtcagcacggcagcgcaacaagtaaaaaagccgtgcgcggtaccgcagacacagcacctctggagcggatttccgccgctagggggtgggccctcccgatggaggcaacagtgtccgtatttcgtgcacaccagtggcagtggaactag

SEQ ID NO: 54707 - DNA, 561 bp, Artificial Sequence
  Description of Artificial Sequence: Synthetic coding sequence
atggaacttagctgccccggtagccgatgcccagtgcaggagcagagagccaggtgggagcgaaaaagagcttgcacggcccgtgaactgctggaaacagaacgaagataccaggaacagttgggcttggtggcgacttattttctcggcatcctgaaagccaagggtaccttacgccctcccgaacgccaggcactttttgggagttgggagctgatctatggggcttcccaggaattactgccttatctggagggaggatgctgggggcagggcttggagggtttctgcagacacctggaactatacaaccaattcgcggctaatagtgagaggtcacaaaccaccttgcaagaacagctgaagaaaaataaaggattccgccgtttcgtgagattgcaggaggggagaccggagttcggtgggctacagctgcaggacttgctcccattacctttacagagacttcagcagtatgaaaatctggttgtggccttggctgaaaatacgggccctaacagccctgaccaccagcagctgacccctgtgctgccctcatag

SEQ ID NO: 54708 - DNA, 1008 bp, Artificial Sequence
  Description of Artificial Sequence: Synthetic coding sequence
atggagttatcctgccctggaagcagatgtcccgtgcaagagcaacgggcacgatgggagcggaagcgagcttgcacagcacgcgagttgctcgaaacagaacgcagataccaagaacagcttggccttgtcgcaacatactttctgggtatcttgaaagctaaggggaccctccggccacctgagcgtcaagccctgtttggctcttgggagctgatttacggggcatcgcaagagctcctaccatacctggaaggcggatgttggggacaaggtctggaaggattctgcagacatctcgagctttacaaccagtttgcagccaattcggagaggagtcagacaacactgcaggagcagctgaaaaaaaacaaagggtttagacgctttgttaggttacaggaaggacgcccagagttcggcggactccagcttcaggatctccttccgctgccgctgcaacgattgcaacaatacgagaaccttgtagttgccttggccgaaaatactggccctaacagcccagatcatcaacagctgacccgcgctgctcgtttgatttccgagaccgcccagcgcgtgcacaccatcggccagaaacagaagaatgaccagcacctccgccgtgtccaggcgcttctcagcgggcgacaggctaaagggctgaccagtggtagatggttcctacgtcagggctggcttttggttgtgcccccacacggggagcccaggcctcgaatgttcttcctgttcaccgatgtgctcctgatggcgaaaccaaggccacccctgcatctcctgagatccggcacatttgcctgtaaggcactgtatcctatggctcagtgccacttaagccgggtgttcggacactccgggggaccctgtggtggtctgctgtctctctccttcccacacgagaaattgttactcatgagtactgatcaggaggagctttccagatggtaccacagccttacttgggcaatctcttctcaaaaaaactag

SEQ ID NO: 54709 - DNA, 900 bp, Artificial Sequence
  Description of Artificial Sequence: Synthetic coding sequence
atgcttggtgtctgccagactttgaaacaatactttctggggatcctcaaggccaagggcacacttcggcctccagagcggcaggccttgtttggctcatgggaactcatctacggcgcttcacaagagcttcttccttatctggaaggcggatgttggggacagggactagagggcttctgccgccacctggaactttataaccagtttgctgctaattctgagcgctctcagaccaccctccaagaacagctgaagaaaaacaagggatttcggcgtttcgtgcggttacaggaggggaggccagagtttggtggacttcagctccaggacctcctacccctgccgctacagcgcctacaacagtacgagaacctagtcgtggccctcgcagaaaacaccgggcctaacagccccgaccaccagcaactgaccagagctgcgagacttatttctgagaccgcacagcgcgtacacacaatcggccaaaagcagaaaaacgaccagcacctgagacgcgttcaggccctgctgagcggccgtcaggcgaaagggctgacatcaggcagatggtttctcagacagggctggcttttagtcgttccacctcacggagaaccacggccacgaatgtttttcctctttacagacgtgctgctaatggccaaaccacgcccacccctccacctgctgcgctcagggacattcgcttgcaaggccctttacccgatggcgcagtgtcacttgagtcgggtgtttggccactccggaggaccttgcggcggacttctgtccctgtctttcccccatgagaaactcttacttatgagtacggaccaggaagagctgtctagatggtaccattcgctgacgtgggccattagttcacagaagaactag

SEQ ID NO: 54710 - DNA, 171 bp, Artificial Sequence
  Description of Artificial Sequence: Synthetic coding sequence
atgcgtcgcccttgggaaaagaaggaggctacccggaatcccatcgcagaggttctggcccgaaaaaaaaggacagaagaactcatttccctgcaggagcatggctcgcgtaaacagaagattaaagaggcgtcaattagctgggctgagactagcagacaaatcgggtag

SEQ ID NO: 54711 - DNA, 222 bp, Artificial Sequence
  Description of Artificial Sequence: Synthetic coding sequence
atgcagtttgctgactggctccatccatccggctggactatagaaatcctaaacgcatacggcatgggagatagaaagagaaccaattcgatgtcaaaggaggcattcactccagaacagcttcacctcgagaaggaactgggcgaaatgaggctgagaccaaccgtgcttcattctcagacagatcaccaaggcttccggcctattcccatgatgcaatag

SEQ ID NO: 54712 - DNA, 1131 bp, Artificial Sequence
  Description of Artificial Sequence: Synthetic coding sequence
atggcggaaagaggacggaaacgcccttgtgggccaggagagcacgggcaaaggattgagtggagaaagtggaaacaacaaaagaaggaagagaaaaagaaatggaaggatttaaagcttatgaaaaagctggaaaggcagcgggctcaggaagaacaggctaagagattggaggaggaagaggcagccgcagaaaaagaggatcggggacgaccgtacacgctgtcagtcgcattaccagggtctatcctcgataacgcacaaagccccgaactgcgtacttatctagcaggccagattgctcgggcatgcgcaatcttttgtgtcgacgagatcgtggtgtttgacgaggaaggccaagatgcaaagaccgttgaaggcgaattcaccggcgtgggaaagaagggacaggcttgtgtgcagttagccaggatcctgcaataccttgagtgcccccaatatctgaggaaggctttcttcccaaaacaccaggatctccagttcgctggcttgctcaatccactagacagcccccaccacatgcggcaggatgaggaatctgaattcagagagggcatcgtggtggaccggcctaccaggcctgggcatgggagctttgttaattgtgggatgaagaaggaggtcaagatagacaaaaacctcgagccgggacttagggttactgtccggctaaatcagcagcagcaccccgactgcaagacctaccacggcaaggtcgtcagctcacaagatcctcggaccaaggcgggtctgtactggggctacaccgtgcgcttagcaagttgtctcagcgctgttttcgccgaggctccttttcaggatggctatgatctcacaatcggcactagcgagagaggaagcgatgtggcctccgcgcagcttcccaacttccggcatgccctagttgtgttcggcggactccagggccttgaagcgggtgctgacgctgaccccaacttggaagtcgcagagccatccgttctgtttgacctgtatgtgaatacctgcccgggacaaggtagcaggacaatacgcaccgaggaggcaattttaatcagcctcgccgctctgcagccaggcctgatccaggccggagcccgacacacatag

SEQ ID NO: 54713 - DNA, 1167 bp, Artificial Sequence
  Description of Artificial Sequence: Synthetic coding sequence
atggctgagcgaggtcgtaagaggccttgtggcccaggcgagcatggccagcggatcgaatggcgtaaatggaaacagcaaaagaaggaggaaaaaaaaaagtggaaagacctcaagctgatgaagaagttagaacgccagcgagcccaggaggagcaagccaagcgcctggaggaggaggaggctgccgcagagaaagaggatcgcggaaggccttacacactgagcgtcgcgctgcctgggtctatactgacaatgctgagccgccgttcctttgccccaacttggcccgtccgattacccgaacctgtgcctagtagcgtgtggatgcgttcttggtgccttatgcgcagagcccgaatgcctcgcttatggagaggaaattcccaggagttagaggagggggctggggtgcgcactgccggacccgacccagcagtgcctgagtgcccccagtatctgagaaaggcattcttccccaagcaccaggatctccagttcgcaggcctgctgaatccgttggactccccccaccatatgcgtcaggacgaagaaagtgagttccgggagggcatcgtcgtcgaccgaccaacacgccctggacacggcagttttgtaaattgcggaatgaagaaggaggtgaagatcgataagaacctagagcccggactgcgtgtgacagtgcggctgaaccagcagcaacaccctgactgcaagacataccacggcaaggtggtgagctcccaggatcccagaacgaaggccggactatactggggctacacagtgaggcttgcttcttgtctttccgcggtgttcgccgaggccccttttcaggatggctatgatctgaccattgggacctctgagaggggaagcgacgttgcatcggcgagcttcccaactagcggtatgctcttatggtgttcgggagcatcacgggtttggaagctggaacgcatgctgacccctacttggcggtggcttaatcctgtatcctccctcacatgcactagcatccctgtgctggcacgcgtggccgttcccagcgctcgcaggaaacctagctcatcaccttggcctccctgttcactggcaagttcaagaagagtcccgggaactcctgaatcaagtaaaggcccaaggacgagcgtgaagcaacagtag

SEQ ID NO: 54714 - DNA, 279 bp, Artificial Sequence
  Description of Artificial Sequence: Synthetic coding sequence
atggcggaggaatgccccagagcatgcgctgaacctgtggctcccaaggccaccgctccacctgaacggacctccgactactatcgcgtttcagccgacctaccaggccgatttaacaacccgggttggtttagaggctacagaacacagaaggctgtgtccgtgtataggaccagcaaccaggcttacggaagccgagcccctactgtccacgagatgcccagagtggagtgctccgggactattcttagcatgttcacctggaggaaggcctcctag

SEQ ID NO: 54715 - DNA, 279 bp, Artificial Sequence
  Description of Artificial Sequence: Synthetic coding sequence
atggccgaggagtgtcccagggcctgtgccgaacccgtcgcccctaaagctacagcccctcctgagcggaccagcgattactatagggtgtctgcagaccttcccggtaggttcaataatcccggatggttcagaggatatagaacgcaaaaggccgtctctgtgtaccgcacgagcaatcaggcatatggcagtcgagcacctaccgtgcatgagatgccgagagtggagtgcagtggcacaatcctgagtatgtttacatggcggaaagcatcctag

SEQ ID NO: 54716 - DNA, 411 bp, Artificial Sequence
  Description of Artificial Sequence: Synthetic coding sequence
atggctgaagagtgtccccgtgcttgtgcagagccggtggcccctaaagccactgctcctccagaacgaacaagcgattattacagagtgtccgctgaccttccagggagattcaacaatccagggtggttccgtggctatagaacccagaaagcagtaagcgtgtatcggacttcaaatcaagcctatgggtctagggcacccactgtgcatgagatgcctaaagtgttctaccctaactccaataagttcagtcagcagttagccgctggcggtatgttccggaacaatacgctgaacgtgtacttggagaaatccatcgtcaccggccctgacaattgtattacatcatgtgaccggctgaattttcaccctagctacaatatcaataggccaagcatctgtgattag

SEQ ID NO: 54717 - DNA, 381 bp, Artificial Sequence
  Description of Artificial Sequence: Synthetic coding sequence
atgggaaccgaggtaggcattagctggacccgcgtaggcacaggcgcaactgttggcttattgccccctcaccctcaccagcaaatgcacagagacgaggaggattcagacgtcgacgtcaccttccagccttggcataaggagatgctgcaacagctgctagtgatgctgtccagcaccgtcgcaacccgccctcagaaagctgcctgcccccaccaggagtcccagagtcacggaccgccaaaggagtctgtgccttgggctcctacacagaggtccggcaacgccgagcagcgctgctcaggggagggtgctagacggagaggacccgaaacgcggcctttgagaacccctgaaggttgggctggacgcgcaccttag

SEQ ID NO: 54718 - DNA, 1563 bp, Artificial Sequence
  Description of Artificial Sequence: Synthetic coding sequence
atggcccctaagaagtccgtaagcaaagccggaaaagaactcgaggtgaaaaaaaaagggggaaaaaaggagccggtcgtcgccgtcgaacctccactcgcgaaggagatgaaagagttctatcatatccagataagagatctagaggataggcttgcccgatatcaaagaaaatgggacgaactggccgttcaagagaaaatgtttcggcaggaatttgaacaactcgctaacaacaaaaaagaaattgttgccttcttgaagaggacactaaaccaacaggtggacgaaatcaccgatttgaatgaacaactccaaaatcttcagctcgctaaggagatggaaaaagatgcatttgaggcccagctggcacaggtccgccatgagttccaagagaccaaggaccaactcaccaccgagaatataatcctcggagggaaattagcggctctcgaagagtttaggttgcagaaggaggaagtgacagataagtttactcttttggaagagcaggttcgcaaacaagaaaatgagttccgagactatgcttataatttggagaagaaatccgttctggataaggacaggctgcgtaaggagatcattcagagggttaatcttgttgctaacgagttccataaagttacaactaaccgaatgtgggaaacaactaaacgagctataaaggagaacaacggcattacattgcaaatggccagagtgagccaacagggaatgaagttactgcaagagaatgagcagcttaaaggtagacagaacaatctgtgtaaacagttggagctgctcgaaaatacccagaaagtgatggccagacacaaaaggggacatcagaaaatcatacttatgctgaccaagaaatgtcaggaacagcaacaggatactaaggaggctgaagagctgaggctgcttctgtcccaactcgagcaaaggagcttacagctgcaggtcgataatcaagcacttaaatcccagagggatcaactatcactgcagctcgagcagcagcaggttgatttgcagaggctccaacaggagctcgccaacgaacaaaaagtccgggctagcttagaagctgccctggtacaagctacctctttcctgcagaatatactgcagatgcaccgcgatgaggaagacagtgacgtcgacgttacatttcagccatggcataaagaaatgctgcagcaactccttgtgatgctcagctccactgtggctacaagaccgcaaaaagccgcatgtccccatcaagaatcccagtcacacggacccccaaaagagagtcgcccttccattcagcttccaagaactgggagtttgctcccgcaattgtcagatataacaccctaccagccaggagacttgggtttagtgcccaggcaggtacacatcccccctaacccccaggacctccgccttctaagttatatcacccgggtcggcacgttccgggctcacagcagtcctgagatgcgcgcacccggaagcctgaaacggctggagaagttctcgctccccgaggttcctctgaggcccaaatag

SEQ ID NO: 54719 - DNA, 210 bp, Artificial Sequence
  Description of Artificial Sequence: Synthetic coding sequence
atgtgctacgtggtccctggctgtttcatttacatttgcggctgtactaggattaagtcaacacatttcaacggcaaatcacagatggtcgacctaaaaagccagagttgggatctcgaaaggctggagaacaaaccacccccagccgtgtatgacctcgccgctaccaccagtcagttgggtgagtgggccaaatctagaatctggtag

SEQ ID NO: 54720 - DNA, 906 bp, Artificial Sequence
  Description of Artificial Sequence: Synthetic coding sequence
atggaggctcacgaaataatagaggagcctcatattacaatggacgcagaaaaacacccccctagcaaggacccctccgcggaggacctgcaggagaatcacatctccgagagctttcttaagcccagtacttcagagacgccgctggaaccccatacctctgagtcacccctggtgccatccccctctcagataccccttgaggcacatagtcctgaaacccaccaggaaccttcaatctctgaaacccctagtgagacaccaacctacgaggcttcgttggatagccctatttccgttgtgccagagaaacatctgactctgccccctcaaagccgcgactacgtgtgcctttcatcgtctgatactctgaaagaggatcttagcagcgaaagtagcagcaacgaggtcccctggacgaggcggtctactcatctaagcgaatccgagtcactaccagaacactgtctgagcgggcctagcagccaagtacaggtcgatacaacggaaaaacaggaggaagaggctggggaggtggagaaaggcgtggatgccagtgatagcacagcccacacagcccaacccggacatcaactgggcaatacagctcggcctgtgtttcctgcgagacagacagagctggtggaggttgccaaagcaatgcacagagaagaatttggcgctcaggtcaataatctcttccagtgggagaaagatgccgctctgaacgctatccagacaggactgtacataggctggcgctgcccacactatctgtgggattgttttcgaatcggagacgagtccagatgtttctgtggacatctcctgcgcgaacatcggataatatcggacatttccgtgccctgcaaagttagtcagtgcagatgctttatgttttgctag

SEQ ID NO: 54721 - DNA, 1209 bp, Artificial Sequence
  Description of Artificial Sequence: Synthetic coding sequence
atggaggcccacgagataatcgaagagccccacattactatggacgccgagaagcaccctccatccaaggacccaagcgccgaggatttacaggaaaaccatatttccgagtctttcctcaagccgtctacctccgaaacaccactggagccccacacgtccgagtctcccttggtgcccagccccagccagattcctctggaagcacatagccctgaaacacaccaagagccgtctatcagcgaaaccccaagtgagacgcctacatatgaagccagtttggatagccctatcagtgtggtgccggagaagcacctaaccctgccccctcagtccagagattatgtctgcctcagttctagcgataccctaaaggaggacctttcctccgagagttcatctaatgaagtaccatggaccaggcgctccactcatttgtctgagtcagaatccctgccagagcattgtctgtcaggaccttcatcacaggtccaggttgatacaacggagaagcaggaggaagaggctggcgaagtcgagaaaggagtggacgctagcgatagtactgcccacacggcgcagccaggccatcaattaggtaacacagcacggccagtgttccccgcacgacagacagaactggtggaagtagctaaggctatgcacagagaagaattcggcgctcaggtaaacaatctgtttcaatgggagaaagatgctgcactcaatgcgatccagacaggcctctacattggatggaggtgcccgcattacctatgggactgttttcgaataggcgatgagagtcggtgcttttgcggccacttactgcgggagcaccggataatcagtgatataagcgtgccttgcaaagtctcgcagtgccggtgttttatgttctgcttcatccctagcaggccagaagaagttggcgagttttggctgaaacgacgcgcaacattcgacccgaaggcttggcgggcacagtgtaggtgcaagcacagccacgaggagcacgccgctaccggtcctcacccatgccggcatcatggctgctgctgtggatgcttcgaaagcaactttctgtgcgccgcttgcgatcgcaggtgggaggagcatgaaacatttttcgatacacagaaaacacgtcaaagaggaggtcggcctcggggaacagacaccgtgagcaactggcatagaccgctttag

SEQ ID NO: 54722 - DNA, 273 bp, Artificial Sequence
  Description of Artificial Sequence: Synthetic coding sequence
atggaagcgcacgagatcattgaggaaccacatattacaatggacgccgagaaacaccctccttcaaaggatccgagcgccgaggacctgcaggaaaaccacattagcgaaagtttcctcaagccctctacaagtgaaactcctttagagcctcatacctccgagtcaccactggtgcccagtccatcccagatccccttagaggctcatagtcccgaaacccaccaggaaccatccatcagcgagactccctccgagactccaacatactag

SEQ ID NO: 54723 - DNA, 591 bp, Artificial Sequence
  Description of Artificial Sequence: Synthetic coding sequence
atgccaggaatggtgccccctcatgtcccaccccaaatgctgaacatcccccagaccagccttcaggccaagcctgtggcaccacaggtcccgtcccccggaggagcacccggacagggaccttacccctattctctcagtgagcctgcacctctcacattagatacaagcggcaagaatcttacagagcagaactcgtattcgaacatcccacatgaagggaaacacactccactgtacgaacgctccctgccaataaatccagcccaatccgggagtccaaaccacgtggactctgcctacttccccggatcctctacaagcagctctagtgacaatgacgaagggtcaggcggtgcaacgaagtacacaatctactggggctttagagcgacggaccatcatgtgcagggcagagactctcaagcacggggaacagctgcacactggcacggcggtcatgtctgttccccaaacgtattttggcgcatcagccatggacctgcccaacagctgacattccccactgaacaagccgctccacccgtctgccctgcaccggcttcccggcgactgagtgctccgggatag

SEQ ID NO: 54724 - DNA, 3240 bp, Artificial Sequence
  Description of Artificial Sequence: Synthetic coding sequence
atggagtggctgctggaagacttgctcggcgcaaaaggggatatgggcttgctgtggggacagttgacacatgcactggcttgcagacactgtgggtcatcctgttttcagtcaccaggcaacctcgtaaccctcttcctgtttgtcgtgtggcagattcagaggtggtggcagctcggacgcctgcgccagctgcacccctggtgctccggcaatatggtgcagggaaaggagttaccactactacatagggttgccttcctggatcacctgtgcaaacagaagtcagaggttgaggaggaaggagaggaggaagaggaaggggaggacgaagcgtctttggacccgcttaaaccgtgttcccctacaaaagaagcgcctaccggagaacaggcaacacccgcacccccacagccaagttgtggcagcgaagggctcttgaaggctattgggattccagaacaaacagtgatgcagccggtctcccccagccgttcatttccaattttccagatactgacctcattccctgtacgacataaaatcgcttccgggaacaggcagcagcagagaaagagccagctcttttgggggctaccctctctgcatagtgaaagcctggaggcaatcttcctgagctctggcggacccagcccactcaagtggtcagtgtgttcgagtgtattcttcaataaattggctttcctcccaagaagcaaccttctgctgccccaataccactcgtcggcccagtttagcactcacggagctcacactatggaagacctcgaaggcatggcgccagaccctcagctcctcccaccacccagctccccttcagtttcttcgctcctgctgcacctacgaccctttcctgtggaccataagggggtgctaagcggggcagaagccccaacacaatctcctggcacctcccctcttgaggtgctgcccggatacgagactcatttggaaaccaccggccacaagaagatgccccaagcctttgaaccaccaatgccccctccttgtcagagtcctgcctccttaagcgagccaaggaaagtctcacccgaaggaggattggcaatttctaaagatttttgggggaccgtggggtatcgcgaaaaaccgcaggcttcagagtcctcaatgccggtcccctgcccccctctggacagcttgccagagctgcagagagaaagcagccttgaagatcccagccggtacaaacctcagtgggaatgccgtgagaacagcgggaatctctgggcttttgagagcccagtgcttgacctgaaccccgagctgagcgggacttcacctgagtgcgttcctcccgcaagtgaaacgccatggaaaggcatgcagtccagagaaaatatctgggtgcccgctgatccggtgagccccccttctcttccttccgtccctctccttgagagtctggttatgggaccgcagggagtgctaagtgagagcaaggccctctgggagacaatgggccaaaaagaaaatctgtgggcgtcggatagccctgaccctgtacacagcacgccacccaccacgctgatggagccacacagaattaaccctggcgagtgcttagccacgtcagaggccacctggaaagatactgaacacagccggaatagctccgcttccagatctccgtccttagctctgtcgcctccgccagccctcgctcctgagttgctccgagtgcgaagcatgggggtgctttcagattctgaagcaaggtgtggcgatatccagaaaaccaagaattcctgggcgagtaagcatcccgcatgtaatctgccgcaagaccttcacggagcctcacccctaggggtgctcagcgattcacagtctatcgtcggcgaaatggagcagaaagagaattgtgtcccagttttccccggacgcggttcatcaccatcctctaacagtgtgagtaaatcccacgtttccgaacccatcgccgaccaatccaattacaagccggatggcgaagccgtcgagcagaggaaaaaccactgggccacagaactgcctgcaccatcttccctgtctactcctttgcccgagcctcatattgatctagagctcgtgtggcggaacgttcagcaacgtgaggtaccccagggcccaagccctctggccgttgatccgctgcacccagtcccccagcctccaacacttgccgaagctgtcaaaatcgagcgtacacatccaggactgccgaaaggcgttacctgtccaggtgtaaaggcagaggctccactcagtcagcgctggacagttccagaactcctgactcaccccggaatccacgcctggcaatggagtcgcgaactcaaattacgcctcaaaaagctacgacagtccccagccagccgggctccaggaccctcacaaagtttctgctccagcccaatcctgtcatctaccatacctgatttttgggggttgccttcctgtccaccgcagcagatctaccccccaaacccatgtccccatagctcctcctgccacccacaggaagtgcagcggaccgtcccacagccagttcaaagctcccactgtcaccatttccagtcgagttcccagctacagccacaagagtctggtcgggctgagcaggggagccagaggggagagaagatgaagggcaagatggtgtctcaggtgccttcccagggaccttgcgtgcatatggaggcgggtgtagactatctgagccctggacccggagagccatccaacagtaaagtgctggtcagtggtaaacggaaagataaggcctctgccagttctagcgcgaagaaaagagaacatccaaggaagcccaaagccggagaccatcgcagaggaacagcccgactgggtttgtcaaccgtcactggcaaaaatcaccctgcccaggcccgttcgctggtggaggctcctgtgagcacattcccccagagatcccagcaccggggacagtcctcacagcacacagcgttgccgcagcttcttcttcctaaggctagcggtccccaggatcagcccgaggccggacgcagggcatctgacatactgacacctagacactgcaagcactgcccttgggcacacatggagaaatacctgagctttccaacattgaaagccagcctgacacggggtcttcaaaaagttttggctaagtgcctcgacaaccatagacctctaccaacaaaaagcagccagtag

SEQ ID NO: 54725 - DNA, 3021 bp, Artificial Sequence
  Description of Artificial Sequence: Synthetic coding sequence
atgctccggaaggagctcccccttctacaccgtgtggctttcctcgaccatttgtgcaaacagaagtcggaggtggaggaggaaggtgaagaagaggaggagggggaggatgaagcatctctggatcccttgaagccctgttcacctacaaaggaagcacctacaggcgagcaggcgacacccgctccgccacaaccaagctgcggttccgaagggctgttgaaagccattggcattccagaacagactgttatgcagcctgtgagcccatctcgctcgttccctatttttcagattctgacctcttttcccgttcgccacaagattgctagtggcaacaggcagcaacagagaaagtcacagcttttctggggcctcccatctttacactccgaatccctagaggctattttcctgtccagcggaggtccaagccctttgaaatggagcgtgtgcagtagtgtcttctttaacaagttggccttcttacctcggagcaacctcctcttgccccagtaccactcatcagctcaattctccacccacggcgcacacacaatggaagatctggagggcatggctccagaccctcagctcctgccacccccaagtagtccctcagtttcctcactgctgctgcacctcaggcccttccctgtcgaccataaaggtgtgctgtctggcgcagaagcgccaacacagagccccggtacctccccgctggaggtgctgcccggatacgagactcatctggagacgacaggccacaagaaaatgcctcaggcctttgaaccacccatgccccctccgtgtcagtcccccgcttccctgagcgaaccaaggaaagtcagcccagaaggcggtctcgcaataagcaaagatttttggggcacagtcgggtatagggaaaagcctcaggcctcagagtcttctatgccagtgccatgcccccctctcgactcattgccagaactccaaagagagtcttctctggaggacccttcacgctataagcctcagtgggagtgtagagagaacagcggtaatctgtgggcctttgaaagccctgttcttgacctcaaccccgaactgtctgggacaagcccagagtgtgtcccacccgcatccgaaaccccctggaaaggaatgcagtcacgagagaacatttgggtcccagcagaccctgtgagccctccatcgttaccgtctgtgcccctgttggaaagcctagtgatggggcctcagggtgtgctttctgagtctaaggcgctctgggagaccatgggacagaaagagaacctctgggccagtgattccccagacccggtccactccacacccccaacaactcttatggaaccccacaggattaatcctggggagtgtctggctacatccgaggcaacctggaaagacacagagcatagcagaaacagctcagcatcccgctctcctagcttggccctcagtcccccaccggcactggcacccgaactgcttcgcgtacggtctatgggggtgttgtccgacagcgaggccagatgtggcgatatacaaaagacaaaaaattcttgggcgtctaaacatcccgcatgtaacttaccacaagacctgcacggcgcatcacctctcggggtgctgagcgattcgcagtctatagtcggggaaatggagcagaaggagaactgtgtcccagtgtttccgggtcggggtagctccccttcctcaaatagcgtgagcaaaagccatgtcagtgagcccatcgcggaccagtccaactacaagcccgacggagaggccgtggaacagcgcaaaaatcactgggctacagagctccccgctcccagctccctctcgacacccctgcccgaaccccatatcgacctcgaactggtatggagaaatgtgcagcagcgtgaggtccctcagggtcctagccccctggcagtggatcctttacatccagtccctcaaccgccaaccctggcagaagcggtgaaaattgagcggactcatccaggactgcctaaaggagtgacttgtcccggtgttaaggcagaagctccactgagccagagatggactgtgccggagctgcttacgcaccccggaatacatgcttggcagtggagtcgggaacttaagctccggctgaaaaaactccggcaatctcctgcttcccgagcccctggaccaagtcaatctttctgctcatctccgattctcagttcgacgatcccagatttctgggggctgccgtcttgtccacctcaacagatttatccacctaatccctgtccacactcctcttcttgccacccacaggaggttcagcgcactgtaccacaacctgttcagtcatcacactgtcatcattttcagagctcctcccagctacaaccacaagagagcggtcgcgcagagcaaggctcccagagaggcgaaaaaatgaagggaaaaatggtctcacaggtgcctagccagggaccatgtgttcacatggaggcaggcgtggattacctcagccctggcccaggcgagccatctaacagtaaggtgctggtgtcaggcaaacggaaggacaaggctagcgcaagcagttcagcgaaaaaacgcgaacacccaagaaaacctaaagctggggaccataggagaggaacagctcgcctgggcctctccacggtcaccggtaagaatcaccccgcacaggccagatctctggtcgaagctccagtgtcaacctttcctcagcggtcccagcacaggggccagtcaagccagcacacagcccttcctcaacttctcctcccaaaagcctccgggcctcaagaccagccagaggctgggaggcgcgcttccgacattctgactcctaggcactgcaagcactgcccatgggctcacatggagaagtacctcagcttccctactctcaaggcgtctctgacccggggtctgcagaaggtactagccaaatgcctagacaatcatcgacctctgccgacgaagtcctctcaatag

SEQ ID NO: 54726 - DNA, 3096 bp, Artificial Sequence
  Description of Artificial Sequence: Synthetic coding sequence
atgttaaggaagattcagcggtggtggcagctcgggcgactcagacaactacatccatggtgcagtggaaatatggtgcagggaaaggaactgcctctactgcacagagtcgctttcctggatcacttatgcaaacagaagtccgaggtagaagaggagggagaagaggaagaggaaggggaggatgaggctagcctcgatcccctcaaaccgtgtagccctacaaaggaggccccaacgggcgagcaggctacgccagcccctccccagcctagttgcggaagcgagggcttactcaaagctataggcattcctgagcagacagtcatgcaacccgtcagtcccagccgatctttccctatttttcaaattctcacatcattccccgtaaggcataaaatagcttccgggaaccggcagcaacaaaggaagtcccaactcttctggggtctccctagtctgcattccgaatcactcgaggccatctttctgtcaagcggtggtccgagcccgctgaaatggagcgtctgctcctctgttttttttaacaaactggccttcctacctaggtccaacttgctactaccacagtaccacagtagcgcccagttttcaacccatggggctcacaccatggaggatctggaagggatggctcccgacccacagctcctgccccctcccagttcaccctcagtgtcatctctccttctgcatctcaggcctttccccgtcgatcacaaaggggtcctgtcaggagctgaggctccaacacagtcacccggaaccagccccctggaggtactccccggatatgagacgcatctggagactaccgggcacaagaaaatgccacaggcctttgagccaccaatgcctccgccttgccagagccccgcaagtctttcagagccaagaaaagtgagcccggaaggcggattagccatctcaaaagacttttggggcaccgtggggtaccgggagaaaccccaggcctccgagtcaagcatgcccgtgccttgccccccactggatagtctgcccgagttacaacgggagagcagcttggaagacccttcccgctataaacctcagtgggagtgccgcgagaatagtgggaatctctgggcctttgagtcccctgtgctagatttgaaccccgagttatctggaacatctcccgagtgcgttccgcctgccagcgaaactccatggaaaggaatgcagtccagggagaatatctgggtgcccgctgacccagtgtctcctccaagcttgcctagtgttcctctcctagagtcactggtgatggggccacagggagtgttgtcagagtcaaaggctctgtgggagactatggggcagaaagagaacctttgggccagcgacagccccgatcctgttcacagcacacctcccaccactctgatggagccgcatcggattaacccaggtgaatgccttgctactagtgaagccacttggaaagacaccgaacacagtcgtaattcatcggcgagccgatctccttctcttgccctgtctcctcctcctgctctcgcccctgagttgctgagggtgcgctctatgggggtgctgtcagactcagaggccagatgtggcgacatccagaaaacaaagaatagttgggcttccaagcatcctgcctgcaacttgccccaggatcttcatggcgcatctcccctgggggtgctgtccgattcccagtccatcgttggggagatggaacagaaagagaactgtgtccccgtctttcctggccgtggcagctccccatcctccaattcagtgtctaaatcacatgtgtctgagccaattgctgaccagtcaaattataagcctgacggcgaagccgtcgagcagcggaagaaccattgggcaaccgagctgccggcaccctcttcactcagcacgccgctgccggagccccacatcgatctcgaactggtctggcgcaatgtgcagcagcgggaagtcccacaaggcccttcccctctcgcagtggatcctctgcatccagtgccccagcccccaaccctcgctgaggcagtcaaaatcgagaggacccatcctgggttgccaaagggcgttacctgtccaggggtgaaagctgaggcgccacttagccagcgatggaccgtgccggagctgctgacacaccctgggattcacgcctggcaatggagcagagagctcaaactccgtctgaagaagctgagacagagccccgctagccgggcaccgggacccagccagagcttttgttcctctcctattttaagctctacgatcccagacttttggggcttaccatcttgccccccacaacagatataccctccaaacccctgtccacactcgtcatcctgtcatccccaggaagtccagagaacagttcctcaacccgtacagtctagccattgccaccatttccagagttctagccagctccagcctcaagagagtggcagagccgagcagggaagtcagagaggagagaagatgaagggaaaaatggtgtctcaggtccccagtcaagggccttgcgtccatatggaagccggtgttgattacttgagccccggaccaggtgagccctcgaactccaaggttcttgtcagcggcaagcggaaggacaaagcatctgctagtagcagcgctaagaagcgcgagcacccgcgtaaacccaaggcaggagatcatagaagaggaactgccaggcttgggctgtcaacagtaacgggtaaaaatcacccagcccaggcccgatctctggtcgaggcccctgtgtcgactttcccacagcgctctcagcatagggggcagtcttcacagcacacagcgcttccacagctgctcttgcctaaggccagcggcccacaggaccaacccgaggcaggtagacgggcttcagatatcttgacgccgaggcattgtaagcattgcccttgggctcacatggaaaagtaccttagctttccaaccctgaaggcttccctaacacgcggactgcagaaggtcctggccaaatgccttgacaaccatagacctttgcctacaaagtcatcgcagtag

SEQ ID NO: 54727 - DNA, 1665 bp, Artificial Sequence
  Description of Artificial Sequence: Synthetic coding sequence
atggtgcaggggaaagagctgcctctgctgcacagagttgcctttctcgaccacctgtgcaagcaaaagtccgaggtagaggaggaaggcgaggaagaagaagaaggagaggacgaagctagccttgaccctccagagctccttagggtccgttccatgggagttctttcggacagtgaagcgcgttgtggggatatccagaagaccaagaatagctgggcctccaagcatcctgcgtgtaatttaccgcaggacttgcatggtgctagccccttgggcgtcttgtccgacagccagagcatcgtaggggaaatggagcaaaaagaaaattgtgtacctgtttttccagggagaggcagtagcccgagttccaattctgtgtctaagtcgcacgtctccgagccaatcgccgatcagtccaattacaagcctgacggggaagcagtggagcaaaggaagaaccattgggcgaccgagctgccagccccaagttccctttctacacctctcccagagccacacatagacctggagctcgtttggcggaacgttcagcagagagaagtgccacagggcccatctccgttggccgttgacccactccatcctgtaccccagccaccaaccctggcggaagccgttaaaattgagcggacccatcccggactcccaaagggagtcacatgtccgggtgtgaaagcggaggccccactcagtcagaggtggaccgtgcctgagctcttgactcatcctggcatacacgcctggcagtggtcgcgcgagctgaaactgagactgaaaaagttaaggcagtcccccgcatcccgagctcccggaccttctcaatcattttgctccagtcctatcttgagctcaaccatacccgacttctgggggctgccgagttgtccacctcagcagatctacccgccaaacccttgtccccactcatccagttgtcatccgcaggaggttcagcgcacagtcccacagcctgtgcaatcatcacactgtcaccatttccagtcctcttcacaactgcagcctcaggaaagcggcagagcagagcaaggctcgcagagaggagagaagatgaagggtaagatggtgtcacaagtgccttctcagggaccctgcgtccatatggaagcaggggttgattatttgtcacccggtccaggggagcccagtaattcaaaagtccttgtgtccggcaaaaggaaggataaggcttccgcttcaagcagtgctaagaagagggaacatcccaggaagcccaaggccggtgaccacagaagaggcaccgcaaggctgggcctatccacagtaacaggaaagaaccaccctgcacaagcacgctctctggttgaggcgccagtgagtacattccctcagagatcacagcaccggggacaatcctcccaacacacagctctcccccaactgcttctgccaaaagcttccggccctcaagaccagccagaggcaggacgtcgggcatcagacatcttgacccccagacactgtaagcactgcccctgggcacatatggagaagtatttgagctttccaacattgaaggccagcctcactcggggactgcagaaggtgcttgcgaagtgcctagataatcatcgcccacttccaaccaaatctagtcaatag

SEQ ID NO: 54728 - DNA, 573 bp, Artificial Sequence
  Description of Artificial Sequence: Synthetic coding sequence
atggccctgcgaggccatccagaacctcagcctacgaacacccctctcagtgctactgtcggcggtccaattagcctattcacacaaccacgttgtcactctgccgctcgggacctggtgtggtctcaggcatggccagatccagatgtgctggaaatctccatgcagacccctggtggctcaagctgtcgcaaggaggccgtcctgccacggttgcgggttacaagacctcttgtgcccgagcctgcaatcctgccggtgtgcgctgccaggttggctgggtctctggcaacagatttgtcgcgctcccactcactgctgcccccatgggtggatctgaaggaacccccacctcccagtgcgcctagtctgctgctggaggacccagggcaggggggttgccacggtgcacagtcttgcgtcggtacgtgcgagttagcaaatggtgcccgaggtttttgtccggagatggggcagaatgaatcattgagcgaggagcgcaaggggcatgaatccaagcgtaagagcgggggtagggggtctccaagcagccaccctactcaggcctcatag

SEQ ID NO: 54729 - DNA, 693 bp, Artificial Sequence
  Description of Artificial Sequence: Synthetic coding sequence
atgctcggcactcagtggacccttgccagatgccttctcccgtcccacccagacccgggtcttgccggttctctcaggggggacagttccgaagacgggagacgcggacaactcctcccacaaagccccgcaccctgcagtcctgtgtggagccccggtacacccgtgggcggtccccatcccgcaggggacggccctgccaccgcaccgggaccacctgagggtcccgagctcgcttttccacaggacctgagcccagcctggcctcagaagggggctggcactcaccctgccaatgccggacctggacctttaagtcgcaggagctctcagctgcggacccccctggaggccggacggaaatggggctggaagatgactcggtggcggctccgccgagaccaagcccctggagagggcacgcaagcaaaacttctgggggaagctctgtccacagctggcagggggcacgccggaccgccagagggatgggccggtgagggaggggtctcccccggactgaccccacttctgggcacaggccagggcaaagaactggatctggacctgcgggaaaagtttattcggtttgatcagatccttggaatcagcctggaccatattccctttctgccccaaaccggacctggccgtccatggggatgtggtgtcgggaagcagagaccccactag

SEQ ID NO: 54730 - DNA, 615 bp, Artificial Sequence
  Description of Artificial Sequence: Synthetic coding sequence
atggacccgctatcccctcctctgtgtacactcccacccggaccagagccgcctcggtttgtgtgctactgcgaaggcgaggagtctggcgagggagatcggggtggcttcaacctgtatgtcactgacgcagccgaactgtggagtacgtgctttacgccagactctttagccgcactgaaagcaagattcggcctgagcgcagctgaagacatcacaccgaggttccgggcagcttgtgagcagcaagcggtggccctcaccctccaggaagatcgagcgagcctaactttgagtggtggccctagcgccctggcattcgatctctcaaaagtgcccggaccagaagcagctcccaggctcagggccttaaccctaggtctggccaagagggtctggtccctggaaagaagactggccgctgccgaagaaacagccgtcagtccacggaagtccccaagacctgcagggccacagttgtttttgcccgacccagacccccaaagaggcggtccgggacctggggtcaggagaaggtgtccaggagagtccctgattaaccccggattcaagtctaagaagccagcgggtggggtcgacttcgatgagacatag

SEQ ID NO: 54731 - DNA, 177 bp, Artificial Sequence
  Description of Artificial Sequence: Synthetic coding sequence
atgcccaatagacataaaactaaggaccaaaccctgctccccgcacagcaatatatctggttacttaacagccacacccagatgactgcacccgtgccgcaattcaaattgagcgagacagctagtcttctgtgtaaaaggaaaatcagtactgccatgagctcgacatgcctgtag

SEQ ID NO: 54732 - DNA, 459 bp, Artificial Sequence
  Description of Artificial Sequence: Synthetic coding sequence
tgaggacgtcccccacacaaaggtgcccctcgattagggagaggggtaggtgcgctggtgcctgccccacgcgcagggagtcatcctccagccggagtatgcgcatccgttcacaggaatgccgttggagctgggggtcccgctcgcgctgggcagcctggtttggacgggaccggccgacggggagccagagccggaggcgaacgtcctgagggacgtgctccgaaagtgtggaatcccccatccccactctggagcgaagaagtgtattcaacggccccttactacacaagctgggcacgtggccctaggtgcccaccagagctgtgtgctcctcctctaaaacgaaaggaacagacggagccaactccatccgtgagacatcccactatgatgcgctatctagtagagcagacgaactcggccaccgagaacgatgagagctgccttaagaaatag

SEQ ID NO: 54733 - DNA, 687 bp, Artificial Sequence
  Description of Artificial Sequence: Synthetic coding sequence
atggaggactcgccgctgcctgacctccgcgatatcgaattgaaactgggacggaaagtgcccgaatcgcttgtgcggtcactgagaggggaggaaccagtcccccgagagcgcgatagggatccctgcggcggaagcggcggaggaggcggtgggggtggcggatgctcaagcagttcttcttattgcagtttccctcccagcctctcaagcagctcctcttcttcacctacatcaggtagtccacgtggtagtcactcttcggctctagaacggctagaaacaaagctgcatctgctgcgtcaagagatggtgaacctgcgcgcaacagacgtacgccttatgcggcaactcttggtgatcaacgagtccatagaatccattaagtggatgatagaggaaaaagcaacgatcacatccagagggtccagcctgtctggctccttgtgctctctgcttgagtcccagagcacgtctctcaggggatcatacaattctttgcacgatggttccgacgggctggatggcatatctgtgggttcttacttagacacgctagccgacgatgtccctggccatcagactccatccgacttagaccagtttagcgactcctccttgatagaagatagccaggctctgcacaagcgaccaaaactggattccgagtactactgttttgggtag

SEQ ID NO: 54734 - DNA, 720 bp, Artificial Sequence
  Description of Artificial Sequence: Synthetic coding sequence
atggaagggctgccctgcccttgccctgcgctaccccacttctggcagctcaggagccatcttatggccgaggggagccgcactcaggcccctggcaagggccctccgctcagcattcagttcttgcgcgctcagtacgagggactcaaaagacagcagaggacccaggcccatttattggtcctgcccaaagggggtaacaccccggctccagccgagtccatggtcaacgcagtgtggattaataaagagaggcggtcatccctgagtttggaagaagcagatagtgaggtggaaggaagactagaggaggcagcacagggttgcctccaggccccaaaatcaccttggcatacacacctcgaaatgcattgtttggtccagacctctccccaggatacctcccatcaggtgcatcacagagggaagcttgtcggttctgaccagaggctccctcccgagggggatactcatctgtttgaaactaatcagatgacacagcaaggcactggcatcccagaggccgcacagcttccatgtcaggtcggtaacacgcaaacgaaagccgtagaatctggtctgaaattttctactcagtgtcccctttcgataaaaaatccccataggtccggcaaacctgcttactatccattccctcagcggaagacaccacgaattagccaggccgcacggaatctgggactttacgggagcgcatag

SEQ ID NO: 54735 - DNA, 288 bp, Artificial Sequence
  Description of Artificial Sequence: Synthetic coding sequence
atgtttttaacaggagatacatctccggcagaagacaatcgcgaagccacgctcccacagtgcagcctaccagagctttatgcctgcatcgagaatttcaacaaagagtccaaaaagtcgaacctcttaaaaatgcacggcattagtctcaacgaagcccaggaggtcctggcgaggaatctcaatgtcatgtctttcacaagaggagccgacgttcggggtgatttacaacccgtgatcagaaagacgatccacgaatctaaaggctccggcatggaaattttctag

SEQ ID NO: 54736 - DNA, 306 bp, Artificial Sequence
  Description of Artificial Sequence: Synthetic coding sequence
atgtttctcaccggcgacacctcccctgccgaagataatcgggaggctacactcccacagtgtagcctgccggaactgtacgcttgtatagagaactttaataaagagtcaaaaaagtccaatctccttaagatgcacggaatatcgctcaatgaggcccaagaggtgctggcacggaacctgaatgtaatgagctttaccaggggcgctgacgtccgtggggacctgcagccagtgatcagcgtgaataaaatgaataagccaggaaaacatcgcaagactccttctccgaagataaacaaatag

SEQ ID NO: 54737 - DNA, 558 bp, Artificial Sequence
  Description of Artificial Sequence: Synthetic coding sequence
atgtcctggagtcagcctgtgctgcggggattacccgcttcgcgcgacgaggactctaagcaggtcactaccctgccctggggtaagcgatcgtcacgcggtggtgctatttaccttagtggcatagatatgattcatgggacgcctgtgctcgacattaaaccatatatcgctgaatatgactcaccacagaatgtgatggagcccctagctgactttaatctgcagaataatcagcatactcccaataccgttagccagtcagattcgaagactgatagctgcgatcagaggcagctgtccggctgtgacgagccgcagccacaccactcaactaagagaaaaccaaagtgtcctgaggaccgaacatctgaggagaattacctcacccactctgacacagcgcgaatccagcaagccttccccatgcacagagagattgcagtggattttggtctggaaagccgcagagaccagtcctcaagcgtggccgaggagcagatcggtccctactgtcccgagaagtcattttccgagaaaggcactgatagatcatag

SEQ ID NO: 54738 - DNA, 480 bp, Artificial Sequence
  Description of Artificial Sequence: Synthetic coding sequence
cgagggctggaagaatctggacctagaccaacagccacgccatgtgggtgcgtgaagccagctctggagacgggcaacctcttgaccgagcccgtaggttatctggaaagctgtttttcagctaagaatggtacaccgagacagccctccatttgctcctacagcagagcctgtttgcgtatacgaaagcgcatcttcaacaatcctgagcactctctcatgggcctggagcagttctctcatgtgtggatcctgtttgtgttccacaaaaatggacatctctcatgcaaagccaaagtgcagccccctaggctcaatggcgcaaagacaggcgttttcagcacccgaagcccacacaggcctaacgccatcggtcttactcttgcgaagctggagaaagtggaagccctcggcaagtggaccgatataatggccgctgttctgatgagcaccgtgctgtgtggaagatctctgggttag

SEQ ID NO: 54739 - DNA, 888 bp, Artificial Sequence
  Description of Artificial Sequence: Synthetic coding sequence
atgattcacggcactcccgtcttggacatcaaaccatacattgcagagtacgacagcccacagaatgtcatggagccactggcagacttcaacctccaaaataatcaacacacccccaatactgttagtcagagcgacagtaagactgattcctgtgatcagcgacagctgtctggctgcgatgaaccgcagcctcaccatagcactaagcgcaagcctaaatgccctgaagatcggacttcagaggagaattatctaacccattctgatactgctaggatccagcaggcgtttcccatgcatcgagaaattgctgtggacttcgggcttgagagccgacgggatcaatccagctccgtggcggaggagcagatcgggccttattgcccggaaaagtcattcagcgagaagggaaccgataagaagctggaacgggtggaaggagccgctgtgctgcaaggctcacgggctgaaactcagcccatggccccacactgtcccgcagggagggcagatggggcaccacgaagcgtggttcccgcatgggtcactgaggcgccagtggccacgcttgaggtgagattcacgcctcacgccgagatggacctcggccagctcagcagccaggatgtcggacaagccagtttcaaatactttcagagtgccgaggaggctaagagagccattgaggccgtgctcagcgcggatccacgttctgtgtatcggaggaagctctgtcaggatcgcttgttttatttcacagtagatatagctcacgtgacctgctggtttggtgatggtttcgcagaggtgctgcggattaagcctgcctctgagcctgtgcatatgactggacctgttggctctctggtctcactgggttcgtag

SEQ ID NO: 54740 - DNA, 1326 bp, Artificial Sequence
  Description of Artificial Sequence: Synthetic coding sequence
atgcgtgggttggaagagtctggccctcggccaacagctaccccgtgtggttgcgtgaaaccagccctggagactggcaatcttttaacagaaccagttggatacctcgagagctgtttctcggctaagaacgggacaccgagacagccgtcaatttgttcctattctagagcctgtctgaggattcgcaagcgcatatttaacaatcctgagcactccttgatgggccttgaacagttctcccatgtctggattctctttgttttccacaagaacggacaccttagctgtaaggctaaggttcaacccccaaggcttaacggagccaaaactggggtcttttcaactagatcaccacacagaccaaacgccataggccttaccttggctaaactggaaaaagtggagggcggtgcaatatacctctctggaatcgatatgatccatggaacccctgtactcgacattaaaccttacattgctgagtatgacagcccccagaacgtgatggaaccactcgctgacttcaacctgcagaacaaccagcacacaccaaacacagtgtcccagtccgactccaagaccgatagttgtgaccaaaggcagctaagcggttgcgacgagccccagccccaccattctaccaagcgaaaaccgaaatgtccagaagacaggactagcgaggagaattatctgacacactccgatactgcacggatccaacaggcttttccaatgcaccgggagatagctgtcgactttgggctggagtcccgcagagatcaatcatccagtgtggccgaggagcagattgggccatattgccctgaaaaaagtttctccgaaaagggaacggataaaaagcttgagcgcgtggagggggcagctgtgctgcagggtagtcgcgctgagacccaacctatggcacctcattgtccggctggtagagccgacggggctcctcgcagcgtagtgcccgcttgggttactgaagcacctgtggcaaccctagaggtgcgcttcacaccgcacgccgaaatggacctgggccaactctcctcccaggacgtgggccaggccagctttaagtacttccagagcgcggaggaggcaaagagagccatcgaagccgtgctgtctgcggacccacggtccgtttaccgacgtaagctgtgccaagaccgactgttttactttacggtcgatatcgcccacgtgacatgttggtttggggacggctttgctgaggtgctgcgcattaaaccagcatcagagcctgtacacatgacaggccctgtcggcagcctggtgagcctgggctcctag

SEQ ID NO: 54741 - DNA, 519 bp, Artificial Sequence
  Description of Artificial Sequence: Synthetic coding sequence
ggcctcgaagaaagcggcccaagaccaaccgccactccttgtggctgtgtcaaaccggctctcgagacaggtaacctgcttactgagcctgtcgggtacctggagtcgtgtttctcagccaaaaatggcactcccagacagccatccatctgtagttacagccgagcctgtttaagaattagaaagagaatttttaacaacccagaacacagcctaatgggactggagcagttctcgcatgtgtggatcttgttcgtttttcacaagaacggccacctttcttgcaaagccaaggtgcagcccccaagactgaacggagctaagaccggcgtgtttagcacacggagtccccataggcctaacgctatagggctcaccctcgccaagctggagaaagttgaagggaacccttttcatttctatttttatctgtttcctcatcctaagaagccatacaagatcaattccatccatcactggctgttcattcagacatccacaaatgatgtcaatagttag

SEQ ID NO: 54742 - DNA, 252 bp, Artificial Sequence
  Description of Artificial Sequence: Synthetic coding sequence
atgtcgggaccgaatggcgaccttggaatgccggtggaagcaggcgcagaaggtgaggaagatggattcggcgaggcagaatacgccgctattaattcaatgcttgatcagatcaattcatgcttagatcaccttgaagagaagaacgatcacctccacgcacgcctgcaagagctactggaatcaaaccgacagacccggctggaattccaacaacaattaggtgaagctccttctgacgcttctccttag

SEQ ID NO: 54743 - DNA, 612 bp, Artificial Sequence
  Description of Artificial Sequence: Synthetic coding sequence
atgcccggacctctgacctgtacccccgcttggcaggggcaaggcagggccgcagcctttctgtgttgtagttttcagcgcgcaggagctgtcgtcggcgtcccggctagatggcaccgaggtagactgagcagccagcagcgcctgcgatcttctctggggggtagccatccatgccctcagttgggcagaaggctcgttcgagagggggtcatcagcgtgccaagacagcaagggaggagacgatgtcgtgagtccttttcgcccgctgacgtggccccagggcctatctgcagtgccaatatctgcctgtccggtgtgagatttctcacatgtctaaacagagttcgcgagcatgtcgtgggcccatcaccctctcctgcggcacctatttgcttttttcctgtagttgaggcattgtgcactcttcgcggtcggcgttgccactgccttcccttcccaaaaaggggcatgcagagatggatgctaccattgcggagaggcgctagactgctcccactcgctagcagtaaaaaccccagagctcgtagcccaggcctggaccccctgggctctagcgagaccctatggagccacaggggcggtcactag

SEQ ID NO: 54744 - DNA, 435 bp, Artificial Sequence
  Description of Artificial Sequence: Synthetic coding sequence
atggacccacaggaaatggtcgtgaaaaacccttacgcgcacatctccataccacgcgctcatctgcgtccggacctcggacaacaactggaggtggcgagtacatgcagctccagcagcgaaatgcagccgctgccagtaggaccctgtgccccagaacctacccatctgctgcagcctaccgaggtgcctggtccaaagggcgcaaagggaaatcaaggggcagccccaattcagaatcagcaggcctggcagcagcctggtaatccgtacagtagcagccagcgccaggctggtctgacatacgctggccctcctcccgcaggaaggggcgatgacattgcccatcactgctgttgctgcccatgctgtcactgctgccactgcccacctttctgccggtgccactcttgttgctgctgtgttatttcttag

SEQ ID NO: 54745 - DNA, 366 bp, Artificial Sequence
  Description of Artificial Sequence: Synthetic coding sequence
atgtggtccagacgcggtctcggtgtgtcccgcgcaccgctgcaccttcttttaggtgtgtggggccctagcggacgcactggcggacagagaaagggggcttcattggccaggcccggacgcggtgggctcgcttcctgtagtgtcggagcaaacgggaaacgcgatgtcctcttcctgagaaagactctgactaataccgtggaggatatacaaatcgataactttcgacgcaagtccgatttgggggtgggtagccccgactggaaaaatcttttgatcgacgtgacccgtgaggatcacgaaaacagccagaataacagtaaacggaggtgcaaggtaaattgcgaaaccgaccaacggtag

SEQ ID NO: 54746 - DNA, 963 bp, Artificial Sequence
  Description of Artificial Sequence: Synthetic coding sequence
atgcctgaggccagatcttccggccctgatctaactaggtggaggaagcaacagcaacccgtgagaaggacagtgtcccaagtctgcccccctccacgtagacctctgacagttgccgatattagaagtggcatggagaacgagaggctcggagtcgtgagggatagtatgtttcagaaccctctaatcgtcaaggccgcaggccctgcaagtgtcggaacaagctacagtgtgtacgattcttccgcggtccagaaagtgattccgtccttggccggtcaccacattaagggaggcccacaggccgagctgggcaaacctcgtgagcgctcgtactccttacctggaatcaactttaattacgggctctacatcagagggctcgacggaggtgtacctgaggcgataggacgctggaatgttttcaagcagcagccaacgtgccctcacgagttgacccgaaattatatcgctatgaaccgcggagccgtgaaagcgggattagtgactgccagagagaatttactgtacaggcagctgaacgatataagaatatccgatcaggacgatcgccgaatgaaaaaggagccgcctccattgccaccaaacatgacgttcgggattcgagcccgtccaagtactccattcttcgacctcctgcagcatcggtacctccagttgtgggtgcaggaacagaaagccactcagaaagctatcaaactggagaagaaacagaaagtagttttagggaaactgtacgaaactcgatccagtcagctgaggaaatataagcccccagtaaagctggacaccctgtggcatatgccccatttccagaaggtgggccgacatctagacacattcccgacagaagctgataggcagagggctttaaaggcacatcgagaagagtgcgctgttaggcagggtactctccggatgggtaactacacacatccttag

SEQ ID NO: 54747 - DNA, 855 bp, Artificial Sequence
  Description of Artificial Sequence: Synthetic coding sequence
atgcccgaggctcgcagtagtggtccagatctgaccagatggcggaaacagcaacagccggtgcggagaacagtttcacaagtttgccccccaccacgtcgacccctcacggtcgctgatattcggtccggcatggaaaatgaacgtctgggagtcgttcgggactcaatgttccagaatcctctaatcgttaaagccgagcttggaaaaccgcgagagcgcagttactccctgccagggatcaattttaactatggcctttacatccgaggcttggatggcggtgtaccagaggctatagggagatggaatgtgttcaaacaacagcccacttgtccccacgaacttacaaggaattatatcgccatgaacaggggggctgtgaaagcaggcctggtcacagccagggagaacctactgtacaggcaactgaatgacattaggatcagcgaccaagatgacagaagaatgaaaaaagaacctcctccgctgccacccaacatgaccttcgggattagagcacgcccttctacacctttcttcgatcttcttcagcatcgctacctgcaactctgggtccaagagcagaaagctacccagaaagctattaaactggaaaagaagcaaaaagtggtccttggcaaattgtatgaaactaggtcttcccagctgcgtaagtataagccaccagtgaaactggacaccctctggcacatgcctcattttcagaaggtcggccgtcaccttgatacatttcctaccgaagccgaccggcaaagggcgctcaaggctcaccgcgaggagtgtgctgtacgacaaggtacgctccgaatgggcaactacacccacccatag

SEQ ID NO: 54748 - DNA, 2931 bp, Artificial Sequence
  Description of Artificial Sequence: Synthetic coding sequence
atgacgcgcaccgacccccctgatttgctggtgtctacagtgtaccaggatattaaggtggccacaccgggaccagcctctaaatgctcaccttgcgagaggagtgtggcacgccctgccgaacccgctcccttcaacaaaagacactgcagatcatttgactttctggaggcgctagatggcccagcaatggagacacttcccgagccgcctcccccagaatcagcagtgccgcgtgcgagaacaagggaagccgagcctcggaggcgcgctcggtccaagtcggcgcctcgagctccacctgggctaacacccgctcccgcttctcccccagtccttcctcggaggggccgtgaagctcagagggccgctcgcgctgaagccagtccccgaagagaacctgcctacccagccctgagggcccttgcaaatgagctacatccaatcaagttgcaaccacagagggggggtcctggcagggtggctcccctgtgcgccgcagccggtagatgcgctccccctgagccacccgctggtcctgcccctcacgttcgatgtcgattggatatcaagcctgacgatgccgtcctgcaacatgccacacggggtagccgttcgtgcggtcccactgaggctgcccactgggctaggcccgctcctcagtttcacggattgactgttcccggtccaagacatatggccttgtcccgaacgcccacaccatcagattcttactgtgccgaccctagggctttttattgcgatggacctcttcccggtccaagagactatgccgaaagaagaagcctgccctttactaccccacccggaccaactcagtttttttacactgaggagccacaggggttccgaggctcgtttgctgcatcacctgggccaacttttgatgcctattacccacggccatatccaagtgaagaattaagtggtccctctcctcggaggatgggtgggtattatgctggcgaggtcagaacttttcccatccaagagcccccatcacgctcttattacggagaagccccaagagcctatggtcttccttatggcccacgctatgtgcctgaggaaccccgtgcacactcgactgcacgtcccttctataccgaagactttggccgatacagggaacgggatgtccttgcgaggacgtacccgcacccccgttcgtcccccgcatgggctgattggggtccaaggccttatcggacacttcaagttgtgcctccctccgatccggatcctttgctagcctcttggcacggcggtactgggactagcccccctcgcctggccacggatagccggcactattcaagatcatgggacaacattttggctccaggcccacggagagaagaccctctcggaagggggcgtagctatgaaaaccttctcggaagggaagtgcgcgagcctaggggagttagccctgaagggagaagacctcccgtcgtggtgaatctgagcactagtcctagacggtacgccgcactgtccctgagcgaaacgagcctgacagaaaaaggcagagccggagaagggctggggcgtaattggtacgtcactcctgagataaccataacagacaacgatctccgtgccactgagcgccctagtgcccgagcgtgggaactgcccggaggcaggacccgccctccaccccacgcagctcctgatggcccaactagcggtagacagagatcccttgagcaattagacgagctaatcaccgatctcgtgatcgactcacgccctaccgctggtcaagcctctgagcctgcagccgattgcctcggaccccagctcagaagattgctcgattcccggccagcaggctccggggctccagcgctggcaccacctagatctccacccgcaagcgcgggttccgctgaggagcccgcagcacctggcgaagccgctgacgcgtcccctgagccctccgccgatgaagatgacctgatgacgtgctctaacgcccgatgccgtaggacagaaaccatgttcaacgcttgtctctactttaagtcctgccacagttgctatacctactattgctcacggctttgtcgcagagaggattgggatgctcacaaggcgagatgcgtctacggaagggtgggctctgtttgtagacacgtcttgcagttttgtcgcgactcaggcccagtgcatagagctttttcaaggattgcacgggtggggttcctgtccaggggcagaggggtgctgttcttggggttcccgagccccggatctgccgacaattttctgcgctttggcctggagggcctcctactgagtcctacctacttgagccttcgtgagctggcgactcacgccgcacctctcggcagctatgcacgcgaactcgctgccgctggtcggctctacgagccggcagaatgtttcctactgagcgttagtgttgctgtggggccagggactgccccacccggtactccagctctgcccgcacccgctcctcgaagtcatggccctacagttaggaaattcgcaaaagtagcccttgctgcgggtagcccagctcggccaccccctgctagaagccgggagccagatatggagacactgattctgactccgcctcccggtaccgcaggtctcgatcaagacggcgaagctggtaggcgggctcgggaggttgcctttatacacatccagagggagctacgcctacgcggagtgtttctgcggcatgagttccccagggtttacgaacagctgtgtgagttcgtcgaggccaaccgccgatttacgcccaccaccatatatcccacagatagacgaaccggccgaccattcatgtgcatgatcatggctgcgtccgagccacgagctctcgattgggtggcgtcggctaatctgctcgatgatatcatgtag

SEQ ID NO: 54749 - DNA, 1161 bp, Artificial Sequence
  Description of Artificial Sequence: Synthetic coding sequence
atgatgaactccgatcagaaggctgtgaaatttttggctaacttctacattaacggaggtaaacactggacacatggccatcttcgccagacgcagcctgaacctacacagccgaaggccagtgtcttgctgctgggtccagaaccaggcatggcttgggatgaaacccagccccctaaaatgaaagaaatccctgtgggattgcgcttacagaccggcactcctcaagaatctctgccgacctacacccaaactctgcgcgagttactgcttgaacaaagaccccttatcactgccgacctcgaagtccctagtcctaccagatatcaggtgccttcccctagtgtaagagagtcgagccctcaccctcactattcaatcgggtgtaagcatcagggcagagagggaggtggtagacgtgcctggcagactttgtggttccaatccgaaagtcccttcactcagaaagcagattttgatcaggaacagaaatggccttctcccgcacactaccaacttctgtcccggccagcctttcccgcttttagctttcgtggatgtcacagcgcttccaaaacgcctgagggccatacacatcttgggttgcccggtgctagaggactgggactgagggtccagccccagtcgctgctgcaagcatctctccaggctcctgggaagaggtgcccaggccctaatacctataacattctccccggaagccgtttgcagtcccctcgcagccctgcattttccatgtctcggtctccagccttcacaagctggctatctacgagtttctcttttgggagcccgaacccgtggcctagtaggctgccgagagggggtcttcagctgactttgccctttggcgcatggcgtggacacccaggctgtacacagacccaggccccaaggcaccggcctctgctccacgccttggaacccgctgggcacaatcttctcggtcctgcgacagagtggaaccacggtctgccacggggttttcccagacctccacttggattgggcgctcccgcatggccatccgaccctctgggcacacccatgcaccctagtggatggcccactctgctgtgggcagttgataaagccggtcctgcatggatcccccacctgcctatatcacctttgcactag

SEQ ID NO: 54750 - DNA, 927 bp, Artificial Sequence
  Description of Artificial Sequence: Synthetic coding sequence
atgatgaactctgaccagaaagctgtaaagtttcttgcgaacttctatataaacgggggaaaacactggactcatgggcatttaagacagacccagcctgaaccgacccaaccaaaagcctccgttctgcttctgggaccagagcccggaatggcatgggatgagacccagccccctaaaatgaaggagattccagttggattgcggctgcaaactggtaccccgcaggagagcctgcccacctacacccagacgctccgcgagttgttgctggaacagcgtccccttatcaccgctgaccttgaagtgccttcccctacacggtaccaggtaccaagtccatccgtgcgagaatcaagcccccatccccactacagtatagggtgcaagcatcaggggcgtgagggtggcggacgacgagcctggcagaccctctggtttcaatctgagagccctttcacccagaaagccgatttcgaccaggaacaaaagtggcccagcccggcacactatcagctcctatcgagacctgccttccccgctttcagcttccgtgggtgccatagcgccagtaagaccccagagggacatacgcatctgggtctgcctggcgctcgtggcttgggcctgcgggtgcagcctcagagcttgctgcaggccagccttcaggctccaggaaaacgctgtcccggacctaacacatataacattctccctgggtctagattacagagtcccaggagcccggctttctccatgagccggagtccagcctttacctcatggctgagtaccagtcgaacccccggacccgctgcctatcatgttgaagattgtaacagtcggtttccatcagcccctggagttgtgatccagggcgtgaggaggccaaagagacatgataccggccctttttgcacattatag

SEQ ID NO: 54751 - DNA, 549 bp, Artificial Sequence
  Description of Artificial Sequence: Synthetic coding sequence
atggccgcaccagcgcctgttacccgccaggtcagcggcgctgcagctctagtcccagctcccagcggaccagactcaggtcaacccttagcggcagccgtagcagaactgccagtgttagatgccagaggtcagcgcgtgccgttcggggctttgttccgggagagacgagctgtggtggtgttcgtccggcacttcttgtgctacatctgtaaggaatacgttgaagacctggctaagattcccaggtcattcctgcaggaggcgaatgtgaccctcatcgttatagggcagagttcgtatcatcatatcgaaccattctgcaaactgaccggctattctcatgaaatatatgtggatcctgaacgtgaaatttacaaaagactgggcatgaagaggggtgaggagattgcttctagtggcaataatatacacttcatccaccgtgaccgcaataggctcgatcacaaaccaattaattcagtcctgcagcttgtcggggtgcaacacgtgaatttcacgaacagacccagcgtaatccacgtgtag

SEQ ID NO: 54752 - DNA, 681 bp, Artificial Sequence
  Description of Artificial Sequence: Synthetic coding sequence
atggcagccccagctccagtaacacgtcaggtgtcaggagcagccgctcttgtacctgcaccctctggccctgacagtggccaacccctggccgctgcagttgcggagctaccagtgctcgacgcacggggtcaaagggtgccgtttggagccctgtttcgagagcggagggcagtggttgtgtttgttcgtcactttctttgctatatatgtaaggagtatgtcgaggaccttgctaagatacccaggagttttctacaggaggctaatgttacgttaatcgtcataggccagtcgagttaccaccatatcgaaccattctgcaaacttacaggctattctcacgagatatacgtcgatccagagagggagatctataaacgtttagggatgaaacggggtgaggagatcgcgagctcaggccaaagcccacacattaaatccaacctcctatcagggtctctacagtcactgtggagagcagtgactggcccactgttcgattttcagggtgaccctgcgcaacaaggcggtacactgattctcgggccagggaataatatacatttcatacacagggataggaatcgcctagaccacaaacccattaactcagtactacagttagtaggcgtgcagcacgtgaacttcaccaaccgtccctccgtcattcatgtatag

SEQ ID NO: 54753 - DNA, 333 bp, Artificial Sequence
  Description of Artificial Sequence: Synthetic coding sequence
tgatacgtcgaggatctagcaaagataccgagaagcttcctccaagaagccaacgtgacactaatcgttatcgggcagagcagctaccaccatatcgagcccttttgcaagttgaccgggtactcccatgagatttatgtagaccctgagagagagatctacaaacggctgggcatgaagaggggcgaggaaatcgcgagttccggcaacaacatccacttcattcatcgcgataggaatcgcttagaccacaagccgatcaactcagttctccagttagttggtgtgcagcacgtcaactttactaatcggcctagtgtgattcatgtgtag

SEQ ID NO: 54754 - DNA, 543 bp, Artificial Sequence
  Description of Artificial Sequence: Synthetic coding sequence
tagggtccacgccctccacgggttatggccgcacctgccccagtcacacggcaacacttcctgtgctacatttgtaaagagtatgttgaggatctcgcaaagattccacggtcctttctccaggaagctaacgtcaccctaatcgtcatcgggcagagttcgtaccaccacatcgaacctttctgtaaattgactggatacagccacgaaatctacgtggaccctgagagggaaatttacaaaaggttgggaatgaagcgaggagaagaaattgcatccagcggacagagcccccacattaagtctaatctgctgagcggttcgctgcagagcctttggcgtgccgtgactgggccactatttgatttccagggggatcccgctcagcaaggagggaccctcatcttaggacccggtaacaacattcactttattcatagagatcggaatcggctggatcataagccgatcaacagtgttctacaactcgtgggcgtccagcacgtgaactttaccaatcggcctagcgtgattcacgtgtag

SEQ ID NO: 54755 - DNA, 492 bp, Artificial Sequence
  Description of Artificial Sequence: Synthetic coding sequence
atggagcattaccggaaggccggatctgtcgaactgccagccccttcccccatgccccagctccccccagacaccctggaaatgagagtccgggacgggagcaagatccgaaacctgttaggcctggcgcttggtagactagagggtggatctgccaggcatgtggtattctcaggatctggacgggctgctggcaaggccgtaagttgtgcggagattgtcaagaggcgcgtgccgggacttcaccagctgacaaagttaaggtttcttcagactgaagacagctgggttcctgcaagcccagacaccggcttggaccctctgaccgtgcggcgacatgtgcctgctgtgtgggttctgctgtcccgagatccacttgaccccaacgagtgcgggtatcaaccacctggcgctcccccaggccttggctcgatgccttcctcttcatgcggaccacgcagcaggaggcgtgctcgtgatacaaggagctag

SEQ ID NO: 54756 - DNA, 492 bp, Artificial Sequence
  Description of Artificial Sequence: Synthetic coding sequence
atggaacactacagaaaggctggatctgttgaattgcccgcacccagtcccatgccccagctcccacctgacacattagagatgagagtgcgcgacggctctaaaatccgaaacctcctgggtctagcgctggggagactggaagggggatcggctcggcacgtagtcttttcaggaagcggcagagccgctggcaaagctgtgagttgcgcagaaatcgtcaaaaggcgggtaccgggactgcatcaactgacaaaactgagattcttacagaccgaggattcatgggtcccagccagtcccgacacaggactggacccacttactgtgagaaggcatgtgcccgcagtgtgggtcctgctgtctcgcgatcccctggaccctaacgagtgcgggtatcagcctcctggcgctccaccgggattgggatctatgccttcaagtagctgcggaccacggagccggcgacgagcccgtgatactaggagttag

SEQ ID NO: 54757 - DNA, 495 bp, Artificial Sequence
  Description of Artificial Sequence: Synthetic coding sequence
atggagaccgccgtcaggggaatgcccctggagtgccccccacggcctgagcggcttaacgcctacgagcgcgaggtgatggtgaatatgctcaactcactcagcagaaaccaacagcttccaagaattacaccgcgatgcggctgtgtggaccctcttccaggaagactgccgttccatggttacgagtcagcctgtagcggtaggcactactgtcttcggggaatggactattatgcaagtggagccccatgcacagatagacggcttagaccatggtgccgtgagcagcctactgtccggtgcgtccctccctatgagcatcggcctgggatgcagtgcgcagtgacaacccccccacctagctattatccctatccgaaccttaggtgggacactagccacttcaaaaaatctggcggaccccagcggaacaactatgtgattcaccctgaattcgtgtctgagacttatcccgattaccgatgctggtag

SEQ ID NO: 54758 - DNA, 336 bp, Artificial Sequence
  Description of Artificial Sequence: Synthetic coding sequence
atggagactgcggtgcgaggcatgcccctggagtgcccacccaggcccgaacgccttaatgcttacgagcgggaggtgatggtgaatatgctaaattcgcttagccgcaatcagcagctgccgcgaatcaccccgagatgtgggtgcgttcctccttatgaacataggcccggaatgcagtgtgcagtcactaccccaccaccttcctactacccttacccaaacctccgctgggatactagtcatttcaaaaaaagtggcggtccacaacggaacaattacgtgatccatccggagttcgtctcggagacctaccctgactaccgatgctggtag

SEQ ID NO: 54759 - DNA, 495 bp, Artificial Sequence
  Description of Artificial Sequence: Synthetic coding sequence
atggaaaccgctgttcggggaatgcctctcgaatgcccaccacgccctgagaggcttaatgcctatgaaagagaagtcatggtgaatatgctgaacagtctcagccggaaccagcagctgcccaggatcactcctcgctgcggctgcgtggaccccttacccggacgcctcccctttcatggatatgagtcggcctgtagtggtaggcattactgcctccggggaatggactactatgcttccggagccccttgtaccgaccgacggctgcggccttggtgtagagaacaacctaccgtgcgttgcgtgccaccatacgaacaccgtccgggaatgcagtgcgctgtaaccacgcctccaccttcttactatccgtatcccaatctccgctgggacacctcacattttaaaaaatccggaggacctcagcgcaacaattacgtgatccaccctgagtttgtgtcagaaacctaccccgattatcgatgctggtag

SEQ ID NO: 54760 - DNA, 384 bp, Artificial Sequence
  Description of Artificial Sequence: Synthetic coding sequence
atggagacagccgttagaggcatgccactcgagtgcccgccaaggccagaaagactgaatgcctacgagcgagaggtgatggttaatatgttgaatagtctcagccgcaatcaacagcttccccgtataacccccaggtgcggctgcgtcgatccgctcccgggtcggctgccgttccacgggtacgaaagtgcttgttctggtcggcactactgtttgcgagggatggactattatgccagcggggctccatgcactgatcgtcggctgaggccgtggtgtcgtgagcagcccacaatgtgcacttcactaagagcccctgccagaaacgccgtatgctgctataattcacccgctgttattctcccaatctcggagccttag

SEQ ID NO: 54761 - DNA, 381 bp, Artificial Sequence
  Description of Artificial Sequence: Synthetic coding sequence
tgagcctgggaggcaaacaagtttctaacgccaggactgactcacacgatggagcgacatgtcgaccccgaggcattacaaaagatggccaaatgtgcagtgcaagattatacatatagggggtcaatctcagggcatccatatttgcccgagaagtactggcttagtcaggaagaagctgataaatgtagtccaaactaccttggatccgattggtataatacatggcgtatggagccgtataactcttcctgttgcaacaaatacactacctatctcccgagactgcctaaggtcagcgtggccccatctacagatgtatgggggctcggccacgcttatcctacgacgtcccaaactacggtcacggacatttcgtag

SEQ ID NO: 54762 - DNA, 507 bp, Artificial Sequence
  Description of Artificial Sequence: Synthetic coding sequence
atgatggaggaaatcgaccgtttccaagtcccaaccgctcattcagaaatgcagcccctggacccggctgctgccagcatcagtgacggtgattgtgatgccagagaagaaaagcaacgagagctcgcacggaaaggcagtctgaagaatggcagtatgggctcgccagtaaatcagcagccgaagaaaaataatgtcatggcacgcacgcgactggtagtcccaaataaaggctatagctccctcgatcagtcaccggacgaaaagcctctcgttgccttggatacagattccgacgacgatttcgatatgagcaggtatagtagtagtggatattctagcgctgagcagattaaccaggacctgaacattcagctcctgaaagatggctaccgcctggatgaaattcccgatgacgaggatcttgacctgatccctcccaagtcagttaaccctacctgcatgtgctgccaggctaccagcagcactgcctgccatatacagtag

SEQ ID NO: 54763 - DNA, 471 bp, Artificial Sequence
  Description of Artificial Sequence: Synthetic coding sequence
atggaagagatcgacagattccaggtgcccaccgcccattcagaaatgcagcctttagatccagctgctgcttccattagcgatggtgactgcgatgcaagagaaggggagtctgtggccatgaactacaaaccaagcccacttcaggttaaactcgagaagcagagggaactcgcgagaaaggggagtctaaagaacgggtccatgggaagcccagttaatcagcaaccaaaaaagaacaatgtgatggcgcgtacgcgcttggtggttccaaataaagggtatagtagcctcgaccagagtcctgacgagaaaccacttgttgctttggacaccgatcgctgtgtctggggattgggagggagctgggcggcacagaggaatctatacagtacttcgggattgtaccgacctcatctcctatactgtcagaattgggacatcctgcaacccgaatcactgcaggggtag

SEQ ID NO: 54764 - DNA, 519 bp, Artificial Sequence
  Description of Artificial Sequence: Synthetic coding sequence
atggaggagatcgacaggttccaagatcctgcagccgcaagtatttccgatggcgattgtgacgcacgcgagggagagtctgttgcgatgaactataagccgtcaccattgcaagtcaagttggaaaaacagcgggagctggccagaaaagggagcctcaagaacggaagtatggggagcccagtaaatcaacagcctaaaaaaaataatgtgatggctcggacgaggcttgtggtccctaacaaaggatatagtagtttggaccaaagccctgacgaaaaacctttagtggctctagacaccgattctgatgatgattttgatatgtcaagatactcgagctctggctattcttccgctgagatcaaccaggatctgaatatacagctgttgaaagacgggtacaggctcgacgagatcccggacgacgaagatcttgatcttataccacccaaatcggtaaatcccacatgcatgtgttgtcaagctacttcgagtacagcttgtcatattcaatag

SEQ ID NO: 54765 - DNA, 471 bp, Artificial Sequence
  Description of Artificial Sequence: Synthetic coding sequence
atggaagagattgaccgctttcaggatcctgctgcggcttctatttcagacggggattgtgacgccagggaagagaagcaacgcgaacttgctagaaaaggaagcctgaagaacgggagcatgggatcgccagtgaaccaacagcccaagaagaataatgttatggctagaaccagactggtggtccctaataaaggctacagcagcctggaccagtcgcccgacgagaagcccctggtagctcttgacacggatagcgacgatgacttcgatatgagccggtactcaagctctggatacagctcggccgagcagatcaaccaagacctcaacatccagctgttgaaggatggctatcgtctcgatgagatccctgacgacgaggaccttgatttaatacccccaaagagcgtgaacccgacctgtatgtgctgtcaggcaactagcagcactgcctgccacatccaatag

SEQ ID NO: 54766 - DNA, 495 bp, Artificial Sequence
  Description of Artificial Sequence: Synthetic coding sequence
atggaggaaattgaccgctttcaagtgcctaccgcacacagcgaaatgcaacctttggatcctgcagcagcctccattagtgacggggactgcgatgccagagaagaaaagcagagggagttggctcggaagggaagcctgaaaaatgggtctatgggcagccctgtcaaccagcaaccaaaaaagaataatgtgatggcacggactcgactggtcgtgcccaataagggatactcatctctggaccagagccccgatgagaaacctttggtggccctggataccgacagcgacgacgatttcgacatgagccgctactcctcctctgggtattcgtctgccgagcaaatcaaccaggacttgaatatccagctcctcaaggatggctaccgccttgatgagattcccgatgacgaggatctggacctgatccccccaaatcaggtgtcaccttgcagcttgatttactttcaggagggagtgtggaaaacctag

SEQ ID NO: 54767 - DNA, 501 bp, Artificial Sequence
  Description of Artificial Sequence: Synthetic coding sequence
atggaggagattgaccggtttcaggtcccaacagcacactccgagatgcagcctctggacccggcagccgctagtatttccgacggcgattgcgacgcacgcgaagaaaagcagcgagagcttgccaggaagggtagtctgaaaaatgggtccatgggttcaccagtgaatcagcaaccaaaaaagaataacgtgatggcaagaaccagactcgtggtcccgaataaaggatacagctccttggatcaatcgcctgatgagaaaccactcgtcgcactagacacagacagcgacgacgactttgacatgtcacgatactcttccagcgggtactcttctgctgaaatcaatcaagacctgaacatacaacttctaaaagacggatatcgtcttgatgagatcccagatgatgaagatctggacctgatccccccaaaatcagtgaatcctacatgcatgtgctgccaagcaacgagtagtaccgcttgccatatccaatag

SEQ ID NO: 54768 - DNA, 552 bp, Artificial Sequence
  Description of Artificial Sequence: Synthetic coding sequence
atggaagaaatagacaggtttcaggtccctacggcccactctgagatgcagcctctagatcccgcagcagcatctatttctgacggagactgtgatgccagggagggagagtccgtggcaatgaactacaaaccatcgcccctccaggtgaagctggagaaacagcgagaactggcacggaaggggtcccttaaaaatggatcaatgggttctccggttaaccagcagcctaagaagaacaatgtaatggccaggacccggctcgtcgtacctaacaagggctatagcagtcttgaccaatccccagatgagaaaccccttgtggctctggacacagactccgacgatgatttcgatatgagccggtattcctcatccggatacagctcagccgagataaatcaggatctgaatattcagctgcttaaagatggttacagactcgatgaaatacctgatgacgaagatctggatttgatccctcccaagagcgtgaatcccacatgcatgtgttgtcaggcaacatcaagcactgcttgccacattcagtag

SEQ ID NO: 54769 - DNA, 510 bp, Artificial Sequence
  Description of Artificial Sequence: Synthetic coding sequence
atggaagagatcgatcggttccaggtgcctaccgcacacagcgagatgcagcctctggacccagccgcagcatcaatatctgacggagattgcgatgctcgtgaaggcgagtcagttgccatgaactataagccctccccgctccaggtgaagctggagaagcagcgtgagttggctagaaaaggcagcctgaaaaatggctctatgggatctccggttaaccagcagccaaaaaagaacaatgtcatggcacggaccaggctggtggtgcccaacaagggttatagcagcctggatcagagcccagacgaaaaacccctcgtggcactggacacagattcagatgatgatttcgacatgagtcgttacagttcttcgggctatagttcagcggaacagatcaatcaagatttgaatatccaactcctcaaggatggctaccgcttggacgaaatccccgacgatgaagatctggacctcattccaccaaaatcagttaacccaacctag

SEQ ID NO: 54770 - DNA, 558 bp, Artificial Sequence
  Description of Artificial Sequence: Synthetic coding sequence
atgatggaggagatcgatcgttttcaggtgccaacggcccacagtgagatgcagcctctcgaccctgccgctgcttctatttcagacggtgattgtgacgcacgagaaggagaatccgtagcaatgaactacaaaccctctccccttcaagtcaaactagagaagcagcgtgaattggctcggaaaggcagtctgaaaaacgggtccatgggctcgccggtgaaccagcagccaaaaaaaaacaatgttatggctagaacccggctggtcgttcctaataaaggatatagttctctggatcagtcccctgatgagaaacccctcgtcgccctggacaccgatagcgatgacgattttgacatgtcccgttactcaagctcagggtactcatctgctgagcagatcaatcaggatcttaacatccaacttctgaaggatggctatcggctggacgaaataccggatgacgaggacctcgatctgatccctcctaagagtgtgaatcccacctgcatgtgctgtcaggccaccagcagcaccgcttgtcatattcagtag

SEQ ID NO: 54771 - DNA, 153 bp, Artificial Sequence
  Description of Artificial Sequence: Synthetic coding sequence
atgaagctgttgtctgagcaacaggaattaagaaccgtgtccatgacggcatggaagccacgcatgaaccgcaagtccaggagcagaatgtctcccattgaccctcgacactcgggtacaccgaattctaaccgaattggtctgtctacatag

SEQ ID NO: 54772 - DNA, 153 bp, Artificial Sequence
  Description of Artificial Sequence: Synthetic coding sequence
atgaaactcctcagcgaacagcaagagctcaggacagtgtccatgaccgcttggaagcctaggatgaatcgaaagtctcgctcgcggatgagtcctatagacccccgacactccggcacgccaaatagtaatcggatcgggttgtccacatag

SEQ ID NO: 54773 - DNA, 360 bp, Artificial Sequence
  Description of Artificial Sequence: Synthetic coding sequence
atgaataggaatattctcgaagaaatgttgcaatacctgttgatcgactggattgtgggagatcagtttgaaatccagctcaaccagcagctctggtcccttattcccaacaacgacgtcaggaggctcgtgtcacatgtcatccgaaccttaaagacagattgtactgaaacacacttgcagttagcatgcgcgaagttgatcagtcgtaccggcctgctcatgaagctattgagcgagcagcaggaacttcgtaccgtttctatgacggcctggaaacctagaatgaataggaaatcccggtctagaatgagcatccccagtgggccagatatggaagaaaccaccgacgtgagctag

SEQ ID NO: 54774 - DNA, 297 bp, Artificial Sequence
  Description of Artificial Sequence: Synthetic coding sequence
atgttgcaatacctgctgattgattggatagtgggcgatcagtttgagatccagttgaaccagcaactttggagcctcattccgaataatgatgtgcgcagattggtgtcccatgtgattaggactctcaagacggactgcaccgaaacccacctccaattggcatgtgcgaagttgatcagccggacgggattgctaatgaaactgctgagcgagcagcaagagctgcgaacagtatcgatgaccgcctggaagcccaggatgaacagaaaatcgcgttcacgaatgcgatcgtag

SEQ ID NO: 54775 - DNA, 2163 bp, Artificial Sequence
  Description of Artificial Sequence: Synthetic coding sequence
atggacatacagctggatccagctagagacgatcttcctctgatggccaatacatcccatatcctggttaaacactatgtcctcgacctcgacgtagatttcgaatctcaggtgatcgaaggtaccatcgtgttgttcctggaggacggaaaccgattcaaaaaacagaacagtagcattgaggaagcctgccagagcgaatctaataaagcatgcaaattcggaatgcctgaaccttgtcatatacccgttacaaacgcacggaccttctcaagcgaaatggagtacaatgattttgccatttgcagtaaaggggaaaaggatacctccgacaaagatggcaaccatgataaccaggagcacgcttccggaatttcatcttccaagtattgttgtgacactggaaaccacggctccgaggactttctcctagtgctggactgttgtgatttatcagtactgaaagtggaagaggtggatgtggcggctgttcccggacttgaaaagtttacgcgatcccctgaactcaccgtcgtgagcgaggaattccgcaaccagatcgtccgagagcttgtaacactgcctgctaataggtggcgggagcaattagactactacgccagatgttctcaggcaccagggtgtggagagttactctttgatactgacacctggtccctccaaattaggaagacaggggctcagacggctaccgatttccctcatgctatccggatctggtataaaactaagcccgagggccgatctgtgacctggaccagtgatcagtcaggacgcccttgtgtgtatacagtgggatcgccaattaacaatcgggctctgttcccctgccaagaaccaccagtggcgatgagcacttggcaggcaaccgtgagggcagctgccagtttcgtagtgttgatgagtggcgaaaactctgccaaacccacacagctttgggaggagtgttcatcatggtactattatgtgaccatgccgatgccagcctctacgtttaccatcgcggtgggctgttggaccgagatgaagatggagacctggtcttctaacgacctggccactgagcggccattctcgcctagtgaagctaattttcggcacgtaggcgtctgctcccatatggaatatccatgtagatttcaaaacgccagcgctactacacaagagatcatcccccacagagtgttcgctcccgtgtgtcttaccggcgcatgtcaggagactcttcttcgactcattccaccttgcctgtccgcggctcacagcgtgctaggtgcccatcccttttctaggttggacgtattgatcgtgcctgcaaactttcccagcctgggtatggcccgtccttctaaggacaagacaggccatactagcgattcaggcgcttctgtgatcaaacacgggttgaatcctgaaaagatctttatgcaggtccactatctgaagggctattttctattgagattcctggcaaaacggctcggggatgaaacttacttttcattcctgcgcaagtttgtgcacaccttccatggacaactgatattatctcaggactttctgcagatgctgctggaaaacatcccagaagagaagcgattggagctgtcagttgaaaacatatatcaggactggttggagtcctccggcatcccaaagccactacagcgggagcgcagggcgggtgccgaatgcggccttgcccgacaggtacgggctgaagtcactaaatggatcggggtgaaccgacgacccaggaaaagaaagcgcagggagaaggaggaagttttcgaaaagctgctgcctgaccaactggttctgctgcttgagcacctccttgaacagaaaacactctcccctagaacactacagtctttacaaagaacttatcatttgcaggatcaggacgctgaagtgcgtcataggtggtgtgagctcatagttaagcacaaattcaccaaggcctacaaaagcgtggagaggtttctacaggaagaccaagccatgggcgtctacctgtatggcgagctgatggtttccgaggacgctcggcagcagcagttggcaagaagatgtttcgagcgcaccaaggaacaaatggatcgatcatctgcgcaggtggtagccgaaatgctattttag

SEQ ID NO: 54776 - DNA, 552 bp, Artificial Sequence
  Description of Artificial Sequence: Synthetic coding sequence
gccgatcccggacgcgctcagggagccggttccggggcagccgcagccagttcccccgctgccggagaaccgctccagcgggagcggagagccggagcagaatgcggcctggccagacaggtgagggccgaagtcaccaagtggatcggcgtaaatcgacgccctcgcaaacggaaaagaagagaaaaggaggaggtatttgagaagctgctgccagatcagctggtcttattactggagcacctcctggaacagaaaactctttcacctcgcacactccagtctctgcaacggacgtaccacctccaggatcaggatgccgaggtgcgccaccggtggtgcgagttaatagtcaagcacaaattcaccaaggcgtacaagtcggtcgagagatttctccaggaggaccaggccatgggtgtctatctgtacggtgagctgatggtgagcgaagatgctaggcagcagcagttggctaggcgctgctttgaacgaacaaaggaacaaatggaccgtagttccgctcaggtcgtcgctgagatgctgttctag

SEQ ID NO: 54777 - DNA, 2460 bp, Artificial Sequence
  Description of Artificial Sequence: Synthetic coding sequence
atggatatccagctggaccccgcacgggacgatcttccgttgatggcaaacacaagccacatcctcgtgaaacattatgtcctcgacctcgacgtggatttcgagagccaagtgatcgagggcactatcgtgttgtttctggaggacggcaatagatttaaaaagcagaactcatctattgaggaagcctgccaaagcgaatccaacaaggcctgcaagttcgggatgcctgagccttgccacatacccgtgactaatgcgcgaacattttcgtcggaaatggaatataacgatttcgctatctgttccaaaggcgaaaaggatacgtcagacaaagacggcaatcacgataaccaggagcatgcttcaggaatctcgtccagcaagtactgctgcgataccggtaatcacggatcagaggactttctgttggttttagattgctgtgatctgtctgtgttaaaggtagaggaggtagatgtggcggctgtacctggccttgagaagttcacccgaagtcccgagctgactgtggtctccgaggagttccgcaatcaaatagttagggaactggtgactctccctgccaacaggtggagagagcagctcgactactacgccagatgtagtcaggctccaggttgcggggaactcctcttcgatacggacacatggtccctgcagatcagaaagacaggcgcacaaaccgcaactgacttcccacatgccattaggatttggtacaagactaaacccgagggaaggagtgtcacttggactagtgaccagtcaggtcgaccatgcgtctacactgtgggaagtccaatcaacaacagagccctgtttccatgccaggaaccgccagtggctatgagtacctggcaggccaccgtgagggccgctgccagcttcgtggttttgatgtcaggagaaaacagcgctaaacccacacaattgtgggaagagtgttcctcctggtattactacgtgacgatgcctatgcctgcgtcgaccttcactatcgcggttggttgctggactgagatgaaaatggagacttggtccagtaatgatctggcgacggagcgcccattctccccctccgaagcaaatttccgtcatgtgggagtgtgtagtcacatggaatacccgtgccggtttcaaaatgcaagcgcaaccactcaagaaattattccacatcgcgtctttgccccagtatgcctgacaggcgcatgtcaggaaaccctgctccgattgatcccaccttgcctctcagctgcccacagcgtgctcggtgcccatcctttttctcgattggacgtgctgattgtgcctgctaattttccttccctcggtatggcaagtccgcacatcatgttcctttcccagtccatactgactggaggtaaccacttgtgtggaactcgtctgtgccatgaaatcgcacatgcctggtttggtctggcaataggcgcacgcgattggaccgaggagtggttaagcgaaggttttgctacacatctcgaggacgtcttctgggcaactgcccagcagctcgcgccttacgaggcgagagaacagcaggaactccgagcctgtctccggtggcggagactgcaagacgagatgcagtgctcaccagaggagatgcaggtgctgaggcccagtaaagataaaaccggccacacctccgattcgggagcctccgtgattaaacacgggctgaatccagaaaaaatcttcatgcaggtgcactacctcaaaggttattttctgctgaggttcctggccaaaaggttgggagacgaaacttatttctcattccttagaaagttcgtccatacatttcacggccagcttatcttatctcaggattttctccagatgctcttagaaaacattccggaagaaaaaagactggaactgtctgtcgaaaacatctatcaggactggcttgagtcctccggtatccctaagcctttgcagcgagagagacgggctggcgctgaatgtgggttggctaggcaggtcagggctgaggtaactaaatggataggagttaatagacgcccacgaaagcggaaacggagagaaaaagaggaagtattcgagaagctgctgcccgatcaattggtgcttctgctggagcacctattggaacaaaagaccttgagcccacgcaccttacagtcgttacagaggacttaccatctccaggatcaggatgccgaggtgcgacatcgttggtgcgagctgatagtcaagcacaagtttacaaaagcttataagagtgtcgagaggttcctccaagaggaccaggccatgggtgtgtatctgtatggagaactaatggtgagtgaagatgcccgtcagcagcagctggctcgacgatgctttgaacgcactaaagaacagatggatcgctctagcgcacaggtggtggctgagatgctcttttag

SEQ ID NO: 54778 - DNA, 495 bp, Artificial Sequence
  Description of Artificial Sequence: Synthetic coding sequence
atgcaagtgcattacctaaaagggtattttttactccgctttttggctaaacggctcggagatgaaacctactttagcttccttcgaaagttcgtacacactttccacgggcagctaatactgtcccaggatttcctgcagatgctcctcgagaatattcctgaggagaaacgtctggagctgagtgtcgaaaatatataccaggattggctcgagtctagcggaatcccaaagccgttgcagagggaaaggcgcgcaggcgctgagtgcggactggctcggcaggtgcgcgctgaggttaccaagtggattggcgtcaacaggcggcctcgtaagcgaaagaggcgagaaaaggaggaggttttcgaaaagacattgaactggtcacacctgaggaatcgcgaacggagaagaaaaaaatggataacattcaaaacgctgggagggattctgtttactgtcaaacaaatgcgcaacctgtttgcacaagtgtag

SEQ ID NO: 54779 - DNA, 561 bp, Artificial Sequence
  Description of Artificial Sequence: Synthetic coding sequence
atggaatacccttgtagattccagaacgctagtgcaaccactcaggagattataccccaccgagtgtttgctccggtgtgccttacaggtgcctgccaggaaacactgctgaggttaattccaccctgcctttctgccgctcactccgtgttgggggcacaccctttttcgcgcctggacgttttgattgtacctgcgaacttcccttccctgggtatggcctccccacatatcatgtttctttcacagtctattctgactggcggtaaccatctttgcgggacaaggctctgccatgagatcgcccacgcctggttcggcttggccatcggtgctcgagactggaccgaagagtggctgtctgaagggttcgcgacgcaccttgaggacgtgttctgggccacagcccagcagttagccccatatgaggccagagaacagcaggaattgcgagcgtgcctcagatggcgcaggcttcaggacgagatgcagtgttccccagaggaaatgcaggtgctgcggtttcctcacgttggcggttgcagtgggtccttcagctag

SEQ ID NO: 54780 - DNA, 1527 bp, Artificial Sequence
  Description of Artificial Sequence: Synthetic coding sequence
gttgtgtcagaggagttccgaaatcagattgtccgggagctggtcactctgccggctaacaggtggcgggagcagttagactattacgctagatgttctcaggccccaggatgtggggaactcctgtttgacaccgacacttggtccctgcagatccgcaagaccggggctcagactgctacagacttcccgcacgctatccgcatctggtacaaaaccaaacctgaaggaaggagcgtcacatggacctctgaccagagcggccgtccatgcgtgtacaccgtggggagtcccattaataatagggccctgttcccatgccaggagcctcccgttgcaatgagtacatggcaggcgactgtgagggccgcagcctcttttgtggtgctcatgtccggcgagaactccgctaaacccacccaactgtgggaggagtgctccagttggtattactatgtaactatgccaatgcctgcttcaacgttcaccattgccgtaggatgttggactgagatgaaaatggaaacatggtccagcaacgacctggcgaccgaaaggcccttctccccctctgaagccaattttagacatgtgggcgtttgctcacacatggaatatccatgtcgattccagaacgcatctgctacaacccaagagatcatccctcacagggtcttcgctcctgtctgtctgactggagcctgccaggagaccctgctgcggcttatacccccttgcttatctgcagctcattccgtcctcggagctcacccattttcgaggctggacgtcctgatcgtgcctgctaactttccttcactggggatggctcgccctagcaaggacaaaaccggccataccagcgactccggcgctagcgtgatcaagcacggcctgaatcctgaaaagatcttcatgcaggtacattatctaaagggctactttctgctgcgtttcctcgccaaaagactcggagacgaaacttacttctcttttctgaggaagttcgtccacacattccacggccaacttatactgagccaagactttctgcagatgcttctcgagaacatcccggaagagaaacgcctggagctgtccgtggaaaacatttatcaggattggctggagtcttccgggatcccaaagcccttgcaaagagaacggagagctggtgcagagtgtggcctcgcccgtcaggttcgagcagaggtaaccaagtggattggagttaaccgcagaccacggaaaagaaaaagaagagaaaaggaagaagtctttgagaaactgctgcccgatcagctggtgctcctcctcgagcacctcctggagcagaaaacgttgtctcccagaaccctgcagtccctccagcgaacttatcatcttcaggatcaggacgcggaggtgcggcatagatggtgcgagctaatagtgaagcataaatttaccaaggcttataagtccgtggagagatttctgcaggaggaccaggtcggtgtaatctttcagcagatgggtatcctttag

SEQ ID NO: 54781 - DNA, 546 bp, Artificial Sequence
  Description of Artificial Sequence: Synthetic coding sequence
atgagaatgagacgccctctggccggtggtgggaaatcctgggggatcgcccacttctataaaccgctccagcgcgagcgcagagcaggtgctgagtgtggactcgctcggcaggtgcgtgcagaggtcactaaatggataggcgtcaaccggaggccacggaagagaaaacgtcgagagaaggaggaagttttcgagaagctcctacccgaccagttggtcctgctgctggagcacctgctggagcagaagaccctgtctccaaggaccctgcaaagcttgcagcgcacatatcatctccaggatcaggacgcagaggtcagacacaggtggtgcgagttaatcgtgaaacataaatttaccaaggcctataagagtgtagagcgcttcctgcaggaagatcaggcaatgggggtctacctttatggagagttgatggttagcgaggacgccagacaacagcaactggccagacgatgtttcgagcgaacaaaggaacagatggaccgatcttctgcacaggttgtggccgaaatgcttttctag

SEQ ID NO: 54782 - DNA, 423 bp, Artificial Sequence
  Description of Artificial Sequence: Synthetic coding sequence
tcgtcaaaatattgctgtgatacaggaaaccatggatctgaggattttctattggtcctcgattgttgtgacctttcagtgcttaaagtagaggaggtggatgtcgcagctgtgccaggactggagaaattcacgagatcccccgagttaaccgtggtcagcgaagagtttaggaaccaaatcgttagagagctcgttacattgccagccaatcggtggcgggagcaactggattactatgcaaggtgctcccaagctccgggttgtggggagttgctgtttgacaccgacacttggagcctacaaatccgtaaaacaggggctcaaacagcaaccgattttccacacgccattcgcatttggtacaagaccaaaccggaaggcagatctgtgacttggacttccgaccagtctgggcgttag

SEQ ID NO: 54783 - DNA, 1806 bp, Artificial Sequence
  Description of Artificial Sequence: Synthetic coding sequence
ctgttcgacacagatacctggtcactgcagatacgtaaaacgggagcacagactgccaccgatttccctcacgctattagaatctggtacaagacgaaacctgagggtcggtcagtcacttggacatctgaccagagtggaaggccctgcgtttatacagtaggaagtccgatcaacaaccgggctctgtttccctgtcaggaaccaccagtagccatgagtacttggcaggcaaccgtgagggctgcagccagcttcgtggtcctgatgtctggggaaaactctgcaaaaccaacccaactctgggaagagtgcagcagctggtactactatgtgaccatgccaatgcccgctagtacgttcacaattgccgtgggctgctggaccgagatgaaaatggaaacatggagtagcaacgacctcgccacggagaggcctttttcaccctccgaggcaaatttccgtcatgtgggagtttgttcccatatggagtatccatgtagatttcaaaatgccagtgccacgacccaagagattattccacaccgtgtgtttgctcccgtctgcctgacaggtgcatgccaggagaccttattgaggctgatccccccttgcctttccgccgcacactcagtattgggcgctcacccattctcacgccttgatgtcctcatcgttccggctaatttccccagtttaggcatggcttctcctcatatcatgtttctctcccagtccatcctcaccggcggaaatcacctttgtggaaccaggctgtgtcacgagattgcccatgcatggtttggtcttgccattggcgcaagggactggaccgaggaatggcttagtgagggctttgccacccacctggaggacgtgttctgggcaaccgcccaacagctcgccccttatgaagcccgtgagcagcaggaacttcgcgcttgtctgcggtggaggaggctgcaggatgaaatgcaatgttcaccagaggagatgcaggtcctgaggcccagcaaagacaaaacagggcatacaagcgattcaggagcttccgttataaagcacgggctgaaccctgaaaaaatcttcatgcaggttcactacctgaaaggctacttccttctgagattcttggcaaaaaggttaggagacgagacttacttttcattccttcgtaaattcgtccataccttccacggtcaattgatactgagccaggacttcctacagatgttactggaaaacattcctgaggagaagcgcttggagctgagcgtggaaaatatctaccaggattggttagagtcatcagggatccccaaaccactgcagcgcgagaggagggcaggagctgaatgtgggttggccaggcaagtccgggcagaagttacaaagtggatcggtgtgaacagacgtccgcgtaagcgcaagagaagagaaaaggaagaggtgttcgaaaagctcctgcccgaccagctggtcctcctattggaacaccttttagaacagaaaacactctcacccagaactcttcaatcgctgcagcggacgtatcatctgcaggaccaggacgccgaggtgcgtcaccgctggtgtgaactgatagtaaagcataaattcaccaaggcttacaagagtgtggagcgcttcttgcaggaagatcaggcaatgggtgtctacttgtacggtgagctcatggtgtccgaagatgctcgccagcaacaattagcgagacgttgtttcgaaagaactaaggagcagatggatcgttcatctgctcaggtggtggcagagatgctcttttag

SEQ ID NO: 54784 - DNA, 483 bp, Artificial Sequence
  Description of Artificial Sequence: Synthetic coding sequence
atgcgtatgaggagaccccttgccggtggaggcaagagttggggcattgcccatttttacaaagtgactaagtggatcggagtcaaccgtcggccacgaaagaggaagcggagagagaaagaagaagtcttcgagaagcttctgcctgaccaactggtcctgctgcttgaacatctgctggagcagaagactctgtctccgcgtacattgcagagcctgcaaaggacttaccacctccaggatcaggatgcagaagtcaggcacaggtggtgcgaacttatcgtaaaacacaagtttactaaagcttacaaatctgtggagcgctttctccaagaagatcaagccatgggtgtgtatttgtacggtgagcttatggtgtccgaggacgcacggcagcaacaactcgcgaggcggtgcttcgaaaggaccaaggagcaaatggatagatccagcgcccaagtggtggccgaaatgctgttctag

SEQ ID NO: 54785 - DNA, 555 bp, Artificial Sequence
  Description of Artificial Sequence: Synthetic coding sequence
taggctgacccaggacgtgctcagggtgccggttccggagccgcagctgcctcctctcccgctgccggagagccactgcagcgtgaacgacgcgctggagcagagtgtgggctggcacgccaggtgcgagctgaggtcacgaaatggattggggtgaaccgccgacccaggaagcggaaacgacgcgagaaggaagaggtgtttgagaagctgctaccagaccaactcgttttgctgctagagcacctgttggaacagaagaccctgtctcctaggacactgcaatccttacaacgcacgtaccatctgcaggaccaggacgctgaagttcgacatagatggtgtgaattaatcgtcaaacacaagtttaccaaggcctataaaagcgtcgagaggtttctccaagaagatcaggcaatgggggtgtatctttacggggaactgatggtatccgaggacgcaagacaacagcaactcgccaggcggtgctttgagcgcaccaaggaacagatggatcgtagctctgcccaagtggtggccgagatgcttttctag

SEQ ID NO: 54786 - DNA, 438 bp, Artificial Sequence
  Description of Artificial Sequence: Synthetic coding sequence
tgagacgagacatatttcagcttcctgagaaagtttgtgcatacgtttcacggacagcttattttatcccaggacttcttacaaatgctgctcgaaaacattcccgaagaaaagagactcgagctgtcagtcgaaaatatctatcaggactggttggaaagcagcggaatccccaaacccctacaacgtgaacgaagagccggagccgagtgtggcttggccaggcaggtgagagccgaggtgactaaatggattggcgtgaatcggagacccaggaagaggaagcggagagaaaaagaggaagtgttcgagaaaactctgaactggagccatctgaggaacagagagcgacggcgaaaaaagtggataacatttaaaactctcggaggcatactgtttaccgtgaaacagatgcgaaaccttttcgcgcaagtgtag

SEQ ID NO: 54787 - DNA, 546 bp, Artificial Sequence
  Description of Artificial Sequence: Synthetic coding sequence
atgcagaacaatgaaataataaagccggcaaaatatttcagcgaactggaaaagtccatcctcctggctctggtggaaaagtacaaatatgtccttgaatgcaagaaaagtgatgccagaaccatcgcactgaaacaaagaacatggcaagctttggctcatgagtacaattctcagccatcagtctccttaagggactttaaacagctaaagaagtgttgggaaaatatcaaggcacggactaagaaaataatggctcatgaaagaagggaaaaggtgaagcgcagtgtgtcacctctgctttcaactcacgtgttaggtaaagaaaagattgcgagcatgcttcctgaacagctctacttcctgcagagtccacccgaggaggagccagaataccacccggatgccagtgcgcaggagtcttttgcagtttcgaatcgggagctgtgtgacgatgagaaggagtttatccattttcctgtctgcgaaggaacttctcagccagagccaagctgcagtgcggtacggatcaccgcgaataagtag

SEQ ID NO: 54788 - DNA, 828 bp, Artificial Sequence
  Description of Artificial Sequence: Synthetic coding sequence
atgcagaacaacgagattataaaacctgccaaatacttctccgaactggagaagagcatcctgctcgctctggtagagaagtacaagtatgtgctcgagtgcaagaaatccgacgccagaaccattgcgttgaaacaaaggacatggcaagcactcgcccatgaatataactctcaaccctctgtgagcctcagggattttaagcaactcaaaaagtgctgggaaaacattaaggcaagaacaaagaaaatcatggcccacgaacgaagggaaaaagtgaaacggtctgtgagtcctctgctgtcaacgcatgttctaggcaaggaaaagatagcttccatgcttcccgagcagctgtactttttgcagagtccgccagaagaggagcccgaataccacccggatgctagtgctcaggagtcattcgccgtgtccaatagagagttgtgcgatgacgaaaaggagttcatccactttcccgtttgcgagggtacttctcaaccagaaccttcttgcagtgctgtacgcatcacggccaacaagaactacaggtccaagacttcccaggaaggagcgctaaagaagatgcacgaagaagagcaccatcaacaaatgagtattctgcagcttcagctgatccagatgaacgaggtccatgtggccaagatccaacagatcgaacgcgaatgcgagatggctgaagaagagcatcgaattaaaatggaggtgctgaataagaaaaagatgtattgggaacgaaagcttcagacctttaccaaagagtggcctgtatcttcttttaatcgccctttccccaattcgccatag

SEQ ID NO: 54789 - DNA, 405 bp, Artificial Sequence
  Description of Artificial Sequence: Synthetic coding sequence
atgcaaaacaatgaaatcatcaaaccagctaaatatttctctgaactggagaaatcaatactcctagccctggtcgaaaaatataagtacgttctggagtgtaaaaaatctgatgccagaaccattgccctaaagcagcgaacttggcaggcactagcccacgaatataactcccagccatccgtctccctgagagactttaaacagctgaagaagtgctgggaaaatatcaaggcgagaaccaaaaaaattatggcacatgaacgccgagaaaaggtgaaacgtagtgtcagcccattgctgagcacacatgttctcggcaaggaaaagatcgcatccatgctgcctgaacagttatactttctgcaatcaccaccagaagaagaacccgaatatcatccgtag

SEQ ID NO: 54790 - DNA, 492 bp, Artificial Sequence
  Description of Artificial Sequence: Synthetic coding sequence
atgactcaccccctgccacacgactcccacactagcggagcaccccctctggttaacaagagccgagaccttgcaaacggtcccccatttttctcccccctgcagagcttgtgggaagagttcctgcatctgctctttatgggcaccctgctgttctaccgcatagcgaccaaagccctaagaggaaaagcaacattgctgaagagccactcgaagcagcccgctcagccagggtgggaacccggaatcagagcgccaagtccggtccctgcctcttccctgcaggaccactccaggttgacctctctatccagaacaggaaaagagcagcggaggacactgtctctcataagaaagacaagtggcactccaactgagtcgactgttgccactgccgcagcaagtaccacggaggttccgtccaggctcccctgggccgctagggctggttttaaaaggacaaccggagtgtgcatagctctccccacttag

SEQ ID NO: 54791 - DNA, 435 bp, Artificial Sequence
  Description of Artificial Sequence: Synthetic coding sequence
atgccatcaagtgctcacgcccacgctatattgaaagacgctcaggattcccctggcgtagttctcggacagggtgtgatacgagccggtaagggttgggagaacggacccgaaagtcatcgcgtccgctatcgtgggaagaagaatacagactggcacacccggtctcctgcactcacatttactgttctgtggccaagttgcccattggtgccaatcgtgctggggctcaacccgggattctgtccttgcgcccgttctagcggggaatgtaaccacagtggacacatcatcgagggcactcggtgggaccaaggccagttgtgtcttctgtttacactcagccgcgctgatattcgcgcttgctggcgcgttggggaacaacagtacgtgtccctgttcacacacgtgcagatgcagcatcctagcctatag

SEQ ID NO: 54792 - DNA, 531 bp, Artificial Sequence
  Description of Artificial Sequence: Synthetic coding sequence
atggaatttcactatgtcgcccaggccgatctggagttgctgacttcctctaaccctcccgcttcagccagtcaatctacaggcattaccggtgggtctcatcgcgctcgacccggaccagtccatttcatagacaaggtcactgataagccatctcacagccatccatttgcattaaaagagaattggaatctcaaccctgagcccagctcgcccccatcaccccttttccttgaggcgccttctaggcaagcctctcagcatcatggcgcttcgccgggtgccggaactagtgccggatgccccttcgaaaaatgctgcagcacagagccgtgcctgtccgggctcggcgatgtaggcagaggcgaggctgcttcccttcgggctcgcccaggttcaggagcgtcgaggggacagggccctggcagccgagtatcttgtagacgagacctgggcaaacccctgcacgccccagccggattcagcgcaggcgaggttcatactacccccctggggaacctgggagcatag

SEQ ID NO: 54793 - DNA, 357 bp, Artificial Sequence
  Description of Artificial Sequence: Synthetic coding sequence
atgcccagtaagacagccgagaacgcaaccttctactatatttccagtctgctgtccagtcggagtcctgtgttcaaccagagcccgaaggtgaaagccggacacatgctggaggccagtcagatctctgccaagaacagtgcagacttctttcaccctactccgtcgtgtagtgagttggattttaccctccacccagagctggctgactcactgggcgcaaaacacaactacaaagccacctgcctaatgcgattcctccccctccagaggcatactcgcagctggttctccctcatcctgtggtgcattcagagagacgactatttgattggcctgttctcctgcttctcttag

SEQ ID NO: 54794 - DNA, 462 bp, Artificial Sequence
  Description of Artificial Sequence: Synthetic coding sequence
atgcagagaaggaggcgacccccacccccaaccagtcgtctccctgaggggtgtggaggcggaggaggaggcagtgaagaagtagaggtccaattttcggccggacgttggggttctgcggctgccgtctctgccgcagcagcggcagcaactaggtccacagaggaagaggaagagcgactagagagagagcatttctggaaaatcattaacgcctttagatactatggaacatcaatgcacgaaagggttaatcggactgaacgccagttcagaagtctcccggctaaccagcagaaattgctgccacagttcctcctgcatttagataaaatccgcaagtgtatcgaccacaaccaggagatcctcctaacaatcgtcaacgactgtattcatatgtttgaaaataaagagtacggcgaggacgtctgtgagtcactgttctatttttgcctgttctag

SEQ ID NO: 54795 - DNA, 1230 bp, Artificial Sequence
  Description of Artificial Sequence: Synthetic coding sequence
atgcagcggagacgtcgccctcctccacctacgtctaggctgcccgagggttgcggtggtggcggaggcggttccgaggaggttgaagtgcagttctctgccggtagatggggctcagcagccgcagtcagcgccgcagccgcagctgccacacgctcgaccgaggaagaggaggagcgactcgaaagggaacatttttggaagatcatcaacgccttcaggtattatgggacctctatgcacgagcgcgtcaacaggaccgagcgtcaatttcggtccctacctgctaaccagcagaaactgctccctcagtttctgttgcacttggacaagattagaaagtgtatcgaccataatcaggagatactgctgaccatcgtaaatgattgcatccatatgttcgaaaataaagaatatggggaagatggtaacggcaaaatcatgccagcttctacattcgatatggacaagctgaagtcgaccctgaagcagtttgttagagactggtccgaaactggcaaagccgagcgggatgcatgctaccaacctataatcaaagagattttgaagaatttccccaaagaacgctgggatccatccaaagtaaatatcctggtgcccggagccggacttggcaggctagcatgggaaatagccatgctcggatacgcatgccagggcaatgagtggagcttttttatgctcttctctagtaacttcgtgctaaatagatgctccgagataaataagtataagttgtatccgtggattcatcagttctcaaataaccggaggtcagccgatcaaataagacccatattcttcccagacgtcgatccacattctttgccgccagggagtaatttctccatgacagcgggagattttcaggagatctattccgagtgtaacacctgggactgcatcgccacatgcttctttatcgacaccgcccataacgtgattgactatatcgacacaatttggaaaatcctcaaaccaggcggaatatggatcaatcttggtccactcctttatcacttcgagaacctggctaacgaactgagtattgaactgtcttatgaggatatcaagaacgttgtgttgcagtatggttttaaggtcgaagttgagaaggagtctgtcctttctacctatactgtgaacgacttatccatgatgaagtattattacgaatgcgttctgttcgtcgtccggaagccacagtag

SEQ ID NO: 54796 - DNA, 591 bp, Artificial Sequence
  Description of Artificial Sequence: Synthetic coding sequence
atgcagagaaggcgtcgtccacccccaccaacatcaagactgcccgaaggatgtggcggaggcggaggcggttctgaggaggtagaagtacaattcagcgccggtcgctggggctccgccgcagccgtctccgcagcagcagccgcagcaactagatcaactgaggaagaagaggaaaggttagagcgcgaacacttctggaaaataattaacgctttccggtattacggcacctctatgcacgagagggtcaatagaactgagcgtcagtttagaagtttgccggcaaatcaacaaaagctccttcctcagttcctgctccatcttgataagatccggaagtgcatcgaccataatcaggagattctgctaaccattgtgaacgattgtatccacatgttcgagaataaggagtacggagaggacggtaacggcaagattatgccagcgagtaccttcgatatggacaagttaaagagcactctgaaacagttcgtgcgcgactggtcagagaccggtaaagcagagcgggacgcttgctaccagcctatcatcaaagagattctgaagaacttccctaaggagcgatag

SEQ ID NO: 54797 - DNA, 717 bp, Artificial Sequence
  Description of Artificial Sequence: Synthetic coding sequence
gtacttagactgcaactcgagagtgaccgccacgaccttctccggtcgacatcaatgcacgaacgagtaaacagaactgagagacaatttagaagcttgccagctaaccagcagaaattgcttcctcagttcctgcttcatttggataagataaggaagtgcattgatcataaccaggaaattctgctcacaatcgtaaacgattgcattcatatgttcgagaacaaagagtacggggaggatggtaatggcaagataatgcccgcaagtactttcgacatggacaagttgaagagtaccctgaagcagtttgtccgggattggagcgaaaccggcaaagcagaaagggatgcatgctatcaaccaattatcaaggagatcctcaagaattttcccaaggagcgatgggacccttccaaagtaaatattctggttcctggagcaggcctcggccgattagcatgggagatagccatgttgggctacgcctgccaaggcaatgaatggtcatttttcatgctgttctctagcaacttcgtgttgaatcgatgttcagaaatcaacaagtacaagctgtatccttggattcatcagttcagtaataatcgccgatctgccgatcaaatacgaccaattttttttccagacgttgatcctcactccctgccccctggttcaaacttttccatgacggctggcgacttccaggagatctag

SEQ ID NO: 54798 - DNA, 1386 bp, Artificial Sequence
  Description of Artificial Sequence: Synthetic coding sequence
atggacctgcccgacgagtcccaatgggatgaaaccacatgtggattggccgtctgccaacacccccagtgttgggccacaatcaggcgcatcgagcggggtcaccctcgcattctcggcagctcctgtaagacacccctcgacgccgaagataaattaccagttcttacagtggtggacatccttgattccggtttcgcagcccaccacctgcctgagtgtaccttcactaaggcccactccctcctctcacaaagctctaagttttattcgaagttccacggacgtccccctaagggattgccagacaagagccttattaactgtactaatcgtctgccaaagttccccgtgctaaacctgaatgagacccaactgccttgtcccgaagatgtgaggaacatggtggtgctctggattcctgaagaaacagagatacatgtctcacaacacggcaaaaaaaagaggaaaaattccgccgtgaagtccaagagcttccttggcctgagcggcaaccagagcgcgggaactagggtgggcacccccggaatgatcgtgcccccaccgacaccagttcaactatctgagcaatttagctccgattttctgccattgtgggcccagagcgaggccctgccccaggatttattgaaggagcttcttccgggagggaagcagacaatgctatgtcccgaaatgaagataaagctggctatgatgaagaagaacctgcctctggagaaaaacagacccgacagcgttatttcatccaagatgtttctgtcaatccatcggctgacacttgaaaggcccgctcttagataccccgagcggttgaaaaaactgcataaccttaaaacggagggctatagaaagcagcagcagcggcagcagcagcagcagcagcagcagaagaaagtgaaaacaccgatcaagaaacaagaggctaaaaaaaaagcaaaatctgaccctggaatacaaagcacatctcataaacatcctgtgacaaccgtgcatgatagactctacggataccgaacgttgcccggacagaacagcgacatgaagcagcaacaacaaatggagaaggggaccacctctaagcaggactctaccgagagaccaaaaatgaactactatgatcacgccgactttcatcactctgttaagagcccagaactgtacgagaccgagcctacgaataaggatatctctgctcctgtagacgcagtcccagaggcacaggcagcgcgtcagaagaagattagcttcaatttctctgaaattatggcctctacaggctggaattctgaactgaagttgctgaggattctgcaggacactgatgatgaggatgaggaggatcagtcgtctggtgcggagtag

SEQ ID NO: 54799 - DNA, 1386 bp, Artificial Sequence
  Description of Artificial Sequence: Synthetic coding sequence
atggatctcccagatgagtcccaatgggacgagaccacctgcggcctggctgtttgccagcatccccagtgctgggccacaataagaagaatagaacggggtcatcctaggatactgggttccagctgtaaaacccctctggacgccgaagataagttgcccgtgctgaccgtcgtagatatcttggatagtggcttcgccgctcaccatttacctgagtgtacatttaccaaagcacactccctactgagtcagtcctcaaagttttatagcaaatttcatgggaggccccctaaagggctgccagataagagtctcattaattgcactaatcggctcccgaaattccctgtactcaacctcaatgagacgcagttgccttgtcccgaggatgtgcggaacatggtcgtgctctggattccggaagagacagaaatacacgtgagtcagcacggaaagaagaagaggaagaactctgctgtcaagagtaagtctttcctgggtctgtctggtaatcagagtgcagggacacgtgtgggcaccccgggaatgattgttccccctccaactcctgtacagctgagtgagcagtttagctcggactttttacccctttgggcacaatcagaggcgttaccccaggatctactcaaagaactgcttcccggtgggaaacagaccatgctgtgcccggaaatgaaaattaagctcgccatgatgaagaagaatttgccccttgagaaaaaccgcccagactccgtgatttcaagcaagatgtttctgtccatccaccgcctcaccttggagcgccctgccttgagatatccggagcgactgaagaagctccacaatcttaagaccgagggttatagaaagcagcagcagcgtcagcaacagcaacaacagcagcagaagaaagtcaagacccctataaaaaagcaggaggccaagaaaaaggccaaatcagatcccggtattcaatctacctctcacaaacacccagtgaccaccgtacacgaccgcctatacggttataggaccttgcccggtcagaacagtgacatgaagcaacagcagcagatggaaaagggtacgacttcaaagcaggactccacagaacgacctaagatgaactactacgaccatgctgactttcatcatagcgtgaaatcgccagagctttacgagactgaacccacaaataaggacatctcagccccagtagacgcggtgcccgaggcccaggcggcaaggcagaaaaagatcagctttaacttctcagaaatcatggcatctaccggctggaactccgaactgaagcttcttagaattctgcaggatacagacgatgaagatgaggaagatcagtcctccggtgcggagtag

SEQ ID NO: 54800 - DNA, 1386 bp, Artificial Sequence
  Description of Artificial Sequence: Synthetic coding sequence
atgagcaggatcaataagaatgtggtcctcgcgctcctcacccttacaagctcggccttcctcctgtttcagctctactactataaacactacctgtcaacgaaaaacggcgctgggctgtctaaaagtaaaggctctaggatcggtttcgactcaacacaatggcgagccgttaagaaatttattatgctcacaagcaatcagaacgtgcctgtgtttttgatcgacccactcatattagaacttatcaataaaaacttcgagcaagttaaaaacaccagccacggctctacctcccaatgcaagttcttttgtgtccctagagacttcacagccttcgcactccagtaccatctgtggaagaacgaagaagggtggttcagaattgccgaaaatatgggattccaatgcctgaagatcgaaagcaaggaccctaggttggacgggattgactcattatcagggacagagatcccacttcattacatttgtaaactggctacacatgcgatacacctcgtggttttccatgagagaagtgggaattatctgtggcacgggcacctccggcttaaagagcacatcgaccgcaagttcgtgccttttaggaagctgcagtttggacgctatcctggcgctttcgacaggcctgaattgcagcaagtgaccgttgatggtttggaggttttgattcccaaggatcccatgcactttgtggaagaagtgccccactcccggtttatcgagtgtcgatataaggaggcccgagcattcttccagcagtatcttgatgacaataccgtagaggccgtggcattccggaaatccgctaaggagctgctgcagcttgcagctaaaacactcaacaagctgggtgtgcccttctggctttcttctggcacttgtctgggatggtataggcaatgtaatataatcccttactctaaggacgttgatctggggatctttatccaggactacaaatctgatattattctggccttccaggatgcgggtctacccctgaagcacaaattcgggaaggtcgaagactcactggagctgtctttccaggggaaagatgatgtgaagctcgatgtgttttttttctatgaagagacagatcacatgtggaacggcggaactcaagcgaagactggtaagaagtttaaatatctgttcccaaagttcactttgtgctggacggagttcgtcgatatgaaagtgcatgtgccatgcgaaacattggaatacattgaagctaactacggtaaaacctggaagatcccggtaaagacatgggattggaaaagatccccccctaacgtacagcccaatggcatttggccgattagtgagtgggatgaagtaatccaactatattag

SEQ ID NO: 54801 - DNA, 2640 bp, Artificial Sequence
  Description of Artificial Sequence: Synthetic coding sequence
atggctgatggcggtggccctaaggatgctcctagcttgcggagcagcccgggacccgctcccagagtcccacgtgctgtgggcccatcgggagggggaggagagacaccacggacagcagcccttgcactgcggttcgacaagcccatcaagcaggctttttacaatacgggggcagttctgttcgtgtgcctgtgctgcggggctgctgtcctggtgtacttcattctggaggcatttctgcgtcctctgctgtgggcagtactgtgcggcactttcctccaccccttcaaaagtagtctgacacgcttagggaggcattggctccagcgcctgcatagagcacacacaccaattgtgttagcggcattgctcctccctctgtgtttcgtggactatggagtcgaggctctgggcgagcaagctctgagacgaagacggttattgctgctcctcggagcaggtgggcctctactgtacggcctctactgtctgggaagttatctgggcgtgcaggtactgctcgtccacgctgccaccctgatttgtaggggcctcgattatttctcgtcactctggatctggactttggtcgtcggctatgtgctaaccgtgagtttcaagtggaatgcctcaaccgagcgatatttgcgcgctgtttctattccagtgtggataatccttttatttcatctcgcctcactggctggctcctggcgtatcccagtcttcctggttattgtgttcttgatgtcagtgggaacattgtacgagaagcagaatggcaaagagtcttccggggcagaacttcctggacaggtcataagtatggctgcgagcaccctcgcaaacctggccatctccataaccggatatgagtcaagttccgaggaccaacccagcacgcagcccgcagaggccgtcgaccggggtgaaagtgcccctacactgtcaacgtccccaagccctagcagtcccagtccaacaagcccctccccaaccttaggccgtaggcgtcccgagattggcactttccttagaaaaaaaaagacaagtgatatctacttcgtttccctcgtgtgggcaatcgttgtcatgcagatttggttgaacctttggatagtgcagctgctcccagtgcctattgctgtgtggattctcaagaagcttgtgatccattttggcgtggttgacttcctcgaaaaacggtaccatgtttggtggggtattatcgaaagttttttgaaagagagacagggagcactggccccttggcctatcgtggggctgggcaaatttcttttgaaggtggactctaaactttggcattggctgaataaaaagatgattatttggctggagaagatgctcgataagatcatcagcatcttcatcatctttttgctggtaatcggtaccctattactcgccctgctgctgactgcgaaggtgcatcaggaatcggtgcatatgatcgaagtgacttcaaatctgatcaacgaaacgcttgctaaccaccccgaatgggccaattggctgcccgaggcccaggttgtgcaaagggctctcaattccgccgcaaataatgtgtatcagtacggacgggagtggattacgcacaaactccataagatcctgggtgataaagtgaacaataccgctgtaattgagaaacaagttttagagctctgggatcgcttataccattcgtggtttgtcaagaacgtaacacattccggaagacacaagggtcagaagcttcacgtctccaggcagaactcttggctgggtgacattcttgactggcaggacattgtttcttttgtgcacgaaaacatcgagaccttcctgtccattctggaatctctgtggatagtgatgtctaggaacgtcagtctcctcttcaccacggtgaccactctgcttaccattctgttttattcaggcacagccctgctgaactttgtcctgagtctgatcatctttctaaccacgctgttttacttgctctcgtcatcggatgaatattataaaccagtgaagtgggttatttctctcactccacttagtcagcctggtcctagtagcaatattattggccagtcggtggaggaggccattcggggagtcttcgacgcctctctcaagatggcaggcttctacggactctacacatggctgacccacaccatgtttggaattaacatcgtcttcatcccatctgccttggctgccattctgggagccgtgcctttcctaggtacatattgggcggcagtgcctgcagtcctggacctctggctgactcagggactcggttgtaaggcaatcctgctgctaatcttccacctgttgcctacttactttgttgataccgcaatctatagtgatatctccgggggtgggcacccctatcttacggggttggccgttgcaggcggagcatattacctcggactggagggggcaattattgggcctatactactgtgcatccttgtggtcgcctcgaatatatactctgcgatgctggttagtcctaccaatagtgtgcctacacccaaccagaccccatggccggctcagccacagcgtaccttccgtgatatatccgaagacctcaaatcaagtgtaggttag

SEQ ID NO: 54802 - DNA, 1509 bp, Artificial Sequence
  Description of Artificial Sequence: Synthetic coding sequence
atggctgacggtggaggacctaaggatgctccaagtttgagaagtagccccggtccagccccacgcgtgccccgagccgtcggacccagtgggggtggcggtgagacgccacgaacagccgctttggcactgagattcgacaaaccgatcaagcaggctttctacaacactggcgctgtcttgttcgtgtgcctgtgctgtggagcagccgtcctcgtttacttcattctagaggctttcctacgtccccttctatgggcagtattgtgcggcactttcttgcaccccttcaagtcttctctaacccgtcttggccgtcactggctccaaaggctgcatcgtgcgcatacccccatcgtgctggctgcactccttcttccactgtgttttgtagactatggtgttgaggctctcggcgagcaggcactgcgacgcagaagactgctcctactgctcggcgcaggtggacccctgctctacggcctctactgtctgggaagctacctgggcgtccaggtgttactggtgcacgcagctaccttgatctgccgtgggcttgactacttcagctctctgtggatttggacgctggtcgtggggtatgtcctcacagtgtcttttaagtggaacgcttcaacagagagatatctgcgggcagtgagcatacccgtctggatcattctcttattccacttggcatctctggccggatcttggagaattccagtgttcttggtgatcgtttttctgatgtctgtgggcaccctgtacgagaagcagaacggcaaggagagttcaggtgctgagctgcctggccaagtcatttctatggcggcttctaccctggccaacctggccatctcgatcacaggatacgagagcagttcagaagatcaaccgagtactcagccggctgaggcagtcgatcgcggagaatcggcccctactctgtccaccagcccgtccccgtcctcaccaagccctacttctcctagcccaacactcggtcgcaggcggccagagataggcacttttctccgaaagaagaagacatcagatatctacttcgtaagcctggtgtgggctatcgtggtgatgcagatttggctgaatctctggatcgttcagttattacccgtccctattgctgtatggattctgaaaaagttggtgattcattttggagtcgtcgatttcctggaaaaacgttaccacgtgtggtgggggattatcgagtcatttctcaaagagcgtcagggcgctttggctccgtggcctattgttgggctgggaaaattcctcctgaaagtcgatagtaaaatgattatctggctggagaaaatgcttgataagatcatatctatcttcattattttcttgctcgtgattggaacactcctgctggccctgctcctgacagcgaaggtacaccaagaaagcgtgcatatgattgaagtcacatcaaatctaattaatgaaacacttgcgaatcatccagaatgggcctag

SEQ ID NO: 54803 - DNA, 1296 bp, Artificial Sequence
  Description of Artificial Sequence: Synthetic coding sequence
atgttttggagaaggctgcgccctggagcccaggatctggcgcctaagggtctgcccggagacggagactttcgcagaagctccgatcccagattgcccaaactcacgccacccgctctccgcgctgccctcggggcaagaggatctggcgactggagaatcccagggggaggcgcagcctggtggccagagggagatgcgaagcccggagtcggagtgggacggctgcccccacgactgcctgccctgctgactgctactcgtcgggcagtcaggaagcgcggtctcctgcgcagcctcttacccccaccgcttctctccgccggagcctctagggagtcagctcctaggcagcccggtcccggagagcgcgaaaggcccagaaggcgagtcgctcgggaggacccagacttcctaggcgcattcctgggcgagctgcttcccagtcgcttcagggagttcctgcatcagttacaggaaaaatgtgcagaggagcctgagccactgacctctcctgccccacagcaccagcggggtgttctggagcattgtccgggtagtcctagatgccctaactgcagctttcttcctgacctgtggggccagagcagccatttgcaggacagcctgactaagatctccctgcagcagacaccaatcctggggccactcaaaggagaccactcgcagtttacaacggttagaaaggctaaccaccggcctcacggcgcacaggtccctagactgaaggccgcactgacccacaacccatccggcgagggttccaggccttgtaggcagagatgtccctttagggttagatttgccgacgaaaccctgcaagataccaccctgagatattgggagcgcagacggtcagtccaacagtcggttattgttaaccaaaaagcagccctacccgtggccagcgagcgcgtattcgggagcgtcggtaagagactagagagcctgccgaaagcattataccctggagccaaagaagaaactctggccagcagctcatgttgggattgcgctggactctccacccagaagacccagggatacctgtctgaagacacgtcgatgaacagttcactgccattctgctcttggaaaaaagccgctgcccagcggcctagatcgtccctgcgagcattcttggaccctcataggaacctggagcaggaatctctgctgcccaatcgtgttcttcaatctgtgctaaagcagggatgtccaaaagggtaccacttgctgcttgcatccgcaacattacagcccgacaagcgctag

SEQ ID NO: 54804 - DNA, 816 bp, Artificial Sequence
  Description of Artificial Sequence: Synthetic coding sequence
atgagagacaggagggggcctttgggcacatgcctggcccaggtgcagtgggcaggtggcggtgactccgataagctgagttattccctgaagaagaggatgccaaccgagggaccatggccagcagacgccccatcgtggatgaataagcccgcagtggatggtaactctcaatctgaagcactgagtttggaaatggcaggactgtccctacctagtgggggtcccgtgctgccctacgtgaaggagtctgcccgaagaaatccagcatctgcagccactccttctgcggctgtgggccttttcccagcccctactgagtattttgctcgcgtgtcatgctcaggggtggaggcccttggcagagattggctcggcggaggccctcgcgcaactcacggtcaccgaggacagtgccccaaaggagagccaagagtctccagattgaccagacatcaaaaattaccggaaatgggatcattttgggatgaccctccttcggcttttcctagtggactcggtagtgaattagagccaagttgcctgcattcaattctgtccgccactttgcacgcttgtcctgaagtactgttaaaggatgaaaccaaacggatttttctggacctgctaaaccccatgttttcaaagcaaacgatagagttcaagaagatgttcaagagcacctctgacggactacagataaccttgggcctcctggcactgcagcacttcgagctggcaaactccttgtgccacagtctcaaatataagcagaacaatgcaagtcgcctcattctgcgagtggttttggaatag

SEQ ID NO: 54805 - DNA, 240 bp, Artificial Sequence
  Description of Artificial Sequence: Synthetic coding sequence
atgcgccagcggggacaggaacatctgccgacatccgtcaaaagtgagcccagagcctgcaataaccccacggtggccgagaaccggagggtgccatctgggctcgcagctgtaataagaaatcttacagctctctggaatccgagccttggcgtctcagaaagacgcggtggggactgggagccaagtaggattcccagactgtgggcccgtgtcgggtggatccagttacctgggtag

SEQ ID NO: 54806 - DNA, 459 bp, Artificial Sequence
  Description of Artificial Sequence: Synthetic coding sequence
atgggcctgtcaccaggacaaaccagcgtcagctttttgtggccactcttggaagtacgggaccacaatacagggcgaggtctggtgccagcgaccgttttgacccccggtagtcccgaaacgctgctggaactacgccaggccttcctcggcagccgacaggccagacatggccacgacgcagccccaagctccggccagcaggggtgttcagtcgacagaaccgcaggacggccagtcctgggatggcgtctgaggaattcacttacagggcaggagggcaggcagcatctgcatttgagcgggatcagaacgtctcggaaggccaaggagtacaagcctgtattttttggggcaaccgaaatttcggttctgatggccgttgcagagagtcttcgggagccaccgccaccccagtgggggtggtttctcagttccttatttcttaaaattttctag

SEQ ID NO: 54807 - DNA, 603 bp, Artificial Sequence
  Description of Artificial Sequence: Synthetic coding sequence
atgcctctcgtggaggaaaggcatagaatcttgaacgagacaggcaaaatactactggaaaagttcggaggatcattcctgaactgtgtacgagagagcgaaaattccgcccaaaagctcatgcatctggttgtggagtctttcccttcttacagggacgttacattatttgagggaaagcgggtgagcttctacaaacgagcccagattctggtggccgacacgtggagtgtcttggaaggtaaaggagacgggtgctttaaggacatttcgtccattacaatgttcgcagattatcgcctgcctcaagtccttgcccacttaggcgcactgaagtacagcgacgacctgctgaaaaaactcctgaagggagagatgctctcctatggtgatcgccaggaggtcgaaattagaggctgtagtttgtggtgcgtcgagctaattagggactgtctcctggagctgatcgaacaaaaaggagaaaagcccaatggtgagattaactcaatccttctagattattacctgtgggactacgcccatgaccacagggaggatatgaaaggtatccccttccatcgcattcggtgtatctattactag

SEQ ID NO: 54808 - DNA, 183 bp, Artificial Sequence
  Description of Artificial Sequence: Synthetic coding sequence
atgccccttgtcgaggagcggcacagaatcttgaatgagaccggcaaaatattgctcgagaagttcgggggatcttttctgaattgcgtccgggaatcagagaattcggcacagaaattgatgcacctggtggtagagtcatttccctcttaccgagacgtgacattgttcgaatgtacctag

SEQ ID NO: 54809 - DNA, 1026 bp, Artificial Sequence
  Description of Artificial Sequence: Synthetic coding sequence
atggacggactgctaaatccacgcgagtcttccaagttcatcgccgaaaatagccgagatgtttttatcgatagcggcggagtccgcagggtggcagaactgcttttggccaaggcagcaggtcccgagctgcgtgtcgagggctggaaggcactgcatgagctgaacccacgcgctgcagatgaagccgcagtaaactgggtcttcgtcacggacaccctaaacttttcattttggagcgaacaggacgagcacaaatgcgtggtgcggtaccgaggtaagacgtattccggctattggagcttgtgtgccgcagtgaacagagcactggatgaaggtattcctattacatccgcttcttattatgccactgtgacactcgatcaagtacggaacatcctccgtagtgacactgacgtctcgatgcctcttgtggaggagagacaccgtattctgaacgagaccggtaagatattgctcgagaagttcggcggaagttttttgaactgcgtccgtgaatccgaaaatagcgcccagaagcttatgcatcttgtggtggaatctttccctagttatagggatgtgactctcttcgaagggaaacgagtctccttttacaagagagcccaaatacttgtggccgatacctggagcgtgctggagggcaaaggcgatggctgcttcaaggatataagctcaataactatgttcgccgactatcggctaccgcaggttttggcgcatctgggagcgttaaagtacagtgatgaccttttgaaaaagttactcaaaggggagatgctgagctacggagacaggcaggaggttgaaattagaggctgcagcctgtggtgtgtggagcttattagagattgcctgctggaactgatcgaacagaagggtgaaaagccaaacggggagatcaattcgattcttttggattactacctgtgggactacgctcatgaccacagggaagacatgaaaggcatacccttccaccggattaggtgcatatactactag

SEQ ID NO: 54810 - DNA, 888 bp, Artificial Sequence
  Description of Artificial Sequence: Synthetic coding sequence
atgaggcactctgtggcccgtcccacgcggttgcctcgcagattgagcccgttttgggaccctgccacctgcaaaaacctggaagggggagccggtgaggttgtgagagggagggacccaagacggcttcgtacttcgcgcagtaccgaaatcctgggcgaagacctggccggaccgagcgctggtgccgctgctagaccagcagcaccaccccctcagccgagggaaccgggagcaccgggtctgcggagggccccacccagaaccagaatggatagctcgggactgggcccatgcagtgaggcaccattgcacaccagcgcaggccttagcggtcgtaacttacgagctgccggaggtgtgttacctgttgacctcgagcgcgagagggccgcactgtgtgccaggcagtctggacatgggcctccagctgtccgctggctccttggatcacgtggagccgagtccgggggactggcgaggcgcagggtagccgctgaacacgctcaaccctccgccaatctagtgtgtcgctccgctcttgagacttcagctttccctcccagcaagcccaagtctcccaggggacgggttcgcgcacggtctagcgacgggcgtctgaggcatccagcctggcgggctggatctggcggacgtggaggcagaggcccttccgcagaactcgcaagtagatactggggcagacggagggcacttcccggagctgcggacctgcgaccaaagggcgcacgcgcagacgatcgacgccctctgcgagctggcaggaaactgcacctgccagaagccgctagactgccaggcaatgttgggaagtccggggagccccacaaggctggcgaggtcggcaatcaccctagagactcgtag

SEQ ID NO: 54811 - DNA, 810 bp, Artificial Sequence
  Description of Artificial Sequence: Synthetic coding sequence
atgggcccaagacctctagaaaaaggatgtttcccagggtgctttttccggaactcaaaagaggaaaggcatgagtcccgacgtcccttgtcaacgagtcatgaacccatcttccctttaaataccataaagatgaagcttaaggagaacaacctgaaccgccttcccaaggggatgcaggccagagccccatcgcagtactcaacacgccacttcttccaggatcagcccgcacagctcaacctgggcaacaacttcaaaatttctggtggctctaagcctccttttgtggtgcggcacgtcgacagtgctaagccctttggagagaacatttcagagcatcatctgaggaggtcccgtaggaagagtaagtttagcgactttcctttccctacgagaagagcatctagcctggactccctggccgcaaacgtcaaagtcattaaggagcccgatgagcgtattgtgttgagatctgactcttcgagctgtctggattctagtcagtttggaaaatcttcttcttccaagcagggtgacgcagattttcatggcaaagcaagcttcgcaacctatcagcacagtacttcccccggacccctggaccagcctttgttgcgcgagagatttcatccgggatctcaatcaacgtggaagaacatccacgaaagggtctgctctctgttaacatcccaccgggctcagctacaccaaaacaaagaagattccacatcagaggtgaattacattatcgaacgcccaagctatcctctgaaaaagtactctctccatgagcagcgctatttttag

SEQ ID NO: 54812 - DNA, 1179 bp, Artificial Sequence
  Description of Artificial Sequence: Synthetic coding sequence
atgcctcttgaggttgttgtggagcttcagattcgcgctattagttgtcccggagtgttcctgcccggaaagcaagacgtgtatctcggggtgtatcttatgaaccagtacttggagacaaattcatttccgtccgctttccccattatgatccaggaatcgatgaggttcgaaaaggtgtttgaatctgctgtcgatcccggagccgtggtggatctgctggaaatgtgggatgagcttgcttattacgaggaaaatacgcgcgacttcttgtttcctgaaccaaagctgacccctagccatcctcgacgctgtagagaggtgctgatgaaaactgctctcggttttccaggaattgctcctaaaattgaattttccactaggactgcaatccgggaatgtgtattcctgcatcggaacagattcctggaggaaagacacgaaagtagaagacccctgtccactagccatgaacctatcttcccacttaatactatcaagatgaaactcaaagagaacaacttgaatcgtctgccaaagggaatgcaggccagggcacccagccagtactccaccagacatttctttcaagatcagcccgcacagctgaacctgggcaataacttcaaaatcagtggaggcagcaagcctcccttcgtggtccgccacgttgactcagcaaagccttttggcgaaaatatttcagagcaccaccttcgccgttcccgcaggaaatctaaattttcagactttccttttcctacgcggagggcttccagcttggactctctcgcagcaaacgtgaaggttatcaaggagccagacgagcggattgtactaagaagtgatagcagctcctgtctggattctagtcagttcgggaagtcttcaagctcaaaacagggtgatgccgacttccatgggaaggcctcatttgcaacataccagcactctacctcacctggtcccctggatcaaccacttctacgagagaggttccacccgggatctcagtctacctggaagaatatacacgaaagggtgtgtagcctgctcacatcacatcgggcacagttacatcagaacaaggaagacagcaccagtgaggtgaactatatcatagaacggccttcttatcctctgaaaaagtattctctgcatgagcaacgttatttctag

SEQ ID NO: 54813 - DNA, 408 bp, Artificial Sequence
  Description of Artificial Sequence: Synthetic coding sequence
atgactcctaccccaacggcggcttggactcctcccccacctttgaggccctctgctgctgctgccggtgctcaatgtaggtcgtgcccatttcgcggaggatgcgcaccttccaccgcccgtacgccacctgcatgtatgaggcctgcaggaccatgtgccccacctacttggcccgctccttcaacgactacatctacctgtactagtagacgtgcgggttgcactgcctcctcagctagctacagcactctggctgccgcttgtagcctgagaaggagtggggtcaggtggccacctagttctgcttatagtacttgggcgtttgccagctgttgcgctagctcagctagttgcaggtgttgttgctgctgctgggctgcaggggcatggacttcagcctggtag

SEQ ID NO: 54814 - DNA, 870 bp, Artificial Sequence
  Description of Artificial Sequence: Synthetic coding sequence
atgcccgtcgttcggaagatctttcgcagaaggcgtggcgattctgagagtgaagaggatgagcaagacagcgaggaggtgagactaaagttggaggagacacgtgaggtgcagaatctgcggaaaagacccaacggcgtgtcagcagttgcgctgctcgtgggagaaaaagttcaagaagagacaacattagtggatgaccccttccagatgaaaactgggggaatggtggacatgaaaaagctgaaggagcgcggaaaggataagatctcagaagaggaggacctccatctgggtacgtccttctcagccgaaacaaaccgacgcgatgaggacgcggacatgatgaagtacattgagacagaattgaagaagcggaaaggcatcgtggagcatgaagaacagaaggtgaaaccaaagaacgcagaggattgcctatacgagctcccagagaatattagagtgagttcggccaaaaaaaccgaggagatgctctccaatcagatgctttccgggatcccagaagttgatctgggcatcgacgccaagatcaagaacatcatctcaacggaagatgccaaggcacggctcttggccgagcaacagaataagaaaaaagatagcgaaacttcatttgtgcctactaacatggccgtgaattatgtccaacataacagattctatcacgaggagttgaacgctcccattcggcgtaacaaagaagagcctaaggccaggcccctgcgggttggtgacacggagaagccagaaccggaacgctctcccccaaaccggaagcggccagccaatgaaaaggccacagacgactatcattacgagaaattcaaaaagatgaaccgacgatattag

SEQ ID NO: 54815 - DNA, 528 bp, Artificial Sequence
  Description of Artificial Sequence: Synthetic coding sequence
atggtcgacatgaaaaaactgaaggagcggggaaaggataagatctctgaagaggaggatttacatctgggcacaagctttagcgcagaaacaaacaggcgggatgaagatgctgacatgatgaagtacattgaaaccgaactcaaaaagcggaaaggtattgttgagcacgaagaacagaaggtcaaacccaagaatgccgaagattgtctgtacgagctgcccgaaaacatccgagtgtctagtgcaaaaaagaccgaagaaatgctatccaaccagatgctttcaggtatccctgaggtcgatcttggaatcgacgccaagatcaaaaatattatttccacagaggatgccaaagctcgtctgctcgctgagcagcagaataagaaaaaggattcggagacgtcttttgtgcccactaatatggctgtcaactatgtgcaacacaaccggttctaccacgaggagttaaacgcccatacagagaagcagagaagagcccaggggcctgcattggagtcccgatag

SEQ ID NO: 54816 - DNA, 1086 bp, Artificial Sequence
  Description of Artificial Sequence: Synthetic coding sequence
atgaccggaaagaagtcctctcgagagaaacggagaaagaggtccagtcaggaggctgccgcagccctggccgcaccggatattgtgcctgctctagccagcggaagtagcggttctacctctggctgtggttcggctggtggatgtggctccgtcagctgctgcggaaatgccaacttctccgggagtgtaacaggtggcggaagtggcggttcatgttggggcggaagctccgtagaacgtagcgagagaagaaagcgaaggagcacagatagtagtagcgtgtcgggaagtctgcagcaggagactaagtatatattgcccaccttggaaaaagagctgttcctggctgagcacagcgacctggaggagggaggtctcgatctgactgtcagtctcaagcccgtcagcttctacatttccgacaaaaaggagatgctgcaacagtgcttctgcatcatcggcgagaaaaagttgcagaaaatgttgcctgacgtacttaaaaactgcagcatcgaggaaatcaagaaactttgtcaagagcaactggagctgctgtctgaaaaaaagattctgaaaatactggaaggcgataatggaatggattccgacatggaggaagaagccgatgacggctccaagatggggtccgatctggtttcccagcaggatatatgcattgattcagcatcatctgtgcgggagaataaacaaccagagggactggaactgaagcaagggaaaggtgaggacagcgatgtcttgagcattaatgcggatgcttacgacagcgatatcgaaggcccttgcaacgaagaagccgcagcccctgaagcgccagaaaacactgtccagagcgaggcagggcagatcgacgacctggagaaggacatcgagaagtcagtgaacgagattcttggtcttgccgagtccagcccgaacgagccgaaggctgcgactttagccgtgccccctcccgaggacgtgcagccctctgcacagcagctggagcttttagagttagaaatgcgcgcacgagccatcaaagccctgatgaaggctggcgacataaaaaagcctgcgtag

SEQ ID NO: 54817 - DNA, 651 bp, Artificial Sequence
  Description of Artificial Sequence: Synthetic coding sequence
atgctgcagcagtgtttttgcatcatcggtgagaagaagctccagaagatgctccctgatgtcttgaagaattgtagcattgaggagataaaaaagctctgccaggaacagctcgaactgctctccgagaaaaagattctcaagatcctagaaggcgacaatggaatggatagtgatatggaggaggaagccgacgacggcagtaagatgggaagtgatctggtgtctcaacaagatatctgcatcgattccgcctcctcagttcgcgagaataaacaaccagaaggtttagaactgaagcagggtaagggcgaggactccgatgtcctgagtattaatgctgatgcgtatgactccgatattgagggaccttgcaacgaggaagccgctgcccctgaggcccctgagaatacagtgcagtcagaagccggtcagattgacgatctggaaaaagacatcgagaaatccgtgaatgaaattttgggtctcgcggagagctcacccaatgaacccaaagctgccacgctggcagtacccccaccagaggacgtccagccttcagcccagcagcttgaactgcttgaactggagatgagggcacgggctatcaaagccttgatgaaggccggtgacattaagaagcccgcatag

SEQ ID NO: 54818 - DNA, 4335 bp, Artificial Sequence
  Description of Artificial Sequence: Synthetic coding sequence
atgaccgacacaagcgtcttggaccagtggaaagccagctttttcgttgaggactttctcgagaagaagactatcactagaatggtgacacagatcaactgcgagtttgaagaagtagtgccgtcttcgaatccagactcccaaattgaggtggaggaggtctccctgtatacacatatggattataacgaggtttttactcctgtatcctgtctggaaaagtgttccgccttacagaaccaaaaccaggatctgttcatcgatgacaaaggcattctgtttgtctcttcccgcaaacaccttcccaccctgcccacattgctaagcagactgaagctgtttttagttaaagaccctttgcttgatttcaagggacagatttttacagaggcaaacttctccagagaatgcttttctttgcaagagacgctagaggcattcgtaaaagaggatttctgcatggacaaggtgaatttttgtcaggagaaattggaagatactatctgtttgaatgagcccagctccttcctcatcgagtacgagttcctcattccaccttctctgaaacccgagatcgatatcccgagcttaagtgaacttaaggagttgctgaatcccgttcctgagataatcaactacgttgatgagaaagagaagcttttcgagcgcgatttaacaaataaacacgggattgaagacataggagacataaaattcagcagcactgaaatcttgactattcagagccagagcgagcctgaagaatgctccaagccgggtgaactggagatgcccctcacccctctgttcctaacctgtcagcacagttccgtgaactccctaagaactgagctgcagacttttccactgagccccgtgtgcaaaatcaaccttctgaccgccgaagaaagcgccaatgaatactatatgatgtggcagctggaacggtgtagaagtcccttaaatccctttctacttactgtaccaaggattcaagagcctcattctcagtactccgtcacggacttgaagaagatcttttcagtaaaggaggagtccctggtcattaatctcgaaaaggccgaatggtggaaacaagccggactgaatctcaaaatgatggaaacgcttgagcacctaaatacatacctctgccatgataatctctcttcaaatgataccaagatagagatcttcctgccgaccaaggtgctgcagctggagagttgtttagagcataagtcccattcaagtccgattgctttaattgatgagaagagcaccaatgcacatttgtccctgcctcagaagagtccctcccttgctaaggaagtccctgatctctgcttttcagatgactacttctctgacaagggggctgcaaaggaagaaaagccgaagaatgatcaggaaccggtgaaccggattatccaaaaaaaagaaaacaacgatcactttgagcttgactgcactggcccatctatcaagagcccgtcgagctccatcataaaaaaagcctcattcgagcacggaaagaagcaggagaacgatttggatttactctcggacttcattatgttaaggaataaatacaagacgtgcacgtccaagactgaagtgactaattccgacgagaagcatgacaaagaggcgtgttcactcactctgcaggaagagtctcccatcgtacacatcaacaagactctggaggaaattaatcaagaacgcggaactgattctgtaattgaaatacaggccagcgactctcagtgtcaggccttttgcttgctagaggctgccgcttcacccatactcaaaaacttagttagcctatgtactctgccaacggccaactggaagttcgccaccgtcattttcgatcagacacgatttctgcttaaagaacaagagaaggtcgtgtcggatgccgtgagacaaggaactatcgacgaacgggagatgacatttaagcacgccgctctcctgcatttgctggtgaccatccgcgacgtcttacttacgtgttccctggacactgctctgggctatttgtcaaaagcaaaagatatctacaactctatcctagggccatatctgggggacatttggcgtcagctggaaatagtgcagtttatccgtgggaagaaaccggagactaactataagatccaagagttacagtgccaaatactgtcttggatgcaaagtcagcagcagatcaaagtattgatcataatcaggatggattctgacggtgagaaacacttcctaatcaaaattttaaacaaaatagaggggctgacacttactgtgctccactctaatgagagaaaagattttctggagagcgagggcgtcctgaggggcacaagtagttgcgtggtcgtccataaccaatatatcggcgctgacttcccctggagtaacttcagctttgtggtggagtacaactacgtggaagactcctgttggaccaaacactgcaaagagctgaatatcccttacatggccttcaaggtgatattgcccgacactgtgttggaaagatccaccctgctggaccgattcggtggattcctccttgaaatacagatcccgtacgtcttcttcgcctctgagggactacttaacaccccggatattctgcagctactagagtctaattataatatctcacttgtggaacgtgggtgctccgaaagcttaaagctgtttgggtcctctgaatgttacgtcgtggttacaattgatgagcacacagccatcattctgcaggacctggaggagctgaattatgaaaaggccagtgacaatattattatgcgtcttatggcgctttcgctccagtatcggtattgctggattatactttacaccaaagaaacattaaattctgagtaccttctcacagaaaagaccctccatcaccttgccctgatctatgcggctctggttagctttggactgaacagcgaggagctcgacgtgaagctaatcattgcgcctggagttgaggcgactgccctgataattcgccagattgcagaccatagcctgatgacatctaagcgagaccctcatgagtggcttgataaatcctggctgaaggtgtcccctagtgaagaggagatgtatctcctggactttccttgcattaacccactggtcgcacagctaatgttgaataaggggccaagcttgcactggatcctgttagccacactgtgccagctgcaggaacttttgccagaggtgcctgaaaaggtgctgaagcacttctgtagcattacctcactttttaaaattggttcttccagcataacaaagtctcctcagatttcatcaccgcaggagaaccggaaccaaatcagcacactgtcatcacagtctagcgcctcggacctggactctgtgatccaggagcacaacgagtactaccagtacttgggtctgggtgagacagtgcaggaagacaagacgacaatcctgaacgataacagcagcatcatggaactgaaggagatatcaagttttctccctccggttaccagttataatcagactagctactggaaagactccagttgcaaatctaatatcggacagaacaccccattcctgatcaacatagaatctagacgacccgcatacaacagttttctgaaccactctgactccgaaagtgacgtgtttagcttgggcctcacgcagatgaattgcgagacaatcaaaagcccaacagacacccagaagagagtctccgtagtgccaaggttcataaactctcagaagagacggacccacgaggcgaagggatttatcaataaggacgtgtctgatcccatcttctcgctggaaggcacccagtccccactacactggaacttcaagaaaaacatttgggagcaggaaaaccacccctttaatttgcagtacggcgcacagcagactgcatgtaacaagctgtactcccagaagggaaacttgtttaccgaccaacaaaaatgcctgtccgatgaaagtgaaggcctgacatgcgagtcaagcaaagacgagactttctggagagaattaccgtcagttccctccctggatctatttcgtgcctccgattcgaacgctaaccagaaggagtttaacagcctctacttttatcagagagcgggaaagagcctgggacagaagcggcatcacgaatcttccttcaattctggggacaaggagtccttaactggtttcatgtgtagccagctgcctcagtttaaaaaacggaggctggcctacgaaaaggtgcccggtagagttgacggacagactcgcctgcggttcttttag

SEQ ID NO: 54819 - DNA, 1467 bp, Artificial Sequence
  Description of Artificial Sequence: Synthetic coding sequence
atgttcagtgcactaaagtaccatgctatcgactatctttacgagaatgtggtcagaaagaagttctacagagacgccctgttactgcgtatcccatcctgcctgtaccaggacgaatcctatcatgtggctgtgaccgataataaatttagaagaccatggactcgggtgtccgctgtaagtgtgccaggaatgactgacaccagtgtcttagaccagtggaaagcttcctttttcgtggaagacttcttggagaaaaaaaccattacacgcatggtgactcagattaattgcgagttcgaagaggtagtcccctcgagtaacccagacagccagatagaagttgaggaggtgtctctctacacacatatggactacaatgaagtatttacaccagtatcttgtttggagaagtgtagcgccttacaaaatcaaaaccaggacctgttcattgatgacaaggggatactgttcgtgtccagcagaaagcatttgcctaccctgcccactctgctttctcgtctgaaactcttcctggtcaaggaccctttactggacttcaagggccagattttcacagaagccaattttagccgggaatgtttcagtttgcaagagaccctggaggcgtttgttaaagaagatttttgcatggataaggtgaatttttgtcaggaaaagcttgaggataccatatgtcttaatgaaccatcaagcttcctcatcgagtatgaattccttatcccaccaagcctaaaacccgaaattgatataccatccctgagtgagctcaaagagctactgaatcccgttcctgaaataattaattatgtcgacgagaaggagaaattgttcgagcgcgatctcaccaataaacatgggatagaagacattggagatatcaagttttcgtcaacagagatcttgacgatccagagccagtcagaacctgaagagtgttctaaacccggtgagcttgaaatgcctctgacccctctattccttacatgccagcattcttccgttaactccctgaggacagagttgcagacattcccccttagcccagtttgtaagatcaatctccttacggccgaggagtctgccaatgaatactacatgatgtggcagttggagcggtgcaggtctcctcttaatccctttctgctgactgtgccgcgtatacaggaaccacactcccagtactccgtaactgatctaaagaaaattttctcggtgaaggaagagtccttggtgatcaacctagagaaagccgagtggtggaaacaggctggactcaacctgaaaatgatggagactttagaacatcttaacacctacttatgccatgacaacctttcgtccaatgacaccaaaatagaaatcttcttgcctaccaaagtgctacaactggagtgcaagtatattaccgtcaatatttcttatgtgaacatcttccgaatgtag

SEQ ID NO: 54820 - DNA, 4335 bp, Artificial Sequence
  Description of Artificial Sequence: Synthetic coding sequence
atgacggacaccagcgtgctggatcagtggaaggcttccttctttgttgaggacttccttgaaaagaagaccatcacccgcatggtcacacagatcaattgtgaatttgaggaggtggtgccgagctcgaaccccgacagccagatagaggttgaggaagtgtctctgtacacacatatggattacaacgaggtgttcactccggtgagttgcttggagaagtgctcagccctgcagaatcagaaccaagatctttttatagacgacaaaggcattctatttgtcagctctcgcaagcacctccccaccctccctaccctgctatctaggctcaagctcttcctggtaaaagacccactcctggatttcaaggggcagatttttacagaggccaacttttccagagaatgtttctctctccaggaaacattggaggctttcgtgaaggaggatttctgtatggataaagtcaatttctgtcaggagaagctggaagacactatttgcctgaatgagccttcatcattcctgattgaatacgaatttttgatacctccctctctcaagcctgagatcgatattccgtccctcagtgagcttaaagagctcttaaacccggtgcccgagattatcaactatgtggacgaaaaagaaaagctgtttgaacgcgatttgacaaacaagcatggcattgaagacatcggagatattaagttctccagtaccgaaattctgaccatacagagccagagcgaaccagaggagtgctctaagcctggggaattggaaatgccattaacccccctgttcctgacatgccaacactcttcagtcaatagtctgaggacagaattacagactttccctctgagccctgtttgcaagatcaaccttttaaccgcggaagaaagcgctaacgaatactacatgatgtggcagctagagaggtgtaggagtccgctgaatccatttttactgaccgtccccagaattcaggagccccactcccagtatagtgtcacagatcttaaaaaaatcttcagcgtgaaagaggaatcactggttataaacctagagaaggctgaatggtggaaacaagcaggactcaacctcaagatgatggagaccctggaacacctgaatacgtacctgtgccatgataatctgtccagcaatgacacaaaaatcgagatcttccttccaactaaagtgctacagctggagtcttgcctggagcataaatcccatagctctccgattgcactgattgacgagaaatccaccaatgcgcacctctctctcccacagaaatcgccttctcttgctaaagaggtccccgacttatgcttctctgatgattacttcagcgataagggagctgcgaaagaagagaaacctaagaatgaccaggagcccgtgaatcgaatcatccagaagaaggagaataacgaccacttcgaactggactgcacaggccctagcataaagagcccctctagttctatcataaagaaggctagctttgagcacgggaagaaacaggagaatgacctcgacctgttgtctgactttattatgctccgcaataagtataaaacctgcactagtaagaccgaggtaacaaacagcgatgaaaaacacgataaagaggcctgtagcctcactctccaggaggagtccccaattgtacatattaacaagacattagaggagataaaccaggagcgtggcaccgattccgtaatcgaaatccaggcgtctgacagccaatgtcaagcattttgcttactggaggcagctgcgtctcccatcttaaaaaatctagtgtcgctatgtaccctgcccaccgcgaattggaaatttgcaaccgtcatttttgaccagacccggtttcttctgaaggaacaggaaaaggttgtgagcgatgccgttcggcaaggtacgattgatgagagggaaatgacattcaagcatgcagctctgttgcacctgctggtgaccattcgcgatgtgctgctaacttgctcactagacacggccttgggctacctgtccaaggcaaaagatatctataacagcatactcggaccctaccttggggacatctggagacagctggaaattgtacagttcataagaggaaaaaaaccggagacgaattacaaaatccaggagctccaatgccagatcctttcatggatgcaatcccagcagcagattaaagtcctcatcattataagaatggacagtgacggagaaaagcacttcctcataaaaatactcaacaagatcgagggtctgaccctcacagttctccactcgaatgaaaggaaggactttcttgaaagtgaaggcgtacttagaggcacttcatcttgtgtggtggtacacaaccagtacatcggcgctgatttcccatggagcaacttctcatttgtagtcgagtataattacgtcgaggatagctgctggaccaagcactgcaaggagctgaatataccatacatggcttttaaggtcattctcccggatacggttctcgagagaagtaccctgctggatagattcggaggctttctgctggagatccagatcccttacgtcttcttcgcgagtgagggcttgctaaacacaccagacatactgcagctcctggagagtaactacaatatctcgctggtcgagaggggatgctccgaaagcctgaagctgtttggcagcagcgaatgctatgtggtggtaacaatagatgaacacactgctattatcctgcaggacctggaagaactcaattatgaaaaagcatccgataacattatcatgagactaatggctctgtctctgcagtaccgctattgttggatcatcttatatacgaaagaaactttaaacagcgagtatctactcacagaaaagaccttgcaccacttggccctgatttacgcagctttagtaagctttgggctgaacagtgaggagctggatgtgaagcttataattgcaccgggtgtcgaagcgaccgcgctgattatccgccagatcgccgaccatagtttaatgacctcaaagcgcgatccccacgagtggttggacaagtcatggctcaaagtctccccctctgaggaggagatgtacctcctggactttccttgcattaacccgctggtcgcccagctcatgttgaacaagggcccatccctgcactggattctcttggcaacactgtgccaactacaggagctactgccagaagttccggaaaaagtcctgaagcacttctgttctataacatcgcttttcaaaataggcagtagtagcatcaccaaatccccccagatatcaagcccacaggagaacaggaatcagattagcaccctgagtagccagtccagcgcttccgacttggattccgtgattcaggagcacaatgaatactatcagtatctggggctgggcgagaccgttcaggaagacaagacgacaatcctgaatgacaactctagcatcatggaactaaaagagatttctagcttcttacccccagtgactagctacaaccagacgagttactggaaggattcctcttgtaagagcaatataggccaaaatacccccttccttattaatattgagagccgcaggcccgcttacaatagttttctgaaccactccgactcagaaagtgatgttttttcccttggacttacccaaatgaattgtgagaccattaaatcccccaccgatacccaaaagcgagttagtgtcgtacctcggttcatcaactcccagaagcgcagaacccatgaggccaaagggtttatcaacaaggatgtcagcgatcctattttctcgctcgaaggaactcagtcgcctctgcattggaacttcaagaaaaatatttgggaacaggagaaccaccctttcaatctgcaatatggggcacaacaaactgcgtgcaacaagctgtatagccagaaagggaatctgttcaccgaccagcagaagtgtttatcagacgagagcgaggggctgacctgtgaatcatccaaggatgaaacattttggcgggagcttccgtcagttccaagtttagacttgttcagggcttccgatagtaacgctaatcagaaggagtttaattctctctacttctaccagagagcaggaaaaagcctgggccagaaacggcatcacgaatcttcgtttaactcaggagataaagagtcgctcactggatttatgtgcagccagctgccacagttcaaaaagagacgcctggcatatgagaaagtgcccggtagagtcgacgggcagacccgactacggttcttttag

SEQ ID NO: 54821 - DNA, 3177 bp, Artificial Sequence
  Description of Artificial Sequence: Synthetic coding sequence
atgatcatctgcctcctgatgacactgaagctgaggtacctacccactaaagtgctgcagctggagtcatgtctcgaacacaaatcccactcttcaccaatagcactcatcgatgagaagtctacaaatgcacacctgagcctcccccagaaaagtccatccctcgcaaaggaagtacccgatttatgtttctcagacgattacttctccgataagggggcagcaaaagaggagaagcccaagaatgatcaggagccagtgaacaggatcatccagaagaaagagaacaacgaccattttgagctagattgcacaggcccaagtatcaagtctcccagtagttctattattaagaaagcgtccttcgagcacgggaaaaaacaggaaaacgatttggatctgttgtctgactttatcatgctgagaaataagtacaagacatgcacaagcaaaaccgaggtgaccaattccgacgagaagcatgacaaagaggcatgcagcctgaccctgcaggaggagtcccctattgtgcacattaacaaaactctggaggagataaaccaggaacggggaacagacagcgtaatcgagattcaggcctctgactcgcagtgccaggcattttgcctgcttgaggcagctgcctctccaatcctgaagaacctcgtttccctgtgtaccttgccgacagcgaattggaaatttgccaccgtcatttttgatcagacaaggttcttgctgaaagagcaagagaaggtggtttcagacgccgtacggcaaggaaccatcgacgagcgagaaatgacctttaaacacgctgccctgcttcacctgctggtgacaatcagagacgtactgctaacctgtagcctggacactgccctggggtacctgagcaaagcgaaggacatctataattccattctcggtccctacctgggcgacatctggagacagctcgagatagtccaattcattcggggtaagaagccggaaacaaattacaagatacaagaactccaatgccagatcttgagttggatgcaatcccaacagcagattaaggtcttaattatcatccgaatggactctgacggcgagaagcattttctgatcaaaatccttaacaagatcgaaggtctgacattgaccgttctgcattcaaatgagcgcaaagatttccttgaaagcgaaggggtgctgcgagggacctcttcatgcgttgtcgtgcataatcagtacatcggcgcagacttcccctggtccaatttctcattcgttgttgaatacaattatgttgaagatagctgttggaccaagcactgcaaagaactcaacatcccatacatggcattcaaggtgattctgccagacaccgtacttgaaaggagcaccctccttgaccggttcggaggctttctcctggagattcaaatcccctatgtgtttttcgctagtgagggcttactgaatacccctgacatcttgcagctactggaatccaactacaacataagcctcgtggagagggggtgtagcgaatcactgaagctgttcggctcctccgagtgctatgtggtcgttactatcgatgaacacacagctattatcttacaggatctggaggaacttaactacgaaaaggccagtgataatatcattatgcggctgatggccctatctcttcaataccgctattgctggatcatactatatacaaaggaaacccttaactctgaatacctcctgactgaaaagaccctgcaccatctagcacttatttacgccgctctggtgtcatttgggctaaattcggaggagttagacgtcaagctgatcatcgctcctggtgtggaagccacagcgcttataataagacaaattgccgaccacagcctgatgaccagcaagagagatccccatgagtggctggacaagagctggctcaaagtgtccccaagcgaagaggaaatgtacctgctagacttcccatgtattaacccattggtggctcagctgatgctaaacaaaggcccatctctccactggatcctcctcgctactctttgtcagctgcaagaattgttacccgaggttccagaaaaggtgctgaagcatttttgttccattacctccctttttaagatcggatcctctagcattacgaaatctcctcagatttctagccctcaagaaaacagaaaccagatctccaccctgtcaagccaaagtagtgcgtctgatttagactccgtcattcaggaacacaacgagtattaccagtacctgggcctgggtgaaaccgtgcaggaagacaagactaccatcctgaacgacaacagtagcatcatggagttgaaggagatctccagctttcttccccctgtgacctcctataaccagacctcctactggaaggacagcagttgtaaatccaacattgggcagaatactccctttctgattaatatcgaatcccgcaggccagcatataacagtttcctgaaccattcagactctgagtctgatgttttttccctgggactgacccaaatgaactgtgaaacaatcaagtcccctaccgatacccaaaagcgtgtctcagtggtcccacgttttattaactcccagaaaaggaggacccacgaggctaaaggctttattaacaaggacgttagtgacccgattttttctctcgagggaactcaaagccccctgcactggaacttcaaaaagaacatttgggaacaggaaaatcaccccttcaacctgcagtacggtgctcagcagaccgcatgcaataaactctacagccaaaaagggaacctcttcacagatcagcagaagtgcctttctgatgagagtgaaggtcttacatgtgagtcttcaaaagacgaaaccttttggagggagcttccctcggtgccctctctcgacctgtttagggcatctgacagtaatgccaatcagaaagagtttaacagtctgtatttttaccagagggctggcaagtcactcgggcagaagcgccaccacgagtcctccttcaactcaggtgataaagagtcactgacaggttttatgtgcagccaactgccgcaattcaagaaaagacggctggcatacgagaaggtccccggtcgcgtcgatgggcagactaggctgcggttcttttag

SEQ ID NO: 54822 - DNA, 4218 bp, Artificial Sequence
  Description of Artificial Sequence: Synthetic coding sequence
atgtctgaaacactgggagacgagttggaaatcctgcgagggaagatgatgcaaagaagaccccgtagcgcggaagtcaaatacttctatttctttaagatcctgctgcggctacgactggccatcctcaagtacctgttcatcgatgataagggcatcctattcgtcagctctagaaagcatctacccacgcttcccactctcctttcccgcctgaagctgtttctcgtgaaggatcctctcctcgattttaaaggacaaattttcactgaagccaacttctcacgcgagtgtttctctctgcaggaaacacttgaggcatttgtgaaagaagatttttgtatggacaaggtgaatttctgccaggagaagcttgaggataccatctgcctgaacgaacctagctctttcctgatcgaatatgaattcttgatccccccatcattgaaaccggagattgacattccttctctgagtgagctcaaagagttgctcaaccctgtccccgagattattaactacgtggacgagaaggagaagcttttcgagcgcgacttgactaacaaacacggtatcgaagatataggagacatcaaattctcgagtaccgaaatcctcaccattcaatcacaaagcgagcctgaggagtgctctaaacccggagagcttgaaatgcccttaaccccattgtttctcacgtgccagcattcatccgtgaattctcttcggactgaactgcagacattcccgttatccccagtgtgcaaaattaacctcctgactgcagaagagtcggcaaatgagtattatatgatgtggcaacttgaacgatgcagaagccctttaaaccccttccttctcacagtaccaagaatccaagaacctcattcccagtactcggtgaccgacctgaagaaaatttttagcgttaaggaagaatctttggtgatcaatctggaaaaggctgagtggtggaagcaagctggacttaatctcaaaatgatggaaaccctcgaacatcttaacacctatctttgtcatgataatctttcttcaaatgatactaagattgagatctttctgcctaccaaggtgctgcagctcgaatcttgcctggagcacaagtcccatagctcccccatcgcgcttatcgatgagaaatccacaaatgcccacctcagcctgcctcagaaatcgccatccctggctaaggaagtgcccgatctgtgcttttccgatgactacttcagcgacaaaggagccgctaaagaggaaaaacctaaaaatgatcaggaacctgtgaatcgtattattcaaaaaaaagagaataatgaccactttgagttggactgtaccgggccaagtataaaatctccttcaagctccatcattaaaaaggcctccttcgagcacgggaaaaaacaagagaatgacctggacctgctgtctgacttcataatgctgagaaataaatacaagacatgtacttccaagacagaggtgacgaactcagacgaaaagcatgacaaggaggcttgctcccttacgctgcaagaggagtccccaatcgtccacattaataaaacactggaagaaataaatcaggagcgtggaacagattccgttatcgaaatccaggccagcgactcccagtgtcaggcattctgtttgctggaagctgctgccagcccaatcctcaaaaacctggtaagcctttgtacactgcccacagccaactggaagtttgcaaccgtgatttttgatcagacccggtttctgctcaaggagcaggaaaaggtcgtcagcgacgccgtccgtcaggggaccatagacgagcgggagatgactttcaagcatgccgctttactgcaccttctcgttaccatacgggacgtacttcttacttgttccctcgataccgcactgggctatctctccaaggcgaaagacatttacaattcaattttaggcccatatttgggagacatttggcggcaactggaaatcgtccagttcattcgtggcaaaaagcctgaaactaactacaagatacaagagctacaatgccaaatcttgtcttggatgcagagccagcagcagatcaaagtgcttattattatcaggatggattctgatggagagaagcattttctcattaagatccttaataagattgaggggctaacgctgaccgtgctgcactcaaatgagcggaaggattttctggaatctgagggtgtgctccgcggaacttctagctgtgtcgtagtccataatcagtacatcggcgcagactttccttggagcaacttctccttcgttgtggagtataactatgtggaggactcttgctggactaaacattgcaaggagctgaatatcccatacatggcgtttaaagtcatattgcccgacaccgtgctggaaagatcgaccctgttggaccggtttggagggtttctcctagaaatccagatcccctatgtattttttgcaagtgaaggactgttgaatacaccagatattctccagttgctggaaagcaattacaacataagcctagtggagcggggttgcagtgagagtttaaaactgttcggctcctctgaatgctacgtagtagttacgatcgacgagcacaccgctataatcctccaagacttagaggaactgaattatgagaaggcctctgataacattatcatgaggctaatggccctgtctttgcaataccggtactgttggatcattctgtatacaaaagagacactgaactcagagtacttgctgactgagaaaacactgcatcacctggctttaatttatgccgcattggtgtccttcgggctcaatagcgaggagctggacgtgaagctcattattgccccaggggtggaagctacagctttgatcatccgacaaatcgctgaccactcactgatgaccagcaagcgggatccccacgaatggttggataagtcttggttgaaggttagccccagtgaagaggagatgtatctgctcgattttccttgcataaatcccttagttgcccagcttatgctaaacaaaggtccttccctgcattggattctgcttgctaccctctgccaactgcaggagctgctgcccgaggttcccgaaaaggttctcaagcacttctgctctatcacctctctttttaaaatcggatccagttccatcacaaaatccccacaaatttcctccccccaggaaaatagaaatcaaatttctacactgtccagccaaagtagtgcctctgacttagattctgtgattcaggaacacaacgaatattaccagtatctcggtctcggggaaacagtccaggaggacaagactactatcctgaatgacaattcttctattatggaactgaaggagattagctcttttctacctccggttactagctacaatcaaacctcttattggaaagattcaagctgtaaatcgaatattggacagaatactccgtttctgatcaacatcgaatcacggaggcccgcttataacagcttcttaaatcattcagactctgagtccgacgtcttctccctgggactcactcagatgaattgcgagaccatcaaatctcctacagatacacaaaaacgcgtgagtgtggtaccacgatttattaactcccaaaaacggagaacgcacgaagcgaagggatttatcaacaaagacgtcagcgaccccatattcagtctggaaggtactcaaagtccactgcactggaatttcaagaagaacatatgggagcaggagaatcaccctttcaacctgcagtatggcgcacagcagacagcgtgcaataaattgtattctcagaagggcaaccttttcacggatcagcagaagtgtctatctgacgagagcgagggcctgacatgcgagtctagcaaagacgaaactttttggcgtgagttgccatctgtcccttcactcgacctctttcgggcatcagactccaacgccaatcagaaggaattcaattcactgtatttttaccaaagagcaggcaagtcactaggacagaagcgtcaccatgagtcctcttttaacagtggagacaaggagtcattaacggggttcatgtgcagccaactaccgcaattcaagaaaaggaggttggcttacgagaaagttcccggacgggtggatggacagaccaggctcagattcttctag

SEQ ID NO: 54823 - DNA, 474 bp, Artificial Sequence
  Description of Artificial Sequence: Synthetic coding sequence
atgtcaagtcagaaaggcaatgttgcaaggtcacgaccacagaaacatcaaaatacatttagcttcaaaaatgacaaattcgataaaagcgtgcagacgaagaaaattaacgcgaagctccatgatggggtgtgtcaacggtgtaaggaggtacttgagtggagggtgaagtattctaagtataaacccctttctaagcctaagaagtgcgttaagtgcttgcagaagacagtgaaggactcatatcacatcatgtgtaggccgtgcgcatgtgagcttgaggtgtgcgctaagtgcgggaagaaggaggatatcgtgatcccactgaataaagagaccgagaaaatcgaacatacagaaaataaccttagttccaaccaccgacgaagttgtaggcgcaatgaagagtctgatgacgacctcgacttcgacatcgacttagaggacacgggaggcgaccatcagatgaactag

SEQ ID NO: 54824 - DNA, 108 bp, Artificial Sequence
  Description of Artificial Sequence: Synthetic coding sequence
atgtcttcacagaagggcaacgtggccagatctaggccacagaaacatcagaatacgttttccttcaagaatgacaagtttgacaagtctgtccagaccaagtgttag

SEQ ID NO: 54825 - DNA, 540 bp, Artificial Sequence
  Description of Artificial Sequence: Synthetic coding sequence
atgtccagccagaaaggtaatgtggcacgctcaagaccccaaaagcaccagaacaccttctccttcaaaaatgataagtttgataagtccgtgcagacaaagaagatcaacgctaagcttcacgacggagtctgccagcgatgtaaagaagtactggagtggcgcgttaagtactcaaagtacaagccactctcgaaacccaagaaatgcgtgaagtgcctacagaagaccgtcaaagactcctatcatattatgtgccgcccttgcgcttgcgagctggaagtctgcgctaaatgcgggaaaaaggaggacattgtgattccctggtccctgcccctgctccccagacttgagtgttctggacgcattctggcccaccataatctgagacttccctgctcaagtgatagccccgcttctgccagtagggtcgcgggtactacaggagcccaccaccatgctcagttgatttttgtgttccttgtggagatgggctttcactacgtggggcaggctgggctggaacttttaacgagctag

SEQ ID NO: 54826 - DNA, 507 bp, Artificial Sequence
  Description of Artificial Sequence: Synthetic coding sequence
atgaatgaggtgaaggagagtctcagaagtatcgagcagaagtataaattgtttcagcagcaacagttgactttcaccgcggcactggaacactgtcgcgagaatgctcacgacaagatcaggccaatctcatctattgggcaggtccagagttatatggaacattactgtaatagcagcaccgacaggcgggtgttgctgatgttccttgacatctgctcagagttgaataagctctgtcagcacttcgaggctgtgcactcagggacgcctgtcaccaataatcttttggaaaagtgcaagactcttgtgtcccagagcaatgaccttagttccctacgtgctaaatatccccacgatgttgtgaaccatctttcctgcgatgaagccagaaaccattacggtggcgtggtttcgctcattcctttaattctcgatctgatgaaagagtggattgcgcatagcgagaaactccctcgaaaggttctgcagcacggaacaacttag

SEQ ID NO: 54827 - DNA, 669 bp, Artificial Sequence
  Description of Artificial Sequence: Synthetic coding sequence
atgaacgaggtaaaggaaagcttgaggagcatcgagcagaagtacaagctttttcagcaacagcagctcacctttaccgcagcacttgagcactgtcgcgagaatgcgcacgacaagatccggcctatatcttccattgggcaggtgcaatcttacatggaacactactgtaactcttccacagaccggagagtgctgctcatgttcctggacatttgctcagaattaaataaactctgccagcattttgaagccgtgcacagcggaacacccgtcaccaacaatctgctggaaaagtgtaaaaccctggtgtcgcagtccaatgatctgtccagcctgcgggcaaagtacccccacgatgtggtcaaccacctcagttgcgatgaagccagaaaccactatggtggcgtagtctctctgattcctctcatcctggatttgatgaaggagtggatcgcccacagcgagaaacttccacggaaggtattgcaacacgtgtcagaaccccaagcgcaccaagaatctacaagaggagctgctagaccagcacaggcgataggcacacagccgagagccacaaaacataaatgtcgccagcttacgaaggccagccttaagccacggggttgtagtaaacccccttggcgaccacccggtggcaaactgtag

SEQ ID NO: 54828 - DNA, 669 bp, Artificial Sequence
  Description of Artificial Sequence: Synthetic coding sequence
atgaatgaagtcaaggaaagccttcggtcaatcgagcagaaatacaagctcttccagcagcagcagttgacattcacagccgcattggaacactgccgggaaaatgctcacgataagattcgtcctatatctagcatcggtcaagtgcagagctatatggaacattactgtaatagctccaccgaccgcagagtcttactgatgttcctggacatctgttccgaactcaacaagctatgccagcatttcgaggccgttcacagtggtactcccgtgacaaacaacctgttagagaaatgtaaaacactcgtgagccaatcaaacgatctcagcagcctgagagctaaatacccccacgacgtcgtgaatcacttgtcttgcgacgaagctagaaaccattatggaggagtggtgtcccttatacctctgatcctcgatttaatgaaagagtggattgcccactctgaaaagctgcctcgcaaagtgctccagcacgtttctgaaccacaggcccatcaagagagcactcggggagccgcacgcccagcgcaggccattggcacccaaccacgggcaaccaagcacaaatgtagacagttgaccaaggcgagtctgaaacccaggggttgttctaagcccccttggcgtcccccaggcggaaaactttag

SEQ ID NO: 54829 - DNA, 234 bp, Artificial Sequence
  Description of Artificial Sequence: Synthetic coding sequence
atggcaagattccagagaacgaaggaacgcgaagaggaccgatgttcactgaatatttactatgtgagaaatacgacccaaggaaccgcacccgcttgtgtcggaaaacgcatgcagcctagccctaccggcaagggtggcaagtgctgtactgtccacggactgactcgaaagatacataatgttcagcctaacctgcagagccccatcctcagtgctgcttgtgtcgactag

SEQ ID NO: 54830 - DNA, 327 bp, Artificial Sequence
  Description of Artificial Sequence: Synthetic coding sequence
atggagctgaacactaatatcaaaagcaaaaaaggcttagggcgacgcaatcttaaaccgatgaatggggcatggcccccagccaggcgcgagatggctcgctttcagaggactaaggaacgcgaggaagaccgatgttcccttaatatctattatgtgcgtaacacaacccaggggaccgccccagcctgtgtcggcaaacgcatgcagccgagccccactggaaaagggggtaaatgttgcaccgtgcacggactgacccgcaaaatccataacgttcaacctaacctacagagtccgattctgagcgcagcctgcgttgactag

SEQ ID NO: 54831 - DNA, 234 bp, Artificial Sequence
  Description of Artificial Sequence: Synthetic coding sequence
atggctcggtttcaaagaacaaaagagagggaagaagatagatgctctctcaacatttactacgtgagaaacactacccagggaactgcacctgcttgtgtaggcaaacgtatgcagccaagtccaaccggtaagggaggtaaatgttgcaccgtccacgggttaaccaggaagattcacaatgtccagcctaacctgcagtcccctatcctttctgccgcttgtgtggactag

SEQ ID NO: 54832 - DNA, 225 bp, Artificial Sequence
  Description of Artificial Sequence: Synthetic coding sequence
taaaatggggcttggccccctgcccgtagggagatggctaggttccagcgcactaaggaacgcgaagaggaccgatgttcattgaatatctactacgtgagaaatacaacccaggggactgctcccgcatgtagccaggggcgttatataatgtatagccggatttattcactgcttttttgccagctcttagtgttgatcaagacatcaattaagatattatag

SEQ ID NO: 54833 - DNA, 3690 bp, Artificial Sequence
  Description of Artificial Sequence: Synthetic coding sequence
atgaacttgaatacatcctcaaacacaggggatactcagaggctgaagattgcttcactagatgtcaagcagatcttaaaaaacgagactgagcttgatataacagacaatttacgcaaaaagctccactgggccaagaaggagaagctggagatcacaacaaagcacaacgcagagctcgcttcatacgaatctcaaattgcgaagttaaggtccgaagtagaaaaaggtgaggcactgcgccagtccctggagtatgacctggcggtagcaagaaaagaggcgggactgggcagaagggctgccgaggagcgcctagcagaggctcaccggatccaggaaaaattgtgcgcccagaattccgagctacaggctaagaccaacgaaacagagaaggcttttcaaacctcccaacagaaatggaaggaggaatgcaggaggttcgagcacgacttggaagagagagacaatatgatccagaattgcaatcgagagtatgatctgcttatgaaggaaaaaagtcgcctcgaaaaaaccctgcaggaggccctcgagaagcatcagagggaaaagaacgagatggaatcccatattagggagaccgctctggaagagttccgcctgcaggaagaacagtgggaagccgagaggcgagaactgcaattcattgtgcaggagcaggatacagccgtgcaaaatatgcataagaaggtcgagaaactggagaccgagcatatggactgctccgatctcctgcggcgtcagacatccgagcttgaatttagtacacagagagaagaaagactgaggaaggagttcgaggctaccactcttcgagtgagaaagttggaggaaaacatcgaggccgagagagctgcccatctggagtcaaagtttaattcagaaattatccagctgcgaattcgagacctcgaaggcgcattgcaggtggagaaagccagccaggctgaggccgtggcagatttagaaattataaaaaatgagttcaaggaggtcgagtctgcgtatgagagggaaaagcacaacgcacaggaatcgtttgcaaaattgaatctgctcgaaaaagagtatttctctaagaataagaaattaaacgaggacattgaggaacaaaagaaggtaatcatcgacttatctaaaaggctgcagtacaacgaaaaatcttgttccgaattgcaggaagagctggtgatggcaaagaagcaccaggccttccttgtcgagacatgcgagaataacgtcaaggagctggagtcaattttagactccttcaccgtgtctggtcagtggaccagcgggatccataaagacaaagataaaccacccagcttttcagtggtcctggaacgccttcgcagaaccctcactgattatcagaataaactggaggatgcttccaacgaagagaaagcctgtaacgagctggactctaccaaacaaaaaattgacagtcacactaaaaacatcaaggagctgcaggacaagctagcagatgtaaataaggaactgtcacatctgcacactaagtgcgcagaccgggaggccctgatatctaccttgaaagtggagctgcagaatgttctccattgttgggagaaggagaaagctcaggcagcccaatctgaatccgaactccagaagctgtctcaagccttccataaggacgctgaagagaagcttaccttcctccacactctttaccaacacctggtggcaggatgcgtactgattaagcagcctgagggcatgctggataagttcagctggtcagagctatgtgctgttttgcaggagaacgttgacgctttgattgccgatctgaatcgcgcaaatgagaaaatacgtcatctggagtacatctgcaaaaacaagagcgacacaatgagagaactgcagcagacccaggaagataccttcaccaaagtggcagaacagatcaaagcacaggaaagctgctggcacaggcagaagaaagagctggaactgcagtattctgaactgtttctcgaggtgcagaagcgcgctcagaaatttcaagaaatcgcggaaaagaacatggaaaagctaaatcacatagagaagagccatgagcaactagtgcttgaaaacagccattttaagaagttactttcccagacacagcgagaacagatgagcctgttggccgcatgtgctctgatggctggggcattataccccctatattctcggagctgtgcgctgagtacacagagagatttccttcaggaacaagttaacactttcgaactgtttaaactcgagattcgcacactggcacaagctctgagtaccgtggaggaaaagaaacaggaagaggctaagatgaagaaaaaaactttcaagggcctgataagaatcttccggaagggggtaattgccgtgctggcagccaaccgtctcaagattctgggtcagtcttgcgccagcctctttacatggatggagtcttttaaggaaggaatcggaatgctcgtctgtactggagaaccgcaggacaagcataaattcccaaagcaccaaaaggagcagctccgctgtttgcaggccctctcctggctgaccagctccgacctcctcgcagctatcatttccagcatggcagaactgcaggacgtgataggaaaggccgatcccaactcacggatttgcgggcacctgctgatcggagctgccaagaattcttttgccaaactgatggacaagatcagtctagtcatggagtgcatcccactgcactccagccggagcataacctatgttgagaaagacagcctcgtgcagaggctagctcatggcctccataaggtcaacaccctcgccctaaagtacggcctaagaggccacgtgcctatcactaagtccaccgcttccttgcaaaagcagattctgggtttcacccagcgcctacatgcggcagaagtcgaacgccgatcactccggctcgaggtgactgagtttaagaggtccgtaaacgagatgaagaaagaattagataaggcccagggccttcagatgcaactgaatgagtttaagcagagtaagttgataacccatgaaaagtttgagagcgcatgcgaggagctcaataacgcattgcttcgggaggagcaggcccagatgctgctcaatgagcaggcacagcagctccaggaactgaattacaaactggagttgcacagctccgaggaggccgataagaaccagactctcggggaggctgtaaaatcactgagtgaagctaaaatggaactccgacggaaagaccagtctctgcgacagctcaaccgtcatctcacacagttggaacaggataagaggcgcttggaggagaatattcatgatgccgaatcggcacttcgcatggctgccaaggataaagaatgtgtagcaaaccacatgcgagctgtggagaataccttgcataaggtgcgggatcaaatctccctgtcctggagtgccgcatctcggaatgactttactctgcagttaccgaaactccacctggaaacctttgctatggaaggacttaaagggggaccagaggttgtggcctgccaggtgcgtgtccagtggtgcgaccacagtagcttgcaatcacagatgccaggcctgaagcaatcgtcatgcctgtctcttctgagcacttag

SEQ ID NO: 54834 - DNA, 411 bp, Artificial Sequence
  Description of Artificial Sequence: Synthetic coding sequence
atgagggccgtagagaataccctccataaggtgagggaccaaatatctctgtcttggtctgcggcttcacggaacgattttactttgcagctgcccaagttgcaccttgagaccttcgccatggaaggcctgaaaggtggccctgaagtagttgcctgtcaagcaatgatcaagagctttatggacgtctaccagctcgcttcaactcggataatgaccctcgagaaggagatgacatctcacagatcacacatagctgctctcaaatctgagcttcatacagcctgtctccgagaaaacgcctccctgcagagtgatacatttattatcagttttcgacgcgacgggtctccctgtagcgattccagcagcattgagtgtgaaacctttccacaggtgatattaatgtag

SEQ ID NO: 54835 - DNA, 1497 bp, Artificial Sequence
  Description of Artificial Sequence: Synthetic coding sequence
atggcgggagccctgtatcctctttattcacgctcttgcgccctgagtactcagcgggacttcctgcaggaacaagtaaacacattcgagctgttcaagctggagattcgcacactcgctcaggccttgtcaactgtggaagagaaaaagcaggaagaggctaaaatgaagaagaagacgttcaaggggcttatccgtattttccggaaaggcgtgatagccgtgttagctgcaaatcgtttaaaaatcctggggcagagttgtgcttccttattcacctggatggagtccttcaaagaaggaatagggatgttagtctgcactggagagccccaggataagcacaaattccctaaacatcagaaggagcagctgagatgtttacaggcattaagctggcttacaagcagcgatctgctggccgcaatcatctccagtatggcagagctgcaagatgtgatcggcaaagctgaccccaatagcagaatctgcggtcatctcctgataggtgctgctaaaaactctttcgcaaaattgatggacaagatctccctggtgatggagtgtatccccctgcacagttctcgatccatcacgtacgttgagaaggatagcctggtccagcgattggctcacgggttacataaggtcaatactcttgccctgaagtacggcttacggggtcatgtgcctatcacaaaatcaaccgcatctcttcaaaaacagatattaggtttcacccagcgtctgcacgccgctgaagtcgagagacggtctctccgactcgaggtgacagaatttaagcggtctgtgaacgaaatgaagaaggagctcgacaaggcccaaggtctgcaaatgcagcttaacgaattcaagcagtctaaactgatcacccacgaaaagttcgaaagcgcatgtgaagaactaaacaatgctttgctaagggaggagcaggcccagatgttacttaacgaacaagctcagcaacttcaggagctgaattataagttggagctgcatagcagcgaggaagcagataagaaccaaactctgggtgaagcagttaaatcactttcagaagctaaaatggagttgcgcagaaaggatcagagcctcaggcaactcaaccgacatctgacacagctcgagcaagacaagcgcagacttgaggaaaatatacatgacgccgaaagtgcgctcagaatggcagccaaggataaagaatgcgttgccaaccatatgagagccgtcgagaataccctgcataaagtccgagatcagatttccctgtcctggtccgccgcatcccggaatgacttcaccctgcaactgcccaaacttcacttagagacatttgccatggagggacttaaaggaggaccggaggttgtagcgtgtcaagtcagggtcagagtccagtggtgcgatcattcctccctgcagagccaaatgccaggactcaagcagtcttcttgcctgtctttactaagcacctag

SEQ ID NO: 54836 - DNA, 3981 bp, Artificial Sequence
  Description of Artificial Sequence: Synthetic coding sequence
atgaacctgaatacttcctctaataccggggacactcagaggctcaagattgcctctttggacgtcaaacagattctgaagaatgagacggaattggatatcactgataacctgcgcaagaaactgcattgggcaaaaaaggagaagctcgagataacgaccaagcacaacgcagagctggcatcttatgaatctcagatcgccaaactgaggagcgaggttgagaagggagaggctctccgccagagtctggagtatgaccttgccgttgcgcgtaaagaggctggcctaggcagacgggctgcagaggagcgcttggctgaggctcatagaatccaagagaagctttgcgcacagaattccgaactgcaggccaaaaccaatgagaccgagaaggctttccagacctcccagcagaagtggaaagaggagtgtcggaggtttgagcacgacctggaagagagagacaatatgatccagaactgtaaccgagaatacgatctgctaatgaaggaaaaaagccggttggaaaagacgctgcaggaggctctggagaagcaccagcgggagaaaaatgaaatggagtcacacatcagggagacagccctcgaggagtttcggttgcaggaagagcagtgggaggcagagcggagggaactccagttcatcgtccaagagcaagacacggctgtgcaaaacatgcacaaaaaagtagagaagcttgagaccgagcacatggactgttctgacttactgcgaagacagacaagtgagctcgagttttcgactcagcgagaggaaagactgagaaaagagttcgaagccactaccctgagagtgcgcaaactggaggaaaatatcgaggctgagcgggctgcccacttggaatccaagtttaactccgagattatccaactgagaattagagacctggagggcgcactccaggtggaaaaagcctcccaggctgaagcagtagcggacctggagatcataaaaaacgagttcaaggaagtagagagcgcttacgagcgggagaagcataatgcacaggagtccttcgcaaagttaaacttgcttgagaaagagtattttagcaagaataagaaactgaacgaagatatagaggaacagaagaaagtgataatcgacctgagcaaaagattacagtataatgaaaagagttgctcggagcttcaagaggaattagttatggcaaaaaagcaccaggccttcctggtggaaacgtgtgagaacaatgtcaaagaattggaatcaattttagattcatttaccgtgtctgggcagtggacctcaggaattcacaaagataaggacaagccaccatcctttagcgtggttttggagagacttcgccgaactctgaccgattaccagaacaaactggaggatgcctctaatgaggagaaggcatgtaacgagttggatagcacaaagcaaaagatagactctcatactaagaacattaaagagttgcaagataagcttgctgatgtgaataaagagctatcccacctccatacaaaatgcgcggatcgtgaggccctcatcagcacacttaaggtcgaactccagaacgtgcttcattgttgggaaaaggaaaaagcccaggccgcacaatcggaatctgaattacaaaagttatcacaggcctttcacaaagatgcagaagaaaagttaacttttcttcacaccttataccaacatctggtggccggatgcgttctcatcaagcagcctgagggaatgttggataagttttcttggtctgagctatgcgccgtcctccaggaaaacgttgatgctttaatcgcagacttaaatcgggctaatgagaagattagacatctggagtatatttgcaagaataagagtgacacaatgagagaactgcaacaaacccaggaggatacttttacgaaggttgccgaacagattaaagcacaagaatcctgctggcaccggcagaagaaagagctcgagctgcagtattctgagctcttcttggaggttcagaaaagagcccagaagtttcaggaaatcgccgagaagaacatggagaagctgaatcacatcgagaagtcccacgagcagcttgtgttagagaactcacacttcaaaaagctactttcccagacccaaagagagcaaatgtccctgctcgcggcttgcgccctaatggctggagccttgtacccactttattctagaagttgtgcactgagcacacagagagattttctgcaagagcaggttaataccttcgagctttttaaactcgagatccggacgctggctcaggctctgtcaacagtggaggagaagaaacaggaagaggcaaagatgaagaagaagactttcaaaggcttaattcgtatttttagaaagggtgtcatcgcagtgcttgctgcaaatagactaaaaattttggggcaatcctgcgcctccctctttacatggatggagagttttaaagaggggatcggcatgctcgtttgcactggcgagccccaggataagcataaattccctaagcaccagaaggagcagcttagatgcctgcaggccctttcttggttaacatcctccgatctgctggctgcaatcattagcagcatggccgagttgcaggacgttattggaaaggctgacccaaactcacgcatctgcggccatttgctaatcggtgctgcgaaaaactcattcgccaagctgatggataaaattagcttagttatggagtgcattccacttcactcatcacggagcatcacttacgtggaaaaagattcactggtgcagagactggctcatgggttgcataaggttaacacccttgctctgaagtacgggctgcggggtcacgtaccgatcaccaaatcaaccgctagcttgcagaaacaaattcttggctttactcaacggctacacgcggctgaagtggagaggcgcagtctgcgattagaagtgaccgagtttaagagatccgtgaacgagatgaaaaaagagctggataaagcacagggcctgcagatgcaattaaacgagttcaagcagagtaaactgattacacacgaaaaattcgaaagtgcctgtgaggaactgaataatgctctgcttcgtgaggagcaagcccagatgctgctaaacgagcaggcccaacagctgcaggagcttaattacaagttggagcttcactctagcgaagaagcagacaaaaatcagacacttggcgaagcggtcaagagtctaagcgaggcgaagatggagcttcgccgtaaagatcagagccttcgccaactgaataggcacctcactcagctggagcaggataaacgcaggctcgaggagaatatacatgatgccgaaagcgctctaagaatggccgctaaggacaaagagtgcgttgccaatcacatgcgcgctgtggagaatacgttacacaaagtgagggatcaaatctccctgagttggagcgccgcatctcgcaatgattttaccctgcagctgcctaaacttcatttggagaccttcgcgatggagggcctgaaaggaggcccagaggtggtggcgtgccaggctatgataaagtctttcatggatgtgtatcagcttgcctcaaccagaataatgacgctcgagaaggagatgacaagtcaccgttcccacatagccgctttgaaatcagaattgcacaccgcatgcctcagagagaacgcgtccctccaatccattggatcccgggatcatagtaacctgagcatcccgtcccgggcacccctgccagccgacacaaccggaatcggcgacttccttccactgaaagcagagttggacaccacatacacattcctcaaggaaactttcattaacaccgttcctcacgccctgacctcaagtcacagtagtccagttacaatgtcggccaacgccaacaggcctacccaaattggcctgtag

SEQ ID NO: 54837 - DNA, 774 bp, Artificial Sequence
  Description of Artificial Sequence: Synthetic coding sequence
tgacataaagtgaatacccttgcactgaagtacggcctgcgaggacatgtgcccatcaccaagagtactgcctctttgcagaaacagattcttggcttcacccagaggctgcacgcggcagaggtggagagaagatccctgcgcctggaggtgacagagtttaagaggagcgtgaatgagatgaagaaagagctggacaaggcccaaggactgcagatgcagttgaacgagttcaagcaaagcaaactgatcacgcacgaaaagttcgaatccgcctgtgaagaacttaataatgctctgcttcgggaagaacaagcgcagatgctgttaaatgaacaggcccagcagctgcaggagctgaactataagcttgaactccatagttctgaagaagcggacaagaaccagaccctaggcgaggccgttaaatccctttccgaggcaaaaatggagctgcggaggaaagatcagagcctgcggcagttaaacagacacttgacacagctagagcaggacaaaaggcgcctggaggaaaacattcacgatgctgagtctgctctgcggatggccgctaaggataaggagtgcgtcgccaaccacatgcgcgcagtcgaaaatacactgcataaggtgagagaccagatttctctgtcttggtctgccgctagcagaaacgattttactctgcagctgcctaagcttcatctggaaacattcgccatggagggcttgaaagggggaccggaagtggttgcctgtcaggtaagagtttag

SEQ ID NO: 54838 - DNA, 1416 bp, Artificial Sequence
  Description of Artificial Sequence: Synthetic coding sequence
tagtttgagctcttcaagctcgaaataagaaccctcgctcaggcactgagtaccgtcgaagagaagaaacaggaagaagcgaagatgaagaaaaaaacattcaagggactcatcagaatcttccggaagggagtcatcgccgtcctggcggctaatagattgaagatccttggtcaatcatgcgctagcctgttcacctggatggaatccttcaaagagggaatcggaatgctggtctgtaccggtgagccccaagacaaacacaaatttcccaaacaccagaaggagcagctgcgatgcttgcaagcactctcctggttaacctcttcagatctgcttgccgcaattatcagctctatggccgaactgcaggacgttataggaaaagcggaccccaactcacggatttgtggacacctgttaataggagcagctaagaattctttcgccaagcttatggacaaaatttctttggtgatggaatgcatccctctgcatagcagtaggagcattacatatgttgaaaaggattcactggttcagcgtctcgcacatggcttgcacaaagtcaacacgctcgcccttaagtatggtttacgcggtcatgtgcccattacaaaaagtacagcgtctctgcagaaacagatcctgggctttactcagcgccttcatgccgcagaagtcgagagacgatctctcaggctggaagtgacagaatttaagagaagcgtgaacgagatgaagaaagagcttgataaagcacagggactgcagatgcagttaaacgaatttaagcaatctaagcttatcacccatgaaaaatttgagtctgcgtgcgaggagctgaacaacgccttgttacgtgaggagcaggcacagatgctgctgaacgaacaggctcaacagctgcaggagttaaactataaattggagcttcacagcagcgaagaggccgataaaaaccagacactgggagaggcagttaagagcctctcagaggcaaagatggaactcagacgaaaagatcaaagcctgaggcagctgaataggcatttgactcagctggagcaggataaacgtcgcctcgaagaaaatattcacgacgcagaatctgccctgcgaatggcagcaaaagataaagagtgcgtagctaatcatatgcgagcagtggagaatacactgcataaggtccgcgaccagattagtctgtcttggtccgcagctagccgaaacgacttcaccttacagctgccaaagctgcatcttgagacatttgcaatggaggggctgaaaggagggccagaggtggtcgcttgccaggtgcgagtgagggtgcagtggtgtgaccactccagcctgcagagtcagatgccagggctaaagcaaagttcctgtctgagtctgctgagtacctag

SEQ ID NO: 54839 - DNA, 954 bp, Artificial Sequence
  Description of Artificial Sequence: Synthetic coding sequence
atgaatctcaataccagcagtaatacaggagatacacagcggctgaaaattgcttcactggacgtgaaacagatcctaaagaatgagactgaactggacattaccgacaatctgagaaagaaactccattgggcgaagaaggaaaagcttgaaattaccaccaagcacaatgccgaactggccagctatgaatcacagatagccaagcttcgatctgaggtcgaaaaaggcgaggctctgaggcagtcactggaatatgatctggccgttgcccgtaaggaagctggcctgggcagacgcgcagctgaggaacggctagccgaggcgcaccggatccaagagaaactgtgcgctcagaatagcgaactgcaggcaaagacgaacgagacggaaaaggccttccagacctctcagcaaaaatggaaagaggaatgtaggcgtttcgaacatgacctcgaggaacgggacaatatgattcaaaattgtaatcgggagtatgaccttctgatgaaagagaagagtcgcttggaaaaaaccttgcaggaagctctagaaaagcatcagagagagaaaaatgaaatggagagccacattagagagaccgcactcgaggagtttcggctccaggaggagcaatgggaggccgagaggagagaactgcagttcatagttcaggaacaagacacggccgtgcaaaacatgcataaaaaagtcgaaaaactggagaccgagcacatggactgctctgatctgctgcgcaggcagacgtctgagcttgagttcagcacgcagagggaggagaggctgagaaaggaatttgaggcgacaacattacgcgtgcggaaactggaggaaaatatcgaagcagagcgtgccgcacacctggagagcaaattcaactccgagattattcaagttaaatgtaagcagattttttggcctgccttttcttag

SEQ ID NO: 54840 - DNA, 600 bp, Artificial Sequence
  Description of Artificial Sequence: Synthetic coding sequence
atgaagacgtttattataggcatctcgggcgtgacaaattccggcaagacaacactcgcgaagaacttgcagaagcatctccccaattgcagtgtgataagtcaagacgatttctttaagcccgagagcgagattgaaaccgacaagaatgggtttttgcagtacgatgtgcttgaggcgcttaacatggagaagatgatgtctgccatcagctgctggatggagagcgcacggcatagcgtcgttagtactgatcaggagtctgccgaagagattcccatcttaataatcgaggggtttcttctctttaactataaaccactggatacaatctggaaccggagctatttcctgacaattccttacgaggagtgcaaacgcagacggagtactagggtctatcagccacctgattcccctgggtatttcgacgggcacgtgtggcctatgtacctgaaataccggcaggagatgcaggacatcacatgggaggttgtttatctcgacggaacaaaatctgaggaggatctgttcttgcaggtttatgaggatttaattcaggagctcgcgaaacagaagtgtctgcaagtcacagcctag

SEQ ID NO: 54841 - DNA, 558 bp, Artificial Sequence
  Description of Artificial Sequence: Synthetic coding sequence
atgggcaaacggaggcatcggcgaggtaacgtgattagctgcgtcacaaacagtgggaagacaaccctggctaaaaatttacagaaacaccttccaaactgctccgttatatcgcaggacgacttcttcaagcccgagagtgagattgaaaccgataagaatggcttcttgcagtacgatgtgctggaagccctgaacatggagaaaatgatgagcgccattagctgttggatggagtctgccaggcatagtgtggtgtctacagatcaggagtccgctgaagagattcctattctgatcattgagggttttctgcttttcaactacaaacccctagataccatctggaataggagctacttcctcacaatcccttacgaggagtgtaagagaaggaggtcaacaagggtctaccagccacccgattcccccggttattttgacggacacgtttggcctatgtatctgaagtatcggcaagagatgcaggatataacttgggaagtggtgtatctcgatggtacaaagtcagaagaggacctttttcttcaagtgtag

SEQ ID NO: 54842 - DNA, 528 bp, Artificial Sequence
  Description of Artificial Sequence: Synthetic coding sequence
atgaagaccttcattatcgggatatccggagtgacaaattcagggaagacgacattggccaaaaatctccaaaagcaccttccaaactgctctgtgatttcccaggatgacttctttaaacctgagagtgagatagagaccgacaagaacggattcctgcaatacgatgtgctcgaggccctgaacatggagaagatgatgtccgcaatatcttgttggatggagtcagcacggcactcagttgtatctacagaccaggaatctgccgaggagatcccgatcttgatcatcgagggctttctcttgtttaactataatacaagggtatatcaacctcccgatagcccaggctacttcgatgggcacgtctggccaatgtaccttaaatacagacaggaaatgcaggatattacctgggaagttgtatacctggatggcactaagtcagaggaggacctgtttctccaagtctacgaggacctcattcaggaattggctaagcagaagtgtctacaggtcacggcctag

SEQ ID NO: 54843 - DNA, 612 bp, Artificial Sequence
  Description of Artificial Sequence: Synthetic coding sequence
atgggaaagcgcaggcaccggagaggaaacgttatatcctgcgtaaccaatagcgggaaaacgacgttggccaaaaaccttcaaaagcatctacccaactgtagcgtgataagccaggacgacttcttcaagcccgaatccgagatcgagacagataaaaatggcttcctacagtatgacgtcctggaggcattaaacatggaaaagatgatgtctgccatcagctgctggatggagtctgccagacactccgtggtgagcaccgatcaggaatcagctgaggagatccccattctcattatcgagggcttcctactttttaactacaagcccttagacaccatctggaatcggtcctattttctaacgatcccctatgaagaatgtaaacgtagaagatccacccgtgtctaccagccccctgacagtcccggatactttgatgggcacgtttggcctatgtatttaaagtatcgacaggagatgcaggatatcacatgggaagtggtgtacctggatgggaccaagagcgaggaagacttgttcttgcaggtgtacgaggatctgatacaggagctggcaaaacagaaatgtctccaggtaaccgcctag

SEQ ID NO: 54844 - DNA, 642 bp, Artificial Sequence
  Description of Artificial Sequence: Synthetic coding sequence
atggagctgcatgatcgcgttctggacgttcagctgtgcgcttgcagcctgcttctgcacctgctgggccagggcatcattgttaacaaggcaccacttgagaaggttccagacttgatcagccaggtgctggctacatacccggctgacggagagatggccgaagcgtcttgcggggtattttggctgctttcactgctcggctgcattaaggaacaacagttcgagcaagtcgtagcgctgctcctgcagtctattagactgtgccaagatcgcgctctgctagtgaacaatgcctatagaggactcgcctccctagttaaagtcagcgagttagctgccttcaaagtcgtggtgcaggaggaggggggatccggcctaagccttataaaagagacttaccagcttcaccgcgatgaccccgaagtcgtcgaaaatgtagggatgttgctggtccacctcgcgtcctacgaagaaattttgcctgaactggtctcctcaagtatgaaagccctactgcaggagataaaggagcggttcacgagctccctggtcagtgactcatctgcgttctctaaaccaggactaccaccgggaggcagcccccagctgggctgcacaaccagcggagggctcgagtag

SEQ ID NO: 54845 - DNA, 2043 bp, Artificial Sequence
  Description of Artificial Sequence: Synthetic coding sequence
atgcttggcccaggttcgaacagaaggagacctacccagggagagagaggccctggctctccaggcgaacctatggaaaagtaccaggtattataccagctgaacccaggggctctgggggttaatctggtcgtggaagagatggaaactaaggtaaagcacgtgatcaagcaggttgagtgcatggatgatcactatgcctcccaagcccttgaagagctaatgcctttgctgaagctccggcacgctcacataagcgtatatcaggagctcttcattacatggaacggcgaaatatcctcactgtacctctgcctggtgatggagtttaacgaactctctttccaggaagtgattgaagacaagcggaaggccaagaaaatcatcgattcagaatggatgcaaaatgtgcttggacaagtcctggatgccctcgagtatctccatcacttggatattatacacaggaatttgaagccctctaacattatcctcatatcctctgatcactgcaagttgcaggatctgagctctaacgttctgatgacagataaagccaaatggaacatccgcgctgaagaggatcctttccggaagagctggatggcgccagaagctctgaatttctctttctcccagaagagcgatatatggagcttaggatgtatcattctcgacatgaccagctgctccttcatggacggcactgaagctatgcacctgcggaagtccttgcgccaatccccgggaagtttgaaggctgtgctgaagacaatggaagagaaacaaatcccagacgtcgaaacatttaggaacctgctgcctttgatgttgcagatcgacccgagtgacaggattacaatcaaggacgtggtccacattactttcctgagaggatcatttaagtcctcctgtgtatccctcacactgcatagacagatggtccctgcttctatcacagatatgctgctagaaggaaatgtggcttctatactggaggtcatgcagaagttttctggatggccggaggtgcagctacgggctatgaaaagattgttgaagatgcccgcagaccagctgggactcccatggcctcccgagctcgtggaggtggttgtgactaccatggagctgcacgatagagtactcgatgtgcagctgtgcgcctgttctctgctgcttcacttgctgggccaggctctcgtgcatcaccctgaggcgaaagccccttgcaatcaagcgatcaccagcacgctcctctccgcccttcaaagccatccagaagaggagcctttgttagtcatggtctattctctgctggccatcacaaccacccaggaaagtgaaagtcttagcgaggaactccagaatgcgggactgcttgagcacattctggagcatctgaacagtagcctcaaatctagggacgtgtgtgcatctgggctcggactcctgtgggctcttcttctcgacggaattatcgtcaacaaggccccattggagaaggtccctgatctcataagccaggtgcttgctacctacccagcggatggcgagatggcagaagctagctgcggggtgttctggttgctgagtctgctcgggtgtataaaagagcaacaatttgaacaagtagtagccctgttgctccagtccatccgcttgtgccaggaccgcgcactgttggtcaataacgcctatcgcggacttgcatcactggtcaaagtaagtgaactcgcagcctttaaagtggttgtgcaagaagagggaggcagcggccttagcttaatcaaagagacatatcagctacatagagacgatcccgaggtggtggaaaacgttggaatgctactcgtccatttggcaagctacgaagagattttgccagaactggtctcctcgtccatgaaggcccttctgcaggagattaaagagcggtttaccagctccctggtatcagactcgtcagcgtttagcaagccgggattgccacctggcggatccccacagctgggctgcacgacgagtggcggactcgagtag

SEQ ID NO: 54846 - DNA, 486 bp, Artificial Sequence
  Description of Artificial Sequence: Synthetic coding sequence
atgctgggaccgggttccaaccgacgcagacccacccagggggaaaggggacccggttctcccggagagcctatggagaaataccaggtactgtaccaactgaaccccggtgcccttggcgtgaatctggtggtggaggaaatggaaactaaagtaaaacacgtgatcaaacaagtcgaatgcatggatgatcactatgctagccaagctctcgaagaattgatgcccctgctcaaactgcgacatgctcacatatccgtctatcaggagctcttcatcacatggaatggcgaaattagctccctgtatctatgcttagtgatggaattcaacgagttgtctttccaggaagtgatcgaagacaagcgcaaagctaaaaaaattatcgatagtgagatcaagaccgagggcgttcctaacactaggcgctttccggtcggcgatcacgactcgagactgttctgccgatcactgaaattcttatag

SEQ ID NO: 54847 - DNA, 906 bp, Artificial Sequence
  Description of Artificial Sequence: Synthetic coding sequence
atgctgtctgaaggttatctgtctggtctggagtactggaatgatatccattggtcttgcgcatcatataacgaacaggtagccggagagaaagaggaagagacaaatagcgtcgccactctgtcatatagcagcgttgatgagactcaggtcaggtcactttacgtgagctgtaagagcagtgggaaatttatcagttccgtgcactccagagagtcccagcattctcggtcccagcgcgtgacagtgctacagacgaaccccaaccctgtgttcgaaagtccaaacctggctgcggttgagatttgcagggacgcgtctcgtgaaacctacctggtacccagcagctgtaagtccatttgcaaaaattataatgacttacagatagcaggaggtcaggtcatggctatcaactccgttaccacagacttcccctcagaatcaagcttcgagtatggtccgcttctaaagtcatccgaaattccattacctatggaggattcaatatccacacagccatcagacttccctcaaaagcctatacagcgctattcttcctactggcgcattacgtctatcaaggagaaatcctccctacaaatgcagaaccccatcagcaatgcggtgctcaatgaatacctcgaacagaaagtcgtggagctttacaagcagtatatcatggacacagtctttcacgattcctctcccactcagatcctggctagtgagctgattatgacttctgtcgatcagatctccctgcaagtgtcccgcgaaaaaaaccttgagacttcgaaggccagagatattgtgttctcaaggctcctccagctcatgtctaccgaaatcacggaaatctccacaccatccctacacatctctcagtattcaaacgtcaatccttag

SEQ ID NO: 54848 - DNA, 2931 bp, Artificial Sequence
  Description of Artificial Sequence: Synthetic coding sequence
atgaacacgcaaaagggaagcctcacaatcaacgtccataggggaagcctcgctatgagcatccagagaggttcactcgtcccgagagatatggacagtagtggacgagatatgcagctgcgtgtgattccagccgaggtcaaatttctcgacactatggctggaagggtgtacaggttacccatcactgtgcacaacatctgcaggtggaatcagaaaatccgcttcaaggaacccgtcaaaccccagtttaaactcatgttaacttccctcgacaaagagctcgcatcaggcctgcagatgacggccatggttgagtatcacccggataaggatgaggacaccttcgaccgtctgctgattagtatagaaaacaagaccacagaaataccgctcattggcttaattccttcatgtcagctcgagattgaaagtgtcgtgaatttcggcactcttgtggccaattcaaaggtgtactcaaaagaaataacaatcaccaaccacggaaaagcccctgggatctttaaggcagaataccatggccagcttcccattttgattttcccaacatccgggatcgtagatgccaagtcatcaatggtgattaaagttgatttctgcgctgatcagcccaggatcgtcgatgaagaagcaatcgtgatactgcaggggcagcccgagatgctcctttccatcaaggcgcatgtcgtagagcagataattgagctcttatccatgagtagcgatcgccgactcgagtgcatccatttcggtcccgtcttcttcggctctagcaagattaagcacgccagggtgtacaataattcgcccgagcctattaattgggtggctatcatacaggatgacgccgtaggcgaggagctgggcacagacatccagcagcgcactgatatcgctcttaacaacctgacttacattcgcaaaattaaaaacattgacaccaccattatcatctcatgcctcccaaacgagggcacccttcaaccatatcagaaaacggtgataaccttttgttttacacctaagctgatggctgttggcaaaaaagatatcggcccttcatatcgccaagattatgccctattcctgaggtttgaaagtgtgggatccaaggacgggttcttgcgtgatgacgactacaagaccatcaagagtgagcggtttcagaaggtggaactagctctgactggaaccggtcttccagtgctgttgcagtttgatcccggtcccgtgttgaacttcaaaccatgtttcatgggcgagagatcagagatacagtgcatcataaaaaaccagtgtgaactgctgccagtgacttaccattttaagaagacggcgaattttgagatagatcccgaaaagggtaagattaccggaggcggaatggtcgacgttatgtgcagcttcgtgccacaccagctgggcgtgttcaaggtcaagcagatgattgaaataatcggcctcgtggctgaagaggacttacagtccctgagtgtcaaatcctttcatcacgtgtacttggccttcaacagcatctgtaaagccagcaccaaaaaggtggtgatgaaattcgatccgggaattttgcccagcatcagaaatccaacggggaagtttgtggttaaggacttggcaaaaaggaagaattacgcccctgttgcaatgctccaaagtgcgatgactcgcactcataaccaccgctcttgcgaggaacctgtaaaagatatgttgctggcattcccaaacgaccgcgctgccacgatcaggtcaaaagaccatcacaagcactttcgtcctatctttactaaagtgcctaggtttaattatgtcaatcacgacttcgcctacacaacgttcgagaaacagcaaaaaaagctgcacgaaaattactacgctatgtacctgaaatacctgaggtctgtgcgcctgcagaaaaaacaggctgagagagaacggatgtactcttacgacgacaccgatatcggcttggaacccggttccgggctgaaaagcccttctctgtccgaggcagaaatcgaggaggagctgtccagcgccgcaaactctatcagggctaacagactgctgacaaccagggggattgcgagccaggaggaggaatctgtgcggcgaaaagtcttgaaaggcctaaaatccgagcctagcaccccccaggagaagcatgactgctcccttatgttgaccccaaaacaaattcaccaggtaatcgtagggccatctgtgcttaatttcggaaacatctgtgtaaactcccccaatacccacctgctgcacgtcatcaacatgcttcctatgcatgttctgttgcagctcgacacagatctcgaggagctccagaaaacaaatcagtttagttacgtcatcttacctactagcagcacctacatatccatggtgtttgacagtcccactatcggaaagttttggaaaagcttcacctttacggtgaataacgtgcccagcggccacatcctggtagtagctgttgtgcagcctgtaaccctggagctgtcctcaaacgagttagtgctccgacccagggggttcttcatgaagacctgcttccggggaacagtaagactctacaaccgacagaattgctgcgctcagtttcagtggcagcccgtcaacaccgggaggggcattgcctttagcatttgcccggcaaaaggaacagttgaggcatacagcagcctggaatgcgaagtgacgtggcagcagggcttctcgtcccctgaagaaggcgagttcatcttacatgtgttccaggggaacgctctgaagctaaagtgtgtggcccacgtaattatatttctggagcacggtttttgcttcgaggggtatgaatttgtgggctacacgcttgtgtacattgtcacttacatatag

SEQ ID NO: 54849 - DNA, 705 bp, Artificial Sequence
  Description of Artificial Sequence: Synthetic coding sequence
tagtctcagaaacttcctgacgtcaaaccctctcccatcaatctgaggaagaaaagcctaacagtgaaggtggatgtaaagaaaaccgttgatactttccgggtggcttccagttacagtaccgaaagacagatgtcccacgatcttgtggccgttggacgaaaatctgaaaactttcaccccgtgttcgagcacttagactcaacacagaataccgaaaacaaacccactggagaatttgcacaggagatcattacaatcatacatcaggtgaaagcaaactacttcccctcaccaggaattactctccacgagcgcttcagcacgatgcaagatatccacaaggcagacgtgaacgaaatccccctcaactccgatccggaaatccatcgcaggattgacatgtctctggctgagctccaaagcaaacaggccgtgatctatgagtccgagcagacactcataaagataatcgatccgaacgacctgcgtcacgacatcgagagacgacgcaaagagcgactgcaaaatgaggacgagcatatatttcatatagcctctgcagccgaacgggatgatcagaacagctcattctctaaggggttagcactgtcacccaggcttgaatgtggggtgaccatcactgcatactgctctctgtatctgcaggactctagttatctcccccctcagcctccagaatag

SEQ ID NO: 54850 - DNA, 1878 bp, Artificial Sequence
  Description of Artificial Sequence: Synthetic coding sequence
atggcaaggagtaggagccgatcacctcgatggaaacaccggagtttatcaccagtgcccaggaatgcagagcattataagcagcgccactcacatggacactatggctgcgaataccgaaaagaccccaagaggcctgttgcctggcgcatggatagcgaaaaacacggccagagcaaaccgaggatcccatcccgcggaaacatctattaccagtcttacgagcataggagcccctctcccaacatacgtaactctctagagaacgtctatatgtacaagccacacagagggtactctcccggacggggagacagtaatagacgcgctcagtacatgcctaaatactccgaagggattccctataaggaacacgagcggaactcctatccgcagaaagtccaagggggtcatagtcctgacgatcaccgcgttcgagggtccggcaagggcggtaagccaccccaacgatcgatagccgattctttcaggttcgaggggaaatggcacgaggatgaactcaggcaccagcgcatacaggaagagaagtactcccagagcactagacgcggatctgaggattttgagaccaggagttccttccagaagcgatacccagaggaccgggacttcagaaaatacggacataccagcaagagacctaaggacgttgagcgctatgaatcacgtgagcctgcccgtaaccccaagtggaagcccgaacacagcctgcccccttaccaggaggacactgatcagtggaacttggggcctcaaacatataggcacgctgagagagagcaccctgagactagctccgccacaaaggtcagctacgactaccgacacaagcgaccaaaactcctggacggagaccaggacttcagcgacggcaggacccagaagtactgcaaggaagaagaccgtaagtactcattccaaaaggggcctctgaatagagaacttgactgttttaacacagggcgtgggagggagacccaggacggtcaggttaaggagcctttcaaacccagtaagaaggactctatagcttgtacgtatagtaacaaaaacgacgtcgacctgcgttcttcaaacgataagtggaaggaaaaaattaaaaaggagggggactgtaggaaagaaagcaattcctccagtaaccagttagacaaatcgcaaaaacttcccgatgttaaaccttccccaatcaacctgaggaaaaagtctctgaccgtaaaggtcgatgtgaagaagaccgtcgatacttttcgggtggcaagctcttacagtacagaacggcaaatgagccacgacctcgtcgcagttggacgaaagtctgagaattttcatcccgtgtttgaacatctggatagcacacaaaacacagagaacaaacccacgggggagttcgcccaggaaataattactataatacaccaggtaaaggctaactactttcccagtccaggtattactctgcatgagcggttttcaaccatgcaggacattcacaaagccgatgtcaatgagattcctttgaattcagacccagaaatccacaggcgtatagacatgtcactcgctgaactgcagagtaaacaggccgttatctacgagtccgagcagaccctgataaagattatcgaccctaatgatttgaggcacgacatcgagcgcaggaggaaagagaggcttcagaatgaggacgagcacatcttccatatcgcctcagccgctgagagggacgatcagaactcctcgttttctaaggggctggccctgtctcccaggctggagtgtggtgtcacaataaccgcctactgctctctctacctgcaggatagctcatatctcccgccacagcctccagagtag

SEQ ID NO: 54851 - DNA, 2049 bp, Artificial Sequence
  Description of Artificial Sequence: Synthetic coding sequence
atggcacggagccgttctagaagcccgcgttggaaacaccgctcactctctccagtccctagaaacgctgagcactataagcaacggcactcgcacgggcactatgggtgtgagtatcgcaaggatcccaagcgaccggttgcctggcgcatggacagcgagaaacatggtcagtccaaaccacgcatcccttcccgcggaaacatctactatcagagctacgagcatcgatccccttcccccaacattaggaacagcctggagaatgtgtatatgtataagccacatagaggttatagtccaggcagaggagattcaaatcgaagagcacagtatatgcccaagtattcagaaggtatcccgtacaaagaacatgagaggaactcttatccacagaaggtgcagggagggcactctcccgatgatcaccgtgtgcggggatctggcaaaggagggaaaccccctcagcggtctattgcggactctttccgctttgagggcaaatggcacgaggatgaattgaggcaccagagaatacaggaagaaaaatatagccaatcaacacggaggggctctgaggacttcgagacccggtcttccttccagaaaagatatccggaagatcgggactttcgcaagtatggccacacttcaaaacgtccgaaagacgtcgagcggtacgagagccgagagcccgctaggaatccaaagtggaagcccgagcattctctgccgccttatcaggaggacacggaccagtggaatttgggtccccaaacctatcgccatgcagaacgggaacacccggagaccagctctgccaccaaggtcagttacgactatagacataagcggcctaaattgcttgatggagaccaagacttttcggatgggcgaacccagaagtattgtaaggaggaagatcgaaagtactcattccagaagggacccttaaatcgggaacttgattgctttaatacaggccgtggcagggaaacccaggacggccaagtaaaggagccattcaagcccagcaaaaaggattctattgcttgtacatattctaataagaatgacgtagatttgcgaagtagtaatgacaagtggaaggagaaaatcaagaaggaaggcgactgcagaaaggaatcaaattcatcatctaaccaactggacaagtcccagaagctccctgacgtaaaaccctcaccgattaaccttcgaaaaaagagcttgactgttaaggtggatgttaaaaaaaccgtcgatacctttcgtgtggccagctcatactctaccgagcggcaaatgtctcatgatctggtggcagtcggaaggaaatcagaaaattttcaccccgtcttcgagcacctggacagcacacagaataccgagaacaaacctaccggagagtttgctcaggaaataattacgattatacaccaggttaaggctaactacttcccatctcccggaattacattgcacgaacggttttctaccatgcaagacatccataaggcagacgttaacgagattccactcaacagcgaccctgaaatacaccggagaatagatatgagtctggcagaactccagtcaaaacaggccgttatttatgagagtgagcagactctgatcaagatcattgaccccaacgatctgcgacatgacattgaaaggcgcagaaaggaaagattgcaaaacgaggatgagcacatcttccacattgccagcgccgcagagcgcgacgatcagaactccagcttttcaaagaattatacaactcagcgcaaggatatcattactcataaacccttcgaggtggaggggaatcacagaaatacacgcgtgcgacccttcaagagtaactttaggggcggaaggtgccagccaaactataagtctggattggtccagaagtcactgtacatacaggcaaagtaccagagactgcgattcaccgggcctcggggttttataacccacaagttcagagagcgcttgatgagaaagaagaaggagtacaccgacgtcgcaactggaatatag

SEQ ID NO: 54852 - DNA, 1467 bp, Artificial Sequence
  Description of Artificial Sequence: Synthetic coding sequence
atgcccaagtacagtgagggcatcccttacaaagagcacgaacgcaactcgtatccccagaaagttcagggagggcattcccccgacgatcacagagttagaggtagcgggaaggggggaaaacctccacagcggagcatcgctgactcttttaggtttgagggaaagtggcacgaagacgagctgaggcatcagagaatccaagaggaaaaatactctcagtcgaccaggaggggcagcgaggattttgaaacaaggagttcatttcaaaagcgttacccggaggacagagattttaggaaatatggacataccagtaagcggcctaaagatgtggagagatacgagagccgagagccggctcggaatcccaagtggaaacctgaacacagtctgccaccatatcaggaggatacagaccaatggaatctggggcctcagacatacagacacgccgaacgggaacatccagagacaagttctgcaacaaaagttagctatgattacagacacaaacggccaaagcttctggacggtgaccaggatttttctgacgggaggacgcaaaagtactgtaaagaagaggataggaagtatagctttcagaaaggtcctctgaatagggaactggattgcttcaacactggtcggggtcgggaaacccaggacggacaagttaaggaacctttcaaaccaagtaagaaggactctattgcttgtacctatagcaacaagaatgacgtagacctgcgtagttccaatgataaatggaaagagaagatcaagaaggaaggggattgtcgcaaagaatctaatagctcctctaaccagctagataagtcgcagaagctgccagatgtcaagccatccccgatcaatctcagaaaaaaaagccttaccgtgaaggtagatgttaagaagaccgtggatactttccgtgtggctagtagttacagcacagagcgacagatgtcccatgatcttgtagcggtgggaagaaagtcagagaattttcaccctgtctttgagcatctggactccacccagaacaccgagaataaaccgactggcgaatttgcacaggagattatcacgattatccatcaggtgaaagctaactactttcccagtcccggtatcaccctgcacgaacgttttagcacaatgcaggacatccacaaggctgacgtgaacgagatccctctgaacagcgacccagagatccacagacggatcgatatgtctttggccgaactacagagcaaacaggccgtgatctatgaaagcgaacagacccttatcaagatcatagacccaaacgacctccgtcacgacatcgaacgcaggcggaaagaacgcctgcagaatgaggacgagcatatctttcacatcgcatctgccgcagagagagatgatcagaacagcagtttcagtaaggtcaatacgagcaagtgtgcgggaatatag

SEQ ID NO: 54853 - DNA, 285 bp, Artificial Sequence
  Description of Artificial Sequence: Synthetic coding sequence
atgggtgcccttttccgattactcttgcaggagcgcggtaaagccgcagagttctactccagggggcgaaaacaaagacgaccttctgcctcctgtacatttggcggaatctggtcaagtggagtagatatgctgcccaatggcgctgtggggagcctgacccagctgggcccttccaggcctgttcttggaattgactacagcaagaaagaattccggggaactgctgagaatgtgacaggcttgaataccattctgcattttcggaagagaacgaggtcatag

SEQ ID NO: 54854 - DNA, 699 bp, Artificial Sequence
  Description of Artificial Sequence: Synthetic coding sequence
atggcagccacatccggaacagacgaaccagtgagcggtgagcttgtcagtgtggcgcacgctctttcattgccagctgaaagctacggcaacgaccctgatatagaaatggcatgggctatgagagccatgcagcacgcagaggtttactacaaactgatttcgtcagtggaccctcaatttcttaagctgacaaaggttgacgaccagatttactccgagtttagaaaaaacttcgagacgctcagaatcgacgtcttggaccccgaggagctcaaatctgaatctgccaaagagcccccaggctacaacagtctgccacttaagcttctaggaacagggaaggcgattaccaagctgttcatatcagtgtttcgcacgaagaaagagcgaaaagaaagtacaatggaggaaaagaaggaactcactgttgaaaagaagcggacacccagaatggaggaacgcaaggaactcatcgtggaaaaaaagaaacgcaaagagagcaccgagaagacaaagttgaccaaggaggagaagaaaggtaaaaagttgacaaaaaaaagcaccaaggtggtgaaaaagttgtgcaaagtgtatagggagcagcattccaggtcatatgattcaattgagactacaagtaccacggttctcctggcccagaccccactggtgaaatgtaaatttctctacaactag

SEQ ID NO: 54855 - DNA, 702 bp, Artificial Sequence
  Description of Artificial Sequence: Synthetic coding sequence
atggcggctacttctggcaccgacgagccagtctcgggtgagctggtttcagtagcccatgccctgagcttgcctgctgaaagttacggaaacgatcctgacatcgagatggcgtgggcaatgcgcgctatgcagcacgctgaggtttattacaagctcataagctcggtggacccccagtttctaaagctgacgaaggttgacgatcagatatattctgagttccgtaagaattttgagactttgaggattgatgtgttggatcccgaggagctgaagtctgaatcagccaaagaaaaatggcgtcccttctgtctgaaattcaatggcatcgtagaagatttcaattatggaacacttcttcggcttgactgtagccagggatatactgaagagaatacgatctttgcgccaaggatccaattctttgctatcgaaatcgcaagaaatcgtgagggttacaataaggccgtatatatcagtgtacaggacaaagaaggtgaaaaaggagtaaacaatggaggggaaaagcgcgcagacagcggagaggaagagaacacgaagaacgggggagaaaaaggagcagactctggagaggaaaaggaagagggtatcaacagagaggataagactgataagggtggcgaaaagggtaaggaagccgacaaggaaattaacaagagcggtgagaaagctatgtag

SEQ ID NO: 54856 - DNA, 354 bp, Artificial Sequence
  Description of Artificial Sequence: Synthetic coding sequence
atgtcagaaaaaaagaactgtaaaaactcctccaccaataataaccagacccaagacccttcgcgcaatgagctgcaggttcctcggagctttgttgaccgcgtcgtccaggacgagagagacgtgcagagtcagagttcctccaccattaacaccctgctcaccctgctagactgtcttgccgactacatcatggagcgggtcggcctcgaagcctctaacaacggctctatgagaaacacctcccaggatcgggagagagaagtggataataaccgggagccacacagcgctgagagcgatgtcactcggttcctcttcgacgaaatgccaaaaagcaggaagaacgattag

SEQ ID NO: 54857 - DNA, 270 bp, Artificial Sequence
  Description of Artificial Sequence: Synthetic coding sequence
atgggagaactcgcagccagtgctaaccatggccatagtccctgttaccccgagcgcaagggaacccctggcgatttgagtaaaagaaaaatgttggtccacttttatcccagacggcactcccatcctcgagccacgcaacagtggatcttaaagaacaaaacgcaggagggtagtcatctccaaacaaagagacgcgttctttccagaccctggatttgctggcaccccgaccttgggttgccggcatccagaaccatgcggaattag

SEQ ID NO: 54858 - DNA, 189 bp, Artificial Sequence
  Description of Artificial Sequence: Synthetic coding sequence
atgggggagctggcagccagcgcaaatcacggtcactcaccctgctatcctgaaagaaaaggtactcccggtgatctttctaagaggaagatgcttgtgcacttctaccctagaagacattcgcatccacgggcaacacagcaatggatcttgaagaataagaccctctgccggaggataaaagagtag

SEQ ID NO: 54859 - DNA, 2757 bp, Artificial Sequence
  Description of Artificial Sequence: Synthetic coding sequence
atcctgatcgcctcagacggctccgtgccactgcctctacagtttctcccgttacagagtggacggtatccctgtaaaatcctgcttaaatcgcgatacgacgttagagcctattacgtagagggcatcgtgaacgaagaacagcccgaggctaaattcgagttcgagactcctgcattcgaagcactgacacaaaatatcccaattaaaaaccagacgaacgataagtggacatttcaagtcacaattgaaggcgagtggttttatgggcctgtggatctccacgtcgggccagatgaaatagttgagtaccccctcacattcaagccaattttcgaatgtgtaatcaccgggaaattaatcctccagaacgaggtggacgggcgtgaacatattttcgatatcaagggtgtcggcaagaagccatcagctctggaacacatcaccgtcgaatgtcaggtagggaatgtgacgcagaagcatatcactcttccacattttacaaacaccgcgctgacattcaaggtaaccgctgatctccccatagtgtggggtaacccccagattacggtatacccgtacaaggagattctgtatctgatccacgtcagaccgtggaagagggggatcctgaaaggaactattactttttccaccacccgcaggtgcactacaagaagaaagcacgacgactacgaggaggatacagaccaagaccaggccctgtcctgcctcgactctatcaccgagcagtccagcatcctggatgatgccgatacgtacggcaactttaacaacctgcgtttctggtataaccttgagatccattccacccccggaccgcctatcgagattatggagatgacgtgcattgccctggactccacctgtattgagatccctcttagcaaccctaaagaccgcggattacatctggaagtgcagctcacatccgcagccttgaacggagacaatgaaatcattctgtcaccactgcagtgtaccaagtatatcgtctggtactcgccagcaaccaccggttattcggatgaatccataatttttcaacctgagatggccgaagaattctggtatcttctcaagctgaccatcgaactacctaagcctacaaccatgccagagatccagtgtgatctgggaaagcacgtgacccagattatccctctggtaaattgcactcatgaaacccttaaacttcaagtcacaaactctaatcctgaaaacttcgtgctggacattaatagaaaaagccagctcataatttcccctcattctaccaccgaactcccagtactgttctacccgagcgccttgggacgggctgaccatcaagcatgcatcaatttctactgcactcaattcacagagtggaagttctacttatcgggggtaggcctatttcctcagccactcgacacagaaaggattaccacacgcatcggcttgcagagtaccatcgtgattccattcaagaacccgaccatggaagacgtgctcatcgatatcatcttgacaagtgtggaacatcctcgtaatttggtgatggaccactgctgggactctttcatctacgagagttctgcctttcggttctcaagtccctccgaaatacagggcatcgctcttcctcccaaagggaatatagatattagccttctcttcattccccagattatgaaattgcacaaaacgatggtaatcatcgagatgacgaaagccaatggaaagtattggcccatcgacaattttgacgaactggacatcaagtttaaatccatcgtcggcattgatagcgaggaaatccaggctatccactggatctacccgatcgttggtctcccccaagccccaccacctaaaagccctcccgttgttattcagtgccaatctcgcaaaagagctgaagagaaggtggaaatcatcctgaacgctggctttttcggtttttccctgacaccagatttaaccgaggtgttggtgatacctaagcgcaattcccacaacttttgcgaggatcccaacgagattcctaaaattcacgagttcgagtacgaaattcagtttgagagcgaggccatgaagtctaagcttgagagctgtgtggcattatacatgatcgaaaaaagctatgacattatggccaaaagaataactttcatttttaatctcgtgtttaccccaaagaagccgttgcggagccatattacgctgaaaatcgagtgtgtgaccgaggggatctggaagtttcccataatgctgatagcaaccgaaccggatactgacgccgtcatcgatatcgaaggtgtgggcctttttaaagagtcagtttttgagctccggcttaagagccaaacccgtaatccagaaccttttacagcacatttccttccaggctctgacctcgaattctttgtaaaacctcaagccggagagctgttgcctttcaataccaacggaaccctgattaccgtcggcttcaaaccaaagatgtattgtcggaagtataaggccacactggtgatccagaccgaggaaatgtactggaaatatgagattaacgggctgacacctaccacagttcctccaaaaaacgctaaagctaagattgacgctacgcataagacacatgataatatgcccgtgaggccacataatttcgtgcgtgagaatacaaagctgatcaggacgggtgtctcgagtacgataaagggagccccactggtgaagaatcaatag

SEQ ID NO: 54860 - DNA, 1902 bp, Artificial Sequence
  Description of Artificial Sequence: Synthetic coding sequence
atggagatgacatgcatcgccctggacagtacatgcattgagatcccactgagcaaccccaaggaccggggactgcacctggaagtgcagctcactagcgcggcactgaacggggataatgagattatcttgagcccgctgcagtgcacgaaatacattgtttggtacagcccagctactaccggatacagcgatgagagcattatcttccaacccgaaatggccgaggagttctggtaccttctgaagttgacgatagagctgcccaaaccaaccactatgcctgagatccagtgcgatctgggcaaacacgtgacccaaatcatccccctcgtgaactgcacccacgaaaccctgaagttgcaagtgaccaattctaatcctgagaactttgtcctggatattaacaggaagtctcagctgatcattagcccccatagcacgaccgaactgcctgtgctgttctaccctagtgcccttggccgagccgatcaccaggcatgtattaacttttattgtacccagtttacggagtggaaattttatttgagtggcgttggattattcccccagccactcgacacagaacgcattaccacaagaatcgggctccagagcaccatagttatcccattcaaaaacccaactatggaggatgtgctcatcgatatcatcttgacctctgttgagcatccccgtaacctcgtgatggatcattgctgggattcgttcatctacgaaagtagcgcttttcggttttcttccccaagcgaaatacagggaatcgcccttccccctaaaggcaatatcgatatcagcctcctgttcatcccacagatcatgaagctacacaagaccatggttattatcgaaatgaccaaggctaacgggaagtattggcctatcgacaattttgatgagctggacataaagttcaagtctatagtcggcattgactcggaggaaatccaggcaattcattggatttaccctatagtcgggttgcctcaggcgcctcctccaaagtctccccctgtagtgatacaatgccaatccaggaagagggccgaggaaaaagtagagattatcctaaatgccggattcttcgggttttccttgacccctgacctaacagaagtgctcgtgattcctaagagaaattctcataacttttgtgaggaccctaatgagatcccaaaaatccacgaattcgagtacgagattcaatttgagtcagaggcaatgaaatcaaagctggagtcctgtgtggcgctgtatatgattgagaaaagctacgatattatggctaagagaattaccttcatcttcaatctggtgtttacccccaagaagccactgagatctcatatcactctcaaaattgagtgcgtgactgaaggcatctggaagtttcctatcatgctgattgcgacggagccggatacggatgctgtaatcgacatagagggagtgggattgttcaaggagtcagtattcgaactgcggttaaagtcccaaacccgcaacccagagccctttaccgcacattttttgcccggaagcgatctggaattcttcgtgaaaccacaggccggtgagctactccctttcaacaccaacggaacactgataaccgtaggttttaaacctaagatgtattgcaggaaatataaagcaacacttgtgatccagactgaggaaatgtactggaagtatgaaattaacggtctgactcccacaactgtccctccaaaaaacgctaaggcaaaaattgatgccacacacaaaacccacgataacatgcctgtgcggcctcataacttcgtcagagaaaatacgaagctcatcaggactggcgtgtcctccacgataaaaggggcacctctggtgaaaaaccagtag

SEQ ID NO: 54861 - DNA, 543 bp, Artificial Sequence
  Description of Artificial Sequence: Synthetic coding sequence
ctggagattcctaaaatccatgaattcgagtatgaaatacagttcgagagcgaggccatgaagtccaagctcgagtcatgcgtggctctgtacatgatagagaaaagctatgacataatggcaaagcgcattacattcatctttaatttggtgtttacccccaagaagccccttcggtcccatatcaccctgaagatcgaatgcgtaacagagggaatctggaagttcccaattatgctgattgccacagagccagataccgatgccgtgattgatatcgaaggagtgggattattcaaagagagcgtattcgaattgcgcctcaaatctcagacacgcaaccccgaaccattcacggctcattttctacctgggagcgaccttgaattttttgtaaagcctcaagccggtgagcttctgccatttaacaccaacggaaccttgataacggtcggcttcaagcctaagatgtattgcagaaaatacaaagctactttggtaatccaggtgagctctataagagctattgccaaggatgtctag

SEQ ID NO: 54862 - DNA, 240 bp, Artificial Sequence
  Description of Artificial Sequence: Synthetic coding sequence
atgtacaggatgaaacgaagccaagtgcgaactcctattaggagactgatcaggaatgtgaatctggactgggaggatagtatggctctgggttgcactaccgtcattgagcgcggaaccttgcgacgcctgaagcgtgcaactctgaatacatttctggactcaccagtgcatgtgttgttagtgatgcccaagctgataccagaacactgggagaagtgggaagatgttaagagatag

SEQ ID NO: 54863 - DNA, 960 bp, Artificial Sequence
  Description of Artificial Sequence: Synthetic coding sequence
atggtgctgtccgaactggccgctagactcaattgtgccgagtacaaaaactgggtcaaagcaggccattgtctccttttgttacgttcctgcctgcagggtttcgtgggacgcgaagtgttaagctttcatagagggctcctggctgccgctcccggtttagggccaagggcggtgtgtcgtgggggtagtagatgctcacccagagccagacagtttcagccacagtgtcaggtatgcgccgaatggaagagagaaattctccggcatcacgtcaatagaaacggcgacgtgcactgggggaattgcagacccggacgctggcctgttgatgcatgggaagttgccaaagcgttcatgcccagggggctcgcagacaagcagggcccagaggagtgtgatgccgttgccttgttgtctctgatcaactcatgcgaccactttgtggtggacagaaaaaaagtgaccgaggtgataaaatgtcgtaatgagattatgcacagttcagagatgaaggtgtctagcacctggctgagagacttccagatgaaaatacaaaatttcctgaatgagtttaaaaacatcccagagatagttgccgtctattcacgtatcgagcagctcctgacaagcgattgggcagttcacatcccagaagaagaccagagagacggatgtgaatgcgaaatgggcacatacctgtccgaatcccaggtgaacgaaatcgagatgcaacttttgaaggagaagctgcaggagatctacttacaggccgaggagcaggaagtactgcccgaagaactcagtaatcggctggaagtggttaaggagttcctccgaaataacgaggatctccgaaacggactcactgaggatatgcagaaactggactcgctgtgcctgcaccagaaactggatagtcaggaaccaggtagacagacaccagacaggaaggcctag

SEQ ID NO: 54864 - DNA, 468 bp, Artificial Sequence
  Description of Artificial Sequence: Synthetic coding sequence
atggtgctgtctgagctcgcagcccgactcaattgtgcagaatataagaattgggtaaaggctgggcactgtttgctgctgctgcggagttgtctccagggcttcgtcggccgagaggtgctatcttttcataggggactgttggcagctgccccaggcttaggaccgcgagcagtttgccgaggcggtagcagatgttctccacgtgctaggcaatttcagccccagtgccaggtctgcgcggagtggaagagggaaatcctccgccaccatgtcaatcgaaacggggacgtgcactggggaaactgtcgaccaggcagatggccagtcgacgcttgggaagtggccaaggggctggatcttctctctaggttggaatgctccggcgaatctgagctgattgctacgctgaactcttgggctcaagccatcctgttgccccaacctctggagtacctcggcctgtag

SEQ ID NO: 54865 - DNA, 603 bp, Artificial Sequence
  Description of Artificial Sequence: Synthetic coding sequence
atgcccaggggtctggctgataaacaaggaccggaagagtgcgatgccgtagctctgctatccttaatcaacagttgcgatcattttgtcgtcgaccggaaaaaagtaaccgaagtgataaagtgtaggaacgagataatgcactcctccgagatgaaagtctcctcaacctggctccgcgatttccaaatgaagatccagaatttccttaacgagttcaagaacataccagaaatcgtggctgtctatagccggattgagcagctactcacttcagactgggcagttcatataccggaggaggatcagagggacgggtgcgagtgcgagatgggcacatatctgagtgaatcccaagtgaacgagatcgagatgcagcttctgaaggagaaactgcaggagatctatctccaggccgaagagcaggaggtgttgccagaagaactctccaaccgtctggaagtggtgaaagagttcctgaggaataacgaagatttgcgcaacgggctcacagaggacatgcaaaagttggactccctctgtttgcatcagaagctggactctcaggaacctggtcgccaaactcccgatcgcaaggcatag

SEQ ID NO: 54866 - DNA, 603 bp, Artificial Sequence
  Description of Artificial Sequence: Synthetic coding sequence
atgccccgtggcctggcagataaacagggtcccgaggaatgcgacgccgtggctcttttgtctctgatcaacagctgcgaccactttgtggtggacagaaagaaggtcaccgaagtgattaaatgccgcaatgagataatgcacagttccgagatgaaggtctcctctacctggttgcgggactttcagatgaaaattcagaattttctgaacgaatttaaaaatattcccgagattgtggctgtttactcccgtatagaacaacttctgacctctgactgggccgtgcacataccagaagaggaccaacgtgacgggtgtgagtgtgaaatgggcacatacctgtctgaatctcaggtgaacgagatcgagatgcaactgctcaaggaaaaactgcaggaaatttacctgcaggctgaggagcaagaagtcttacccgaggagctgtctaacaggctggaggttgttaaggaattcctgcgcaataacgaggatctccgtaacgggttgaccgaggacatgcaaaaactagactctctctgcttacatcagaaattggatagtcaggagccgggtcgccagacccctgacaggaaggcatag

SEQ ID NO: 54867 - DNA, 705 bp, Artificial Sequence
  Description of Artificial Sequence: Synthetic coding sequence
atggtgctcagtgagttagccgcaaggctgaactgcgccgagtacaagaactgggtaaaagcaggtcactgcctgcttcttctgcgctcttgtctgcagggattcgttggcagggaggtcctgtcctttcaccgcggactacttgcagctgcccctggacttgggccaagagctgtttgccggggtggtagtaggtgttcccctcgggctaggcaggtgatcaagtgtcgtaacgagataatgcacagcagcgaaatgaaagtgtcatctacttggctccgggatttccagatgaaaatccagaatttccttaacgagttcaagaatatcccagaaattgttgctgtctacagtcgaattgagcaactgttgacgtcagactgggccgtccatataccagaagaggatcaacgagatggttgcgagtgcgagatgggaacctatttgtccgagagtcaagtcaacgaaatcgagatgcagttactgaaagaaaaactgcaggaaatctatctgcaggcagaagaacaggaggtccttccagaggagctgtcaaatcgcctggaagttgtgaaggaatttcttagaaataatgaggatcttaggaacggtctgactgaggatatgcagaagctcgattccctgtgcctgcaccaaaagttggactcacaggagcctggccgacaaacgcccgaccggaaggcttag

SEQ ID NO: 54868 - DNA, 477 bp, Artificial Sequence
  Description of Artificial Sequence: Synthetic coding sequence
atgaaatttggatgcctgagcttccggcagccgtatgcgggttttgtgctgaatggcatcaaaacagtggagacacgctggcgaccactgctgagttcccaacggaactgtacaatagccgtgcacatagcccatcgcgattgggaaggtgacgcttggcgtgagcttttggtcgaacggttaggcatgacgcctgcacagatccagacactgctgcgcaaaggcgaaaaattcgggagaggggtgattgcaggactggttgatattggagaaacattacagtgcccggaggacctgacgccagatgaagtagtggaactggaaaatcaggcagtgctcacaaatttgaaacagaagtatctcacagttattagcaatcccagatggcttcttgagcccatcccacgcaagggcggtaaggatgtgttccaagtggacatcccggagcacctaattcctctggggcacgaggtgtag

SEQ ID NO: 54869 - DNA, 477 bp, Artificial Sequence
  Description of Artificial Sequence: Synthetic coding sequence
atgaaatttggctgcctgagctttcgccagccttatgcaggctttgtcctgaacggtattaaaactgtcgagactcgatggcgtccacttttgagcagccagagaaattgtaccattgccgtgcacatcgcccaccgagattgggagggtgacgcttggcgggagcttctagtcgagagactggggatgactccagctcagatacaaactctgttgcgaaaaggtgagaagtttggaaggggagtgattgcagggctggttgacatcggagaaacattgcagtgcccagaagatttaacacctgatgaggtagtcgagctagagaatcaggccgttctgacaaacctgaagcagaagtatctcactgttatttctaaccctaggtggctgctggagccgattcctaggaagggcggtaaggatgtgtttcaggtagacatcccagaacatcttatcccattgggacacgaggtgtag

SEQ ID NO: 54870 - DNA, 477 bp, Artificial Sequence
  Description of Artificial Sequence: Synthetic coding sequence
atgaaattcgggtgtttgtcattcagacagccttacgccggattcgttctgaatggaataaaaacggttgaaactaggtggaggcccctcctctctagtcaacggaattgtaccatcgcagtacacattgcccatcgggattgggagggcgatgcctggcgggaactccttgtggaacgactaggaatgacccccgcacagattcaaacactgttaagaaaaggcgagaagttcgggcgaggcgtcattgccggactggttgacatcggcgaaacccttcaatgcccagaggatttaacgcctgacgaagtcgtggagcttgagaaccaggctgttcttaccaatttgaagcaaaaatatctcacagtgatcagtaaccctagatggctgctagagcccatccccagaaaaggcggtaaagatgtgtttcaagtggatattcccgagcacctcatccctttgggacatgaagtctag

SEQ ID NO: 54871 - DNA, 477 bp, Artificial Sequence
  Description of Artificial Sequence: Synthetic coding sequence
atgaaattcggttgcttgtcctttcggcaaccgtacgcaggattcgtgctgaacgggatcaaaacggtagaaaccaggtggagaccactgctttcctctcaacgtaattgcacaatcgccgtgcacattgcccaccgcgactgggagggagatgcctggagagagctccttgtggagcgactgggcatgacccctgcccagattcagacactcctgaggaaaggcgagaagttcggtcggggtgtgattgcgggacttgttgatatcggcgagactctccagtgcccagaagacctcacacccgacgaggtagtggaattagaaaaccaagcggtgctgactaacctgaagcaaaagtatctcactgttatctctaatcctcgatggttgttggaacccatccctcgcaagggcggtaaggacgttttccaggtagacatccctgagcatctaatccctttagggcacgaggtgtag

SEQ ID NO: 54872 - DNA, 93 bp, Artificial Sequence
  Description of Artificial Sequence: Synthetic coding sequence
atgaagttcggatgcttgagtttccgccagccctatgccggattcgtgctcaatggaataaagaccgtcgaaacccgctggcgcccattgtag

SEQ ID NO: 54873 - DNA, 477 bp, Artificial Sequence
  Description of Artificial Sequence: Synthetic coding sequence
atgaaattcggctgcctcagcttcagacagccgtacgcaggtttcgtccttaacggcatcaaaaccgtggaaacgcgttggcgtccattactatcttcccagcgcaactgcacgattgcagtgcatatcgctcatcgggactgggaaggagatgcctggcgggagctgcttgtggagagactgggcatgactcccgcacagattcagacgctgctccgaaaaggcgaaaagttcggtcggggtgtgatcgccggactcgtggacattggagaaactttacagtgccctgaagacttgacgcccgatgaagtggtggagttagagaaccaagccgtcttaacaaacctcaaacagaagtatctgaccgtaatctccaaccccaggtggctgcttgagccaatccctcgtaaaggtggcaaggatgtgttccaggtagatatccccgagcaccttatacctctcggtcatgaagtatag

SEQ ID NO: 54874 - DNA, 477 bp, Artificial Sequence
  Description of Artificial Sequence: Synthetic coding sequence
atgaaattcggctgtctatcattccgccagccctacgccggattcgtattgaatgggatcaaaaccgttgagacaaggtggcggccactcctcagcagtcagcggaactgcaccattgctgtgcacatcgcccacagagactgggaaggtgacgcatggagggaactgcttgtggagcgccttggcatgacgcccgctcagatccagacgctgctccgcaaaggggagaaatttggacgcggagtgatcgccggtctcgttgacatcggcgaaactcttcaatgccccgaagaccttacccctgacgaagtcgtggagctggaaaaccaggcggtgctgacaaatctcaaacagaaatatctgaccgtgatttcaaatcctcgatggctactcgaacctatccccagaaagggcggaaaagatgtatttcaggtggatattccagagcacttgatcccgctcggacatgaggtgtag

SEQ ID NO: 54875 - DNA, 441 bp, Artificial Sequence
  Description of Artificial Sequence: Synthetic coding sequence
atgaagttcggctgcttgtccttcaggcagccatatgctggcttcgtactcaatgggataaagacagtagaaacaaggtggagaccactgctatcctcccaaagaaattgcactattgcagttcacatcgcacacagagactgggaaggcgacgcttggcgcgagcttctggttgaaaggttgggaatgacccccgctcagatccaaaccctcttgcgcaagggtgaaaaatttggccgaggtgtcatagcaggactggtagatataggggaaaccttgcaatgtcccgaggatttaacgcctgatgaggtcgtcgaactggaaaaccaggccgttctgactaacttgaagcaaaagtacctcactgtaatttcaaacccaaggtggctcttagaacccatacccaggaaagggggaaaagacgtctttcaaaacccctag

SEQ ID NO: 54876 - DNA, 477 bp, Artificial Sequence
  Description of Artificial Sequence: Synthetic coding sequence
atgaagtttggttgtttgtctttcaggcagccctacgctggcttcgtgctgaacggaatcaagacagtggagacaaggtggcgccctctgttgtccagccagcgaaactgtacaatcgccgttcacattgctcaccgagattgggagggcgacgcatggcgtgagttgcttgtcgaacgtttaggcatgacaccagcccagatccaagccctgctcaggaagggtgaaaaattcggacgaggcgtcattgccggattagtggacatcggcgagacccttcaatgccctgaggacttgactccagacgaggtggttgagctggagaatcaggctgtgctgacaaatttaaagcaaaagtacttgaccgttattagcaatccccgttggttgctggaacctatccccagaaaaggcggaaaagatgttttccaggtagatattcctgaacaccttatacccctcgggcacgaggtttag

SEQ ID NO: 54877 - DNA, 477 bp, Artificial Sequence
  Description of Artificial Sequence: Synthetic coding sequence
atgaagttcggatgtcttagtttcagacagccctacgccggttttgttttgaacggcatcaagacagttgagacacgctggcggcctctgctttcttctcagagaaactgtacaatcgccgtccatattgcacatagggattgggagggggacgcctggcgggaattattggtggaacggttagggatgactccagcccagatacaggccctcctgcgcaaaggggagaagttcggtcgaggagtcattgctgggctggttgatatcggagagacattacaatgtcccgaggatctaacacctgacgaggttgtggagctagaaaaccaagcagtcttgaccaatctcaaacagaaatacttgactgtgatctctaacccccgatggctgttagaacctattcctcgaaagggaggtaaggatgtatttcaggtagatatcccagagcacctgattccattaggccatgaagtatag

SEQ ID NO: 54878 - DNA, 477 bp, Artificial Sequence
  Description of Artificial Sequence: Synthetic coding sequence
atgaaatttggctgcctgtcctttaggcagccttatgcagggttcgtgctgaacggcattaaaacagtggagactcgctggagacccctcctgtctagccagcgcaactgcacaatcgctgtgcatatcgcccatagagactgggagggggatgcctgcagggagctcctcgtggagcgccttggaatgacacctgcacagatccaagcactcctcaggaagggggagaaatttgggagaggagtgatcgccggactcgtagatattggggaaaccctacagtgcccggaggacctgacgcccgatgaggttgtagagctggagaatcaagccgcactaacaaacctgaagcaaaagtatctcactgtgatcagcaacccgagatggttgctcgagcccatcccacgaaagggtgggaaggacgtgtttcaagtggacatccccgaacacttaatacctctggggcatgaggtctag

SEQ ID NO: 54879 - DNA, 477 bp, Artificial Sequence
  Description of Artificial Sequence: Synthetic coding sequence
atgaaatttggatgtctttccttcagacaaccatatgccggtttcgtcctgaatggtattaaaacggtggagactcggtggcggcctttgctgtcttcacagcggaactgcaccatcgctgttcacatcgcacatcgcgattgggagggcgatgcttgtcgggagctgttggtggagcgtcttgggatgactcctgcgcagattcaggctctactacgtaaaggggagaagttcgggagaggtgtcatagcaggtctggtcgacataggggagacacttcagtgccccgaagacttgaccccagacgaagtggtggaacttgagaaccaagcagcattaacaaacctgaagcagaaatatctcacggtcatatcaaaccctcggtggttactagagccaattccacggaaggggggaaaagacgtgtttcaggtcgacatccccgaacatctcatcccactgggccatgaggtttag

SEQ ID NO: 54880 - DNA, 477 bp, Artificial Sequence
  Description of Artificial Sequence: Synthetic coding sequence
atgaagtttggatgtctgtcttttcggcagccttacgccggatttgtgctgaatggcattaagactgtggagactcgttggcgcccactgctgtcaagtcagcggaattgcacaattgcagtacacattgcccacagagattgggagggagacgcctgccgcgagctgctggtggagaggttgggaatgactccagctcagattcaggccctcctgaggaagggcgaaaagttcggtaggggagtcatcgctggcttagttgacatcggagagaccctgcagtgccccgaagatctgacccctgatgaggtggtcgagctggaaaatcaggctgccctcacgaacttgaaacagaaatacctgacggtgattagcaaccccagatggcttttagaacccataccacgcaaggggggaaaggacgtatttcaggtagacattccagagcacctgatccccttaggccacgaggtgtag

SEQ ID NO: 54881 - DNA, 441 bp, Artificial Sequence
  Description of Artificial Sequence: Synthetic coding sequence
atgaaattcgggtgcctttcttttcgtcaaccgtatgccggtttcgtgctgaacggcatcaagaccgtggagactcgctggcgtccattactttcctctcagcggaattgcaccatcgccgtgcatattgctcaccgggactgggagggggatgcttgtagggaattgctagtggagcggctcgggatgactcctgcacaaatccaggccctccttcggaagggtgaaaagtttggacggggtgttatagcaggtctggtggatattggggaaactctgcaatgcccagaagatctgacacccgatgaggtagtggagttagaaaaccaagccgcacttactaacctcaaacaaaaatatcttacagtcattagcaaccccagatggctccttgagccaattcccaggaaggggggaaaagacgtattccaaaacccatag

SEQ ID NO: 54882 - DNA, 477 bp, Artificial Sequence
  Description of Artificial Sequence: Synthetic coding sequence
atgaagtttggctgtctatccttccgccagccatatgcaggatttgttctcaacggtattaagacagttgaaacgaggtggagacctctgcttagctcacaacgtaactgcactatagcagtgcacatcgcacatagggactgggagggggacgcttgccgcgaactcctggtggaacgattaggtatgacacccgcacaaatccaagctctgctacgcaaaggggaaaagtttggcaggggggtcattgctggccttgtagacattggcgaaacgttgcagtgccctgaggacctgacaccagacgaagtcgtcgaactagaaaaccaagcagcattgactaatctgaagcagaagtacctgaccgtgattagtaacccacgatggttgctcgagcctattccaaggaagggaggtaaggatgtgttccaggtagacatcccagaacacttgatccccttaggccacgaagtgtag

SEQ ID NO: 54883 - DNA, 645 bp, Artificial Sequence
  Description of Artificial Sequence: Synthetic coding sequence
atggaatcagagaatatggacagcgaaaatatgaaaactgagaacatggaatcccagaatgtggatttcgagagtgtcagttccgtgactgccctggaggccctctccaaacttctgaatccagaggaggaagatgattcagactacgggcagactaatggtttatccaccataggcgctatgggccctggcaacattggccctccccaaatagaggagctgaaggttatcccggaaacctctgaggaaaataacgaggatatctggaacagtgaagaaatacccgaaggcgcagagtacgatgatatgtgggatgtacgtgaaattcccgaatacgagattatttttcggcaacaggtaggcaccgaggacatcttcctgggtctcagtaaaaaggactcaagcactggctgctgctccgaattggtcgccaaaattaagctgccaaacaccaacccatctgatatccagatagacatacaggaaactattttagatctgaggactccccaaaaaaagctactgatcacattgcctgaactcgtggagtgcacatctgcaaaggctttctatatccccgagacggagacattggaaattaccatgacgatgaaaagggaactagacattgccaacttcttttag

SEQ ID NO: 54884 - DNA, 645 bp, Artificial Sequence
  Description of Artificial Sequence: Synthetic coding sequence
atggaatccgagaacatggactcggagaacatgaaaactgagaacatggagtctcagaatgtggacttcgaaagcgtcagttcagtgaccgcactcgaagccctaagcaaattactcaaccccgaagaggaagatgattccgactatgggcaaaccaatggattaagtacaatcggggctatgggtccaggcaatattggtcccccacaaatcgaggagttgaaggtgatccccgagacgtcagaggagaataatgaagacatttggaatagtgaggaaattcctgagggtgcggaatatgacgatatgtgggatgtgagggagatccctgagtatgagatcatattcaggcagcaagtgggcaccgaagacatttttctgggcctgagcaaaaaagattcaagtactgggtgttgtagtgaactggtagctaagataaagttgcctaatacaaaccccagtgacatccaaattgacattcaagaaaccattctggacctgcgcaccccacaaaagaagttgctgattaccctgcccgagctggtggaatgtacgtccgcaaaggccttctatattccggaaacagaaacgctcgagatcacgatgacaatgaaacgcgaattggatattgcgaacttcttctag

SEQ ID NO: 54885 - DNA, 645 bp, Artificial Sequence
  Description of Artificial Sequence: Synthetic coding sequence
atggagagtgaaaatatggattccgagaatatgaaaaccgaaaatatggagagccagaacgtcgacttcgagagcgtaagtagcgtgacagcactggaggcactcagcaaactattaaaccctgaggaggaggatgattcagactatgggcaaaccaatggcctcagcacaattggggcaatgggaccgggtaatattgggccacctcaaatagaggagctgaaggtgatcccggaaacctccgaagagaataatgaggatatctggaacagtgaggaaatccctgaaggggcagagtatgatgatatgtgggatgtgcgtgagatcccagagtacgaaatcattttccgacagcaagtgggcaccgaggatattttcctgggcctctcaaaaaaggactcatctaccgggtgctgtagcgagttagtggcgaaaatcaagctgccaaataccaatccctctgatattcagatcgacatccaggaaacaatcctagatcttaggactcctcaaaagaagttattaatcaccttgccagaactggttgaatgcacttcagccaaggcgttctacattccggagacggagacccttgaaatcaccatgacaatgaaacgcgagctggatatcgccaactttttctag

SEQ ID NO: 54886 - DNA, 795 bp, Artificial Sequence
  Description of Artificial Sequence: Synthetic coding sequence
atgctacgattactgagacttgctcttgcattctacggccgaaccgcggatcccgctgagcgacagggccctcaacagcaggggttgcctcagggcgacacccagctcaccaccgtacagggcgtggttactagtttttgcggggactacggcatgatcgacgagtctatatacttctcaagtgacgtggtgaccggtaacgtgcctctgaaggtgggacaaaaggtgaatgtagtcgtagaggaggacaaaccccactatggccttcgagctatcaaggtcgatgtggttccgagacacttgtatggcgcagggccaagtgatagcggaactagagttctaattggctgtgtgaccagtatcaatgaagacaacatctatatatccaatagcatctatttttcgattgccatcgtcagcgaagatttcgtcccgtacaagggggacctgttggaggtggaatattccaccgagcccggtatttccaatatcaaggcaacaagtgtcaagccaataaggtgtatacatactgaggaggtctgtattaccagtgtgcacgggcgaaatggcgtgatcgactacactatcttttttacactcgactctgtaaagctgcccgacggctatgtgccccaggttgacgacatcgtcaacgtggtcatggtggaaagcatccagttctgcttcatctggcgtgcaatcagcattacacctgtgcacaagtccagcagtggatttcaggatgatgggggactggggaggccaaaaagggaaaggcggtcccagagcatatag

SEQ ID NO: 54887 - DNA, 729 bp, Artificial Sequence
  Description of Artificial Sequence: Synthetic coding sequence
atgctcaggctgttgaggctcgccctggcattctatggacggacggccgatccggcagagagacagggccctcagcagcaaggcttgcctcagggcgacacccagctcaccaccgtccagggggtggtaacaagtttttgcggcgactatggcatgatcgatgagtcgatctactttagcagcgacgtcgtgacagggaacgtgccactaaaagtggggcagaaggttaacgtggttgtggaagaagataagcctcattacggcttgagggccatcaaagtcgatgttgtcccccgtcacctctacggcgctgggccttctgactccgggacacgggtgctgataggctgcgtgacgtcgataaatgaagataacatttacatctccaactccatctacttttctattgcaatagtctcggaggattttgtaccttacaagggagatctgcttgaagttgagtattcaacagaaccaggaatctccaatattaaggctacatcggttaagccaataagatgcatccacacagaggaggtctgcattactagcgttcacgggcgaaatggagttattgactatactattttcttcacactggacagcgttaaacttccagatggctacgtaccccaggtggatgatatcgtgaacgtggttatggtcgaatcaatccagttctgtttcatttggcgagcaatctcgattacgccagtgcataagtcgtag

SEQ ID NO: 54888 - DNA, 522 bp, Artificial Sequence
  Description of Artificial Sequence: Synthetic coding sequence
atgcgtccacgcgacaggtcgcgcgtcattgacgccgctaagcacgcccataaattttgcaatactgaggatgaagagacaatgtacctgcggaggcccgaagggatagaaagacagtaccggaagaaatgcgccaaatgtgggctacctctcttctaccagtctcaaccaaagaatgcgccagtgacatttatagttgatggggctgttgtcaaatttggacaaggcttcgggaaaacaaatatttatacgcaaaagcaggagcccccaaagaaagttatgatgacgaagcgaaccaaagatatgggcaagttttcttctgtaactgtgtcaacaatcgatgaagaggaagaggagatcgaagccagagaggtagcagacagctacgcgcagaatgcaaaggtcatcgagaaacagctggaaaggaagggaatgagcaaacggaggctgcaggagctcgcagagctagaggccaaaaaggcgaaaatgaagggaaccttgatcgacaaccagtttaagtag

SEQ ID NO: 54889 - DNA, 669 bp, Artificial Sequence
  Description of Artificial Sequence: Synthetic coding sequence
atgccaaaggtggtgagtcgttccgttgtgtgttccgacacccgcgatcgcgaggaatatgatgacggggaaaaaccgcttcatgtatattactgcttgtgtggacaaatggttctggtcctagactgccagctggagaaactgccaatgaggcctcgtgacaggagcagagtcatcgatgcagccaaacatgcacacaagttttgtaatacagaggacgaggaaaccatgtatctgaggagacctgagggcattgagaggcagtatcgcaagaagtgtgcaaaatgcggcctgcctttgttctatcagtcccaaccgaagaatgctcccgttaccttcatcgtggacggggctgttgtgaaattcggccagggatttggcaaaacaaatatatatacccaaaagcaagaacccccaaagaaggttatgatgaccaagagaacaaaggacatggggaaatttagcagtgtaactgtctctaccatcgacgaggaggaagaagaaattgaagcacgcgaggtcgccgattcttacgcacaaaacgcgaaagtcatagagaaacagctggagcgcaagggaatgagcaaacggaggctccaggagctggccgagctagaggccaaaaaagcaaagatgaaaggcacgctgatagataatcagttcaagtag

SEQ ID NO: 54890 - DNA, 669 bp, Artificial Sequence
  Description of Artificial Sequence: Synthetic coding sequence
atgccaaaagtcgtaagtcgcagtgtggtatgttctgacacccgcgatcgagaggagtatgacgatggcgaaaagccattgcatgtctattactgcttgtgcgggcagatggtgcttgtgctcgattgtcaactcgagaagctcccaatgcgcccaagagataggagtagagtgattgacgcagccaagcacgcccacaaattctgcaacactgaggacgaggaaaccatgtatcttaggcggcctgagggcatcgagagacaatataggaagaagtgtgccaagtgcggactccccctattctaccagtcacagccgaaaaacgccccagttacttttatagtggacggagccgtagttaaattcgggcagggttttggtaagaccaatatctacacacaaaagcaggagcctcccaagaaggtgatgatgacgaagagaacgaaagatatgggtaaattttctagcgttacggtgagcactatcgacgaagaggaagaggagatcgaggctcgcgaggtggctgattcatatgcacaaaatgctaaagtaatcgaaaaacaactcgaaagaaaagggatgtcaaaacgcaggttgcaagagctggcagagctagaagctaagaaggccaagatgaaaggcacactcatcgacaaccagttcaaatag

SEQ ID NO: 54891 - DNA, 669 bp, Artificial Sequence
  Description of Artificial Sequence: Synthetic coding sequence
atgccaaaagtggtcagcagatctgtggtctgcagcgacacacgggatagggaagagtatgatgacggggagaaaccgttgcacgtgtactactgcttgtgtgggcagatggtgctggtgctggactgtcagctggagaaattaccgatgaggccccgtgacagaagtcgggtgatcgacgcagccaagcacgcccacaagttctgcaacaccgaggacgaagagaccatgtatctgaggaggcctgaaggcatagagaggcaatatcggaagaagtgcgctaagtgcggattacctttgttctatcaatctcagcctaagaacgcacccgtgactttcatcgtcgacggggctgtggtgaagttcggccaaggctttggcaagaccaacatatacactcagaaacaggagcccccaaaaaaggtgatgatgacaaagagaacaaaagacatggggaagttctctagcgtcaccgtttccaccattgatgaggaggaagaggagatcgaagcaagagaggtcgcggactcttacgcacagaacgcgaaagtcatcgagaagcaactggaacgtaaagggatgtcgaaacggagactccaggaacttgcagaactggaagccaagaaggctaaaatgaagggcactcttatcgataaccaattcaaatag

SEQ ID NO: 54892 - DNA, 627 bp, Artificial Sequence
  Description of Artificial Sequence: Synthetic coding sequence
atgccaaaagtcgtgagtagaagcgtggtttgctccgatacgagagaccgcgaggagtacgacgacggagaaaaacctctgcacgtgtactactgcctgtgcggacagatggttttggtccttgactgccagcttgaaaagctgccaatgcggcctagggatcgatctagagtgattgatgccgctaagcatgcacataaattctgcaataccgaggacgaggagacaatgtatctgcggcgatgtggattacctctcttctaccaaagccagcctaagaacgccccagtcacatttattgtggacggggctgtcgtgaaattcgggcagggctttggcaaaactaacatttacacgcagaagcaggagcctccaaagaaggtcatgatgaccaagagaacaaaggatatgggcaaattctcttcagtcactgtctccacaatcgacgaagaagaggaagaaatcgaagccagggaagtggccgattcatacgcgcagaacgctaaagtgatagaaaagcagcttgaacgtaagggcatgagcaaacgccgactccaagagcttgcagaactggaagctaaaaaagccaagatgaaaggaaccctgatcgataatcagttcaagtag

SEQ ID NO: 54893 - DNA, 2277 bp, Artificial Sequence
  Description of Artificial Sequence: Synthetic coding sequence
atgagcggcgagtccggccaacctgaagctggtcctagccacgcgggactcgattggcccaacccggagaggaaccgggctggtgtaccaggcggagtgattcgcagagccggatcccaagggcctcggtcctggatacagaaggtactggagcagatcatggattcccccaggcagtgcgtcaccccttctgaagtagtgcctgtgacagtcctcgcagtccaacgctacctgctggaggatgagcccagggatacagtcccaaagccaccactatattgctacgacgttacgattagtgacggggtataccaggaaaagtgctatctggacccttctttgaattctctggtctaccagaacatactgaaggtcggcatccaaatgagaatctctcgcgtcagctgcctctacaacgagaaaagaatcggccaggggatcctgtgcatagacaatgtgcattgcggcgagacctcagactccatctcactcgaaacaccctttcggaatagggcgcatcaggaaaagcctgagcgtcccctccgcggaggtaaatcacattaccttgctctctggaataacgaggacccttacggggatatttggctcactgataaacagcctgaagaacacaattttagcgatactaaaattattagcctgagtcacctggagatgacctggacgaacagaagaaatttcccagctctcctcgtgagaatcctgcataaatccaagctgagatactacggcaagcccgacaaaaagatgatagaaccgtatcagacctttcttgaggtcgcagactctagtggaacagtctcagttatcatgtggaacgccctctgcccggaatggtataagagtctgagggtggggctcgtgctactgctccaggattacagcgtgaagaaaagttacccattccgaattcagccagtgcctgtggatccccagatcaagctgatctcaactatggaaatctgcctgaacctcagggatcctcccacaaacatcattattatcccagaaaagcaggtcaagccagagtggcgcctacccaagttgaaccaccggttcacgacccggagtgagcttgatgatatgcctgaaaattgtatctgcgacgtgatagggctactggtgttcgtagggagagttcagcggtccaagaaaaaggaaaacagggaagatttctggtcataccgctggatccacattgctgatgggacaagcgagcaaccatttatcgtggagctgttcagcacatctcagccggaaatcttcgaaaacatatacccaatggcctattttgtgtgcacacaactgaaggtggttagaaatgacaaccaggtgccaaagctcctctatctgacaacgaccaacgaaagtggggttttcatcaccgggcatcggggacaaccctatacttatgatgccaagaatgccaacaggccaagcacctctcaggctgccagggtggagatacaggaaaggaacgggaagcggcaccaggatgacgaaccagttaactctcaatacttccagactacatccactaatttgtcactgtcgaacaagatcaggattctccaggggccacacgcaaatccagtcgccgtgccacaaccaggggcttccgttcagacaaagggcatcaagccgggaatgccatccatctttaaccgtcgggctaacatcaacgccaacctacaggggaaggctcggaagaccatttctgacaggtgggaatcccagttgtggagggaaaagaagttcggactcatagatcacttgcattatagccgtgtctatcctgagtcgatccctagaaagttcatgttcgagcatagaaagtttctgtccgaccaatacaacagccagcctgcaaaatatgtaccgcctgagggtcggcctccaaaacttgacgatttcaagtctgcacgctccttaggacacttcgaagttactattctcggactgaaccacgagatcgccatcgacgttgcttttttgccgatgtactgccccgaagatattaggaccagtcagatagataccctgctcaccagcatgaattatagttgtgcctacccccaagacactactggaaatgatcggctgccagggcctcgcgcagtggccggagacattatcaaagccgctacagagttggatagagtgcatatagttggaatacttgacatctgtaatctcggaaataataaggtggaggtatatctgcacaaaatttactctccagagaataccagctag

SEQ ID NO: 54894 - DNA, 2568 bp, Artificial Sequence
  Description of Artificial Sequence: Synthetic coding sequence
atgtccggagagtcaggccagccagaggcaggcccttctcatgcgggactggactggcccaacccagagcggaaccgggctggagtgcccggtggagtgatacggagggcgggatcacaagggcctcgctcctggatccagaaggttctggaacaaataatggattcgcctagacagtgcgtcaccccttcagaggtggtccccgtgacagtattggcagtgcaacggtatctgttggaggatgagcctagagatactgtgccgaaaccacccctgtactgctacgacgtcactatctctgatggagtgtaccaagaaaaatgttatttggatccaagccttaactctctggtttaccagaacattctcaaggtggggatccagatgcggatttctagggtctcttgcctttataatgaaaaacggattggtcaaggcatcctttgtatagacaatgtgcactgcggtgaaacaagtgattccatttctctggagactcctttcaggaacagggcccatcaggaaaaacctgagagacccttacgcggaggaaaatcccactacctagccctatggaataatgaggatccctacggagacatctggctgaccgataaacagccagaggagcacaatttttccgatactaaaatcattagcctatctcatcttgagatgacatggactaataggagaaattttcctgccctcctcgtgcgcatcctgcacaagtctaaacttcgatattacggaaaaccagacaaaaagatgattgagccgtatcagacattcctcgaggtcgccgactcgtccggcaccgtgtccgtcattatgtggaatgcattgtgccctgagtggtataaatcgctacgagttgggttagtgctgctgcttcaagattacagcgttaagaagagttacccgtttcggatccagccagtgcccgtcgatccccagatcaaactgatttcaaccatggaaatctgccttaatctgagagatcccccaacaaacatcatcattatacccgagaagcaggtgaaaccagagtggagactgcccaaactgaatcatcgttttacaacccggtcagaattggatgacatgccagaaaactgcatttgtgacgtgattggcctgctggtttttgtgggccgtgtccagagaagcaaaaaaaaagaaaatagagaggacttttggagttatagatggatccacattgccgatggcacctccgagcaacctttcattgtggagctgttcagcaccagccagcctgagatcttcgagaatatatatccgatggcttattttgtgtgcactcagctaaaggtggtgcgcaacgataaccaagtccctaaattgctctacctgactactactaatgagtcaggggtatttataaccggacacagaggacagccttatacttacgacgctaaagtgaaaaattttatacagtggatacggactaagagtgattctggcgagcagaagaatatggttataggcggatattatccctatccgccagtgccagagacattttccaaatactccagcagtatcaaggttgagtcattgctgactgccatctccgaagtacggaaagagatcgaagacctccaataccgagagcagaaacgcattgcaattcagggcattattactgccatcaagtacattcctcattcttctgcaacggagagcgctagcgcgagcgaaactctgaggaacgccaacaggcctagcacatctcaggctgcccgagtggagattcaggagaggaatggcaagcgccaccaagatgacgagcctgttaatagtcagtacttccaaactacatctaccaacttatccctgtcgaacaaaatccgaattctacagggaccccatgccaacccagttgctgttccccagcccggtgcaagcgtccagaccaaggggattaaacctggcatgcctagcatctttaataggcgggcaaatattaacgccaacctgcaaggaaaagctcgcaagacaatttcagaccggtgggagtctcagctgtggcgggaaaagaaatttgggctcatagatcacctacattacagccgcgtctaccccgagtcaatccctaggaagtttatgtttgaacaccgcaagttcctcagtgaccaatacaatagtcagcccgctaagtacgtgcctcccgagggaagaccgccaaagctggatgactttaagagcgccagatccctgggacacttcgaggtaacaatcctagggctgaaccatgagatcgcaatcgacgtcgctttcctcccgatgtattgccctgaggacattagaaccagtcaaatagatacgcttctgacctctatgaactattcatgtgcatatccacaggatactacagggaacgaccggttgcccggtcctagggcggtcgcgggagacataataaaggccgctaccgagcttgacagagtgcacatcgtgggtatcttagacatctgtaatctcggtaacaataaagtggaagtctatcttcacaaaatctattcaccagagaatacgagctag

SEQ ID NO: 54895 - DNA, 1701 bp, Artificial Sequence
  Description of Artificial Sequence: Synthetic coding sequence
aacaatgaagacccatacggcgacatctggctcaccgataagcagcctgaagagcacaacttctctgacactaaaattattagtctgtcccacctggagatgacctggactaaccggcgtaatttccctgcgctgctcgttcggatactgcacaaatctaagctgcgatattacggaaagccagataaaaaaatgatagagccctaccaaacgttcttagaagtcgccgacagctctgggaccgtgtcagtgattatgtggaatgccctgtgccccgaatggtataagagcctcagagttgggctggtgttgcttttgcaggattattccgtcaagaaatcttatccgttcaggattcagccggtgcctgtcgatccccagatcaagctaatttccacaatggagatttgtctgaatctcagagacccgcctacaaacattatcataattcctgaaaaacaggtaaagcccgagtggcgtctcccgaagctgaatcacaggttcacaacccgctccgagctggatgatatgccggagaattgtatctgcgatgtgattggactattagtgtttgtggggcgagttcagcgatcaaagaagaaagagaatagagaggacttttggtcctatcggtggatacacatagccgatggaacaagtgagcagcctttcatcgtggaactattcagtactagccaaccagagattttcgaaaatatctatccgatggcatatttcgtttgcactcaacttaaagtagtgcggaatgataatcaggtacccaagctgctgtacctgactaccactaatgaatctggtgtattcattacgggacacaggggccaaccatacacatacgacgctaagaacgccaatagaccctccactagtcaagccgcaagagtcgaaatccaggagaggaacggtaagcgccaccaggacgacgagccagtaaactcccaatatttccagaccacttcaaccaatctgtccctttcaaataagatcaggatcctgcagggaccccatgcgaatcccgtggccgttccccagccaggagcatccgtccagacgaagggcattaaacctggcatgccctctatttttaatagacgtgcgaacattaatgccaatttacagggaaaagctcgaaaaactatctccgacaggtgggaatcacagctctggagggaaaagaaattcggcctgatagatcacttgcattattcccgcgtctatcccgaatctatacctcggaaatttatgtttgagcatagaaagtttctgagtgaccagtacaatagccagcctgctaaatacgttcctcctgaggggaggcctcctaaactagacgactttaaaagcgcgagatctcttggacactttgaagtgacaatattgggactcaatcatgaaattgccatcgatgttgccttcctacccatgtactgtccggaagacatacggacatcccagattgacacactgctcactagcatgaattactcatgcgcctatccacaggatacaacgggcaatgacaggctgcctggccctcgtgcagtggcaggagacatcatcaaagccgcaactgagctggaccgggtgcatattgttggcatattagacatttgtaacctgggcaataataaagtcgaggtctatcttcataaaatctatagtccagagaatacgagttag

SEQ ID NO: 54896 - DNA, 999 bp, Artificial Sequence
  Description of Artificial Sequence: Synthetic coding sequence
atgaaccgctcatcaaatgtgcctcggaaagggatcctcaaatcagggactcgcagcctacagaaggtccgccgtgtgcatttcgccaacgccaggaacgctcgtagcctgctatccatgcttaaagacattagtgcccaaataatccaacgggcttggctcagtcatacgaacaagatgatatttagactacttaagcatgccatatgcgcagccgagttctacgtcacccacgagatcctgaagaaggtagcccctctcgaggcgaaattgattaaggatcccacaatgcagtgtaagatccgatttagattccgcggagaaaccttcccgccttttattgttttcaaaatcttcctgcacaccgacgggcatggttataagtactttagcggcaagaacgtgctgatgccaagctccaaagcagtcgatgacgcctgtaagctcatgggtgaacgaaagttccaccggatcataatggaagacgagagaatattcccaaaatcaaaggtaactgacatcatggacgttgtcaccatgcaggactacgtgcagtatagatcattttttgacgaagctccagcattcagcgggggaagaaacaactcatggcggaaactgaacctggagaatattcccagaacgatgctcatgtatgacatcgttcattactctgagtccggagtcatctccaatcgtttgagaaatgagatgaagtttctgctccagagacctgtgacacaggaaatccacaaacaccagctgaggattgtgtctgagatccgaggaccttatctgaccgtgcagcctctatacaggccttataagcagcagaatcaggttaagttcttggggaggcgttctaagcaggcacagatgaaggtcgaaaagatgcgaaaggtatacctggccaaggagaagaatacctctgaagtgacagagcccaaaaccggaccttccgggactaaggacaattatcacctccattcgatcttttag

SEQ ID NO: 54897 - DNA, 381 bp, Artificial Sequence
  Description of Artificial Sequence: Synthetic coding sequence
tgatttgctaatgctaggaatgcacggtccctccttagcatgctgaaggatatctccgctcagatcatccagcgggcttggctgagtcataccaacaagatgatttttcggcttctgaaacacgccatctgcgcagccgagttctatgtaacccacgaaatcctgaagaaagtcgcgccacttgaagcgaagctaatcaaagaccccaccatgcagtgcaagattcgctttagattccggggagagacattcccccctttcatcgtatttaagattttccttcacaccgatggccacggttataaatacttctcaggcaaaaatgtgctgatgccatcatctaaggtgacgttccacgatgtgcatttcatgcttacctag

SEQ ID NO: 54898 - DNA, 897 bp, Artificial Sequence
  Description of Artificial Sequence: Synthetic coding sequence
atggcctgcatcgaaaatgtcctggggggtcacgctccctcgccattggttgtgtccgtggataagaatggaaaccaagagctccaccatgacatgcctctgcagtgcctgtccagtaagccagaggacgatgccgaaccatgggggcagccccaagttccactaaggccatcggtgaacgtactgaccgacttagactcaaagcagctggagtggccaagtgagcgcaccgggagctgcatccctctccacagccttagagcacacagacatccctatggtccaccacccgcagtggccgaagagtccctcgcaacagctgaggtaaactccagcgacgccctggccggttggagacaggaaggacaggacgctatcaatgtgagttgggaggtgtcaggcggtcctccagcgctgatcgtgggtggtacaaaagtcaacaatgggggaacagagcgcggtagcaataatgccaggcttcacgtggccctcccccagggtaaaggcttctttcctccaagaggaccccaggtccgaggcccttctcacatcccaacactgcggtccgggattgtaatggaggtgcccccaggcaacaccaggatagcctgtcgcggaaaactggcccatgttagcttccctctgagagggccttgtcatccaatgcacaattggcccagaccaatacccttgagttcatcaacgcctggccttccctcctgcagcaccgtccattgctttatccctcccaggcccccaatcttcaatccattcctgaccatgcctcttccattcgcccctccgccaatctttggacccccactcccatcttattttgcccactttcactcaggagggatgcccgctcctgcgagccctaaccgcgagcactcctag

SEQ ID NO: 54899 - DNA, 552 bp, Artificial Sequence
  Description of Artificial Sequence: Synthetic coding sequence
atgttcatcttcatcaagcatggggacaaccagcaatttctggtaaataccaattgtgccgtcgttgtcctgctttactatatccgatccaaagtcaaactaccgaaaactaataccatcgatctgtgcgaacaaaccgggaaaatgaagatgctattcctgatgaaacccaaccacgctgagtatgcgtctaaatatttaaccgctcgaagtacttattacgtgtgcaaagtggaacggggtcctcccggtaccaggctcgaaaacgcttatagggccttcgtacctcttctcaaaaatcccgagccatggctacttgtcgccctgaggattcagtgcgacgctctcgaacgcaggaggatccagatgctgaagatgaaggaggctaaaaaggtcgtcattattgagccgccagccagtgtgccttcaaaacagtccgggcgatctgataagaaaaagtctactcgtaaatcccctactttccggaatcgccctgatttcaggaaaaataaggggagacaacttaacaaaacgacaaaacagaagaaatag

SEQ ID NO: 54900 - DNA, 612 bp, Artificial Sequence
  Description of Artificial Sequence: Synthetic coding sequence
atgttcatatttatcaagcatggagataatcaacagtttcttgtcaacaccaactgcgccgtggtggtgctcctctactacatccggtcgaaggtaaaactccccaagacaaatacaattgacctgtgtgagcaaactggaaagatgaagatgcttttcctgatgaaacctaatcacgccgagtatgcttctaagtacctgacagcacgttctacttactacgtgtgtaaagtggaaagaggacccccagggactaggctcgagaacgcttatagggcctttgtgcccctcctgaaaaatcctgaaccgtggctcttggttgcacttagaatccaatgtgacgctttggaacggaggcgcatacaaatgctgaagatgaaagaagcaaaaaaggtggtcataatcgagccacctgctagcgtacccgtgagactcgcgaagtgcgatctaccacagcacccaccgctccctaccagccgtctgaactccaaacaaagcgggaggtctgacaagaagaaaagtacccggaagagcccaactttccggaaccgacctgacttcaggaagaataagggtcgacagttgaataagaccaccaaacaaaagaaatag

SEQ ID NO: 54901 - DNA, 1512 bp, Artificial Sequence
  Description of Artificial Sequence: Synthetic coding sequence
atggcaacacaatctgacatggaaaaggagcagaagcaccagcaggatgaggggcagggtgggttaaacaatgaaaccgccctcgcctctggcgatgcctgcggaaccggcaatcaggaccctgctgcttccgtgaccacagttagctcccaggcctcaccttccgggggagcggcattatccagcagcaccgctgggtccagcgcggctgcggcaacctctgcggcaatcttcatcacggacgaggcctcaggcctgcctatcatcgctgctgtactgaccgagagacactccgatagacaggactgtaggtccccccatgaggtatttggatgcgtcgtgccagaaggcggatcgcaggccgcagtgggtcctcagaaggccactggccatgccgatgagcacttagcccagactaaatcccccggtaacagccgtcggaggaagcagccctgtcggaaccaggccgctcctgcccagaagcccccaggcagaagattgtttcccgagcctctgcccccttcatctccagggtttaggcccagtagctatccatgctccggggcttccaccagcagccaggcaactcaaccaggcccagctctcctcagccacgcatccgaagcccgtcctgcaactagaagccggattacacttgtagcgagtgccctgcgcaggcgcgcttcaggcccaggacccgtaatcaggggttgtacagcccagccgggtcccgcttttccccacagggccactcatctggaccctgccaggctctccccggagagtgcacccggtccagcaaggagaggaagagcaagcgttcctggaccagccaggcggggatgtgattcagcaccaggaccagcgcgaaggggtcgggacagtgcccctgtctctgcgcctcgagggcgagactccgctcccggtagcgccaggcgcggacgcgattcagctcctggcccagcgctgagagtgaggacagcccgatcagatgctggtcaccgctccacctcaacaactcccggtacaggcctacgcagcaggtcgacacaacaacggagtgccttgctgagcagaaggagcctcagcggctcagcagacgaaaaccctagctgtggcacaggaagtgaacgcttagcttttcagtcccgatctggatcacctgaccctgaagtgccatctagagcatctcccccagtgtggcacgccgttagaatgagagccagctcaccctccccacctggtagatttttcctaccgatcccacagcagtgggatgaatcctcaagctccagctatgcttccaacagctcaagtcctagtcgctcacctggtctcagcccatctagccctagcccggaattcctggggttgcgatccataagcactcctagtcccgaatctcttaggtacgccctcatgcctgaattctacgccctgtcacccgtcccacctgaggaacaggctgagatagagtccacggcccatcccgcaaccccccctgaaccatag

SEQ ID NO: 54902 - DNA, 252 bp, Artificial Sequence
  Description of Artificial Sequence: Synthetic coding sequence
atggaggcgttaggatcaggacattacgtggggggttctatcagatcgatggccgcagccgctctgagcggattggccgtgcggctatctcggcctcaaggaacccgcggttcctacggggctttctgcaaaaccttgacacgtacgctcctcaccttttttgatttggcatggcggctgcggaagaactttttttacttctacattctggcgagcgtcatcctgaacgtgcaccttcaagtgtatatctag

SEQ ID NO: 54903 - DNA, 549 bp, Artificial Sequence
  Description of Artificial Sequence: Synthetic coding sequence
atgatgcggcgttccccttccgggctgaagtctccgagagtctctcagggcaggaagcctagggaccctgagtccttgctgtttttaagatgttgcctggggagcgagcctcataacctgtcatccttattaagccctgaggctggacaggaacccctgccgaagttgctccctcaacctttagccggtcacgctgcttgggggatccatggagtgcccacctctctccttctggcaggggagtgttgggggcaagggatggccgtgcctgccgatccgcctccggcatctccgtatcggacgagcccacgtcccccacctggccctctgccgaggtaccgtccccagcaacacctgctgctgcctctggggaggctgcacgctctttgccccggatgccccctccagcagtctctgcagtttgaacgcggaacactgtccgcacctcggttgtggtcgtggatgaaacttgaaaccatcattttgagcaaattatcccaggggcaaaagactaaacaccgtatgttttcactgatcagcgaaagttag

SEQ ID NO: 54904 - DNA, 549 bp, Artificial Sequence
  Description of Artificial Sequence: Synthetic coding sequence
atgatgcggcgaagccccagcggcttaaaatcacctagggtgtcccaagggaggaagccgagagatccagaatctttgctgtttttacgatgttgtttggggtccgaaccacacaacctttctagcttactgtcgccagaagcgggacaggaaccgttgccaaagctgttgccccaacctcttgccggacatgcggcatggggtattcacggagtcccaaccagtttgctattggccggagagtgctggggacagggtatggcggtccctgctgaccctcctccagcgagcccatatcggacctcacccagacctcctcccggaccgctgccccgttacaggccccagcagcatctactgctccccctgggcagattacatgctttgtgccctggatgtccgctgcaacaaagtttgcagtttgagcgtggcactctgtctgctccgcgtctgtggtcctggatgaaattagagaccatcattctgtctaaactcagtcagggtcagaagactaaacaccggatgttttcccttatcagcgagtcctag

SEQ ID NO: 54905 - DNA, 306 bp, Artificial Sequence
  Description of Artificial Sequence: Synthetic coding sequence
atgaataaactcggacacaacgaactgaaggagtgcctcaagaccgcaactgactccctgcagactgttcagcctagtatcagtcaaacttgcactagctatggacccgctttaggcgctcccctcccgggaagaaacgaagtggccctgctgaccagcctgccaccgaactatgagattagcgaaggcaagcccagagcaatttctgcatacgtcagagccggaaaagggaacgtgacacggcgtcgaaaaaaaactcacctgggaaatgacgatggcaagaaggaggcccaagaaaagatgtag

SEQ ID NO: 54906 - DNA, 306 bp, Artificial Sequence
  Description of Artificial Sequence: Synthetic coding sequence
atgaacaagctggggcacaatgagctcaaggagtgcttgaagaccgccactgattcactccagaccgttcagccctctatctcacagacgtgcacttcctacggccctgcgctgggggctccactgccgggacggaacgaggtggcgcttctgactagcttgcctccaaattacgaaatctccgaaggtaagcctcgcgcaatcagcgcctatgtccgagccggaaagggcaacgtaacaagacgaaggaagaagacgcacctgggcaatgacgacggtaaaaaagaagcccaggagaagatgtag

SEQ ID NO: 54907 - DNA, 1416 bp, Artificial Sequence
  Description of Artificial Sequence: Synthetic coding sequence
atgtgcggcgactgcgtcgaaaaagaataccccaatcggggaaacacctgccttgaaaatggaagcttcctgcttaacttcactggctgcgccgtctgttctaagagagactttatgctcataacgaacaaaagcctgaaggaagaagacggagaggaaattgtgacctacgatcacctttgtaagaattgccaccatgtcatcgctcggcatgaatatactttctctatcatggacgaatttcaagctaaagtcgaagaaaaaatccaggaggtattcagttcctataagtttaatcacctggtgcctaggctagtgctgcagcgggaaaagcattttcactacctcaaacgtggactgcgacagctcacagacgcatatgagtgtctggacgccagccggccatggctttgctactggatcctgcacagtttggagctcctcgacgaacctatcccgcagattgtcgcgaccgacgtttgtcagtttttagaactgtgccagagccctgaaggcggtttcggcggaggccctgggcaatacccacacctcgcgccaacctacgctgccgtgaacgcactttgtatcatcggaaccgaagaggcctacgatattattaatagggagaagcttctacaatatctgtattctctcaagcagcccgacggctcattcttaatgcatgtcggcggagaagtggatgtgagatccgcttattgtgctgcttctgtggccagcctcaccaacatcatcacgcctgatttattcgagggaacagccgagtggatcgccagatgtcagaactgggagggaggcatcgggggagttcctggtatggaggcccacggagggtatactttttgcggattggcggcattagtgatcctgaagcgagagcggagtttgaacctgaagtcgctgttgcagtgggtcaccagtcggcaaatgcgattcgaaggtggattccagggcaggtgtaacaaattggtggatggttgctactcattttggcaggctggtctgctgcccctgctgcatcgagccctccatgcccagggggatccggctctcagcatgtctcactggatgttccaccagcaagctttgcaggagtatatactgatgtgctgtcaatgtccggctggcggactcctggacaagccaggaaagagccgggacttctatcatacctgttattgcctaagcgggttgtctatcgcacagcatttcgggtccggcgctatgttgcacgacgtggtgcttggtgtcccagaaaacgccttgcaacccacacatcctgtgtacaacattggcccagacaaagtcatccaagccaccacgtacttcctgcagaagccagtgccaggttttgaggaactaaaggacgagacaagcgctgagcccgctaccgactag

SEQ ID NO: 54908 - DNA, 582 bp, Artificial Sequence
  Description of Artificial Sequence: Synthetic coding sequence
atggaagcccacgggggatacacgttctgcggtctcgccgcactggtgatcctcaagcgcgaacgtagtctgaacctaaagagccttttacagtgggtgactagtcggcagatgcggttcgagggaggcttccagggacgctgcaacaaactcgttgatggctgttacagcttctggcaggccggactgctgcccttgctccatcgggcattgcacgctcagggagaccctgcactgtccatgagccactggatgtttcatcaacaggccctgcaggaatatattttgatgtgctgccagtgcccagccggaggactgctcgataagcctggcaaatcccgggatttttatcatacttgctattgcctgagtggattgtccattgctcagcacttcgggagcggtgccatgctgcatgacgtagtgttgggggtacccgagaatgctttgcagcccacccacccagtgtacaacatcgggccagacaaggtgatccaggcgactacttactttctgcagaagcctgttccaggtttcgaagaactcaaggatgagactagtgcggaacctgctaccgactag

SEQ ID NO: 54909 - DNA, 1176 bp, Artificial Sequence
  Description of Artificial Sequence: Synthetic coding sequence
atgattgccaaggttgaagaaaagatccaggaagtgtttagctcctataagtttaatcaccttgtccccagattggtcctgcagcgcgagaagcattttcactacctgaagcgcggtctacggcaactcactgacgcgtacgagtgtttagacgcctccagaccttggctgtgctactggatcctgcatagcttggaactgctcgacgagccgattccccagatagttgccaccgacgtgtgccagtttctggaactctgccaaagccctgagggaggctttgggggtggccctggccaatatccccacctggcgccaacatatgccgctgtaaatgctctgtgcattattgggactgaagaggcctatgatattattaatcgggagaaattgttacagtatctatattcactgaaacagcccgatggttcgtttcttatgcatgtgggcggtgaggtagacgtcagatcagcctactgtgctgcctcggtagcgtccctaaccaacattataacccccgatttgttcgagggcacagcagaatggatcgcgaggtgtcaaaattgggagggtggcatagggggagtgcctggaatggaggcccacggcggttatacattctgtgggctggcagccctcgtcattttgaagagggagcgatccctcaatctgaaaagcctgcttcagtgggttacctcccgacaaatgcgctttgagggcggtttccagggacggtgtaataagctcgtggatggttgttactccttctggcaggccggactgcttccactcctgcaccgagctttgcatgcgcagggcgatccagccctgagcatgtcccactggatgtttcaccaacaagctcttcaagaatacatcttaatgtgttgccagtgcccagctgggggactcttagacaaacccggaaagagtcgggacttctatcacacttgctattgtctgtcgggcctctcgatcgctcagcactttggatcaggcgctatgctgcacgatgtggtcctaggggtgcctgaaaatgcccttcagcctacacatccagtctacaacattggacccgataaggtgattcaggccactacctactttttgcaaaagcccgtgccgggattcgaggagctgaaggatgagaccagcgcggagcctgctacagactag

SEQ ID NO: 54910 - DNA, 1419 bp, Artificial Sequence
  Description of Artificial Sequence: Synthetic coding sequence
gccatgtgtggggactgtgtcgagaaggagtacccgaacaggggaaatacttgcctggagaatggaagttttctgttgaacttcacaggttgtgccgtttgttcgaaacgggacttcatgttgatcactaataagagtctcaaggaggaggacggagaggagatcgtgacctatgatcacctgtgtaagaactgtcatcatgtcatcgcaaggcacgaatataccttctccatcatggatgagttccaggctaaagtcgaagagaagatccaggaagtttttagcagctataaatttaaccatctggtacctcgactggtgctgcagcgcgaaaaacatttccactatttgaaacgcggactgagacagttaaccgacgcttacgaatgcttggacgctagccgcccatggctctgctactggattctccattcacttgagctgcttgatgaaccaattccccagattgttgcaacagacgtgtgccagtttttggaactttgtcaaagtcctgaggggggttttggtgggggacccggacagtacccacatctagccccaacatacgctgctgtcaacgcactgtgtattatcgggactgaagaggcttatgatatcataaacagggaaaaacttctacaatatctgtatagcctgaagcagccggatggcagctttttgatgcacgttggcggagaagtcgatgtgcgtagcgcctactgtgctgcaagcgtggcttccctgactaacattatcacacccgacctttttgagggaaccgctgaatggattgctaggtgtcagaattgggagggcggaattggtggagtgcccggtatggaggcccacggcggatacacgttctgcggcctggccgctctcgtgatcctcaagcgcgagagatctctgaatctgaaaagcttgctccagtgggtgacatcacgacagatgcgctttgaaggtggattccaggggaggtgcaataagctagtcgatgggtgctacagcttttggcaagccggattgctgccactgctgcaccgcgcattgcacgcccagggagatcccgctcttagcatgagccactggatgttccaccagcaggcgctccaggagtatatcttgatgtgttgccaatgtcccgcaggtggcctgctggataaacccggtaagagtcgggacttttaccatacctgttattgcttgtccggtctgagcatcgcccagcacttcgggtctggagccatgctccatgacgtggtgctgggcgtgcctgagaatgctttgcagccaacccatccagtctataacatcgggcctgataaggtgatccaggccaccacttactttctgcagaaaccggtgccagggttcgaggaactcaaagacgaaacatccgccgagcccgcaactgactag

SEQ ID NO: 54911 - DNA, 342 bp, Artificial Sequence
  Description of Artificial Sequence: Synthetic coding sequence
atgtgcggggactgcgtggagaaggaatatcccaatcgcggaaatacctgccttgaaaatggcagcttcttgctgaattttaccggttgtgctgtgtgctcaaagcgcgattttatgcttattaccaataagtcactgaaggaagaggacggcgaagaaatcgttacttatgatcccgacctgtgcaagaattgtcaccacgtaatcgcccgtcatgagtacacgttttctatcatggacgagttccaggaatataccatgctatgcctgctgtgtggcaaggcggaggacactatttctatactgccagacgatccgaggcagatgactctcttgttctag

SEQ ID NO: 54912 - DNA, 318 bp, Artificial Sequence
  Description of Artificial Sequence: Synthetic coding sequence
atgcgacagccctacctgtcatcccgcgaagtcagcagctctcgaaaaaggtggcgaacgtttccggtggattgtgttgctatgtgcggggactgtgtggaaaaagagtacccgaaccgaggcaatacgtgtttggagaatggtagcttccttctcaactttaccggttgcgcagtctgctctaagagggactttatgctcattacgaataaaagccttaaagaagaggatggggaggaaattgtaacctacgaccgagtctatcatgctgtgtcagttatgaggcagagccggagatattaccagtattccccctag

SEQ ID NO: 54913 - DNA, 420 bp, Artificial Sequence
  Description of Artificial Sequence: Synthetic coding sequence
atgcgtcaaccctacctatcatcaagggaggtgagttcctcccggaaaaggtggcgtacgttccctgtcgactgtgtcgcaatgtgtggggattgtgtggagaaggagtacccaaacagaggaaatacatgtcttgagaacggcagctttttactgaactttaccggatgtgccgtgtgcagcaaacgcgactttatgctgattaccaacaagtcattgaaagaggaggatggagaagagatcgtgacgtatgaccacctgtgcaaaaactgccatcatgtgatcgccagacatgagtatactttcagcatcatggacgagtttcaggagtacacgatgctctgcctgctgtgcggtaaggcagaggacactatcagcatactaccagacgacccaagacaaatgaccctgctgttctag

SEQ ID NO: 54914 - DNA, 423 bp, Artificial Sequence
  Description of Artificial Sequence: Synthetic coding sequence
atgcgtcagccctacctaagctcccgtgaagtttcatctagcagaaagcgttggcggaccttcccagtagactgtgttgcaatgtgcggagactgtgttgaaaaggaatatccaaaccgaggaaatacatgtctcgagaacggaagcttcctgctgaacttcaccggatgcgccgtttgctccaaaagggactttatgttaatcacaaacaaatcattaaaggaggaggatggtgaagagatcgttacatatgaccccgatctatgcaagaattgtcaccacgtgatcgcaagacatgagtacacctttagcataatggacgaatttcaagagtacactatgctctgtctgctttgcggaaaagccgaagacacaattagcatcctgcctgacgatcccaggcagatgaccctgcttttttag

SEQ ID NO: 54915 - DNA, 381 bp, Artificial Sequence
  Description of Artificial Sequence: Synthetic coding sequence
tgtggtgtttccacttatgctccggatatgtccagaatgcttggaggggaagaagcaagacccaatagttggccatggcaggtgtctctccagtacagcagtaatggccaatggtatcacacctgcggtggctctctcatcgcaaacagttgggtgcttacagccgctcattgcatccgccaaatcatcaaagcccataaagttttgcagcgctgctcactgatcctatttttcgtgcgtgatctttgtagcagccagttggaactgaccggagtctcagccggaagttctggtatatatagagtcatgctcggccagcataacctgtacgtcgccgaaagcgggtccctcgctgtgtccgtgtctaaaatcgtggtatag

SEQ ID NO: 54916 - DNA, 813 bp, Artificial Sequence
  Description of Artificial Sequence: Synthetic coding sequence
atgatgctgcggctcttgtcgagcctattgcttgttgctgtggcctcagggtacggtccaccctcttctcacagctcctctcgcgtggtacacggcgaggacgccgttccttacagctggccctggcaggtcagtttgcagtatgaaaagagtgggtcattttaccatacatgcggtggtagtctaatcgctcccgattgggtcgtcaccgcgggacattgcattagcagggacctgacataccaggttgttctaggagagtacaatctggctgttaaagagggcccagagcaggtcatccccattaactcagaggaactgttcgtgcatccgttgtggaaccgtagctgtgttgcgtgtggaaatgatatcgctttaattaaactaagtcggagtgcgcagcttggtgacgcggtccagttggcctccttacctcctgccggagatatactgccgaacaagaccccctgctacattacgggctggggcaggctgtatactaatggaccccttcccgataaactccaacaggccagacttccggtggtagactacaaacactgcagccgctggaattggtggggatcgacagttaagaagaccatggtgtgcgccggagggtacatccgcagcggctgtaacggtgattccgggggacctcttaactgccccacagaggatggcggatggcaagtccacggagtgacaagttttgtgtccgctttcggatgcaattttatctggaagccgacagtcttcactcgggtgagtgcatttatagactggattgaggaaactatcgccagccactag

SEQ ID NO: 54917 - DNA, 495 bp, Artificial Sequence
  Description of Artificial Sequence: Synthetic coding sequence
atgcgctcatgttacgtcgcccaagccggactgaaactgccaggctccagcgaccctcccgcatccgccagccagtcaacgcgcatcacagcctccgggtatggccctcccagtagtcattcatcttcccgagtggtccatggtgaagacgcggtaccatacagctggccatggcaagtgagcctgcagtacgagaagagcggaagtttttaccatacctgcgggggaagtttgatcgcacccgattgggtagttaccgcaggtcactgcatttctagggacctgacctaccaggtggtcctgggcgaatacaacttggcagtcaaagagggccctgaacaagtaatccctataaatagtgaggaactctttgttcacccgctgtggaacaggagctgtgtggcatgtgggaatgatatcgccctgatcaagctgtctcgctctgcgcagctcggagacgctgttcagttggctagcctgccccctgcaggctag

SEQ ID NO: 54918 - DNA, 366 bp, Artificial Sequence
  Description of Artificial Sequence: Synthetic coding sequence
atgatgttgcgcctgctctcctctctgttgctcgtcgccgtggcctcaggctacggaccaccctcatcccatagctcctcacgggtggtccatggagaagacgccgtcccgtattcttggccatggcaggtgtctctgcaatacgagaagtcagggagtttctatcatacttgtgggggtagcttgattgcccctgattgggtcgtgaccgccggacattgcatatcaagggatctgacctatcaagtggtgctcggcgaatacaatctggccgttaaggagggcccagagcaggtcatccctataaattctgaagagcttttcgttcatccactctggaatcggtcatgcgtagcctgcggttag

SEQ ID NO: 54919 - DNA, 228 bp, Artificial Sequence
  Description of Artificial Sequence: Synthetic coding sequence
tggtggggttccactgttaaaaagacaatggtgtgtgccggtgggtatattcgatccggctgcaacggagattccggtggccctctgaactgtccaactgaggacggcggatggcaggtccatggcgtgacatcatttgtgagcgcctttggatgcaactttatctggaagccaaccgtgtttacaagggtctcagcgttcattgattggatcgaggaaggagggtag

SEQ ID NO: 54920 - DNA, 348 bp, Artificial Sequence
  Description of Artificial Sequence: Synthetic coding sequence
atggacaatgtgcagccaaaaatcaaacatcggcctttttgtttctctgtgaagggtcacgttaaaatgctgagattagatttgaccaactccataatcactgctgtcttcctcagcgtggtggctattctcgcaatgcaggagaagaagagacgtcacttattgtatgtcggcggatctctctgtctcactgccgtcattgtatgctgtatcgacgcctttgttgtcaccaccaagatgcggactaacctgaaaagattcttgggcgtcgaggtggaaagaaaactgagtcctgccaaagatgcttatcctgagacaggaccggacgcaccacagagacctgcctag

SEQ ID NO: 54921 - DNA, 195 bp, Artificial Sequence
  Description of Artificial Sequence: Synthetic coding sequence
atcaatagtctggtaaccaccgtcttcatgcttattgtatccgtccttgccctgattcctgagacgactactctcactgtggggggtggcgatctcactaattcaataatcaccgcagtgttcctttctgtggtggcaattttggccatgcaggagaaaaaacggaggcatctgctttacgtggggggacgctag

SEQ ID NO: 54922 - DNA, 1395 bp, Artificial Sequence
  Description of Artificial Sequence: Synthetic coding sequence
atgcggattatcgagtccaatagctctaaaatccagtcccagattgatcacataaaacagtgtcgcgcagagtatgacacgaaggaggttaagtactgcactttctcaaaggatccctccaagcccatcccgggtatgacactccaggaatccatgaaccttgacgccctgacaaaatacatgaagcacttggaagataagtacgcagaaataaaacaagcaatgctgattaagtatgtgccggcacagaggaaggccgacctcgacgaagaaatgatcgtgctcttaaagagacgggacgtagcagagaatctaaacaagaaactccagttttgccaccagcgcctacagattatttcccaggcactctcttcctgggtgaagagcgacatgagctccccctttcaagatttcgttgaacagatacagaaaacgaaatacctccaaggggatcaggggattgtggaagagctgatggaggacgatccgagacgggctaaggaagctgagattatgctgcattatattgagcggtttaacgaattgattagtctaggagagtacgaaaaagccgcttgttatgccgcaaacagcccgcgtcgcatcctaagaaatattggcaccatgaacaccttcaaggctgtgggcaagattaggggaaaacccttacctctcctgctgttcttcgaagcgctcttcatcacctcccatgcgtttccttgcccagttgacgccgcactgactttggagggcattaagtgcgggttgtccgagaagagactcgacctagtcaccaattgggtgacgcaggagcgcctgacattttctgaggaagctggggacgttatatgtgactacggggagcaggatacctacaataaagcaaaatgcttggcccttgctcagatcgtgtatagcgagtgcgggcttcacaagaaagccatcttgtgtctgtgtaagcaaggccagacacatagggtgatggagtatatacagcagttgaaagactttacaacagatgacctcctccaactactcatgtcctgcccccaggtggagcttattcagtgcctgactaaggagttgaatgaaaaacagccctctcttagcttcggcttagccattcttcacctcttctctgcggacatgaagaaggtgggcatcaagctcctgcaggagatcaacaagggtgggatcgatgcagtggagagtcttatgatcaatgactccttttgctcaatagaaaaatggcaggaagtggctaacatctgctcacagaatggatttgacaaattgtccaacgatatcacctccatcctccggtcacaagctgcggtgacagagatctccgaggaagacgacgccgtaaacctcatggagcacgtcttctggtag

SEQ ID NO: 54923 - DNA, 663 bp, Artificial Sequence
  Description of Artificial Sequence: Synthetic coding sequence
atggctttgatttttcgcacagccatgcagtccgttggcctgctcctttcccttctgggctggatcctgagcattatcactacttacctgccccactggaagaatcttaacttagatttaaacgaaatggagaactggacaatgggactgtggcaaacctgcgtcatccaggaggaagtgggcatgcagtgcaaagatttcgatagcttcttagccctgcctgccgaacttagggtgagccgcattctcatgtttctgtctaacggcctgggttttttgggattgctcgtgagcggttttggccttgattgcctgagaatcggcgaatcccagcgcgatctcaaacgccgactcctgatccttggcggtatactctcttgggcgtctgggatcacggcactcgtgcccgtcagctgggtggcacacaaaacggttcaggagttttgggatgagaacgtaccggacttcgtgccccgatgggagttcggagaggccctctttctgggctggttcgctgggttatctcttctgttaggcggttgcctgcttaattgcgccgcttgctctagtcacgctccccttgctttaggccattacgccgtggctcaaatgcagactcagtgcccctatctggaagatgggaccgctgatccgcaggtttag

SEQ ID NO: 54924 - DNA, 630 bp, Artificial Sequence
  Description of Artificial Sequence: Synthetic coding sequence
atggctagcatgggattacaggttatgggaatcgccttagcagtcttgggatggcttgcagtcatgctgtgttgcgccctgcccatgtggcgcgtgaccgcctttattggcagtaacatcgttacctcacagacaatctgggaaggtctatggatgaattgtgtggttcaatccacaggacagatgcaatgcaaagtgtacgattccttgcttgctttaccccaggacctgcaggccgctcgagctctggtgattatttctatcatagttgcagctctcggtgtacttctgtcggtcgttgggggaaagtgtaccaactgcctggaggatgagtctgctaaggcaaagacaatgatcgtcgccggtgtggtgtttcttctggcgggactcatggtcatagtgccagtttcgtggactgcacataatataatacaggacttttacaatccgctggtggcatctggtcagaagcgggagatgggcgcttcactgtacgtaggctgggccgcttccggacttttgctgctgggcggtggtctgctgtgctgtaattgcccacccaggaccgataagccatactcggctaagtactccgctgcaaggtctgcagccgcaagcaactacgtgtag

SEQ ID NO: 54925 - DNA, 630 bp, Artificial Sequence
  Description of Artificial Sequence: Synthetic coding sequence
atggcctccatgggcctacaagtgatgggcatagcgcttgcagtgctgggttggctggccgtgatgctctgttgtgctctgcccatgtggcgcgtcaccgcttttattggtagtaacatcgttacgagccaaactatttgggagggattatggatgaattgtgtagtgcagtccacaggccagatgcagtgtaaagtgtacgattctctattggcactgccccaggacctacaggcagcgagagcactggttattatcagtattatcgttgccgcactcggcgtgctcctgtccgtggtcggtgggaagtgtactaattgcctcgaagatgagtcagctaaggctaaaacgatgattgttgcaggtgtcgttttcctgctggccggactgatggttatcgtaccagtgtcctggactgcacacaatatcattcaggatttctataaccctttagttgcgagcgggcaaaagagggaaatgggggcttccctgtatgtgggatgggctgcctccggtttgctcctcttaggagggggtctcttgtgttgtaactgccccccaagaactgataaaccttattctgctaagtactctgccgcacgctctgctgccgcttcaaattatgtatag

SEQ ID NO: 54926 - DNA, 540 bp, Artificial Sequence
  Description of Artificial Sequence: Synthetic coding sequence
atgcaagaggtgattgcgggattggaacgctttactttcgcattcgaaaaggacgtggaaatgcaaaaagggacgggattgcttcccttccagggcatggataagtcagccagcgccgtttgtaacttctttaccaagggcctttgcgaaaaagggaagctgtgcccatttaggcacgataggggcgagaaaatggtggtgtgcaagcactggttgcgcggactgtgtaagaaaggtgaccactgcaagttcctgcatcaatatgacctgaccaggatgccagagtgctatttttactccaaatttggagactgtagtaacaaggagtgcagcttccttcatgttaagcctgcgtttaaatcccaggattgtccttggtacgaccaagggttctgcaaggatggacccctctgtaagtatcgccatgttccacgcatcatgtgcctgaattacctggtggggttctgtccagaagggcctaagtgccagttcgcacagaaaattcgggagttcaagctgctgcccggttcaaagatttag

SEQ ID NO: 54927 - DNA, 459 bp, Artificial Sequence
  Description of Artificial Sequence: Synthetic coding sequence
atggtggtgtgtaagcactggctgagggggctttgtaagaagggtgaccactgtaaatttctgcatcagtacgatctcacccgtatgcctgaatgctatttctactccaaatttggcgactgctccaataaggagtgttccttcctccatgtcaagccggcttttaagtcacaggattgtccatggtacgaccagggtttctgcaaggatgccggaccactctgtaagtaccggcacgtgccgaggatcatgtgccttaactacttggtagggttctgcccggaaggcccaaaatgtcagttcgcacactgtagccttcctgctggacctgggatccagcacctgcttttcctcctttggaagcttggaaacccacatcctcagcagagcgcgtgtagtccagcgtgggggtcaggcgtgaaaggcagagcctgcgccaccggcccattgtgccaatag

SEQ ID NO: 54928 - DNA, 678 bp, Artificial Sequence
  Description of Artificial Sequence: Synthetic coding sequence
atgagcaaagagatctttcccttctgcagggtgggcaatattccatacgaggcaactgaggaacaactgaaagatattttcagcgaggttggccctgtagtcagctttaggttggtctacgaccgggagacagggaaaccaaagggttacgggttctgcgagtaccaagatcaagagacggctctgtctgctatgcggaaccttaacggccgtgagttttccgggcgagctctgagagtggataatgcggcaagcgaaaagaacaaggaggagttaaagagtctgggaactggcgctcccgtcattgagtccccttatggggaaacgatctctcccgaagatgcccctgagtcaataagcaaggcagtagcttctttaccacccgagcagatgttcgaactcatgaagcagatgaagctgtgcgttcagaattccccgcaagaggcccgaaatatgctcttgcagaaccctcagcttgcatacgcattgctgcaagctcaggttgttatgcgcatcgtggaccctgaaattgccctgaaaattctccaccggcagacgaatatccctaccctcatagccggaaatccccagcccgttcacggcgcaggccctggatcagggtcgaatgtgagcatgaaccagcagaatcctcaggcccctcaggcccaatccctgtag

SEQ ID NO: 54929 - DNA, 1794 bp, Artificial Sequence
  Description of Artificial Sequence: Synthetic coding sequence
atggctggattgaccgtgcgagacccagcggtggaccgatctttacgaagcgtttttgtaggcaatatcccctatgaggcgacagaagaacagcttaaggacatattctccgaggtaggccctgtggtcagctttcgcctggtatatgatagggaaaccggcaaacccaaggggtatggcttttgcgagtaccaggaccaggagacggcattgtcggcgatgcgaaatcttaacggccgagaattcagcggccgagctctgcgggtggacaacgcagcctcagagaagaataaagaggagctcaagagccttggaactggcgctcctgtgatagagtctccctatggggaaacgattagcccagaagacgccccagagtcaataagcaaagcagtggccagccttccaccagaacagatgtttgaacttatgaaacagatgaaattgtgtgtccagaacagtcctcaggaagctcgtaacatgctgctgcagaatcctcagctcgcctacgcactcctacaggcccaggttgtaatgcgtatcgtggaccctgagatagcccttaaaattcttcacagacagaccaatataccaactctcatcgccggtaatcctcagcccgtgcacggagctggccctggctcaggatccaacgtgtcaatgaaccaacagaacccacaggcccctcaggcacagtctctggggggtatgcatgtcaacggggctccccctttaatgcaagcgtcaatgcaaggcggtgtgccggctccaggtcaaatgcctgctgccgtcacggggccaggacctggctctcttgctccgggaggcggaatgcaggctcaggttgggatgccgggatcagggccagtgagcatggagcgcggacaagggactctgcaacatagcccagtgggacctgccggacctgcaagcattgaaagggtccaggttcctatgcaggacccaagagcagcaatgcagaggggatcactgccagccaatgtccccactccaagggggcttttaggcgatgccccaaacgatccaaggggagggacactgttatctgtgacgggagaggttgaacccagaggatacctcggcccacctcaccagggacccccaatgcaccacgtgcccggtcatgaatccagaggacctcctccacacgagttacgtggcggacccctgcccgagccgaggcccttgatggcagagccccgagggccaatgctggatcagcggggaccacccctggacgggaggggcggacgcgaccccagaggtatcgatgctaggggtatggaggctagggcgatggaggcaaggggcctggacgctaggggactggaagccagggcaatggaggccagagccatggaggcccgtgctatggaagcgagggctatggaggccagggccatggaagtgcgcggtatggaagccaggggcatggatacccggggacccgtcccgggaccacggggaccaataccatccggcatgcaaggcccatcacctatcaacatgggcgctgtggtaccccagggatccagacaggtacctgttatgcagggcactggcatgcagggagcctctatccagggaggatcccaaccaggtggattcagccccggtcagaatcaggtgacaccacaagaccatgagaaggctgctctgataatgcaggtgttgcaattgacggctgaccagatcgccatgttacccccagagcagcgacagtccatcctcatacttaaggagcagatccagaagagcacaggcgctccgtag

SEQ ID NO: 54930 - DNA, 786 bp, Artificial Sequence
  Description of Artificial Sequence: Synthetic coding sequence
atgcacggggaagctagcgatggtgagggagagggcgacactgaagtgatgcagcaggagactgtgcccgtccctgtgccgagcgaaaagaccaagcagccaaaggagtgctttctcattcagcctaaggagcgaaaggaaaatacgactaagacaagaaagagaaggaaaaagaagattaccgacgtgttggcaaagtctgaacccaaacccggtttgcctgaagacctgcagaaactcatgaaggactactatagcagtaggaggctcgtgatcgagcttgaagagcttaatctcccagattcttgcttcttaaaagccaacgacctcacccactctctcagctcatacctgaaggagatatgccccaagtgggtcaaacttaggaagaatcattccgagaaaaagagcgtcctcatgttaattatttgctcttccgctgtgagggcactggagttgattaggagcatgaccgccttcagaggcgacggtaaggtgatcaaactgtttgccaaacacatcaaggtgcaagcccaagtcaaactactggaaaagcgagttgtgcacctgggagttggcacacctggacgcattaaagaattggtcaagcagggcggactaaatttaagccctctcaaatttctggtattcgactggaactggagggatcagaagctgcgaagaatgatggacatcccagaaatccgaaaggaggtgtttgaactgctggagatgggcgtcctgtctttatgcaagtctgaatctctgaagctcggactgttttag

SEQ ID NO: 54931 - DNA, 732 bp, Artificial Sequence
  Description of Artificial Sequence: Synthetic coding sequence
atgtccccagatcaattcctgctgacagtatcagctcttcaacacgcaaggaactccggggagtttgcttacccttgcaggccacagacagaaattactgatgtgtggggaccatctatctcctatccgcgtaaagtgctgaatttcaaggggaagtccattcagcgggcagtcgacaggctacggctgtcaaatccaccaatcgatgtgaagcgcacaagtattcctttggagatccagaagcttcagcccaacttgaagatttctttgcattcccctcgggcacaaagtacaatcccggaacccatgattattcggtcccgcttcagtggttctcttaaagggggagaccaggtgacctcaagcattgagcgcgctgtttgctccaccggcccactgaccagtatgcaagtgattaagcctaaccggatgctggcaccacaggtcggcaccgcaacactgagtcttaaaaaggagagaccccgaatctacaccgctcttgatcccttcagagtgaacgcagagttcgtgctcctgactgttaaagaggagaaggagcaccaggaggccaaaatgaaagaataccaggccagagaaagcaccggtgtcgttgatcctggtaaggccagtaaggctgcctggatcagaaagatcaagggtttgcctatcgacaactttaccaagcagggaaagacagccgcacccgaactaggtcagaatgtcttcatatag

SEQ ID NO: 54932 - DNA, 759 bp, Artificial Sequence
  Description of Artificial Sequence: Synthetic coding sequence
atggatctgtgcaagaaccgcttggtaagtggcggaagagactgccaggtaaaggtgtgggacgtggatactggcaagtgccttaaaactttccgacacaaagatcccattcttgcaacgcgcatcaatgacacctatattgttagctcgtgtgaacggggtctggttaaagtgtggcacattgctatggcccagcttgtgaagacgctatccggccatgaaggcgctgttaaatgcctgttttttgaccagtggcatctgcttagcggtagcaccgacggcttagtgatggcatggagcatggtcgggaagtacgagaggtgtttgatggccttcaagcaccctaaggaagttctggatgtaagcttgctgtttttgagagtgatctctgcttgtgccgatggcaagattcgcatctacaactttttcaatggaaactgcatgaaagttatcaaggccaatgggagaggggatccagtgctgagcttcttcatccaaggaaatcggataagcgtttgccatattagcactttcgccaagcgtatcaacgtaggctggaacggcatcgagccttccgcgaccgcacaaggaggcaacgcatctctgactgagtgcgcacacgtgaggctccacatagctggccatcttcccgctagtaggctgccggtcgccgctgttcagcccatgacagggggtatggcacccaccaccgcacccacccacgtcctggctatgctgattctcttctctggagtgtag

SEQ ID NO: 54933 - DNA, 2259 bp, Artificial Sequence
  Description of Artificial Sequence: Synthetic coding sequence
atggagaacctcgaatcccgactaaagaacgcaccatactttcggtgcgaaaaagggacagactcaatccctctgtgccggaagtgcgaaacaagagtactggcttggaagatcttttccactaaggagtggttctgtcggattaatgacatctctcagaggcgctttctggttgggattctgaaacagctcaatagtctttacctgcttcattacttccaaaatatacttcagactacacagggcaaagactttatctacaatcgttcccggattgacctgtctaagaaggagggaaaggtggtgaagtcttccctgaaccagatgttggacaagacagtagagcagaagatgaaagagatcctttactggtttgctaacagcacccaatggactaaagccaactacactttgctgctgctgcagatgtgcaatcctaaattgctcctgacagctgcaaatgtcatcagggtgctcttcctgagagaggaaaacaatatctcagggctgaaccaggatattaccgacgtgtgcttctcaccagagaaggaccactcctccaagagcgctacctcacaggtgtattggacagctaagactcaacacacatccttgccacttagcaaagctccggagaatgagcatttcttgggggcagcctctaaccctgaggagccctggaggaattccctccgctgcatctccgaaatgaatagactgttttctggcaaggccgatataaccaaaccagggtacgacccctgtaacctgctggtagacctcgacgatattagagatctcagtagcggtttcagcaaatatagggacttcattcgttatcttcccatccatctctctaaatatatcctccggatgcttgataggcacaccctgaacaaatgtgcgagtgtgtctcagcactgggccgctatggcacagcaggtaaagatggacctgtccgcacatggattcatacaaaaccaaatcacctttctacaaggctcttacactaggggcatcgatccaaattatgcgaataaggtttcgatcccggtgcctaagatggttgatgacgggaaaagcatgagggtgaaacaccccaaatggaaattgagaacgaagaacgagtataacttatggaccgcctaccagaacgaagagacgcagcaggtcttaatggaggagcgtaatgtcttctgcgggacgtacaatgtgagaattctgagcgatacctgggatcagaacagagtgatccattacagtggtggtgacctgattgccgttagttcaaatcgcaaaattcacctcctggatataatccaagtgaaggctataccagtggagtttagagggcatgccggttctgtcagggctttatttctctgtgaagaagaaaattttctgttgtctggatcttatgacctgtccattcgttattgggatctgaagagcggagtctgcactcgaatatttggcggtcatcaggggactattacctgcatggatctgtgtaaaaatagactggtgtctggtggacgggattgccaggtgaaagtctgggacgtcgatacaggcaagtgcctgaagaccttcaggcataaagatccaatactggccactcgcatcaacgacacatacatcgtgagctcatgcgaacggggattagtgaaggtctggcacatagcgatggctcagcttgtcaagacactctccggacatgagggggcagttaagtgcctgtttttcgaccaatggcatcttctttccggaagtacagacgggttagtgatggcgtggtcaatggttggaaagtacgagaggtgcctcatggcttttaagcacccgaaagaggtgctggacgtttctttgttgtttctcagagtgatatcggcctgcgccgacggtaaaatccggatctataatttttttaacggaaactgtatgaaggtgattaaggccaacggaaggggggacccggtgctttcattctttatccaaggtaatagaatttctgtgtgtcatatttccacgtttgccaagaggatcaatgtgggttggaacggaatcgagcccagtgccaccgcccaaggtgggaacgcgtcacttaccgaatgcgcacatgtccggcttcacatcgcaggccacctgccagctagtcggctgcccgtcgctgctgtgcagcccatgacaggagggatggctcctacaacagctcccactcatgtgctggcaatgctgatactgttctccggggtttag

SEQ ID NO: 54934 - DNA, 567 bp, Artificial Sequence
  Description of Artificial Sequence: Synthetic coding sequence
atgttctcctgttgtttcccaacctcccgtggctgttgtttccgcaacggcggaagtgaaagcctttttcgtcggtgtcgacgcaggctgattccccacccaagacgcctgagcccggtagttataagaagaattcaagtcccgcaggactcccttggacaggccttagccggtcaagccactccagagatcccactcggcctacaattgcacactgtgcttgtacaggagattcaggagctgattgaggctcagacgctggcgccaggtccctgtgctgaggtcagagcacttcctgcccctgccgctgaacctgaacctgcctgggaggaggccccaccggaacgggcactggagttagagggtgccccagccaaagatcagaccaatgaggagctgccagagatcacggaagttcccgaaagcattaagcggagactggggagacgcgtgccagcagcaacaccggctcccagaggcaaccttctcctccaggcgtggatgcgagtccatagttgggcatcccgcctgttcgcgccaaatgttctgccagggactggaccctag

SEQ ID NO: 54935 - DNA, 369 bp, Artificial Sequence
  Description of Artificial Sequence: Synthetic coding sequence
atgccaaaaaaagcacatccaagcccccagacgccggtggcgcgttgtaataaagcccatccagcccctggcccttgcgccgaggttcgggctctgccagctcccgctgcagagccagagcccgcatgggaggaggcaccacccgagagggctctggagctagagggcgctcccgcaaaggaccagacaaacgaggagctccccgagatcaccgaagtgcccgagagcatcaaaagaaggctggggcgtagggtaccagctgccacacccgcaccaagaggcaacctcttgctccaggcatggatgagggttcactcctgggccagtcgattgttcgccccaaacgtgctcccaggaacgggcccttag

SEQ ID NO: 54936 - DNA, 846 bp, Artificial Sequence
  Description of Artificial Sequence: Synthetic coding sequence
atgttctcttgttgtttccccacttcaagggggtgctgcttcagaaatgggggatcagagtccctgttccgtcagtgtaggagaaggctgatcccacacccacgcaggctgtggccctttgttaggcgtcgcacacaggtcccccaggattcacccggacaggcccttgcgggacaggccacccccgaaataccctctggactgcctctccacattgtgttggtgcaggaagaaattcgcgaaccaatggaggcacaaactcacgccccaggaccctacgccgacatcgcagccctcgctgcgcctgccgtggaacccaaacccgcatgggaggaacctcctcccgagcgtgcattggaggtggaaggagccccagctaaagatcagccatcacaggagttaccagaaataatggcgcctacagtggctaccggattaaacgctggtgctgaaaacgtagcaggagaaagaagcggacgggaaggtgtgacttctacggcaccagcaagcaggagtcacgcggctccatcacccggacatggcggaaagcatgggggaggagatcagggtatccaaacaggtcttctctacctcgctggagagcgactgctgagcttcgccggaaccacagctctcctgctccagggactcttcattgtgctgatactggtggggtatatttcggtcaaggttatgctgaaatccattaaaacccggctcggccgacgggtacccgcagcacctcctgcactccgcaggaacctgctgctgcaggcatggaaatgtgtttgtaattgggcctcccgcctgttcgcgccaaacgtgctgccacggacaggcagctag

SEQ ID NO: 54937 - DNA, 456 bp, Artificial Sequence
  Description of Artificial Sequence: Synthetic coding sequence
atggacgccaggagaatgaagaaggaggggctaactgaaaataccgggctgcctagaaaacttctcgagaaacatgacccatggcccgcatacgtcacctatacctcccagactgtgaaacgtctgatcgagaaaagcaagactcgggagctggaatgcatgagggctttggaggaacgtccctgggcttcccgccaaaataagccatcatctgtgattcagcccaagaggaggaagtctagcaaatcaagtggcaaagccgtattccgtgatacccttagtgaaagcacactgtcaatgtggggggcatactccgtgctcgctatggctcccaccatgatcccagagccaacccacctgcacgccgactctcgtgattgtcctacggagaattacaataaaatcattttcgcgagaaaaccaatgatgcggatgctgcccactgtccgctactag

SEQ ID NO: 54938 - DNA, 459 bp, Artificial Sequence
  Description of Artificial Sequence: Synthetic coding sequence
atggatgccagaagaatgaagaaggaagaaggtttaacagaaaatactggattaccccgtaagttactcgaaaaacatgatccgtggcccgcatacgtgacatatacatcccagactgtgaaaaggttgatcgagaagtctaagactcgggagcttgagtgcatgcgcgctcttgaggagcggccatgggcctctagacaaaataagccttcttccgtgatccagcctaaacgacggaaatccagcaaatcctcaggtaaggcagtgtttagggacacattgtcagagagcacattatccatgtggggcgcttactctgtgctcgctatggccccaacaatgattccggagcccacacacctccatgctgactctagggattgcccaacagaaaactataataagatcatattcgcacggaaacccatgatgagaatgctccccaccgtcagatactag

SEQ ID NO: 54939 - DNA, 75 bp, Artificial Sequence
  Description of Artificial Sequence: Synthetic coding sequence
atggacgcacgacgcatgaaaaaggaagagggattaaccgagaatacgggccttccgagaaagctgctggagtag

SEQ ID NO: 54940 - DNA, 627 bp, Artificial Sequence
  Description of Artificial Sequence: Synthetic coding sequence
atgcagagacctgaatggccgaggccgcaccccggagaaggcgctgccgcagcaggcaggggccctgcgccacctgccagggccggtgagccttccggcctgaggctgcaggaaccctctttgtacaccatcaaagctgttttcatactggacaacgacgggagacgccttcttgccaagtactatgacgacacattcccttcaatgaaagaacaaatggtgttcgagaaaaatgtgttcaataagactagtcgcaccgaatcagaaatcgcattctttggtggtatgacaatcgtgtacaaaaattctatagatctgttcctttacgtagtgggctcaagctatgagaacgaactgatgctgatgagtgtgttgacctgtcttttcgaatccctaaatcatatgctcaggaaaaacgtagagaagcggtggttgctcgaaaacatggatggcgcttttcttgtgctcgatgaaatagtcgatgggggagtcattctcgagagcgatccccagcaagtgatacaaaaagtgaactttcgggcagatgacggaggcctgacagagcaatcagtagcccaggtgcttcagtctgccaaagagcagataaaatggtctcttctgaaatag

SEQ ID NO: 54941 - DNA, 3702 bp, Artificial Sequence
  Description of Artificial Sequence: Synthetic coding sequence
atgcctccatcttggtctcctttaatgtgtggcagagctgcagaggccgctgcttcaagcagaactcctgggagagaaatgggccaggcggtgacccgaagactgggagccggagcccgagcagctccccgaagagctatggacggcaggaccccaaggccccaggacgctcccgctcggagagagatcgccggaagttggcggaaaccaaaggcaaaggcaccgctgccgccagcagaaactaaatacacagacgtctcttctgcagctgacagcgtcgaaagcacagctttcatcatggagcagaaggagaatatgatagacaaggacgtcgagctgagcgtggtcctgcccggtgatatcatcaaatccacaacggtgcatggcagcaaacccatgatggacctgcttatctttctgtgtgcccagtaccacctgaaccctagctcctatacgatcgacctcttgtcggccgagcagaaccatattaaattcaagccaaacacacctataggaatgctcgaagtggaaaaagtgatcctgaaacccaagatgctagataagaaaaagcccaccccaataatcccagaaaaaaccgtgcgggtcgtcatcaattttaagaagacacaaaagaccatcgttcgcgtgtcaccacatgcgagccttcaggaattggcccctatcatttgctctaaatgcgaattcgatccgctccataccctactgctcaaggattatcagtcccaagaacccctagacctgactaaaagtttgaatgatttgggcctccgggaactgtatgccatggacgttaaccgcgctaccagtgttaccgtgttcagcaagtcgtccctgcaggaatcatgccagatctcccaaaacctcgatataatgaaggaaaaagagaacaaaggtttcttcagcttttttcaaagaagcaaaaaaaagagggaccagaccgcctcagctcccgctacccccctggttaataaacatcggccaacctttacaaggtcaaacacaatctccaagccttacatttctaacacccttcctagtgacgcccctaagaagcgacgggcaccactccccccaatgcccgcatcccaatccgtgcctcaggatctggcgcatatacaagaacggccagcatcttgcatcgtgaaaagcatgtccgtagacgaaacagacaagtcaccctgtgaagccggtagagtccgggcaggatccctgcagctgagttctatgtccgcaggaaattccagtctgcgcagaaccaaacgaaaagcaccgtcccccccttccaagatccccccacaccagagcgacgaaaatagtagagttacagctctccagccagtagatggagtgcctcctgatagcgcttccgaggcaaacagtccagaagaacttagcagccctgagactttccatcccggattgtccagccaggaacaatgcactgctcccaagctgatggaagagaccagcgtgtttgaatgcccagggacgccggaagcagccatcacctccctcacctcagggatctccagcgattactcgttagaagagatcgacgagaaagaagagcttagtgaggtacccaaggtggaggctgaaaacatcagtccaaagagtcaggatataccattcgtttctactgatattataaacactctgaagaacgatcccgattctgccctggggaatggctccggtgagttcagtcagaatagtatggaggagaagcaagagaccaagtcgacggacgggcaggaaccgcacagcgtcgtgtacgatacctcgaacggcaaaaaggtggtcgactccatcaggaatctgaagtcgctggggccaaatcaggaaaacgttgtgcagaatgaaattattgtgtaccccgagaataccgaagacaacatgaaaaatggcgtcaagaagactgagataaatgtggagggtgtggcaaagaataacaacattgatatggaggtcgagcgaccctcaaacagcgaggcccatgagactgacactgcgataagctataaggaaaaccacctcgctgccagttccgtgccagatcagaagctgaaccagcctagcgccgaaaaaacaaaagacgccgctatccagaccacaccaagctgcaactccttcgatgggaagcaccaggaccacaacttgtccgactccaaggtggaagagtgcgtgcagactagtaacaacaacatttcaacccaacatagctgtcttagctcacaagacagtgtgaacactagccgggagttcaggagccaaggtaccctgattatccactccgaggatcctttgacggtcaaagaccctatatgcgcccacggcaacgacgacttgttaccccctgtcgacagaattgataagaactctaccgccagttacctcaagaattatccgttgtaccgccaggactataaccctaaacccaagccatccaacgaaattacacgggagtatatccctaaaattggcatgaccacgtacaagatcgtgcctcctaaatctcttgagatttctaaagattggcaatctgagacaatcgagtataaagacgatcaagatatgcacgcattgggcaagaagcacacacatgagaacgtgaaggagacagctattcagacagaagacagcgctatctcggagtccccagaagagcctctgccgaacttgaagcccaagcccaacctgcgaactgagcatcaggtgccatcgagcgtgagctcccctgatgatgctatggtgtcgccactcaaacccgcacctaagatgacaagggacaccggtaccgcgccattcgcgcctaacttggaagaaatcaacaatatcctcgaatcaaaattcaagtcacgcgcaagtaacgcccaagcaaaaccttctagttttttcctgcaaatgcagaaacgtgtttccggtcattatgtgactagcgctgcggctaaaagcgtgcacgccgctcccaatcccgctccgaaagagctgaccaacaaagaagctgagcgtgacatgttgccctccccagaacagacactatctcctttgagcaagatgcctcattccgtgccccagcccctggtggaaaagacagacgacgacgttatcggtcaggcacccgctgaggcctcccccccacctatcgcacccaagcccgtgaccataccagcctcccaggtctcaacgcagaacttaaaaacactaaagacatttggagcaccccgtccgtactccagttcaggtccgagtcctttcgcgctggcggtcgtgaagagatcccagagctttagcaaggaacgcacagagagcccctctgcctctgctctggtccagcccccagccaataccgaggaaggtaaaacacattcggtgaacaaattcgttgatattcctcagctgggcgtctcagataaagagaacaatagcgcacacaacgagcagaacagccagatcccaactcccactgacggcccttcattcacagtgatgcgccaaagttcccttacatttcaaagcagtgaccccgaacagatgcgccagagtctactgaccgcaatcaggtcaggcgaggccgcagccaagcttaaaagggtgaccattcctagcaatacaatctccgttaacgggagaagccgcctgagccacagcatgtcgcccgacgctcaggatggtcactag

SEQ ID NO: 54942 - DNA, 3501 bp, Artificial Sequence
  Description of Artificial Sequence: Synthetic coding sequence
atggacggaaggacaccacgcccacaagacgccccagcccgtcgcaagcctaaggcaaaggcccctttgccccctgccgagaccaagtacaccgatgtatcctccgccgctgacagcgttgagtcaacagctttcatcatggagcaaaaggaaaacatgatcgacaaagacgtggaactgtcagtagtactgcctggggacatcatcaaatctacaaccgttcatggtagcaagccaatgatggacctgttaatttttttgtgtgcccagtatcatctcaatcccagcagctatacaattgacctgctctctgccgagcagaatcatatcaagtttaaacctaatacgccaataggtatgctggaagttgaaaaggttatacttaagccaaagatgctcgacaagaagaagcctactcctattatcccagagaagactgtccgcgtggtaatcaatttcaagaagacacaaaaaaccatagtgagagtctctccccacgccagcctgcaggaattggccccaatcatttgcagtaagtgcgaatttgaccctctgcacacattacttctaaaagactaccagagtcaggagcctttggatttaactaagtccctgaatgacctcggcctgagagagctatacgctatggacgtgaaccgagagtcatgccagatttctcagaatcttgatatcatgaaagagaaagagaacaaaggctttttttctttctttcagcggagcaaaaaaaagcgcgaccaaacggcctctgcccctgccacccctcttgtgaataagcaccgacctaccttcacgcggagcaataccatatcaaaaccgtacatctctaatacactccccagtgacgcacctaagaaaaggcgggctccactgccccctatgcctgcgtctcagagcgtcccccaggatcttgcacatatacaggagaggcctgcaagctgcatagtcaagtcaatgagcgtggatgaaacggataagtccccttgtgaggccggacgggtgcgggcagggtctctgcagctctcttccatgagcgccggtaatagtagcctcaggcggacaaaacggaaggccccttcaccccctagcaagattcctccccaccagagtgatgagaattcccgggtaactgctcttcagccggtggacggggtgccacctgattccgcatcagaggctaacagccccgaagaactgtcctctccggagacttttcaccccggtctgagcagccaggagcagtgcaccgccccaaagttgatggaggagaccagtgtcttcgagtgcccaggaactccagaagctgctatcacctccctgacctctgggatctccagcgattacagtctggaagagatcgacgaaaaggaagagttgtctgaggtccctaaagtggaagcggagaatattagccccaagtctcaggacatcccgttcgtatctacagatatcatcaataccctgaagaatgatcccgatagcgccctgggcaacggcagcggggaattcagtcaaaactctatggaggagaaacaagagacaaaaagtactgacggccaggagccccactctgtggtctacgatacatccaacggaaaaaaagtggtggattccatccgaaatttgaagtccttgggacccaatcaggaaaacgtgcagaatgaaatcatcgtatacccagagaacaccgaagacaacatgaagaacggggtgaaaaaaaccgagatcaatgtagagggagtggctaagaacaacaatatagacatggaggtggagcgacccagcaactctgaagcgcacgaaacggataccgccatctcatacaaagagaatcacttagctgccagttctgtgcctgatcagaagctgaatcagccctctgccgaaaagacaaaggacgccgcaattcagacaactccatcttgtaattcgttcgatggcaagcaccaggaccacaatttaagcgattcaaaagttgaggaatgcgtgcaaacatctaacaataacatcagcacacagcacagctgtctatccagtcaggattcagtcaatacctcaagagagttccgtagtcagggcactcttatcatccattccgaagacccacttaccgtaaaggaccccatctgtgctcacggcaatgacgatcttctgcctccagttgaccgcatcgataaaaacagtactgcctcctatctcaaaaattatcccctttatagacaagattacaatcctaagcccaaaccatccaacgaaatcactcgagagtacattccgaaaattggtatgactacctacaaaattgtccctcccaaatcccttgaaatttccaaagattggcagagtgagaccattgagtataaggacgaccaagatatgcacgctctcggcaaaaaacatacacatgagaacgtgaaagagactgcgatccagaccgaggacagcgcgatctccgagtctcctgaagaacctctccccaacctgaagccaaaaccaaacctgcgcacggagcaccaagtaccctcaagcgtgagtagccctgatgacgccatggtctccccactcaaacctgctcccaaaatgacaagggacacgggcactgcccctttcgctcctaacctggaagagatcaacaacatcctggagagtaaatttaagagcagagctagcaacgctcaggccaagccctcatccttttttcttcagatgcagaagagggtctcgggtcactacgtgacaagcgcagccgctaagtctgtgcacgccgctcccaatccagcccctaaagaacttacaaataaggaagccgagagggatatgttgccctctcctgaacagactcttagcccacttagcaagatgccacactcagtgccacaaccgctcgtggagaagaccgacgatgatgttattgggcaggccccagccgaagcatcccctcctccaatcgctccgaagcccgtgacgatccctgcctcacaggtatccacccagaacctaaagacattgaagacgtttggggcacccagaccctactctagctctggaccttcaccgtttgccctcgccgtggtcaagcgcagccagagcttctctaaggaacggactgagtccccatcagcatcagccctcgtgcaaccgccagccaataccgaagaagggaaaactcatagcgtgaataagttcgtggacatcccccagctgggagtatcggataaggaaaacaactccgcacataatgagcagaattcacaaattcccacacctacagatggaccttccttcaccgtgatgcgccaaagttccctgacatttcagtctagcgatcctgagcagatgcgccagtctcttctcactgctattcggtccggagaggcggctgctaagctgaagagagtaacaatcccctccaacacaatatcagtaaacggtaggtcaaggctttcccactctatgagccccgatgcacaggacggacactag

SEQ ID NO: 54943 - DNA, 3387 bp, Artificial Sequence
  Description of Artificial Sequence: Synthetic coding sequence
atggatgggagaactcctcgtcctcaagacgccccagctcgtagaaagcccaaagcaaaagcaccactccctcccgctgaaacgaaatatacggacgtgtcctcagcagccgatagtgtcgagagcactgcgtttattatggagcagaaggagaacatgatagacaaggacgtggagctgagtgtggtgctccctggggacatcataaagtcaactacagtacacggaagcaagcccatgatggatctactgattttcctgtgtgcacagtatcatctgaacccatctagttacacaatcgatctcttatctgccgagcaaaatcacatcaaatttaagccaaatacccccatcggcatgttggaagtagagaaggtgatactgaaacctaaaatgctggacaagaagaagccaacaccgatcatccccgagaaaacagtcagagtggtaattaattttaaaaagacccagaagaccattgtaagggtttccccacacgcctcactgcaggaacttgccccaattatctgcagcaagtgtgagttcgatccactgcataccttactactcaaggactatcagagtcaggaacccctcgatcttaccaaatcactgaacgacctgggcttacgggaattgtacgcaatggacgttaaccgtgaaagctgtcagatctcacaaaacttagatattatgaaagagaaagaaaacaaaggattttttagcttcttccagcgctccaaaaagaagcgggatcagacggcctcagcccctgctacaccccttgtgaataagcataggccgacattcacccgctccaacaccatttctaagccatatattagtaacactttgccctcggacgccccaaagaaacggagagctcccctgcctccaatgcccgctagtcagtccgtgccccaggatctggcacacattcaggaacgcccagcctcttgtattgttaagagcatgtcggtggacgaaacagacaagtctccttgcgaggctgggcgagtgcgggcaggctcactgcaactgagctcaatgagcgccggaaactcttcattgcgccgaactaagagaaaagcaccgtcccccccaagcaaaattccgcctcaccagagcgacgagaattcccgcgtgactgctctgcagccagtggacggagttcctcctgattcagcctctgaggccaatagtcccgaggaactgtcatctccggctggaattagcagcgattattccctggaggagattgatgagaaagaagagctcagcgaggtacccaaagtagaagcagaaaacatcagccctaagagtcaggatattccttttgtcagcaccgacattattaatactctcaagaatgacccagatagcgctctgggtaatgggtcgggcgaattctctcagaattccatggaggaaaagcaggaaactaagtctaccgatggccaagagccgcacagtgtagtgtacgacacttcgaatggcaaaaaagttgtggactcaatccggaacctcaagagtctcggccctaaccaggaaaacgtcgtgcaaaacgaaattatcgtgtaccctgaaaatacagaagataacatgaaaaacggcgtgaagaagaccgagataaacgttgagggcgtcgccaagaataacaatattgatatggaggtggaaaggccgtccaatagtgaagcccacgaaacagatacggcgatatcctataaggagaatcatttagccgcatccagcgttcctgaccagaaacttaaccagccctccgcagaaaagacaaaggacgctgccatccaaaccaccccttcctgcaactcatttgatgggaagcaccaagaccataatttgtctgattctaaagtagaggagtgtgttcaaacatctaacaacaacattagtacccagcattcatgtctcagctcccaggattcagttaatacttcaagagagtttcggtcccaaggaaccctgattatacactcggaggatccactcactgttaaggatcccatttgcgcccacggcaacgatgaccttttgcctccggtggaccgcatcgacaaaaacagtacggccagctacctcaaaaattatcctctgtatcggcaggactacaaccctaagcctaaaccctctaatgagatcaccagggaatacattcctaaaatcgggatgacaacttacaagatcgttcctcctaaaagcctcgaaatctccaaggactggcagtcggagaccattgagtacaaagacgaccaagatatgcacgccttgggaaaaaaacatacccacgagaacgtgaaagagacagctattcaaaccgaggacagcgcgatctcagaatccccagaggagccccttcctaacctgaagcctaaacccaacctacggaccgagcatcaggtgcctagcagcgtgagtagccccgatgatgctatggtgagtcccctgaagcctgcccctaaaatgacaagagacactggcacagccccatttgccccaaatctggaagagattaacaacatactcgagagcaagttcaagtcccgagccagtaatgctcaggcaaaacctagcagctttttcttgcagatgcagaagcgggtctcgggccattacgtcacgtccgccgctgctaagtcagtccatgccgctccgaatccagccccaaaagaattaactaacaaggaggccgagcgagacatgttaccctcgcctgaacagactctctccccactcagcaagatgccacacagcgttcctcagccactggtggaaaaaaccgacgatgatgtcatcggtcaggcccctgccgaagccagccctcccccaattgctcccaagcctgtcactatcccagcatcacaggtgtcgactcagaatttaaaaaccctcaaaacttttggcgcacctagaccctacagctcctctggtcccagcccctttgccttggccgttgtaaagaggagtcagagctttagtaaggagaggacagagagcccatctgcgagcgccctcgttcagccacctgccaataccgaagaagggaagactcacagtgtaaataagttcgtggatataccacaacttggcgtgagcgacaaggagaataattctgcccataacgaacagaacagtcaaattcctaccccaactgatgggccttcctttaccgttatgcggcagtcttcattgacattccagtcatctgaccctgaacagatgagacagtctctgttaactgccatccgctccggtgaagcagctgccaaactgaaacgggtcactattcctagcaataccatatccgtgaacggacggtcccgtcttagtcactccatgtcaccagacgctcaggatggtcattag

SEQ ID NO: 54944 - DNA, 3615 bp, Artificial Sequence
  Description of Artificial Sequence: Synthetic coding sequence
atgtgtggcagggctgccgaggcagctgctagctcaaggacccctggcagagagatgggccaggccgtgacaaggcgattgggagccggagccagagcagctcctaggcgggctatggatgggagaaccccaagaccccaggatgcccctgctcgacggaaaccaaaagccaaagccccactgccacctgccgagacaaagtacacagatgtaagttctgctgctgacagtgtcgagtctaccgccttcataatggagcagaaggagaacatgattgacaaagatgtggaactcagcgtggttctccccggtgacatcataaagtcaaccacagtgcatggttctaaaccaatgatggatctcctgattttcttgtgtgcccagtaccatttaaatccatcttcctatacaatcgacctcctcagtgcagaacagaaccacatcaaatttaagccaaacacccccattggaatgttggaggtggaaaaggtaatcctaaaaccaaaaatgctggacaagaagaagccaactcctattatcccagaaaagacggtccgcgtcgttatcaattttaaaaaaacacaaaaaactattgtaagggttagtccccacgcctcgttgcaggaactcgccccaatcatatgcagcaaatgtgagtttgaccctctgcacacattattactcaaagactaccaaagtcaggaacccctggatttaaccaaatcactgaatgacttggggctgcgcgaactgtatgccatggacgtgaaccgggagagttgtcagatcagccagaaccttgacattatgaaggaaaaggagaataagggatttttcagcttttttcagagatctaagaaaaaaagagatcagaccgcctctgccccagccacaccgcttgtgaataagcaccggcctacctttacgaggtccaataccataagcaagccctatatatccaacacgcttccatcagatgcgccaaaaaagagacgagccccactgccccctatgccagcctcgcagtctgtcccacaggaccttgctcacattcaggagagaccagctagttgcattgtgaagagcatgtccgtagacgagaccgacaagtcaccttgcgaggcgggacgcgtcagggctgggagcttacagctttcctccatgtctgctggcaactcttccttgcgaagaaccaaacgaaaggccccttcaccaccatccaaaataccccctcatcagtcagatgaaaattcccgggtgaccgcacttcagcccgttgacggcgtcccacccgatagcgcgtccgaggctaattcacctgaggagctcagctcacccgaaactttccaccctggtctgagttctcaagagcaatgcacggcccctaaattaatggaagagacctctgtgtttgaatgtcctgggacccctgaggctgccattactagtctgacttcagggatctcaagcgattactccttggaggagatcgatgagaaggaggagttgagtgaggtgcccaaagtggaagcggagaatatttcacctaagagccaggatataccttttgtttccaccgacatcattaataccctgaaaaatgatcccgatagcgcgctgggtaacggctccggggagttcagccagaattcaatggaagaaaaacaggagacaaagtcgaccgatggacaggagccccactctgtagtgtacgacacaagcaacggtaaaaaagtcgtagacagtattcggaatcttaagtctctgggtccaaaccaggaaaatgtgcagaatgagatcatcgtttacccagagaataccgaggacaatatgaaaaatggagtcaaaaaaacggaaatcaatgtcgagggcgtggctaagaataacaatatcgacatggaggttgagagaccctctaactccgaggcccacgagaccgacacagcaatttcctataaagagaaccacttggcagcctcttccgttcctgatcagaaattgaatcagccatcagccgagaaaacaaaggacgccgcaattcaaaccacacccagctgtaacagttttgatgggaaacaccaagatcacaatctgagcgactccaaagtggaggaatgtgtgcaaacatccaacaacaatatttctacccaacatagctgcttgtctagtcaagatagcgttaatacttcgagagaatttcggtcgcagggtactttgatcatccactctgaggacccactgaccgtgaaagacccgatctgcgcacacgggaatgatgatttactccctccagtcgataggatcgataagaattcaaccgcaagttatcttaaaaactatcccctttaccgccaggattataatcccaaacctaagccaagtaacgagataacaagagagtacatcccaaaaataggcatgacaacatataaaatagtgccacctaaaagcctggaaatatcaaaggattggcagagcgaaacgattgagtacaaggacgaccaggacatgcacgccctagggaagaaacatacgcatgagaacgttaaggagacagccatccagacggaggatagcgccattagtgaatcaccggaggaaccacttccaaacctaaagccaaagcctaacttgcggacagaacaccaagtcccttcttctgtttctagcccagacgatgccatggtctcccccctgaaaccagcaccaaaaatgacaagggacacaggaacagctccattcgcacccaacctcgaggagatcaataatatcctggagtcgaagtttaagagtagagcctccaatgcccaggccaaaccctcctccttcttcttgcagatgcaaaaacgggtctcaggacattacgtaacatcagccgctgcaaagtcggtccatgccgcacccaatcccgcaccgaaggaactaacgaataaggaagcagaacgcgatatgctgccgtcccccgaacagacgctgagccccctgagtaagatgccgcacagtgtgccccaacccctggtcgaaaaaacggatgacgatgtgatcggacaagcaccggctgaagcctcgccaccgcctattgcccctaagccagtaaccatccctgccagccaggtctctacacagaaccttaagaccttgaagacattcggagcccctaggccctatagctcaagcggccctagccctttcgcccttgctgtagtgaagagaagccagagcttctcaaaggagaggaccgagtccccgagtgcctctgcattagtgcagccacccgcaaatacagaagaaggaaaaacccattcagtcaacaagttcgtggacatcccccagctgggcgtgtccgacaaggaaaacaactcagcgcacaacgagcaaaacagccagattccaacacccaccgacggtccttcttttaccgtcatgcggcagagcagcctaacattccagtcctcagacccagaacagatgcgccaaagcctgctaacagccattcgatccggagaggctgctgcgaaactcaaaagagtgaccattccatccaataccattagcgttaatggtcgttctagactgagtcattccatgtcgcctgatgcccaggatggtcactag

SEQ ID NO: 54945 - DNA, 3501 bp, Artificial Sequence
  Description of Artificial Sequence: Synthetic coding sequence
atgtgtggcagagctgccgaggccgcagcctcctcaagaacacctgggagagagatggggcaggccgttactcgcagactgggagcaggagcccgtgccgctccacggagagccatggacggcaggactccgaggccccaagacgccccagcccgtcgtaaacccaaagccaaggctcctctgcccccagcggaaactaagtatactgatgtgtctagtgccgcagatagcgtagaaagtaccgcctttattatggagcagaaagaaaacatgattgacaaggacgtggaactgtctgtggtgctccccggagacatcattaaatctaccacggtgcacggatcaaagcccatgatggacctgcttatcttcttatgtgcccagtaccatctcaatccctcttcctacacaatcgacctcttgagcgccgagcagaatcatataaagttcaagcccaatacaccaataggaatgctcgaagttgagaaagtcatcctcaagcctaaaatgcttgacaaaaagaagccaacccctatcattcctgaaaagaccgtgagagtggtcattaactttaagaagacccagaagactatcgttagggttagcccacatgcctctttgcaggagctcgctcccatcatctgctcaaaatgcgaattcgaccctctacatactctcctactgaaggattaccagtcacaggagcctctggacctgactaaaagtctgaacgacctcggactccgcgaactttatgcaatggacgttaatagagaaagctgccagatctctcagaatcttgatattatgaaggagaaggaaaacaaaggtttcttttctttcttccagcgctccaagaagaagagggatcagacagcctccgcccctgccacgcctctggtcaacaagcacagaccgacttttaccaggtccaacacgatcagtaagccatacatctcaaacaccctgccgtccgatgcccctaaaaagcggcgagcccctctgcctcccatgcccgcatcgcagtccgtgccacaggacctagctcacattcaggagagaccagcttcctgcatcgtcaagtcaatgtctgtcgatgagactgacaaatctccatgtgaagctggtcgggtgcgcgctggatctttgcagttgagctccatgagtgcaggaaactcctcacttaggcgaactaaacgtaaagccccaagccccccttcaaagatacccccacaccaatcggacgagaatagccgggtgactgctctgcagcccgtcgacggtgttcccccagactctgcttcagaagccaactctcccgaggagctcagttcgcccgctgggatttcctccgactactctctggaggaaatcgacgagaaagaggagctctcagaggtccccaaggtggaagccgagaacatcagtccgaaatcccaggacattccatttgtgtccactgatataattaataccttaaagaacgatcctgactctgcgctgggtaacggctccggcgagttttctcagaattctatggaggagaaacaggaaactaagagtacagacgggcaggagcctcacagtgtcgtttatgacacatccaatggaaagaaagttgttgattccataaggaatcttaagtctctgggacccaatcaagaaaatgtcgtgcaaaacgagataattgtttacccggagaatactgaagataatatgaaaaatggagtgaagaaaaccgagataaacgtggagggggtcgcgaaaaataacaatatcgatatggaagtagagagaccttctaacagcgaggcccatgaaaccgacaccgctataagctacaaggagaatcatttagcggcatcctctgtacctgatcagaagctgaatcagccctctgccgagaagacaaaggatgctgccatccaaactactccatcttgcaattcgttcgatggcaagcaccaagaccataacctctccgactcaaaggttgaagaatgtgtgcagacaagtaacaataacattagcacgcagcactcctgtctctctagccaagactctgtcaacacctctcgcgaattcaggtcacagggtaccctgatcattcactctgaagatcccctcacagtgaaggaccccatctgtgcacacgggaacgacgatctgctgcccccagtggacagaatcgataaaaattctactgccagttatttaaaaaattatccactttatagacaggactacaatcctaaacccaagcccagcaacgagattacacgggagtacattcctaagatcgggatgactacatataagatagtcccgccaaagagcctggaaatcagtaaggattggcagagcgagaccatcgagtataaagacgaccaggacatgcacgccttaggaaagaagcatacccacgagaacgtaaaagaaactgccattcaaacagaggactccgcaatttctgagtcaccagaggaacccctgccaaaccttaagcccaaacccaatctcagaactgagcatcaggtgccatcctccgtgtcctcccccgatgacgcgatggtgagccctctgaaaccagcccctaaaatgactcgggacactggcactgccccattcgcaccaaacctggaggagatcaacaatatcctagagagcaaattcaagagcagggccagtaacgcccaggctaagccctcctctttcttcctgcagatgcagaagcgtgtgagcggccactatgtcacatccgcggctgccaaaagcgttcacgccgctcccaacccagcaccaaaagagctaacaaataaggaggccgagcgggacatgttacctagccccgagcagactctgtcacccctgagtaagatgcctcattcagttccccagcccttagtcgagaagactgacgatgacgttatcggccaggcccctgcggaggcttccccacccccaattgcacctaagccagtgacaatccccgcatcccaggtgtctactcagaacctcaagacgcttaaaacattcggcgctcctcggccatactcttctagtgggccatcgccatttgcattggctgtcgttaaaagaagtcagtcctttagtaaagagagaaccgagtctccatcagccagcgcattggttcagcctcctgccaacaccgaagaggggaaaactcattcagtgaacaaattcgtcgacataccccagctgggagtgtccgataaggagaataatagtgctcacaacgagcaaaacagccagatccccacccctaccgatggaccatcctttaccgtcatgagacagtcgtcactgacattccaatcaagtgaccccgaacagatgcggcagagcctcctaaccgctatacggtctggagaagccgctgcaaagctgaagcgtgttacgatcccctccaacacaatttcagtcaacgggagaagccggttgtcccacagcatgagtccggacgcccaagatggacactag

SEQ ID NO: 54946 - DNA, 420 bp, Artificial Sequence
  Description of Artificial Sequence: Synthetic coding sequence
atggacggacggacgccacggcctcaggatgctccggctcggcgaaagcctaaggccaaggccccacttcctccagccgagaccaaatataccgacgtgagctcagccgcagatagcgtagaatcaactgccttcatcatggaacagaaggaaaacatgatagataaagacgttgagctgtctgtggttctgccaggagacattataaagagcacaacagtgcatgggtccaaaccaatgatggatctgttgatattcctgtgcgcacagtaccacctgaaccctagttcctacactatagatctacttagtgcggagcagaaccacatcaagtttaagcccaacacccccatcggaatgctggaagtggagaaagttatacttaagcccaagatgctggacaaaaagaagcctacgtag

SEQ ID NO: 54947 - DNA, 474 bp, Artificial Sequence
  Description of Artificial Sequence: Synthetic coding sequence
atggacggaagaactccccgacctcaggatgctccagcacggagaaaaccaaaggccaaggctccacttccacccgcagagactaaatatacagacgtgagttctgcagccgatagcgtggaatctaccgccttcattatggagcagaaagagaatatgatagataaggacgtggagcttagcgttgtgctcccaggagacataatcaagagtaccactgtgcatggctctaaacccatgatggacctgctgattttcctgtgtgcacagtaccacctgaacccctcaagctatactattgacctgttgtccgccgagcagaaccatattaaatttaagcccaataccccaatcggaatgttggaggtggagaaggtcattctgaagcccaaaatgctggataaaaaaaagcccacccccattattcctgaaaaaactgtgcgcgtcgttattaacttcaaaaagacccagtag

SEQ ID NO: 54948 - DNA, 1080 bp, Artificial Sequence
  Description of Artificial Sequence: Synthetic coding sequence
atgtactttaagagagcccctagagcgttccctgtgcttcttaccggcgctggaaagacaaccctgctaaattacatcctgaccgagcagcattctaaaagagtggcagtgattttgaatgagtctggcgaagggtctgctctcgaaaagtctctggccgtgtcacagggaggtgagctttacgaagagtggctcgagctgcggaatggttgcctatgttgctccgtcaaagacaacggactacgtgccattgaaaacctgatgcagaagaaaggaaagttcgatgatatactgctggagactacgggattggcagacccaggggcagtgacatctatgttctgggtagatgccgaactgggatctgacatctacctagacggcatcatcacgattgttgacagtaagtacggtctgaagcatttgaccgaggaaaagccagacggcctcatcaatgaagccactcggcaggtcgcattagctgacattattctgatcaataagactgacctagtaccagaagaggatgtgaaaaaattacggacaaccattaggtcaatcaacgggcttggccagattttagagacccagaggagcagagtggatctgtccaacgtgctggatctgcacgcctttgattctttgagcggcattagtcttcagaagaaattgcaacacgtacctggaacacaacctcacctggatcaatcaattgtgaccattacctttgaagtgcctggcaatgccaaagaggaacatctaaatatgttcattcagaacttactctgggagaagaatgtgaggaacaaggacaaccactgtatggaggttattcgcctaaaggggcttgtctcaatcaaggataaatcccagcaggtcatcgtgcaaggcgtgcacgagctgtacgatcttgaggagacgcctgtgtcctggaaagatgataccgaaaggaccaacagactcgtgctaatcggcagaaacctggacaaggacattctcaaacagctgtttatcgcaaccgtcaccgaaacagagaaacagtggactacccatttcaaagaggatcaggtgtgcacttag

SEQ ID NO: 54949 - DNA, 1188 bp, Artificial Sequence
  Description of Artificial Sequence: Synthetic coding sequence
atgctgccagcagtgggatctgtcgacgaagaggaagacccagcagaggaggattgccctgaacttgtgccaattgagaccacccaatccgaggaggaggaaaaaagcggcctcggagcgaaaatcccagtgactatcattacgggatatttaggggctggaaagaccacactgctgaactatattctgacagagcagcattctaagagagtcgcagtcatactgaacgagtctggagagggatccgccctagagaagtcactcgccgtgtcccagggcggagaactctatgaagaatggctggaattacggaacggctgtctctgttgcagcgttaaggataacgggctacgggcaatcgagaacctcatgcaaaaaaagggaaagtttgatgacatactcttggaaactaccgggctggccgatcccggtgccgttacaagcatgttttgggtggatgccgagttgggcagcgatatctacttggatggaattataactattgttgactccaaatatgggctgaagcatctaaccgaggagaaacctgacggtctcattaatgaggccacacgccaggtggccctcgccgatatcatcctcataaataaaactgacctggtgccggaagaagatgtgaagaaactgaggactaccatccgatctatcaatgggttaggacagattctggagactcagcgcagcagagtcgacttgagtaacgtgctagacctccacgcattcgattcattgagtggaataagcttacaaaagaagctgcagcacgtgcctggcacccagccacatctggatcagtccatcgtgacaattactttcgaagtaccgggtaatgcaaaagaagaacatctcaacatgttcatacagaacttgctctgggaaaaaaatgtgcgtaacaaagacaatcattgtatggaggttatacgtctgaaggggctggtcagtataaaagataaaagccagcaggtcattgtccagggcgtacacgagttgtacgacctggaggagaccccagtgtcctggaaagatgacaccgaacgcactaaccggctagtcctgataggaagaaacttagacaaagatatcctgaaacagcttttcattgcaacggtaacggagaccgagaagcagtggacaacccatttcaaagaggaccaggtgtgcacgtag

SEQ ID NO: 54950 - DNA, 1044 bp, Artificial Sequence
  Description of Artificial Sequence: Synthetic coding sequence
atgctgccagccgtcggaagtgtggatgaggaagaagatccggcagaagaggattgccctgagttagtgcccatcgagaccactcagtcggaagaggaagagaaatccggcctcggcgcaaaaattccggttactattataacaggatacctgggcgcaggtaaaaccaccctgctcaactatatcctaaccgagcagcactccaaaagagtggccgtcatactaaatgagtcaggtgaggggtccgccctggagaaaagcttggccgttagccaaggcggagagctgtatgaagagtggctggagctgcgaaatggttgcctgtgttgctctgtgaaagacaacggcctgagggccattgagaatctcatgcaaaagaaagggaagtttgacgatattctcctcgagacaaccggcctcgctgatcctggtgcggtgaccagtatgttctgggttgacgcggagctcggctcagacatctacctcgacggcatcattaccatcgttgattctaagtatggacttaagcacctcaccgaggaaaaaccagacggccttattaatgaagccacccggtcaattaacgggcttggacagatactggagacgcagcggtcgagcctgcaaaagaagctgcagcatgtgcccggaacacagccccatttagatcagtcaatcgtgacaattacatttgaggttcctggcaacgcaaaagaggaacacttgaatatgtttatccagaatcttctgtgggagaagaacgtgcgtaacaaagacaaccattgcatggaggtgatcagactgaaaggcctggtttctataaaagacaaatctcaacaggtgattgtgcagggggttcatgagctctatgacctcgaagaaacacccgtcagctggaaggatgatacagagagaactaataggttggtcctgattggacgcaatctggacaaagatattctcaaacagcttttcattgctacagtgaccgagaccgaaaagcaatggaccacacacttcaaagaggaccaggtgtgcacatag

SEQ ID NO: 54951 - DNA, 249 bp, Artificial Sequence
  Description of Artificial Sequence: Synthetic coding sequence
atgctgccggctgttggatccgtggacgaggaagaagatcctgccgaagaagactgtccagagctggttccaatagaaaccacacagtctgaggaggaggagaagagtggactgggagctaaaataccagtgacaatcataaccgggtatctgggcgcaggtaaaacaacccttctcaactacatcctgacagagcagcattccaagcgggtcgccgtaattctaaacgagtctggcgaaggaaagtag

SEQ ID NO: 54952 - DNA, 342 bp, Artificial Sequence
  Description of Artificial Sequence: Synthetic coding sequence
atgcttcccgcagttggtagtgtcgatgaagaggaggaccctgcggaagaagattgccctgaattagtgcccatagagaccacccaaagcgaagaggaggaaaagagtggactgggagcgaaaatccctgtgaccataattactggctatcttggggctggaaaaactaccttgctcaattacattctgacggagcaacacagcaagagagtggccgttattctgaacgagagtggagaagggtcagctctagagaaaagcctggctgtctcacaaggtggggaactgtacgaagagtggctggagctgcggaacgggtgcctatgctgtagcgttaagtag

SEQ ID NO: 54953 - DNA, 729 bp, Artificial Sequence
  Description of Artificial Sequence: Synthetic coding sequence
atgctaccagccgtaggcagcgttgacgaggaagaggacccggctgaggaggactgcccagagttggtgcctatcgagacaacccaatccgaggaagaagagaagagcgggctaggcgcaaagattcccgtgacaataatcacgggctatctaggcgcaggcaagacaaccctgctaaactacatcctcactgagcagcactcaaagcgcgtagcagtgatattgaacgagtctggagaggggtccgcactggagaaatccctggctgtttctcagggcggagaactttatgaagagtggctggagctgagaaatggatgtttgtgctgcagcgtgaaggacaatggtctgcgcgctattgaaaatctgatgcaaaaaaaaggtaaattcgatgacattctcctagagacaaccggactggccgacccaggtgccgttgcctcaatgttttgggtggacgctgagctgggttccgacatctacttggacgggatcatcactatagttgactctaaatatggtttaaaacatttgactgaggagaaaccagacggacttatcaacgaagcaacacggcaggttgcattagccgatatcatcctgatcaacaaaacagatttggtcccagaggaagacgttaagaaattgaggactacgctcaggtacaaaatgatgtgcgttaaatgtctgcagattcacatagtgtatacggagtgttttctgctttag

SEQ ID NO: 54954 - DNA, 1080 bp, Artificial Sequence
  Description of Artificial Sequence: Synthetic coding sequence
atgtattttaaacgggcaccgcgagcctttcccgtgctgcttacaggagccggaaaaacaacattgttaaactacatcctgaccgaacaacactctaagagggtagcagtgattctgaatgaaagcggggagggcagcgccttggagaagtccctggccgtgagccaggggggagagctctacgaagagtggctagagcttcgcaacgggtgtctgtgttgtagcgtcaaggacaacgggttgagagccattgagaatcttatgcaaaaaaaggggaaattcgacgatatcctgctcgaaacaactggcctggctgacccaggcgcagtcgcctcaatgttctgggtagacgccgaactggggtcagatatttacctggacgggattattactattgtggattcaaaatacggtctcaagcaccttacagaggaaaaaccagatgggctgatcaacgaagcaactaggcaggttgcactagctgacataattctgattaacaaaacagatctggttccagaggaggatgtgaaaaagctgcgcaccactctcaggtccattaacggtctaggccaaattttggaaacccagcgatctagggtcgatctgtctaatgtgcttgacctccacgctttcgactcgctttccggtatctccttgcaaaaaaagcttcagcatgtgcccggtacacaaccccatctggaccaaagcatcgtaaccataacgtttgatgttcctggaaacgcaaaagaagaacatcttaacatgtttatccagaatctcttgtgggaaaagaacgtacgcaacaaagataaccactgcatggaagtgatccggctcaaggggctcgtctctatcaaggacaaatcacagcaagtgatagtgcagggggtgcacgagttatgcgatctggaggagacccctgtgagctggaaggacgacaccgagagaaccaaccgtcttgtgctcattggacggaatctagacaaggatatcctgaagcagctttttatcgccactgtgaccgaaactgaaaaacagtggactactcactttaaggaggatcaggtttgtacctag

SEQ ID NO: 54955 - DNA, 1044 bp, Artificial Sequence
  Description of Artificial Sequence: Synthetic coding sequence
atgctacctgctgtgggctcagtggatgaagaggaggatccagcagaggaggattgtcccgaactggtcccgatcgaaacgacccagagcgaagaggaggaaaagtccggactgggagccaagattcctgtgaccatcattactggctatctgggggctggcaagactacccttctgaactatatcctaacagagcaacactccaaacgggtggcagtaatcttaaacgagtccggggagggttctgccttagagaagagcctggccgtctcacagggaggtgagttatacgaagagtggctcgaattgagaaacggttgcctctgctgttccgttaaagataatggacttagagccatagagaacctgatgcagaaaaaagggaagttcgacgatatcctgttagaaacaacaggcctggctgatcctggtgcggtggcctccatgttttgggtggatgcggagttgggatcagatatttacctggatggaataatcactatcgtcgatagcaaatatgggctcaagcacttaactgaggaaaagcccgatgggctcatcaatgaagcaactaggagcataaacgggctcgggcagattctggagacacagcgaagctccctgcagaagaaactgcagcacgtgcctggaacccaaccgcacttagaccagagtatcgtgactatcaccttcgatgtgcccggaaatgcaaaagaggaacacctgaacatgttcattcagaatctgttgtgggagaaaaacgtgcggaacaaggataatcactgcatggaggtgatcaggctgaaaggccttgtatcaatcaaggacaaatcacagcaggtaattgtgcagggtgtgcacgaactgtgcgacctagaagagaccccagtcagttggaaggacgatacagagaggacgaacaggctggtactcatagggaggaaccttgataaggatatcctgaagcaattgttcattgcaaccgtgacagaaacagaaaaacaatggacaactcattttaaggaagatcaggtgtgtacctag

SEQ ID NO: 54956 - DNA, 1188 bp, Artificial Sequence
  Description of Artificial Sequence: Synthetic coding sequence
atgctgcctgccgtcggcagcgttgacgaagaagaagatcctgcagaggaggattgtccggaacttgttcccatcgagaccacccaatccgaagaagaggaaaaatcaggactcggggctaagattccggtgaccatcataaccgggtacctcggagcaggcaaaacaactctgctgaactacatcctgacagaacagcatagtaaacgagtagccgtcatcctgaatgagtccggcgagggcagtgccctggaaaagagcttggccgtgagccaggggggtgagctgtatgaggaatggctggaacttcggaacggttgcctgtgctgttccgttaaagataacgggctgagggccattgagaacttaatgcagaaaaaagggaagttcgatgacatcctgctggagaccaccggccttgccgatccaggggcagtggcctccatgttttgggttgacgcagagctcggcagcgacatctacttggatggcatcattactatcgtagacagtaagtacggattgaagcatttgacagaggaaaaaccggacgggctcatcaatgaagcgactcggcaagtggctctcgcggacataatcctcataaacaaaacggatctggttccggaagaggacgtaaagaagctgagaacaacactccgctcgatcaatggactgggacaaattctcgagactcaaaggagtagggtggatctcagcaacgtgcttgacctgcacgccttcgattccctaagcggaatctctctacaaaagaagttacagcacgtgcccggtacccagccccacctggaccaaagtatcgtcacaataacctttgatgtgcctggcaacgctaaggaggagcacctgaacatgttcatccagaacctcctgtgggagaagaacgtgcgcaacaaggacaaccattgcatggaagttatccgccttaaaggcctggtaagtatcaaagataaaagtcagcaggtgatcgtccagggcgtgcacgagctctgcgatctggaagagacccctgtctcatggaaggacgacactgagcgaactaatcgattggtcctgatcggcaggaacctggacaaagatatactaaagcagctgttcatcgctactgtgactgagaccgagaaacagtggacaacacacttcaaggaggatcaggtctgcacttag

SEQ ID NO: 54957 - DNA, 1128 bp, Artificial Sequence
  Description of Artificial Sequence: Synthetic coding sequence
atgctgcccgctgtgggctcagtcgatgaagaggaggaccccgctgaggaggactgtcccgaactggtgccgatagaaactactcagtccgaagaggaagagaagtccggccttggggcaaaaattcccgtgacaatcatcacgggttatttgggggctggaaaaaccacactactgaattatatactgaccgaacaacattccaaacgcgtcgccgtaatcctaaacgagtccggcgagggatctgcgcttgagaaatctctggctgtttcccagggaggggagttgtacgaagaatggcttgagctgcgtaatggctgcttgtgctgcagtgtgaaggataatggtttacgtgccattgagaacctgatgcagaagaaggggaaatttgatgacatactccttgaaacaaccggactcgcggatccaggaataataactatagtagattctaaatacggacttaagcatttgaccgaggagaagcccgatggcttaattaatgaggcaacacgacaggtcgctttggccgacattatactcattaacaagacagacctggtgccagaggaggacgtcaagaagctccgcaccaccctgcggagcatcaatgggttgggccagattttagagactcagagatctagagtggatctctcaaacgtgcttgacctgcatgcgtttgactccctgtcgggtatcagtctgcaaaagaagctgcaacacgtccccggtactcagcctcacctggatcagtctatagtcactattaccttcgatgtcccgggaaatgctaaggaggagcatttgaacatgttcattcagaaccttctgtgggagaaaaatgtacgaaacaaggataaccactgtatggaagtcatacgactgaaaggtctggtcagcataaaggataagtctcagcaagtaatcgtgcagggtgtccacgagctgtgtgacttggaggaaacaccagtttcgtggaaagatgatacagagaggactaaccgccttgttctcatcggcagaaatctcgacaaagatatcttaaagcagcttttcattgcgacagtaaccgagactgaaaagcagtggactacccatttcaaggaggaccaggtgtgcacatag

SEQ ID NO: 54958 - DNA, 282 bp, Artificial Sequence
  Description of Artificial Sequence: Synthetic coding sequence
taactcgaccttcacgcgttcgactcactgtccggaattagcctccagaaaaagttgcagcacgtgccgggaacgcagcctcatcttgatcaaagcatcgtgaccattactttcgatgttcctggcaacgccaaagaagaacatcttaatatgttcatccagaatctgctgtgggaaaaaaacgttcgcaataaagataatcattgcatggaggtgatcaggctgaaagtgcaatttacagttgccgatttctggacgaaaagcttctcctggctcctatag

SEQ ID NO: 54959 - DNA, 543 bp, Artificial Sequence
  Description of Artificial Sequence: Synthetic coding sequence
atgctccccgctgttggctcagtggatgaagaggaagaccctgctgaggaagactgtcccgaactggtccccatcgagacgacccaaagcgaggaggaggaaaagtccggacttggcgctaagatcccggtgactatcataaccggctacttgggcgctgggaagaccacactgctgaattatatcttgaccgagcagcacagtaagagagtagcagtcatactgaacgagtcgggcgaaggcagcgctctcgagaaatcattggccgtttcccagggcggtgagctgtacgaagagtggctggaacttcgaaatggctgtctctgttgtagcgttaaggataacggcctgagagccattgaaaatctaatgcagaaaaagggaaaatttgacgacatcctcctggagaccactggcctagcggaccctggcgctgtggcatctatgttctgggtcgatgcggagctcggtagtgatatctatttggacgggataatcacgatcgtcgattcaaagtacggtctgaaggtctcgcaccattag

SEQ ID NO: 54960 - DNA, 759 bp, Artificial Sequence
  Description of Artificial Sequence: Synthetic coding sequence
tgagcagtcacctctatgttctgggtcgatgctgagctaggaagcgacatctatctagacggaattatcaccatcgtggattcaaagtatggactgaaacaccttacagaggagaagcccgatggtctcatcaatgaggccacgcgccaggtggcactcgccgacatcatcctcatcaataaaactgaccttgtccccgaagaagatgtgaaaaagttacggaccactatccggtccatcaatggcctgggacagatactggaaacccaacgttcacgagtggacttgtccaatgtccttgacctgcacgcgttcgacagcctttcagggatctctcttcaaaagaaacttcagcacgtgcccggtacgcaaccccatttggatcaaagcattgtcaccatcacctttgaggtgcccggaaacgcgaaggaagagcatctgaatatgtttattcagaacctactgtgggagaaaaatgtgcgcaacaaggacaatcattgtatggaggtcattaggctgaagggactggtctcaataaaggacaaatctcagcaggttattgtgcagggagtgcatgagctctacgacctggaggaaacccccgtgtcttggaaggacgataccgagcgaaccaatcgtttggtgctgattgggcgtaacttggataaagacatcctcaagcagctgtttatagctacagtcacagagacagagaagcagtggacaacccattttaaggaggaccaggtgtgcacctag

SEQ ID NO: 54961 - DNA, 702 bp, Artificial Sequence
  Description of Artificial Sequence: Synthetic coding sequence
taggcagtgacgagtatgttttgggtcgacgccgagttgggaagtgatatataccttgacggtatcattaccatcgttgactcgaaatatggccttaaacatctcaccgaggagaagccagatgggttgatcaacgaggccaccagacaggtggccttggcagacatcatcttgattaacaaaactgatctggtcccggaggaagacgttaaaaaactgcggacgaccattcggtctataaatggactgggtcagatcctggaaacccaacgaagctctctgcagaaaaagctgcaacatgttcctggcacgcagccccatctcgatcagagtatcgtaactatcacttttgaggtacctgggaatgccaaagaggagcacttgaacatgtttatccagaatcttctttgggaaaagaatgtcaggaacaaagataaccattgtatggaggtgatccgtctcaagggactcgtctccatcaaagataagtcccagcaggttatcgtccagggagttcacgaattgtacgacctggaggagactcctgtgtcttggaaggatgacacggagcggactaataggctggtgctgatcggtcgtaacctggacaaagatatcctgaagcagctattcatcgccacagtgaccgaaacagagaagcagtggaccacccatttcaaggaagatcaggtctgcacctag

SEQ ID NO: 54962 - DNA, 420 bp, Artificial Sequence
  Description of Artificial Sequence: Synthetic coding sequence
tgagaagaagtgcgcaaacgggcaatcaggatgtttaagaacgagaagagtatcgtgacaatcacttttgaagtgcccggaaatgcaaaggaggagcatctgaatatgtttatccagaacttgctgtgggaaaaaaatgtccgcaataaagacaatcactgtatggaagttataagactcaaaggtttggtgtccattaaagacaagtcacagcaggtgatagtgcagggggtgcacgaactgtatgatctcgaagagacacccgtttcctggaaggacgataccgaacgaacaaaccgcctggttctgattggcaggaaccttgataaggatatcttaaaacagttgtttattgctactgtgacagagaccgagaagcagtggaccacgcactttaaggaagaccaggtatgcacctag

SEQ ID NO: 54963 - DNA, 531 bp, Artificial Sequence
  Description of Artificial Sequence: Synthetic coding sequence
atgtatttcacagagtttccgactgcccacgtctcctttctgccattccgggtggatctctcaaatgtgctggatttgcacgcctttgacagcctgtctgggatctccctgcagaaaaagttgcagcatgtacctgggacccagccacatttggatcagtccattgtgacaattaccttcgaggtgcccggaaatgctaaggaggagcacttaaatatgttcatccagaacctcctttgggagaagaatgtgcggaataaagataatcactgcatggaagtaattcggcttaagggcctggtgagtatcaaggacaaatcccagcaggtgattgtacagggggtgcatgagctgtacgaccttgaagaaacccccgtttcttggaaggatgacaccgagcgtacaaaccgcctcgtcctcatcggacgaaacttggataaagatattctgaaacagttgttcatagccacagtgaccgagacggagaaacagtggacaacccacttcaaagaggatcaagtttgtacatag

SEQ ID NO: 54964 - DNA, 2559 bp, Artificial Sequence
  Description of Artificial Sequence: Synthetic coding sequence
atgatgccaggaccgaggccacggaagggaccacaggcacggggacagggggtcgctgctgccaaacagatggggctgtttatggagttcgggcctgaggatatgctgctgggaatggatgaagccgaagacgacgaagatctggaggcggagttactggctttgactggcgaggcacagacgactgggaagaaacccgcaccaaagggacaggccccacttcccatggcgcatatcgagaaattggctgcagactgtatgcgtgacgtagaggaggaagaagaagaggaagggctggaagaggacgcagaactccttaccgaactccaagaggtgctgggagtggacgaagagaccgagcccctcgacggagacgaggttgcggaccccggtgggtctgaggaggaaaatggtctggaggacaccgagccaccggtccaaaccgcggttcttaccgcaagtgcacctgcggcacaggctggcgcatctcagggcctgcatgcgttgttagaggagcggattcataattatagagaggctgcagccagtgcgaaagaggcgggagaggcggcaaaagccagacgctgcgagcgtggcctcaagactctcgagagccagctggcttcagtgcggcgtggtaggaaaatcaatgaggatgagatcccaccccctgtcgctttaggaaaaagaccgctcgctccacaggagccagcgaataggagtcctgaaactgaccctcctgccccacccgctctcgagtctgacaacccttcccagcccgaaacctccctgcccggaatttctgcacagcccgtctccgacctggaccctgatccccgagctttacttagctcacgtcagagggaatataaggtcgctgcactttcggcaaagcgggctggcgaattggatcgcgctagagagctgatgcgcattgggaagcgattcggagccgtcctggaagccctggagaaagggcagcccgtcgatctcagcgcgatgcctcccgcaccagaagacttaaagccacagcaggccagccaggccccaaccgcccctagtgtaattcctccagcagttgagcgtgtccagccagtgatggcccctgacgtgccagccacaccagtggcccctactgaaagccagacagtgctcgatgcgctgcaacagcggttgaataaatatcgtgaggcaggtatacaggctcgatctggtggggatgagcggaaagctagaatgcatgagagaatcgccaagcagtaccaggatgcgattagggctcatcgcgcagggaggaaagtgaacttcgcagagcttcccgtacccccaggttttccgccaatcccaggtttggagtccactatgggagtggaggaagatgccgtggccgcaaccctggcagctgctgagaaacttgcctccgccgaagatagtgctcccgctgacaaggacgaggacgagggtgagccacccgcacaggcgcctgtggccaaaaaaccggctcgaccaacagtaccgtcttcccagcgcttgcctgaacccagggcctcaagctcgaaggagtccccaagcccatctgtcagagagcagctggcccttcttgaagccagaaaattgcagtaccagcgggcagcactgcaggctaaaagaagtcaagatctggaacaagcaaaggcatacctccgggtggcaaagtggctcgaggctcagattattcaggcaagaagtggcaggccagtggacttatctaaggtgccaagtcctctgaccgatgaagagggcgacttcattctgattcatcacgaggatctgcggctgtctcaaaaggctgaggaagtatacgcccagctgcagaaaatgcttctggaacagcaggaaaaatgcttactgttctctaagcagtttatgcatcagggtaatgtggcagaaacgacccgatttgagaagttagctcaggatcgaaagaagcagttagaaatcctgcagctggcacaggcccaggggttagatcctcccacgcaccattttgaattgaagacatttcagaccgtgaggattttctcagagttaaattccactgaaatgcacctaattatcgtgagggggatgaacttaccggcacctcctggagtgacgcctgacgacctggatgcattcgtgcggtttgagttccattatcctaattccgaccaggcacagaagtctaagacggcggttgtgaagaataccaatagccctgagtttgatcagctatttaaactgaacataaatcggaatcacagaggtttcaagcgcgtgatccagtctaaaggcatcaagttcgaaatattccacaaaggctctttctttcgaagtgacaaactggtgggcaccgcacatttaaagctggagcgcctggagaacgagtgcgaaatacgcgagatcgtcgaggtccttgatggccgaaagccgactgggggtaagcttgaggtgaaggtcagactcagggaaccactgtctggccaggacgtgcaaatggtgactgagaactggttggtgctggaaccgcgagggctgtag

SEQ ID NO: 54965 - DNA, 2268 bp, Artificial Sequence
  Description of Artificial Sequence: Synthetic coding sequence
atgcgggacgtggaagaggaggaagaggaggaggggctggaagaagatgcagaactgcttacagaattgcaggaggtcttgggagtggatgaagagactgagccactggatggagacgaggtggccgaccctggtggaagcgaagaggaaaacggactagaggacacagaaccgccagtacagacggccgtgctgaccgctagcgcccctgcggctcaggccggtgcttctcagggtctccatgctctgttagaggagcggatccataactacagagaggccgcagcctccgccaaagaggccggagaggccgctaaagccaggaggtgcgagcgcggactgaagacactggagtcacagttggcctccgtaaggcggggtagaaagatcaatgaggacgaaatcccacctcctgtagctctggggaaaagacctctagcgcctcaggaacctgcaaatcgctccccagagactgaccctcctgccccaccagcacttgaatctgataacccttcccaacctgagaccagcttgccaggcattagcgcgcaacccgtctccgatttggacccagacccgagggctctgctctcttcaaggcagagggaatacaaggttgcagccctgtctgcgaagcgcgcaggggagctagaccgggcacgcgagctgatgcggataggaaaaaggtttggcgcagtgcttgaagctcttgagaaaggacaacccgtggatttgtccgctatgccgcctgcccctgaggatctcaagcctcagcaggctagtcaggcaccaactgccccaagcgttatcccaccagcagtcgaacgggtccagcctgtgatggccccagatgtgccggctaccccagtcgctcccacggaatcccaaaccgtgctcgatgccctccagcagcggctgaacaaatatagagaggctggcatccaggcaagaagcggcggtgatgagaggaaagctaggatgcacgagagaatcgcaaagcaataccaggacgctatcagggctcatcgggctggacggaaagtgaatttcgccgagcttcctgtgccgcctggctttcccccaatccctggcctcgagagtaccatgggggtcgaggaggacgctgtggctgcgacccttgcggctgccgagaaacttgcttctgccgaggatagcgcccctgcagataaagacgaggatgaaggcgaacccccagcccaggccccagtagcaaaaaaacccgctaggccaactgttccttcctctcaacggctcccggagcctagagcgagctccagcaaggaaagccctagccccagcgtccgtgaacaactcgcgctgctcgaagctagaaaattacagtaccagagggccgcactgcaagccaagagatctcaagatctcgaacaagccaaagcttatctgcgggtagccaagtggttggaggcccagataatccaggctcgctccggcaggcctgtggatctgtccaaagtgccctcccctttaacagatgaggagggcgatttcatcctgatccaccacgaggatctgcgcttgtctcagaaggccgaagaggtttatgcccagttacagaaaatgctcctggagcagcaggaaaagtgtctgctgttctccaagcagttcatgcatcagggtaatgtggccgaaacaacccggtttgagaaactggcacaggatcggaaaaagcagcttgaaatcttgcagttagcgcaagcccaggggctggaccctcctactcatcattttgaattaaaaacattccagaccgtcagaattttttcggaactaaattcaacagaaatgcatctgattattgttagaggcatgaacctgcccgctcctccgggagtgacaccagacgacctggacgccttcgtccgtttcgagttccactatcctaattctgaccaagcccagaagtccaaaaccgctgtcgtcaagaacacaaacagccctgagttcgatcagctctttaagctcaatatcaatcgcaatcaccgcggttttaaaagggtgattcagtccaagggcatcaagtttgagatctttcataaaggaagcttcttccgcagcgataagctggtgggcactgcacacctaaagctcgagcggctggagaacgaatgcgaaatccgggaaattgttgaggtgctcgacggcagaaagccaacagggggtaaattagaggtgaagccaatggcctctacccgtcggggagtgagacctcgcctttgccggcgatag

SEQ ID NO: 54966 - DNA, 372 bp, Artificial Sequence
  Description of Artificial Sequence: Synthetic coding sequence
atgatgccagggccacgccctaggaaaggaccccaggctaggggccagggtgtggccgctgctaaacaaatgggcctattcatggagtttggtcctgaagacatgttgctcggcatggatgaggctgaagatgacgaggacctcgaagcggagcttctggctctgacaggtgaggcccagaccactggcaagaagcccgcacctaagggccaagcccctctcccgatggcgcatatcgaaaagttagctgctgattgcatgcgagacgttgaggaagaggaggaggaagagggtctagaagaagatgcaggacgcgattgtgctggcgacgactttccatccttcgcaggcttcaggagcctgtgtacgtag

SEQ ID NO: 54967 - DNA, 2577 bp, Artificial Sequence
  Description of Artificial Sequence: Synthetic coding sequence
atgatgccaggacccagacccagaaaggggcctcaggcacgagggcagggcgtggccgcagcaaagcaaatgggcctcttcatggaattcggccctgaggacatgctcctgggcatggatgaggctgaggatgatgaggacctggaggcagagttattagccctaactggcgaggcccagaccactggaaagaagcccgctcctaaggggcaggccccattgcctatggcccacatcgagaaactggccgctgattgcatgcgcgacgtcgaagaggaggaagaggaggaaggcctggaagaggatgccgagctcctgaccgagctacaggaggtcctgggggtggacgaagagaccgagccactcgatggtgatgaggtggctgatccaggtggcagtgaggaagaaaatggcctggaagacaccgaaccacctgtccaaactgccgttcttactgcgagtgcgcctgcagcacaggccggagcgagtcaaggcctccatgccttactggaggagcggatccataactatcgtgaagcagctgccagtgccaaggaggctggggaagctgcaaaagccagacggtgcgaaagagggctgaaaactttagagtctcagttagcctcagtgcggagaggcagaaaaattaacgaggatgaaatacctccaccagtggccctaggaaaaagacccctcgcccctcaagagcccgctaataggtcgccagagacagaccctccagcgcctccagccctggaatccgacaacccatcacaaccagaaaccagcctacctggaatttctgcacagccagtgtcagatcttgaccctgaccctagagccttactgagctcgagacagcgagagtataaggtggcagctctttctgccaagcgggctggcgaactggatcgtgctcgagagcttatgcggatcggcaagaggttcggagctgttctggaggccctggagaaggggcagccagtagacctgtctgccatgccacctgccccagaagatctcaagccgcagcaggcgtctcaggccccaactgcgccatccgtgatcccccctgccgtggaacgagttcagcctgtaatggctcccgacgtgcccgctacccctgtggccccaacagagtcccaaaccgtattggacgccttgcagcagcggctaaacaaatatcgggaagcaggcattcaagccaggtctggtggcgacgaacggaaggcccgaatgcacgagcgaatagcaaaacagtaccaagacgccataagggcccatcgtgcagggagaaaggtgaactttgccgagctgcccgtcccaccaggcttccccccaatccccggtctggaaagcactatgggggtcgaggaagatgcagtggcagccacattggccgctgctgaaaaattggcgagtgccgaggactcggccccagccgacaaagacgaggacgaacccccaggccacctgcagggagagcctcccgctcaggcgcctgtcgctaagaagcccgctcggccaactgttccatcgagccagcgattacccgaaccgagggcatcgagttctaaggagagcccatctcctagtgtacgagagcagctggcactgctggaggccagaaagctccagtaccagagggccgctcttcaggcaaagaggtcccaggaccttgaacaggctaaagcgtatcttagagtcgccaagtggctggaggctcaaatcatccaggccaggtcgggcaggcctgttgatctatcgaaggtgcccagtccgctgacagacgaagagggcgacttcatccttatccaccacgaggacctgaggctgtcccaaaaggctgaagaggtgtatgcccagcttcaaaagatgctgcttgaacagcaggagaaatgtttgctattttcaaagcagttcatgcaccaggggaatgttgcggagactacaagatttgagaaactggctcaggatcggaagaagcaactggaaatcctgcagctggcacaggcacagggactagatcccccaacgcaccatttcgaattgaagacgtttcagaccgttaggatcttctccgagctgaattccaccgagatgcatctgataattgtgcggggaatgaatctgccggctcccccaggagtaacccccgacgacctcgacgctttcgtgcgattcgagtttcactaccctaattcggaccaggcgcaaaaatccaagacagctgtggtaaagaataccaattctcctgaattcgaccagctcttcaagcttaacatcaatcgaaatcacaggggattcaaacgtgttatacagagtaagggaattaaattcgagatttttcataagggaagcttcttccggtctgacaagcttgtcggaaccgcacacctaaagcttgaacgcctggagaacgaatgcgagatcagagagatcgtggaagtcctggatgggaggaaaccgaccggcggtaagttggaggttaaagtcagactccgggagcccctgtccggacaggacgtgcagatggttacagaaaactggctcgtgttagagcccaggggtctttag

SEQ ID NO: 54968 - DNA, 1887 bp, Artificial Sequence
  Description of Artificial Sequence: Synthetic coding sequence
taaaagatcaacgaggacgagatccccccacctgtcgcccttggaaagagacctctggctccccaggagcctgccaatagaagcccagagaccgatcccccagccccacctgctctggagtccgacaaccccagtcagccggaaacttccctgcctggcattagcgcacagcctgtatccgacttagacccagatccccgagccttactaagctcccgccagagagagtacaaggtggcggctctgagcgccaaaagggccggagagctagatagggcaagagagctcatgagaattggaaagaggtttggtgcagtgctggaagctcttgagaagggacaaccagtggacctgtccgccatgccaccggcacctgaggacttgaaaccacaacaagctagccaggcacctacagccccaagtgtcatccccccagccgtcgagcgcgtccagccggtgatggccccagacgtgcccgctacacccgttgctcccactgaaagccagaccgttttggatgctctacaacagcgacttaacaagtaccgtgaagcaggcatacaggcacggtccgggggagatgaacgcaaagcgagaatgcacgagaggattgctaaacagtaccaagacgcgattagagcccatcgggcaggtcgcaaagttaatttcgccgaattaccagtgcccccaggtttcccccctatccctgggctggagtccactatgggcgtcgaagaagacgccgtggctgctacactagccgctgccgaaaagttggcgtcggccgaggactcagcgccagcagataaggacgaggatgagggggagcctccggcacaagctcctgtggcaaagaaacctgccaggccaactgttccctcgtcccagaggttgccagagcccagagcaagcagttctaaagaatccccgagtccttcggtccgagagcagctcgccttgctggaggctcgcaaactccagtaccagcgagctgccttgcaggccaaacgttcccaggacttagaacaagccaaggcttatctgagggtcgctaagtggctcgaggcacagatcatccaggctaggtccggtcgacccgtggacctgtctaaggtgccgtcaccattgactgatgaggagggagattttatactgatccaccacgaggacctgaggttgtcgcagaaggcagaagaagtttacgcgcagctacagaagatgctccttgagcagcaggagaagtgcctgctgttctctaagcagtttatgcaccaaggcaacgtggccgaaactacacgcttcgaaaagctcgctcaggatagaaagaaacagctggaaatattgcagctggcccaggcgcaggggctagatccgccaacccatcacttcgaactgaaaacattccagactgtccggattttcagtgaactgaacagtaccgaaatgcacttgatcatcgttcgaggtatgaacttaccagctcccccaggagtaacgcccgatgacttagatgccttcgtccgctttgaattccactatccaaatagcgaccaggcacaaaagtcaaagacagcggtagtgaagaatactaacagtccagagtttgaccaactgtttaagcttaatattaacagaaaccacagggggtttaagagagtgatccaaagtaaaggcataaagtttgagatattccataaaggctccttctttcgctccgataaactcgtcggaactgcccacttaaaattggagcggctggaaaacgaatgcgagattcgagagatcgttgaggtactcgatggcagaaaaccaacagggggaaagttggaggtgaagccgatggctagcacccggaggggtgtccgacctcgcctatgccggcgttag

SEQ ID NO: 54969 - DNA, 645 bp, Artificial Sequence
  Description of Artificial Sequence: Synthetic coding sequence
atgctgctggaacagcaggaaaaatgcttgcttttctctaagcagttcatgcaccagggcaatgttgcggaaacgactcgattcgagaaacttgcccaagatagaaagaaacagttggagatactgcagctcgcacaggcacagggcctcgacccacctacccaccattttgagctgaagacatttcagactgtgaggatcttttccgagctgaactccacggaaatgcacctgattattgtgcggggtatgaacttaccagctccacccggtgtgacccccgacgacctggacgctttcgtcagattcgagtttcactacccaaatagcgatcaggcgcagaaatctaagactgcagtcgttaagaacactaattccccagagtttgatcagctttttaagttaaacataaaccgtaatcatcgcggatttaaaagggtcatccaatcgaagggtatcaagtttgagatctttcacaagggcagcttcttcagatctgacaaactggtgggaaccgctcatcttaaactggagcgcctggaaaacgaatgcgagatccgggagatcgttgagatggaaaggttcaggaggtcggagaaaagtcacagggggactcaggaaaaggctgcctctttattcccgtag

SEQ ID NO: 54970 - DNA, 2319 bp, Artificial Sequence
  Description of Artificial Sequence: Synthetic coding sequence
tgaacaacaggtaaaaagcctgcgccaaagggccaggcaccccttcccatggcccatatcgagaagctggccgctgattgtatgcgcgacgtagaggaggaggaggaggaagaaggcctggaggaagacgccgagttactgacagaactgcaggaagtgcttggcgtggacgaagagacagaaccactggatggcgacgaagtggcagaccccggtggctccgaagaagaaaacggcttagaggatacagaaccaccagtccaaacagctgtacttaccgcctctgctccggcagcgcaggcgggagcatcccagggcctgcacgctctgctggaagaaaggatccataattacagagaagccgctgccagcgccaaggaagcaggggaagcagccaaggccagaaggtgcgaaagaggcttaaaaacattggaatctcagctcgcttctgtccgcagagggcgtaagatcaatgaggacgagatccctccacccgttgccctgggaaagcgcccactcgccccacaagagcctgctaaccgatcccctgagactgaccccccagcaccccctgcactggagtctgacccggatcccagggccctgttatcatccagacagagggagtataaagtcgcagccctcagcgccaagcgtgctggggagttggatagagcacgagagctgatgcgtatcgggaaaagattcggcgcagtattggaggctctggagaagggacagcccgtcgacctgagtgcaatgccacccgctccagaagatctgaaaccgcagcaggccagccaggccccaaccgctccctcagttatccctccagcagtcgaacgagtgcaaccagtaatggcacccgatgtccctgcaacacctgtggcccctactgagagccagactgtcttggacgctctgcaacagcggctgaacaagtaccgggaagccggaattcaggccaggagtggtggagacgagcgcaaagcaaggatgcatgagagaattgcaaagcagtatcaggatgctattcgcgctcaccgtgccggaaggaaagtcaacttcgccgagctgccagttcctcccggttttccccctatcccaggtctggagagcaccatgggagtcgaagaagatgccgtggcagccacactggcagccgctgaaaagttagcatccgcagaggatagcgctcctgctgacaaggatgaagacgagggcgaaccccctgctcaggccccagtggcgaaaaagcctgcaagacccaccgtgcccagcagtcagcgcctcccagaaccccgagctagctcttcaaaggagagcccaagccccagcgtgagagagcaactggctctgctagaggcaagaaagctgcagtatcagcgggcagcactccaggcgaagcgaagccaagacctagaacaagctaaggcctacctccgggtcgcaaagtggctcgaagcacagatcatccaggcccgatccggtaggccggtagacctgagcaaagtaccttcccccctcaccgacgaggagggtgacttcatcctgatccaccacgaagatctccgtctttcgcagaaggctgaggaagtgtatgctcagctgcagaaaatgctacttgaacagcaagaaaagtgcttactgttttccaagcaatttatgcatcaggggaacgtggccgagacgacgcggttcgaaaaactggcacaggaccgcaagaaacagctggaaatcttgcagctggcccaggcgcaaggcttggatcccccaacacaccacttcgaactaaaaacatttcaaacagttcgaatattttcagagttaaattccacagaaatgcacctgatcattgtccgcggaatgaatctgcctgcaccccctggagtgactcccgatgacctcgatgccttcgtgagatttgagtttcactatcccaattccgaccaggcacagaaatcgaagaccgccgtggtgaaaaatacaaatagcccagagttcgaccaactgttcaagctgaacatcaatcggaatcaccgcggtttcaaaagggtcatccaatctaagggcattaagttcgagattttccataagggtagtttctttcgtagcgataagcttgtgggaactgcacacctgaaattggaaagactcgagaacgagtgtgagattcgagagatagttgaggttttggatggcaggaagcccaccggcggaaagcttgaggtcaaggtgcgcctgcgtgaacctctatctggacaggacgtgcagatggtcaccgagaattggttggtgctagagcctaggggcttgtag

SEQ ID NO: 54971 - DNA, 969 bp, Artificial Sequence
  Description of Artificial Sequence: Synthetic coding sequence
atgatgaccgaaaagcatgaggatcattgtctgaaaagttgctctggtcacagttacatacgcaaaaattggttgggctgtatcgtcttccccttcagcgccctgctccagcagagcgaatttttagaccaaaccgaagtactgcagagggctcagatattcaagaagaattgcaaagctatgttccctaaccggcgaattgtgactacggtcttcaacgacgagggcatccaatttctagtgactaggtatattaaagctctgaatccgcctcagcagctactcgacatattcctgcataactccaacgccactttcgaccttatcgccaggttcgtaagcctaatcccattcgtaccaaacactccggacgagaacgatggttctgacatttggatgacctccgagcactgcatttccctcgccatcggcaacaaggaggagcacgctattttgttatgtaacttcttcttgtacttcggtaaaaaagcccttgtgttattaggaaccagcgtcctggaggggcatgtggcatatgtcgtgacgcaagagacaaacgaatacctgctgtggaatccatcaactggtcagtgctacaaacagttcgaccctttctgccctctgaagtctgtagactgcctgttcgacgacagaaacgtatggttcaacatccagcagaacaacacacctatggccgtcttttttgattacagcaaggaaagcttttggaaacagctgttacccaagaacgtccaagggacaaagatccagagtatacaggttaccggatttcctatccaaatgccatacattgacgtccaaagcatcatagacgctgtctaccaaacaggaatccacagcgctgaatttccccagacagaatttgctcttgctgtgtacatacatccctatcctaacaatatcctgagtgtgtgggtctatctggcgtccttagtacagcaccagtag

SEQ ID NO: 54972 - DNA, 417 bp, Artificial Sequence
  Description of Artificial Sequence: Synthetic coding sequence
atgcccacctgcctgaagtcaagtatttcctgtcttcgccacagagaaaccataaagagtgttgcctccgatgagaccctgcatgaagatacagtacacccattcgtcgaggtatcatttcagcataccgtgtacaagacaaacaccgccagcggttcccacccgtgttggaacgaggaaattaaagttgacttcgtaagccccggtcacgattactctttttccagtctttccaagatcaaagacaacatctacatcaacatttttgacgaaatgatgacagaaaagcatgaagatcattgtctcaaatcctgcagcggacactcctacataaggaagaactggctggggtgtatcgtgttcccattctctgctttgctgcagcagtctgaagatcggaaggactccgaagagtag

SEQ ID NO: 54973 - DNA, 1206 bp, Artificial Sequence
  Description of Artificial Sequence: Synthetic coding sequence
atgatgaccgagaaacatgaggatcactgccttaaaagctgttctggacactcctatattaggaagaattggttagggtgcattgtatttccctttagtgcgttgctgcaacagtcagagtttctggaccagacggaggtgctgcagagagcccagatattcaaaaagaactgcaaggccatgtttccaaaccggaggatcgtgaccacagtgtttaatgatgaggggatccagtttcttgtaacacgatacatcaaagcactgaacccaccacaacagttactcgatatctttctccataacagcaatgctacctttgacctcatcgccagatttgttagcttaataccatttgttcctaacacacccgatgagaacgatggcagcgacatctggatgacgagtgagcactgcatctcattggccatcggaaataaggaggagcacgcaatcttactctgcaatttctttctgtactttggtaaaaaagccctggtgctgctgggcacatccgtgctggaagggcacgtcgcatatgtggtgacccaggagacaaatgagtatcttctgtggaacccaagcaccggacagtgctacaaacagttcgacccattttgtccactgaagtccgttgactgtcttttcgacgaccgcaacgtgtggtttaatatacagcagaataacacacctatggctgtttttttcgactacagcaaagaatccttctggaagcagctgctcccgaagaatgtgcaggggaccaagatccagtcaatccagcccgaagagatcatttattttgaaaccgacaagtccatggtagaagaccttcgaaacaggattgagaggaccttgaagagcaaggtgatggaatggagaccgaagcaccctacacattggaaccggcaatgcacattcatcctcaggcagatcctacctaagctggagtttggcatcggctcctttgtttcgagcgaaggagataacgagtttgaaaggatcctccagttttattgggtcactggttttccaatccagatgccttacatagatgtccagtctatcatcgatgctgtctaccagacaggcatccactccgctgaattccctcagactgagttcgcactggcagtgtatatccatccgtatccaaataatatcctgtccgtgtgggtgtacttggcctctctggtgcaacaccagtag

SEQ ID NO: 54974 - DNA, 1653 bp, Artificial Sequence
  Description of Artificial Sequence: Synthetic coding sequence
atgagccacggccctagtcctaggctggctgaatcaccgcaattgtccaaggggagcctgctgactatcctagggagccccagtcccgagcgcatggggccagccgattctctgccaccaacccccccatctggcactccaagtccaggtcccccaccagcccttccgttaccacccgcaccagctctcctggccgatggggattgggagtctcgagaagaactgcgcctgagagaactagaggaggctcgcgcaagagccgctcagatggagaagaccatgaggcggtggagtgattgtaccgcaaattggagggagaaatggagtaaagtgcgagccgagcgaaatagggccagagaggaagtgcgtcagctgcggcagcgacttgatgcactgaccaaggagctggctggggcacggcgtgagcgtcaagaggcccaaggagaatgcgaagccagagggcgagaactcgcaaggctccgcggagccagaggcgttgctgaccagacaagagatggacccgaaccagaagctgagcgggagcctgtacgcgatgtaggaagcgagcgtcctcccggaagtcaagagttggagctggtggagtcgctgttgaagtctatgcccgaagaatccgaggactgttgggaagcaaggtctctaggagcagggggacccaggggcagtagtggaagacaggagagatcgcggctgccgtgggaagatactgccgctacagaagaggaagcttctaagcttacagcactccggttgcgccttgacgagagccagaaggttctgctcaaagagagggaggacaaactcgccttaagtcgaaacatcgagaaattggagggagagttgagccagtggaaaatcaagtatgaagaattgtccaagactaagcaggagatgctgaaacagttaagcattctcaaagaagctcatcaggacgaactcggcagaatgtcggaggacttagaggacgagctcggagccagatcttccatggatcggaagatggccgagctgaggggtgaaatggagcggctacaagcagagaacgcggcagagtggggccgtcgagaacgcctggagaccgaaaagctaggcctggagagagagaacaaaaagttacgtgcccaggttggtgatctagaagaagctctggcgaggagacggagacaaaccgcatccgctcttgattgcgatctgcgggcaagccaggccgcactgtttgagaagaacaaggaactcgccgacctgaagcacgtccacggtaaactgaaaaaacaattccaggaaaaagttgccgaactcgctcacgctaaccgacgtgtcgagcagcacgaggcggaagtgaagaagctgcggctgagggtggaagagctgaaaaaggagctagcacaggcagaggacgaactggacgaggcccacaaccaagccaggaagttgcagcggtccctcgatgaacagaccgagcagtcagaaaacctgcaggtccagctggaacacttgcagtcacgcctccgtcgccagcagcagaacgctcccctctttggcaaaatcaggtccgcgagatttggcaccgaggaggctgaggatggaacttcagacctcgacgaggacgaagatctacaaatacaagtcgcatag

SEQ ID NO: 54975 - DNA, 1542 bp, Artificial Sequence
  Description of Artificial Sequence: Synthetic coding sequence
atgaatttggattcaattcatcgcctgatcgaggagactcagatatttcaaatgcaacagtccagcatcaaaagcaggggcgatatggtcgcccctgcgtcacctccccgtgacacttgtaacacctgctttcccctgcatggtctgcaatcacacgcagcccacaatttctgtgctcatagctacaatacaaataaatgggatatttgtgaggaactgcggttgagggagctcgaggaagtgaaggcgagggccgcacaaatggagaaaactatgaggtggtggtccgattgcacagctaactggagggaaaaatggtcaaaagttcgagccgagagaaacagcgctcgggaagagggacgccagctgcgcattaagctagagatggctatgaaggaactgagtacacttaaaaagaaacagagccttccaccacagaaagaagcactcgaggctaaagtcacacaggacctcaagttgcccggatttgtcgaagagtcttgcgagcacacggaccaattccagttatcatctcaaatgcacgaatcgatacgagagtacttggtgaaaaggcaattttctactaaggaagacacaaacaacaaagagcagggggtggtcatcgattcccttaagctcagcgaggagatgaaaccgaatctagacggcgtggatctgtttaacaatggtgggtctgggaacggagaaactaagacaggcctgagactgaaggccatcaacctccctctggagaatgaagtgaccgaaatctctgcccttcaagtgcacctggatgagttccaaaaaatcctgtggaaggagagggaaatgaggacagctttggagaaagagattgaacggcttgagagtgcattatcactgtggaagtggaagtacgaggaactgaaggagagcaaacccaagaatgtgaaggagtttgacatccttctgggtcagcacaatgacgagatgcaagaattaagcggcaacatcaaagaggagagcaaaagtcagaactcaaaagacagggtcatttgcgagttgagggcagagctggagcgtctgcaggccgagaataccagcgagtgggataagagggagatccttgagcgggaaaaacagggcctggagcgggagaatagacgacttaagatccaggtgaaggagatggaggaattgttagacaagaaaaaccgattgtctgcaaactcccagtcgcctgatttcaagatgagccagatcgatctccaagagaagaaccaggaattactcaacctgcaacatgcttattacaagctgaatcggcaataccaggccaatatagcagaactgacccatgccaacaaccgggtagatcaaaatgaggccgaggtgaagaagctgcggctaagagttgaagagttgaaacaggggctgaaccagaaagaagatgagctcgacgactcactgaaccaaatccgtaaactgcagaggtcactggacgaagagaaggaacgtaatgagaacctggaaacggagcttaggcatttacagaattggtag

SEQ ID NO: 54976 - DNA, 1275 bp, Artificial Sequence
  Description of Artificial Sequence: Synthetic coding sequence
atgaacctggactctattcatcgcctaattgaggagacccagatctttcaaatgcagcagagtagcattaagagtcggggtgatatggtagctccagccagtccccctagggatacctgcaacacatgctttccactgcacggccttcagagccacgcagcacacaatttttgtgctcattcttacaacaccaataagtgggacatctgcgaggaactcagactgagagaacttgaggaagtcaaagctagagcggcacagatggaaaaaacgatgcgctggtggtctgactgtaccgcgaattggagggagaagtggtcgaaggtgcgggctgagcgtaattccgcgcgagaggagggcagacagctccgcataaaacttgaaatggcaatgaaagagctgtcaacccttaaaaaaaaacaatccttgcctccccagaaagaggccctagaggccaaggtgactcaggacctcaaactgcccggattcgtcgaggaaagttgcgaacacacagatcagttccagctcagtagtcaaatgcacgagtctatcagagaatatctggttaagaggcaattcagcactaaagaagacaccaacaacaaagaacagggggtggtaatcgatagtctcaaattaagtgaagagatgaagcccaaccttgatggagttgatcttttcaataacgggggaagtgggaacggcgagacaaagacagggctgcgtctcaaagcgattaaccttccattagaaaatgaggtaacagagatctcggccctccaggtgcacttggatgaatttcagaaaatactctggaaagagcgagacctgagttttaaatccctgaagatcgtcaacaccgaccggctaaatgcacatagcttcgggaagcggaaccgcgaaaccggcgttggattcgtttccgttgaggtggagttcgacattcttctgggccagcataatgatgagatgcaggaactgagtggcaacatcaaagaggaaagcaaatcacagaactctaaggatcgtgtcatctgcgagctgagagccgaactcgagagactgcaggcagagaacacctctgaatgggataaaagagagatcctggagagggagaaacagggacttgaacgagagaatcgaagattaaagattcaggtgaaggagatggaggagctgctggataagaagaatcgcttgagcgctaattcccagagtcccgatttcaagatgtcccaaatcgacctgcaggagaaaaaccaggacgttaaatag

SEQ ID NO: 54977 - DNA, 1542 bp, Artificial Sequence
  Description of Artificial Sequence: Synthetic coding sequence
atgaatctggactcaatccaccgactaattgaagagacacagatctttcagatgcagcagagttccatcaagtcccggggagacatggttgcaccagcatcacccccaagggatacatgtaatacatgcttccctctacacggattgcagagccacgccgcacacaatttctgcgcccatagttacaacaccaacaaatgggatatatgtgaagagctgcgactccgcgaactggaggaagtgaaggcaagagccgcacaaatggagaagaccatgaggtggtggagcgattgtaccgcaaattggagagagaaatggagcaaagtacgcgctgaaagaaatagcgccagggaagaaggtaggcagctgaggataaagctggagatggctatgaaggagcttagcacacttaaaaaaaaacagagtctgcctccacaaaaagaagcactggaggccaaggtgacacaggacctgaagttgccaggcttcgtggaggaatcgtgtgaacacaccgatcaattccagttgagttcccaaatgcatgaatccatccgtgagtacctcgtgaagagacaattttccacaaaggaggacactaacaataaggaacagggagtggtgatcgacagtctgaagttatcagaagaaatgaagccaaatctggatggggtggacctgttcaacaatggaggctccggcaatggagaaaccaaaactggactgagactcaaggcgattaacctgccacttgagaacgaggttactgagattagtgctctgcaagtacacttggatgaatttcaaaaaattctgtggaaggaacgcgagatgaggactgcccttgagaaagagatcgagcgcttggagtcagcgctcagtctgtggaagtggaagtacgaggagctcaaggagagtaagccaaagaacgtgaaggaattcgatatccttctgggtcagcacaatgatgagatgcaggagttgtccggaaacattaaagaagagagtaagtctcagaattcaaaggacagggtcatatgcgagctcagagccgagctggagcgcctgcaagctgaaaacacatctgagtgggataaacgggaaatattggagcgtgagaagcaaggtctggagagagagaatagacgactgaaaatacaggtgaaggagatggaggagctccttgataagaagaacagactgtcagcaaattctcaatccccagacttcaaaatgagccagattgatctccaggagaagaatcaggaacttctgaacctccagcacgcatactataaattgaataggcagtatcaggcaaacattgcagaactgacacatgcaaataatcgcgtcgaccaaaacgaggcggaggtcaaaaagctgagactgagggtcgaagagctgaagcagggcttaaatcagaaggaagatgagctcgatgatagcttgaaccagattcgcaagctccaacggtccctcgacgaggaaaaggagcgcaatgaaaacctcgagaccgaactgcgtcacttgcagaactggtag

SEQ ID NO: 54978 - DNA, 714 bp, Artificial Sequence
  Description of Artificial Sequence: Synthetic coding sequence
atggaaagaaacgacatcatcaattttaaagctctggagaaagagctgcaggcagccttgacggctgacgaaaagtataagcgcgaaaatgcagccaaactgagagccgtagaacagagagttgcaagctacgaggaattcagagggattgttctcgcgtctcatctgaagcctcttgaaaggaaggacaaaatgggaggaaagcgcacagtgccttggaactgtcacacaattcagggtcggacgttccaggacgtcgctacggagatctctcctgaaaaggcccctctgcagcctgaaacctcggctgacttctatagagactggcgcagacacttaccctccggtcccgaacgataccaggctctactgcagctcgggggtccaaggctgggatgtctgttccagactgatgtgggattcggcctcctgggggaacttttagtggccttggccgaccatgtggggccagccgacagagccgcagttctcggaatactgtgctccctggcttctactgggagattcaccctgaacctgtcactcctgagtagagcggagagagaatcctgcaaagggctgttccagaagctccaggcaatgggtaatccaaggtcagtcaaagagggtctgagttgggaagaacaagggttggaagaacaatcaggcggattgcaagaggaagaacggttgctacaggagctgctggagtag

SEQ ID NO: 54979 - DNA, 729 bp, Artificial Sequence
  Description of Artificial Sequence: Synthetic coding sequence
atggagcgcaacgacataattaacttcaaagctcttgagaaggaactgcaggctgctctcaccgccgacgaaaagtacaaacgagaaaacgctgccaaactgcgagccgtggagcaacgggttgccagttacgaagagtttaggggcatagttctggcctcgcatctgaaaccactggaaaggaaagataagatgggcggaaagcgaacagtcccatggaactgccacactatccagggcaggacttttcaggatgtggctactgagatctcccccgagaaagcaccactgcagccggaaacgtccgctgatttttaccgcgattggcggaggcatctgccctcagggcctgagagataccaggctctactgcaattagggggaccacggctgggctgtttattccagactgacgttggatttgggctcctgggtgagcttctggtcgccctggccgatcacgtggggcctgctgatagagcggcagtccttggaattttatgcagtcttgcttcaactgggagattcacacttaacctgtccctgctctccagagctgaaagggaatcctgtaaggggctctttcaaaagctgcaggcaatgggaaatccaaggtcagttaaagaaggcttgagttgggaggagcagggccttgaagaacagtccgggggactgcaagaggaggaacgcctgctacaggaactcctggaactgtatcaggttgattag

SEQ ID NO: 54980 - DNA, 729 bp, Artificial Sequence
  Description of Artificial Sequence: Synthetic coding sequence
atggagcgaaacgacatcatcaactttaaagctcttgagaaggagctccaggccgctttgaccgctgacgagaagtataagcgcgaaaacgcagcaaaactgcgtgccgtggagcagcgggtggcgtcttatgaagagttcagaggaattgtgctcgcttctcacctcaaacctttagagagaaaagataagatgggcggaaagaggacggtcccttggaattgtcatacaatacagggcaggactttccaggatgtggccactgagataagtcccgagaaagccccactgcaacctgagacttccgccgatttttaccgagactggaggcgccatcttccatcaggacctgagaggtatcaggcactgttgcagctgggaggacctcggctcggttgtctctttcagactgatgtggggttcggcctcctgggagagctgctggtagccctggccgaccacgttggacccgctgatcgcgctgctgtgctgggtatcctgtgttccctcgcaagcaccggccgttttaccctgaatttgtctttgctcagcagggcggaacgcgaatcctgtaaaggcctctttcaaaagttgcaggctatggggaatcccagatcagtgaaggaagggctcagctgggaagagcagggactggaggagcaatcagggggactgcaggaggaggaacggcttcttcaggaattactggagctatatcaggtggattag

SEQ ID NO: 54981 - DNA, 1104 bp, Artificial Sequence
  Description of Artificial Sequence: Synthetic coding sequence
atggccgcagaagaagaggacgaagtagaatgggtcgtggagtccatcgccggattcttgcgcggacctgactggtcgattcccattctcgactttgtggaacaaaaatgcgaggtgaactgcaaggggggtcatgtgataacacccggtagccccgaacccgtgattttggttgcatgtgtccccctggttttcgacgacgaggaggaatccaaattaacctacacagagatccaccaggaatataaagagctggtcgaaaagctgcttgagggctacctgaaggaaatcggaataaatgaggaccagtttcaagaggcttgcacaagtccactggccaaaacacataccagccaggcaattctacagcctgttctggcggcagaagattttacaatattcaaagctatgatggtgcaaaagaatatagagatgcagttgcaggccatccggattatccaggaacgcaatggagtgctgcctgattgcctcacagatggaagtgacgtcgtctccgacctcgagcatgaagaaatgaagatactgagagaggtgttgcgtaaaagcaaggaagagtacgaccaagaagaggagcgcaagcggaaaaagcagctctcggaggccaaaaccgaagagccaaccgtgcacagcagtgaagctgccataatgaacaactcccagggagacggggagcattttgcacatccaccctcagaggtaaaaatgcatttcgccaatcagagcatcgagcccctaggccgaaaagttgaacgaagtgagactagctcattgccccagaaagacctaaagatccccggattagagcacgcctccatcgagggccctatagccaatctcagcgtgttaggaacagaggagctaagacagcgcgagcactatttgaaacagaagcgggacaaactgatgtccatgaggaaggacatgagaaccaaacagatacagaacatggagcaaaagggaaagcccactggtgaggtggaggaaatgacagaaaagcctgagatgactgcggaagaaaagcaaacactgctcaaacgacggctcctggccgaaaagttgaaagaggaggtgattaacaagtag

SEQ ID NO: 54982 - DNA, 1029 bp, Artificial Sequence
  Description of Artificial Sequence: Synthetic coding sequence
atggcagcggaggaggaggacgaagtggagtgggtggtcgagtcaatcgctggtttccttagaggaccagactggtctatcccaatcttggattttgtggaacagaagtgcgaggtgtttgatgatgaggaagagagtaagctgacctacacagagatccatcaggaatataaggaactggtcgagaaattgctggagggttatttgaaagagattggaattaacgaggatcaattccaggaggcatgcacatctccactggctaaaacccacacttcacaggcaatcctccaacccgtgctggcggctgaagactttactatctttaaagccatgatggtccagaagaacatcgagatgcagctgcaggctatccgaatcattcaagagagaaatggagtcctgccagattgccttacagatggctcagacgttgtgagtgatctcgaacacgaggagatgaaaatattgcgggaagtgctgaggaaatcaaaggaagagtacgaccaagaggaggaaagaaaacgcaaaaagcaactgtccgaggccaaaactgaggagccgaccgtgcattcttctgaggcggctatcatgaacaactcgcagggagacggagaacactttgctcatcctccaagcgaggtgaaaatgcactttgccaatcagagcatagaaccgctgggaagaaaggtggagcgttcggagacctcctcccttcctcagaaagacctcaagatccctggtctggagcatgcttccatagaaggacccatcgcaaacctgtctgtcctgggcacagaggagctgaggcagagagagcattacctcaagcagaaacgagacaaattaatgagcatgcgtaaggatatgaggactaaacaaattcaaaatatggaacagaagggcaaacccacaggggaggtggaagagatgactgagaagccagaaatgaccgccgaggaaaagcaaacattgctgaagagaagattgctcgcagagaaacttaaagaggaagtgattaacaaatag

SEQ ID NO: 54983 - DNA, 1545 bp, Artificial Sequence
  Description of Artificial Sequence: Synthetic coding sequence
atgtactcccagcgcttcgggacggtgcaacgggaagtgaagggcccaactccaaaagtagtcatcgtccgctccaaacctccaaagggccagggagccgagcatcatttggaacggatcaggcgatcacaccagaagcataatgcaatactcgcctcgattaagtcgagtgagcgggataggctgaaagccgagtgggatcagcacaatgactgtaagattctggattccctggttcgcgctcgcatcaaggatgctgtgcagggattcatcatcaatattgaagagagaaggaacaaattgcgcgaactgttggctttggaagagaatgagtactttaccgaaatgcagctcaaaaaagaaacaatcgaggagaagaaagatcgtatgcgggaaaagaccaagctgctcaaggaaaagaacgaaaaggagcgccaagacttcgtcgccgaaaaactcgaccaacagttcagggaacgctgtgaggagctccgcgtggaacttttgtctatccatcaaaagaaggtgtgcgaagagcgcaaggcccaaatcgcttttaatgaggaactttcccggcagaaattggtggaagaacagatgtttagcaagctgtgggaagaagaccggctggccaaggagaagcgggaagctcaagaagccagacgccagaaagagctcatggagaacacgaggctgggcttgaatgcccagattacatccattaaggcacagcggcaggctacccaattgctgaaggaggaggaagctaggctggtcgagagtaataatgctcagatcaagcacgaaaatgagcaggacatgttaaaaaagcaaaaggctaaacaggaaactcgcactatccttcagaaagcactgcaagagagaattgagcacatccagcaggagtatcgcgacgagcaggacctgaatatgaaactggttcagcgcgcactacaggacttgcaagaggaagccgacaaaaagaaacagaagcgagaggatatgatacgtgagcagaagatctatcacaaatacctggcacaaagacgggaggaagaaaaagcgcaggagaaggagtttgacaggatcctcgaggaggataaagctaagaaactggcagagaaggacaaagagcttaggctggagaaggaagcgaggagacagctcgtagacgaggtcatgtgtaccaggaagctccaggtccaggaaaaactccagagagaggcaaaggaacaggaagaaagagccatggagcagaagcacattaacgagagcctgaaggagctaaattgtgaagagaaggagaacttcgccaggagacaaaggctggcccaggagtacaggaagcagttgcagatgcagattgcatatcagcaacaatcacaagaggcagaaaaggaagagaagaggagagagttcgaggctggggtcgctgccaataagatgtgtttagataaggtccaggaggtactttctactcaccaggtgctgccacagaatatacaccccatgaggaaggcatgtccctcaaagttgccgccatag

SEQ ID NO: 54984 - DNA, 1683 bp, Artificial Sequence
  Description of Artificial Sequence: Synthetic coding sequence
atgaatcgtaaatgggaggctaagcttaagcagatcgaggagcgggcatcccactatgagcggaaacccctgtcgagtgtgtacagaccccgactgagtaagccagaggaacctccttctatttggcgcttattccataggcaggctcaggcctttaattttgtgaagagctgtaaggaagacgttcacgtcttcgccctagagtgtaaagtgggcgatggccagcgaatttatctcgttaccacttatgcagagttttggttttattataagtcgcgcaagaatctacttcactgctatgaggttattccagaaaacgctgtgtgcaaactgtattttgacctcgaatttaacaagcctgcaaaccctggggctgatggcaagaaaatggtggcactcttaatcgaatacgtgtgcaaagctctgcaagaattatacggagtaaactgtagcgcagaagacgttttgaacctggactcgtccacagatgagaaattttcgcagcatttgattttccagctgcacgatgtggcgtttaaagacaatatccatgtgggtaactttttgaggaaaatcttgcagcctgctttggatctgctgggttccgaggatgacgactctgctcccgaaaccactggtcacggattcccacactttagcgaagccccagctagacagggcttcagcttcaataagatgttcacagagaaagccacagaagaaagttggacaagcaattccaaaaagcttgaaagactcggtagtgctgaacagagctctccagatctaagcttccttgtggtgaagaataacatgggtgagaagcatctgttcgtagacctaggagtgtacactcggaatcgaaatttcaggttgtataaaagctcgaagatcggaaagcgagtggctcttgaagtgacggaagacaacaaatttttccccattcagtcaaaagacgtctctgatgaataccagtatttcctgtcatccctggtgtccaacgtgcgcttcagtgacaccctgcgcattctgacgtgcgagccgagtcagaataaacagaaaggagtgggatatttcaacagtatcggaacttcagtggaaactatagagggctttcagtgctctccttatccggaggtagatcattttgtgctcagtctggtcaacaaggacggaataaaagggggaatccggagatggaactatttctttccagaggaactgcttgtgtatgatatctgcaaatacaggtggtgtgaaaacatcggcagagcccataagtcaaacaatatcatgatactcgtggacctaaagaacgaggtgtggtaccagaagtgccatgatcccgtatgtaaggctgaaaattttaagtcggactgctttccccttcctgcggaggtctgtcttctatttctctttaaagaagaagaggaattcacgaccgacgaagccgacgagacacggagcaatgaaactcagaatcctcataaacccagcccctcgcgcctgtccactggcgcttcagccgatgccgtgtgggacaatggaattgacgacgcctacttcctcgaagccacggaggatgccgagctggctgaggccgcagagaattctctgctgtcatataactccgaggtggacgagatcccggatgagctgatcatagaggtgctgcaggaatag

SEQ ID NO: 54985 - DNA, 1590 bp, Artificial Sequence
  Description of Artificial Sequence: Synthetic coding sequence
atggctgcccttactaccgttgtggtggcagccgctgccactgcggtagctggagctgtcgctggggctggggcagccactggaactggtgtgggggcaacacctgctccccagcagtcggacgggtgcttctctacgagcgggggaatccggccatttcatctgcagaactggaagcagaaagttaaccagaccaaaaaggcggagtttgtgaggaccgcagaaaagttcaaaaatcaggttatcaatatggaaaaagataagcactcgcacttctacaatcagaaaagtgatttcaggatcgagcacagcatgctcgaagaactggaaaataagctaattcactctcggaagacagagcgtgccaaaatacaacagcaactggcaaaaatacacaacaatgtgaaaaagctccaacaccagctaaaagacgtgaagcctacacccgacttcgtggaaaaactcagagagatgatggaggaaattgagaacgctattaatacatttaaggaagagcagagactaatctatgaagagctcatcaaagaagagaagacaacgaataatgaactgtctgctatttcccgcaagatagatacttgggctctcggaaactctgagaccgagaaggccttccgggctatctcttctaaagtgcccgtggataaagtcacaccttcaaccttgccggaggaggtcttagatttcgaaaagtttctgcagcagacggggggacggcagggtgcatgggacgactacgatcaccaaaattttgtcaaagtccgtaataaacacaagggcaaacccacctttatggaagaggtgcttgagcatctccccggaaagacccaggacgaagttcaacagcatgaaaagtggtaccagaaattcctagcgctggaagaacgcaaaaaagaatcgatccagatatggaagaccaaaaagcagcagaagagggaagaaatctttaaacttaaagaaaaagccgacaacacgccagtcttatttcataataaacaggaggacaaccagaagcaaaaagaagagcagaggaagaagcaaaagctagcggtcgaggcatggaagaagcagaaaagcatcgaaatgagtatgaaatgcgcctcacaacttaaggaggaagaggaaaaggaaaagaagcatcagaaggaacggcaacgccaattcaaactcaagctcttgctggagagctacacacaacagaagaaggagcaggaggagttcttgagactggagaaggagattcgggagaaagctgagaaggctgagaagcgaaagaacgcggcagatgagatctctcgattccaggagagggatctgcacaaacttgagcttaagatcctcgacaggcaggccaaagaggatgagaagagccaaaagcaacgtcgtttggcaaaattaaaggagaaagtggagaacaacgtgtcaagagatccttcacggctttacaagcccactaaaggctgggaggagcgcacaaagaaaatcggcccaacaggcagcgggcctctgctgcacatacctcatagagctatccccacctggcgacagggaattcagagacgggtgtag

SEQ ID NO: 54986 - DNA, 1341 bp, Artificial Sequence
  Description of Artificial Sequence: Synthetic coding sequence
atggagaaggacaagcactcgcatttctacaaccagaagtctgactttaggatcgaacacagcatgctagaagaactcgagaacaagctcattcacagtaggaagactgagcgggcaaaaatacaacaacaactggccaagattcacaataatgtgaagaaattacagcaccagctcaaagacgttaagcctactcccgatttcgtggaaaaattgagagagatgatggaagaaatcgagaacgcgatcaacacttttaaggaggaacagaggctgatttacgaggagctgataaaagaagagaaaaccacaaacaatgagctctccgccatatcccgaaagatagacacgtgggcactcggtaacagtgaaacagaaaaagcattccgcgctatttcctctaaagtgcccgtcgataaggtgacccctagcaccctgcctgaagaggttctggacttcgaaaagtttttgcaacagacggggggacgccaaggcgcttgggacgactacgaccaccagaattttgtgaaagttcgtaataagcataaaggcaaaccaacttttatggaagaggtgctcgaacacctgcccggtaaaacccaggacgaagtccagcaacacgaaaagtggtatcagaagttcttggccttagaagagaggaagaaagagtcgatccagatttggaagacgaaaaagcagcagaagagggaggaaattttcaagctgaaagaaaaggccgacaatactccagttctctttcataacaagcaggaagacaatcagaagcagaaggaggaacagcgaaagaagcagaagctggctgtcgaagcctggaagaaacaaaagagtatagagatgtccatgaaatgcgcctcccagctgaaggaggaggaggaaaaagaaaagaaacatcagaaagagaggcagagacagttcaaactgaaacttctgttggaatcatacactcagcagaagaaggagcaagaggagtttcttcgactggaaaaggaaattcgcgagaaggcagaaaaggcagagaagagaaagaatgctgcagacgaaatctctcggtttcaggagcgggatttacacaagcttgaattgaaaatccttgaccgacaagcaaaagaagatgaaaagtctcagaaacaaaggcgcttagccaagctgaaagagaaggtcgaaaataatgtgtcccgggaccccagtcggctctataaacccacaaaaggctgggaagagcgcacaaaaaaaatcgggccaacaggatctggtcctcttctacatataccacaccgggctatcccaacctggcgccaaggtattcagaggcgggtgtag

SEQ ID NO: 54987 - DNA, 798 bp, Artificial Sequence
  Description of Artificial Sequence: Synthetic coding sequence
atgagtgctgcacctctggttggttattcatcctccggtagcgaggatgagagcgaagatgggatgaggactcgccctggggatggctcccaccggagagggcagagtcctctgccgaggcagagattcccggttcccgattcggtcctaaacatgtttcccggaacagaggagggaccagaggatgacagcacaaagcacgggggtcgcgtgcggaccttcccccatgagaggggcaactgggctactcacgtgtatgtaccctatgaggcaaaagaagagtttctggacttactggatgtcctgctacctcacgcccagacctatgtgcccagactggtccggatgaaagtgttccacctctctctgtcacagtcggtggttttgaggcatcattggatcctgccattcgtgcaggctctcaaagcaaggatgacaagcttccacagattcttcttcaccgccaatcaggtaaagatttacactaatcaggagaagactagaacattcattgggctggaggtgacttctggccacgcacagttccttgatctagtttccgaggtggatcgagttatggaagaatttaacctcacgaccttttaccaagatccaagcttccacttatccctggcctggtgcgtaggcgatgctaggctgcagctcgaggggcagtgtctgcaggaattgcaggctattgtggatggcttcgaggatgcggaagtgctcctcagagtgcatactgaacaggttagatgtaagtcgggcaataagttcttttccatgccattaaagtag

SEQ ID NO: 54988 - DNA, 972 bp, Artificial Sequence
  Description of Artificial Sequence: Synthetic coding sequence
atgactgatgatgagagcgaatctgttctgtccgactcacacgagggcagcgagctcgaactgcccgtgattcaactctgcggcttagtggaagagctgagttacgtgaacagcgcactgaaaacagaaacagagatgttcgagaagtattacgccaaactggagcctagagaccaacgaccaccacgattgagtgagatcaagatttccgctgcggactacgctcaggccattatcgaggaagcggagatcaggtggtcagaggttagtagggaggtccatgagtttgaaaaggacattttgaaagccatctccaagaaaaaaggtagcattctcgctacacagaaggtgatgaaatatatcgaagacatgaaccgccgtcgcgacaatatgaaggaaaagttgcgcttaaaaaacgtgagcctgaaagtgcagagaaagaaaatgctcctccagctccgccaaaaggaggaagtgtctgaagctctccacgatgtggactttcagcagttaaagattgagaatgcgcagtttctggagaccattgaagcaagaaaccaggaactcactcaacttaaattaagcagcggaaacacactccaggttctcaatgcctataaatctaagctgcataaggctatggagatttacctgaacctggacaaggaaatccttcttcggaaggaactcctggaaaagattgaaaaagaaactctgcaagtcgaggaagacagagccaaggcagaagctgtgaacaagcggttgagaaaacagctggccgaattcagggctcctcaggtaatgacctatgtcagagagaaaatccttaatgccgatctggagaagtctatccggatgtgggagcgtaaagtagagatcgctgagatgtcactgaaaggacacaggaaggcctggaaccggatgaagataaccaacgaacagcttcaagctgactacttggctggcaagtag

SEQ ID NO: 54989 - DNA, 2013 bp, Artificial Sequence
  Description of Artificial Sequence: Synthetic coding sequence
atggagggggagagaagagcttactccaaagaggtgcaccagagaataaataaacagctggaggagataagacgcctggaggaggtccgcggtgatctgcaggtgcagatctctgcagcccagaaccaggtgaaacgcttgagggactcccagcgtctggagaatatggatagattgctaaaggggcgtgcccaagttcaggccgagatcgaggagctgcaggaacaaaccagagcccttgataaacagatccaggagtgggagactcggattttcactcatagcaagaacgtccgctcccccggattcattttggaccagaaagttaaaattaggaggaggatccggattctggaaaaccagctcgaccgcgtgacttgccactttgataaccagttggtgcgtaatgcagccctgagagaggagcttgacttactgcgcatagatcggaaccggtacctgaatgtcgacagaaaactaaaaaaggagatccaccacctccatcacctcgtcagcacgctgattctgagctcaactagcgcctacgcggtacgggaagaagcgaaggccaagatggggttgctgcgcgagagggcggaaaaagaggaggcccagtccgagatggaagcccaggtgctgcagagacaaattttgcacttggaacaactgcatcactttttgaagcttaagaataatgatcggcagccggacccagacgtgttagaaaagagagagaaacaagctggtgaggtcgccgagggagtgtggaagacaagccaggagagactcgtgctctgctatgaagacgcgctcaacaagttgagccaactcatgggagagagcgatccagatcttctggtacagaaatatctggagattgaggagcgaaattttgctgagtttaacttcattaatgagcagaaccttgaattggaacacgtgcaggaagagatcaaggagatgcaggaggccctggttagtgctcgggcatcaaaggacgatcagcacctgcttcaagagcagcagcagaaggtgttacagcagagaatggacaaagtgcactccgaggcagagcgcctggaagcccgttttcaagatgtgcggggacagttggaaaagctgaaagccgatatacagctgctcttcactaaggcgcactgcgacagctccatgatcgatgacctcctgggagttaagaccagcatgggggacagagacatgggtttatttctgtccctgatcgagaagcgcctggtggagttgctcacagtgcaggccttcttgcacgctcaatcctttactagcctcgctgacgccgcactgctagttcttggccaaagcctggaggacttacccaagaagatggccccattgcagcccccagataccctcgaagaccccccagggtttgaggcttccgatgattatcctatgtcgagagaagagcttctgagtcaggtggaaaaactggtggaattacaagaacaggccgaagcacaaaggcaaaaggatctagctgccgctgcggcaaagttggatgggaccctctcagttgacctcgcctccacccaacgcgcaggctcaagcacagtcttagttcctacccgccatcctcatgcgatccccggaagcatcttgtcacataaaacttcccgagaccgcggtagcctaggacacgtgacattcgggggactgtccagctcaactgggcacctgcccagccatatcacccacggcgaccccaacacgggacacgtgactttcgggtcgacctcagcaagttctggcggtcacgtgaccttccgaccggtgtccgcctcctcatacctaggttccaccggctacgtcggatcctcccgtggcggtgagaacactgaagggggtgtggaatctggcggtactgcatcggacagttccgggggattgggctcttcccgagaccacgtatcaagcaccggcccagccagttctaccggacctggaagcagtacatcaaaagacagcagaggctag

SEQ ID NO: 54990 - DNA, 1842 bp, Artificial Sequence
  Description of Artificial Sequence: Synthetic coding sequence
atggccagatgcaggcaccattccggctacctggccgatgacgaggccagccatagtatgtgtagtgctagagttcagttgccaaaaaaaccccttgtccccgagatgaggcctgcctgtaaaccaggaagagtgccacaccctcctagtacttgtggcagctctgcactccagggccaaagacgtaataagcggcacccccagcccttcggccacttcctcgatttcctgaccgaatctcaggtcctggacagcctcgagaccgtcgtggaaaaggccacagaaagaatggcagccatgaaaacagaagccggagttcccttagtggaggtccaagaccccgtagaagtgccctccggcggtaggcgggcacatgccagaccatcacttagcaccgtgcaccgccatcgggttaggcctacgctatgtaccggccatccgaacaattatccctcgagcagcagttccatgtccaactgccatagttccctcatggccggatgtctggggtcccatagtcgagactcagacctgggcgctcaaggaagtctgcctccggtaagagacaaactgttactagagaaaaacttgaaacgccttcttcaactggagagggaaggaaaagggctgagccagagctgcagccagagagattcattactctgggactccttaggaagccagacctccttccaatggacacaggagcagcctctgtcctggttctcaggtctgctcgggagcagcagcggtgttcctgaagctagcgagcccaggcctggcgagcaggagcccatctttcgaaagagggaatttaacaaagagatcaagtccctcttgagtcagttagaaagcttggacttacccggttattgtcccctccgggagccccatcggaccctgaactttctggccgatcacagacttttccccgctctgcagagtgtggtaagccaagccgttgataaactccgtggagcgcactgtcgcgatggacgaccgttgttccccacatcactcgagcccacgagcgatctccctcctttaggttcggaacccgcaaagccaactaatggcggtcagccgtatgctagcccgaggcctaccgtctccagtccaaagatgctgcagagaaaacgcaaggacagagggggaagtccatccatgagcagcgcgcaggtcgctacccgcttcaagttgaaaagtccctgttcttcaagtaggttcaccaagaagaagcccctgccctcgatcagttcgaagagtagtatgtctcacttcagcaacaggctgtacgaggaattggctgactttctaacccaacaagctgcgagtctggtgatccgcaaatacgaattcgagaaggatctaagcaagcagctgggatttttctcttttcctattacgcacgtgctaagggatctgagcctgggtctgaagaaagttaaaggctctaggattcatctgtcctccgagacacataggtcatgcctgttaaggaaactggaggagtccaaacgagcaagacaggcctcacgcctcagcacaagccactgttcaacagagaccccctccgtccagcaggagcccgcaactcatacagcccaggaccaagcaaccgaaccttgccgcagtctctacacaaatttacccgcatccagacagctgtcacccttggaaccgaagctctacatgtctgcctgcacaggaatggggtccagtcccccaaaaagtaaggacatggataacgagggtcgcgataaagcggagattgaagatgaagacgaagacgagttcaaggacgaagaccaggatgaagacaaagatgaagatggagtttag

SEQ ID NO: 54991 - DNA, 840 bp, Artificial Sequence
  Description of Artificial Sequence: Synthetic coding sequence
atggccgcactgggaagaccttttagtggtctgcctttaagtggcggttcggactttctgcagcctccacagcccgcattccccggtagggccttcccaccaggcgctgacggtgccgagctagcccctagaccaggtccacgggctgtgccgtccagcccagcaggaagcgcagctcgcggacgagtgtccgtccactgtaagaaaaagcacaagcgcgaggaggaggaagatgacgattgcccagtcagaaaaaagagaataacggaagcagagctttgcgccggaccaaatgactggattctctgtgcccaccaagacgtagagggccacggagtcaaccccagtgtgagtggtttatctatccccggaattctggacgttatttgtgaagagatggaccaaaccacaggtgaaccccaatgcgaggtggcccgaaggaaactgcaggagatcgaagatcggatcatcgacgaagatgaagaggtagaggcagacagaaacgtcaatcatcttccgtcccttgtgctaagcgatactatgaagacaggtttgaagcgggagttcgatgaggtgtttacaaaaaaaatgattgaaagtatgagccggccaagtatggagttggtgctttggaagcccctgcctgagctgctcagtgataagcccaaacctagctccaacactaagaattacacgggtgaatctcaggccaagcacgtcgccgctggcaccgcctttcctcagcgcacagagttattttcagagcctagacctacggggatgagtctctacaacagtctggaaacagccaccagcacagaagaggaaatggagttgtag

SEQ ID NO: 54992 - DNA, 615 bp, Artificial Sequence
  Description of Artificial Sequence: Synthetic coding sequence
atggccgctttgggtcgaccattttcgggtctgcctctgagtgggggtagcgacttcctgcagcctcctcagcccgctttccctgggagagcctttccaccaggagccgatggcgcagaactcgccccacgaccaggcccacgggcagtcccatcgtcgcccgctggttcagctgcccgtggacgggtttctgtgcactgcaaaaagaaacacaaaagagaagaggaagaagacgacgaaattattgatgaagatgaggaggtcgaggccgacagaaatgtgaaccaccttccatctctcgtgttgtccgataccatgaaaacaggcctcaagcgggagtttgacgaggtgttcaccaagaaaatgatcgagagcatgagtcgtccctcaatggaacttgttctgtggaagccacttcctgagttgttgagcgataaaccaaagcccagctccaacacaaagaactatacgggcgaatcccaggctaagcacgtggccgcaggcaccgcatttccccaacgcacggaattgttttctgagcctcgcccaaccggtatgagcctgtataatagtctggagaccgctaccagcactgaggaagaaatggagctctag

SEQ ID NO: 54993 - DNA, 444 bp, Artificial Sequence
  Description of Artificial Sequence: Synthetic coding sequence
atggaccagacaactggggaaccccaatgcgaggtagctagacgaaaattgcaggagatcgaggaccggatcattgatgaggatgaagaagtggaggcagatagaaacgtcaatcatttgcctagtctagtgctgtccgatactatgaaaacggggcttaagcgtgagttcgacgaggtgttcaccaagaaaatgatcgagtcaatgagccgcccttctatggagcttgttctctggaaaccgcttcccgagctgttatctgataagccgaagccctcttcaaatactaagaattacactggtgaaagccaggccaaacatgtggcagcgggaactgcctttccccagcgtaccgagctgttctccgaacccagaccaacaggcatgagcctatataatagccttgagacagccaccagtacagaggaagagatggaactgtag

SEQ ID NO: 54994 - DNA, 786 bp, Artificial Sequence
  Description of Artificial Sequence: Synthetic coding sequence
atggccgctctcggacggcctttctccggcctccccctctcaggaggctccgattttctccagcctccccagcccgcattccctggcagagcttttcctcccggtgccgacggagccgagctggctccaaggccaggtccgcgtgcagtcccttcctcgccagccggatcagccgctcgcggaaggtgccccgtgagaaaaaagagaataaccgaggccgaactctgcgccggtccaaatgattggattctttgcgcccaccaggacgtggaagggcacggagtgaatccttccgtgtccgggttgagcattccaggaattcttgacgtaatctgtgaggaaatggaccagacaacgggagagccacagtgtgaggtggctcgacgcaagctccaggaaatagaggataggatcattgacgaggatgaagaggttgaagctgatcgaaatgtaaaccatctgccctctctcgtgcttagcgataccatgaagactgggctcaagcgggagttcgatgaagtgttcactaagaagatgatcgagtctatgagccggccatccatggaacttgttttgtggaagcctcttccagaacttctatcagataagccaaagccttcttcaaataccaagaattacacaggagagtcccaggccaagcacgtagccgctggtacagcctttccgcaacgaaccgagctgttctcggaacccaggccaaccggcatgagcttatacaatagtctggaaactgctactagcactgaagaggagatggagctgtag

SEQ ID NO: 54995 - DNA, 540 bp, Artificial Sequence
  Description of Artificial Sequence: Synthetic coding sequence
atgcaagacggccgtaagggaggagcgtatgccggaaagatggaagccaccaccgctggggtgggcaggctggaagaggaggccctaagacgaaaagaacgactgaaggctctccgagagaaaaccggcaggaaggacaaagaggatggggagcccaaaaccaagcatttgcgtgaagaagaggaagagggtgagaagcatcgcgaacttcgcctgcggaattacgttccggaagatgaggatctcaaaaaaaggcgagtgccgcaggccaagccagtcgcggttgaggagaaagtcaaagagcagctggaggctgctaagccagaaccagtgattgaggaggtggatctcgccaacctggccccacgtaaacccgattgggatctcaaaagggacgttgccaagaagttagaaaagcttaagaagaggacgcaacgcgcaattgccgaactaattagagagcgtctgaagggccaagaggacagccttgcttccgctgttgacgccgcaacagaacagaaaacgtgtgatagcgactag

SEQ ID NO: 54996 - DNA, 540 bp, Artificial Sequence
  Description of Artificial Sequence: Synthetic coding sequence
atgcaggacgggaggaagggaggagcttatgctgggaagatggaagctaccacggcgggtgtgggccgattagaggaagaagccttgaggcgcaaagaaaggctgaaagcgctacgggagaagacagggcgaaaggataaggaagatggcgagccaaaaactaagcatctgcgggaagaagaggaggagggcgagaagcaccgcgagcttaggctgaggaactatgtgccagaagatgaagatctcaagaaacggagggtgccacaggccaagcctgtggctgtcgaggagaaggtcaaagaacagttggaagccgcaaagccagaacccgtgatcgaagaggtggatcttgcaaacctagctccaagaaagccggattgggaccttaagcgcgacgtcgcgaaaaagctggagaagctaaagaaacgcactcagcgcgcaatagccgaactaatacgtgagcgcctgaagggacaggaggattcccttgcctcagccgtggatgccgctaccgagcagaaaacttgtgactcggactag

SEQ ID NO: 54997 - DNA, 309 bp, Artificial Sequence
  Description of Artificial Sequence: Synthetic coding sequence
atgcaagatggcaggaaaggaggagcctatgccggtaaaatggaggccaccacagcgggagtggggcgactggaggaggaagccctgcggcgaaaggagcgtttgaaggcgctaagggaaaagaccgggaggaaggacaaggaggacggagagccaaagaccaagcacctcagagaggaagaagaagagggcgaaaaacaccgggagctccggttgcgaaactacgtccctgaagatgaggacctgaagaaacgcagagtcccccaggctaagccagtagcagtagaggagaaggttaaggagcaatag

SEQ ID NO: 54998 - DNA, 501 bp, Artificial Sequence
  Description of Artificial Sequence: Synthetic coding sequence
atggaggctaccactgccggagtcgggcgtctggaagaagaggcccttagaaggaaagaaagacttaaagctcttagagaaaaaaccggcaggaaagataaagaggatggagagccgaagactaagcaccttagggaagaagaagaagaaggcgagaaacaccgcgagctgcgactgcggaattatgtccccgaggatgaggatctgaaaaaacgaagagtcccacaggccaagccagtggccgttgaagagaaggtaaaagaacagctcgaagccgctaaaccagagcctgtcatcgaagaagtggacctagcaaacctcgctccaagaaagcctgattgggacctgaagcgtgacgtggcaaagaaacttgagaaattaaaaaaacggacgcaacgtgccatagcagaactcattagggagcgattaaagggtcaggaagactcattagccagcgccgtggatgccgctaccgaacagaaaacatgcgatagtgactag

SEQ ID NO: 54999 - DNA, 1893 bp, Artificial Sequence
  Description of Artificial Sequence: Synthetic coding sequence
atggaggtgaaagggcagttgatctctagcccgaccttcaatgctccagcagctctgttcggtgaggccgctccgcaggtaaagtctgagcgcctgagagggcttctcgatcgccagagaacgttacaagaagccctgtctttgaagctgcaggagctaaggaaagtgtgcttgcaggaagccgagttaactgggcagctcccacctgaatgcccactagagccaggggaaaggcctcaactcgtgcggagacggccacccacagcacgggcatacccgcctcctcacccaaaccaagcccatcactctctgtgcccagccgaggaacttgccctggaagcgttggaaagggaggtttctgttcagcagcagatcgccgcagccgcacggagactcgcgctggctcccgatctgtctaccgagcagaggaggaggagaaggcaggtgcaggccgacgcgctgaggcgactccacgaactggaagagcagttgagagacgtgagggccagactgggattgcccgtgctgcctctgccacagccgctgcctcttagtaccggttcagtcataactacacagggcgtctgcctgggcatgaggctggcacagcttagccaggaggacgtcgtcttgcacagtgaatctagcagcctgagtgaatcaggcgcatcccacgacaacgaggagccacatggctgcttcagcctcgcggaacgaccatccccacctaaggcttgggaccagctcagggcagtgagtgggggatctcccgaaagaagaaccccgtggaaaccgccaccaagcgatctgtatggcgacttgaagagccggcgtaactccgttgcatcccccacctcacctaccaggagcctgccaagaagcgccagcagcttcgaggggcgaagcgtaccagcaacccccgtcttaacaaggggagccggtccccaactgtgcaaacccgagggtttacatagtaggcaatggagtgggtcccaagacagtcagatgggcttccctagagccgatcccgcaagtgacagagcctctctgttcgtcgctaggacgcgacggagcaactcatcagaagccctccttgtggatcgagccgctgggggtggcgctggcagtccacctgcgccactggccccaagcgcctctggtccacctgtctgcaaaagctctgaagtcctatacgagagacctcagccgacccctgccttttcttcgcgaacggcgggtccacccgacccccctagggcggcacggcctagctcagccgcacctgcaagccggggagctccacgcctaccccctgtatgtggtgacttcctgttggattactctctggacagaggcctacctcggagtggaggtggcaccggttggggggaacttccacctgctgccgaagtgcccggtcctctgagcaggcgcgatggcctgctgaccatgttgccgggaccaccaccagtgtatgccgcagacagtaattccccattgcttcgcaccaaggatccacacaccagggcaacacgcacaaaaccttgtggactgccccctgaggccgcagaaggtcccgaagtgcaccctaatccactgctatggatgccccctcccaccaggatccccagtgccggtgagagatctggccacaaaaacttggccctggagggactgcgtgactggtacattaggaactcagggttagcagcaggcccacagaggcgaccagttctccctagcgtcggacctccacatcccccattcctgcacgccaggtgctacgaggtcggacaggcattatacggggcaccctcccaggcacctttgccccactcccgctcctttactgcacctcctgtctccggccgttacgggggatgtttctactag

SEQ ID NO: 55000 - DNA, 1986 bp, Artificial Sequence
  Description of Artificial Sequence: Synthetic coding sequence
atggaagtcaagggccagctaatttcgagccctacattcaatgcccctgcggctctatttggggaagcagcgccacaggtgaaaagcgaacgactgaggggtctgctggaccgccaaagaaccctccaggaggccctgagcctgaagctgcaggagctgaggaaagtgtgtctgcaggaagcagaactcacagggcagctgccacctgaatgcccactggaaccaggtgagcgtcctcagctcgtccgacgaagacccccaactgcacgcgcttacccaccgccacatccaaaccaggcacatcactctctttgccccgcagaagagttggctctggaagcgctggagagggaggttagcgtgcagcagcagatagccgctgccgctaggcggctagctttggctccagatctttctactgaacagcgtcggcgacggcgtcaggtccaggccgatgctttaagaagactccacgaactggaggagcagctgcgggacgtccgggctcggctgggcctgccagtgctccctttgccacagcctctgcccttatccacagggtctgtaatcaccacacaaggggtgtgccttggcatgaggctggcccagctcagtcaagaggatgtggtgctgcattccgagtctagctcgctgagcgaaagcggcgcatctcacgacaacgaagagccacacggctgtttttcgctggccgaaagaccaagccccccaaaagcctgggaccagctccgcgcagtctcagggggatcaccagagagaagaacaccatggaagccaccaccttctgatctgtacggtgatttgaaaagccggcgtaactctgtcgcctcgccaacctccccgacacgctcccttccaaggagtgccagttcttttgagggaagatcagtgcccgctacacctgtgttgacgcgaggggctgggcctcagctatgtaagcccgagggactgcactctcgtcaatggagtggcagccaggattcccaaatgggtttccctagagcagatcccgcatctgacagggcatccctctttgtggcgcgtacgcgcagaagcaattcttcagaagccctgctggtggatagagcggcaggcggtggtgcaggcagcccccctgcaccgctggcacctagcgcaagtggcccaccagtttgcaaatcctcagaagtactttatgagcgacctcaacctacacctgccttttcaagcagaacagcaggtccccctgatcctcccagggcagcacgaccttcaagtgccgctcctgccagccgcggtgcgccacgactaccacctgtttgtggcgatttcttgctggattatagtctagacaggggcctgcctcggagcgggggaggtacaggatggggcgagctgcctcccgcagccgaggttccgggtcctctatcccggcgagacggactgttgacgatgctccctgggcctccccctgtctacgccgcagatagcaacagccccctccttaggaccaaggatccccacacaagagctactcgaacaaaaccctgcggcctaccacccgaggcagctgaaggccctgaggtgcaccctaatccactgctgtggatgccgccaccaaccaggatcccctcagccggtgagcgctccggccataaaaacctagctctagaaggtctacgcgactggtacataagaaattctggtctggcagctggcccacagcgcagacccgtgcttccatcggttgggccaccgcacccaccattcctccacgcaaggtgttacgaggttggccaagcactgtacggagctccatcccaagctcctctcccacattcaaggtcctttaccgccccacctgtttctggtcgttactatgccgattttttgtatcccccagagctgtctgccaggctgtctgaccttacattagaaggggagcagtccagcagtagcgatacccagacgccgggtacgctagtctag

SEQ ID NO: 55001 - DNA, 1857 bp, Artificial Sequence
  Description of Artificial Sequence: Synthetic coding sequence
atggaagtaaaggcagctctgttcggcgaggccgctccgcaagtaaagtccgaacggcttagagggctccttgatagacagcgcactctccaggaagctttaagcctgaagctgcaggagctaaggaaggtttgcctgcaggaggccgaattaaccggacagctgcctcccgagtgtcccctggaaccaggagagcgaccgcagctcgtgagacgcaggcctccaactgcgcgtgcctaccccccaccccatccaaaccaagctcatcactctctgtgtcccgctgaggaattagcccttgaggccctggaaagagaggtgtctgtccaacagcagatagcagccgctgctcggcgattggcactcgctcctgacttgtctacagagcagcggcgacggagacgccaggtccaggccgacgctctgaggagattgcatgaactcgaggagcaattaagggatgtgagagcacgcctcggactgccagttctgcccctgcctcagccactgccgctttctaccgggtccgttatcactactcagggcgtgtgcctagggatgaggcttgcacagttgtcacaagaggatgtcgttctgcactccgaatcctcatcgctgtcagaaagcggtgcatctcacgacaatgaagagccccatggctgcttcagcctcgctgaacgcccttcccctcctaaagcttgggaccagctgcgagcagtgtccgggggttcaccagagcgacgcactccttggaagcccccaccttcagacctgtatggtgacttgaagtcccgaagaaatagtgttgcaagtcccacaagcccaactaggtctttaccccgaagtgcctcaagctttgaaggtcggtcagtgcctgccactccagtgctgaccagaggtgctggaccgcagctgtgcaagcccgaggggctgcacagccgccagtggtctggcagtcaggattctcagatgggatttcccagggcagatcccgcttctgaccgcgctagtctgttcgttgctcgcactagacgctccaattcctccgaagcgttgctcgttgatcgcgcagccggaggtggcgctggctcccctccagctccactcgccccttctgccagcggccctccagtgtgcaaatcctccgaagtcttatacgaaagaccccaacccaccccagccttttccagcaggaccgctgggcctccggaccctccgagggctgcacgccctagttccgccgctccagccagtcgtggagcacccaggctgccaccagtgtgcggtgatttcctgctggactattctctggatcgtgggctccctaggtcaggaggcggaacaggttggggagaattgcctcccgcagcggaggtccccggaccgcttagtaggagagacgggctgctgactatgctccctggcccaccacccgtctacgccgctgatagtaactctccactcttaagaactaaggatccgcacactcgagcaaccagaactaagccttgtggcttacctccggaagctgcagaaggccctgaggtgcatcccaacccattgctctggatgccccctccaacccgcatccccagcgcgggtgagaggtcgggacacaagaacctggccctggaaggcctgcgggactggtacattaggaatagcgggctggctgccggaccccaacgtcgcccagttctgccatcagtgggtcctccccaccctccattcctgcacgctagatgctacgaagtgggtcaagccctgtacggcgcacccagtcaggcccctctcccccatagtagaagcttcactgctccacccgtctccggaagatatggaggctgcttctattag

SEQ ID NO: 55002 - DNA, 837 bp, Artificial Sequence
  Description of Artificial Sequence: Synthetic coding sequence
atgacagacctgaacaaacacattaagcaagctcagacgcagagaaagcaactcctcgaggagagtcgggagctgcatcgtgagaaactgcttgtgcaagcagagaataggtttttcctggagtacctgacgaacaagacggaagagtataccgagcagccagaaaaagtctggaacagttaccttcagaaatccggagaaattgagcgtcgaagacaggaatccgcaagcaggtacgctgagcagattagtgtgttgaaaacagcactcctccagaaggagaacattcagagctccttgaaaaggaaactccaggctatgagagatatagccattttaaaggagaaacaggagaaggaaatccaaactttgcaggaggaaacaaagaaagtgcaggctgaaaccgcttctaaaacccgggaagtccaagcccagttgttgcaagagaagagactgctcgaaaaacaactttcagaaccggacagacggctgctgggaaagagaaaacgccgtgaactcaacatgaaagcacaagctttgaagttggcagcgaagcgctttatttttgagtatagttgtggcataaaccgggaaaaccagcagttcaagaaggaactgctgcagcttatagagcaggcccagaaactgactgctacccaatcacacctggaaaacagaaaacagcagctccaacaagaacagtggtatctagagagtctcattcaggcacgacagcggctccaagggagccacaaccaatgcctgaatcggcaggacgttccgaagactactccatccctgccccaaggcaccaaatctcgtatcaatccaaagtag

SEQ ID NO: 55003 - DNA, 1323 bp, Artificial Sequence
  Description of Artificial Sequence: Synthetic coding sequence
atggggtcccgtggacagggctcacactcgaagaaaacaaggagcatgcctgtgattttatctccacagcgcaccggatcaggggctaccgggggtccagccgctagggcttactctgtggctgaagccgtcaaacagtttagggctggacctgccggaaccggcgctggatgcagcctccagggctgttgggcagcccctagaccctttgagcaccgaaccaacaaactgcgcgagttgagtactctagcacactgcagccgcgagctgcagactcaagtgccagatgcctcggctcactccctggctgtcactttgagcgagctgcattcctgtcgggacctgcaggacgaatgcctggacagccgattcgccgagggccctcgcagactgttgcccccataccatagcctgatcaataattttgtaaaacccgaaaagctaactaaagttgagactcgtctcaaggaaaagatagtcgccgagatgactgatttgaataagcatatcaaacaagcccaaacacaaaggaaacagcttctggaagaatctcgggaactacatagagagaagttgctggtgcaggccgaaaataggtttttccttgaatacttgaccaataagactgaagagtataccgagcagcctgaaaaggtctggaattcctaccttcagaaatcaggcgagatcgagcgcagaaggcaggaatctgccagccgttatgcggagcagatctctgtcctaaaaaccgccctcctgcaaaaagagaacattcaatcttcactgaaaagaaaactgcaagcaatgagggacatcgctattctgaaagagaaacaggagaaggagatacagactctacaggaggaaacaaaaaaagtgcaagcagaaacagccagtaagacccgcgaggtccaggcccagctcctccaggagaaaagactgctcgaaaaacagttgtcagaaccagatcggagacttctcggcaaacgcaagcggagggagctgaacatgaaagcacaggccctaaagctcgccgctaaacggtttatctttgaatactcttgcggcatcaacagagagaaccagcagttcaagaaggagctcctgcaactgatcgagcaggcccagaagcttaccgctactcagtcccacctcgagaatcggaaacagcagctgcagcaggaacagtggtacctggagagtctgatccaagccagacaacgactccagggatcgcacaatcaatgccttaatcggcaggacgtccctaagaccacaccgtccctgcctcagggcacgaaaagcagaatcaacccaaaatag

SEQ ID NO: 55004 - DNA, 672 bp, Artificial Sequence
  Description of Artificial Sequence: Synthetic coding sequence
atgcctaagaagttccaaggcgaaaacaccaagagcgcagctgctcgggcacgtagagccgaggcaaaagctgcagccgacgccaaaaagcagaaggagctggaggacgcgtactggaaggatgatgataagcatgttatgaggaaggagcagagaaaggaagagaaggaaaaaaggagactggaccagctggagcggaagaaggaaacccagcgtctgctggaggaggaggactccaagttgaaggggggaaaggcaccgagggtagctacttcatcaaaagtaacccgggcacagattgaggataccctgaggcgtgaccaccagttgcgagaggccccagacacagccgaaaaagcaaaatcacatctcgaagtgccgcttgaagaaaatgtgaaccgcagagtgttagaggagggaagtgtggaagcccgaaccatagaggacgccatcgctgtgctctcagttgcggaagaggccgctgacagacaccccgaacggagaatgagagctgcctttactgcctttgaggaagcccagctaccgaggctgaagcaagagaaccctaatatgagactgtcgcagctgaagcaactcctgaaaaaggagtggttgagatcgcccgataaccctatgaaccagcgcgctgtaccattcaatgccccaaaatag

SEQ ID NO: 55005 - DNA, 672 bp, Artificial Sequence
  Description of Artificial Sequence: Synthetic coding sequence
atgcctaaaaaatttcaaggagagaacaccaaatctgctgccgctcgcgctagacgggcagaagccaaagccgctgctgatgccaaaaaacagaaggagctcgaggacgcctactggaaggatgatgacaagcacgtaatgcgaaaagagcagaggaaggaagagaaggagaaacggaggcttgatcagttggagaggaagaaggaaacccaaagactgttggaagaggaggattcaaagctgaaggggggtaaggctcctcgggtggccacatcctccaaggtgacgagggcccagattgaggatacactaaggagagaccatcagctgcgggaggctcctgacactgcggaaaaggcaaaatctcatctagaggtaccattagaagaaaatgtcaaccgcagggtcctggaagagggatccgtagaggctcgtacaatagaagatgcgatagcagttttgagcgtcgcggaggaggcagccgaccgccaccccgaaaggagaatgcgtgctgctttcactgccttcgaggaggcccagttgccgagattgaagcaggagaacccgaacatgagactgagtcaactaaagcagctgctgaaaaaagagtggctgcgcagcccagacaaccccatgaatcagcgcgctgtaccattcaacgcccctaaatag

SEQ ID NO: 55006 - DNA, 783 bp, Artificial Sequence
  Description of Artificial Sequence: Synthetic coding sequence
atgaataaccttaacgatccccctaactggaatatccgacccaactctagagctgacggaggagacggtagccgatggaattatgcattactcgtgccaatgctcggcctggcagcctttcgatggatctggtcccgggagtcacagaaggaggtggagaaggagagggaggcgtacaggcgacgaactgccgcatttcagcaagatctggaagctaagtatcatgccatgatcagtgagaaccgcagagccgttgctcagctgtccctagaactggagaaggaacagaacagaacagcttcctaccgtgaggcgctcattagtcagggcaggaaactggtcgaggaaaaaaagctgcttgaacaggaacgggctcaagttatgcaggaaaaacgtcaggttcagccgctccggtctgcctaccttagttgcctccaaagggaggaaaactggcaacgccgagccaggctgctattgaaagaatttgaggcagtgctcacagagcgccaaaacatttactgttctttgttcctgcctcggagcaagcgactcgagatagaaaaaagtctgctggttcgggcttcagtggaccctgtggctgctgacctcgagatggctgctgggctgaccgacatcttccagcatgacacctactgcggggacgtgtggaataccaataaaaggcagaatggcagactgatgtggctctatctgaagtattgggagctcgttgtcgagttaaaaaagtttaagcgcgtggaagaggcaattctggagaaatag

SEQ ID NO: 55007 - DNA, 210 bp, Artificial Sequence
  Description of Artificial Sequence: Synthetic coding sequence
atgaataacctgaatgatccccctaattggaacattcggcctaatagcagagccgatggcggagacggctcacgatggaattacgcgctgcttgtcccaatgctgggcctagccgcattcaggtggatctggtcccgagagtcgcagaaagaggttgagaaagaacgggaggcttatagacgacggacagccgcatttcaacaggattag

SEQ ID NO: 55008 - DNA, 2691 bp, Artificial Sequence
  Description of Artificial Sequence: Synthetic coding sequence
atgatggcccaaaagtcccagggcagtgataatttgcaggagggtcaggaaaagtccaagagggagatcctgaagtgtaccaagtcggcatgggcaccactggacgagtggttgccacctgaccctgaagaagaatcccagtctctgaccatccctatgctggaagattccaagcaagagagtatccagcagtggctggactcgggctttttcgtgagcgcgaatgagaactttcagcaagtgattgacagaacggtcagtttatatgaacagggaatggtgcagatgaccgtcaaagactatatgaggagtttacatcagtttagcgagaccccaatcctgagtaggggaaccagcttcaatagctgctatagtactgcctctgtgcctcagagtatccccgaatggcttgagttttgggaaatagaccccgtcgaaatactcctggacttggggtttggtgctgacgaacccgatatttgcatgcaaattcctgctcggtttcttggatgcgggtccgccgcaaggggaattaatatccgggtctttctcgaagcacagaagcaacggatggatatagagaatccaaacctctatggaaggtttagacagttggagatacttgaccatgtcactaacgctttttcttcactccttagtgacgtgagtatccttccaaaccgagccgaagaaaaggccggtggtgaaagcgttcagaggacttctgtgcagagcttcgaagaggaaactgggaatcccttggatatgaccagcggcacagtaggggcacgagtcgaccgcgctaactcctgtcaaagtgatagttctggattcctggaagaaccgctggaacctctccctctgcaaatgccttccctccccaatagccaaagccccgctgaaaacggcggacgcaaaccaagggatcaatcccattcgttagttagttcacaagactgtcagctggaaagtgatggccctgatagcaagtcccgcgcttcaatgagctttagcagtcaagaggcaaatgccctggaacagagggcttctgtgtcagtcatggaagaagagttcctgttggaagcaatggagggtcctccagaactatacataccggatatggcctgcgccaaaacaaccacccgaggtgagtgcccaagaaaagattcacacctctggcaattactacctatgccccacgcggaatatgaggttactagacctactgcaacctcaaaatacgaccatcctttgggcttcatggtcacacacgtaacagagatgcaagatagcttcgtgaggcccgagggagctggaaaagtccaatctcatcataacgaatctcagagatcccccggtaatgatcacacacaggataaattcctgcatgtcgattctgaggcacctagagaggaagagagctctgggttttgtccccatacgaatcactcactccttgtgcccgaatcatcttcccagtgcattcccaagcacagtgagatcaccccctacgccacagacctggcacagacctcagaaaaactgatcccacatctgcataagctgccgggagatcccgctcaagtgaagtctaggtcaggaaccctcggacagatccttcctgggactgaggccgaaatggaaaatttgcccctaaataccggctcctctcgctctgtgatgacccagatgtcaagtagtctggttagtgctgctcaacgggctgttgccctcggaacgggacccagagggacctcactggagtgcaccgtttgcgaccctgttaccgcaacggagacacgtttagggacaaaggccaggcagttaaacgacgctagcatccagacaagtgcactgagcaacaaaacactgacccacggccctcagccgttgaccaagtccgtaagtttagactccggttttagcagcatttgccccatgggcacgtgccacgccatcccggcacactgttgcatatgttgtcatcatcacccccattgtcacggagagcggcaatctccaggccctgaaccttcagtgtgtcgccactgtctgtgtagcctcacaggccatcaggaagcacagtttatgaccacgctgaaagctctgcaggacacaacagtgagagaactctgcagctgtacagtccacgagatggaagccatgaagacgatctgtcaaagcttccgtgaatacttggaagaaattgaacagcatctgatgggacagcaggctttgttttctcgagacatgtctgaagaggaaagggaagaggctgagcagttacaaacgcttcgagaggcattaaggcaacaggtggctgagctagaattccagctgggagatcgcgcacagcagatacgcgaggggatcttactccagctagaggtgctcactgccgagcctcctgaacactactcgaatctgcatcagtacaactggattgaggagagcaatgggcagacatcatgctccaaaattcacccagggatggccccacgaaccgttttccccccagatgacggccaggaggcaccatgcagtggcggtacacaattggctgccttcacgcctccaacacttgagaacagcaccaggatgtccccctcaagttccgcctgggccaaacttggacccaccccgctatcaaactgtcccgtcggcgagaaggatgccgatgttttcctgtag

SEQ ID NO: 55009 - DNA, 3135 bp, Artificial Sequence
  Description of Artificial Sequence: Synthetic coding sequence
atgatggcccagaaaagccaaggctctgacaacctgcaagaaggacaagaaaagtccaagagggagattctgaagtgtaccaaatcggcttgggctccattggacgagtggctgccccctgaccccgaggaggagtcacagtccctcaccatcccaatgctagaggactccaaacaagagtccatacagcagtggctggatagtggcttctttgtatctgctaacgaaaattttcagcaggtgatcgaccggacagtttcgctgtatgagcagggcatggttcagatgactgtcaaagactacatgagatcactccatcagttctccgagactcctatactgtcccggggaaccagtttcaatagctgttacagtacggcctctgtgccccagtccatcccagagtggctggagttctgggagattgaccccgtggaaattctgcttgacctaggttttggcgctgatgaacctgatatttgtatgcaaataccagcccgattcctgggatgtggaagcgcagctaggggcataaacatcagggtgtttttggaggcacagaaacaacgtatggatatcgagaatccaaatctgtacggccgatttcgccaattggaaatcttggaccacgttacaaacgccttttcttccctattgtccgatgtgtccatactccctaacagggccgaggagaaagctggaggagagagcgtgcagaggacatcagtgagtgctgcaaaggagcatagacgacgtatgggcaagctcctcaggcgggcttctaagcaaaatatcaggagggattgtaaccctgaagtttcagaaagctttaaggtcaaagatgaggtgttcgtacccttcaccaaaccatgggactgcggcgctgagctggcggctacatcgatcaaccataagcaaaatcacctgagcctatccgttgaacatcagagcctgcaagcctgtgatgacctgcttccttatccacctcacggtctgctaagcaaacagtggccttgcagctctatgccagcaaagcaggcccctccttcctgcgttagtgagggctcagtaaagggcagaacccagaaagagaacctttttcagacaaacaaactcaagagtttgtcccacctggctggcaagggaccggatagctttgaaatggaggaggttcagtcctttgaggaggagacaggaaatccgttggacatgaccagcggaacagtgggggcacgcgtggaccgggctaactcatgccagtccgactcctcaggcttcctcgaggagccgttagagccactacctctgcaaatgccttctctgcccaattcacagagtcccgctgaaaacggagggaggaagccacgggatcagagccactccctggtaagcagtcaggattgccagttggagtccgacggtcctgactctaaatcgcgagcctctatgagtttcagcagtcaggaagcaaacgccttagagcaaagagccagtgtctcggtgatggaggaggagttcttgctggaggcgatggaggggccacccgagctgtacattcccgacatggcctgtgcaaaaaccacaacacggggtgagtgccctcgcaaagattcacacctgtggcagctactccccatgccccacgcagaatacgaagtcactcgccctaccgcaacatctaagtacgatcatcccctgggctttatggttacccacgtcacagaaatgcaagattcgtttgtgcggcctgaaggcgctggaaaagtgcagtcgcaccataatgagtctcagcgcagcccgggaaatgaccacacacaggacaaatttttgcatgttgatagtgaggcccctagagaggaagaatctagcggattttgcccccatactaaccacagtctgctggtgcctgaatcctcaagtcagtgcatcccaaagcactcggagattacaccttatgccactgatctggctcagacttcagaaaaactcatacctcatttacacaagttacccggtgaccccgctcaagttaaatccaggtccgggacactcggtcaaatccttccaggcaccgaagccgagatggagaatctgccactcaataccggtagcagtagatctgtgatgacccagatgtcctcttccttggtctcagccgctcagcgcgctgtggccttaggcaccgggcctagaggaacgagcttggagtgcacagtctgcgaccctgtgaccgctacagaaacccgattgggaaccaaggccagacagctgaatgacgcctctatccagacctcagctctttccaataaaactctcacacacggcccacagccgcttaccaaatctgtctccctcgacagcggtttctcatctatctgtccgatgggcacatgtcacgccatcccagcacactgttgtatctgttgccatcaccatccccactgccacggtgagcggcagtccccagggcctgaaccctcagtttgcagacactgcttgtgcagtctgaccgggcaccaggaggctcaatttatgactaccttgaaggccttgcaggacacgacggtgcgggagctctgcagctgcaccgtccacgaaatggaagccatgaagactatttgccaatcttttcgcgaatacctggaggagattgagcagcacctcatgggacaacaagctctgttttcccgggacatgagtgaggaggagagggaagaagcggaacagctccagaccctgcgcgaagcacttcgccagcaagtcgccgagctcgagttccagttgggtgatcgggcacaacagattagggaggggatactgctccagctggaggtgctcaccgccgaaccgccagaacactattctaatctgcatcagtataattggattgaagagtcgaatggccaaaccagttgtagcaagatccaccccggtatggcacctcgtaccgtgtttcccccagatgatggccaggaggccccatgctcaggcggaacccagctagcagcttttacaccacccacattagagaactcaacacggatgtccccctcatctagcgcttgggcaaaattagggccaacaccgctgagcaattgcccagttggcgaaaaagatgctgatgttttcctctag

SEQ ID NO: 55010 - DNA, 429 bp, Artificial Sequence
  Description of Artificial Sequence: Synthetic coding sequence
atgatggcacaaaaaagccaaggctccgacaacctgcaggaggggcaggagaaaagcaagcgcgagatactcaagtgtaccaagtctgcctgggcaccactggatgagtggttgcctccagaccccgaagaggagtcccagtcccttacaatccctatgttggaggactcaaaacaggaatcaatccagcagtggctggacagtggcttttttgtgtctgcaaatgaaaactttcagcaagttatcgatcggacggtgtctctctacgagcaaggaatggtccaaatgacagtcaaagactatatgaggagcttgcaccagttttccgaaacgcctattttaagccgagggacttcattcaactcctgctacagcacggcctctgtgcctcaatcaatcccagagtggctcgagttttgggagatatag

SEQ ID NO: 55011 - DNA, 3189 bp, Artificial Sequence
  Description of Artificial Sequence: Synthetic coding sequence
atgcccacaacggcctcatgcaagactatctcactgcttaagctcctgtactcagtatctttacagaactactcccccatgatggctcagaaatcccagggatccgataatctccaggagggacaagagaagagcaagagagaaattctgaagtgcacaaagtccgcatgggcaccactggatgagtggctcccccctgatcctgaggaggaatcccagtcactgaccatccccatgctggaggactcaaaacaagagagcatccaacagtggctagattctgggtttttcgtgagcgctaacgagaattttcagcaggttattgacaggaccgtgtcactgtacgaacagggaatggttcaaatgaccgtcaaggactacatgagatcactccaccaattttcagagacacctatccttagcagaggcacatcatttaattcttgctacagcaccgcaagcgttcctcagtccatccctgaatggctggaattctgggagattgatcctgtggagatcctactagaccttggatttggcgctgatgaacctgatatatgtatgcaaataccagccaggttcctgggttgcggctctgcggctcgcggaattaacatccgcgtttttctggaagctcagaagcagcgtatggatattgagaatcctaacttgtacggcagatttcgtcagctcgagatcctggaccatgttaccaacgccttttcaagtctattgagcgacgtgtctatactgcctaatcgggctgaagagaaagccggaggcgaatctgttcagagaacctccgttagtgccgcaaaggagcaccggaggcgcatgggcaagctcctcagacgggcaagcaagcaaaacatcaggcgggactgcaacccagaagtgagcgagtctttcaaggtcaaggacgaagtattcgtgcccttcactaaaccttgggattgcggagccgagctagccgctacatcaattaaccacaaacagaaccatctgagcttgtcagtagagcatcagagcctgcaggcatgtgacgacctgttaccttatccaccgcacgggctgctttccaaacaatggccatgcagctcaatgccagccaaacaagctccaccctcctgcgtgtccgaaggcagcgtgaaaggcagaactcagaaggaaaacctgttccaaaccaataaattgaaatctttatcccacttggcaggtaagggaccagactcatttgagatggaagaggtccagagtttcgaggaggaaacagggaatcccctggatatgacatccgggacagttggtgcccgagtagacagagccaattcctgtcagagtgatagcagtgggtttctcgaggaaccactggagcccttacctctccaaatgccatcattaccgaactctcagtcccctgctgagaacggcggaagaaaaccccgtgatcagtcacactcgttagtgagtagtcaggactgtcaactcgagtcagacggcccagactctaaaagtagggcctccatgagcttttcctcgcaagaggccaacgctctagagcagcgggctagtgtgagtgtaatggaggaggagtttcttctcgaggcaatggaagggcctcctgagctgtacatacccgatatggcttgtgccaagacgacaactcgaggagaatgcccccgtaaggatagtcacctgtggcagctactgccaatgccacatgcggaatacgaggtgacccgcccaacggctaccagcaaatatgaccacccgctggggttcatggtcacccatgtcacggaaatgcaggattcctttgttcgccctgagggcgcaggcaaagtccaatctcaccataacgagtcccagaggtcaccaggcaacgaccacacccaagataaattcctgcacgtggactctgaagcccctcgggaggaagagagctctgggttttgcccacatacaaaccatagcctgctggtgccagagagttcttcccagtgtatcccgaaacactctgagatcacgccttatgcaaccgatctcgctcaaacttctgaaaaactgattcctcacttacataagcttccaggggaccccgcacaagtgaaaagccgctctggtaccctgggacagattctgccaggcacagaagcagagatggaaaatctgcctctgaacacaggcagctcccgcagtgtcatgactcaaatgtcttcctccttggttagcgctgcacagcgcgctgtagctctaggaactggtccacggggaacatcgctcgaatgcacagtctgtgatcctgtgacagctacggagacacgattggggactaaagccagacagctgaacgatgcctccattcagacttctgccctgagcaataagacactcacgcacgggcctcagcctctcaccaagtcagtgagcctggactcaggctttagttcgatttgccccatggggacctgccatgcgattcccgcacattgttgcatttgttgccaccaccatcctcattgccatggagagagacagagcccgggaccagagccctctgtttgtagacactgtctctgtagtctgacaggccatcaagaggctcaatttatgaccacactgaaggctttgcaggacacaacggttcgggagctgtgcagctgtactgttcatgaaatggaagccatgaagactatctgccagtccttccgagaatatctggaagagattgaacagcatcttatgggccagcaggccctgttcagtagagacatgagcgaggaagaacgggaagaggctgaacagctgcagactctcagagaagccctgcgccagcaggttgccgagctggagtttcaactcggcgaccgggctcagcagatcagggagggcatcttactccagttggaggtgctcacagcagaaccccctgaacactactcaaatctgcatcagtataattggatagaagagtccaacggtcagacctcttgcagcaaaattcacccagggatggctccccgaacagtattccccccagacgatggacaggaggccccttgttcgggagagctcctgagcgccgaactggatccctttttcttctcctccaaggccaacaactccgccaaagacgaaaaaattaaatccaaagacttcctgaagacacaggattccggtctgttgtag

SEQ ID NO: 55012 - DNA, 492 bp, Artificial Sequence
  Description of Artificial Sequence: Synthetic coding sequence
atgatggcccagaaaagtcaggggagcgataatctgcaggaaggacaagagaagtcgaaacgcgaaatcctcaagtgcacgaagagcgcgtgggctcccctggacgagtggctgccacccgatcccgaagaggagtcgcagtctctcaccattcctatgctagaggactctaaacaggaatcaatccagcagtggctggactccggtttctttgtgagtgccaatgagaatttccagcaggtgatagacagaacagtctctctgtatgagcaaggtatggttcaaatgacagtcaaagactacatgcgtagcctgcatcagttcagcgagacgccaattctatctcgtggtaccagctttaacagttgttactccaccgccagcgtaccacagtcaataccagagtggctggagttctgggaaatcgatcccgtggagattctgctggacctcggatttggcgctgatgaaccagatatctgtatgcagtag

SEQ ID NO: 55013 - DNA, 507 bp, Artificial Sequence
  Description of Artificial Sequence: Synthetic coding sequence
atgatggcacagaaatcacagggaagtgataatctgcaagaaggccaggagaagtcgaagcgtgaaattctgaagtgtactaagtctgcgtgggcccctctggacgaatggctgccccctgaccctgaagaagagagccagagcctgaccattcccatgttggaggactcaaaacaggaaagtatccagcaatggctggattctggcttctttgtgtccgctaatgaaaacttccaacaggtgatcgatcggaccgtgtctctgtacgagcagggaatggttcagatgactgtcaaagactacatgcgttccctgcatcagttctccgagaccccgattctctcgcgagggacttctttcaactcatgctactcaaccgcaagtgtgccacagtccattcctgaatggcttgagttctgggaaatcgacccagtagaaattctgctggacctgggcttcggcgctgacgaacccgatatctgtatgcagatccccgctagattctag

SEQ ID NO: 55014 - DNA, 3165 bp, Artificial Sequence
  Description of Artificial Sequence: Synthetic coding sequence
atgagtttttccttacagaactacagtcctatgatggcccagaagtctcagggttcagacaatctgcaggaaggtcaggaaaagtcaaaacgggagatattgaaatgtacgaaaagtgcctgggcgcctctggacgaatggctgccaccggaccctgaagaagagtcgcagagccttactatccctatgctcgaagactctaaacaagaatcaattcagcagtggttggacagcggcttttttgtttctgccaacgagaattttcagcaggtgatcgacaggactgtgagcctgtatgagcagggtatggtccaaatgacggtgaaggactatatgcgatctctgcaccagtttagtgaaaccccgatactctctagaggtacttccttcaattcttgctacagtacggcgtcagttccacagtcaattcctgaatggctggagttttgggagattgaccccgttgagatcctgctggatttaggctttggcgcagacgaaccggatatctgtatgcagatcccggctcgattccttggttgcgggtcagccgctagggggattaatatccgagtgttccttgaagctcagaagcagagaatggacatcgaaaatccgaatttgtatggccgtttccggcaattggaaatcctagaccacgtaacaaacgctttttctagtttgctgagcgatgtgagcattctgccaaaccgtgccgaagagaaggcagggggtgagagcgtacagaggaccagtgtcagcgccgcaaaagagcatcgtcgtcgcatgggtaagctcctcaggcgagcttcgaaacaaaatattaggcgcgactgtaatccggaagtgtccgagtccttcaaagttaaagacgaagtgtttgtcccattcacaaaaccctgggactgcggagcagaactggctgccaccagcatcaatcacaaacagaaccatctgtctttgtctgtggagcaccaaagcttgcaagcatgtgacgatctcttaccttatcctccccacggacttttgtccaagcagtggccttgtagctctatgccagctaagcaggccccaccctcatgtgtcagtgagggttctgttaagggacggacacaaaaagaaaatctttttcagaccaataagctcaaaagtttatctcacctagccggaaaggggcctgactctttcgagatggaggaagtacagtcgttcgaagaagagacaggaaaccccctcgacatgactagcggaaccgtgggcgctcgagtggatcgcgctaacagctgccaatcagacagctcgggattcttggaagagccactggagccacttcctctgcaaatgcctagccttccaaactcccagagcccagccgagaacggtgggcgtaagcctcgggatcagagtcattccctcgtgagctcccaggactgccagctagaatcggacggtcccgactctaagtccagggctagcatgagcttcagttcccaggaggctaatgctctagagcagcgcgctagtgtttctgttatggaggaggagtttctgctggaggctatggaagggcctccagaactctacatcccagatatggcctgcgcgaagacgactactagaggggaatgtccgaggaaggatagccacttgtggcagctgcttcccatgcctcatgcagaatacgaggtgaccagacctaccgccacatcaaagtacgaccacccccttggcttcatggtcacccatgtaaccgaaatgcaggactcctttgtcagacccgaaggtgctggcaaggtacaatcacaccacaacgaatcacagcgcagccccggaaatgaccacacccaagacaaattcctgcacgtggattccgaagctccccgtgaagaagaatcgagtggtttctgtccgcacaccaaccattctttgcttgttcctgagtcctcttctcagtgcatcccaaaacattccgagattactccatatgcaaccgatctggcccagacatccgaaaaacttatacctcacctccacaaactgcctggagatcctgcgcaggtgaagtcaaggagtggcaccctgggtcagatcttacctggcactgaagccgaaatggaaaacctgccgctgaatactggctccagcagaagtgtgatgacgcagatgagctcttcgttggtttctgctgctcaaagggcagtcgccttaggcacaggccctagagggactagccttgagtgtactgtgtgtgaccccgtgaccgctacagagacaaggctgggcactaaggccaggcagctcaatgacgcttcaattcagacaagcgctctgtcaaataagactttgactcacggcccacaaccactcactaagtccgtaagtctcgattccgggttttctagcatctgccccatgggaacttgccatgccattcccgcacactgctgcatctgctgccaccaccacccccattgtcatggagaaaggcagtcacccggtccagagcccagcgtgtgtcgtcactgtctttgtagccttacggggcaccaggaggcacagttcatgacgactttgaaggctcttcaggatacaactgtgcgcgaactctgctcatgtacagtccatgagatggaagccatgaagacaatttgtcagtccttccgcgagtatctggaagaaattgagcaacacttaatgggccaacaggccctcttctctagggacatgtccgaggaggaaagggaagaggccgaacaactgcaaaccctcagggaggccctgcgccagcaggtcgctgaactggagtttcagctcggggatagggcccagcagatccgtgaggggatactattgcagctggaagtgctgactgctgaaccaccggaacattatagtaacctacatcagtacaactggatcgaggaatctaacggacagacttcgtgctccaagattcaccccggtatggccccacgtacggtgtttcctccagatgacggccaggaagccccttgtagcggaggcacccagcttgccgcattcaccccgcctaccctcgaaaatagcacccgcatgtccccgtcttcttcggcttgggctaagctcggtccgacccccctctcaaactgcccagttggtgagaaagatgccgacgtttttttgtag

SEQ ID NO: 55015 - DNA, 2148 bp, Artificial Sequence
  Description of Artificial Sequence: Synthetic coding sequence
atggccgctgacgaatcctcccaaaataccctgaggctgcaatttaaggccatgcaggagatgcagcataagcggctgcagaaacagatggaaaagaagcgagagaaagaactgagtctgaaatccagagcagacgatcaggaagagcccttggaggtcagcgatggactgagtttacttcacgcaggcgagcccaattctaaaaactcctttgagaaacgagtcctggaagacgagattgagcacctgaggaacgaactgcgcgagaccgttgatgagaacggacgactgtacaagttgttgaaggagcgcgacttcgagatcaagcatctcaaaaagaaaattgaagaggacaggtttgccttcaccggcactgccggtgtggctggcgacgttgttgctacgaagatcgtggaactgtcgaagaaaaatcgcctactcatggctgagagtgaaggggcaaagaccagggtgaaacagctaacgaacaggatacaggaactcgaacgggagcttcagaccgccctcaccaggttgtccgccaaaggagcgactgatgccggtgctaagccgcctagggcacagatgggtgacagagctcttctcgaaactcccgaagtgaaggccctccaggacaggctcgtggcaaccaatcttaagatgtccgacctgaggaaccagattcagagcgttaaacaggaacttcggatggcacagaaggtcctcgctagggaagtgggcgaggacatcaatgtccagcagttgttaagcagtccagggacatggagaggcagggcccagcagattctggtgctgcagtcaaaggtacaggaacttgaaaagcagctgggccaggccaggagtcaaagcgcgggtacggctagcgatgaactgagcgtttaccctgacccacggaagctgtcagctcaggagaagaacctcttgcgcattcgcagcctggaacgggagaaacaggagggcctggaaaagctggccagtgaaagagacgtactgcagagagagttggaggaactcaagaagaagttcgaaggcatgcggtcgcgaaataaactgctttcgtccgaaatgaagacccttaagagtcagatgggcacccttgtggagaaggggcgacacgacgacgagttaattgacgcgctgatggaccagcttaagcagctccaggaaatattaggctcactgagcctgcaggaagaaaagacccgggtttctcaacaccaccttgatcagcagttgaattccgaagcacagaggtccaactctctggtcgcacaactacaggcaatggtggcagagcgtgaagcaaaggttagacagctagagatggaaattggccagcttaatgttcattatttaagaaataagggggtcggtgagggcagcagcggcagggaagtgtctcccgcttatactcagtttctagaggaccctgggttgacaaagtcaccagcctccgctggggatcatgtgggcagactgggatcttctagaagcgttacatcactgggtcacaccctcgttgaaagtgctctcacccgcccttctctaccttccccccatcgcacatctccgaggttcagcgactcacccgagcaaaagggctggcaggctcaggtgagcgagattaaagctttgtggcaggccgcagaagtcgagagggatagactcacggagtttgtcactgtgcttcaaaaacgcgtagaggagagcaattccaagcttctggagtctgagcgcaagttgcaagaggagcggcaccgaacggtcgtgctggagcaacacctggagaagatccgactcgagcccggaaaagccagtgcctcacagagagccgcacccagaactaaaaccgggttacccacatccaacaaccggcataatcctacagggtccgaaaagaaagatccctcttttgcccagctatcagatgtccccgtggaatcccaaatggaagagctcaccacacgcttggccattcaggtggaagagaatgagatgctgaaggctgccctgggaagtgcccttagagggaaagaggaggactttaggatgtaccacgagattctaggacaggttaagtccgtgttccttcaggcactcaggcagcagaagaccggaaagcagtag

SEQ ID NO: 55016 - DNA, 1947 bp, Artificial Sequence
  Description of Artificial Sequence: Synthetic coding sequence
atggagggggctggatacagagtcgtgttcgagaagggaggagtgtatctgcacacaagtgccaagaagtaccaagatagagacagtcttatcgctggggtgatccgggtcgtggagaaagacaacgacgtcttactgcattgggcacctgtcgaagaagcaggcgactcgacccagattttgttctctaagaaggatagctccggaggagacagctgtgctagtgaggaagagcctacctttgatccggactacgaacccgattgggcggtcatatcaacggtgagacctcagctgtgccactctgagcctacccgtggcgctgaaccttcgtgccctcagggatcctgggccttcagtgtgtctttgggcgaacttaaatccataagacggagcaaaccgggactgagctgggcctatctagttttagttacccaggccggaggcagcctccctgctctgcacttccatagagggggtaccagagctttactgcgcgttctgagtcggtatctactgctggcttccagcccccaagactctagactttatctggtttttcctcacgattctagcgctctgtcaaatagcttccaccacctgcagctcttcgatcaggacagctctaatgtggtctcccgctttctacaggacccatactctaccacgttcagctcattctccagagtgaccaacttctttcgcggtgctctgcagccacagccagagggcgcagcctccgacctgcctcctccccctgatgatgagcctgagccaggtttcgaggtgatctcatgtgttgagctgggcccacgacctaccgtcgagcgtggcccacccgtgacagaagaagagtgggctcggcatgtgggcccagaaggaagactgcagcaagtccctgaactgaagaatagaatcttcagtgggggtctgagcccctcactgcgcagagaagcctggaaattcctcttaggttacttatcgtgggagggtactgccgaagagcataaggcacacattcgtaagaagaccgatgagtatttccgcatgaagctgcagtggaaaagcgtttcgcccgagcaggagcggagaaactcccttctgcacggttaccggagcttaattgaacgggacgtcagccgcacagacaggactaataaattctatgaagggcctgaaaaccccggattgggcctgttaaatgatatattattgacttactgtatgtatcattttgacctcggatacgtgcaagggatgagtgatttgttaagccctatcctctacgtaatccagaacgaagtcgacgctttttggtgtttttgtggctttatggagctggtacagggaaacttcgaagagtcgcaagagactatgaaacgtcagctgggccgacttctgttgcttctgcgagtgctggatcctctgctctgtgactttcttgatagtcaggactctggatccttatgcttctgttttcgttggcttctcatttggtttaaacgcgaattcccattcccagatgtgctgagattatgggaagtgctctggacaggcttgccaggccctaatctgcacctgttggtggcttgcgccattctggacatggagcgcgatactcttatgctctctggattcgggtccaacgagatcctgaaacatattaacgaactgacgatgaagctgtccgtcgaagatgtattaacacgggctgaggctctacaccggcagctcacagcgtgccctgaattgccccataatgtccaggaaatcttggggctagcaccacccgctgagcctcactccccctcccctaccgcgagccctctcccactcagccccacacgcgcacccccaactcccccaccatcaacggacactgctccacagcccgattcatccctggaaatattaccggaagaggaggacgagggcgctgattcatag

SEQ ID NO: 55017 - DNA, 480 bp, Artificial Sequence
  Description of Artificial Sequence: Synthetic coding sequence
atgggagaacgcaagggcgttaacaagtattatccaccagactttaacccagaaaaacatgggtccctgaatcggtaccacaattcacatccacttagagagagagccaggaaattatcccaaggtatattgatcatacgctttgaaatgccctacaatatttggtgcgacgggtgtaagaatcatattggaatgggtgttcgctataacgctgagaaaaaaaaggtgggcaactattacacgacgcctatctaccgattccgcatgaagtgtcatctctgtgtcaattacattgagatgcaaactgatcctgccaactgtgactacgtcatagtgtctggcgcacagcgcaaagaggaacgctgggacatggctgataatgagcaggtgctgaccaccggggagcgccatcctcttacatgcctcggcgctctagccctctcattgcgttggggcccacaatccccagccgagctatag

SEQ ID NO: 55018 - DNA, 984 bp, Artificial Sequence
  Description of Artificial Sequence: Synthetic coding sequence
atgcagaaaataaagtccctcatgacacgccagggtctgaagagcccacaggagtcactgtctgatctcggggcaatagagtccttaagagtgccaggaaaagaggaattcagggaacttagggagcagccatccgatccccaggccgaacaggaactgattaattctatagaacaggtttacttttctgtcgattctttcgacatcgtgaagtacgagctcgagaagctacctccagtgctgaacttgcaggagctcgaggcatacagggataagctcaagcaacagcaggccgctgtcagcaagaaagtcgccgaccttatcttggagaagcagccagcctacgttaaagaacttgagcgtgttacatcactccagacaggccttcagttagccgcagtgatctgcaccaatggaagacgtcacctcaatatcgctaaagaaggcttcacccaggcatctttggggttacttgcaaatcagaggaaaaggcagctgctgatcggccttttaaagtccctcagaacgatcaagaccctgcagcgtactgacgtgaggttatcagaaatgcttgaggaagaagactatcctggagcaattcagctgtgcctcgagtgtcagaaagcagctagcacctttaagcactactcgtgcatctctgaacttaactccaagctgcaggacaccctcgagcagatcgaagaacagctggatgtggcgctatccaagatttgcaaaaactttgatattaaccattacaccaaggtgcagcaggcctacagactcctcggaaagactcagacggccatggaccagcttcatatgcacttcacccaggcaattcataacacagtttttcaggttgtactgggatacgtagaactttgcgccggtaatacggacacaaaattccaaaagctgcaatacaaggacctgtgtacggtttgctctgacctgatcacaattcacatttccctgctatag

SEQ ID NO: 55019 - DNA, 2895 bp, Artificial Sequence
  Description of Artificial Sequence: Synthetic coding sequence
atgcagaaaatcaagagccttatgacgcgtcaaggcctgaagagcccacaagagagcctatccgaccttggagctattgagagtttgagagtgcccggaaaagaagagttcagggagcttagggagcagcctagtgatccgcaagccgaacaggaactaatcaactccatagagcaggtgtatttttccgtagactcatttgacattgttaaatatgagctagagaagctcccacccgtgcttaacctgcaggagctagaagcttaccgagataaacttaaacagcaacaggccgcagtgtccaaaaaggtggccgacttgattttggagaagcagcccgcatatgtgaaggaactggagagagttactagcctgcagacaggtttgcagcttgcggcagtgatatgcactaacggcagacggcacctcaatatcgcaaaggaaggattcacccaggccagcctcggtctgctggctaaccagcgcaagcgtcagctcctgattggcttgcttaagagcctgcggactatcaagacccttcagcgcaccgacgttcgtttatctgaaatgcttgaagaagaggattatcctggtgctatccagctctgtctcgagtgccagaaggcggcttccactttcaagcactatagttgcatctctgagttgaattcaaagctgcaggatacattggagcaaattgaggagcaactggacgtggccctgtctaaaatctgtaagaattttgatattaaccattatacaaaagtgcaacaagcctaccgactgctcggtaagacccagactgcaatggatcagctccacatgcatttcactcaggcgatccacaacaccgtgtttcaagtggtcctcggttacgttgaactgtgcgcgggaaatacggataccaagttccagaaactgcaatacaaggatctctgcactcacgtcactccagactcatacatcccctgtctcgctgacctgtgtaaggcactttgggaggtgatgctttcctactaccgtaccatggagtggcatgagaaacacgataatgaagacaccgcttctgcctcagaaggatccaacatgatagggaccgaggaaacgaacttcgatagaggttacataaaaaagaaattggaacacggtctgacacgcatctggcaggatgtgcagttgaaagtcaaaacatacttgctggggaccgacttgtctatattcaagtacgacgacttcatcttcgtgcttgacattatttctagattaatgcaggtaggagaagagttttgcggctccaaatctgaggtactccaagaatccataagaaaacagtctgtgaactattttaagaattatcatcgaaccagacttgatgagcttagaatgttcctggaaaatgaaacttgggaactatgtcctgtcaagtccaattttagcattctccagcttcacgaattcaagttcatggaacagagtaggagtccaagcgtctcccctagtaaacaacctgtatctacaagcagtaaaactgttacactgttcgagcaatattgcagtggcggaaacccttttgagattcaggctaatcataaagatgaagagaccgaagatgttctcgcctctaatggttatgagtcagatgagcaggagaagagtgcctaccaagaatatgacagcgactcagatgttccagaggagttgaagcgtgattatgtcgacgaacaaacaggggatgggcctgtaaaatccgttagccgggagactctcaagtctaggaagaaatccgattacagcctcaacaaggtgaacgctccaatccttacaaatactactcttaatgtgattagactcgtaggtaaatacatgcagatgatgaacatcttaaaaccaatagccttcgatgtaattcatttcatgtctcagctgttcgactattatctatatgccatctataccttcttcggaaggaatgacagcctggagtcaacaggactggggctgtcgtcctcgagactccgcactactctgaacaggatccaagaatctctcattgatttggaagtgtcggccgatccaaccgctacactcacagccgcagaagaaagaaaggagaaggtacccagcccccacctgtctcacctggtggtgctcacgagtggggacactttatacggcctggctgagcgcgtagttgcaaccgaaagcctagtgtttctcgccgaacagttcgaatttctacagccccatctagacgcggtgatgcccgctgtgaagaaaccgttcctccaacagttctactctcaaactgttagcaccgcctctgagcttcggaaacccatttattggatcgtcgccggaaaagcactcgactacgagcagatgctgctgttgatggccaatgtgaaatgggacgtcaaggagattatgtctcaacataatatatatgtggacgccctgctgaaagagtttgaacagtttaatagaagactcaacgaagtctccaagagggtgaggattcctctgcctgtgtcaaacatcctttgggagcattgcatcaggctggctaatagaactattgtggaggggtacgctaacgttaaaaaatgctcaaacgagggccgtgccttgatgcagttagattttcagcagtttctgatgaagttggaaaaactcacagacatacgtcctatcccagataaggaattcgtggaaacttacatcaaggcatactatctgacagaaaacgacatggagcgttggataaaagaacatagagagtactcaaccaagcagctgacaaatcttgtcaacgtatgtctgggaagccatattaataaaaaggcgagacagaagctgctggcagccattgacgatatcgatcggcctaaacgctag

SEQ ID NO: 55020 - DNA, 1242 bp, Artificial Sequence
  Description of Artificial Sequence: Synthetic coding sequence
atggaccaactgcacatgcactttacacaagcaattcataatacggtgtttcaagtcgttctgggctacgtggagctctgcgccggaaataccgacacaaagtttcagaagctccagtacaaagacctgtgtacacacgtaacgccagactcatacatcccctgcctggccgatctctgtaaagccctctgggaagtgatgctctcgtactatcggacgatggaatggcatgagaagcatgacaatgaggatactgcaagcgcttcagaaggcagtaatatgattggcaccgaggagacaaatttcgaccgcggatatattaaaaaaaagctggaacacgggttgaccaggatttggcaggatgtccaacttaaggtaaaaacctaccttctgggcactgacctctccattttcaagtatgacgacttcatcttcgtgctggatatcatctccaggctgatgcaggtgggcgaggagttttgtggctcaaagagtgaggtgctgcaggagagcatccggaagcagtctgtgaattactttaaaaactatcatcgcactaggctcgatgagctgaggatgttcctggagaatgaaacatgggagctgtgtcctgtgaagtcgaatttttccatattgcagctgcacgagttcaagttcatggaacagagccgttccccgagcgtgagccctagtaagcagcctgtgagcacctcctctaaaaccgtgactctctttgagcaatattgttccggcggaaatccctttgaaattcaagcgaaccacaaggacgaggaaacagaggatgtattagcctccaacggatacgaatctgacgagcaggagaaaagcgcctaccaggaatacgactctgactctgatgtccctgaggaactgaagagggactacgtcgacgaacagaccggcgacggtccagtgaaaagtgtgtctcgtgagactttgaaaagtcggaagaagagcgattattccttgaacaaggttaatgccccaattctcactaacactaccctcaatgtgatacgcctcgtcgatggcgtctctttgtgctgtctgggatggtcaacagttgcacacttgcacagtctccaggccccaccgcctggcttcaagcccttctcctgcctctctttgcctagatcttgggattaccgcagaccccctcccaggccagctaatttcctgtatttccttttctttagccgagatggggtgagcccatgctag

SEQ ID NO: 55021 - DNA, 2055 bp, Artificial Sequence
  Description of Artificial Sequence: Synthetic coding sequence
atgcaaaaaattaaatctctgatgacgagacagggactgaagtcccctcaagagtccctcagcgatttgggtgccatcgagtctctccgggtccccggaaaacacgtgacccctgatagttacataccttgcctggcagacttgtgtaaggccttgtgggaggtaatgctctcctattatcggaccatggagtggcacgaaaagcatgacaatgaggacacggccagcgccagtgagggttccaatatgatcggaactgaggagaccaattttgatcggggttacattaagaagaaattggagcacggcctgacaaggatttggcaggacgtgcagctgaaagttaaaacatatctactcggcaccgatctctcgatctttaaatatgatgatttcattttcgtgctggacattatttctcgactgatgcaggtcggtgaagaattctgtggcagcaagtcggaggtgctgcaggagagcatcaggaagcagagtgtgaactatttcaagaattaccataggactcggctggacgagctgagaatgttcctagaaaacgagacctgggaactgtgtcctgtcaagtccaacttttctatcctgcaactgcacgaatttaagtttatggagcagagccgctccccatctgtttcgccaagtaaacagccggtcagcacatcaagcaaaactgtcactctgttcgagcagtattgctctggcggaaatcctttcgagattcaagcaaatcacaaagacgaggagacagaagacgtgctagcttccaacggctacgagtcggacgagcaggagaagagtgcctaccaggaatatgactcggatagcgacgtgccagaagagctcaaacgcgattatgtggacgaacagacaggagatggcccagtgaagtctgtgtctcgggagactctgaagagtcgtaagaagtctgattactcacttaacaaagtgaacgcgcctatcttaacgaacactactctcaacgtgatccggcttgtgggtaagtacatgcagatgatgaacatcctgaagcctatcgcttttgacgtgatccacttcatgagtcagctgttcgactactatttgtacgcaatatacaccttcttcggacggaacgactccctagagtcaaccgggctcggcctaagctcttcgcggctgagaacaacgttgaacaggattcaggagagcctgattgacctcgaggtcagtgccgacccgaccgccacacttactgccgcagaagaaagaaaagagaaggtcccatcacctcacctcagccatctcgtggtgttgacatcaggcgacaccctttatggactggcagagcgtgtggtagcgaccgagtcactcgtgtttcttgccgagcagtttgaattcctccagccccatcttgacgcagtcatgcccgcagtcaagaagccttttctacagcagttttattcacaaactgtttcaactgcttcagagctccggaaacctatctattggatcgtagccggaaaggctcttgattatgagcagatgctgttgctcatggcgaacgtaaagtgggacgttaaggaaatcatgagccagcacaacatctatgtggacgccttgttgaaggaatttgaacaattcaacaggcgtctgaacgaggtatcgaagcgggttagaatccctcttcccgtgtccaatattttgtgggaacactgcataaggctcgcaaatcgaacaatagtagagggctatgcgaatgtgaaaaagtgctccaacgagggccgtgctctgatgcaactggacttccagcagtttctgatgaaactggagaagttaaccgatattcggcctatcccagataaagaattcgtggaaacctatattaaggcctactatcttaccgaaaatgacatggaacgttggattaaggagcaccgggagtattccacgaagcaattgacgaacctcgtgaatgtctgcctgggaagtcatatcaataagaaggcgagacagaagttactcgctgccatagacgatattgatcgacccaagaggtag

SEQ ID NO: 55022 - DNA, 1782 bp, Artificial Sequence
  Description of Artificial Sequence: Synthetic coding sequence
atgcttgaggaggaagattatcccggtgctatacagctctgcctcgagtgccagaaggcggcttccacatttaaacactacagctgtatcagcgaactgaacagcaagctccaggacactctggaacagatcgaagaacagctggatgttgccctgtctaagatttgcaagaatttcgacattaatcattatactaaggtgcaacaggcctatcgtctgctcggcaaaacccagactgcgatggaccagctgcacatgcacttcactcaagccatacacaataccgtattccaggtagtgctggggtacgtcgaattatgtgctggtaacacagatactaagtttcaaaaactgcaatacaaagatctgtgcacacacgtcaccccagactcatacataccatgcttagctgatctctgcaaggctctatgggaagtcatgttgtcttactatcggacaatggagtggcatgagaaacacgataatgaagatactgcaagcgcttccgagggctctaacatgatcgggaccgaggagacaaatttcgacagggggtatattaagaagaaactggagcatggtctgacccgcatctggcaggacgtacagctgaaagtgaaaacctacttactggggactgatctgtccattttcaaatatgacgacttcatatttgtcctggacattatcagcaggttaatgcaggttggggaggaattttgcggctcaaagtccgaggttctgcaagagtctatccgtaagcagagcgttaattatttcaagaattatcaccggacccgattggacgaacttcggatgtttctggaaaatgaaacttgggaattgtgcccagtgaagtctaacttctccatcctgcaacttcatgagtttaaattcatggagcagtcacgctctccatcagtttctcctagcaagcagccagtgtcaactagctcgaaaacagtcaccctgttcgagcagtattgcagcggcggaaatccattcgagattcaggccaaccataaggacgaagaaaccgaagatgtgctcgccagcaatggctacgagagcgacgagcaggagaagagcgcctatcaggaatatgattctgactcagacgtgcctgaagagctgaaacgggattacgtggacgagcagaccggcgacgggcctgtgaaaagcgtgagccgcgagacacttaagtcccgaaaaaaatctgactatagccttaataaagtcaatgcgcctattctcacgaacacgaccctgaacgtgatacgcctggttggaaaatatatgcaaatgatgaatatcttgaaaccgatcgcttttgacgtgattcacttcatgtcccagctttttgactactacctgtacgctatctacactttttttggtcggaatgattccctcgagtctaccggactgggtctgtcctcgagtcgactgcgtaccaccctaaaccggattcaggagtcactgatcgatcttgaggtgagtgctgatccaactgccacactgacagccgctgaggagcgcaaggagaaagtcccctcaccccacctaagccatctcgtagtcctgacatcgggtgatacactgtacggcttagcagaaagggtggtagcaacagaaagccttgtattcttggctgagcagtttgagttcctccagccccatctggatgctgtaatgcctgctgtgaagaaaccattcctgcaacaattctactctcagagccagcccccagtgaactacggtaaccagtttaccgggctatag

SEQ ID NO: 55023 - DNA, 2805 bp, Artificial Sequence
  Description of Artificial Sequence: Synthetic coding sequence
atgctgactcttgaggaatttcgcgagcttcgggaacaaccatccgatcctcaggccgagcaagagttgataaactctattgaacaagtctatttttccgtggactcatttgacatcgttaagtacgagctggaaaagttgccaccagtcctgaacttacaggagctggaggcatatagagacaagctgaaacagcaacaggcagctgtgagcaagaaggtggccgatctgattttagagaagcagcctgcctacgtgaaagagttagaaagagtgaccagcctccagaccggactgcagctcgcagccgtgatttgtaccaacgggaggcgccacctgaatatcgccaaggaagggttcacgcaggctagcctggggctactggccaaccagcggaaaaggcaactcctcattggtctgctaaagtctctgcggacaatcaagacccttcagaggacggacgtccggctgtccgagatgctggaggaggaggattatcccggtgccatccagctctgcctggagtgccagaaagcagccagtacattcaaacactacagttgtataagtgagctgaacagcaagctgcaggacacacttgagcagatcgaagagcagctggacgtggctcttagcaaaatatgtaaaaacttcgacattaaccactacaccaaggttcagcaggcgtaccgactgcttggcaaaacccagaccgctatggatcagctgcacatgcacttcactcaggctatccacaatacggttttccaagttgtgctaggatacgtcgaactctgcgctggtaataccgatacaaagttccaaaaactgcagtacaaggatctgtgtacccacgttacacccgacagttatataccatgtcttgccgacctgtgcaaggcgttatgggaggtgatgttgagctactatagaactatggagtggcatgagaagcacgacaacgaggatactgcatccgcctcagaggggagtaacatgatcggcacagaagagacaaactttgatagaggatacataaaaaagaagttggaacatggcctcactaggatttggcaagacgtgcagctgaaagtcaaaacttacctgctgggaactgatctgtccatcttcaaatacgatgacttcatctttgtcctggatattatttcgagactgatgcaggtgggtgaagagttttgtggttcaaagagcgaggtcttgcaagagtccattcgcaagcagtctgtgaactattttaagaactaccacaggacccggctcgacgagttaagaatgttccttgaaaacgaaacctgggagctctgccccgtgaaaagcaacttctcaattctgcaactgcacgaatttaagtttatggaacagagcaggtccccatcagtatcgcccagtaagcaacccgtatcaacgagctccaagaccgtgactcttttcgagcagtattgctccggcggaaacccatttgagatccaagcaaatcataaggacgaggaaacagaagacgtgttggcctcaaatgggtacgagtccgatgaacaagaaaaaagtgcataccaggagtatgactctgacagcgacgtgccagaagaactgaagcgggactatgtagatgagcagacaggagatggcccagtgaaatcagtctctagggagaccctgaagagccgtaaaaagtctgactactcgctaaataaagtgaacgccccaatactgacgaacacgacactgaacgtgatcagacttgtggggaagtacatgcagatgatgaatattctgaaaccaattgccttcgacgttatccactttatgtctcagctgttcgattactacctttatgctatctacacattcttcggcagaaatgactccctggaatctacagggctgggcctgtcatcttcgcggctgagaacaactttaaatcgaatccaagagtcactcatcgatctcgaggtgagcgccgaccccacagcgactctcaccgccgcagaggaaaggaaggaaaaggtcccgagcccacacctgagccatctggtggtcctgacctctggtgacactttatacggactcgccgagagagtcgtagccaccgaatcccttgtcttccttgccgagcagttcgagttcttgcaaccacacctggatgccgtcatgccagctgtgaaaaaaccgttcctacaacagttttactcacagaccgtctccactgcatcggagttacgaaaaccaatttattggatcgttgctggcaaggcactggattacgaacaaatgctactgctcatggcgaacgtgaaatgggatgtaaaggagattatgtcccaacacaatatttacgttgacgccttgctcaaagagttcgagcagttcaacaggaggcttaatgaggtctcaaaacgggttagaatcccactgcctgtttcaaatattctgtgggaacattgcatccggctggctaacaggaccatcgtggaagggtacgctaacgtcaagaaatgtagtaatgaaggacgtgcactcatgcagctggacttccagcaatttctgatgaaactcgaaaaacttaccgacattcggcctatccccgataaagaattcgttgaaacttacatcaaggcctattatctgactgagaatgatatggagcgctggattaaagagcacagggaatactctacaaagcagctcacaaacttagtgaacgtctgtcttggctcacacatcaacaaaaaggccagacaaaaactgctggccgctatcgatgacatcgaccgtcctaagcgttag

SEQ ID NO: 55024 - DNA, 1998 bp, Artificial Sequence
  Description of Artificial Sequence: Synthetic coding sequence
atggagccaagggtcgtcaaacctccgggacaggacctggtggtggaaagccttaaaagtcgctacggacttggaggctcctgtccagacgaatacgatttctcaaatttctatcagtctaaatataagcggaggacattgacaagccctggagatctggacatttactctggggacaaggtgggcagctccctcaagtacagcgacgaatcaaagcactgtcgaactcccctgggttctctcttcaagcacgtgaacgtcaattgtctggatgacgaactggatagctttcatgatttgaaaaagcaagagacagaggaggagttaatcgaaaatgactaccgcgtgtctacttctaaaatcacaaagcagagttttaaggagatcgagaaggtcgccctgcctacaaacaccacatcttcacgacctcgaacagaatgttgcagcgatgcaggcgattcaccactgaaacccgtttcatgccctaagagcaaggcttcggataagcgatcgttgcttccacaccagatttcccagatctacgacgagctgttccagatccatctgaaactccaatgtgagacagccgctcagcaaaaatttgctgaggaactacaaaagagagagaggtttctcctggagagggagcagctgctctttcgtcacgaaaatgccctttcaaaaataaaaggcgtggaagaggaggttcttacccgattccagataatcaaagagcagcatgacgcagaggtggaacaccttactgaggtgcttaaggagaaaaacaaggagaccaagagactcaggtcatccttcgatgctctcaaagaactgaacgacacgttaaaaaagcagttgaacgaagcttctgaggaaaaccgcaaaattgacatccaagccaaacgagttcaggccaggctggataatctgcaacgcaagtatgaattcatgaccatacagaggttgaagggatcgtcacacgctgtgcacgagatgaaaagcctgaaacaggagaaggctccggtctccaaaacatacaaagtgcctctgaatggacaggtatacgaactgcttaccgtcttcatggactggatcagtgaccaccacttatcaaaagtgaagcacgaggagagtggtatggatggtaagaagccccaactgaagttcgcctctcagcgtaacgatatccaggagaagtgtgtcaaactgcttccattgatgaccgaacaactgcaatggatgcccttcgttaacatcaagctccacgagccttttgtgaagtttatctactggtccctccgccagctagatgcgggtgcacagcactccacaatgaccagtaccctccgccgtctcggcgaggacatctttaaaggcgtggtgacgaagggcatccaagataactctccccagcatagtgtcgagaataagcccaaaacagccgcattctttaagagcagtaatttacctctgcgcttcctctcaacactgatcgtcctgaaaaccgtaacgcaggctgactacctggcgcaggccttcgacagcctctgtctggaccttaaaacagaagagggaaaaactttatttctggagtaccaagccgtaccggtgatactaagccatctgaggatcagctctaagggcctgttgtcaaatgttatagactccctgctgcagatgactgtggagtcaaaaagcttacagccatttctcgaagcatgctccaattctctctttttcaggacctgcagcgtcctgctgcgcgcacctaaactggatctgcaaattttggagaaattgagtatcattctacagaagctgtccaagattaagagcaataagaagctgttcgagctgttcacaatccacttgatgcttcaggagattcaacggactacaaatccagaacacgcctttctgtgcataaatctgaactcaaccttgtttaatcttggactcaccaaatgtaatagcttagtatcgtccgctagtccttag

SEQ ID NO: 55025 - DNA, 1734 bp, Artificial Sequence
  Description of Artificial Sequence: Synthetic coding sequence
atggaacccagggtggtgaaaccccctggacaggatctcgtggtcgagtctctgaagagtaggtatggcttgggtggttcctgtcctgacgaatacgacttttccaatttctatcagtcaaagtacaaaaggcgcacccttacgagccctggggatctggatatctacagtggtgataaagtaggctcaagtctgaaatactcagatgagagcaagcactgccgtacccccctcggatctctatttaagcacgttaacgtgaattgtttagacgatgagttagactcatttcacgatctgaagaagcaggagactgaggaagaattaatcgagaatgattatcgggtgtccacaagcaaaattaccaagcagtcttttaaggagattgaaaaggtcgcgctccccacaaataccacttcttccaggcctagaaccgagtgctgttccgatgccggtgactcccccctgaagcctgtgtcatgtccgaaatcaaaagcgagtgacaaacgcagtcttctccctcaccagatcagccaaatttatgatgagttgttccaaattcatctgaaactacagtgcgagacagccgctcagcagaagtttgccgaggaactgcagaaaagggaaagattcctgctggaaagagaacaactgctcttcagacacgaaaatgcgctgtctaaaataaaaggagtggaagaagaggtcttgaccaggttccagatcatcaaggaacagcacgacgcggaggtggaacacctgacagaggtgctgaaagaaaagaataaggagactaagagactgcgttcatccttcgacgcgttaaaggagcttaacgacaccctgaagaagcagttgaatgaggcgagcgaagagaacagaaaaatcgacattcaagcaaagcgcgtgcaggcgcgtctggacaacttacaacgtaagtatgaattcatgactattcagaggcttaagggctcttcacacgccgtccatgaaatgaagtctttgaaacaggagaaggcccctgtctcaaaaacttacaaggtacccttgaacgggcaagtatacgaactcctgactgttttcatggactggatttccgaccaccacctgtccaaggtgaaacatgaggaatctggcatggacgggaagaagccccagcttaagttcgcctcccaacgtaacgatattcaggaaaaatgtgtgaagcttttaccgttgatgaccgaacagctccaatggatgccatttgtaaatatcaagctccatgagcctttcgttaagttcatttattggtccttgaggcaattagacgccggtgctcaacacagtacgatgacctccactctgcggaggctgggggaggatatcttcaagggcgtggtgacaaaaggaattcaagacaatagccctcagcatagcgtggagaataaacctaaaacagcggctttttttaagtccagtaatttgccattgaggttcttgagcacgctcattgtgctcaaaacagtaacccaggccgactatttggcccaggcgttcgattctttgtgtctggatctcaagacggaggagggcaagaccttgttcctggagtaccaggctgtgcctgtgatcttgagccatttgcgaatctctagtaaaggtcttctgagcaacgtcatagatagcttgctccagatgactgtggagagtcgcgtgatccggtcttcactaaacttcctgcgctttatctag

SEQ ID NO: 55026 - DNA, 492 bp, Artificial Sequence
  Description of Artificial Sequence: Synthetic coding sequence
atgggcgatgaatgttcaaatccggacctactcgctgaaccgggaagttcccctccatgggaccatgggaatcagcgccaggaggcagccaacgagagtaatacaagggttccaagagtactgaaggcccatttgggacccgaaacagcccagcctactaaaagatccaagagaaaccgctggaggaggcagagttgccagggccctagccccgcaagatctggccagttcctcggttccgctgacttggggcttcagcgtggggtgctcaaaagtgcagcacggacttgcctgagcgaaatctctaactcaaccagggcaagcccagagtccgcacagagtaccgacccagggagagctgctaggccaagaacacgaaccctgcccactccgcatagcttcaaaattggcgaggaagctgaagagatgaaaaagaagaaagagcgcaagcgcaggaaagagcgcaagaaggagcggaattttaaaaaatag

SEQ ID NO: 55027 - DNA, 54 bp, Artificial Sequence
  Description of Artificial Sequence: Synthetic coding sequence
atgggcgacgaatgttctaatcccgacctgcttgcagagcccggttcgtcttag

SEQ ID NO: 55028 - DNA, 2628 bp, Artificial Sequence
  Description of Artificial Sequence: Synthetic coding sequence
atgcaattccagtccctcaaggaattctacgaaaccgagataccacaaaaagaacaggacgacgcgaaagccaaacactgcagcgacagtgcagagaagcaatggcagttgttccttaaaaaatccttcattacgcaggacctaggtctggagtttttgaatcttatcaacatggccaaggagaacgagatcctggacgtaaagaatgaagtgtatctgatgaagaacacaatggaaaatcaaaaggccgagcgcgaggagctatcactcttgcgcttagcctggcagctgaaagcaacagagtctaaaccagggaagcaacagtgggctgcctttaaggagcagctgaaaaagacctctcacaacttgaaattgttgcaggaagccctgatgcctgtgtccgccttggaccttggagggagtttgcagtttatcctcgacctgcggcaaaaatggaatgacatgaagccccagttccaacaactgaacgatgaggttcagtatattatgaaggagtcagaggaattgacgggcaggggtgctcctgtgaaggaaaaatcccagcaactcaaggacttaattcactttcaccaaaagcagaaagagcgcattcaagactacgaggatatcttgtacaaggtcgtccagttccatcaggttaaggaagaactaggaaggctgatcaaatctcgggagcttgagttcgtggaacagcctaaagagttgggtgacgctcatgatgttcagatccacttgaggtgtagtcaggagaagcaggcacgcgtggaccacctgcaccggctggccctttcactgggggtggacatcattagttctgttcagaggcctcactgctccaatgtctccgctaaaaatctgcaacagcagctagagttactggaggaggacagcatgaagtggagagcaaaggcagaagagtacggaagaacattgtcccggtccgtcgagtactgtgctatgagagacgaaattaatgagctgaaggattcgttcaaggacataaaaaagaagttcaataacctgaagttcaattacactaagaagaacgagaagtcacgcaatctgaaagctctcaagtatcaaattcagcaagttgacatgtatgcagagaaaatgcaagcactcaagcggaagatggagaaggttagcaacaaaacaagtgactctttcctgaattacccttccgataaggtcaacgtactcctggaggtgatgaaagacttgcagaagcacgtagacgactttgacaaagtcgtcactgattataaaaaaaatctcgatctgacagaacacttccaagaggtgattgaggaatgccacttctggtatgaagatgcgtcagctacggtggtcagagtaggaaaatattctacagaatgcaagactaaagaagcagtgaaaatactccatcaacagtttaacaagtttattgcccctagcgtcccacaacaagaagaaaggatccaggaagcaactgatcttgcccagcatctgtatgggctagaagagggccagaagtatattgagaagatagtcacgaaacacaaggaggttcttgaaagtgtcaccgaactgtgtgaaagtttaactgagcttgaggaaaagctaaaacagggggacgtgttgaagatgaatcctaacctggaagacttccactacgattatatcgacctgctgaaggagcccgcaaaaaataagcagacaattttcaacgaggaacggaataaaggtcaggtccaagtggcggatctgctcggaataaacggtacaggggaggaaagacttccacaggacttgaaagtttctaccgacaaggaagggggagtacaggatttattactcccagaggatatgctgagcggggaggaatatgaatgtgtttcacctgatgacatctccttgccaccgctgcctggcagcccagaaagcccgctggcgccatctgacatggaagtcgaagagccagtgtcctcctctctgagcctgcacatttcctcttatggggttcaggctggtaccagttctcctggggatgcacaggaatccgttctaccgccacctgtcgcattcgcagacgcctgtaacgacaaacgggaaacctttagcagccatttcgagcgcccttatcttcagtttaaggccgagccacccctcactagcagagggtttgtggaaaaaagtaccgcactgcaccgtatcagcgctgagcatcccgagtctatgatgagcgaagtgcatgaacgagccctgcagcaacatccacaggctcaaggcggtcttctggagacgcgagaaaaaatgcatgccgataacaatttcacaaagacccaggacaggcttcacgccagctctgatgccttttcaggactgcgcttccagtccggaactagcagagggtatcagcgacagatggtccccagggaagaaattaagtcgactagcgccaaatctagtgtcgtgtccctcgctgaccaggcccctaattttagccgtcttctgtctaacgtcacagtgatggagggatctccagttacgctggaagtcgaggttaccggatttcccgagcctacactgacgtggtgggtggcatataacgacaagccttag

SEQ ID NO: 55029 - DNA, 2685 bp, Artificial Sequence
  Description of Artificial Sequence: Synthetic coding sequence
cgaagccaagtcctccagacatacgtggccttcctgaagtcaagtgaagaagtcgagatgcagtttcagagccttaaagagttttatgaaaccgagatccctcagaaggagcaagacgatgcgaaggcgaaacactgtagcgattccgccgaaaagcagtggcagctgttcctgaagaagtctttcatcacccaggatttgggcttggagtttttgaatttgattaacatggctaaagagaatgagattctagacgtgaaaaacgaagtatatttaatgaaaaataccatggagaaccagaaagccgaaagggaggaactgagccttctgcgtttggcctggcaacttaaagctactgaatccaagcctggaaagcagcaatgggccgctttcaaagaacagctgaaaaagacgagccataatctgaaactcctgcaggaagccctgatgcccgttagcgctctggaccttggtggatccctacagtttattctggacctaagacagaagtggaacgatatgaaaccccagttccagcagcttaacgacgaggtacagtacattatgaaagagtcggaggagttgactggtagaggagcccctgttaaagagaaaagccagcagctgaaggaccttatccactttcaccagaaacagaaagaacggatccaggattatgaagacattctgtacaaggtagttcagtttcaccaagttaaggaagaactgggccgactcataaagagccgggagctcgaattcgtcgagcaacccaaggagctgggcgacgcgcacgatgtgcagattcatcttcgttgttcgcaggagaaacaggcaagagtagatcacttacacaggctagccctgagcctaggggtagacatcatcagtagtgtgcagaggccacattgcagtaacgtgtccgccaagaacctgcagcagcagttggaactcctagaggaggactccatgaaatggcgggcaaaagccgaagagtatggcaggaccctctcacggtcagtggaatactgcgccatgcgggacgaaattaatgagctgaaggacagcttcaaagacatcaaaaaaaagtttaataaccttaagttcaactacaccaagaaaaacgagaaatcacggaatctgaaggcattaaagtatcaaatccagcaggttgatatgtatgccgaaaaaatgcaggccctgaaaagaaaaatggaaaaggtgtcaaataagaccagtgattctttcctcaactatcccagtgacaaggtgaatgtgctcctggaagtcatgaaggatctgcagaagcatgtagacgattttgacaaggtggtgaccgactacaaaaaaaacctcgatctgaccgagcactttcaggaagtcatcgaggagtgccatttttggtatgaggatgcttcagctacagtcgtccgagtgggtaagtatagcaccgagtgcaaaacgaaagaggcagtgaagattctccatcaacagtttaataagttcatcgccccatctgtgccccagcaagaagagcgaattcaagaggcaacagacctggctcagcacctctatggactcgaggagggtcagaagtacattgaaaagattgttacaaaacacaaggaggttctcgaaagcgtgacagagctgtgcgagtccctgacagagcttgaggagaagttaaagcaaggggatgtgctgaagatgaaccctaacctggaggactttcactatgattatattgatctattgaaagagccagcaaaaaacaaacaaacaatctttaacgaagagagaaacaagggtcaagtccaggtggctgaccttctggggatcaatgggaccggtgaagaaaggttaccccaagacctgaaggtgagcaccgataaggagggaggcgtgcaggacttgctgctcccagaggacatgttaagtggcgaggagtatgagtgcgtcagccctgacgacatttcactgccccctctacctggtagccctgagagtcccctcgccccaagtgatatggaggtcgaggaacctgtgagtagctctttaagcctccatatttcttcttacggcgtccaggctgggacatcctctccaggggacgcacaggaatcggtgttacccccaccagttgcttttgccgatgcatgcaacgacaagagagagaccttttcttcacattttgaaagaccatatttgcagtttaaggccgagcctccactgaccagccgcggtttcgtggagaaatcgactgctcttcatcggatcagtgctgaacaccccgagagtatgatgtccgaagtgcacgagcgggcactccagcagcacccccaggcccagggtgggttgctcgagacaagggaaaagatgcacgccgataacaactttacaaaaactcaagaccgcctccacgcctcctcagatgccttttcagggctgcggtttcagtctgggacctcacgaggataccagaggcagatggtgcctcgggaggagatcaagagtactagcgcgaagagcagtgtcgtctcactggccgatcaggccccaaatttttcccgcctcctcagtaatgtgaccgtgatggagggatccccggtgacactcgaagtagaagtgactgggttccctgagcctactctgacatggtgggtggcttataacgataagccgtag

SEQ ID NO: 55030 - DNA, 4592 bp, Artificial Sequence
  Description of Artificial Sequence: Synthetic coding sequence
atgtcatcccaggggtcccccagcgtggccctttctaccactactgtgtcttctgtggcagtgcaggctggcgacagcaaaattgtaatagcagttatcaaatgcggcaagtgggtccagctgcagttggctgaatctcagcctaatctcttggaaattggtagttctcaagacgagaccaaaaaactgctccacgaccacgaactgttactggccaaactcaaagctctcgaggacagagtgtgggagctcctccaggaggctgataagactgcggaggagaacaaggaccaatcccaggtctacgatgcaatggcagaaaccctcggggaagcttgggcagctctcgtaagcatgttggaacggcgaaccgagctgcttaggctgacctcagaattttttgagaatgcgctggaattcgccatcaaaattgaccaggctgaggactttctgcaaaacactcatgaattcgagtcagccgagtccctcaaatcgctcttgcagctccacgaacatcataccaaagagttgctggagagaagcctcgcgctgttaaataagtcccaacagctcaccgactttatcgagaagttcaagtgtgaggggcctaatgtgaaccccgaacttacgcaaggtgcccattcttcttgcctgaaggtggacaggctactggagctcctccaggaccgtagacggcagctcgataaatacttgaagcagcagtggcaggaattgagtcaggtgttgcagatatgccagtgggaccagcaagaaaaccaagttacatgctggtttcagaagactatcaggaacctccaggaacagtccctcggatccagcctgtccgacaacgaggacaggattcacaagcaggaagaactcattattaaagcgaaggaatggaacagcgccgtggaaaaattaaaaagtgaggcactgaggatcctgctgtcgaaggattacgtggaaaaagagcatctgcagctgtcccaccaaaagctctcccagttacaagaagagttcgggcagctgatggtggagcgcaatacgtggctgaaaaaagcaaacgagttcttcaattcagccaataaagctttcgatgtcttgggacgcgtggaggcatatctgaaacttcttaagtccgaaggactgtcactagccgtgctggcagtgcgtcacgaggaactgcaccggaaaattaaagattgtaccaccgacgccttgcaaaaaggtcagaccttgatttctcaagtggattcatgttcctcacaggtgtccggcatccatgaaatgatgggatgcattaaacggagagtagatcatctgactgagcaatgcagtgctcacaaggaatatgccttgaaaaagcaacagctgaccgcatcggttgaagggtatttacggaaggtggaaatgtctatccagaaaatttcacctgttctgagtaacgcgatggatgtggggtccacccgcagcgagtctgagaagattttaaacaaatatctggagcttgatatccaggcaaaagaaacatctcacgaactggaggcagccgctaagaccatgatggaaaagaacgagttcgtctcagatgagatggtgagcttgtctagtaaagcgcgttggctggccgaggagctgaacctattcgggcagtctattgactatcggagtcaagtccttcagacatatgtggcgtttttgaaatcctcagaagaggtggagatgcagttccagtctctgaaggagttctatgagacagagatcccccagaaggagcaggacgatgctaaggccaagcattgttcagacagcgccgagaaacagtggcaactgttcctgaagaagtctttcatcacacaagatcttggattggaatttctgaacctgattaacatggccaaagagaacgaaattctggacgtaaagaacgaggtgtaccttatgaaaaatacaatggagaaccagaaggcagagcgggaagagctatcactgttacggttggcctggcagttgaaggccaccgaaagcaagcccggtaagcaacagtgggccgcattcaaggagcagctcaaaaagacatcccacaacctgaagctgcttcaggaggcactgatgccagtgagcgcgttggatctggggggtagccttcagtttattcttgatctccggcagaaatggaacgacatgaaaccgcagttccagcagctcaacgatgaggtgcagtacatcatgaaggaaagtgaggagctgacaggcaggggcgcacctgtgaaggaaaagagtcagcagctgaaggatctcattcacttccaccagaaacagaaggagcggatccaggactacgaagacatactatacaaggttgttcaattccatcaagtgaaggaggaactcggccgtttaattaagtcacgcgagctggaatttgtagagcaacccaaggagcttggtgacgctcacgatgtccagattcatttgaggtgtagccaagaaaaacaagcgagagtagaccaccttcaccgcctggcattgagcctaggggttgatattataagttcagtgcagaggccgcattgctcaaatgtttcggccaaaaatctacagcaacagcttgaattgctggaagaggatagcatgaaatggagagcaaaagcagaggagtatggcagaacgctcagccgatctgtggaatactgcgcgatgcgcgatgagattaatgagctcaaagactcattcaaagacattaagaagaagttcaataatctgaagttcaactataccaagaaaaacgaaaagagccggaacctcaaggctttgaaataccagatacagcaggttgacatgtatgccgagaagatgcaggcattgaaacgaaaaatggagaaggtgtcaaacaagacttctgattcctttctaaactaccccagtgataaagtcaacgtgctgctggaagtgatgaaagacctccagaaacatgtcgatgattttgacaaggtggtaactgactacaagaagaacctcgaccttacagagcacttccaagaagtaattgaggaatgtcacttttggtatgaggacgcttccgccactgtggtgcgtgtggggaagtacagcactgaatgcaaaacaaaagaggcagtgaagattctgcatcagcagtttaacaagtttatcgcgccaagtgtgcctcagcaagaggagaggatccaggaagctactgatctggctcagcacctgtacggattagaagaggggcagaagtatattgagaagatagtgaccaagcacaaggaagtgctcgaatccgtgaccgaactgtgtgaatctctcacagagctcgaggaaaaactgaagcaaggggatgtgctcaaaatgaatcctaatctggaggattttcattacgactacatcgatctgctgaaggagcccgctaagaataagcagacaattttcaatgaggaaaggaacaaaggccaggtgcaagtggccgacctgctggggatcaacggcaccggggaggagcgcctgcctcaagatctgaaagtgtctactgataaggagggaggcgtgcaggatctgctgttgcctgaggacatgctgagtggggaggaatacgaatgcgtgagccctgacgatataagcttacctcctctgcccggaagccctgagtccccgctggcaccttccgacatggaagtcgaagaaccagttagcagctccctatctctgcatatcagctcttacggggttcaggccggtacctctagcccaggagacgcacaggaaagtgtgctgcctccacccgtggcctttgcagacgcctgcaatgataagagggagacctttagctctcactttgaaaggccctacctgcagttcaaggctgaaccacctctgacaagcaggggcttcgttgaaaagagcaccgcgctgcacaggatatcagcagaacaccctgaatcgatgatgtccgaggtccacgaacgcgcactccaacagcacccgcaggctcagggtggactccttgagaccagggaaaagatgcacgccgacaacaacttcaccaaaactcaagatcgactgcatgcaagcagtgacgccttctctgggctgcgctttcagagtggcaccagcaggggctaccagcgacagatggtacccagggaagaaatcaagtctacctcagctaagtcctctgtggtttctctggccgaccaggcgcctaactttagcagacttctcagcaatgtaaccgtaatggaggggtctccggtaacgttggaggtggaagtaacaggcttcccagagccaactctaacctggtataagaagggacagaaactctccgccgatggacatttgcaagtgcttcacaaggagacaagacacagcgtgtttatccctaaagtgtgtaaggctgacgcaggcctctatgtggcacgcgctcagaacagctcgggagccctgtcatcaaatgttattctccatgtcacaggaaactgccggctgcctataacacgagtgaattggattaccttatgcgtggtgtacgtcagcgtctccctcatgtattggctgctcactcaata

SEQ ID NO: 55031 - DNA, 2253 bp, Artificial Sequence
  Description of Artificial Sequence: Synthetic coding sequence
atggctcaggccagtagaagtggatcattgccacccttagtgatagtacccccactccgtgctcaacccggaggcaccggagaggaacagtgggagcgatctcgaactggtggactcagatgggaagtgcactgctggccctcaggcacatctggaggaaccccttggtggcctacacccgctgatgttagcgaagattatgaggccgatgcggcagcatggcgtagaggcccagccggtggtgggcctattcctccagcactgcagaggctgcgcgcagtgctgctgcggcttcaccgcgagcgagaacagctcctccaggctcgggattgcgcctatcacctgcagtctgccgtgcgccttatgaagaccttgtctccgggatcgccaagtggaggtccctcccctctgccccagtggtgccgagatcttcaactccacccgtcccagggggcagtcctgagaatcggcccaggcgagactttggaaccgctgctccttgcacgacctattggtctggcagcgcagtgtttagaggctgttattgagatgcagctgcgggctctcggcagagagcccgcaagcccaggtctttcttcccagcttgcagaactgctgtttgctttgccggcataccatactctgcaaaggaaggccctcagccacgttcctggagccgctaggccattcccaacctccagagtgctaagactgctcaccggggagcgcggttgccaagttgcctccagacttgacgaggctctgcagggcagcgcactgagggaccaactacgaaggaggtgccaggaagagggcgatctgctgcccggacttcttggcctggtgggcggagtggctggatctgcttcttgtgggctgggcctcggcggtgcgggagccctgtggagtcagtactggacactgttgtgggctgcctgcgcccaatcactggatctgaacttaggaccttggagagatccacgggctactgcccaacagttgtctcaagcacttggccaggcaagccttccccaagaatgtgagaaggaactggcatctctatgccatcgactactgcatcaatctctgatatggagctgggaccagggcttctgtcaggcactaggatctgcattaggaggccagtcatccctgcctacatccagcggaacggcagaacttctccagcaactgttccctcctctgctggatgcgctgagggaacctaggctgcggcgaatcttctgccagccagccgatcccgcaccagtcgcactgggcctttgcaccctccaaactacgctgctgtggtttctcggaagggcccagcagtaccttgccgcatgggatcccgctagtttccttcttctcatccaaaaggaccttccgcctcttcttcatgaggctgaggctctgtatagtctcgcctctgaggagtccctagccctggaggttgaacagcagttagggctggaaatccagaaacttacggcacagatccagctcctgccagaagagtccttgtctgtgttctcccaggagtgccacaagcaagcaatgcaggggttcaagctgtacatgccgaggggaagatattggaggttaagactctgtccagagccacccagcgctccatctgaatacgctggcctcgtggtgcgcaccgtgctggaacctgtgctacaggggttacagggtttgccgcctcaggcacaggcgccagccttgggacaggcccttaccgccatcgtcggcgcatggctggaccacattttgacacacgggattaggttcagcttacagggggctctccaactcaaacaagatttcggcgttgttagagaattactggaggaggaacagtggtccttgtctcctgacctgaggcagactctcttgatgctatcaatctttcagcaactggatggggcattgctgtgcctcctgcaacagccactgccgaagagccaggtacataggaggcctccgtgttgttgcgcttgccaggaagttcaaactactaagctgccttccagctgtctgaacagcctggagagcttagaacccccacttcagccgggaacctctcccgctcagacaggccagctgcaatccactttaggaggacgcggtccatctccagaaggttacttggtagggaatcaacaagcctggctagcactcagacagcaccagcggccacgatggcatctcccgttctttagctgtctcggcactagcccagagtcatag

SEQ ID NO: 55032 - DNA, 2232 bp, Artificial Sequence
  Description of Artificial Sequence: Synthetic coding sequence
atggcccaggcctcccgctccggctcactgcctccgctggttatcgtgccgccactgcgcgctcagcccggtggtactggggaagaacagtgggagcgcagccgcactggtggactgcgatgggaggttcattgctggccgtccgggacgtcaggaggcactccttggtggcccaccccggcagacgtgtctgaggactatgaagctgatgctgctgcctggaggagagggccagccggaggcggacctattccccctgccctccaaaggctgcgcgcagtgttgttacggctgcacagggagagagagcaactgctccaggccagggactgtgcctaccacctgcagtcagccgtgcgactaatgaaaacactctcacccggaagccccagcggcggtccttcccctctgccccagtggtgccgggatctgcaactccacccatcccagggagccgtacttcgtatcggccctggagagactcttgagcccttgttactggccagaccaatcggccttgccgctcagtgcctggaggctgtcatcgagatgcagttgagggccctcggtcgggaacccgcttcgcctggcctcagctcccagctcgcagaactcctgttcgcactgccagcataccataccctgcagcgtaaggccctatcgcacgtcccaggagcggcacgtccctttcccacatctcgtgttttacggttgttaactggcgaaagagggtgtcaggtggcatctcgactggacgaggctcttcaaggctctgctctgcgcgaccagctccgccgtcgctgtcaagaggaaggcgatcttctgccgggattgttagggctggtggggggagtggccggaagtgcgagctgcggactcgggcttggcggagcaggcgcactctggtctcaatattggacactgctgtgggccgcttgcgcccagagccttgatctgaatttgggtccctggcgggatccccgagcaactgcccaacagctttcccaggcactaggacaggcctccttaccgcaggagtgtgaaaaggagctagcttccctctgccacagattgctccaccaatcactgatttggagttgggaccaagggttctgtcaggctctcgggtccgccctcggaggccagtctagcctgcccaccagctctggtaccgccgaactccttcagcagctcttccctccccttctagacgcacttagggaacccaggcttagaagaattttttgccagccggcaggattgtgcacactgcagactacactcctatggttcctgggtcgggcacagcagtacctggccgcatgggatcctgcttccttcctgcttctgattcagaaggacctgccccctctactccacgaggccgaggcgctctactcactcgctagcgaggaatctctcgccttggaggtggaacagcaattgggcttggagattcaaaagttaaccgcgcagattcagttactgccagaggagagtctgagtgtgttttcccaggagtgtcataaacaggccatgcaagggtttaagctctacatgccacgcggtcgatactggagactacggctgtgccccgagcctcccagtgccccaagcgaatacgctggcctcgtcgttaggactgtcctggagccagtccttcagggcctgcaagggctcccacctcaggcgcaggctcccgctttaggacaagctttaacagcaatcgttggggcatggctggatcatattttaacccatggcattcggttttccctccagggtgccctgcagctcaaacaagacttcggcgtggtgcgtgagctcctcgaagaggagcagtggagcctgagccctgacctgcgacagacgttgctcatgctgtctatcttccagcaactcgacggtgctctcctctgcctgctccagcagccgctacccaaatcccaggttcataggaggcctccatgctgctgtgcatgccaggaggtgcaaacgaccaagctgccttcatcctgtctcaattctttggagtctttggaacctcccctgcagcctggaacctcacccgctcagactggccaattgcaatctacactggggggacggggtcccagtccagagggataccttgtgggcaatcagcaggcttggttagccttgcgccagcaccagcgccctaggtggcacctcccattcttttcatgcctcggcacttctccggaatcatag

SEQ ID NO: 55033 - DNA, 666 bp, Artificial Sequence
  Description of Artificial Sequence: Synthetic coding sequence
atggcttcctggggaggcgagaagcgcggaggcgcaggagggagcccaaagcccgcagtctacgccacacgtaaaacgcccagcgtggggtcccaggaggatcaatggtatttagattaccccggagaccaatggtctttggggttttcgtactcatggtggaaaaactccgtaggctccgaaagcaaacacggggagggagcgctcgatcaactgcagcatgacgtgcgcctggaggacctaggagagctccaccgtgccgcaaggtccggcgatgtgccgggtgtggagcatgtactcgcacctggcgataccggtgttgacaagcgagatcgtaaaaaatcaatccagcagctggttcccgagtacaaagaaaaacagacgcccgagtctctgccgcagaacaataacccggctgcgccttctcaggccgaaggaggcgaggggggagtcgcgtgtggaacggtggaacagatgacatggctctgtagtttgcctcacgccgtggggggaggtgacggcgaccacagttctacaggtgccgtcggcggacatccccgaggtcccggtgaatactgtcatcttcacgagcagagagtgcaccatcatatctttgcaagggggaaacggaaggggaaaaaccacgtctctaacgttgtgcgttag

SEQ ID NO: 55034 - DNA, 2757 bp, Artificial Sequence
  Description of Artificial Sequence: Synthetic coding sequence
taaaagggttgcgagaataaacagcctcaggtagaggaggaaatggaaaagcacaggagcaatagtaccgagttgtccggaaccctgacagatgggactacagttggaaatgatgatgatggtctcaatcagcagatcccgaggaaggaaaacggagaacatgaccgacctgccgacaaaaccagcaacgaaaagaatgaagtcaagaatcagatttacccggaggcagactttgctgacagcatggagccttcagagattgcctcagaggactgcgagttaagtcacagtgtctatgagaattttatgttgttgatcgaacagctgaggatggagtacaaggatagcgcctccctgcccaggatccaagacaccttttgcctctgcgagcacctgttaaaactcaagaataatcactgcgatcagctgactgtcaaactgaaacagatggaaaacatggtctctgtgctccaaaacgagttgagcgagacaaaaaagacgaagctgcagctggagctgcagaagatagaatgggaaaaagaactgtacgatctcaggctagcattgaagcaggagaacgaagaaaaaagaaatgctgacatgttatataacaaggacagcgagcagctcaggattaaagaagaggagtgtgggaaagtggtagaaactaagcagcagctgaagtggaacctcaggcgactggtgaaagagctgagaaccgtgcgcaacaatttagacctggtggttcaggagagaaatgatgctcaaaaacaactgtcagaagaacaagatgcccgaatcctgcaagatcagatcttgacatccaagcagaaagaattggagatggcacgcaagaagatgaacagcgaaattagtcacagacaccagaaggaaaaagacttatttcacgaagactgcatgcttcaagaggagatcgcacttctccgcctagaaattgatactatcaagaaccaaaacaaacagaaggaaaaaaagtacttcgaggacattgaagctgtaaaagagaaaaatgataacctgcaaaagatcattaagttaaacgaggagaccctcaccgaaaccatcctgcaatactccggacagctcaacaaccttactgccgagaacaaaatcttaaatagcgagctcgaaaacggaaaacagaaccaggagaggctggaaattgaaatggaatcctatcgctgtcgcctagccgctgccgtcagggattgtgaccagagtcaaacggccagagatctaaagttggacttccagagaacgaggcaggaatgggtcaggctgcacgataagatgaaagttgacatgtctggactccaggccaagaatgagatcctgtccgagaagctctctaacgctgagtccaagataaacagtcttcagattcagttacataacactcgggatgcactcggaagagagtccctcatactggagcgtgttcagcgggatctgtctcagacccagtgtcagaagaaggagaccgagcagatgtatcaaatagagcagagcaagctaaaaaaatatatcgccaaacaagagtccgtggaagagagactgtctcagttgcaaagtgagaacatgctgttgcgtcagcagctggatgatgcacacaagaaagcaaacagccaggaaaaaacatcttctacgattcaagatcaattccactccgccgctaaaaacctgcaggcagaatcagagaaacaaattctgtcccttcaggaaaaaaataaggaactgatggatgaatataatcaccttaaagaacgaatggaccaatgtgaaaaagagaaggctggcaggaaagtggtgatgagggaatttcagcaagaatggactgatttactgaaacaacaaccaaccagtgaagcaacgagcagatgccacatcaaccttgatgaaactcaagattcaaaaaagaagctcggccagattagatctgagatcgatctcacagaagctcaggaaacagtgccctctcgttgcttacatctggatgccgagaatgaggttttacaactccagcagactctgttctcaatgaaggctattcagaaacagtgcgagacactccagaagaataagaagcagctcaaacaggaagttgttaatttgaaaagctacatggagaggaatatgctagaacgcggtaaggccgaatggcacaaattgctgattgaagaacgggctcgcaaagaaattgaggagaagttgaacgaggccattctcactttgcaaaaacaggcagccgtctcacacgaacagcttgtccagctccgagaggacaatactacatcaataaagacccaaatggaactgactatcaaagacttggaaagcgaaatctcccggatcaaaacgtcccaggctgactttaacaaaacagagttggagagatataaggagctgtatctcgaggaggttaaggtacgggagtccctgtctaacgaattaagtagaactaacgagatgattgccgaagttagcactcagctgacggtcgagaaggaacagacccgctctcgatctctctttactgcttacgctactcgcccagtcctcgaatccccgtgcgtgggaaacctgaatgatagcgaggggctcaacagaaaacacatcccaaggaaaaaacggtcggccctgaaagacatggaaagttatctgctgaaagtgagttacttgttttcattcggagtgcagatctccgatcggattttggtgtgttacctcgttaagtag

SEQ ID NO: 55035 - DNA, 1716 bp, Artificial Sequence
  Description of Artificial Sequence: Synthetic coding sequence
atggcctcctggggaggcgagaaaagaggcggagccgaaggcagccccaaacctgctgtgtacgccacgaggaagacccccagcgtcggtagtcagggcgatcagtggtatctgggttaccccggagatcagtggagctccggattcccctattcatggtggaagaacagcgttggatctgaaagtaaacacggagaaggcgcacttgatcagccccaacacgatgtgcgattggaggacctgggtgaactgcaccgcgcagctcggtccggcgacgtgcctggcgtcgaacatatcctcgcccctggtgataccggcgtcgataagcgcgacagaaaaaaatctattcaacagctcgtgccggaatataaagaaaaacagactcccgagtcgttgccccagaataataaccccgattggcaccctaccaacctgacactgagtgacgaaacctgccagcgtagcaagaacctgaaggttgacgacaagtgtccaagtgtatcacccagcatgcccgaaaaccagtcagccactaaagagttaggccagatgaacctcaccgaacgggagaagatggacactggcgttgtgctcctctcaggtaacgacacacttcacgatctgtgccaatcacaactgcccgaaaataaagagagcaaggaggagcaggactccgagctgactagcgaggaagaacaagaacgattgaagggttgtgaaaataagcagccccagaaaaccagccaggaaccagaaatggctaaagattgcgaccgggaagacatccctatttaccctgtgttgcctcacgtgcaaaagtccgaggagatgtggatagaacagggaaagttagagtggaagaaccagctgaagctggtgattaacgaactcaagcaaaggtttggtgaaatctacgaaaaatataaaatacctgcctgtccagaggaggaaccacttctcgataacagtacccggggaaccgatgtcaaggacatcccattcaatctcacaaacaacatccccggatgtgaggaagaagacgccagtgagatatcagtctccgtggtatttgagacttttcccgagcagaaggagccatcactgaaaaatataatccatccttattatcacccctattctgggagtcaggagcacgtgtgccagagttccagcaagtttcacctacatgaaaataaactggattgcgataacgacaacaagccgggtatcggacacatctttagcactgataagaacttccacaacgacgctagtacgaagaaggccaggaaccccgaagtggtgatggtcgaaatgaaggaggaccaggaatttgatctacagatgaccaagaatatgaaccagaattcagacagtgggagtactaataactataagtctctgaagcccaaattggagaatttgtccagtctgccaccggacagtgatcgcactagcgaagtctacctgcacgaagaactacaacaagatatgcagaaatttaaaaacgaggtgaataccctggaagaggaattccttgctctaaaaaaggaggatgtgcagctgcacaaggacgtcgaggaggagatggagaagcatagaagcaatagcaccgagttgtcaggtacccttaccgatgggactacagttggcaacgatgatgacggtctgaatcaacaaatcccacgcaaagagaacggggaacacgatcggtag

SEQ ID NO: 55036 - DNA, 2181 bp, Artificial Sequence
  Description of Artificial Sequence: Synthetic coding sequence
atggcttcttggggcggagagaagcgcggaggcgcagaaggcagtcctaaacccgcagtatacgctactagaaagaccccgtctgtggggagtcaaggggatcagtggtacttgggctatcctggagaccagtggtccagcggatttccatacagttggtggaagaacagcgtgggatccgagagcaaacatggtgaaggcgctcttgaccagccccagcacgacgtgcggctggaagatcttggcgagttgcaccgcgctgcccgatccggtgacgtgccgggagtcgagcatatcctcgctccaggagataccggcgtggacaagcgggatcggaagaagagcatccagcagctagttccggagtacaaagagaagcaaacccccgaatcgctcccacagaataacaacccagactggcacccaaccaatctgacgctctcagacgaaacgtgtcagcggtcgaagaatctgaaagtggatgataaatgccccagcgtgtccccaagtatgccggagaaccagagcgccaccaaggagctgggccaaatgaacttaaccgagcgcgagaagatggacactggtgttgtgctcctgagtgggaatgacactttgcacgatctatgccagagtcagctccccgaaaacaaggagagtaaagaggcggagcaggattccgagcttacctctgaggaagagcaagagcggctcaaggggtgcgagaataagcaaccacagaaaacaagccaggagcctgaaatggccaaggattgcgacagggaggacatccccatctatcccgtcctgccacacgtgcagaaatccgaagagatgtggattgaacaggggaagttggagtggaagaatcagctgaaacttgtgattaatgagcttaaacagagattcggagaaatctacgaaaagtacaaaatccctgcttgtccagaggaagaacccttgcttgataacagcactcgcggaaccgacgttaaggatattccatttaatttgaccaataatatacctggctgtgaggaagaggacgcttctgaaataagcgtgtccgtggtgtttgaaacctttccagaacagaaggaacccagtctgaagaacatcatccatccctactatcatccttactccgggtcacaagaacatgtttgtcagtcgtccagtaagttccaccttcacgaaaataagctggattgcgataacgataacaagccgggaatcggccacattttcagtactgataagaactttcacaacgacgcttctaccaagaaagcgagaaatcccgaagtggtcatggtagagatgaaagaagaccaggagtttgacctccagatgaccaagaatatgaaccagaatagtgactcgggcagtacaaacaactacaaatccttgaaacccaagctggagaaccttagctctctacccccagattccgacagaacttctgaggtttacttgcacgaagagctacagcaggatatgcaaaaattcaaaaatgaggttaataccttagaagaagaattcctcgctctaaaaaaagaagacgtgcagctccacaaggacgtagaggaggagatggagaagcaccgcagcaattctaccgaattaagtggcacccttacggacggcaccaccgtgggtaacgacgatgacggactcaaccaacagattcctaggaaagagaacggagagcacgatcggcctgccgacaagacctcaaatgaaaaaaacgaggtaaaaaaccagatctaccctgaggctgactttgccgattctatggagccgagcgagatcgcttcagaggactgtgagcttagtcattctgtgtatgagaacttcatgctgttaatcgaacagcttcgcatggagtataaggattccgcatccttgccaagaatacaggacactttttgtctatgtgagcacctgctgaaactgaagaacaatcattgcgaccagttaacggttaagcttaaacagatggagaatatggtcagcgttttgcagaatgagctgagcgaaacaaaaaaaactaagctccagctcgaattgcaaaagattgagtgggagaaagagctgtacgatctgcggtttctcatcgggattagaaagaagcgtattagtttcatgaagatagcctgctgtagaaaaaaactgccctgctag

SEQ ID NO: 55037 - DNA, 4284 bp, Artificial Sequence
  Description of Artificial Sequence: Synthetic coding sequence
atggccagctgggggggagagaagcgcggaggagctgaaggatcacccaaacccgctgtgtacgctaccaggaagactccatccgtggggagtcagggggaccaatggtacttgggctaccccggagatcagtggagctcggggtttccctattcgtggtggaagaactccgtaggttcagagagcaagcacggtgaaggagccctcgaccagccccaacatgatgtgcgtctggaggacctcggggagctgcatcgcgcagctcgaagcggagatgtgcctggagtagagcatatcctggccccaggtgatactggcgttgataaaagggaccggaagaaatcgatacagcaacttgtgcccgaatataaggagaaacagactccagaatctctgcctcagaacaacaaccctgactggcaccccactaatctcacattaagcgacgaaacttgtcaacggtcaaagaatctcaaggtcgacgataaatgcccatctgtctctccttctatgcccgaaaatcagtcggccacgaaggagctaggccagatgaacctgaccgagcgcgagaagatggacacgggcgtcgttctactttctggtaacgacactctgcacgacctctgccagagtcagctgcccgagaacaaagaatccaaagaagccgaacaggactctgagctcaccagcgaggaagaacaggaacggcttaaggggtgtgagaacaaacagccccagaagacctcccaagagccagaaatggctaaggactgcgaccgggaagatatacccatttatcctgtgcttccgcacgtccagaagtcagaggaaatgtggattgagcagggaaaattggaatggaaaaatcagctcaaacttgtgattaatgagttgaagcagagattcggagaaatctacgagaaatataaaatcccagcctgcccggaagaagaacctttgttggacaactcaactaggggcactgacgtgaaagacatccccttcaacctgaccaataacattccaggctgtgaggaagaggatgcatcagagatttctgtgagcgtcgttttcgaaacctttccggagcagaaagaaccctccttaaagaacatcattcacccatactaccacccatattcaggttctcaagaacatgtctgtcaaagttccagcaagtttcatctccacgagaataagttggactgtgataacgataataagcctggcattggacatatctttagcaccgataagaactttcacaatgacgccagcacaaagaaagcaagaaaccctgaggtagtcatggtcgaaatgaaggaggatcaggaatttgatctacagatgacaaagaatatgaaccagaacagtgactcagggagcacaaacaactacaagtcattaaaaccaaaactagaaaatttatcctcacttccacccgattcagataggacttcagaagtttacctgcacgaagagcttcagcaggatatgcaaaagtttaaaaatgaggtgaataccttagaagaagagtttctggccttgaagaaggaggatgtgcaacttcacaaggacgtggaggaggaaatggagaaacatcggtctaactccactgagctctcaggtaccctgaccgacggcaccacagtgggcaatgacgacgacgggctgaaccaacagatcccccgaaaggagaacggggaacacgaccgaccggcagacaagaccagcaacgaaaagaatgaagttaagaaccagatatatccggaggctgacttcgccgattccatggagccttccgaaatagcttctgaagactgcgaactgtcccactcagtgtacgaaaatttcatgttgcttatcgaacagctcaggatggagtacaaggattctgcaagtttgcccagaatccaggacaccttctgcctctgcgagcacctgctgaaattaaagaataaccactgcgaccagctcacagttaagctgaaacagatggaaaacatggtatctgtgcttcagaatgaactttccgaaactaaaaaaaccaaacttcagctagaattgcagaagatcgagtgggaaaaggaactgtatgacctccggctggccttgaaacaagaaaacgaagaaaaaaggaatgcagatatgctatacaataaggacagcgagcaactcaggattaaagaagaggaatgcggaaaggtggtcgaaaccaaacagcagctcaaatggaacttgaggcggttggtgaaagaactgcgtactgttagaaacaatttagacctggtggtgcaggagcgtaatgacgcacaaaagcagctgtccgaggaacaagatgcaaggatcctccaagatcaaattttgacttccaagcagaaggaattagagatggccagaaaaaaaatgaattctgagatcagccaccggcatcagaaggaaaaagatcttttccatgaagattgtatgcttcaagaggagattgccctgctgagactggagattgacactattaagaatcagaacaaacagaaggagaagaagtactttgaggacatagaggctgtgaaggaaaagaatgataatctgcagaaaataataaaattgaatgaagagactctgacagagactattctccaatatagcggccaactgaataacttgaccgcagagaataagattttaaattccgagctggaaaacggaaagcagaaccaagagcggctggagatagagatggagtcgtaccgatgtagacttgctgcggctgtccgtgactgtgatcagagccagactgccagggacttaaaattagattttcagcgtacgaggcaggaatgggtgcgactccatgacaaaatgaaagtggacatgagcggcttgcaggcaaagaatgaaatcctatcagaaaagctgagcaacgccgagtcaaaaatcaatagcttgcagattcagttgcataacaccagggacgcccttggaagagagagtctcatcttggagcgcgtacagagggatctgagccaaacccagtgtcagaagaaagagactgaacagatgtaccaaattgaacagagcaagttgaagaagtacattgccaagcaggagtccgtggaagaacgcctgtcccagctgcaaagcgagaacatgctgctcagacagcagttggatgacgcacacaaaaaggctaattctcaagaaaaaaccagtagcaccatacaagaccaatttcactcggcagctaagaatctgcaggcggaatctgaaaaacagatcctctctttgcaggaaaagaacaaagaactgatggatgaatacaatcatctgaaagaacgaatggatcagtgcgaaaaggaaaaagccggaaggaaaatcgatctgaccgaggcccaggagacagtccctagtcgctgtctccacctagacgcagaaaatgaggtgctacaacttcagcagactttgttttccatgaaagctatccagaaacagtgtgagaccctgcaaaagaataagaagcagctgaaacaggaggtggtcaacttgaaatcctatatggaacggaatatgctcgagagaggaaaagccgagtggcacaaattgctcatagaagagagagctcggaaggaaatcgaggagaaactgaacgaggcaattttgacattgcagaagcaagccgctgtgtcacacgagcagctggtccagttgcgagaggacaacactacctcgattaaaactcaaatggaactcacaataaaggacctggagtccgaaatcagtagaatcaagacctcccaggcagactttaacaaaactgagttggagcggtataaagagctgtatttagaagaggtcaaggtgagggagtctctatccaatgagctgtccaggactaatgaaatgatcgcggaggtctccacgcaactgacagtggagaaggaacagactagatcccgtagcctgtttactgcctatgcaactcggccagtactcgaaagtccatgcgtgggaaacttgaacgacagtgagggtctaaatagaaagcatatcccccgaaagaagcggtctgcgctaaaggacatggaaagctatctgcttaagatgcagcagaaactccagaacgatctgacagcggaggtggccggatcctcccagactgggctccaccgcattccccaatgctcaagctttagtagtagcagtttgcatctgctactttgctctatctgccagccattttttctgattctgcagttgttgctgaatatgaacctagatccgatctag

SEQ ID NO: 55038 - DNA, 681 bp, Artificial Sequence
  Description of Artificial Sequence: Synthetic coding sequence
atggctagttgggggggagagaagcgcggaggcgctgaggggagtcccaagccagccgtgtatgccacccgtaagacgccctctgtgggctctcaaggcgatcagtggtatctgggctatccaggtgaccagtggagcagtgggttcccatactcatggtggaaaaacagtgtgggatcggaatctaaacacggggaaggagccttagatcagccacagcatgatgtgaggctggaagatctgggagagttgcaccgtgctgcccgatctggtgacgtgcctggggtagagcatattttagcacccggagacactggtgtcgacaagagggaccgtaagaagagcatccagcagctggtgccggagtataaggagaaacagacccccgagagtctcccacaaaacaacaaccctgattggcaccctaccaacctgacccttagcgatgagacctgccaaagatccaagaatctgaaggttgacgacaagtgtccttcggtgagtcctagcatgccagagaatcagagtgctaccaaggagctcggccagatgaacctaactgagcgcgaaaagatggatacaggggttgtgctgctgtctggaaacgacaccttacacgacctgtgtcagtcccagctacctgagaacaaagagtcaaaggaaggaaacaaggaggcctag

SEQ ID NO: 55039 - DNA, 4278 bp, Artificial Sequence
  Description of Artificial Sequence: Synthetic coding sequence
atggcgtcctggggaggtgaaaagcggggtggtgccgaagggtccccgaagcctgctgtatatgctacgcgcaaaaccccgtccgtcggatcacagggagaccagtggtatttgggataccccggagatcaatggtcttcaggctttccctattcttggtggaagaatagtgtgggcagtgagagcaagcacggcgaaggagccctggatcagccgcagcatgatgtaaggttagaggacttaggcgaattgcacagagccgctaggagtggggacgtgcccggtgtcgagcacatactggcacctggcgacaccggcgtggataagcgcgaccggaagaaaagtattcagcagctggtaccagagtataaagaaaaacaaacacctgagtccctgccgcaaaacaacaacccagattggcatcccaccaacctgaccctgtccgacgagacctgtcaacgatcgaaaaatctgaaggtggacgacaagtgcccttcagttagcccaagcatgccagaaaaccaaagtgccacaaaggagttggggcaaatgaaccttacggagagagaaaaaatggatacaggggtggtcctcctcagcgggaatgataccctgcatgatctatgtcaatcacaactacccgagaataaagagtctaaagaagctgagcaggactctgagttgaccagtgaagaggagcaggagcggcttaaaggatgtgaaaacaaacagcctcagaaaacctcacaggagcctgagatggcaaaggactgtgaccgggaggatattcccatttatccagtcctgcctcacgtacagaaatccgaggagatgtggattgaacagggcaaacttgaatggaagaatcaactcaaactggtaatcaatgagctgaagcaacgcttcggtgaaatatatgaaaagtacaagattccagcctgccctgaagaggagccactactcgacaattccacaaggggcacagatgtgaaagacatcccgtttaacctgaccaataacatcccaggatgcgaggaggaggacgcaagcgaaatatccgtgtcagtggtatttgaaacctttcctgagcaaaaggagcctagccttaaaaacatcatacatccctactaccatccctattctggatctcaggagcacgtgtgccagtcgagctcaaagttccatctgcatgaaaacaagcttgactgtgataacgataacaaaccgggaatcggacatattttcagcactgacaaaaacttccacaatgacgcttctactaaaaaagctcgcaaccccgaagtagtgatggttgagatgaaagaagaccaggagttcgacctacagatgactaagaacatgaatcagaacagtgatagcgggagcaccaacaattacaagtccctgaaaccaaagctagaaaacctgtcgagcctgccacccgactctgatcgcacaagtgaggtgtatctccatgaggaactgcagcaagatatgcagaagtttaaaaacgaggtgaatacactggaagaggagtttctggcgttaaaaaaggaggatgtgcagttacataaggacgtcgaagaagagatggaaaagcaccgctctaattctacagaattatctgggactctcacagacggcacaacagtcgggaatgatgatgacggtttgaatcagcagattcctagaaaggagaatggcgaacacgacaggccagcagacaagaccagcaacgagaagaacgaggtcaagaatcagatttacccggaggctgatttcgccgactcgatggaacccagcgagattgcatccgaagactgcgagctttcacattccgtttatgagaatttcatgttgctaatcgagcagctaaggatggagtacaaggattctgccagcttaccacggattcaggatacgttttgtctctgtgaacacctcctcaagctcaagaataaccactgtgaccaactgaccgtgaagttgaaacagatggagaacatggtttccgtgctgcagaacgaactgagtgaaactaagaaaacaaagttgcagctcgaactgcaaaagatcgagtgggaaaaagagttgtacgacttgagactggcactgaagcaggagaacgaagaaaaacggaacgcggacatgctatacaacaaggattcagaacaattacggatcaaagaagaggagtgtggcaaggtcgtagagacaaaacagcagctaaagtggaatctgcgacgacttgtgaaagagcttcgaactgtccggaataatcttgatctagtggtgcaggaacgcaatgatgcacagaagcagctctcagaggagcaagatgctaggatcttacaggaccaaattctaacctctaagcagaaggagctagaaatggcacggaagaagatgaattcggagataagtcaccggcaccagaaggagaaagacctgtttcacgaagactgtatgttgcaggaagaaatagcgctgctgcgtttggagatagatacaatcaagaaccagaacaaacagaaggagaagaagtatttcgaggacattgaggccgtaaaagaaaagaacgataatcttcagaaaattattaagctgaacgaagagacccttactgaaaccatccttcagtactcgggtcagttgaataacctgaccgccgagaataagatcctgaactcagaacttgaaaacggcaaacaaaatcaggaacgcctggaaatcgaaatggagtcctaccgctgcagactggcagccgcagtgcgcgattgtgaccagtcgcagacggcccgtgatttgaagctggactttcagaggactaggcaggaatgggtgcgactgcacgataagatgaaggtggatatgtctggattacaggcaaagaatgagatcctgtctgagaagctgtccaatgcggaatccaaaattaactctctccagattcagctgcacaacactcgtgatgccctcggccgtgaaagcctgattctggaacgcgtgcagagagatttgtcccagacccagtgtcagaagaaggagactgaacagatgtatcagattgagcagtctaagctcaagaagtacatcgccaagcaggagagcgtggaggagcgtctttcccagctgcagtctgaaaacatgctgctgcggcaacaactcgatgatgctcacaagaaggctaacagtcaggagaagacttccagtacgatacaggatcagttccactctgcggctaagaatctccaggccgagagtgagaagcagatcttaagtctgcaggagaagaataaagaacttatggacgagtacaaccatctgaaggagcgaatggatcagtgcgaaaaggagaaggctgggagaaagatagatcttaccgaggctcaggaaaccgtcccttcgcgctgtcttcatctagatgctgaaaatgaggttctccagctccagcaaaccctgtttagcatgaaggcgatccaaaagcagtgcgaaacgctgcagaagaacaaaaaacagctgaagcaagaagttgtgaatttaaagtcttatatggaaaggaacatgctcgaacgaggtaaggccgaatggcacaaactgctcatcgaagaacgcgcaagaaaagagattgaggagaaactcaacgaggccattctcaccctacagaaacaagccgctgtgagtcatgaacagctggtacagctccgcgaggataatactacttcaatcaagacccagatggagctaactattaaggacctcgagagcgagatctccagaataaaaacatctcaagccgactttaacaagactgagctagaaaggtataaagagctgtacttggaggaagtgaaggttcgtgagtcgctgtccaacgagctgtcacggacgaacgaaatgatagcggaagtctccacccaactaactgttgagaaggagcagacccgaagccggtccttatttaccgcgtacgccacccggccagtccttgagtcaccttgtgtgggtaatctgaacgactccgaaggtcttaacaggaagcacattccgagaaaaaagagatccgcactaaaggacatggagtcttacctgctgaagatgcagcagaagcttcaaaatgatctaacggccgaagtagcagccgctaccaaatacgagcctggaagctatatcgcatctccgctgggattcacacacaaagagaacttgaatcaagatcctgtgctggaagtgacaaaggaatacgctcagatacttcggaggaagtatatcctgtag

SEQ ID NO: 55040 - DNA, 984 bp, Artificial Sequence
  Description of Artificial Sequence: Synthetic coding sequence
atggcgagctggggcggagagaagaggggcggagccgagggctcgcctaagcctgctgtgtatgcaacaagaaaaactcctagcgtcggaagccaaggagaccagtggtacctgggataccccggtgatcagtggagctccggctttccatactcatggtggaagaattccgtgggtagcgagtcaaaacatggagaaggtgcactcgaccagccccagcatgacgtgcgcttagaagacctgggcgagctgcaccgggctgccagaagtggagacgtcccaggagtggaacacattttggctcctggcgatacaggcgttgacaagcgagaccgcaagaaaagtattcaacagctggtgcccgagtataaggaaaagcagaccccagaatcgcttccccagaataacaaccctgattggcaccccactaacctgactctgagcgacgagacctgtcaaaggtccaagaacctcaaggtggacgataaatgccccagcgtgagccccagtatgccggaaaatcaaagtgccactaaggagctgggccagatgaacttgacggagcgggagaagatggacactggcgtcgtgctactgtccgggaacgacacgctgcatgacctttgtcagtctcagttgccagagaataaggagtctaaggaggccgagcaagatagcgaattgacctccgaagaggaacaggaacgtcttaaggggtgcgagaacaaacaaccacaaaagacgtctcaagagccagaaatggctaaggactgtgatagggaagatatacctatctaccctgtgctgccacatgttcagaaatcggaagaaatttccttacctccagactcagacagaacaagtgaggtgtacctgcatgaggaactccagcaggacatgcagaaattcaaaaacgaagtgaacacattagaggaagagttcctcgcattgaagaaggaggatgtgcagctccataaagactag

SEQ ID NO: 55041 - DNA, 783 bp, Artificial Sequence
  Description of Artificial Sequence: Synthetic coding sequence
atggcctcgtgggggggagaaaagagagggggagcagaaggatctcctaagcccgcagtttacgcaactagaaagactcccagcgtcggtagtcagggcgatcaatggtacctcggctaccctggagatcagtggtccagcggttttccctactcttggtggaaaaatagcgtgggttcagagtcgaaacatggcgagggtgctctggatcaacctcaacacgacgttcgcctcgaagacctgggggagctgcaccgggcagcgagatctggcgacgtcccaggggtcgaacatattcttgctccaggagacaccggtgtcgacaagcgggatcggaagaagtccatacagcaactggtgccggaatataaagagaaacagacacctgagtccttgccccagaacaataatcccgactggcatccaacaaaccttactttgtccgacgagacgtgtcaacggtctaagaatctgaaagtcgacgacaaatgtcctagcgtctctccgtctatgcctgaaaaccagtctgccactaaagaacttggccaaatgaatctgactgagagggaaaaaatggataccggcgtggtgctcctctccggcaacgacaccctccatgacctgtgtcaatcccagctcccggagaacaaagaatcgaaggaggcggagcaggactcagaacttacaagtgaagaagaacaggagaggctcaaaggctgtgagaacaagcagccgcaggataaagctatatttaagacctgctccccaactgaaaagacttag

SEQ ID NO: 55042 - DNA, 4284 bp, Artificial Sequence
  Description of Artificial Sequence: Synthetic coding sequence
atggctagctggggaggagagaagcgcggtggggcagaaggttctccgaagcccgctgtgtatgcgacccgaaaaacaccatctgtgggatctcagggcgaccagtggtacctgggctatcccggtgatcagtggtcttccggctttccatattcttggtggaaaaacagtgtgggatcagagagtaaacatggagagggcgcactcgaccaaccccagcacgacgtccgattggaggatctaggagaactgcacagagccgctcgctcaggcgatgtaccaggcgttgagcacatcttagcgccaggtgatactggtgtagataagagagacaggaagaaaagcatccaacagctagtcccagaatacaaagagaaacaaacccccgagtcactgcctcagaataacaatccggactggcacccaaccaatctaaccctgtcagacgagacgtgccagcggagcaagaacctgaaagttgatgataagtgtcccagcgtgagccccagcatgccggaaaaccagtccgccacgaaagagttaggccagatgaatttgaccgagcgggagaagatggatacgggagtcgtgctgctgagcggtaacgatactcttcacgatctttgccagtctcagctaccagaaaataaggagtctaaggaggcagagcaggactccgaactgaccagtgaggaagagcaggaaaggctgaagggatgtgagaacaagcaacctcagaagacgtcccaggaacctgaaatggccaaagattgtgaccgggaggacattcccatttaccccgttttgccccacgtacaaaaatcagaggagatgtggatcgaacaaggcaaactggagtggaagaaccagctaaaactggtcattaatgaactgaaacagcggtttggagagatctatgagaagtacaagattcctgcatgtccagaagaggaaccactcctggacaactcaacgagaggaacagacgtgaaagacatcccctttaacctgacgaataacatccccggatgtgaagaggaggacgcctcggagatcagtgtgtccgtggtgtttgaaacgttccccgaacagaaggaaccttctctgaaaaatataatccacccctattaccatccctatagtggctctcaggaacatgtgtgtcagtccagttccaagttccaccttcatgaaaacaaattggattgtgataacgataacaagccaggaatcggccatatctttagcactgacaagaactttcataatgatgcctccacaaagaaggccaggaacccagaggtggttatggttgagatgaaggaggaccaggagttcgacctgcaaatgacgaagaatatgaaccaaaacagtgatagtggtagcaccaacaattacaaatccctgaaaccaaagctggagaatctctctagcttgcctccagattctgacaggacctctgaggtgtaccttcatgaggaattgcagcaggatatgcagaaatttaagaacgaggtgaataccctggaagaggaatttctcgccttaaagaaagaagatgtgcagctccacaaagatgttgaggaggagatggaaaaacacaggtcaaactcaaccgagctctctggcactttgactgacggtactaccgtgggaaacgacgatgacggcctgaatcagcagattcctcgtaaagagaacggggaacacgaccggcctgccgacaagacctctaacgagaagaacgaagtgaagaaccagatctaccctgaggcggatttcgccgacagcatggaaccgtctgaaatcgcgtctgaagactgtgaactgtcccactcagtgtatgagaatttcatgttgctgatcgagcagctacggatggaatacaaagattctgcaagtctgccacgcatacaggacactttttgcctgtgcgaacacctgctaaagctgaaaaataatcactgcgatcagctgactgtcaaactcaaacagatggagaacatggtgtccgtgctgcagaacgaattgtcagaaactaagaaaacgaaactccaactggaactccagaagatcgagtgggagaaggagctgtacgacctgcgcctggcactgaagcaggagaacgaggaaaaaaggaacgccgatatgttgtacaataaagatagcgagcagctccgtatcaaggaggaggagtgtggtaaggtggtggagactaagcagcaactgaaatggaatcttcgcagactggtcaaagagctccgtacagtcagaaataacctggacctggtcgttcaggagcggaacgacgcccagaaacaactgtctgaggagcaagacgccagaattctacaggatcagatactgacttctaaacagaaagaacttgagatggctagaaaaaagatgaacagtgaaatttcgcacaggcatcagaaagagaaggatctctttcatgaggactgcatgctccaggaggagattgcactcctgaggctcgagatcgacacaatcaagaaccaaaacaaacaaaaggaaaagaaatatttcgaggatatcgaggcagtcaaagagaaaaacgataatctgcaaaaaattattaagctcaatgaggagactctgacggagactatcttgcagtacagtggtcaactgaataacctcacagctgagaacaaaattttaaattcagagctggagaatgggaaacagaatcaggagagattggagattgagatggaaagttaccgatgtaggctagccgcagccgtgcgggattgtgatcagagtcagaccgcccgtgatctgaaattggacttccagcggactcggcaggaatgggtgcgcctgcatgacaagatgaaagtggatatgagtgggttgcaggccaaaaatgagatcttgtccgaaaaactttccaacgctgaatcaaaaattaacagtctacaaatccagctccacaatacacgagatgcccttggcagggagagcctgatacttgagcgggtacaaagggacctgagccagacacagtgccagaagaaagagacggaacagatgtaccagatcgagcagtctaagctgaaaaagtacatcgccaagcaggaaagtgtggaggaacggctctcgcagctccagtcagagaatatgctactcagacagcagctagatgatgcacataaaaaggccaacagccaagagaagacgagcagtacaattcaagatcagttccacagtgcggctaaaaatctgcaggctgagagtgaaaaacagattctctccctgcaggaaaagaataaagagctcatggacgagtacaaccatctcaaagaaaggatggaccagtgtgagaaagagaaagccggacgtaaaatcgacctcaccgaagcacaggagaccgtccctagccggtgtctccatttggacgcagaaaacgaagtgctgcagttgcagcagactctgttcagtatgaaggcaatccagaaacaatgtgaaacgctccagaaaaacaagaagcagttgaagcaggaggttgtgaatctaaagagctacatggaaaggaacatgctggaacggggaaaggcagagtggcacaagctactaatagaagagagggcacgcaaggagattgaggagaagctgaacgaagcaatcctgaccctgcagaaacaggcggctgtgagccacgaacaactggtgcaactcagggaagacaacactacttctattaagacgcagatggagctcaccataaaagacctggaaagcgaaatttccaggatcaaaacatcacaagctgatttcaacaagacagaactggaacggtataaggagctctatctggaggaagtcaaggtcagggaaagcctaagtaatgaactgtccaggacgaatgagatgattgcggaagtatccactcaactcaccgttgagaaagagcagactaggagccgtagcttgttcaccgcgtatgctacgagaccagtgcttgagtcaccatgtgtagggaacctgaacgactccgaagggctgaacaggaaacacatcccgaggaaaaagaggtccgcactcaaggacatggagagctatttgctgaaaatgcagcaaaagctgcagaatgatctgactgctgaggtggctggaagctcacagaccgggctgcatcggatcccacagtgttcgagcttttcctcttcttccctgcacttgctcctgtgttcaatttgccagccttttttcctgattctccaactgctcctaaacatgaatcttgatccaatatag

SEQ ID NO: 55043 - DNA, 2178 bp, Artificial Sequence
  Description of Artificial Sequence: Synthetic coding sequence
atggcaagctggggaggggaaaaacggggaggggcagagggttcccctaagccagccgtatatgcaacacgcaagactccgagtgtgggctcacaaggcgatcaatggtaccttggctatccaggggaccagtggagctcagggttcccttactcttggtggaagaacagcgtgggctcagagtctaaacacggagaaggcgcactagaccagccgcagcacgatgtacgactggaagacttgggagaattgcaccgagcagccagatctggggatgttcccggtgtcgaacacattttagccccaggagatacaggggtggacaagcgagataggaagaaaagtattcagcaattggtgccagaatacaaagaaaaacagacaccggagagcttaccgcaaaataacaaccctgactggcacccaacgaatctgacgctatccgatgagacgtgtcagcggtccaaaaatcttaaggtggatgacaagtgtccgtcagtgagcccatcgatgccagagaaccagtccgccacaaaggagctgggccagatgaatctgaccgagcgcgaaaaaatggataccggcgtggtgctgctgtcgggcaacgacactctgcacgatctctgtcagagccagctgcccgagaacaaggagagtaaagaggccgaacaggattccgaacttacatccgaggaagaacaagagcggctaaaggggtgtgaaaacaaacagcctcagaagacatctcaggaacctgagatggctaaagattgtgaccgcgaggacatccctatctatccagtgctccctcatgtgcagaagagcgaggagatgtggatcgagcagggcaagctcgagtggaaaaaccagttaaaactagtaattaacgaactgaaacaacgattcggcgagatctacgaaaagtataaaattcctgcgtgccctgaggaagaaccacttctggataattccaccagaggcaccgacgtgaaagacatcccttttaacctcactaacaatataccgggttgcgaggaagaggatgcctcagagatatctgtgagcgtcgtgtttgaaacatttcctgagcaaaaggagccaagtcttaaaaacatcattcatccttactatcacccctattccggtagccaggagcacgtgtgccagtccagctcaaagttccacctccacgaaaataaattggactgtgacaacgacaataagccaggcataggccatatcttctctactgataagaactttcacaatgatgcttctaccaagaaggctcgaaatccagaagtggtgatggtagaaatgaaggaggatcaggaatttgatctgcaaatgactaaaaacatgaatcaaaacagcgactcgggatccaccaataattacaagtcgctcaagcccaagctggagaatctttcctccttgcccccagattccgaccgcaccagcgaggtgtacctacatgaggagttacagcaagatatgcagaagtttaagaatgaagtaaacacccttgaggaagaattcttagctctcaaaaaagaggatgtgcagctgcataaggaagtggaagaggagatggaaaaacatcggtcaaactctactgaactgagcggaaccctcacagatggaaccactgtaggcaatgatgacgatggactgaatcagcagattccacgtaaagagaatggggagcatgaccggcctgctgataaaacaagcaacgagaaaaatgaagttaaaaatcagatttaccctgaagccgactttgcagactccatggagccctcagagatagcctccgaggattgcgagctctcccactctgtctatgagaatttcatgcttctcatcgaacagctgcgtatggaatataaagactctgccagcttaccaagaattcaggacactttttgcttgtgtgaacacctcctgaaacttaagaataaccattgtgaccaactgacagtgaagctcaagcagatggagaacatggtgtcagtactccagaacgagctcagtgagacaaagaagacaaagctgcagcttgaattacagaaaatcgagtgggaaaaagaactatatgacctccggttggctctaaagcaagagaatagacgcaaggagatgcctatttgctgtatcattaagattgtcaacagttag

SEQ ID NO: 55044 - DNA, 3465 bp, Artificial Sequence
  Description of Artificial Sequence: Synthetic coding sequence
atggccagttggggaggggaaaagcgaggtggagcagaggggtctcccaagccagccgtgtatgcaacgcgtaaaactccttctgtgggaagtcagggggaccaatggtaccttggctatccaggagaccaatggagtagcgggttcccatatagctggtggaaaaacagtgttggatcagaaagcaagcacggtgagggggcactggaccagccacagcacgatgtgaggcttgaagatctaggcgaactgcatagggcagcccgttcaggcgacgttcctggcgtcgagcatatcctggccccaggtgacactggggttgataaacgggaccgcaaaaagagcatccaacagctggtacctgagtataaagaaaagcagactccagaaagcctccctcagaacaataaccccgattggcacccaacgaacctgactctctctgatgaaacatgccagcggagtaagaatcttaaagtggatgacaagtgcccctcggtgtcaccctctatgcctgagaaccagtcagctaccaaggagctgggccagatgaatctgacagagcgcgagaaaatggacacaggtgtcgttctgctaagtggcaatgacacactgcacgacctgtgtcaatcacagctccccgagaacaaggaatcaaaggaggctgaacaggactccgagcttacatccgaagaagagcaagagaggctaaagggttgtgaaaacaaacagccccaggtagaggaagaaatggagaagcaccggagcaacagtacggagctgtctggcacgctcaccgacggaacgactgtgggcaacgacgatgatggtcttaaccagcaaattcctcgaaaggaaaacggcgagcacgataggccagctgataagacctcgaacgagaagaatgaggtaaagaatcagatataccctgaggcagacttcgccgattctatggaaccttcagaaatcgccagcgaggattgcgagctcagtcactccgtgtatgagaacttcatgttgttgatcgagcagctcagaatggaatacaaagactcagcaagcttaccgagaattcaggataccttttgtttatgcgaacacctgctgaagctgaaaaacaatcactgcgatcagctgactgttaagctaaaacagatggagaatatggtcagtgtgctccagaacgagctttctgagactaaaaagacaaaactgcaattggaactccagaagatcgagtgggagaaagaattgtacgacctgcggctggccctcaagcaggagaacgaagaaaaacgcaatgccgatatgctatataacaaagattctgagcagttgcgtatcaaagaggaagaatgtggcaaggtagttgagacaaagcagcaattaaagtggaatctgagaaggctggtgaaggagcttcgtactgttcgaaataatctcgatctagtggtgcaagaaaggaatgatgcacagaaacaactgagtgaggagcaggacgcccgaatactgcaagaccaaatcctgacttccaagcagaaggagctggagatggcgagaaagaaaatgaactccgaaataagtcaccggcatcagaaggagaaagacttatttcacgaagattgtatgcttcaggaggagatagctcttcttcggctggagatcgacaccatcaagaatcagaacaagcagaaagaaaaaaagtacttcgaggacatcgaagcagtgaaagaaaaaaacgacaatttgcagaaaatcattaagcttaatgaagaaactttaactgaaacaatacttcagtactccggtcagttgaataacctgaccgcagagaataaaatcctcaattctgagcttgagaatggcaaacagaaccaggaacgtctcgaaatagaaatggagtcctatcggtgtaggctggcggctgccgttcgggactgtgaccagagccaaaccgccagagacctcaaactggactttcagaggactcgtcaagaatgggtccgcctccatgacaagatgaaagtggacatgtccgggctgcaggccaagaatgaaattctgagcgaaaaactgtctaacgcagagtccaagatcaacagcttgcagattcagctgcacaacactcgcgatgccttggggagagagagcctaatcctggagagggtgcagagagacctgtctcaaacccagtgccagaagaaggaaactgagcagatgtatcagattgagcagagcaagctgaagaaatacatcgccaagcaggagtccgtcgaagagagactgagtcagttacagagcgagaatatgctgctgcgccagcagctagacgatgcccataagaaagcaaattctcaagagaaaacaagcagtacaattcaagaccagtttcattccgccgctaaaaaccttcaggccgagagtgagaagcagattttgtctttgcaggagaagaacaaagaactgatggacgaatataaccatctgaaggaacgcatggaccagtgcgaaaaagagaaggccggaaggaaggttgtgatgcgcgaatttcagcaggaatggaccgatctgctgaaacaacagcctaccagcgaggctacctctaggtgccacattaatttggatgagacacaggattccaagaaaaagcttggacagattagaagcgaaattgacctcaccgaggctcaggaaactgtcccctctagatgtctgcacctcgatgcagagaacgaagttctgcagttgcagcaaacgctgtttagcatgaaggcgatacaaaagcagtgtgagaccctccagaaaaataagaaacaactgaaacaggaagtggtgaacctcaagagctatatggagcggaacatgttggagagaggcaaagccgaatggcataaactgttgatcgaggagcgggctaggaaggaaatagaggaaaagctgaatgaggcgatactgactctccagaagcaggcggcagtcagccatgaacagcttgtgcaactgcgtgaggataacacaacttctatcaagacccagatggagctcaccattaaggacctagagagtgaaatcagccgcatcaagacgtcccaagcggatttcaataaaacggaattggaaaggtataaggagttgtacctggaagaagttaaggtgagagagtccctgtccaatgaattgagccgcaccaatgagatgatagcagaagtatctacacaactgaccgtcgaaaaagaacagacaagaagcagaagtctcttcaccgcctatgccacgagacctgtcctggagtctccatgtgtcgggaacctgaatgattcagaaggtctgaacaggaaacatatccctagaaagaagcgctccgcattgaaagacatggagtcttatctacttaaagtgagttatctgttctcatttggagttcagatttcagacagaattcttgtgtgttatctggtgaaatag

SEQ ID NO: 55045 - DNA, 681 bp, Artificial Sequence
  Description of Artificial Sequence: Synthetic coding sequence
atggtatcttggggcggtgaaaaacggggtggggctgaaggatccccaaagcctgctgtttacgcaacccggaaaaccggctccgtgagatctcaggaagaccagtggtatctggggtatcctggagatcaatggtcctcaggctttagttattcctggtggaagaattcagtaggctccgaaagtaagcacggcgaaggagctttggaccagccgcaacatgacgttcgtttggaagacctgggggagctacacagggctgcgaggtctggagatgtgcccggagtcgagcatgtgctggtgcctggagacacgggtgtggacaagcgcgataggaaaaagtcaattcagcaactggtccccgaatacaaagagaaacagaccccggaatcgttgccgcaaaacaacaatcccgattggcatccgaccaacctgacgctgtccgacgaaacttgccagagaagtaagaacctaaaggtggacgacaaatgtcctagtgtgtcacccagcatgccagagaaccagagtgcgaccaaagagctgggtcagatgaacctgacggagcgggaaaagatggacactggggtagtgcttcttagcggaaatgacacattgcatgatctttgccagagccagttgccagagaataaggagagcaaggaggggaacaaggaagcttag

SEQ ID NO: 55046 - DNA, 3714 bp, Artificial Sequence
  Description of Artificial Sequence: Synthetic coding sequence
atggtgagctggggcggagagaagaggggcggtgccgaaggatcccctaaacctgctgtttatgccaccaggaagacaggtagcgtcagatcacaagaggatcagtggtacctgggataccccggagatcaatggagctctggtttctcttacagttggtggaaaaactcggtgggatcagaaagcaaacacggtgaaggcgctctggaccagccccagcatgatgtgcgcctcgaggatcttggcgaactgcacagggctgcgagatccggggacgtccccggtgttgagcacgtgctagtgcctggagataccggtgtagacaagcgcgaccggaaaaagtccatccagcagctggttccagagtataaagagaagcagactccggaatcattgccccagaacaacaaccccgattggcaccccaccaatcttaccctcagcgacgagacttgccagcggagcaagaacctgaaagtcgacgataaatgtccgagtgtaagtccaagtatgccagagaatcagtctgcaacaaaagagctcggacagatgaatctaactgaacgcgaaaaaatggataccggagtgaagacaagtcaggagccagagatggctaaggactgtgatcgggaagatattccaatttacccggtgttgccgcatgttcagaagagcgaagaaatgaggatcgaacagggtaaactggagtggaaaaatcaactcaagctggttatcaacgagctgaaacagcgattcggtgagatttatgaaaagtacaagatccctgcgtgtcccgaggaggaacctcttcttgacaacagcacacgcggaactgacgtgaaggacattccatttaacctgactaacaatatacccggatgcgaggaggaagatgctagcgaaatcagcgtgtctgttgtcttcgaaacctttccagaacagaaagaacccagcctcaagaatatcatccattcctactaccacccatactcaggtagccaggaacacgtgtgccagtcctcttccaaactccatcttcatgagaacaagctcgattgtgacaacgacaacaagccgggaattgggcacatcttcagcacagacaaaaattttcataacgatgccagcaccaaaaaagcccgaaaccccgaagttgtaactgtagagatgaaggaagaccaggagttcgaccttcagatgacaaaaaacatgaaccagaactctgattccggctccactaataactataaaagtctgaagccaaaactggagaacctttcctcccttccgcctgattcagatcggacctcagaggtatatctgcacgaagaactccagcaggatatgcagaaattcaagaatgaggtgaatacactcgaggaagagtttctggcactgaagaaggagaacgtgcagctccacaaagaagtagaggaggagatggagaagcaccgctctaatagcacagagctatccggaacactgactgatggaacaacagtcgggaacgatgacgatggtctcaatcagcagattccccgaaaggagaatggagagcatgatcgactggctcttaaacaggaaaatgaagagaaaagaaatgctgacatgctgtacaataaggattcggaacagctgaggattaaagaggaggagtgtggcaaggtggttgaaacaaagcagcagctgaaatggaacctgaggcgtttggtaaaggagcttcgcactgtggtgcaggagcgaaatgatgcacagaagcagctgtcagaagagcaggacgccagaattcttcaagatcagatactgaccagtaagcagaaagagttagaaatggctcaaaagaaacggaacccggagatatcgcaccgacaccagaaagaaaaagatctcttccacgaaaactgcatgctgcaggaggagattgccctcctgaggctggagatcgatactatcaagaaccagaacaaacagaaggagaagaaatacttcgaagatatcgaagttgttaaggagaagaacgacaacctccagaagataattaagaggaacgaggagacattaaccgagactatcctacaatattccggccagctcaacaacctgacggccgagaataagatgctgaacagcgagctcgaaaatggaaaggaaaaccaggagcggctcgaaatcgaaatggaatcctatcgatgccgtttggccgctgctgtgcacgattgcgatcagtcccagacagcccgagatcttaaactcgattttcagaggacaaggcaggaatgggtcagactacatgacaagatgaaggttgatatgagcggcttgcaagctaagaacgagatcttaagtgaaaagctatccaatgctgaatccaagatcaactcacttcaaatccagctgcataacacgagagatgctctgggcagagaaagcctgatactggaacgcgtgcagagagacctctctcagacacagtgtcagaagaaagagaccgagcagatgtaccagtccaaattaaagaaatacatcgctaagcaggagtctgtcgaagagagactatcccagttgcagtctgaaaacatgcttttgcgccaacagctggacgatgtgcacaagaaggccaactctcaggagaagaccattagcactatacaggatcaattccacagtgcggctaagaacctgcaggccgagtcagagaagcagattctctctctgcaagagaagaataaggaactgatggacgaatacaaccatttgaaagagagaatggaccagtgtgaaaaagagaaagcaggcagaaaaatcgatttgactgaagcccaggagacagttccttctcgctgcctgcacttggacgcagaaaatgaagtcctccagctccagcaaacattattcagcatgaaggccatccagaagcagtgcgaaaccctgcagaaaaacaagaagcagcttaagcaggaggtggtcaatctgaaatcatacatggaaaggaacatgctggaaagaggtgaggcggaatggcacaaattattaatagaggagagagcaaggaaagagatagaagaaaagcttaacgaagccatactaaccctgcagaagcaagccgctgttagccacgagcaactggcccagctgagggaagacaacactacctcgattaagacacagatggaactgaccgtcatcgacctggaaagcgagataagccgcataaagacatcacaagctgacttcaataagacaaaacttgagcgatataaggaactgtacctcgaggaagtaaaggtacgagagagcctgagcaacgagttaagtaggaccaacgaaatgatagcagaggttagcacccagctgaccgtggagaaagagcagacccgatccaggtccctgttcacagcctacgccacacggcctgtcctggaaagtccatgtgtgggaaacctgaatgatagcgaggggctgaaccggaaacacatcccgagaaaaaagcggagcgcactcaaggacatggagagttacttgctgaagatgcagcagaagctccaaaacgatctcacagccgaggtcgctggcagttcacagaccggactccatcgaatccctcaatgctcttctttttcgtcttcatccctccatctgctgttatgctccatatgccagccattctttctgatcttgcaactcctcttgaacatgaatcttgacccaatatag

SEQ ID NO: 55047 - DNA, 2868 bp, Artificial Sequence
  Description of Artificial Sequence: Synthetic coding sequence
atggaggatagttcaaccgacaccgagaaagaagaggaagaggagaaggacgagaaagatcaagagccaatttatgccatcgtgccaacaattaacatacaggacgaaaggttcgttgacctcagcgagacgcccgcatttattttcttgcatgagctgcatgctatggggaagctgccaggtacacgaatggccgctcttaaagcgaaatacaccttgctgcacgacgccgtgatgtctacccaggagtctgaggtgcagctgctccagaatgccaagcgttttacagagcagattcagcagcagcaatttcaccttcaacaggccgacaactttcctgaggctttttctacggaggtaagcaagatgagagaacagctcctcaaatatcagaacgagtataatgctgtgaaggagcgcgagttccacaatcagtacaggctcaactccctaaaagaagaaaagatcatcatcgtgaaggaatttgagaaaataaccaaacccggtgagatggaaaaaaaaatgaagatcctcagagaatctaccgaagaactgaggaaggagataatgcaaaagaaactggaaatcaagaacctgcgtgaagaccttgcttcaaagcaaaagcagctgttaaaggagcagaaggaactcgaagagctgctgggccaccaggtcgtattgaaggacgaggtagcccaccaccagaccattcccgtgcagattgggaaggaaatcgaaaagatcacacggaaaaaggtggagatggagaagaaaaagattgtgttagaacaggaagtgaagacattaaatgactctctcaaaaaggtagaaaacaaagtgtccgccatcgtggacgagaaagagaacgttatcaaggaggtggaaggaaaacgcgcactcttggagatcaaggagagagaacacaatcagctggtgaaactcctcgagttggctagggaaaacgaggcaacgtcacttaccgagcgcggtatcctcgacctgaacctcaggaattcactcatcgataagcaaaactatcatgacgagctgagcaggaagcagcgtgaaaaagaaagagactttcgaaaccttagaaagatggaacttctcctgaaggtgtcctgggatgcactcaggcaaacgcaggcactgcatcagagattacttttggaaatggaggccataccgaaagacgattccaccctcagtgagcgcaggcgagagctccacaaggaggtggaggtggccaaacgaaacctagcacagcaaaagataatcagcgagatggaaagcaaacttgtggaacagcagctcgctgaggagaacaagttgttgaaagagcaagagaacatgaaagaactcgtagtgaacctgttgcggatgacgcagattaaaatcgacgagaaggagcagaaaagtaaggatttccttaaggcccagcaaaagtacacgaacatcgtcaaggaaatgaaggcaaaagacctggaaatccgcatccacaagaagaagaaatgcgagatataccggaggctgcgtgagtttgcaaaactctatgatactatccgcaatgagaggaacaagtttgtaaatttattgcataaggcccaccagaaagtgaatgagattaaagagagacacaagatgagcctgaatgaactcgaaatcctacggaactccgcggtctcacaggagcgcaaactccaaaattctatgctgaagcacgccaataatgttactattagagaaagcatgcagaatgatgtcaggaagatagtgagtaagctgcaggagatgaaagagaagaaggaggcgcagctcaacaacatcgaccgccttgccaataccattaccatgatcgaagaagaaatggtgcagctgaggaagcggtacgagaaggccgtgcaacataggaatgaaagtggagtgcaactgatagaaagggaggaggagatttgcatcttttatgagaagatcaacattcaggaaaagatgaaattgaatggggagatcgaaatccatctgctggaggaaaaaattcagttccttaagatgaaaatcgctgagaaacagcgccagatttgcgtgacccagaagttactgcctgccaagcgctcacttgatgccgacctcgcagtgcttcagattcagttctcccaatgtacagacagaattaaagacctagagaagcagttcgttaagccagacggggaaaaccgagctagatttctcccaggcaaagacttaacagagaaggagatgattcagaaactggacaaactcgaattgcaactcgcaaagaaagaggagaagctgctagagaaggatttcatctatgagcaggttagccgcctgacagatcgactctgctcaaaaacccagggctgcaagcaggatacactgcttctcgctaagaaaatgaatggttatcagcggagaattaagaatgccaccgagaagatgatggcactggtggccgaactcagcatgaagcaggcactgactatcgaactgcagaaggaagtgcgggagaaagaagactttattttcacgtgtaactcccgaattgagaagggtctgccactcaacaaggaaattgaaaaagaatggcttaaggtcctccgggatgaggaaatgcatgccttggccatcgctgaaaagtcccaggagtttctggaggccgacaacaggcaactgccgaatggtgtctatacaactgcggagcagcgaccgaatgcttatattccagaggctgacgctacactgcccttacctaagccctacggcgcacttgccccattcaagccttctgaacccggagccaatatgaggcacattcgaaagcccgtcatcaaaccagtggagatatag

SEQ ID NO: 55048 - DNA, 513 bp, Artificial Sequence
  Description of Artificial Sequence: Synthetic coding sequence
atggaggattccagcaccgatactgagaaggaggaggaggaagaaaaggatgaaaaggaccaggaaccgatctacgctattgttcccaccatcaatattcaggacgagcgctttgtggatctcagtgagaccccagcgttcattttcctgcatgaacttcatgctatgggcaaactgcccggaactcgtatggccgctctcaaagccaagtatacattactgcacgacgcagtgatgtctactcaggaatcagaggtgcagctgcttcagaatgctaaacgattcaccgaacagattcagcagcagcagtttcacctgcagcaggccgacaattttccagaagccttttctacagaggtgtctaagatgcgggaacagctgcttaaataccagaatgagtacaacgcagtaaaagagagggagtttcataatcagtaccgactaaattcattaaaggaggaaaaaatcataatcgtgaaggagttcgaaaaaataacaaaaccgggagtatag

SEQ ID NO: 55049 - DNA, 2010 bp, Artificial Sequence
  Description of Artificial Sequence: Synthetic coding sequence
atggagaagaagaagatcgtgctggagcaggaagtcaaaacgctgaatgactcccttaagaaagtggagaataaggtgtcagccattgtagatgaaaaggagaacgtgattaaggaggtggaaggaaagagagctttgctagagatcaaagaacgagaacacaatcaactggtaaaactgcttgaactagcaagggaaaacgaggctacttccctgacagagcggggaatcctagatctgaatctgagaaatagcctgatcgacaaacagaattatcacgatgagttgtctagaaaacagagagaaaaggaacgcgatttcaggaacttgcgcaaaatggaacttctcctcaaggttagctgggacgccttgagacagacacaggccttgcaccaaaggttattgctggagaagattatctctgagatggaatctaaactggtggaacagcagttagctgaggaaaacaagctcctgaaagaacaggagaacatgaaagagttggtggtgaaccttctgaggatgactcagatcaagatcgacgaaaaggagcagaaaagtaaagactttctgaaggcccaacaaaagtataccaatattgtcaaggaaatgaaagccaaagatttggaaattcgtatacataagaaaaaaaagtgtgaaatctacaggaggctcagagaattcgccaagctttacgacaccatccgcaacgaaagaaataagtttgtgaatcttcttcataaagcgcaccagaaagtcaacgagatcaaagaacggcacaaaatgagcttaaatgaacttgaaatactacgaaacagtgccgtgtcacaagagcgcaaactgcagaattcaatgctgaaacacgcaaacaacgtgactattcgagagtccatgcagaatgacgtgcggaaaattgttagtaagcttcaggagatgaaggagaaaaaggaagctcagctgaacaacatcgacagactcgcgaacaccattaccatgatcgaggaagaaatggttcagctgcgtaagcgctacgaaaaggccgtccagcatcggaacgaaagtggagttcagctcatagagcgggaagaggagatctgtattttctacgaaaaaattaacatccaggaaaaaatgaagctgaatggggaaattgagatacatttattggaagaaaagatccagttcctgaaaatgaagatcgctgagaagcagagacagatctgtgttactcagaagcttctaccagccaagagatcgctggatgccgacctggcagtgctgcaaattcagttctcacagtgcacagacagaatcaaggaccttgagaagcaattcgtgaagcccgacggcgaaaatcgcgcacggttcctacctggaaaagatttgactgaaaaagagatgatccagaagctggacaaacttgagctgcagctagctaaaaaagaggaaaaattgctggaaaaagatttcatttatgagcaggtctcccgcctgacagacaggctgtgttccaaaactcaggggtgcaagcaagacacccttttgttggcaaagaagatgaacggctatcagagacgaatcaagaacgcaaccgagaagatgatggctctggtggccgagctctccatgaagcaggcgctcaccatcgagctccagaaagaagtgagggagaaggaggatttcatattcacctgtaacagcagaatcgaaaagggcctgcctctcaacaaagaaatagagaaggagtggttaaaggtgctgcgggacgaggagatgcatgccttagccatagctgaaaaatcccaggagtttctggaagcagataacagacaattacccaacggagtgtatacgacagctgagcagcgccctaacgcttacataccagaggcagacgcaacgctccctctgccaaagccctacggcgcactggctccattcaaaccttctgagccgggagcgaatatgcggcacatccggaaacccgtgatcaagcccgtcgaaatatag

SEQ ID NO: 55050 - DNA, 279 bp, Artificial Sequence
  Description of Artificial Sequence: Synthetic coding sequence
atggacgaactgttgcgcgagagggatatcctgaataaaaatatgcttaaggcggtgaatgccacccagaagcagactgacttggtcaagctccacgagcaggccaagcgcaatctggaaggggaaattcagaattataaggatgaagcgcaaaagcaacggaaaatcatcttccacctagagaaggagcgagatcggtacattaatcaggccagcgacttgacgcagaaagctgactcagtgagaatgccgtggccgctggacaagggtaaatggtag

SEQ ID NO: 55051 - DNA, 279 bp, Artificial Sequence
  Description of Artificial Sequence: Synthetic coding sequence
atggacgaacttctaagagaacgcgacatactcaataaaaatatgctcaaggctgtcaatgccacccagaagcagaccgatctagtcaagcttcacgagcaagcaaaacggaatttagagggcgaaatacaaaactacaaggacgaggcccaaaagcaacgcaagatcatctttcacctagagaaggagagagaccgctatatcaaccaggcatctgacctgacgcagaaagctgattcagtccgcatgccatggcctttagataaaggtaagtggtag

SEQ ID NO: 55052 - DNA, 2619 bp, Artificial Sequence
  Description of Artificial Sequence: Synthetic coding sequence
atggccgaggaaaagggtggcaagcaggtcttggaggagtcagccttcgaggagatggagagagattttcaaggcgtattgcacgaactgtctggcgataagagcctggagaagtttagaattgagtatgaaagactgcacgccgtaatgaagaagtcctacgataacgaaaaaaggctgatggcaaagtgtagagagctgaacgccgagattgtagtgaactctgccaaagtggcaaccgcactgaaattgagccaagatgatcagacaactattgcctctctgaaaaaggaaatagagaaggcttggaaaatggtcgatagtgcttatgacaaggagcagaaggccaaggaaaccatccttgcactcaaggaagagattgtgaatttgaccaagcttgtggaacaaggtagcgggctttccatggatcaacacagtaacataagggacctacttcgattcaaagaagaggttacaaaggaaagagatcagttgctctcggaggttgtcaagctccgcgaaagcttggcgcagaccacggagcaacagcaagagaccgagcgcagcaaggaagaagctgagcacgctatcagccagttccagcaagaaattcagcagcgccagaacgaagcttcccgggaatttcggaagaaagaaaaattggagaaggagctcaagcagatccaggctgacatggatagtagacaaacggaaatcaaggcactccaacagtatgttcagaaatctaaggaggagctccaaaagctggaacagcagctaaaggaacagaagattttgaatgaacgcgctgccaaggaacttgagcagtttcaaatgcgcaacgccaaacttcagcaagaaaacgaacagcactccctggtgtgcgagcagctcagccaagagaatcaacaaaaagcgctggagctcaaggctaaagaggaggaggtgcatcaaatgagactggacattggtaagcttaacaagatcagggaacagatccataagaagctccaccatacagaggaccaaaaggccgaagttgaacagcacaaagaaaccctcaaaaaccagattgtgggattagaacgcgaagtggaggcctccaagaagcaggccgaactggacagaaaagcaatggacgaactcctgcgcgagcgggacattttgaataagaatatgctcaaggccgtaaacgcgactcagaaacagaccgacctcgttaagttgcacgagcaggccaagcgaaatctggagggagagatacagaactacaaggacgaggcacagaaacaaaggaagatcatctttcaccttgagaaagagagagacaggtacatcaatcaagctagcgaccttacacaaaaagtgctgatgaatatggaggacattaaggttcgtgagacacaaattttcgattatcgaaagaagatcgctgagtctgagattaaactcaaacagcaacagaacctgtatgaagcagtgaggagcgatcggaatctgtacagtaaaaatctggtagaagctcaggatgaaattaccgacatgaaaaggaaacttaagattatgattcaccaggtggatgaactgaaagaagatatctccgcaaaagaatctgctttagtcaagctacatctggaacagcaacgcattgagaaggagaaggagactctaaaggccgaactacagaaactgcgacagcaagccctggagaccaagcacttcatcgagaaacaggaggccgaagagaggaaactgctccggatcatcgcggaggccgacggggagaggctgaggcagaaaaaagagctcgaccaagtgatctccgaacgggacatacttgggtcacaactggtgaggaggaacgatgaacttgccctgctatacgaaaaaattaaaattcagcaatcagtgctaaataagggagagagccagtacaaccagcgccttgaggatatgaggattctgcggcttgaaatcaagaaactgcggcgtgagaaagggatcctggcacgctcgatggccaatgtcgaagaattgcggcaggagttttttcacatgcagcgtgaattgctgaaagaacgtacccggtgtcgggcactggaggaagagctggagaatcctctcaacgtgcacaggtggagaaaattagaagccagtgatcctaacgcctacgaactgatccagaaaattcacactctacaaaaacggttaatctccaagactgaggaagttgtagaaaaagagcttttgctccaggagaaagagaaactttacatggaactgaaacacgtgcttgcgagacagcctggtcccgaggctgccgagcagctgaaactctacaggcggactcttcacgataagaagcagcagttgaaggtgctgagctcggagctgaacatgtatgaggtccagagcaaagagtataagtacgaggtggaaaagctcacgaatgaactgcagaacttgaagaagaaataccttgcccagaagaggaaagagcagttgcagaagaacaaagataccgctcccatggacaacacctttctgatggtgaagcctaacgggcctggtttcaccggcggtgggtttcctcttaggagcactaagatgactttttag

SEQ ID NO: 55053 - DNA, 1776 bp, Artificial Sequence
  Description of Artificial Sequence: Synthetic coding sequence
atgtgtgctgctagtgcctccccagataatcttgtctttcatatgaaaaacgagatgagaaacatcaaatataagcccgtggactaccagcagcttagggcgttaaccgaggccaagaaactcgcaagcgcatcagcaaaattgaagattagaaaggccatgctgacttccaaactctcaaaagagcagacactgattaagcagcacaaacaggtgtggtggcaagagtaccagaggctaaatgaagtccgatgtaaaatggagagcgagattaaaagtcttcttaatgaagagaacatcggtaacgagtgcctgtgcgatctgactaatttcgaacaggagttatctgagcagcaatgcacttatctgaaaaacgtgattaaccccatccagcagctcagggcagaccttaaataccgacaacaccatacccttcaacatagccatccccacattgagtttaattcgatgaaagtactcgaagaagttgacttcgtgaaaaaacagctcaagactgtgttcgaacggctacggttggagcagcaacggatagagaacgacctgagcgattggtccatcaaaatactcgaccatagtctagaggagaaaactaaccccctttcagagctccctattgagctggagtccctggaatgcccctacccggaccttaaatccagtattttgagtgaattctataagtttactcaaaaataccagaagaagcttcaggacttcaatctgcaactggaggatatttaccgcaactgccagctctcagaagaagatcactggatataccaggctatcctggaccagtatcccggagacttgttcggaagacgcacactgtatctcgatatgctgcaacggtatttccctcacaagagccggcacgacctggtggaacatgaaaaatactgcgatcagtacaggttcgcaatcgagcagcagaacatcttaatttccaactggaacaagaataagaaagacttcattcagaaggccgttcttacactcaccgaagcttgtgcaacacacgaaatggaatccatgcttgccaaagataaaaagaagcagcaggagctgtgtgccgacctcaaagcgaaagttaggcagtggcgcgctcatcaggaagaagttgcacggctcgaaatggagatcagcgcgagaaggcgcgagaaagaagaggaaaaagagaagctctggaagaaaaaagaactgctgcaaagggcagaaaaaaaaaaaaagattaagaaatactgggcgaaaaagaaacaaaagtggcaggagatggaaatgcgggatctccaacggttagaggagctgaagaagttgatagcggagcagtctttaaaggacagggaaagggttaaatatagacaggagcttctggaacgaagattaatggaaaagaaggaggtcgcattgcaggaagcacacgaagacaaagaaagagcccgaagattggaggccttacgcaagcaggtcgctgtggtagcccagtttgaccctgttagaatgatgtctgataccatggccagcaaagcgaggatgggcatagaaatcgaggaagagtttatcttgcaaaagccattatttacactgaacacgtataatgaacagcagataattagcgacccgaggctcagatttgaactggctctccgggaggccggactccaccggaccctatacgccaaggaaatcttaccaaagatcagtccacagaaaccacctagaaaagatatggagtccacagtgttcaagatctag

SEQ ID NO: 55054 - DNA, 795 bp, Artificial Sequence
  Description of Artificial Sequence: Synthetic coding sequence
atgaatgtgtttgtgactttacaaatcctggtcgactttgttaagaagcaactcaagactgtatttgagcgattgaggctggaacaacagcgcatagagaacgatctgtctgactggtctataaagatcctggaccactcgttggaggagaagaccaacccactgtccgaactccctattgagctcgagtcactagagtgcccttatccagatttgaaatctagcattctgtctgagttctataagtttacccagaaatatcagaagaaactccaggatttcaacctgcagttggaggacatctaccgcaattgtcagctgtctgaggaggaccactggatctatcaggctatccttgatcagtaccccggagatctgttcgggaggcggaccctgtacctggacatgctgcagcgatattttccccacaagtcacggcacgacctggtcgagcacgagaagtactgcgaccaatatagatttgctatagaacaacagaatattctgatcagtaactggaacaagaataagaaggactttatccaaaaggcagtgctcactttaacagaggcctgcgcaacccacgagatggagtccatgctggccaaagacaagaaaaaacagcaagagttatgcgcagaccttaaggctaaagtgaggcagtggagggctcaccaggaggaagtggcaaggctggagatggaaatttcagccagacgcagggagaaggaagaagagaaggaaaagctgtggaaaaaaaaagagctgctacagagggccgaaaagaagaagtag

SEQ ID NO: 55055 - DNA, 900 bp, Artificial Sequence
  Description of Artificial Sequence: Synthetic coding sequence
atggaaagcgagataaaatctctcctgaatgaggagaacattggcaatgagtgtctatgcgatctgactaatttcgagcaggagctctcggagcaacaatgcacttacctgaagaacgtcattaaccccatccagcagctgcgggctgatttaaagtatcgccagcatcacactcttcaacactcccatccacatatagagttcaacagtatgaaagtgttggaggaggtagatttcgtaaagaagcagcttaaaacggtcttcgaaaggcttaggctagagcagcagcggatcgaaaacgacctgagtgattggtcgatcaagatactggaccattccctggaggagaagactaaccccctcagcgagctgcccatagaacttgagagtctcgaatgtccataccctgatctgaagtccagcatcttgtctgaattctataagtttacgcagaaataccaaaaaaaactgcaggactttaaccttcagctggaagatatctatcggaactgccagttgagtgaggaggaccactggatctaccaagcaatccttgatcagtaccccggtgacctgttcggtcgccgtacgctctatctggacatgctgcaacgctattttccgcacaagagcagacatgatttggtggagcacgagaagtactgtgaccagtacagattcgctatcgagcagcagaacattctgataagtaattggaataaaaacaagaaggactttatccagaaagcggtcctcacgctgaccgaggcctgcgcaacacatgagatggagtcaatgctcgctaaggataaaaagaagcagcaggagctttgtgccgacctcaaggctaagtcacaggtctgcctgtaccaacagcacgagaatgggcttatccagtag

SEQ ID NO: 55056 - DNA, 1362 bp, Artificial Sequence
  Description of Artificial Sequence: Synthetic coding sequence
atggaaattcatcacttcctgctgaagcgcaagcaggctaatctggcccagctgcttagagattcccaggaccgcaacaagcacctgggggaagaaatcaaagagctccaacagaggctgggagaagtccagggcgacaacaagttgctgaggatgaccatagctaaacagcgcctgggggatgaggctattggagtgaggcacttcgcagctcatgaacgagaggatttggtccagcaactggagagggccaaagaacaaatagaatctctggagcacgacctacaggctagcgtcgatgagctgcaggacgtgaaggaggagaggagcagctaccaagacaaagttgaacgtcttaatcaggaactaaatcacatactgtctggccatgagaaccgcatcatagatgtcgatgccctgtgcatggagaataggtacctacaggagagactgaaacagttgcacgaggaggttaacctactaaagtcaaatatcgcaaagtacaaaaatgcgcttgaaaggagaaagaacagtaagggtcagggcaagagctcttcttccgccctgactggggtgctcagcgccaagcaggtacaggatctattatctgaggaccatggatgcagcctacctgcgactcctcagtccatctctgacctcaaaagcctcgctaccgctctgctggaaacaatccatgaaaagaatatggtgatccagcaccagagacagaccaataagattctcggcaaccgggtggccgagctggaaaagaagctgcggacgctcgaagtgtcagggttatggagcctccctggcggtaaggacacaattctttttagtgaccccacactgccttccgggcagcgatcccgctcccctctgctcaagttcgttgagcagcctacagagaacaaggcagaccctaaggacggtgaggctcagaagcaagaggaggatgagtcatgcgccgctgctgaagctctgaccgctcctgaggatgctggacgcccagccgtcaattctcctgctaaccagagcagggggaatcagtgtaagttgttccatccttcccttccccagctcccaagcgaagaagaggtgaactccctaggacgggagataatcaagctgactaaagaacaagctgctgcggaactggaagaggtgcggcgtgagtcccctatagagggacagaggtctgaaaccggcccagcccctcccggactggctatccaaggtgaactccccaagtctcatctggattcatttgaagctagtcgaccggcagcgaaggcgagtacacccgaggacggaaaaggcattccagaaggcggaggaatgcggtccactgtcaaaacttag

SEQ ID NO: 55057 - DNA, 261 bp, Artificial Sequence
  Description of Artificial Sequence: Synthetic coding sequence
atggcaaaccagctccgagaacggcaccagtccttaaagaaaaaataccgtgaactgatcgacggcgacccctctctgccaccggaaaagagaaagcaggccaacctggcccagctcttgcgtgacagccaagaccgaaacaaacacctaggagaggagatcaaagagctgcaacagcgcctgggtgaagtgcagggcgacaacaagggcagactgcgaagtaagaaaaagatgaaggttgttccattactgaggaggtag

SEQ ID NO: 55058 - DNA, 1590 bp, Artificial Sequence
  Description of Artificial Sequence: Synthetic coding sequence
atggaggaggaggcaatgaacggcgatcgcaccgaatctgactggcagggattagtaagtgaatacttggtgtgcaaacgtaaattagagagcaagaaagaagccctactgatactgtctaaagagctggatacatgccaacaggagagagatcagtataagctcatggccaaccagctgcgggagcgccaccagtcgctgaagaaaaaataccgggaattgattgacggagatccctctctgcctccagagaagcgaaagcaggccaatttggcacaattgcttagagattctcaagatagaaacaagcatctgggagaggagatcaaagaattgcagcagcgtctcggggaagtgcagggggacaataagttgttacgcatgaccatcgccaagcagcgcctaggagatgaggccataggcgtgcgccatttcgccgcacatgagcgcgaagaccttgtacagcagttggaaagggctaaagaacagatcgagtccttggaacatgatttgcaggctagcgttgatgaattgcaagatgtaaaggaggaaaggagctcctatcaagacaaggttgagagactaaaccaggagctgaaccatatcctgagtggccacgagaacaggatcatcgacgtcgacgccctctgtatggagaatcggtacctgcaagagcggctcaaacaactgcacgaagaggtgaatcttctcaaatcgaacattgccaaatacaaaaatgctctggagagaagaaagaactctaagggccagggaaagtcctcatcatctgcactaactggcgtcctcagcgctaaacaagtacaggatctactcagcgaggaccacgggtgttcactgcctgccaccccacagagtatctcagatctgaaaagcctggcaactgcgctcttagaaacgatccacgaaaagaatatggtgatccagcaccagcgtcagaccaacaagattcttggcaatagggtggcagagcttgaaaagaaactgcgcacactggaagtaagcgggttgtggtccctgcctgggggaaaagacaccattttattctcagatcctacattaccatccggacaacgatctaggtctccgctgttgaaatttgtcgaacaaccgacagaaaacaaggccgacccaaaggacggggaggcccagaaacaggaggaagatgaaagctgtgcagcagctgaggcgctcaccgcacccgaagacgctggtcggccagcagtaaatagccctgccaatcagagccggggaaaccaatgcaaactatttcacccgtccctaccacagctccccagtgaagaagaggttaactcgttgggtcgggaaatcatcaaactgaccaaagagcaagctgcagcggaactggaggaggtgcgtcgagagagtcccatagaagggcagcgcagtgaaacaggacctgctcctcctggcctggcaatacagggagaactcccaaagagccatttagattcgtttgaggcatctaggccagcagccaaggcctcaactcccgaggatggtaaggggattcccgaaggtggagggatgcgctccaccgtgaaaacctag

SEQ ID NO: 55059 - DNA, 1590 bp, Artificial Sequence
  Description of Artificial Sequence: Synthetic coding sequence
atggttgttatagtggtggttatcatcattattattgccagagccgctacttgggacagcgagtatctggtgtgtaaacgtaagctggaaagcaaaaaggaggcactgctcatcctttcgaaggaactggacacgtgtcagcaggagagagatcagtataaattgatggcgaaccagttgagggaaagacaccagtcacttaaaaagaaataccgtgaactaatcgacggagacccctccctgccacccgaaaaacgtaaacaggcaaacctcgcacagttactgagagactcccaggaccgcaacaagcaccttggggaggaaattaaagaacttcaacagcgcctgggcgaggtgcagggcgataacaagctccttcgtatgactatagctaagcagagactcggggacgaggctataggcgtacgacacttcgctgcccatgaaagggaggacctcgtccagcagctggagcgcgcaaaagagcagattgaatccctcgagcatgatttgcaggctagcgttgacgagctccaggacgtcaaagaagagaggagctcctatcaggataaagtggagagactaaatcaggagctaaatcacatcctgtccggccacgagaacagaataatcgacgtggacgctctgtgcatggagaatagatatttacaggaaagactgaaacagctgcatgaagaagtgaatctccttaagagtaacattgcgaagtacaaaaatgcgctggagaggagaaaaaacagcaaaggccaggggaaatcgtccagttctgctctgacgggcgttctgtcagctaaacaagtgcaggatcttttgtctgaggaccatggatgtagcctgccagctaccccccagagtatcagcgatcttaagtccttggcgaccgctctactggagactattcacgaaaagaacatggtgatccagcaccaaaggcaaaccaacaagatcttgggcaaccgggtcgctgagttggagaagaaactgaggaccctcgaagtttccgggctgtggtctcttcctggcggtaaggacaccatactgtttagcgatcccacattgccgagcggtcagcggtctcgcagccccctcctgaaatttgtggaacagcccaccgaaaacaaggctgatcctaaggacggggaagcacagaagcaggaggaagatgagtcttgtgccgctgctgaggctctcacagctccagaagatgccggaagaccggctgtgaattcacccgcaaatcagtcgaggggcaatcagtgcaagctgttccatccctctttgcctcaactgccatcagaggaggaagttaactctctggggcgtgaaattatcaagctgacaaaggaacaagctgcagccgagttggaagaagtgagacgagaatccccgatcgaggggcagaggagcgagaccggcccagcgcctcctggcctcgcaatccagggtgagctgccaaagtcccacctggattccttcgaggccagtaggcccgcagccaaggcctccaccccagaagatgggaaggggatccccgagggaggaggaatgcgcagcactgttaagacgtag

SEQ ID NO: 55060 - DNA, 2247 bp, Artificial Sequence
  Description of Artificial Sequence: Synthetic coding sequence
atgagtttacatgaagcttccgaaaaggcccaggtactgaatgaccagttgacaaaaaagtgttctgagttaagctgtatgttgcagactgtcacaatggaaaaggccagaattattgcagaccatcaggcgatactgcaagtggagcagaagatgatgactcagacatttcaggagcagaacctgctgttggatgctgctcatgcgtccatcaccaatgaactgcagacagtacagaacgaaaaaactcagctccaggcacatctggaccacctcattctcgaacataatcagtgcatccaaaaggctcaggatgctgaaaagcggaccgcggtgcagaaagagctgctagagtccactattgcgaggctaagaggggaactcgaagcaagtatgcaggaaaagaagagcctgctggaggagaaagagcgttttcagagggaagtgaacaaaacagagaaagaaattgttcaggagcggtgcaatctggagaaagaactggcgaagaacaaagtcgacatcaatactttgacccataaccttcagacactggaagaggagaacaagcatctagccgaccaaatggcctccctagagctgcagcaggttacatctgactatcatggactagcacagcagaaggtcgagaagattacagaaagcaagaataagctggcctatgagaacggcaaactgcagatcaaagttaagcagctggaggagcaggtacagagttttacggatacttccctccagaacgaccacctgcgcaagatgaataagtacttgcagaccaagtatgcacaagtcaagtccatattggagaggtctaaggaggagctcagtcgtaccgtgaagtgcaggaacgccgcactcaaggagagccagaagctgaaggaggatcttgaggcggtggaggatcgcgagaacaagaaagtaggaaactttcagaggcagctggcagaggctaaggaggacaattgtaaggtcactatcatgctcgagaatgtgctggcgtcacactccaaaatgcagggagccctcgagaaagttcaaatcgagctcggaagaagggatagcgagattgcaggactgaagaaggagagagatctgaaccagcagagagtccagaaactcgaggccgaagttgaccagtggcaggcgagaatgctcgttatggaggatcaacacaactccgagatcgagtccctgcagaaggcactcggcgtcgcccgagaagataaccgaaaactggccatgtctttggaacaagccctgcagactaataaccacttgcagaccaaattagaccatatccaggagcagctcgagtctaaagagctggaacggcagaatcttgagactttcaaagacaggatgacggaggagtctaaggtcgaggctgagcttcacgcagaacggattgaagccctgagaaagcagttccaaactgagcgagaaaccacgaaaaaggtggctcaacgcgaggtggctgaactcaagaaggcgttggacgaggcaaattttagatctgtagaggttagtagaacaaacagagaattgagacaaaagttagcggaactggaaaaaatcctggagtctaataaagagaaaattaagaaccaaaagacccagattaaacttcacctatcggcaaaggccaacaacgcacaaaatattgagcggatgaaacagatcgaaaaggagctgaagcagatggagctgatcaaagatcagtatcagaagaagaactacgaacagagcctttcgattcagcggtttgtctgcgagatgactaacctacaaaaagaaatgcaaatgctggcgaagtcccaatacgatgcgtctgtgcgaaacaagcaacaagaactccacctcgaagccgagagaaaaatcaggcaagagctggagaacaggtgccaggaattagaggagacagtgcgccaccttaaaaagtgcaaggaggctaccgaaaataccctgaaagaggcttcagtcgagtccgagcagattactgcgaatctggaggaggctcaccggtggtttaagcacaggttcgatggactgcagctcgagttgactaaaaatcgtcttcagcgtccatctggcgaggaccgctggcaggaaaaagaccaggacgtgaagcacgatgtcatgtcaaatcagtccgtcttgcataggtgggaaagaaaacaaaatctgcggccaatgcccaaaaaatatcattccgaagtccagcgtaagtag

SEQ ID NO: 55061 - DNA, 3306 bp, Artificial Sequence
  Description of Artificial Sequence: Synthetic coding sequence
atggactgtaaagtgcacatggaaactaccgtaagtagacctgtcctgtccccaacgcacatcaatgccaccgctagcgagacatttacagtgctgcagcagagaatgagaatagtagaagagcagacctccagcttgagggatgatctgattatgttggattttggagaaaaacggggttacctcgaggctccagactgccttgaggatttagactcacagaaagtcatcagccccatccagaatgaggccatatgcgccggaaagacggatattctgtggaaaaattgtgaatttcttgtgaaccgcatgtgcaggctggagtccctgatgcagagtttaaaaatgaacatatttagactgcagacagaaaaggacctgaatccccagaaaaccgcattccttaaagaccggttaaacgccatccaggaggagcacagtaaggatctcaagctgctgcatctggaagtgatgaatctgcggcagcagcttcgcgcagtcaaggaggaggaggataaggcacaagatgaggtgcagcgcctgactgctacgctcaaaatcgcctctcagacgaagaagaatgccgcaatcatcgaggaagagttaaaaaccacgaagagaaaaatgaatctgaaaatacaagaactgcgcagacagctggcacaggaaaagtacctgcgggagtcattggagaagagtgccagtgctatgttgctgaaaatccaggagatgggaagcaccgtcgaagtagaacgcaagcaggtccacatcttgcaacagaactgtattgcactgcgtgatagcatccagtcggctcaagagctcttggcccaagaacagaagaagaaggaagagctggaaatcgcaaccagccagcttaaaagtgatcttacaagccgggacgacttgatttcaaagttggtcgaggagaacaagaatttacagatatcatttaataaggaacacgaggagaacgcctacctcagaagcgaaatcatgtctctccatgaggcttccgagaaagcgcaggttctgaacgaccaacttaccaaaaagtgctcagaattgagctgtatgcttcagaccgtcacaatggaaaaggcgagaatcatcgccgatcaccaggccatactccaggtcgaacagaagatgatgactcagactttccaggagcagaatttgctgctcgatgccgcacacgctagcatcaccaatgaacttcagactgttcagaacgagaagactcagctccaagcccacttggatcaccttatcctagaacacaaccaatgcatccaaaaggcacaagatgcggagaagcgaactgctgtccagaaagagttgcttgaatctactattgcccgtctgcgaggggagctcgaggccagcatgcaagaaaaaaagagcctgctggaggagaaggaacgctttcagcgagaggttaataagactgagaaggaaattgtgcaagagaggtgcaatcttgagaaagagttggccaagaataaagttgacatcaacaccttaacgcataacctgcaaaccttggaggaggagaacaaacatttggctgaccagatggccagtctggagctgcagcaggtgacaagcgattaccacggcctggcccagcagaaggtggagaagatcacggagtctaagaacaaactcgcatatgagaatggtaagttgcagatcaaggtaaaacagcttgaagaacaggtccagagtttcaccgacacaagcctccagaacgaccatctacggaaaatgaacaagtatcttcagaccaagtacgcacaggccaatagtgagctgtccgcaaaaagagtccacctgcagcaggctgatgcgcacctcaaggaggtcaagtcgatcttggagcgctctaaagaggagctatcacgtaccgttaagtgtcgcaacgctgccctcaaagagagtcaaaagctgaaagaagatctcgaagcggtcgaagaccgcgagaataaaaaggtcggcaatttccagcggcagctcgccgaggcaaaagaggataactgtaaggttacaatcatgctggaaaacgtgctcgccagtcattccaagatgcagggtgctttggaaaaggtgcagatagagttagggaggcgagattctgaaatagcaggactgaaaaaggaaagagatctgaatcagcagcgagttcagaagctagaagccgaggttgaccagtggcaagctaggatgctagtgatggaggatcagcacaactcagaaatcgaatcactgcaaaaagccctgggtgtcgctagggaagataaccgcaaactggccatgagtctagaacaggccctgcagacaaacaaccacctacaaacaaaattagatcatattcaagagcagcttgagagcaaagaactcgagcgacagaatctagagacttttaaggataggatgaccgaagagagtaaggtggaggctgagttacatgctgaacgaattgaggcactacgcaaacaattccaaaccgaaagggaaaccacaaaaaaagtggcacaaagagaggtagcggagctgaagaaggccctggacgaagcaaattttaggagcgttgaggtgtctaggaccaacagagaactgcgacagaaactggccgagctcgagaagatcctcgagtctaataaggagaagatcaagaatcagaaaactcagatcaagttgcacctcagcgcaaaggctaataacgcccagaatatagaaaggatgaaacagatcgaaaaagagctcaagcaaatggagctgattaaggatcaatatcagaagaagaattatgagcagagtctgtccatacagaggttcgtctgtgagatgaccaacctgcagaaggagatgcaaatgctggctaaatctcaatacgatgcctccgtccgcaacaagcagcaagaactgcacctggaagccgaaagaaagatacgacaggagttagagaataggtgccaggagctagaggagacagtacggcacttgaagaaatgcaaagaggccactgagaacacactgaaggaggcttccgtggaatccgagcagataacagccaacctggaggaggcacaccggtggttcaaacataggttcgacgggctacagctagaactcaccaagaaccgccttcagcgtccctcaggcgaggaccgatggcaggaaaaggatcaggacgtgaagcatgatgttatgagcaaccagagcgtgctacaccgatgggagcgaaaacaaaacttgagacctatgccaaaaaaatatcattcggaggtgcagaggaaatag

SEQ ID NO: 55062 - DNA, 1767 bp, Artificial Sequence
  Description of Artificial Sequence: Synthetic coding sequence
atgccattgcgcaaacgaaaaagtccagaaaggacagcttccagtaagagtcccgaaatttcaagatcacatgtcaacagtataaaggagagaacttcctccgtggggttacccagcgtgatccccaacagcaccaggcgcgtgtcctttgctccaaatctgcccagcatgaagacttctcaggatattggcgattcgaggatctctttaaaaacactgcttaacgccatcaagactatggagggcaggcttgaaggcaaaatcgaaattttagcttcacgacctctgataaatgacgagtcccccaacttcctgaagcaggacagtgtgaaaagcatcctagaaaggtccaaggaagagctaagtcgcactgtgaaatgccgaaacgcagccttgaaggaatcacagaagttgaaggaggacttagaagccgtggaggacagggagaataagaaagtggggaattttcagaggcaactggccgaagcaaaagaagataactgcaaggtaaccataatgctcgagaacgtgctggcgtctcacagtaaaatgcagggcgctctggagaaggtgcaaattgagcttgggagacgcgacagcgaaattgccggtctcaaaaaggagcgcgatctcaaccagcagagggtgcagaaactcgaggctgaggtggaccagtggcaggccaggatgctggtgatggaggaccagcataatagcgagattgagtcattacagaaagctcttggggtggcaagggaagacaatcgcaagttggcaatgtccctagaacaggccctccaaacgaataaccatctgcaaaccaagctcgaccacatacaagaacagctcgaatccaaagagctggagcgccagaatctggaaaccttcaaagacaggatgacggaggaatctaaagtcgaggccgagttacacgctgagcggatcgaggctctgcgcaagcaatttcaaactgagcgcgaaaccaccaaaaaagttgcccagcgggaagtagcagagctgaaaaaggctctcgatgaggccaacttccgttctgtcgaagtcagccggacaaacagggagctccgtcagaagcttgccgagctagagaagatcctggagtctaacaaggagaagatcaaaaaccagaagacacagatcaagttgcacctctcagctaaagcaaacaacgcccagaatattgaacggatgaagcagattgagaaagaactcaaacaaatggagctgatcaaggaccaatatcaaaaaaaaaattatgagcagagcctgagtatccagagattcgtctgtgaaatgaccaacctccagaaggaaatgcaaatgctggccaagagtcaatacgacgcctcagtgcgcaacaagcaacaagaactgcacctggaggcggagcgcaaaattcgccaggagcttgagaatcgctgccaggagcttgaggagacagtccggcatttgaagaagtgtaaagaggcaacagaaaacacactcaaagaggccagtgtcgaaagcgagcaaatcactgccaacctcgaagaagcccatagatggttcaaacaccgatttgatgggctgcagctggagctgacaaaaaacaggttacagcggccaagtggggaagacaggtggcaggagaaggatcaagatgtgaaacatgacgtgatgagcaatcagtctgtcctccaccgctgggagaggaagcagaatctccgcccaatgcccaaaaaataccactcggaggtacagagaaaatag

SEQ ID NO: 55063 - DNA, 456 bp, Artificial Sequence
  Description of Artificial Sequence: Synthetic coding sequence
atgagcctacacgaggctagtgaaaaagcacaagtgctgaacgaccaattaactaaaaaatgtagtgagttgtcttgcatgctacagacagttaccatggagaaggcgaggatcattgccgaccatcaggctatattgcaggtggaacagaaaatgatgacccaaactttccaagagcaaaatctactgctggacgcggcacatgcttccataactaatgaacttcaaaccgtgcaaaatgagaagacacagctacaggctcatttggatcaccttatactcgaacataaccagtgcatccaaaaggcacaggacgccgaaaaacgaactgctgtccagaaggagctgttagaatctacaattgcacgcttgcggggagagttggaagcctcaatgcaggaaaaaaaaagtttacttgaggaaaaggagcgcttccagagagaaggatatttgtag

SEQ ID NO: 55064 - DNA, 387 bp, Artificial Sequence
  Description of Artificial Sequence: Synthetic coding sequence
atgtgccggctggagagcctgatgcagtcccttaaaatgaacatttttcgtttgcagacagaaaaggatttgaaccctcagaaaaccgctttcctgaaggaccggctgaatgctatccaggaggagcatagcaaagatttgaagcttcttcatcttgaggtgatgaacttgcgccagcagttaagagccgttaaagaagaggaggacaaggcccaagatgaggttcagaggttgaccgcaacactgaagattgctagccagacgaaaaagaacgccgctataatcgaagaggaactaaagaccacgaaaagaaaaatgaatctgaaaatccaggaacttctggaaatgaccagtttcccttcgtggctgaagaagatcagattttag

SEQ ID NO: 55065 - DNA, 891 bp, Artificial Sequence
  Description of Artificial Sequence: Synthetic coding sequence
atggactgcaaggtccatatggagaccactgtgagccgtccagttttgagcccaacccacattaacgcaacggccagtgaaacatttactgtactccagcagagaatgcggattgtggaggaacaaacatcctccttacgggatgatcttataatgctagacttcggggagaagcgcggttacctagaggcaccagactgcttggaagatctggatagtcagaaggtaatttccccaatccagaacgaggccatttgtgctggcaagacggatatcctgtggaagaactgcgagttcctggtaaatcgaatgtgccggcttgagtccctgatgcagtctctgaagatgaatattttccgccttcaaaccgagaaagatctgaaccctcagaaaacagcatttctcaaggatcgcctaaatgctatccaggaggagcacagcaaggacttaaagttgcttcacctggaagtgatgaatctacgccaacagcttagagctgtcaaggaagaggaggataaagcccaggatgaggtccagcggttgacagcaacattaaaaatagcctcccagaccaaaaagaatgcggctatcattgaggaagagctgaaaaccactaagcgaaaaatgaatctcaaaatccaagagctccgacgacagctcgcacaggaaaagtatctccgggagtcattggaaaagtcggcttccgctatgctgctgaagatacaggagatgggatccactgttgaagttgagagaaagcaggttcacattctccagcagaattgtattgccctgagagactccatccagagtgcccaggaactcctggcacaggagcagaagaaaaagaagtcatggaggctgctgctccactccagcaacctgatttag

SEQ ID NO: 55066 - DNA, 1788 bp, Artificial Sequence
  Description of Artificial Sequence: Synthetic coding sequence
atgactagcccactgtgtcgggctgcgagtgcgaatgccctgccaccccaggaccaggcaagcactccctcttctagagtaaaagggcgagaagcctccggcaagccttcccacctgcgcggaaaaggaaccgctcaagcctggacgcctggaagaagtaagggaggctctttccaccggggtgctgggaagccctccgtgcattctcaggttgccgagctacacaaaaagatccagcttctcgaaggagatagaaaggccttttttgaatcgtcacaatggaatataaaaaaaaaccaggagacgattagccagctaaggaaagaaacaaaagcgctagagctcaaactgctggacctgcttaagggtgatgaaaaagtggtccaggcagttatccgtgagtggaaatgggaaaaaccctatctgaaaaaccgcactggccaggccctcgaacacctcgaccataggttgagggaaaaagtgaaacaacaaaacgccctccgtcaccaagtagtgctcaggcagagacgccttgaggaactacagttacagcacagcctcagactcctagaaatggcagaagctcagaataggcataccgaagtcgctaaaacgatgcgcaatctcgagaacagactggaaaaggcgcagatgaaagcccaagaggcagaacatatcacgtctgtatacttgcagctgaaagcctatctgatggatgaatcactgaacctggagaacagactcgacagcatggaggccgaagttgtaagaactaagcatgaactggaggcactgcacgtggttaatcaggaagctctcaacgctcgcgatatagccaagaatcagctacagtacctggaagaaacgctcgtgagagagagaaagaagcgggagaggtatatttccgagtgcaagaagcgggctgaagaaaagaagctggagaatgagagaatggaacggaaaactcaccgggaacatctgctcctccagtcggatgataccatacaggacagcctgcatgcgaaggaggaggagttacgccagcgctggagcatgtatcaaatggaagtcatttttggcaaggtaaaggatgcaacaggaaccgacgagacccattctctcgtgagacggttcctggctcagggggatacttttgcacagttggagacacttaagtctgagaacgagcagactctggtcaggcttaaacaggagaagcagcaactccagcgcgagcttgaagacttaaagtacagcggggaagccacactggtcagccaacagaaactccaggccgaggctcaggaacggctcaaaaaggaggagcggcgacacgccgaagctaaggatcagctcgaaagagcactacgggctatgcaagtggccaaagattctctggagcacctagcatctaagcttatccacatcacagtggaagacgggcgtttcgcgggaaaggagctcgatcctcaggctgataactacgttccaaacctgctggggctggtagaggagaaattgctgaagttgcaggctcagctccagggccatgatgttcaggagatgctctgtcatatagctaatcgcgagttcctggcctcactcgaaggcaggctacccgagtacaacacccgcatcgctcttccactggctacaagcaaggacaaatttttcgacgaagaatcagaggaggaagataatgaggttgttaccagagcctccctaaaaataaggagccagaaactgatcgagtcccacaagaaacaccgcagatcacggagaagctag

SEQ ID NO: 55067 - DNA, 1725 bp, Artificial Sequence
  Description of Artificial Sequence: Synthetic coding sequence
ctccctccccaagatcaggcatctaccccctcttctgggaagccctcccacttaaggggaaaaggcacggctcaagcttggaccccagggcgaagtaaagggggtagtttccaccgcggagctggtaaaccgtccgtgcacagccaggtcgccgaactccataagaagatacagttgttggagggtgacaggaaggcttttttcgagtccagccagtggaacataaaaaaaaaccaggagacaatctcacaactgcgcaaagagacaaaagccttggagctgaagctgctcgaccttctcaagggcgatgagaaggtggttcaagcggttattagagaatggaagtgggaaaagccatatcttaaaaaccggacaggacaggccctggaacatttggaccataggttacgcgaaaaggtcaaacagcagaatgcactgaggcatcaggtggtgctgcgccaacgtcggcttgaagaactgcaactccagcattcattgcgcctgctggagatggcagaggctcaaaaccgacacaccgaagtggccaaaacaatgcgtaaccttgaaaatagactcgaaaaggctcagatgaaagcgcaggaagccgagcacatcacctccgtatacctccagcttaaagcatacctgatggacgagtccttgaatctggaaaataggctggattctatggaggccgaggtggtgagaaccaagcacgagctggaagctttacacgttgtgaatcaggaagctctcaacgccagggacatcgccaagaaccagctgcagtatctggaagagacactcgtcagggaacgaaaaaagcgtgagcgctacatttctgagtgcaagaagcgcgcagaggagaaaaagctggagaacgagcgcatggagcgaaaaactcaccgcgagcacctgttgttgcagagcgacgacactattcaagattctctgcatgcaaaagaggaagagctgcgccagagatggtcgatgtatcaaatggaggttatcttcggcaaggtgaaggacgcgactgggaccgatgagacccacagcctggtgaggcgctttctcgctcaaggtgacaccttcgcccagctcgaaacgcttaagagtgagaacgagcagaccttggtaaggctgaagcaggagaaacagcaactccagagggagctggaggatctgaagtacagcggagaggctacgttagtttctcagcaaaaactccaagccgaagctcaggagcgcctgaagaaggaagaacgcagacacgctgaagccaaggatcaactggagagggcactgcgggctatgcaggttgccaaggactcactcgaacacctagccagcaaactcatccacatcacggttgaggacggaagattcgcaggcaaggagctggacccacaggcggataactacgtgccaaatttactgggactcgttgaagagaagttactcaagcttcaggcacagctccagggtcacgacgtccaggaaatgctgtgccacattgctaacagagaatttttggccagtctagaaggcaggctacccgagtataacacccgcatcgccctgccactggccaccagcaaggacaagttctttgatgaagagagtgaagaggaagacaacgaggttgttactcgggcaagcttaaaaataagaagtcaaaagctgatagagtcgcataagaagcatagacgcagccgacgttcttag

SEQ ID NO: 55068 - DNA, 1626 bp, Artificial Sequence
  Description of Artificial Sequence: Synthetic coding sequence
atgcatccccctgtagccccatgcaaaaagctcagatgtccacccaccagaagctttacccctacaagaggcaggagcaaagagggagacaggaaggcattttttgagagcagccagtggaacatcaagaagaatcaggagacaatttctcagctgcgcaaggagaccaaagccctggagctgaaattgttggatctcctgaagggagatgaaaaagttgtccaggctgtgatccgtgagtggaagtgggaaaagccttacctgaagaaccgcaccgggcaggccttggagcatcttgatcaccggctgagggagaaggtcaagcagcagaatgccttgagacaccaagtggttttgcgccaaagaagacttgaggagctgcagctgcagcacagtctccggcttctggaaatggcagaagcccagaatcgacataccgaggtcgcgaagaccatgaggaacttagagaaccggttagagaaagctcaaatgaaggcccaggaggcagagcacatcactagtgtttacctccagttgaaggcgtatcttatggatgaaagtctgaacttggaaaatcggctggatagcatggaggcagaagttgttcgaactaaacacgaactggaagcactgcatgtggtcaatcaggaggctttgaatgcacgcgatatagccaagaaccaactccaataccttgaggagaccctagtgagagagagaaaaaagcgggagagatatatctccgagtgcaagaagagagcggaagagaaaaagctggaaaatgagcgaatggagaggaagacacatagggaacatctgctgcttcagtctgatgatactatccaagacagcctgcatgctaaggaagaagagctccggcagcggtggtctatgtatcagatggaggtgatcttcggaaaggttaaagacgctactggaaccgatgaaacacacagcctcgtgaggagattcctggcccagggagataccttcgcccagttggagactctgaaaagcgagaatgagcaaacattagttcgcctcaaacaggagaagcagcagctccagcgcgagcttgaagatcttaagtatagcggcgaagcaacactggtgtcccagcaaaaactgcaggccgaggcccaggaacggctcaaaaaagaggagcgtcgacatgccgaggccaaagaccagctggagagagcactgcgcgctatgcaggtggcgaaagattccctggaacacctggcgagcaaactgattcatattaccgtcgaggatggacgctttgcgggtaaggaacttgacccgcaggctgacaactatgtccctaatttattaggtcttgtggaagagaagttgctcaagctgcaggctcaactgcaggggcatgatgtacaggagatgttgtgccatatagccaaccgagagttcctggcgtcgctggaggggagactccccgagtacaataccagaatcgccctacccctggccacaagtaaagataagttctttgatgaagagagcgaagaggaggacaacgaagtggtaacgagagctagtcttaagattcgctctcagaaactaattgagtctcataagaagcacaggcgttctcgcagatcctag

SEQ ID NO: 55069 - DNA, 765 bp, Artificial Sequence
  Description of Artificial Sequence: Synthetic coding sequence
atggaccagtccagcgaggggtgtatgaagaagatctcctctgtcaatctagataaactaattaacgacttctctcagatcgagaaaaaaatggtggaaaccaatggtaagaataatatactcgatatacagctcgagaaaagtaactgccttctcaaggttatgcaggcgaaagaggtgtcaatcaaggaagaatgcgctaccctccacaatattatcaaggggctgcagcaaactatcgagtatcagcagaatctgaagggcgaaaatgagcaactgaagataagtgctgatttaataaaagaaaagctgaaatcccatgaacaggagtataagaataatatcgccaagttggtgtcggaaatgaaaatcaaggaagaagggtacaagaaggagatctctaagctctaccaagatatgcagcggaaggtggagctgaacgaagagaagcataaagagctgattgagaagaaggagatggagatcagcgaattaaacgcaaagttacgctcacaggagaaagaaaaacagaacgaaattattaagcttcagctggaattcgatgccaagctggccagagtgcaaactaagagcaagagctaccaggactcaactgtgctgccgcaatccatctatcgcaggaaactgcagcacttccaggaggagaagaataaagaaattgccatcctgaggaatacaatccgcgacctggaacagaggctgtcggtcggaaaggactctcatctgaagagacggaggttttag

SEQ ID NO: 55070 - DNA, 633 bp, Artificial Sequence
  Description of Artificial Sequence: Synthetic coding sequence
atgccaccgaagaataaagaaaaaggcaaaaagtctggagcccagaagaaaaaaaaaaattggggggctgacgtagttgccgaatctagacacaggctcgttgtgcttgaaaaggagttactccgcgaccatctcgccctgaggagagacgaagccagacgggctaaagcatcggaagaccagttgcgacaacgtttgcagggcgtcgaggcagagctggagggcgctagaagcgaaggaaaagcaatttacgcagagatgtccaggcaatgccatgccctgcaggaggatatgcagacacgctccaaacagttagaggaggaggtaaaagggctcaggggtcaactggaagcctgtcaacgtgaggccgctgccgcaagggaggaagccgaacaagccctgggagagcgcgaccaggccctggcccaattgagagctcacatggctgacatggaggcgaaatatgaggaaattctgcatgatagtctggaccggctgttggccaaactgcgggctataaagcagcagtgggatggggctgccctcaggctacatgcaaggcataaggagcagcaaaggcagtttggactgactccccctggaagtttgcgccctcctgctccgtctctgtag

SEQ ID NO: 55071 - DNA, 633 bp, Artificial Sequence
  Description of Artificial Sequence: Synthetic coding sequence
atgcccccaaagaacaaggaaaagggcaaaaaatccggcgcacagaaaaaaaagaagaattggggggctgacgtggtggcggagagccgacacagactggttgttctcgagaaggaactactgcgggaccatctggccttgcggcgagatgaggccagaagagctaaggctagtgaagaccaactgcgtcagcgactgcagggcgtcgaggcagaactcgagggggcacgcagcgaggggaaggcaatatacgcagagatgtctaggcaatgtcacgccctgcaagaagatatgcagactaggtccaagcagcttgaagaggaagtcaagggactcagggggcagcttgaggcatgccagagggaggctgcagcagcgagagaggaggccgaacaagccttgggagaaagagaccaggccctggcacagctgagggctcacatggccgacatggaggccaaatatgaggagattctgcatgattccctggatcgccttctggctaaactacgggcaataaaacagcagtgggatggtgctgccttgaggctacacgctcgacataaagagcaacagagacagttcggcctaacccctccaggaagcctcagacccccagcaccctctctgtag

SEQ ID NO: 55072 - DNA, 2025 bp, Artificial Sequence
  Description of Artificial Sequence: Synthetic coding sequence
atgtctgaactggccgactctggcccttcaggcgcttctgctcccagccagctgcgcgctgtgacacttgaagacctgggactgctgctggctgggggattggctagtcccgagcctctaagtctcgaggaactttccgagcgatatgaatcatcgcatccaacttcaacagctagcgtgccagagcaggacacggccaaacactggaaccagttagagcagtgggtggtggagctccaggccgaggtggcctgcctgcgggaacacaaacagaggtgcgagagggcaacaagatccctcctgagagagctgctgcaggttagagccagagtacagctgcaggggagcgaactaaggcagttgcagcaagaagctcgccctgctgcccaagctcctgagaaagaggccccagaattttcgggactgcaaaatcagatgcaggctctcgataagagattggtcgaagttagggaagccctgaccagactgcgcagacggcaagtacagcaggaggcggaacgcaggggggctgaacaggaagccggtctccgcctcgccaagcttacagacttactgcagcaggaggaacagggaagagaagtagcatgcggggcactccagaagaatcaagaggattcatcacgcagagttgatctggaggttgcacgtatgcaggctcaggtgacgaagttgggggaagaagtaagtctcagatttctaaaaagagaggccaagctatgcggttttttacagaagtcttttctagcactggaaaaaagaatgaaagcgtccgaaagctcaaggcttaaattagaaggtagcctgcgaggtgagcttgagagcagatgggagaagctgcggggacttatggaggagcgcttaagggcgctgcagggccaacatgaggtgggacccggaggccgtagagcagaggaatcacatctcctggaacagtgccaggggttggacgccgctgtggcccaattgactaagttcgtgcagcagaatcaggccagcctcaacagagttctgctcgcagaagaaaaagcttgggatgccaaagggagattggaagaaagccgggcaggagaactagctgcgtatgtacaggaaaatcttgaagctgcccagttggctggtgaactggctcgccaggagatgcacggtgagcttgttttgttgcgagaaaaaagccgcgcactggaagcttcagtggcccagctagccggacagctaaaggagctgagcggccatctgccggctttgtctagtaggctcgatctgcaggaacagatgttggggctgcgattgtctgaagcaaagaccgaatgggaaggagccgaacggaagagcctcgaagacctggccagatggagaaaggaagtgaccgagcacctgagaggagtgcgcgaaaaagttgacggcctgccacagcagatcgagagtgtatcggacaagtgtcttctccataagtctgacagtgatctgcggatttcagctgaaggcaaggctcgggagttcaaagtcggggctttaagacaggagctggctactcttctttcctcagtacaactactaaaggaagacaatcctggacggaaaatagccgagatgcagggcaaactcgccaccaatcagattatgaaattagaaaactgtgtccaggcaaataagaccatccaaaatctgcgctttaacaccgaggcacggctccggactcaggaaatggcaactctgtgggagtcagtgctccgcctctggtcagaggagggcccacggacgcccctgggctcttggaaagccctgccttctctggtgaggcctcgcgtctttatcaaagacatggcgccaggcaaggtggtccccatgaattgttggggcgtgtatcaggccgtcagatggctccgttggaaggcttcattgataaagctcagagctttgcggaggcctggcggagtgttggagaagccacactcacaagaacaggtgcagcagctgacaccttcactgttcattcagaagtag

SEQ ID NO: 55073 - DNA, 1569 bp, Artificial Sequence
  Description of Artificial Sequence: Synthetic coding sequence
atgcaggctcttgacaaacggctcgtagaggttagagaggccctgacacgtttgcgcagacggcaagttcaacaagaggccgagcggagaggtgctgagcaggaagcaggtcttcgactggcaaaactgaccgatcttctgcagcaggaggagcagggaagggaggtagcctgcggcgctctgcaaaagaaccaggaagactcttcacggagggttgatctggaggtggctcgcatgcaagcccaggttacgaagctcggtgaagaagttagtttacggttccttaagagagaggctaaactgtgtggattccttcagaagtcattccttgctctcgagaagaggatgaaggcatctgaaagcagccgactgaagttggaagggtccctgaggggtgagctggagagtagatgggagaagctcagaggtctgatggaggaacgcctgagagccctgcaaggacagcatgaagagagccatctgcttgaacagtgccaggggctggacgcagcagttgcccaactgacaaagtttgtccaacaaaatcaggccagtctgaaccgcgtgctgcttgctgaagagaaagcttgggatgccaagggaagactggaagagagccgtgccggagagctggcggcatacgtccaggagaatctggaggcagctcagcttgccggagagctcgccagacaagagatgcacggcgagctcgttttactgcgcgagaaaagccgcgctctcgaagcctccgtcgcccagctggccggacagctcaaggagctctcaggacatcttccggctctatcttcaagattagatctacaagaacaaatgctgggccttaggctttcagaggctaaaacagagtgggaaggggctgagcgaaagtcattggaggaccttgcgagatggaggaaagaggtgacagaacatctgcgcggtgtgagagagaaagtcgacggtctgcctcagcaaatcgagtctgtctcagacaagtgcttactgcacaaatccgacagcgacttgagaattagtgccgagggaaaggccagggagtttaaagtaggggcattaaggcaagagctggccacactcctgagctccgtgcagctcctcaaggaggacaacccaggccgtaaaatagcagaaatgcagggaaaattggcaacattccagaatcaaataatgaagctggagaattgcgttcaggccaataagaccattcagaaccttcgattcaacacagaagccagattgaggacacaagagatggctacactttgggagagtgttttgaggctatggtccgaggagggtccaaggacccccctgggtagttggaaagctttgccttccctggtgcgcccaagggtgtttataaaggatatggctccagggaaggtcgttccaatgaattgctggggagtgtatcaagcagtccgatggttgagatggaaagcgagcctgatcaagctgagagcattaagacgcccaggtggagtattggagaaaccccactctcaggaacaggtccagcagctgactccctcactttttattcagaagtag

SEQ ID NO: 55074 - DNA, 2259 bp, Artificial Sequence
  Description of Artificial Sequence: Synthetic coding sequence
atggcgcacctgctgggctctcaggcgtgtatggaaagtttgaggacagatctcaccgatctgcagggtgccattgttgatgttttcagtcgcgctggccctgtgcgatttccgagctggaagttcccagatagaatggcatgcgacctggacatggtggctctcttagaacactacgaccatgtgccaggcgacccagagtttacccagctctcccatgcagtactcctggagctggtaattgaccggttgctactccttctacagtcctgcatgtcctaccttgagaacttgggcagtgagcagatgatgccgccagcccaggccgcaggcccttgcatgtccgtgggattgaccgtgcgccgattttgggattcactgttaaggctcggcaccttacatcaacagcccctcccccagaaaggcgcaaaccagagggagaccccaacaagcaagcctacaacgaagggggaacccgctcgctccccggagtacctgacgactaagcttatcaagccctctagccccgtgttggggcttccccagacgtgccaggagccagagtcaatcccggtaagggcatcccttcagttcccagctacgactttcaaaaacacgcgttcggttcattctcaaacaatcgagacagccctggttccctgtgacgcatgtgcaagtgtccaaggttctctgcaaaaagtcgggaaagtggtgatctccctgtgtcaaagccagaacctgcctagctccctgggacagtttcagcagcttgtccaggactccatgggattaaggccactcccggcagcaactgtgggcaggtgggctgcggagcagaggaaagatctgactagactgtcaaaacacgttgaagcactgcgagcccagctggaggaggctgagggacagaaagacgggctgagaaagcaagccggtaagcttgaacaagcgctgaagcaggagcaaggtgctcgaagaaggcaggccgaagaggatgaacagtgtctgtcagagtgggaacacgataaacagcaactcctgacagaaacatcagatctaaagacaaaaatggccactctcgaaagggagttgaagcagcagcgggagtcaacccaggcggtggaagcaaaggcccagcaactccaggaagagggtgagcgcagggccgcagccgagcgccaggtgcaacagctggaagaacaggtccaacaactggaggctcaggttcagttacttgtgggaagactggaaggagcaggacagcaggtgtgttgggcttccacagagctcgataaggagaaggcacgggttgacagtatggtacggcaccaggagtccctccaagctaagcagagggccctgctcaagcagcttgactcactggaccaggaaagggaggagttgcgtggatcccttgatgaggcagaggctcagcgagctcgagtggaggagcagttgcagtcagagcgagagcagggacagtgccagctgagagcccagcaggaactgcttcagagcttacagagagagaagcaggggttggagcaggccacgactgacctgcgactgacaattctggaattagagagagaattagaggaactcaaagaacgagagagactgctcgtggcctttcccgacttgcacaggcccaccgagacacagattcacggaggccgatctagctcggtggagtcacagattacgtgccctaccgactctgggaatgtgacggatcacatggagagacaggtgcagtccaacgacattaggatccgcgtgttacaggaggaaaatgggcgtctccagtctatgcttagtaagatccgtgaagtcgcccagcagggcggactcaaactaatcccccaggataggctgtggtcaccctcctccaagggcacccagggggcaaccccgccagtgcaggccaagtcaacaagccctggtccactcggcagacagcacctgccctcctctcgtactggcaggaccctcctggggcagccctgcactagcccaccgagacagccctgcactagccccccaagacaaccatgtacctctccccctaggcaaccctgcacttctccatccagacagccttgttcgcagcccagcaaatccctcttggagggagtgactcatctcgatacttgtacacaaaatcctatcaaggtcttggtgcggctgcggaaacgcctctcacccggtcgtgggcaagcatcctctgctcaccagccacaggagcgccctatgtag

SEQ ID NO: 55075 - DNA, 2259 bp, Artificial Sequence
  Description of Artificial Sequence: Synthetic coding sequence
atggcacatctccttggctcccaagcctgcatggagtcactgcggaccgaccttactgacctgcagggcgctatcgtggatgtattcagccgcgctggtcctgtccgcttcccctcgtggaaattccccgacaggatggcatgtgatctggacatggtagccctgttggagcattatgatcatgtccctggagacccggagttcacccaactgtcccacgctgtgctcctcgagctggtgatagatcgtctcctactgctcctgcagagttgtatgtcttacctagagaacctgggctctgaacagatgatgcctccggctcaggccgcaggcccttgtatgtcagttggtctaacagtgaggcgcttctgggactctctacttcggttaggcacactgcatcagcagccgttaccacagaagggagctaatcaaagagaaacaccaactagcaaacctacaacgaagggggagcccgcaagatctccagagtacttgactaccaagctgatcaagcccagctcgcccgtcttgggcctgcctcaaacctgccaggagcccgagagcatcccagttagggcttcactgcaatttccagccacaacctttaagaacacccggagtgtgcatagccaaacaattgagacagcacttgtcccttgtgatgcctgtgcgtccgtgcagggcagccttcagaaggtgggaaaggtagtcattagcttgtgtcagagtcagaatctgccatcatccctgggtcaattccagcagttggtgcaggacagtatggggcttaggccgctgcctgccgctaccgtgggtcggtgggcggcagagcaaagaaaagatctgaccagattgagtaaacacgtagaggccttgcgcgcacagctagaggaagccgaaggtcagaaggacggtttgagaaaacaagccggaaagctcgagcaggccttgaagcaagagcagggcgctaggagaaggcaggcagaggaggacgagcagtgccttagcgagtgggagcacgacaaacagcagctgctgacagaaaccagcgacctgaagactaagatggccacactagaacgggagttgaagcagcagagggagtccacacaggccgtcgaagcgaaagcacagcaacttcaggaggagggcgagcgcagagctgcagccgagcgccaggtgcaacagctggaggagcaagtacaacagctggaagctcaggtgcaactacttgtggggcgattggaaggggctggccagcaggtgtgttgggccagcaccgagctcgataaggaaaaagccagggttgacagtatggtacggcaccaggagtccctgcaggccaagcaacgtgccctgctgaaacaacttgacagcctcgatcaggagagagaagagctccggggatcgctggacgaggccgaagcacaaagagccagagtcgaggaacagctgcagagcgaacgggaacagggccagtgtcagctgcgggctcagcaggagcttttacagagtttacagcgtgagaagcaggggttggagcaagcaaccaccgatttgaggctgaccatcttggagctggagcgggagctggaggaactgaaggaaagagagcgcctgctggtggcatttccggaccttcatagaccaaccgagactcagatccacggcggtcgaagttccagcgtggagagtcagattacctgccctactgactctggcaatgtaacagaccacatggaacgtcaggtccaaagtaacgacatcaggataagagtactgcaagaggagaacgggaggctgcagagtatgctttctaagataagggaagtggctcagcagggtggcttaaagctcataccacaggataggttgtggagcccgtctagtaagggaacgcagggtgcaacccctccagtgcaggcaaaatcaacgtccccaggcccattggggaggcagcaccttccaagcagccggaccgggaggactctgctcggacaaccgtgcacttcccctcctaggcaaccttgcacttctcccccacggcaaccatgcactagcccgcctaggcaaccctgcacctcccctagccggcaaccctgtagccaaccatctaagtcgttattggaaggcgttactcatcttgacacgtgcacccagaatcccataaaggtcctcgttcggcttagaaagagactctcacctggtcgcggtcaggcctctagcgcccaccagcctcaggagcggccaatgtag

SEQ ID NO: 55076 - DNA, 1602 bp, Artificial Sequence
  Description of Artificial Sequence: Synthetic coding sequence
atggaatccaaagcctgggagtctaacaacgaggatctgttatctagcagcggagtgacaagtaatggcggtagtagcagttcgttttttgtaagttctatccggggaacaatcatcgagaacaccagtagcgcgggaaccctgacccaagttccctttttccccaaatacgaagttgagttggactcgcctagaaagatcatcccctcccccggaaaggagcatttcgagcgagtgctagaagagtacagtcatcaggtcaaagacctgcagcggcgtctgaatgagagtaacgagctgcacgaaaaacagaaattttacctcagacaatctgtcatcgatctccagacaaaactgcaggagatgcaaatggaacgcgacgcaatggctgacattcgccgtcgagagtctcagtctcaggaggaccttcgtaaccagctgcagaataccgtacatgagctcgaggccgcaaaatgtttaaaagaggatatgctgaaggactccaatactcagatcgaacagctgaggaaaatgatgctgtcacatgagggcgtgcttcaagaaatcaggagtatactcgttgatttcgaggaagcctctggtaagaagatctgcgaacatgactcaatgagcactttgcatttccgttctcttggcagcgctatcagcaaaatcctccgagagctggatactgaaatttcctaccttaaaggccgtatttttccggtagaagaccagctggaggcactcaaatccgaatcccagaataagatagagcttcttttgcagcagcaccaggaccgcattgagcagcttatcagcgaacacgaggttgaaatcaccggcctgacggaaaaagcctcctctgctcgctctcaagccaatagcattcagtcacagatggagataatccaggaacaagcaaggaatcagaattccatgtacatgaggcagctgagcgacttagaatccacggtgtcccagctgcgctctgagctccgcgaggctaagcggatgtacgaagataaaactgaagagctggagaaacagttggtgctggctaactctgaactgacagaggcgaggaccgagcgcgaccagagctcactgcggtcagacatgtgccatcggagcaataacagcctccgggactctaccgaggggtccaagtcgtccgaaaccctgtcacgtgagccagttacattacacgcaggagacagggaggatccttctggttgttttacctttacatctgccgctagtccgtcagtaaagaactcggcctcgagatcattcaattcaagccccaaaaagagtcccgtgcactctctgctgaccagtagtgtcgaggggtccattggctccacgtctcagtaccgcagcgcaaagcccattcatagtagtgattcagtgaaagactctcaaagtcctccgatcgaaaccacaggcaagacctgtcgcaagttacaaaataggctggagtctttacagactctagtcgaggatttgcagctcaagaatcaagccatgtccagtatgatcagaaaccaggaaaaacgaatccagaaagttaaagatcaggagaagatgttgctcaagtag

SEQ ID NO: 55077 - DNA, 3342 bp, Artificial Sequence
  Description of Artificial Sequence: Synthetic coding sequence
atggagtccaaagcctgggaatcaaataatgaggacctgctctcttccagcggggtgaccagcaatggcggatcatcttcctctttcttcgtgtcctctattagaggaactattatcgagaacacctcttctgcaggcacactgacgcaagttcctttcttcccaaaatatgaagttgaactcgatagtccccgaaagattatccctagtccaggaaaggaacactttgagagagttctcgaggaatacagtcaccaggttaaggacttgcagcgacgccttaacgagtccaatgagttgcacgaaaaacagaaattctatcttcgacagagcgtgatcgacctgcagacaaaactacaggagatgcagatggaaagagatgcgatggctgacattcgacgcagagaatcacagagtcaagaagatctccggaaccagttgcagaatacggtacacgagctggaggccgcaaagtgcctcaaggaagacatgctgaaggatagcaatacacaaatcgagcagctgcggaaaatgatgttatctcatgaaggcgtgctacaggagattaggtctattctcgtggacttcgaggaagcctctgggaagaagatttgcgaacacgacagtatgtccactctgcatttccgctcactgggcagcgctatctcaaagatactgcgcgaactggacacagagatctcctatctgaagggcaggattttcccggtggaagatcagctggaggcactgaaatctgagtcccaaaacaagatagaattgctgctgcagcaacaccaggacagaattgagcagctgataagtgagcacgaagtggaaattactggtctgaccgagaaggcctcctcagcgagaagtcaagccaattcaatccaatcccagatggagataattcaggagcaagctcggaatcagaatagcatgtacatgcgacagttatccgatcttgagtcaactgtgtcgcagttaagatctgaacttcgtgaagccaaaaggatgtatgaggacaagaccgaggaactggaaaagcagttagtcctcgctaacagcgagctcacagaagctcgaacggagagagaccagttctctcaggaatccggcaatctagatgaccagctccaaaagctgttagccgatctccataaacgcgagaaagaactgtccctggaaaaggagcagaataaacgcctctgggaccgcgacacaggcaatagtatcacaatcgaccatttaaggagagaactcgacaaccggaacatggaagtccagaggctcgaagctcttctgaaggccctcaaaagcgaatgccagggccaaatggagcgccagatggcagccattcagggaaagaacgagtcattagagaaagtttcgtccttgacagcgcagctcgagtctaccaaggagatgctccgtaaggtggtggaggaattgactgcaaaaaaaatgacattggagagctctgagcgcacgatctctgatctgaccactagccttcaagagaaggagagggccatagaagccacaaacgcagagataactaaactccggtcccgggtggacctcaaactgcaagagctgcagcacctcaagaatgaaggtgaccatctgaggaacgtacagacagagtgcgaggccctgaaactgcaaatgaccgagaaagacaaggtgatagaaattctccgccagcagatcgaaaatatgactcagctggtaggtcaacatggcaggacggccggagctatgcaggtggagaaggcacagctggaaaaggagattaatgacaggcggatggagctcaaggaactgaaaatcttgaaggacaaaaaggacgctaagatacgtgaactcgaagctcgcgtgagtgatttagagctcgagaaggttaaactggtgaacgcagggagtgagcggctgcgggctgtcaaagacattaaacaggaacgtgatcaactgctaaatgaggtcaagaccagtagatcagagcttaataatttatctgaagagtatgaagtactcaaaaggaacttcaggaacaagagtgaggagatggagatgacaaccaataagttgaaaatgcaacttaagtccgcccagtctgagctggaacagacccggaatacactgaaatctatggaaggtagcgacggccatgcaatgaaggtcgcgatgggaatgcaaaagcaaatcactgccaagcgcggacaaattgatgcccttcaaagtaagatccagtttctggaggaagccatgactaacgccaataaggaaaaacatttccttaaagaagaaaaaagtaagctgtcacaggaactgagcacagtggcaactgagaagaacaaaatggctggcgagctcgaagtcctgcggtcacaggaacgccgacttaaggagaaagtaaccaacatggaggttgccttggacaaagcaagcctgcagtttgctgagtgccaggacatcatccagcgccaagagcaagaatccgttcgtctcaagctgcaacacactcttgacatcaaagagctgcaaggccctgggtatacatccaactcgtctcttaaacccagacttctgcagccagcctccgtcaccagatcccattccaatgtccctagctctcagtccacggcctcattcttaagccatcactccacgaaagctaacaccttaaaggaggacccaacacgtgacctgaaacagctgctgcaggagctgcgcagtgtgatcaacgaggagcccgcagttagcttaagcaagacagaggaggacggacgtacgtcactgggcgcactcgaagaccgggttagggattgtattactgagtcttcactgaggagtgatatgtgccacagatccaacaatagccttcgggattcaaccgaaggaagtaagagtagcgagactctgtccagagagcccgtcactttacacgctggcgaccgcgaggatccaagtggatgcttcacctttacttcagccgcatccccctcagtcaaaaattctgcctcgaggtcttttaacagtagcccaaaaaaaagccctgtgcattccctgctcactagctccgtcgagggatctatcggctcaaccagtcagtacaggagtgccaagcctattcattcatctgactcggttaaagactcccagagtccccctatagagaccacagggaaaacctgccgcaagttacaaaatcgcttggagtctctccaaacactggttgaggaccttcaactcaaaaaccaggccatgagctcaatgataaggaaccaggaaaaacggattcagaaagttaaggatcaagaaaaaatgttgttaaagtag

SEQ ID NO: 55078 - DNA, 1239 bp, Artificial Sequence
  Description of Artificial Sequence: Synthetic coding sequence
atgcttctccccgcaagcgacccgttgctcgccggtctgcccagggaccccgattactctgtgtcatgtctgtattcgcccccttctccatcctcgatgtgcttgcccgctaatatgaaatgcgataagtattgggggtcttctagcgataaggcactcgagcgcactgcccactggtccagaacaccggagcctgagactcttggttgcccagcgtccggcgatactgtcagaaccgctgactgccgtccaggatggggcagcggcccttccccccacgaggcagccccttccccctcaccagatctgcagaagcaatgttgtaacgatcaggacatcttgaagcgtcatcataatgtggcgaagaagcccttagagacttcatcgtcgaaagtgaaagctaagaccatcgttatgatcccagattcccagaaacttctccgctgtgagcttgaaagcctcaagtcacagcttcaggcgcagacaaaggccttcgaattcctaaatcactccgtgactatgctggagaaagagtcatgtctacagcagatcaagatccaacaacttgaggaggtcctgtcccctactggtaggcagggggagaaagaagaacacaagtggggcatggagcagggcaggcaggagttgtacggtgcactgacgcaggggctgcagggtctggagaagacactgcgggatagcgaggagatgcagcgagctcgcactactagatgcctgcagctgctggctcaggagatcagggacagcaagaagtttctgtgggaggagttggagctggttcgtgaagaggtgacttttatttaccagaagttacaggcccaggaggatgaaatcagcgagaacttagttaacatccagaagatgcagaagactcaggtgaagtgccgcaagatcctcaccaagatgaagcagcagggtcatgagacagccgcttgtcccgaaactgaggaaattccccaaggtgctagtggctgttggaaggacgacctccagaaagagctgtctgacatatggtctgcggttcacgtgcttcagaacagcattgacagcctaacactgtgtagtggtgcctgcccaaaagcctcctcactccgcggtcacaagggtcaccagtgcttatcccctcctttgccctcatgggactcagactccgactgcgaccaagacctctcacaacctcccttttctaagagcggtcggtcctttccccctggctag

SEQ ID NO: 55079 - DNA, 894 bp, Artificial Sequence
  Description of Artificial Sequence: Synthetic coding sequence
atgggggaacacgaacaagtgaagcctctagaaacaagcagttccaaggtgaaagcgaagaccatagtgatgatccccgattcccagaaactgttaaggtgcgagttagagagcctgaagtctcagttacaagctcaaacaaaagctttcgaattcttgaaccatagcgtcaccatgctggagaaagagagttgccttcagcagattaaaatccagcagctcgaagaagtcttgtcaccaactggacgacagggggagaaagaggaacacaaatggggaatggagcagggacgtcaggagctctatggagccctcacgcagggcttacagggtctcgagaaaacattgagggattccgaggagatgcagagagcgagaacaactagatgtctccagttgctggctcaggagattcgtgactcaaaaaagtttctgtgggaagagctcgagttggtcagagaggaggtgacatttatttaccagaagctgcaggctcaggaagatgagatcagcgagaaccttgtcaacatccagaagatgcaaaagacccaagttaaatgtcgcaaaatattaaccaagatgaagcagcaggggcacgagaccgcagcttgtccggagacagaagagatcccgcagggagccagtgggtgctggaaagacgatctccagaaggagcttagtgacatctggtcagcagtccacgtcctgcagaacagcatcgacagcctgacgctctgctctggcgcatgcccaaaggcttcctctctgcggggacataaaggccaccagtgtctttcccctcctttgccaagctgggacagcgattctgactgcgatcaggatctaagccagcctccgttcagtaaatcaggccgaagtttccctccagcatag

SEQ ID NO: 55080 - DNA, 894 bp, Artificial Sequence
  Description of Artificial Sequence: Synthetic coding sequence
atgggggagcatgaacaggtgaagcctttggagacctccagcagcaaggtgaaggcaaagactattgtgatgatccccgatagccagaagctgctgagatgcgagctggagtctctgaagtcccagttgcaggcccagaccaaggccttcgaattcttgaatcacagtgtcaccatgctggaaaaggaatcttgtctacagcagattaagatccagcagcttgaagaagtgttatctcctacaggcagacagggagaaaaagaggaacataaatgggggatggaacagggacggcaggagctgtacggcgctttgactcagggactgcagggtctggagaagactctccgggattccgaagagatgcagagggctagaacaacgcgctgtctgcagctgcttgcacaggaaataagggacagcaagaaattcttatgggaggagctggagttggttagggaggaggtgacttttatctaccagaaactccaggcacaagaggacgagatttctgaaaatcttgtgaatattcagaagatgcagaagactcaagtaaaatgcagaaaaatactgacaaagatgaaacagcagggccatgagactgccgcttgccccgagaccgaagaaataccccagggagccagcggatgttggaaagatgacctgcagaaagagctgagcgatatctggtctgccgtccacgtgctgcagaactctatcgacagtcttactctgtgtagcggtgcctgccctaaagcgagcagcctacgaggacataaggggcaccagtgtctaagcccacccttgccttcctgggatagcgattcagactgcgatcaggatctcagccaaccaccgtttagcaaatctggacggagctttccgccagcgtag

SEQ ID NO: 55081 - DNA, 978 bp, Artificial Sequence
  Description of Artificial Sequence: Synthetic coding sequence
atggacgctagacgtaagcattggaaggaaaatatgtttacccccttcttcagtgcacaagatgtcctcgaggagacatcggaaccagagagtagctcggaacagacaacagcagacagcagcaaggggatggaggagatatataatctttctagccgtaagtttcaggaagaaagcaaatttaaaagaaagaagtacattttccagctcaatgaaattgaacaggaacagaatctcagggaaaataaaagaaatatcagcaaaaatgagactgatacgaacagcgcctcctatgagagttcaaatgttgatgtgacaacagaagaaagcttcaactccactgaggataattctacatgttcgacggacaaccttccagccctactgcgccaggatatacgaaaaaagtttatggaacgtatgtcacccaaactttgtttgaatctgctcaatgaggagctggaggaacttaacatgaagtacagaaaaatcgaggaagaatttgaaaatgcagaaaaggagcttctccactataaaaaggaaatatttactaaacctctgaacttccaggaaaccgagacagatgcctcaaagtccgactatgagctccaggcactgcgaaacgacctctccgagaaggccactaatgttaaaaatctgtctgagcagttacagcaggcaaaagaggtgatacataagctgaacctggaaaacaggaacttaaaggaggctgtacggaaactgaagcaccaaaccgaggtgggtaatgtccttcttaaggaagagatgaaatcctattacgagctggagatggccaaaatccgcggtgagttaagcgtaattaagaatgaactgcgaaccgagaagactctccaagctagaaataaccgggctctggagctgctcagaaagtattacgctagctcaatggtgacttcaagctcaatcctggatcactttactggggattttttttag

SEQ ID NO: 55082 - DNA, 978 bp, Artificial Sequence
  Description of Artificial Sequence: Synthetic coding sequence
atggacgcgcgaaggaagcattggaaagagaacatgtttactccatttttttcagcgcaggatgttctggaagaaacttctgagcccgaaagctcgagcgaacagactaccgctgactcatccaagggaatggaggagatttacaacctcagttcgcgaaagttccaggaggaaagcaagttcaaaagaaaaaagtatatctttcaacttaacgaaattgagcaggaacagaacctcagagagaacaaacgtaatatcagcaaaaatgaaacagacaccaattcggctagttatgaaagttctaacgtcgacgtgactacagaggaatcattcaactctacagaggataacagcacatgctctacggataacttgcccgcactgctacgccaggatattcgcaaaaaatttatggaaaggatgagccccaagttatgcttaaacctgttgaacgaggagctggaggagttgaacatgaagtacagaaaaattgaggaggaatttgagaacgccgaaaaggagctgctccattataagaaagagatctttacgaaaccactgaacttccaagaaacagagaccgacgcttcaaagagtgactatgagctgcaggcgctgaggaacgatctgtctgagaaggctactaacgtcaagaacctttctgagcagctgcaacaagccaaggaggtcatccacaaattgaatctcgaaaatcgtaacctcaaagaagcagttaggaaattgaagcatcagaccgaggttgggaacgttctccttaaggaagaaatgaagagttactatgaactcgagatggctaagatacgtggcgaactttctgtcattaaaaacgagttgagaacagagaaaactctccaggctaggaacaacagggcactggaactccttcggaagtactacgccagttctatggtgaccagtagctccattctcgatcatttcacaggtgatttcttctag

SEQ ID NO: 55083 - DNA, 2223 bp, Artificial Sequence
  Description of Artificial Sequence: Synthetic coding sequence
atgaacccgccaggctcactcgaggctctggatcccaacgtcgacgagcacctatcaacacagattttggccccttccgtgcatagcgacaatagtcaggaaaggatccaggcgagaaggctgagaattgccgcacgcctagaggctcggcgacgggaagcactgggggagtatttggatggcaaaaaggagtctgaggaagaccaatcaaaatcgtacaagcagaaagaagagtcacgtctgaagctcgctaagctgctcttgtgcggtacggagctggtcaccaatattcaggtggctatcgacattagagagattcacagacgggtggaggaggaagaaataaaacggcagcgaatcgagaaattggagaacgaagtcaagacatcccaggataagttcgacgagatcacgagtaagtgggaggagggcaaacagaaacgcataccacaggaactgtgggagatgctcaatacccagcagttacactgcgctggactgctggaagacaagaacaaactcatttcggagctgcagcaggagctaaaaacaaaggatgaccagtatgtgaaggacctgaagaaacagagtgatgacatctgcctgctgttagagcgcatggaggagcaggtcaagaacgttatgaagacatttcgagaggaattgtacaatatcgaaaaagcttttgaggtcgagcggcaggaactgttggctagcaataagaagaagtgggagcaggccctccaggctcacaatgcgaaggagcttgaatacttgaacaaccgaatgaaaaaagtggaggactacgagaagcagcttaaccggcagaggatctgggattgcgaggagtataatatgattaagatcaaacttgagcaagatgttcaaatcctggaacagcaattacagcagcggaaggcgatttaccagctaaaccaggagaaacttgagtataatctccaggtcctgaaaaaacgggatgaggaatccaccgtgattaaaagtcagcaaaagaggaaaatcaaccggttacacgacatcctgaacaatttaaggagcaagtatgccaagcagatcaagcagttccaggaagagaatcagtcccttacatcagattacaaacggctcgtcatgcagttcaaagagcttcagaaggccatgcgtcacttcgctcttattgacgatgaaaaattttgggagatatggctgatgaatgaagaggaagctaaagatctgattgccagggccttcgatgtggacagaattattcatacccatcatcttggacttccgtgggcagcacctgacttctggtttcttaacaatgtgggcccaatctcccagcaacctcagaaatcagctacccagatcgtcgaggaaatgcttatgcgatcagaggaggaagaagccgaagaggccgcagcggagcctgagtcatacctggatcttcctaaacagatctcggaaaagaccaccaaaagaatcttgatgctgctgtgtgacgagagtggcttcctcatcgaatctaagctactcagccttctccttcccctcgagcaaaatgagtgctacctgctgcgcctcgacgccatattcagcgctctgggaatcgagtccgaggacgacctctataagctggtcaacttctttcttaagtacagagcacaccggctttcatctagcctacaaatcaaaccatgcagtcaagccagtatggagaaggcttcaatggaggagacctcaacgcgctcggagttagagctcgcggagcagacagagatggaaggtgagaaagaggagtccctcgtggagggcgaaaaagaagaagaggaagaaaccccgccatctccgtgggtaatccatccaaacgatgttttaaagatcttggaggccttcgtgatgggcctgaagaaaccaagagattcccgtgcacctctgcgggtccagaagaacgtccgggataacagcaaggactctgaatattggcaggcactgacgactgtgattccttcgtccaagcagaacttgtgggatgctctatacaccgctctcgaaaagtatcatctggtgctgacccagagagccaagctgttgctcgagaactcctctctcgaacaacaaaacacagagctgcaggcgctgctacagcagtacttaaactccaagatcaattctgagctgcaggttccaccaacccaggtgctacgggtacctactaaatag

SEQ ID NO: 55084 - DNA, 522 bp, Artificial Sequence
  Description of Artificial Sequence: Synthetic coding sequence
atgggctcccattccccatcccacttccttgttcacgggtggatccttagcatgatgtttcccgaagaagaggaggccgaggaagctgccgctgagcccgagagttatttggacctgcccaagcagatctctgaaaagactactaagaggatcctcatgttgctgtgcgatgagagcggcttcttgattgagtccaagctcctgtccctcctgctgcctttagagcagaacgagtgctacctactgcgtctggatgccatttttagtgcccttggaatagaatccgaggatgatctttataaacttgtgaacttctttctgaaatacagagcccaccggctgagttcatcactgcagatcaaaccatgctcacaagcctcaatggaaaaggcctcaatggaggagacgtcaacccgctccgagcttgagttggctgaacagaccgagatggagggggagaaggaagagtctctggtagaaggggagaaagaggaggaggaggagaccccgccttctccctag

SEQ ID NO: 55085 - DNA, 2931 bp, Artificial Sequence
  Description of Artificial Sequence: Synthetic coding sequence
atgcattctctcgccctccaaaatactctgcatgagagaacctggtcagacgaaaagaacctgatgcagcaggaacttcgctccctgaaacagaatatcttcctgttctatgtgaagctgcggtggctccttaagcattggcggcagggaaaacagatggaggaggagggcgaggagttcactgagggagagcatcccgaaactttgtcgcggttgggcgaactgggggtgcaggggggacatcaggcggacggtcctgaccacgattccgatcgaggttgcggctttcccgttggcgagcacagtccccactcccgggttcagattggggatcactccttgcgacttcagacagcagaccgtggccagccacataaacaggtcgtggagaatcagcagttgttttccgcctttaaagccctgctcgaggacttccgggcagaactacgagaggacgaaagggctcggctccgtctgcagcagcagtatgcatccgacaaggccgcttgggatgtcgagtgggccgtgttaaaatgtcggttggagcagaattgctgtggatacccgcgaattaacatcgaagaagagactctgggattcacgcgcctgcctgcagggagtaccgtcaagactctgaaatcactcggattacagcggttagagctggaagagaagaccgaaaataagctcggagagcttggcagtagtgcagaatctaagggggcactgaaaaaggaacgcgaggtgcaccagaagttgctcgctgacagccattcactcgttatggaccttcggtggcagattcaccactctgaaaaaaattggaaccgggagaaagtggagcttctggaccgactcgacagagaccggcaggagtgggaaagacagaagaaggagttcttgtggaggatcgagcaagggtccctgcgtatgccgaggcccgtagctatgtggccctgtgccgacgctgactccatcccgttcgaggatcgaccgctgagcaagctaaaagagtcggaccgctgtagtgcaagcgagaatttgtatctggatgcactctctctggatgacgagccagaggagcccccagcacaccgtccagaacgcgaattccggaacagattacctgaagaggaagagaatcataaaggcaatcttcagcgtgccgtcagtgtcagcagcatgtctgaattccaacgcctgatggatataagcccatttctgcccgaaaaaggactcccgtctacgagctccaaggaagacgtaactcctccccttagtcccgacgatcttaaatatattgaggagtttaataaaagttgggactacacgccaaatagaggtcataatggtggtggcccagacctgtgggcagaccggaccgaagtcgggcgagctggacatgaggacagcacagaacctttccccgatagctcatggtatctcacaaccagcgtaactatgactacagacaccatgacttctcccgaacactgtcagaagcagccgctcaggtctcatgtattgactgagcagtccggactccgagtgctccacagcccccctgctgttcggcgtgtagactccataaccgccgctgggggagaagggccttttccaacaagccgcgcaagaggcagccctggagataccaagggcggacctccggagcccatgcttagcagatggccgtgcacatctccacgccacagccgggactatgtggagggagctcggaggcctttggattctcccctgtgcaccagcctcggattcgcttcacccctgcacagcctggagatgtcaaagaatctgagcgacgatatgaaggaggtggccttttctgttcggaatgcgatctgtagcggccctggtgagttacaagtaaaggacatggcgtgccagacaaatggttcaaggactatgggcactcaaaccgttcagacaattagcgtgggtttgcagaccgaggcgctacggggaagtggagtaaccagctcccctcacaaatgcctgactcctaaagctggaggtggcgcaactccagtgagctcaccatctcggtcccttcggtcacgacaagtggcacctgctatcgaaaaggttcaagccaaattcgaaagaacctgttgcagccctaagtatggcagccccaaactgcagcgtaagccactgccgaaagcggaccagccaaataacagaacctctcccggaatggctcagaagggctattcagagtccgcttgggcccgtagcacgactacgagggagtccccagttcatactaccattaacgacggcttaagctctctctttaacattattgaccacagtccagttgttcaagatccttttcaaaaagggctaagggccggaagtaggtcccgatccgcagaacccaggcctgaactcggtccaggacaagaaaccgggaccaactcacggggaaggtccccttccccaatcggcgtcggcagcgagatgtgtagggaagagggtggagagggaactcccgtcaagcaggacctgagtgctcccccaggctatacacttacagaaaacgtggctcggatcttaaacaagaaactccttgagcacgcactgaaggaagaacgtcgacaggcagcacatggaccaccagggcttcatagtgactcccatagtctcggggatactgcagagcctggtcctatggaggaattgccctgctccgctcttgcacctagcctggagccatgtttctcacgacctgaacgcccagcaaaccgacggcctccaagcaggtgggctccccatagtccaaccgctagccagcctcaatccccaggggacccaacttccctggaagagcacggcggtgaagagcccccagaggagcagccacaccgagatgcttccctacacggcctctctcaatacaattcactgtag

SEQ ID NO: 55086 - DNA, 4761 bp, Artificial Sequence
  Description of Artificial Sequence: Synthetic coding sequence
atggaagagatgagggactcttacctggaagaggatgtctaccaactgcaagagctgcgcagggagctggatagggctaataagaactgtcggatcctgcagtacaggcttcgaaaggctgagcagaagagcctgaaagtagctgagaccgggcaggttgacggagagctgattcgcagcttggagcaggacctgaaagtggccaaagacgtgtcagtgaggctgcaccacgaactgaaaacagtggaggagaagcgcgcaaaggcggaagatgagaacgaaaccctccgccagcaaatgatcgaagtggagatttccaagcaggccctgcaaaatgaactagagagactgaaggagtcatctttgaaaaggagaagtacccgggaaatgtacaaagaaaagaaaactttcaaccaggatgacagcgctgacctgcggtgccagttgcagttcgctaaagaagaggctttcttgatgagaaaaaaaatggccaagctagggagagaaaaggatgagctggaacaggagttacaaaagtacaagagcttgtatggggatgtcgatagccccctgcctacaggcgaagccggaggccctccaagcactagggaagcggagctcaagctgcgcctgaagctggtggaggaggaggctaacattcttggcagaaagatcgtggaactggaagtggagaacaggggcctgaaagccgagatggaggatatgagggggcagcaggaacgagaaggaccaggacgggaccacgcccctagcatcccaacaagcccgtttggtgattccctggaatcctccacagaacttcgacgtcacctccagtttgtggaagaggaggcagaactgctccgcaggtcgatctctgagatcgaggaccacaacagacagcttacacacgagctctctaagttcaagttcgagcccccaagggagccaggttggctgggggagggcgcaagccctggcgctggaggcggtgccccactgcaagaggaactgaagtccgccagattacagatcagcgaactgtctggtaaagtgctcaagctgcagcacgagaatcacgccctcctcagtaacatacagaggtgcgatctggctgcacacctcggcctcagagctccaagtccgagagattctgatgccgaatcggatgcaggaaaaaaggagtctgacggggaggagtcacggctccctcaaccaaagcgcgaaggcccagtgggcggagaatccgacagcgaggaaatgtttgaaaagacttccggcttcggatccggaaagccaagtgaagcaagcgagccttgccctacagagctgcttaaggcacgcgaggacagcgagtacctggtgacgctgaagcatgaagcccaacgtctggaacgtacggttgagaggctgattacagataccgacagcttcctgcatgacgccggtcttaggggcggagcaccgttgccgggacctgggctccagggggaggaggaacagggcgaaggagaccagcaagagccccagttgttggggactattaatgcaaaaatgaaggcattcaagaaagagctccaagcatttctggaacaggtaaaccgcattggcgacggactcagtcccttaccacaccttacagagagcagcagctttctgtcaactgtgacatccgtttccagagactccccaattggcaacctcgggaaagaactcggccctgatctccagagccgcctgaaggagcagttggagtggcagcttggccctgccagaggtgatgagcgtgaatccttacgtctgcgggcagcccgtgaactccataggcgagccgatggggatacgggatcccatggactcggaggacagacctgtttttctctggagctccggggtccacctgttctccccgaacaaagcgttagtattgaagagttacagggccagctggtgcaggcagcccgattgcatcaggaagagaccgagaccttcacaaataaaatccacaagatggaagaagaacacctctacgccctcaggtggaaagagttggaaatgcactccttagcccttcagaacacattacacgagcgtacctggtccgatgaaaagaacctcatgcagcaggagctgcgaagcctcaagcagaacatctttttgttctacgtgaagctgagatggctgttaaaacattggaggcaaggcaaacaaatggaggaggaaggggaagaatttactgagggcgaacatcccgagacactctctagattgggagagctgggggtgcagggcggacaccaggctgatggacccgaccatgacagtgatcgtggctgtggtttcccagtcggcgaacactcgccccatagccgggtacagatcggagatcactctctgcgactgcagactgctgaccggggacagccccacaaacaggtggtggagaaccaacagctcttctcagcttttaaagccctgctggaagattttagggccgaactgcgcgaggatgagagagctcgcctcagactacaacagcagtatgcctctgacaaggcggcttgggacgtagaatgggccgtgctgaaatgtcgtctagaacagttggaagaaaagactgaaaacaagctcggggagctggggagtagcgctgagtcaaagggagccctgaaaaaagaacgagaggtgcatcaaaagttgctggctgactcccacagccttgtaatggatttgcggtggcagattcatcattcagagaagaattggaatagggaaaaggtagagctgctggatcggctggatagagatcgacaggagtgggaacggcagaaaaaggagttcctgtggcgtattgaacagttgcaaaaggagaacagtccccgtcgcggaggctcctttctgtgcgatcaaaaggacggcaacgtaagaccgttcccccatcaggggagcctccgcatgccaagaccagtagccatgtggccgtgtgccgacgcggactcaatcccattcgaggaccggccactgagcaagctgaaggagtcagaccggtgcagcgcatctgaaaatctctacctggatgcactgtccctagatgacgagcctgaggagccccctgcacataggcccgaacgggagtttaggaaccgcttgcctgaggaagaggagaaccataaggggaatctgcaacgcgcagttagcgtgagtagtatgtctgaattccagagactcatggacatcagtccatttctgccagagaaggggctcccctctacatcatccaaggaggacgttacgcctccactgtcccccgatgatcttaaatatatagaggaatttaataagagctgggactatactcctaatcggggtcacaatggcggtggacccgacctttgggccgataggaccgaggtcgggagagctggtcacgaggacagcaccgaacccttccctgattcttcatggtatctgactacctctgtcaccatgaccaccgatacaatgacaagtccagaacactgtcagaaacagcccttgaggagccatgtgctcaccgaacagagcggactgagagtgctgcattcgccgccagccgtgcggagggtcgactccattactgccgcaggcggtgagggcccatttccaacttcccgcgcaaggggctcccctggtgataccaaggggggaccacctgagccaatgctgtccaggtggccttgcactagccccaggcattctagggattacgtcgagggagcccgaagaccactcgatagccccctgtgcactagcttgggcttcgcctcccccctacacagtctggaaatgtccaaaaacttgtctgacgatatgaaggaggttgctttcagtgtccggaacgcaatctgctctgggcctggagaactccaagtcaaagacatggcctgccaaacgaacggctcaagaacgatgggcacacagacagtacagacaatctccgttgggctacaaaccgaggccctccgcggtagcggggtaacctcgtcgccccacaaatgtttaactcctaaggcaggaggtggcgcaaccccagtcagttctccatctaggtcccttcgaagtaggcaagtcgcgccagcaattgaaaaagtgcaggccaagttcgagagaacatgttgcagcccaaagtacggttctccaaagttgcaacgaaagcctctccccaaggccgatcagcctaataataggacgtcacccggaatggcccagaagggatacagtgaatcagcgtgggcacggtccactacgacgagggaatcccccgtgcacaccacaatcaacgatgggctctcatccctattcaacattattgatcattcccctgtggtgcaggacccatttcagaaggggttgagggccggatccaggtccaggtccgctgaaccaaggccagaactcggccctggacaggaaacagggactaatagcaggggacggagtccaagtcccattggggtggggtcggagatgtgcagggaggagggaggcgagggtacccctgtgaaacaggatctcagtgcaccgccaggctacaccctgacggagaacgtggcacgcatactgaacaagaaattgctggagcacgcacttaaggaagagagacgccaggccgctcatggcccacccggtctacactcagatagccactctctgggcgacactgcagagcctggaccaatggagaaccaaacggtactgctgacagcaccatggggcctgtag

SEQ ID NO: 55087 - DNA, 4638 bp, Artificial Sequence
  Description of Artificial Sequence: Synthetic coding sequence
atggaggagatgcgtgactcctacctggaagaggatgtctaccaactccaggaactgcgcagagaacttgaccgggcaaataaaaattgcaggattctccagtaccgactgagaaaagccgaacaaaagtctctgaaggtggccgaaactggtcaggtggacggtgagctcatccggtcattggagcaagatttgaaagtggctaaggacgtgtccgtgcggctgcaccatgagctgaagaccgtcgaagagaagagagccaaggccgaagatgagaacgaaaccctgcgccagcagatgattgaagtggagatttcaaagcaggccctccagaatgagttggagcgcctgaaagagagctcgctcaaacgcaggagcaccagggaaatgtataaggagaaaaagacttttaaccaggacgactccgccgatcttaggtgccaactgcagtttgcaaaggaggaagctttcttgatgaggaagaagatggccaagttggggagagagaaggatgagctggagcaggagctgcagaagtataaaagtctttacggggatgtcgactcaccccttcccacaggagaggcaggcggaccgcctagcacacgggaagctgaattaaaactccggctgaagctcgttgaggaagaggcgaatattctgggaagaaagattgtggagctggaggtcgagaatcggggactgaaagcggagatggaagacatgagggggcaacaagaacgcgaaggaccaggtagggatcatgcccctagcatcccgacatcaccctttggagactctctggaatcatccactgagctgcgtcggcacctgcagtttgtggaggaggaagcagagctgctaagacgttcaatttccgagatcgaagaccataatcgtcagttgacccacgagctgagtaagttcaagtttgagcccccaagggagccaggctggttaggggagggggcttctccaggcgctggaggcggagcccctttgcaggaggaactcaagtccgcacggttgcagataagcgagctgagcggaaaggtcctaaaacttcaacatgaaaaccacgcactgctgtcaaacattcagaggtgtgacttggcagctcaccttggcctgagagccccatctccccgtgacagtgacgccgagtccgatgcgggaaaaaaggagagcgacggtgaagagtccaggctcccccagccaaagagggagggccctgtcggcggtgagtccgatagtgaggaaatgttcgagaaaacctcgggctttggatccggcaagccatcagaggcaagtgagccctgtccaacagaactgttgaaagccagggaggacagtgagtacctggtgactctgaagcacgaggcacagcggctagaacgcaccgttgagaggctgataacagataccgattcttttcttcatgacgccggtctccgcggtggcgctcccctccctggccctggtctgcagggcgaggaggagcaaggagagggcgaccagcaggagccccaactactaggcacaataaacgccaagatgaaggcctttaagaaggaactccaggcgtttttggagcaggtgaacaggataggcgacgggttaagtcctttgccccacttgaccgagtcgagcagtttcctatctaccgtgacttctgtcagccgggactctcctattggtaacctgggcaaagagctcggcccagacctgcaatctaggctgaaggagcaacttgagtggcagctagggccagcccgaggagatgagcgcgaatccctgagacttcgcgcagccagagaattgcacaggagggccgatggagataccggctctcatggacttgggggtcagacatgcttctcactggagatggaagaggagcatctgtacgcactcaggtggaaggagctggagatgcactccctggctttgcagaacactcttcacgaacgcacatggtcagacgagaagaatcttatgcagcaagaacttaggtccctgaagcagaatattttcttgttttacgtgaaactgcgatggctgttgaaacattggaggcagggcaagcagatggaggaggagggcgaggaatttaccgaaggtgagcatccggagacactgagtcggttaggggagctgggagtgcaaggtgggcatcaagctgatggccctgaccatgatagtgacaggggttgcggttttccggtgggcgaacactctccccatagccgggtacaaatcggcgatcatagccttaggttgcaaactgcagaccgcggtcagccccataagcaggtcgtggagaatcagcagctcttttctgcctttaaagcactgcttgaagatttccgtgctgaactacgggaagacgagcgagcacggctccggctgcagcagcagtatgccagtgataaggctgcgtgggacgtcgagtgggctgtgctgaaatgcagactagaacagcttgaggagaagacggaaaacaagttaggggagctcggaagcagtgctgagtcaaagggcgcacttaagaaggaacgggaagttcatcaaaagctactggcagactcacatagtctggtcatggatcttagatggcaaatccatcacagcgagaagaattggaaccgggaaaaggtagagcttctggatcgcctggacagggaccgacaggagtgggagagacagaagaaagagttcctatggcggatagagcagctccaaaaagagaactctcccagaaggggcggtagctttctgtgcgaccagaaggacggcaacgtaaggcccttcccgcaccagggctccctgcgtatgcctaggcccgtcgctatgtggccctgtgccgacgccgactctatccctttcgaggatcggcctctgtctaaactcaaggagtccgatcgatgcagcgcatctgagaacctgtatcttgatgccctcagcctagatgacgagcccgaagaacccccagcccaccgcccagagcgggagtttagaaaccgcctgcccgaagaagaagagaaccataaggggaacctccagagggctgttagtgtctcatccatgtcggagtttcagaggctcatggatatatcaccattcctaccggagaagggtctccctagtacaagctctaaggaggatgtcacacctccactctctccggacgatctaaagtacatagaggagttcaataaaagttgggactacaccccaaatcgtggtcacaacggcggaggacccgacctctgggccgacagaacggaagttggtagggctggccacgaagactccacggagcctttccccgacagctcatggtatcttaccaccagtgtcacgatgaccaccgatacaatgacaagccctgagcactgccaaaagcagcctttgcggtcccatgtgctcaccgaacaaagcggcctacgagtgcttcactccccacctgccgtgcggagagtcgactcaattactgcagctggtggcgagggaccttttcccacgtcgagagcaagggggtctccaggcgacaccaagggtggtcccccagagcccatgctcagccggtggccctgcactagccccaggcactcgcgcgactatgtggaaggggctagacgcccactggattcccctctctgtactagcctcggatttgcttctccactccacagcctggaaatgagcaagaatctaagcgacgatatgaaggaggtggccttttctgtaagaaatgctatatgcagcgggccaggggaactacaagtaaaagatatggcttgtcagactaatgggtctcggacaatgggcacacaaacagtgcagaccattagcgtcggactgcagaccgaagcactgcgcggaagtggagtgacttcctcaccacacaagtgtctcacacctaaggctgggggtggagcgacccccgtgagttccccttctcgttcactgaggtcacgccaggtcgcaccggcaatcgagaaggtgcaggccaaattcgaaaggacttgctgcagcccgaaatatggctctccaaagctgcagcgaaaaccattgccaaaagcagatcagccaaacaatcgcacctcacccggaatggcccagaagggatacagtgaatcagcatgggcaagaagtaccacgacaagagaatccccggtgcacactacaattaatgacggcctgagcagcttatttaatattatcgaccatagccccgttgttcaggacccttttcaaaaaggtctgagagcaggatctcgatcacgctccgctgagcctcggcctgagctaggaccagggcaggagacaggtacgaatagccgcggtcggtcgcctagtcccattggcgttggatctgaaatgtgtagggaggagggtggggaaggcactcctgtgaagcaggatctgagcgctccgccaggctacaccctgacggaaaacgtggcacgcattctcaacaagaagctattggagcacgctctgaaagaggaaagacgccaggctgctcacgggcctccaggtcttcactccgactcccatagtctgggagataccgcagagcctggtccaatggaaaaccagaccgtgctccttacagctccgtggggactgtag

SEQ ID NO: 55088 - DNA, 1320 bp, Artificial Sequence
  Description of Artificial Sequence: Synthetic coding sequence
atggctccaaaaaagaaacgaggcccatcagccggatcgcagcccggtggtgctgccgctgctggagcagaacagccacttagtgagagggctcaataccttcagagggaacatgcgttgttgtccgagcagctggatacatgtgaggagtcagtggaccaggttctgcgtgagaacgcctttctagaccgcgaagcactacgactgagagaagagaatagactatacgcaagctacgtgagcgcaagagctcagagatgcgctaaggcgatcgtgaggctcgacgagcagaatagggttgatctcgcccagatccactggcaacgcgctgaactcgcatccctgtatcatggcagagaggatggtgtacgcgcacaattactggagatggaggctcgagctgcccaaatggcccaacaggtgcaggaactccagccgtacaaagtacttcagctggaacaattagccagaatacgggctttggagcgggagcttttgcacatgcgggttgagcatactcagcttttgcacagggtcaaacggagatttctagaagacaaggcggcttttgagcgagaggcccgacagcgggttcagtctttagccaggcgcgctgaacgcgaggcggtgagggccctcgttgcacacacccaggccattaaggccgataacggtaggctgcggcaggagctcctcctgctcctcagaagaactcaattgctgcatcacactagacgtcagttacttgaacagcgagagcaactccaccgcgagcacgaagatactcgagacctcgctcgcgtgcatgggtggttgcgcagggggcctggcggacccccactgtgggagcgtccggcattctcacaacctacttctcgcccaggttcattggcagcacccatctctccttcccgggctgccagtcagactcctagcgtggtcccctctcgcgcagcaccccgagccagcagcgttgtcccctctagagaggccagcagggtcccttccttggtcttatccagcatggacagcagggtgccaagcttggctacctcaaaggttggtagccggatgcctagtttaaccgcctcacgggcaggcagccgggcactgtcgctggttcagagcctcgagggaagtggcatctccagcggcagttctcccagagtcagctcccaggataccctgagatcaacgaagtccggtccgaaactcttgtcaggcttatccagggatcgagaccccgctcttcttcctccacagtctgaagacagcgtgaacgctgaagcggctgctgaagcttcacctggaagagcctag

SEQ ID NO: 55089 - DNA, 7358 bp, Artificial Sequence
  Description of Artificial Sequence: Synthetic coding sequence
atggctcagatccaaaaggacaaagccaatatttccgaaaagtccgttatgcatcctgagtatatcgctgtcaaggctgagaaaagccctctctcccatatcctgaaaacaaaggaactgcaggtcaacattagccagcagggagagaaggctcaagaaggagaggtggagatcgtggtcttgttatcaaagacctgtccatttgttacctccagcgcttttcttgaactggatagcattaaggaggaggagggtgagccgagaattacacggtcattcatgcctcatctggagattcaagagagtttaccgtccaggcagacggcacccacaaaaccaacagagagcctggtcaaaaaagaaaagcaactcctgcctcaaaaggaagacagggtacagacagtatcaatgcatggcctgatgcacccaaatggtgccgtattcaaggccaagacttccgcacctccacaagtctttagcatcaccgagcactcccccctcagcaaacggaaggaaccacagtggggtatgaaagagagggcaggacagaagcaagaccgaaccggacggcctcacgtcattctgaccaagactcatcctttcatgccgtcactgtcgcatcatcgattcagcccttcacagccaaagcttcccatttcgtctggagcaggcaaatctcgtcttgcaaattccaatgaagggattagcagtcacaaggtcattttgaaagctaatcaacaaatgccatataaggaggccaaggatcgcgtcaaaatagaggggagagagggcaggattcttccaaaacgaatccacctgcgggctgaggccctccccctggctctgttgtgtaatggcaagaattactcccttcacatagaggagcagggtgagggggtgcaggaatctaagaaggagccaggcgttgtgcccagaaaatctgctagttttcctcctcctccattctaccttaattgtgatactcgtcgtaatgagaaggagggcacgcttggcaagacacagttcagcttcccaccattgaaaatacaggactctagcgactccgggaagaaggcctacaccgagtctctacatggatacaccttgagcaattccaaagggcctgtgcagcctacagcacaaggagaggaaaaagggggtttacgtatcgatatggaggacaaaatgctgccgaaatgtactgacctgaaggctaagcagctgctactgtcagatatactgaacacaaagaagcttcagtggaaatccaaagagcaaaaacggaaaatccaggaagacaagaataagcaggtcaaaggtctgccctcgatcaacacctctctgctgacacctccctacttgaaatttgacacaaccgagggtcaggagaatgtcatccgcatcgccaaagtctcgctgcctcaaagcaggagcaaagagtcaagcgacgcgggtagaatcgcctgtccggaggctacccacggagagctctcatcggacgttaagcagctaaaagctcaccttctgcaaaaggaagagaaagaccgggaaaaagtggccgacatgacctcagtgctggatcccaacaagatgtatcttaaagctaagaaaagcccggtgctgcatacacatagttttagcgacctccagtggaaaactcgagagcaggaggaagagaaagtgcagaaagtgaaatcggggcctggagtcatgctgagtaagagcccttcaaggtcatcccccctgcacctcaatgtgaacacaggctttcaagaagagtcaatcccgattctgacaaggccgagcttccccctagtcaagctccaggtgtccccagacaccgagggagggacctgcattaggcccatcgcaggcgatatactcatatatttacagaaagggaaacatgtctctcaaaacaaggaggaggatgatgttcaaattgtgtcaatactgatctttcccaagcatcaggaagagaaggtgcaagagtgcgagggcgaaccaggcgtagtgctgaccaagagcacaagcctgccttctctgtcccagctggagcttgacaaagaaacacacctggggaacgagatgctccgattgaagaggcctatcctaaggaggatttctcacattggtgaaacagttcacagggagtcagtggtgggagacattccaaaggatgttaaaaatgagaagcagcacattcctcagaaggaggagagaaatcagaaaaagataatcgatatgcgcggtacagatatcacactcaaaagtaagaaaagccccaggagttgtatgctccataggacagagctgcacgtaaatatcggaggtcaagggagaaaggaacacgaagggcaagacaaaccgcctggcatgatacaacggaagatgtgcatcttgttcagcaagcctttaccttctaacttgaagctagagcgcgctacccacgcagacgaggaacggctgggaggcaaaacatctttcgtcctaccactaatgccctctgccctccccgatactgaaaaaaccgcagacgctgaggcccgttcaggcgatgtacggaagggcaagccccacagatctcagaaagagaatcgacatgaggtgaaaacgattgatatgaggtttcgcatccattgccaggaagccagaatctctcccatgagccatatattaaatgccaaggagctggtcctaaatattaacaagctggaaaaaaaggtgcacaaggacaaggacgaagcttgcgtggtcctcagccgcacctttctctcaatcccaagcgctcctccactgtatcttgacagcggaaacaagactgacaaagacactcctggaattacaggttcttcatgccctcaaaggaccctccatgttccaagcaatacccaaaagatcacaaaccgggattccgtggaaggcgttgacaagaatgtagtcaaacaagccgagcagtacgttccacggcctgaagccgaacagcagctgacatccaacttcatgatcagtgtgcaacagaggaatcaaccctcacgcgtgagatccgaggaggaccttaaccagttggtgctgaacagccgggatgaggatatttatttcacaggatttgggaccatcagaagtggcaagagaccagaatggttgttcaccggaaaaaaagcacaacctgtaaagtacaaaaccgagaccttaactgcctttctttcatatcccactatggatgcaacaaagatgggaggcctggaagaggacaccgaaattatggataacttgaatcacaaaatctcccccaaggcaagcgtttcgctgatcagaaaaataagtaaggagttgtacgttactttgggaacgccagccaactcaaaagggttctccgtgtctgagagatacgcgcatcagcaagagacttcatccaaagtgtcccctgagctggcgggatcatgtaagtttgacaagcccaaggaagacggacagagcaacgaccgaatatctaaaatgttttcccctaaagtcttagcaccccaaacaaagggctcccttaagaagatctcaatcgtaaccaactggaacgcaccacagaatattgaggagcaagacatcgtgatgaagaagcaggtaataagaaggtgcgagcacggacacaagacgcggaccaacacaatcctcagtaagttccctctgcaatctggcaaacagaaaacgccttctgagactgatgttgataagaaaacaacggcccatctgtcactgcaaatgctacccggaatccacatggatatgactgagatcgatcccgctaaaggtggaaggaagcaggcactgctaatctccgagcaagaagagggagttctggaatttctcccgaagtctctatttcccccttggacttttcagttccagagcggggacttggaggagaagcaccaaacagatgctaatactaatataaatcttgaacaaaaaaagctcgagatggacaatgacagcacggtgaaccagaaggaaggaaagctgaagatcggcacaaacagagcgcttcaccttcaggaggaaaaaacagagatgcacaaagctcgaactgccaatttagaaaaagaaagaggcagaatggacaccagtagctctgcccatccccatttgctgagtctaaaggccgaagaaagtcagatgaagacacaggtcattacccatcgggaaaactccaggctgatcatgcagaagcagaagaaggagctggaggcctctaatgccaagcagagcattcaactccagaagcttttccaacggaacgtgttagatagcttctacagctatgtaccgctgagccctaagcgcaaggatcagaaaggccgtctgacaattcgcgatctaaagcgagagctttcaactaagtacctgactatgaagatccaaaaccaccccattcctcagatgctaaatatcacgggcagaggaaccccttccaatcgcaagaagctagagtacgacgtcaaactcaaaaacatcgcaagttggagcaaagacgtctcgggcatcttcattcggagcttatccatctccatcatgcgcagccctcacaccgaccctaaaacgaacctggagcgggagaagcgaatttgcttgcctaagtttcaggaaaagagcccaaacacaagtgagatgagcaagagagatactcttactattgtaaagggagaacaaaactttactaacacagtgccccaggatccccaacctttcgccgtcgataagcagcaaatgcaaaagctcccaaacgtgaaatcagaggctaatctccgttcagagatgaataagaaatatctgaaagcccaaaccaaagaacggatcgtgcctgagcatgacgtgtcccgcatcatcaagaaaccggacctccggattattgaacaagaagaaaaaatactgaaaaggatcctgacgccaacagagtgtccttctatgctggaggaccctaagttgcccaagcagcgtgatcagtcagagccggtttgggacatgactacccagaaggtgcaacagcagaaggccttccctgggacagtgcccattccccctcaggttaaaagcagtgaggttaaaatcgtggcagactcaaccaacgctgaacatctcctacctatctgtgaggccaccaaagctatcagtgagagccaggtcaaaaatatgatacaggacaaagtttcctccgacaagctggataacatccaagcgtacaagcccgatgacctcaaaagtcctccttttcctgagggtcctgacactataagtaccgccatatacccgaagacacagcataagtctctgctggagcagttcactccgaaggaaaagaataaactcacatcccatctggagtcaaaagccctggaaattcaactgaatctaatcccagagatggccagaaagagtctgcagatgttcaacttctatcctaaaggcacaatctccaaggataatagttggcgattttactctagacacaagaccatgaacttcatgagcttagagggcacagataccattgagcccaattctaaacacaaacaccagaaagattcacccttggctagtaacatgaagaccctcattgtggatgtgtcatcagatagtgaagagaccatcacaaaactccagtccattaacaaactcgaaaatgggacgagcgctgtgacgtctgcatcagaaatgctcttgccgcatacactgcagaaccacagcgttaaagaaaaaggaaagctgctgatgcacttttctgtcaagacactggaaatccagatgaaggccttccctagaatagttagggagtcttacgctatgacctctgctcatgagaggaaaaagcctctgagcaactgtatccatcctggttttactggaccgaagcggcaaaaccggattttgctgctctcagaggagaagtccttacatcagatcgacctggatctgcaatacaagtacctcagattcctactcgggctgccagtcgggagtaccttccctaagcctaatgtgcttcctaaacattccaaacttaatactattgcagtttgcaagaacgtgaacgcaggcggacagtccgggtccctgtcaattgacacggaactgcttgaacagcatatttcattcaagaagcaaagtccgcacgaaaatagtagcctcattagaaagttcccacagcccacattggtctgcgccagcgacagagacctgcacagtccaagaaaaaaggacacccaagtactgtctgaaagcgagtttcatgtgacccccgagaagaataagcagtatcacgtgtggttccaggagcgcaacacatgcgagtccgtggacctcagaacacagaggaacgccactggcagtgcggtgagctgtgagacccagatttcagaagattttgtggacattcagactgatatcgaatctccggctgatcttgacgaatgctcctgccttgaagttagtgaaagcgaggagtgcgttttcctggaggctaatagttacttgagccaggaatctgagaacatcctgtttgagcttcagaccggcatccctttggagaacgtttataagattacaacagatctgaagtccttctattccgaagatagcggaagtcactgcactagagaatgtcggaaagaaactttgatcatcaccccaccctcgtgtaaatcccataagagccgaaagtataggagttcctccaaaatgaagagtcccgactggctgtgtcattctagcagcaataccgctgagatccaaagtcgatcctcatccgtgtctttcagcgaggagaagatctcatggacaacaaaatcaagaacctcctattccagcgccccactgaccgagagtaatattaagagtcacctcgctaagaaccagggcaaatctcaccgccacccagaaagtcaggaacgtaagaaagcacgcagcgacttgtttcggaagaatagcagccattgggaccacgattactcttgcactcattcaaaaggtaaacgtgatagaaagaagcgtgtctatgattacgagtctgagaggctggattgctttcagtcaaagcacaaatccgcttccaaaccccaccatgacgacatcaatttctattcagagcgcaagcaaaatcggccatttttctttgcatgcgttcctgccgacagtctggaagttatccccaagactatccgttggaccatcccaccagaaaccttgcgaaaacgcaactttcggattcccttagtggcgaaaatttcctcttcatggaacatctggagctcttccaaaaagttgttaggctcactgagcgggtctttgactaccgtgtttcactctta

SEQ ID NO: 55090 - DNA, 645 bp, Artificial Sequence
  Description of Artificial Sequence: Synthetic coding sequence
atgaaggaagaaaggaattataactttgatggggtgtctaccaatcgcctcaaacagcaactgctggaagaggtccgtaaaaaagacgccgtgcagctatctatattcgagcttaggcataaaataacggaactggaggccaaactcaatactgataacgagggttccgaatggaaaaccagatacgagacacagctcgaactcaatgacgaactcgagaagcagatcgtgtaccttaaggaaaaggtggaaaaaattcacgggaacagttcggaccgattgtcaagtattagggtatacgagcggatgcctgtagagagcctgaacactctgctgaaacaactcgaggaggagaagaaaaccctagaaagtcaggtaaagtactacgccctgaaactcgagcaggagtcaaaagcgtaccaaaagatcaacaacgagcgtcgcacttatctggctgagatgagccaaggatctggactgcaccaggtgtccaagcgacagcaggtggatcagcttccgcgtatgcaggagaatctggttaagactggcaggtacaaccctgcgaaacagaagaccgtaagtgcgaaacgaggaccggtcaagaagatcaccaggccaaatcacctgccggagctgcacccttag

SEQ ID NO: 55091 - DNA, 426 bp, Artificial Sequence
  Description of Artificial Sequence: Synthetic coding sequence
atggagacattacaggagagtctgaacacgcttctgaaacaactggaagaagaaaagaaaacactggagagccaggttaaatattacgctctcaagctcgaacaggagagcaaagcctaccagaaaattaacaatgagcgcagaacctacttagccgagatgtcgcaggggtccggcttgcatcaggtgtcaaagagacaacaggtcgaccagttgccccgaatgcaggaaaatctggtcaaaaccttgctcctgaaggaggaattggatcctctaaaggtgtcgtgtctcgaaacacttggcttctccgccgcaggggtggccggtccagaaaaccggacgtgtctcgggcagaaggcactgtggccagcttgtcttcacggatctagcaccttagctgtgtgccagacacatctgaagagctag

SEQ ID NO: 55092 - DNA, 339 bp, Artificial Sequence
  Description of Artificial Sequence: Synthetic coding sequence
atgccggttgagtccctcaataccctgcttaagcagctcgaggaagaaaagaagacattggaatcgcaggtgaagtactatgctctgaagctcgaacaagagagcaaggcttaccagaagatcaataatgagaggagaacttatctcgctgagatgagccagggcagcggcctgcaccaggtatcaaagcgccagcaggtggatcagttgccacgaatgcaggaaaaccttgtcaaaactggaagatacaacccggcaaaacagaagacagtgagtgcaaagcggggtcccgtgaagaaaattaccagaccgaaccatctgccggaactgcatccatag

SEQ ID NO: 55093 - DNA, 420 bp, Artificial Sequence
  Description of Artificial Sequence: Synthetic coding sequence
atgcctgtggagtctctgaacacccttctcaaacaactggaagaggagaagaaaactttggagtcccaagtgaagtactatgcactgaagctcgaacaggagtctaaggcttaccaaaagataaacaacgagcgacgcacctatctagcggaaatgtctcagggctccggcctgcaccaagtgtccaaacgccagcaggtggatcagttaccacggatgcaagaaaatctggtaaagactctgttattgaaagaagaactcgatccgttaaaggtatcatgtctcgagactctcggcttttctgccgctggggtggccggacctgagaaccgcacatgtttgggtcaaaaggcactgtggccggcatgcttgcacgggagttccactctcgctgtgtgtcagactcaccttaagtcttag

SEQ ID NO: 55094 - DNA, 420 bp, Artificial Sequence
  Description of Artificial Sequence: Synthetic coding sequence
atgccagtcgaatccttgaacacgctgctgaagcagctggaagaagaaaagaaaactctcgagtcacaggtgaaatactacgcgctcaagcttgagcaggagtccaaggcataccagaagatcaataacgaacgaagaacctatctagcagagatgtcgcagggctcaggcctgcaccaggtgtcaaagcgccagcaggtagaccaactaccgaggatgcaggagaacctggtgaagaccctccttctcaaagaggaactggacccactaaaagtgtcttgcctcgagactcttggtttcagcgccgcaggtgtggcaggccctgaaaaccgaacctgcttaggacagaaggcgctctggcccgcatgtctgcacgggagtagcactttggcagtgtgtcagacgcacctgaagtcctag

SEQ ID NO: 55095 - DNA, 339 bp, Artificial Sequence
  Description of Artificial Sequence: Synthetic coding sequence
atgcccgttgagagcctgaacactctgcttaagcagctggaggaggagaagaagacccttgagtctcaggtgaagtattatgccctcaaactcgaacaggaatcgaaggcctaccaaaagattaacaacgagagaagaacatacctggccgagatgagccaggggagcgggctgcaccaggtctctaagaggcaacaggtagaccagttgccacgtatgcaagaaaacctagtcaagacagggagatacaaccctgcaaaacagaagaccgtgtccgccaagcgcggaccagtgaagaaaattaccaggcctaatcatctgccagagctgcatccctag

SEQ ID NO: 55096 - DNA, 726 bp, Artificial Sequence
  Description of Artificial Sequence: Synthetic coding sequence
atgaaggaagagcgcaactacaactttgacggcgtgtctaccaaccgcttgaagcagcagctcctagaagaggttagaaagaaagacgccgtacaacttagcattttcgaactgagacacaagatcactgaattggaggcaaagctgaatactgacaacgaggggtcagagtggaaaacccgttacgaaactcagctggagttgaacgatgagctggagaagcagatcgtgtacctcaaggaaaaggtggaaaagatccatggaaacagcagcgaccggcttagctccattagagtgtacgagcgaatgcccgtcgagagtttgaataccttgttgaaacagttggaagaggaaaagaaaaccctggagtctcaggtcaaatactatgctcttaagttggagcaggagagcaaagcataccaaaagatcaacaacgaaaggcggacctatctagccgaaatgtctcagggtagcgggctacaccaagtaagcaagcgacaacaggtagatcagcttcctcgaatgcaggagaacctcgtgaagactctcctgcttaaagaggaattggacccgctcaaagtgagttgcctggaaacgctgggtttttccgcagctggcgtggccggtcccgagaatcggacctgtctaggtcagaaggctctatggcccgcttgtctccatgggagtagtacacttgccgtttgtcaaacccacctcaaaagctag

SEQ ID NO: 55097 - DNA, 1773 bp, Artificial Sequence
  Description of Artificial Sequence: Synthetic coding sequence
atggattcacactctggggagccagccttactcccttgcgggacctgtgacatggtgtttcggtcttccgccttgctggcaacccatacacagaggttctgcatcggacatcccacccaggagatgaccttcggcgctcaggcaagcgtggcaaccgagcctcagagagccgcagtgcagtggctgaggctctccctccaggaaatgagaccctggataacagaagttcctcgcgtctttgctggcccatggactcgtagcgaggctcggccacagtctccaatgtctgaggcggtcgggtccccctccgagagactccgggcactgttcaggactagagctcgcagagtggccgagatggaagctcagagcagagctctgcaactgcggggtgaggagttatcaaggcggttgcaggtcgtggcttgtacccggggaggaatgtctcgattatttggcctggagcaggagattagagagctgcaagccgaggccggtaggactcgcggtgctctggaggttttgggcgcacgaatccaagaattgcaggccgagcctggaaacccgctttcatctcgcagagaggctgaactgtactctcctgttcagaaagcgaatccaggcaccctggccgcagagattcgtgccctccgcgaagcttacatcagggacggcggacgtgaccccggtgtcctggggcagatctggcaactgcaggttgaggcaagcgcccttgagctccagcgttcgcagacccgcagaggtcgcgctggtgccacttccggggagctacccgtggtggaggcagagaacaggcgcctggaagccgaaattctggctttacagatgcagaggggcagagccccactcgggcctcaagacctaaggctcctgggggatgcaagcttgcagcctaagggcaggagagaccctcctctgttacctcctcccgtggcacctccactacctccacttcctggtttcagcgagccccaactgccaggcaccatgacccgaaatctgggtctggattctcacttcttgttgcctacctccgatatgctcggccctgccccttacgatccgggagctggcctggtgatcttttacgattttttgagagggctggaagcttcttggatttgggtgcagctgaggacgggccttgctcgggatggacgagacacagggaggaccaccgccctgccgcctgctttgtgtttgccaccccctcccgctcccggaccaatgggaaattgcgcaatcctggcctctcgccagcccgttcctagactccctcctagcagttcagtttccctcgtgtgcgaactgcaggtatggcagggtcttgcctgggcgagagcgcctcagcctaaggcctgggtgtcattgggcctgtttgatcaggaccagcgggtgttatctggccgatggcggctacctctgcgcgctctcccactagatccttccttatccttagggcagcttaatggtatcccacaggccggacaggctgaactgtttcttcggcttgtcaacgcccgagatgctgcggtccagaccttggccgaaatcaacccagcctctgtccacgagtatcagtacccaccaccggtttcctccacaagctccctggaagccagctttctgaccccagctgtcggattcgccgaccccccacctcggacagaggaacctttgagcggggtaaaagaccgtgatgaaggattaggcccacatcacagttccgatttgcctcctgtgagtttttag

SEQ ID NO: 55098 - DNA, 333 bp, Artificial Sequence
  Description of Artificial Sequence: Synthetic coding sequence
atggattcgcatagcggcgagcctgctctgctcccttgcggaacctgcgacatggtatttcgcagttcagcactgctcgcaacacacacgcagcggttttgtatcgggcatccgactcaagaaatgacctttggggctcaggcctccgtggctactgagccccaaagggctgccgtctcctcaacctctagcttagaggcttcttttttgacccctgccgtgggtttcgcagacccacctccaaggacagaggaaccgctgagcggtgttaaggacagggacgagggactgggacctcaccacagctccgacctgccacctgtgtccttttag

SEQ ID NO: 55099 - DNA, 1842 bp, Artificial Sequence
  Description of Artificial Sequence: Synthetic coding sequence
atggacagtcactcaggggaacctgctctgctcccttgcggcacttgtgatatggtctttagaagctcggcccttctggccactcatactcagagattttgcatcggccaccccacacaggaaatgacattcggtgcccaggcgagcgtcgctacagagccccaacgagccgcagttgtgccacaagagcaccaaggcgtgccccaggagccccagggcctccccgaccagcaggctagtagaagtgccctcaagcgactgactgaagaggaaatgcgcccttggataacggaggtccctagggtgtttgcagggccttggaccagatcagaggcacgaccacaatctcctatgtcggaggctgtgggttctccttcggaacgcctgcgggcactgtttaggacccgtgcgcgaagagtggccgaaatggaggcgcagtctcgcgcactgcaactgcgaggcgaggagttaagtaggcggctccaggttgtggcctgtacgcgcggaggcatgtcacggctctttggcctcgaacaagagattcgtgagttacaggccgaggccggtcggacaaggggggcactggaagttctgggcgcaaggatccaggaactgcaggccgagcccggaaatcccctatcctctcgccgtgaggccgaactgtacagccccgtgcagaaggccaatcccggtacgctcgcagctgagatccgcgcactgagagaagcatatattcgcgatggtgggcgagaccccggagttctcggtcagatttggcagttacaggttgaagcctctgccctggaactgcaaaggagccagacacgcaggggacgagccggagctaccagcggcgagctccctgttgtggaggctgagaaccgcaggctcgaggcagagatcctggcgctgcagatgcagcgtggcagagccccactgggcccacaagatctccggcttctgggagatgccagtctgcaacctaaggggcgacgcgatcccccactgctgcctccacctgtcgcgccacctctcccacccctgcctggattcagcgaaccgcaactccctggcaccatgacaagaaatttgggcctggactctcattttctcctgcccacctctgacatgctggggccagcaccctacgatcctggggctggactggtgatcttctacgattttctacgtggattggaagcctcttggatctgggtccagctacgaactggtcttgcccgtgacggcagagacacagggcgaaccaccgctctgccacccgctctgtgcttgccaccccctcccgctcccggacccatgggcaattgtgccatcctggcttcaaggcagcctgtcccccgactcccgccttcgtccagcgtctctctggtttgtgaattacaggtgtggcagggcctcgcttgggctcgtgctccacagcctaaagcctgggtatctctggggttgttcgatcaggaccagagagtgctgtcagggcgatggcgactgccgctccgcgcactgcccctggaccccagtttgtcactgggccagttgaacggcattccacaggccggacaggccgagctctttctcagactagtgaacgctagggacgccgctgtgcaaaccctcgccgaaatcaaccccgcttccgtgcacgaataccagtaccccccaccagtgtccagtacctctagcctagaggcttcttttttgacgcccgctgtaggattcgccgaccccccaccgagaaccgaggagcccctgtcaggggttaaagaccgcgacgaggggctgggaccccatcacagcagcgatttaccgccagtttctttttag

SEQ ID NO: 55100 - DNA, 1869 bp, Artificial Sequence
  Description of Artificial Sequence: Synthetic coding sequence
atggattcccattctggagaaccggctcttctcccttgtggcacctgtgatatggtgttccggtcaagcgccctgcttgccactcatactcagcgcttctgcatcggccatccaacccaggagatgaccttcggcgctcaagcctcagtggccactgaaccccagagagccgctgtggtcccgcaggagcaccagggagtgccacaagagcctcagggcctccccgatcagcaggcatcccggtcagccttgaagcgcctcacggaggaggtacagtggctgaggctgtccttacaggagatgcgcccatggatcaccgaggtcccccgtgtatttgccggtccctggaccaggtccgaggccaggccccaaagcccaatgtccgaggctgtgggatcaccttcagagaggctccgcgctttgttcaggacccgcgctcgccgagtggcagaaatggaagcccagagccgcgctctgcagctgcgtggagaggaattaagccgcagactgcaggtggtggcctgcacgaggggtggcatgagcaggctttttgggctcgaacaggaaattagagagttgcaagccgaagctggtaggacgaggggcgcactggaggtgctgggcgctagaatccaggagctgcaggcggagccaggcaacccattgagctcaagaagagaagctgaactctactcacctgtgcagaaggccaacccgggtacgcttgcggctgaaatccgcgctctccgggaggcctacatccgcgatgggggacgagaccccggtgtgctgggccagatatggcagctgcaagtggaggcatctgcccttgagctgcagagatcacagactcggaggggtcgagccggtgccacctccggggagctgccagtcgtggaggctgagaacaggcggctggaggccgagatcctggctcttcaaatgcagagagggagggctccattgggcccacaagaccttcgcctactcggagacgcctctctgcaaccaaaaggacggagagaccctccacttctcccccctcccgtcgccccacctctcccacccctgccaggattttccgagccacagttgcctggaaccatgacccgtaatctgggcttagactcccactttctgttgcccacctctgacatgttgggtccagcgccttatgatcctggagcgggattagtgatattctatgacttcctgcgtggcttagaggcatcctggatttgggtacagctcaggaccggattggcgcgagacggacgggataccggacgcaccacggcacttccaccagccctttgtcttccaccacccccagccccaggcccaatgggaaattgcgctatcttggctagccgtcagcccgtacccagacttccccctagctcctccgtctccctggtctgcgagctccaggtgtggcaaggcttggcctgggctcgggctcctcagccgaaagcttgggtgagcctgggcctattcgatcaggatcagagggttctctctggcaggtggcggttgcctctccgagctctgcccctggatcctagcttgagtttaggacaactgaatggaatcccacaagctggccaagccgaactctttctgcggttggtgaatgccagggatgctgcagtgcagacactggccgaaatcaatcctgcctctgttcatgagtatcagtatcctcctccggtaagctccacctcctcccttgaggccagcttcttaacccccgcagtggggttcgctgaccctcctcccagaacggaagaacccttgtcgggcgtcaaggatagggacgagggccttgggcctcatcacagctcagatctgccgcctgtgagcttttag

SEQ ID NO: 55101 - DNA, 852 bp, Artificial Sequence
  Description of Artificial Sequence: Synthetic coding sequence
atgaaaaaggacgaggcactcaaagctttgcaaaatcaggttagcgaggaaacaataaaggtccggcaactggattccgccctggagatttgcaaggaagaactggtcctacatcttaaccaactcgaaggtaataaggaaaagttcgagaaacagcttaaaaagaagagcgaggaagtctactgcctacaaaaagaattgaaaattaaaaatcactcactgcaggagacatccgagcagaatgtgattctccagcacaccttgcagcagcagcaacagatgttgcagcaagaaacaatccggaacggagagctagaagatacacagactaaactggagaagcaggtcagcaagctcgagcaggaactgcagaaacaaagagaaagctcggctgagaaactacgaaagatggaggagaaatgtgagtcggcggctcatgaagccgatctcaaaagacagaaggtgatcgaactcaccggcacggcccgacaagtgaagatcgagatggatcagtataaggaggagctgagcaagatggagaaggagattatgcacctgaagagggacggcgaaaacaaagcaatgcatctttcacagttggacatgattctggaccagaccaagacagagttagaaaagaaaaccaatgctgtcaaagaactcgaaaagctgcagcactccaccgagactgaactgacagaggccaagaacggcaaatatctgcggactaccaaatgctcttggagaatcaagaagtacttcaaaactacgcctggcatagaacgctgcaccaccgagggatctattatcatccgaggaaagatccattactataagggctcccatagttag

SEQ ID NO: 55102 - DNA, 2412 bp, Artificial Sequence
  Description of Artificial Sequence: Synthetic coding sequence
atggtgattgaaaaggaacaatccttacaggagtctaaggaagagtgcatcaaacttaaggttgacttgttggagcaaactaaacagggaaaacgagccgaacgccagcgcaacgaggcactgtacaacgcagaagaattatctaaagcttttcagcagtacaagaagaaagtcgcagaaaagctcgagaaagtacaggccgaagaggaaattctggagcgtaatcttacgaattgcgaaaaggaaaacaaaaggctccaagagagatgcggactgtacaaaagcgagctggagattctcaaggaaaagctcaggcagctgaaagaggagaataacaatggtaaggagaaacttcgcatcatggctgtcaaaaactccgaggttatggcccagctgaccgagtcaagacaatcaatccttaagttagagagcgagctcgagaacaaggacgagatcttgcgtgataaatttagcttgatgaatgagaatcgggaactgaaggtacgtgtggccgcacagaatgagcggctggacttgtgtcaacaagagatcgaatccagccgcgtcgagctgcgaagccttgagaagatcatctctcagctgccactgaaacgggagttatttggtttcaagtcgtacttgtccaaataccaaatgagttccttcagtaacaaagaggataggtgtattggctgctgtgaggccaacaagctcgtaatttcggagctgaggatcaagctggccattaaggaagccgaaatccagaagctccacgctaatctcacagccaatcagctgtctcagagcctgattacatgcaatgactctcaagagagctccaaactgagttctttggaaacggaacctgtgaaactgggcggtcaccaagtggccgagtctgtgaaggaccagaatcagcataccatgaataaacagtacgagaaggaaaggcagaggttggttacaggcattgaagagctgcggaccaaactcatccagatagaagcagagaacagtgatcttaaggtgaatatggcccatcgcacctctcagttccagttgatccaggaggaacttctggaaaaggcctccaattcatcaaagctcgagagtgaaatgactaagaaatgttcccagttgcttactctggagaagcagctagaagagaaaattgtcgcctactccagtattgcagccaagaacgccgaattggagcaggagttaatgcttgaggcccagttagagaagaaagaccagcagtttaaagaacaagaaaaaacgatgtctatgctgcagcaggacattatatgcaagcagcaccacttggagagtcttgacaggctcctcacagaatctaaaggggagatgaagaaagagaatatgaagaaagacgaggcgctgaaagcccttcagaaccaagtctctgaagagaccattaaagtccgccaattggactccgcacttgagatatgcaaggaagagcttgtgctccatctgaatcagctggagggtaacaaagagaagtttgagaagcagcttaagaagaagtctgaagaggtctactgcctccagaaggagctaaagatcaaaaatcacagcctgcaagaaacatccgaacagaatgtgatcctgcagcacaccctgcagcaacagcagcagatgctacagcaggagacaattagaaacggagagctcgaagacactcaaactaagttagaaaagcaggtctcaaagctcgagcaggaactgcagaagcaaagagagtcatcagccgagaagctgcgtaagatggaggagaaatgcgaatccgctgcccatgaagcggatctaaaaagacagaaggttattgagctcacaggcaccgctcgacaggtcaagattgagatggaccagtataaagaggaactcagtaagatggaaaaagagataatgcatttgaagcgtgatggggagaataaagcaatgcatctcagccaactggatatgatcctggatcagaccaagacagagctggagaaaaagactaatgcagtcaaagaactggagaaactgcagcacagcacggagaccgaactcaccgaggctctgcagaaacgagaggttttggagacagagcttcagaatgcccatggagaactgaagtctaccttgcggcaactccaggaactgcgcgatgtgctgcagaaggcccaactaagcttggaggagaaatacacaaccataaaagatctgactgctgaactgcgggaatgcaaaatggagatcgaggataagaagcaggagctgttggagatggaccaggccctcaaggagagaaattgggaattaaagcagcgggctgctcaggtaacccacctggacatgactatcagagaacaccgtggagagatggagcaaaaaattatcaagtag

SEQ ID NO: 55103 - DNA, 3900 bp, Artificial Sequence
  Description of Artificial Sequence: Synthetic coding sequence
atggagagctcatcatcagactactacaacaaagataacgaggaggaatcacttttagcaaacgtggcaagcttacgccacgagctgaagatcacagagtggtccctccaaagccttggcgaagagctctctagcgtgtctccatctgaaaattctgactacgcacccaatccctcacggtcagaaaaactgattctggatgtgcaaccttcacatcctggcctcttaaactatagcccatacgaaaatgtttgtaaaatctctgggtcatccacagactttcagaagaagccgagagacaagatgttttcctcaagcgcgccagtagaccaggagatcaaatctctgagagaaaagctgaacaaattacgccaacagaacgcatgtctggttactcagaaccactccctgatgaccaagttcgaaagcatccatttcgagctcacacaatcccgggcaaaggtgtccatgcttgaatctgcacagcagcaggcagcatcagtgcccatcctggaagagcagataataaatcttgaggcagaagtctctgcccaggacaaggtgctccgggaagctgagaataaactcgaacagagccaaaagatggtaattgagaaagaacagagcttacaggagagcaaggaggagtgtatcaaactgaaggttgatctgctggaacagactaagcagggcaaacgggctgagagacagcggaacgaggctctgtacaacgccgaagaactctccaaggcctttcagcagtataaaaagaaggtggccgaaaagctcgagaaagtccaagctgaagaagagatcctcgaaaggaatctaacaaactgcgagaaagaaaataaaagactgcaggagcggtgtggactgtataagagcgaattggagattctcaaggagaaactccgccaactgaaggaagagaataataatggcaaagaaaagctccggatcatggctgtgaagaattccgaggtcatggcccagctaacagagtcccgccagagtatcctcaagttagagtccgagcttgaaaataaggatgagattctgcgcgataagtttagcttaatgaatgaaaaccgggagctgaaggtcagagttgccgcacagaatgaacgacttgatctctgtcaacaggagatcgagtcctccagagttgagttgaggtcactcgaaaaaataatttctcaactaccgctgaagcgcgagttattcggattcaagtcgtatcttagtaaataccaaatgagctcattctcaaacaaagaagacaggtgtatcgggtgttgtgaagcgaataaactggttatttctgagcttcggatcaagttggctattaaagaagctgagatccaaaaactgcatgctaatctcaccgcgaatcagttgagccagagtcttataacctgcaacgatagtcaggaatcttctaagctgtcctctttggagacagaaccagtcaagctgggtgggcatcaggttgcagagtctgtgaaagatcaaaaccagcacaccatgaacaaacagtatgaaaaggaacgtcagcggctcgtgactggaatagaggagctgaggacaaaactgattcagattgaggctgagaacagcgacctaaaagtcaatatggcacaccgcaccagtcaatttcagctgattcaagaggagcttctcgaaaaagcatctaatagctccaaactggagtctgagatgaccaagaaatgctctcagttgttaacactggagaaacagctggaagagaagatcgtggcgtactcttcgatcgctgcgaaaaacgctgagttagaacaggagctgatggaaaaaaacgaaaagattcgaagcttagagacgaatatcaacaccgagcacgagaagatttgtttggctttcgagaaggccaagaagatccatctcgagcaacacaaggagatggagaaacagattgaaagattagaagcacaactcgagaaaaaggaccaacaattcaaagaacaggaaaagacaatgtcaatgttgcagcaggacattatatgcaaacagcatcatctcgagagcctggaccgattgctgacagagagcaagggggaaatgaagaaagaaaacatgaagaaggacgaggcactcaaggcgttacagaaccaggtaagcgaggagaccatcaaggtgagacagctagattccgctctggaaatttgtaaagaagaactagtgttacacctgaatcagctcgaggggaataaggaaaagtttgaaaaacagctgaagaagaagtcagaggaggtttattgtttgcagaaggaactgaaaatcaagaaccatagtctccaggagaccagcgaacaaaatgtcatactacagcatacacttcagcagcagcagcagatgctacagcaggagactatccggaatggcgagcttgaggatacccagaccaagctagaaaagcaggtcagtaagctcgagcaggagctgcagaagcagagagagtcatctgctgaaaagctgcgtaaaatggaagagaagtgtgagtcagctgctcacgaggccgacctgaagcggcaaaaggttatcgaactgaccggaaccgcacgccaggttaagatagaaatggaccaatacaaggaagagttaagtaaaatggagaaagaaattatgcatctcaaacgtgacggcgagaacaaagccatgcacctcagccagctcgatatgattctggatcaaactaagactgaactcgagaaaaaaacaaacgcggttaaggagctggagaagctgcagcacagcacggagaccgagctcacggaagccttgcagaagagggaagtcctggagactgagcttcagaacgcacatggtgagttgaaatccacactgaggcagctgcaagagctgcgtgatgtcttgcaaaaggctcagctgagtctcgaagaaaagtacactactataaaggacctaaccgctgaactccgcgaatgtaagatggaaatcgaagacaagaagcaagagctgttggagatggaccaggccctgaaagaacgaaattgggaactgaaacaacgggcagcgcaggtgacccacctggatatgacaatcagagagcaccgcggagagatggagcagaagattattaagctcgaaggaacgctggagaaaagcgaactggagctgaaagagtgcaacaaacagatcgagtcccttaacgataaattgcaaaatgctaaggagcagctacgcgagaaggaattcatcatgctgcagaatgaacaggagatctcccagctgaagaaagagatcgagagaacccagcagagaatgaaggaaatggagtcggtgatgaaagaacaggaacagtacatcgccactcagtacaaagaggcaatcgacttgggacaagagctccgcctgactcgtgagcaggttcagaactctcacacagagctcgctgaagctagacaccagcaggttcaggcccaaagagaaatcgaaaggctgtcttctgagttagaggatatgaagcaactgagtaaggaaaaggacgcacacggtaatcacctcgccgaggagctgggggcttctaaagtgagagaggctcatttggaggcacggatgcaggccgaaattaaaaaactctcggcagaggtggaatcactgaaggaggcctaccatatggagatgattagccatcaagaaaatcacgctaagtggaaaatctcggctgactctcagaagagctccgtccagcagcttaatgagcagttggagaaagccaagctagaactagaggaagcccaggatacagtatctaatctccatcagcaggtgcaggatcggaacgaggtaatcgaggcggcaaacgaggctctcctgactaagggagaaaacgtctag

SEQ ID NO: 55104 - DNA, 4254 bp, Artificial Sequence
  Description of Artificial Sequence: Synthetic coding sequence
atggcctccccaaccaatggacaccacggtggtaactgcggcaaatgctctcccggaagggctcccctggtcggatctggggctctggctgatcatgatcctaggcaagcacccaggctacggagacgcctgactcaatccgcacccggaaggggctctgatagagtgggcgcaagtcagaggttaccacgcagattcgaattctgtgcggctggggtccggtggttctcagaactgtgcccacgccttccacgtgcaggagccagggaaagggttagaggcttcctcacacaaacacgtgtgaggagcgcgcagagccccggaggcagcttgccaagcgacgacctcggcgagatggagagctctagttctgattactacaataaggataacgaggaagaaagcctcctggctaacgtggcatcccttaggcacgaactgaaaatcactgaatggagcctgcagagcctgggtgaggagctctcttctgtgtctccgtctgaaaacagtgactatgcaccaaatccgtccagatccgagaagctcatcttagacgttcagccatctcatccgggtttactgaactattccccctacgaaaacgtctgcaagattagtggctccagtaccgactttcaaaagaaaccccgagataagatgttctcctcgagcgcccctgtggaccaagagatcaagtctttgcgggagaagctgaataagttacggcagcagaacgcgtgcctcgtgactcagaatcactccttaatgaccaagttcgagtccatacatttcgagcttacccagagtcgggcaaaagtatctatgctggagtcagcgcagcagcaagctgcatctgtgccgattctcgaggaacagataatcaatttggaagccgaggtgtcggcacaggacaaggtgctgagggaggctgagaataagctggaacaatcccaaaagatggttatcgaaaaagaacagagcctgcaggaatcaaaggaggagtgtataaaattaaaagtcgatctcctggaacagactaagcagggaaagcgagccgagcggcagcgtaacgaagcgttgtataatgctgaggaactgtctaaggcattccaacagtacaagaagaaggttgccgagaaactcgagaaggtccaagccgaggaggagatcctggagcggaatttaactaattgtgaaaaagaaaacaaacggcttcaggagcggtgcggtctgtataagagcgaactcgagattctgaaagagaaactcaggcagctgaaggaggagaataacaatgggaaggagaagcttagaattatggccgttaagaactcagaggtgatggcccagctcacggaaagcagacagtccattctgaaattggagtcggagctagagaacaaggacgaaattctgcgtgataaattctccctcatgaacgagaaccgcgaactcaaagtgcgtgtcgccgctcagaatgaacggctggacctgtgtcagcaggagatcgagtcttccagggtggaacttaggtctcttgagaaaatcattagccaactccccctcaagagggaactgttcggatttaagtcttatttaagcaaatatcagatgagtagtttctcaaataaggaggaccggtgcattggctgctgtgaagccaataagctcgtcatctctgaactccggattaaactggctattaaggaagccgaaatccaaaagctgcacgccaacttgacggccaatcagctttcacaaagtcttatcacctgtaacgattcgcaagagtcatctaagctctcttccctcgagaccgagccggtcaagctggggggtcatcaggtggccgaatctgtgaaggatcagaatcagcataccatgaataagcagtacgaaaaggaacgccagaggctggtaactggtatcgaagagctcagaacaaagctcattcagatcgaggctgagaacagcgaccttaaagtgaatatggcccaccgcacaagtcagttccagctgatccaggaggaactactcgagaaagccagcaattcgtccaaattggaaagtgagatgactaagaagtgctctcaattgttgacgcttgaaaaacagctggaagagaagattgtggcctattcgagcatcgctgccaagaatgcagaactcgagcaggagctgatggaaaagaacgaaaaaattcgtagcctagaaacgaatatcaatacagagcacgagaagatctgcctagccttcgagaaagccaagaaaatccacctcgagcaacacaaggaaatggagaagcagatcgagcgcctggaggctcaacttgagaaaaaggaccaacagttcaaagaacaggagaaaactatgtccatgctgcagcaggatattatctgcaaacaacaccacctcgagtctttagaccgattgcttactgagagcaagggagaaatgaaaaaagagaatatgaaaaaggacgaggctctgaaggcgttgcagaaccaggtgagcgaagagacaattaaggtacgccagcttgactcagcactcgaaatctgtaaggaggagctggtgctacacttgaaccaactggaaggaaataaggaaaaattcgagaagcagctgaaaaagaaaagcgaggaggtgtactgccttcaaaaggaattgaaaatcaagaatcattccctgcaagaaacaagtgaacagaacgtcatcctacagcatacgctgcaacaacagcaacagatgttgcagcaagaaaccattagaaacggggaactggaagacacacagaccaagctggagaaacaggtatccaaactggagcaggagctccagaaacagcgcgaaagttccgccgagaaactccggaaaatggaagagaagtgtgaaagcgctgcccacgaggccgacctgaagcgtcagaaggtcatcgaactgaccggcacggctcgacaggtcaaaatcgaaatggaccagtataaggaagaactcagtaagatggagaaagagattatgcacctgaaacgcgatggcgaaaataaggccatgcacctgtctcagctggacatgatcctggaccagactaaaaccgagctcgaaaaaaagaccaacgccgtgaaagaattggagaagctacagcacagcacagagaccgagctgaccgaagctttgcagaaaagagaggtgctggagacggaattgcaaaatgcacatggcgagctcaagtcaacactgaggcaacttcaggaactgcgcgatgttctacagaaagcccagctgtcacttgaggaaaaatatacgactatcaaggacctaactgcagagttgcgagaatgtaaaatggagatagaggataagaagcaggagctcctggagatggaccaggcactcaaagaaagaaactgggagttgaagcagagagcggcacaggtgacccatctggatatgacaatccgtgagcataggggcgagatggagcaaaaaataataaagcttgagggtacattagaaaagagtgaactggaactgaaggaatgtaataaacagattgagagccttaacgacaagcttcagaatgccaaggaacagttaagagagaaggaattcattatgctgcagaacgagcaggaaattagccagctcaaaaaggagatcgagagaacacagcagcggatgaaggaaatggaatctgtgatgaaagagcaggagcaatacatagccacccagtacaaagaagccatcgacctcggccaagagctgaggttgacccgcgagcaagtgcagaactcccacacagagctggccgaagcgagacaccagcaggtgcaggctcagcgagagattgagcggctatctagcgagttggaagacatgaaacagctgtcaaaagaaaaagatgctcacggtaaccatttggcggaagaactcggcgctagtaaggtcagggaggcgcatctagaagccagaatgcaagcggagataaagaaactgtctgccgaagtcgagtccttaaaggaagcatatcacatggaaatgatcagtcatcaggaaaaccacgctaaatggaagatctctgccgattctcaaaagtctagtgtccaacagctcaatgagcagttggaaaaggcaaaattggagctcgaggaagcccaggacactgtgtccaacttgcaccagcaggtccaagaccgtaacgaggtaatcgaagccgcaaacgaggcccttctgaccaagggcgagaacgtctag

SEQ ID NO: 55105 - DNA, 201 bp, Artificial Sequence
  Description of Artificial Sequence: Synthetic coding sequence
atggatccccctgccaggaaagagaaaacgaaggtgaaagaatccgtgtcccgggtagagaaagccaaacagaagagcgcacagcaagaactgaaacagcggcagagggctgagatatatgccctgaaccgggttatgactgagctcgagcagcagcaattcgacgagttctgcaaacaaatgcagccccctggtgaatag

SEQ ID NO: 55106 - DNA, 201 bp, Artificial Sequence
  Description of Artificial Sequence: Synthetic coding sequence
atggatcctcctgccagaaaggaaaaaactaaagtgaaagaaagcgtttccagggttgaaaaggctaagcagaagtccgcacagcaggagctgaagcagcgtcagcgggctgaaatttatgcccttaatagagtcatgacagagctggaacagcagcagttcgatgaattctgcaaacagatgcagccccctggagaatag

SEQ ID NO: 55107 - DNA, 201 bp, Artificial Sequence
  Description of Artificial Sequence: Synthetic coding sequence
atggacccgccagcacgcaaagaaaaaacaaaggtaaaagaatcggtgagtcgtgtagagaaggcaaagcagaagtctgctcagcaagagctgaaacagagacaacgagctgagatatatgccctcaacagagtcatgacggagctggagcaacaacagttcgacgagttttgtaagcaaatgcaaccaccaggggagtag

SEQ ID NO: 55108 - DNA, 924 bp, Artificial Sequence
  Description of Artificial Sequence: Synthetic coding sequence
atgctgcgacactctccctccttatgggaactggtggaagagcacgttccactgcgcgagagacgcgaggtaaagcggattctgggcgaggcagcggtggacctctctctggagctgcgggcagaggttgccatgctgcgagccctgctgcaggaggccagatcttctcaggcaccctcttcgaggcccatctccgacccctcatccctgttagccccaccccctctcctcaaggatctgttacgtcaagagctcaggcagctgttacagggcctgagacacaaggctatctgcgaaggcagggaccaggcccaagcctgggtgcagtattcaccacgagtccttcacttcgcactggaggaacccaggtgcgaccttccggaacaggagatttttcaaatgcgcggaggcggaccctcctcgggacatcgagatcttagcattataaaggaccagcttaatgtgtctaatatcgatcaggtagcacgacaccttaggggcctgctggaggaggagtgccacaccctggagcgggagattctcattctgcaacgctgccttgaggaggaatacctgagaccgtgccacccgagcgaggccgcactggaaccaacactcgccgagctgaaagagcaaaagaaggcaatggagcaggaattgcaggcctctgtggggccatcttgcgtgtctccgaaccaccgccaacggccacttggatcatccactcaggggctgcgaccaccacttcccctgtgcggagtagcccctctccagtgctgtcttccagccccaccgcttgagccatacctcaggcctcgtggacagtccgcgacccacaggtggggtaggcagctccagtgttccccacgggaggggcctgcatccacacctatgtcttccgcagcacctcaagcccctgcttag

SEQ ID NO: 55109 - DNA, 627 bp, Artificial Sequence
  Description of Artificial Sequence: Synthetic coding sequence
atggttttctatttcacttctagctccgtgaatagttcggcttacaccatttacatgggcaaagacaagtatgagaacgaggacttgataaagcacgggtggccagaagacatatggtttcatgtagataaactaagcagcgcccatgtgtatctgaggctacacaagggtgagaacatcgaagatatccccaaggaggtgctgatggactgtgctcacctagtgaaagccaattctatccagggttgtaaaatgaataatgttaatgtcgtttacaccccctggtcgaacttaaaaaagactgccgacatggatgtagggcaaattggcttccacagacagaaggacgttaaaatcgtgacagttgagaagaaggttaatgaaatcttgaaccgattagagaagaccaaggtcgaaagatttcctgaccttgccgcagaaaaggaatgcagagacagggaggaaaggaatgagaaaaaggcccagatacaggagatgaaaaaaagggagaaggaagaaatgaagaagaagagggagatggacgagctcaggagctattccagcctgatgaaggtggaaaacatgtccagcaaccaggacggaaatgactccgatgaattcatgtag

SEQ ID NO: 55110 - DNA, 423 bp, Artificial Sequence
  Description of Artificial Sequence: Synthetic coding sequence
atggactgcgcccaccttgttaaggctaactcgatccaggggtgcaagatgaacaatgttaacgtggtctatacaccgtggtcaaacctaaagaagacagcggatatggacgtaggacagatcggatttcaccgccagaaggacgtgaaaatcgtgaccgtcgaaaaaaaggtcaacgagattctcaaccggttagagaagaccaaagtggaaagattccccgatctggcagccgagaaagagtgtagggatagggaggaacggaatgagaaaaaagcacaaatccaggaaatgaagaaacgggagaaagaggagatgaagaagaagagggaaatggacgagcttcgctcttactcatctctcatgaaagtggaaaacatgtcctccaaccaagacggaaatgatagcgatgaattcatgtag

SEQ ID NO: 55111 - DNA, 1971 bp, Artificial Sequence
  Description of Artificial Sequence: Synthetic coding sequence
atgtttgaggccatatttccctctaccccccaagccaggttgaagcgcgaccctagagaaaagccgggactgagctcatttagatccacattccgacagcagtcaagcctgggactgtgcatccctcgtctgatgctccccaaggaagcatcccccagtcaaaggcatagtagtatgtctagcagcatggcacgggcactggttctgcttcagtctatggcctcacgcgatgctcggtgccccgagtggaagcctcaccagaaacctagaaccctgtctaagagcgtgcagactatatcccggtactaccgcaagacttcggaaccaaaggacgctgcgtccctcaccggtttcatgtccaagatggaattgaggcgagtgttccctactcaccctgactgcccccagtttagcactcgtgctacgagcatgtcccactgtggctcgcctacagaagccgatctctccggcgagatcgacaactcttctgagacctggagggggactcaggacttgtttctcgcccgaagagggagcgatactaacgttgacgggtatctcttgcccttcagtaaatccatatgcgaatttgattacctgaggaagaggagaaaaagccagaccctgagtcccgttacctcctcatcagttgcttctcagagctgtctccggaagagaatgccctggtacctgagtgtgatacacgagaaagatcactgtctttctgagctggaaatccaagtgcaaaagaaggatgaggaaattctgctcttgcaggaagaacgagaggccctgaagatgcagctgaaatgtctcctaaagggcaaggggcaggagacctcgatgtctccagggcgacgggagcagcttagcgacgccagccttaaactcggccgactcagtctgctaaaggctttttccaggcatgaggaggagctccagcactggtggcagatgcaggaagagtccgccgctccggagaggggaaaagagcccgacctgggaggaggagaagaggacgaaggtctcgagggcgaacctgacggcgtggaagatactggagcctggggaggcgtcagccagatgggaagcgtgcatgaagaagggtccgaagaagaggaggaagaagagggggaccgggatgaggatagtgaggaacgagagctacccgaggaggaggagataccaaggcgacgtgcttccagccttgctgaaagctttgaagaagagctgttagcacagctggaggaatacgaacaggtgatactggatttccagttcaatctggaggccacaaggacccggtactcattagctacaggcgttatcgccagtctccagcaacaggtcgacttccaggaaactcagttacgaaagattaataccgagaacgagaccctccagaaagagttgcgggagagacgacagcaattgcaggcaatgactgataagttttccaatctgagagaagataagaagcatcaggagatgatgggcctcatcgaaaaagataaccagctcctgaggcagcaggtcagcgagctagagcggaaactgactaagcgcgactgtgtgatttctgaactggatacaaaggtgtcccaactccaggaacaggtcgagcttgatcagaatcacttgcagcggtggaagcagttgcaggaagacctgcagtccaagaaggagatgatacagcaggccgagcagcacactcgggtagccctggaatcctctcaatctagactggagcggcttaggaacaagattatccaggccactttttctattagcgggacaaagagcttagccaatgaaatttccgacaatgacatcctggaggcactacagcgtataatttctgagcggtcagactattataaccaactgaagcagaaaggcgtcaaggttccacccttgcaacagtcagaagccttcctgacatctaagagcaaaaaaggtacctccaaatag

SEQ ID NO: 55112 - DNA, 486 bp, Artificial Sequence
  Description of Artificial Sequence: Synthetic coding sequence
atgcccaagaacgcaatccctgtgtccaaatccacggggttctctaatccagcatcacaatccaccagccaacgaccaaaacttaagcgcgtcatgaaagagaaaacaaagccccaggggggagaggggaagggcgcacagtcaactcctatccagcattccttcttaacagacgtgagtgacgtacaggagatggagcgaggcctgcttagtctactgaatgactttcacagcgggaagctgcaagcctttggcaatgagtgttctatcgaacaaatggaacacgtgagaggaatgcaggaaaaactcgccaggctgaatttggagttgtatggcgagttggaggagctcccagaagacaaacggaaaacagcttcagatagtaacctggaccggctgctatcagatcttgaggaactgaactcctccatccagaagctgcatctggccgatgcacaggatgtgcccaacacgagcgcctcttag

SEQ ID NO: 55113 - DNA, 825 bp, Artificial Sequence
  Description of Artificial Sequence: Synthetic coding sequence
atgccccgagccgaacctcgcgcaacattgggggaacaggagaaggctgggctcccccttggagcctggaggctgtacttgcttagacactttcgcaagcagacggagctgcgacggtccggtagtcgggatgtcaccggcgctcttttagtggccgctgctgtagcctcggaagctgtcggatccctgcgagttgcggaggggggaccaaacaccctcctgttacaggtgctgagaagctggccgtggtgcaacaaggagctaaaaacaatggaggagcggaaggtgaagcgccgttcccccaaatccttctccgctcactgcacacaggttgtgaacgccaagaagaatgcaattccagtttccaaatcaactggcttctccaaccctgcctctcagagtacaagccagaggcctaaattgaagcgtgtgatgaaggaaaaaacaaagccacaggggggagaggggaagggagctcaaagcaccccgattcaacactcctttttgactgacgtatcggacgttcaggaaatggagagaggactactgagcctgctcaacgatttccactccggtaagctgcaggctttcggaaacgagtgtagcatcgaacagatggaacatgtgcgagggatgcaggagaaactcgcccgactaaatctagagttgtacggggagctggaggaacttcccgaagacaaacggaagaccgcatcagattctaacctcgacaggctgttgtcagatttagaggagctgaattcaagcattcagaaactacacctggccgatgcccaggatgtgccaaatacttccgcttcttag

SEQ ID NO: 55114 - DNA, 2352 bp, Artificial Sequence
  Description of Artificial Sequence: Synthetic coding sequence
atgagccaggaaaagaacgaaatgtttgagagtgagtggtccaaggagcgcgagagagaaaaacagcttgcatcaggtcttgacacggccgagaaagcactgaaagtagaatccgaagaactgcagaagtcaaagtctgaactgatatgtctgtacaacgaagtccataacctccctggagaatctgaaagcaaggaccatttccttattgcctgtgacctgctgcagcgagagaactccgagttggaaacaaaggtgctgaaactgtcccaagagttcgcccaactgaaccatttcacactcggtggcaagacagctcctagcaacctgatcacatcagagaatacatgtaaggacccagagtcaaatgagcctatactggaaacagaaattcagtctcgcaaagaagaaactgaggagctctgtcccaagcttggcgaaagaaaacaaaaggagatccctgaagaatccgtgaaagaaggaagcttccctcgggaaggacaaaaagaagagggatcccaacaaaacagggatatgaaggacgaggaaaaagaacaacagttaacgatgaagccagaggagattgtccgtctgagagaagagctgtcccatatcaaccagagcctcctgcagtcacagtccagcggagacagcagtgatgattcaggagcccagcaccccagtagtggtgagaagctcaaatacaaccagcagggcgaagtgcagcagcttcaccaaaatctgcacaggcttcagatactgtgcaactcagccgaaaacgagctccgctatgaaagaggccagaacttggatctgaagcaacacaattccttattgcaggaggagaatattaaaatcaaaatcgaattgaaacacgctcagcaaaaactgttagattctaccaagatgtgttcatctctaaccgccgagtataaacactgccagcagaaaattaaagaactcgaacttgaggtactgaagcatactcagtctataaaatcccagaataatctacaggaaaagctggttcaggaaaaatcgaaagtcgctgatgctgaggaaaagatcctggatctgcagagaaagctagaacacgcacataaagtttgcctgacggacacttgtatttctgagaagcagcagctggaagagaagatcaaggaggctactcagaacgaggcaaaagttaaacaacaataccaggaagagcagcagaagcgcaaactgctgtatcagaatgtcgacgagctccaccggcaggttagaacactacaggataaggagaacctcttggaaatgacctgctcacagcagcagtcccgcattcagcagcaggaggccctcctcaagcagcttgagaacgagaaacggaagtacgacgagcatgtgaaatccaaccaagaactgtctgagaaactgtccaagttgcagcaggagaaagaagctttgagggaagagtacctcagattgcttaagcttttgaacgtccacgttcgaaattataacgagaaacaccatcaacagaaggttaagcttcagaaggtgaagtatagactaacaaacgaggtggagctgagagataagcgcattaaccagtttgaagacgaaatcgggattctgcaacataagatagagaaggagaaggccatccaagaccaaattacagcccagaacgacacattactactggaaaagaggaagttgcaggaacaggtgatcgagcaggaacagctcatccattctaataaatggacaatctcctccatacagagtagagttctgtatatggacaaggaaaataaacagctgcaggaaaattctcttaggctgacacagcagattggattcctcgagaggattatccggtctattcatattcgaaggggtgaaaacctgaaggaattcccagttcccaagtggtggcaccggggtaagctggcgtcccttccaccaacgaaaaagcagaaagaaatctactccacagaagtattcacatccaacaatgccgagctccagcatgaggacgagtccgtgccggaggctacagagaaatggaagcacagtgaacagatggaaactacgatcagcgacattctggaatctgaagtagtgaacgaaattttgcccctgtctaacagctcatttagtggcaagggtctagttgaaagcttcgcgagcttgcaggagactgaagagattaaaagcaaagaggccatggcaagttccaagtctcctgaaaagtcacctgagaatctcgtttgctctcagaactccgaggcaggctatataaacgtggctagcctcaaggaaacacacggcatccaggaacaagaccagaagagcgagctttag

SEQ ID NO: 55115 - DNA, 2352 bp, Artificial Sequence
  Description of Artificial Sequence: Synthetic coding sequence
atgagccaagaaaagaacgagatgttcgaaagtgagtggtccaaagagagagagagagagaagcagttggcgtccggactggatactgcggaaaaagcactgaaggttgaatcagaggaactccaaaagtccaaaagtgaactgatatgcctttacaatgaggtgcacaacctgcctggagagtctgaatccaaagatcactttctgattgcctgtgatctgctccagagagaaaacagcgagctggaaacaaaggtgttaaagctctcccaggaatttgctcagttgaatcacttcaccttgggcggtaaaaccgctcctagcaacctgatcacttccgaaaacacttgtaaagacccagagtctaacgaaccgattctggaaacagagattcagtccaggaaggaagagaccgaagagctatgccctaaactgggagagcgtaaacagaaggagatcccagaggaatccgtaaaagagggaagctttcctagggagggccagaaggaggagggatcacagcaaaaccgcgacatgaaggatgaggagaaggaacagcaactgaccatgaagccggaagagatagtgcgactcagggaggagctgtctcacattaaccagtcactgcttcaaagccagagtagcggggactcttccgacgattccggagcgcagcatccttcttccggtgagaagctgaagtacaaccagcagggtgaggttcaacagctccatcaaaacctgcataggctgcagatcttgtgcaactcggccgaaaacgagctaagatacgagcggggacagaatctcgatctgaaacagcataattctcttctgcaggaggaaaacattaagatcaagatcgaactgaaacatgctcagcagaagttgctggacagtaccaagatgtgttcatcacttaccgccgagtataagcactgccagcagaagatcaaggagctcgaactggaggtgttgaagcacacccagagcatcaaaagccaaaacaacctccaagagaaacttgttcaggagaagagtaaagttgctgacgcagaggaaaaaatattagacctgcagaggaaactggagcacgctcataaagtgtgtcttactgacacctgcatctcggaaaaacagcaactggaggaaaaaattaaagaagcgacccagaacgaagctaaagtgaaacagcagtatcaggaggaacagcagaagcgcaagcttctgtatcaaaacgtggatgagctgcaccggcaggtgcggaccctgcaggacaaggagaacctgctcgaaatgacatgctcacagcagcaatcgagaatccaacagcaggaggcccttctcaagcagcttgaaaatgagaaacgaaagtacgacgaacacgtcaaaagcaaccaggagctctctgagaagctcagcaaactgcagcaagagaaagaggcactacgcgaagagtatctgagactgctaaagctcttgaatgtgcatgtgagaaactacaacgagaaacatcatcagcaaaaagtcaagctacagaaggtgaagtacaggctaactaacgaggtggagctaagagataagcgcatcaaccagttcgaggatgaaatcggcatactgcagcataagattgaaaaggagaaggcaattcaggaccagattacagcacaaaacgacactctactcctggagaaacgtaaattacaggagcaggtgatcgaacaggagcagctcatccactcaaacaagtggacaatatcatccatacaatcccgagtgctttatatggacaaggaaaataagcagttacaggagaactccctgcgactgacccagcagattggttttctggagcgcattattaggtctattcacatccggagaggagagaacttaaaggaatttcccgtccccaagtggtggcacagaggcaagctggccagtctaccacctactaaaaagcagaaggagatctatagtaccgaggtctttacctcgaataatgccgaactccagcacgaagacgagagtgttccagaagctaccgagaagtggaagcatagcgaacaaatggagaccactatctctgatatcctggagtcagaggtcgtgaacgaaattctgccactgagtaactccagtttctccggaaagggactggtcgaatcgttcgcgtctttacaagagactgaagagatcaagtccaaagaagctatggcctcctccaaaagccctgagaagtctccagagaacctcgtctgcagccagaattctgaagcaggatacattaatgtcgcctcattgaaagagacgcacggaatccaagagcaggatcaaaagagcgaattatag

SEQ ID NO: 55116 - DNA, 1719 bp, Artificial Sequence
  Description of Artificial Sequence: Synthetic coding sequence
atgatccaccccccaaggccccctaaagtgctgggtctgcagcatccaagcagtggagaaaagctcaaatataatcagcaaggtgaggttcagcagctgcatcagaacctccaccggctgcagattttgtgcaattccgctgagaacgaactgcggtatgagagaggccagaacctggacctcaagcagcacaacagtcttctccaggaggagaatattaagatcaaaatcgagctgaagcacgcccagcagaaacttctcgattcaaccaagatgtgctcctccctgaccgccgaatacaagcactgccagcagaagattaaggagctggaactggaggtgctcaagcacacgcagagcatcaaatcacagaataatttacaagagaaactggttcaggagaaatctaaggtcgccgacgccgaggaaaaaatcttagacctgcagcgcaagctggaacacgctcacaaggtgtgccttaccgatacgtgtatatcagaaaagcagcagctcgaagagaaaataaaggaggctacacagaacgaggccaaagttaaacagcagtaccaggaggagcaacagaagcgcaagctcctctaccagaacgtggatgaactccaccggcaagtcagaacgctgcaggataaagaaaacctcttggagatgacatgcagccagcagcaaagtcgaatccagcaacaggaggctcttctaaagcagttagagaacgagaaacgaaaatacgatgaacatgtgaaatcaaatcaggaactttcagagaaactcagcaaactgcagcaggagaaagaggccctccgagaggaatatttaagattgctcaaattgcttaacgtgcacgtgagaaactataatgaaaaacatcatcaacaaaaggtcaagctgcagaaggtgaaatatagacttacaaacgaagttgagctgagagataagcggatcaaccaattcgaggacgagatcggtatcttacagcacaagatcgaaaaggagaaggccatccaggatcagataactgcacagaacgacaccctcttgctcgagaagagaaaactgcaggaacaagtcattgaacaggagcagctgatacactccaacaaatggactataagcagtatccagagccgagtcttgtacatggacaaggagaacaaacagcttcaggagaactccctgcggctgacacagcaaatcgggtttctggaacgtatcattagatccatccacatcagacgcggtgaaaatctgaaagaatttcctgtgcctaagtggtggcacaggggaaaattggcaagcttgcctcccacaaaaaagcagaaggaaatctactccactgaggtttttacatctaacaatgccgagttacaacacgaagatgagtccgtaccagaggccaccgagaaatggaagcattccgaacagatggagactaccatctctgacatcttggaatcggaagttgtcaacgaaatcctgccactgtctaattcctccttctctgggaagggactggtggagtcttttgcctccctccaggagactgaggaaatcaaaagtaaggaagctatggctagcagtaaaagtcctgagaagtctcctgagaacctcgtgtgtagtcagaatagtgaggccggttatattaacgtggcctcactgaaagaaacccatggtattcaggaacaggatcagaaatccgagctgtag

SEQ ID NO: 55117 - DNA, 2352 bp, Artificial Sequence
  Description of Artificial Sequence: Synthetic coding sequence
atgtcccaggagaaaaatgaaatgtttgagagcgaatggtctaaagagagagagcgggagaagcagctggccagcgggctcgacacggcagagaaagcactgaaagttgaaagcgaagaactccaaaaatctaaatccgaactcatctgcctgtacaacgaagtgcataaccttccgggtgaatccgaaagcaaagaccactttttgatcgcatgtgacttgctgcagagggagaattctgagctcgaaaccaaagtgctgaaactgtctcaggagttcgcgcagctgaatcactttacactcgggggaaagaccgctccgagcaacctcatcacaagcgagaacacctgcaaggatcccgaatccaatgagccaatcctggaaacagagattcagagtcgtaaggaggagaccgaggagctgtgtccaaagctgggcgagcgcaagcagaaggagattcctgaagagtcagtgaaagagggatcatttcccagggagggccaaaaagaggagggatcccagcagaatagggatatgaaggacgaggaaaaggaacagcaactcacaatgaaaccagaagagatcgttagactccgtgaagaactaagccacataaatcagtcccttctccaatctcaatcctcaggtgattcatcagatgattctggtgcacagcatcccagttccggtgagaaattgaagtataatcagcaaggagaggtgcagcagctgcatcagaacctccatcgcctgcagatcctatgcaactccgcagaaaacgagctgcgctatgagagaggtcagaatctggatctgaagcagcataattccctgttgcaggaagaaaatattaagattaagattgaactgaagcacgcacagcagaagttacttgactccacgaagatgtgcagttccctgaccgctgagtacaagcattgccagcagaagataaaggagttggagctggaggtcctgaagcacacgcaaagcataaaaagccaaaacaaccttcaggaaaaacttgtgcaagagaagtcaaaagttgctgacgcagaggagaagatactagatcttcagcggaagctagagcatgcccacaaggtgtgcttgaccgatacttgtatttccgagaagcaacaactggaagagaagattaaagaggccacccagaacgaagcgaaagtaaaacaacagtaccaagaagaacagcagaaacggaagctgctgtaccagaatgtagacgaactccacagacaagttcgaaccctgcaggacaaagaaaatctccttgagatgacatgcagccagcagcagtcaaggatacagcagcaggaagccctcctgaaacagcttgagaacgagaaacgcaaatacgacgagcacgtgaagtcaaatcaggagctatctgaaaaactgtccaagttgcagcaggaaaaagaggcactcagggaggaatatctccggcttctgaagttgttgaatgtgcatgtgcgaaattataatgagaaacatcaccagcaaaaagttaagctccagaaggtgaagtaccgtcttaccaacgaggtagaacttcgtgacaagcgcatcaatcagtttgaagatgagatcggaattctccagcataagatcgaaaaggaaaaggcaatccaagaccaaattaccgctcagaacgacactcttctcctcgaaaagagaaagctgcaggagcaggttatagaacaggagcagttgatccacagcaataagtggaccatttcctctatccagtcccgggtgttgtatatggataaagaaaacaagcagctccaggagaactctctaaggctgactcagcagatcggattcctggaacgtattatccgcagtatccatattaggcggggagagaacctgaaggagttccccgtgccaaagtggtggcaccgtggcaaactggccagcctgccgcctactaagaagcagaaagaaatctattcgaccgaggttttcacgtcaaataacgccgagctccagcatgaggacgagtccgtgcccgaggccacagagaaatggaagcactctgagcaaatggagaccaccatctctgatatactggaatcagaagtggtgaatgagatcctgcctctctcgaatagtagtttctcagggaaaggactggttgaatcctttgcgtccctacaagaaacagaggagataaagagcaaggaagccatggccagcagtaagtcccccgaaaaatcacctgaaaaccttgtatgttctcagaacagcgaggcgggttacatcaacgtagctagccttaaagaaactcatggaattcaggaacaggatcagaaaagtgaactgtag

SEQ ID NO: 55118 - DNA, 120 bp, Artificial Sequence
  Description of Artificial Sequence: Synthetic coding sequence
atgtcacaggaaaagaatgagatgttcgagagtgaatggtccaaagaacgagagcgggaaaaacaattggcgtcgggcctcgacacagctgagaaagcgctcaaagttgagagtgagtag

SEQ ID NO: 55119 - DNA, 1104 bp, Artificial Sequence
  Description of Artificial Sequence: Synthetic coding sequence
atgggtgaaccaggcccaccttcacctcccgcacccaaggcagcacctggccttattgatagtttctcagaaatgaataactacagacgggcaatgcagaagatggccgaggacatcctctcgctgcggagacaggcttcaatacttgagggcgagaaccgcattctgagatcccggttagctcagcaggaagaggaggaaggacagggcaaagcctccgaagcccagaacaccgtgtcaatgaagcagaagcttcttctgtccgaactggatatgaagaaactcagggaccgggtgcagcacctccagaatgaactgattcgtaagaacgacagagagaaagaacttctgctgctctatcaagcacagcagcctcaggccgctctccttaaacagtaccagggaaagctgcagaagatgaaagccctagaagagacagttcgccaccaagaaaaggtgatcgagaagatggaaagagtgctggaggaccggctgcaagaccgttcgaagccacctcctctcaaccgccagcagggaaaaccatatacgggctttcccatgctctccgccagtgggctgcccctggggagcatgggcgaaaacttacctgtggagctgtattctgtgctgctcgccgagaacgccaaactgaggaccgaacttgacaaaaacaggcaccaacaggctcccataatcctccagcagcaagccttgcctgtcgatcctggcgaacttggtgcaggtggcgacctgactgagcggttacaggagacccacgggccaggccattccgagtgtacggaaaccctccccgcacaggatttgttgagcggcacttcggacaagtttaacctactggccaagctagagcatgcccagagccgaatcctttccttggagagccagctggaggacagtgcgcgaagatggggtcgcgaaaagcaggatctcgccacacggctgcaggaacaggagaaaggatttaggcatcctagcaacagtatcattatagagcagcccgtgtctgacccgcctggcgtggcccctagggggtctggtggaggtgcaggatcccaccgcactcctaaggtcacaggcccatag

SEQ ID NO: 55120 - DNA, 3072 bp, Artificial Sequence
  Description of Artificial Sequence: Synthetic coding sequence
atggccttcagagggcctgaaccgtgggtgtccgcgtcgctgcttagacagaggctgaaagcggaggagaaaacactcgacttggagtttgaggtcctgtctgtcggcttcaatgaagccggtcgctatgccttacgcctcagtgcagagaaccccttgcaggtgggaagcggggcaggagttcagctgcaggtaaacgatggcgacccttttcctgcctgtagcgccatcactgatgtgattgaacaacaggagcctgggcagtcactgactctcacacgcagcaaatttatcttcactctcccgaaaggattttgcaaaaacgatggccagcacgatgcacagcttcacgtggaagctctaaggctggatgagcccttaggcagggccgcacagcgagtgggggaggccattttccctatttaccctcggccagatcaaccaagaatgaacccaaaggctcaggatcatgaagatctgtataggtattgcgggaacctggccctactccgagcaagcacagatcctactgctcggcattgtgggtccttggcttactctgtggctttccatgtgcatagggggcctcagccacctgtttccgattccccaccaagggctggacaaccagagttaattagtccagaggaacccctgatcgcaagccaaagtactgagccggagatcgggcatctgagtccatcaaagaaggagacaataatggttacacttcacggggctacaaacttgccagcctgcaaggacgggtctgagccatggccatacgtagtcgttaaatccactagcgaagaaaagaataatcaaagctcaaaagcagttacctccgtgactagcgagcctaccagggcacccatatggggtgacacagtgaatgtcgagattcaagcagaggatgccggacaggaagatgtgatactgaaggtggtcgataacaggaaaaaacaggagttgttgtcatataagattccaatcaaatatctgcgtgtctttcacccttaccattttgagttggttaaacctacggaatccggaaaagccgatgaggctacagcaaaaacccagttatacgccaccgttgtcaggaaaagcagttttattccaaggtacatcggctgtaatcatatggctctggagatatttttgcggggtgtgaatgaaccattagctaataaccctaatcccatcgttgtgatagctcgtgtggttcctaactataaggaattcaaagtaagccaagcaaaccgtgacctcgcatccgtgggtctgcctattaccccattatccttccccatcccctctatgatgaatttcgatgtgccacgggtgtcgcagaacggttgtccacagctgtctaagccgggtggtccacctgaacagccactgtggaaccagagctttttgtttcagggacgtgacggggctacatcgttctcagaggacacagcactggtcttagagtactatagcagcacttccatgaaaggcagtcaaccttggacgctgaatcagccattggggatatctgttctacctcttaaatcacgtctgtatcagaaaatgctgaccggtaagggtcttgacgggctgcatgtcgagcgcttgcccatcatggatacgtcacttaagaccatcaatgatgaggcacccacggtggctctgagcttccagctcctcagctccgaaaggcccgagaattttctgacacctaataactcaaaggccctgccgaccctggatcctaagatcttggacaagaagctcaggaccatccaggagtcctggtcaaaggatacagtctcatcaaccatggatctgagcacctcaactccacgggaagccgaggaagagcctcttgtgccagaaatgagccatgacaccgaaatgaacaactaccggagggcaatgcagaagatggctgaggatatcctgtctttacgtaggcaggcatctattcttgagggagagaatcggattttaagaagcaggttggcccagcaagaggaagaggaaggccaagggaaggcttctgaagcccagaacaccgtatctatgaaacagaaactgctgctctccgaactggacatgaagaagctgagagacagggtacaacatctgcagaacgagttgatcagaaagaacgacagagagaaagaactgttgcttctttatcaggctcagcaaccacaagcagcgctcctaaaacaataccaggggaagctgcagaagatgaaggcccttgaggagacagtacgacatcaagagaaagtcatcgaaaagatggaaagggttctggaagacaggctgcaagataggagcaagccacctcccttgaatagacaacaggggaaaccatataccggcttccctatgttgagcgcaagcggcctcccactcggcagtatgggcgaaaacttacctgtcgaactttattctgttctcctcgccgagaatgcgaaacttcggactgaattagataaaaacaggcaccagcaggcgccaattatccttcaacagcaggcgttacctgtagaccccggagagctgggggcaggcggtgacctaaccgagaggctgcaggagactcatggtcccggtcacagcgagtgcacggaaacacttccggctcaggatcttctgtcgggaacgtctgataagtttaatctcctggccaaactcgagcatgcacagagcaggatcttgtctctcgaatcccagctagaggattccgctcgcagatggggcagagagaagcaggacctggctaccaggctacaggagcaggaaaaaggctttcgtcaccctagtaactcaatcattattgaacagcccccttattccctgcccccagctcctggggcatctattttcggcaaaccacgggctacagtggacccgggtggatggagagaggaagctttccagtccagggggcagggtgacggtccattgcccgaccccgaaaagaaacaggggcaccagcgtccggctctacttggaaacactagggaagcatgtccttttcacctgccccagaatatttaccatgtgtag

SEQ ID NO: 55121 - DNA, 2268 bp, Artificial Sequence
  Description of Artificial Sequence: Synthetic coding sequence
atgggactgaaaaataaaaagaacacagaagacccagaggagcctctcattgcctcccagtccacagaacctgaaattggacacctgagcccctctaaaaaagagactattatggtgacactccacggtgcaacaaacttaccagcatgcaaggacggctctgaaccctggccctacgtggtggtgaaatcaacgtccgaagaaaaaaataatcaaagttctaaggccgtcacatctgtcacgagcgaaccaacacgcgctcctatttggggtgacactgtgaatgtggagatccaggccgaagacgctggacaggaggatgtgatcttgaaggtggtagacaataggaagaaacaggagttactgagctacaagattcctattaagtatctcagagtctttcatccttatcatttcgaattggtcaaacctaccgagtccggcaaggcggatgaggcaactgctaaaacacaactctacgctactgtggtgaggaagtcatctttcatacctagatacatcggttgtaatcacatggcactggagatattcctgcggggagtgaacgaacccctagctaataacccgaatccaatagtcgtcatagctagagtggtgcccaactataaggagttcaaggtcagccaggccaatcgcgacctcgcttccgtgggactccctattacccctctctcattccccatcccctcgatgatgaactttgatgttcccagggtgtcgcagaacggctgtccgcagctttccaaacccggagggccacctgagcagcctttatggaaccagagcttcctgtttcagggcagggatggtgctacgtctttctctgaagacactgctctggtattggaatactattcgtcaacaagtatgaaagggagtcaaccatggacactcaaccaacctctgggcatatcagtccttccgttgaaatcacggttgtatcagaagatgctgacgggcaagggcctcgacgggttgcacgtggagcgcctcccgatcatggatactagtcttaaaactataaatgatgaggccccaactgttgccctgtcctttcaactgctgagctcagagcgtcccgaaaattttctgaccccaaacaacagcaaggccctgcccaccctcgatccgaaaatacttgacaagaagctgagaactattcaagaaagttggtctaaagatacagtgtcttccacaatggatctttctacttccactcccagggaggctgaggaagagcctctggtgcccgaaatgtctcacgataccgaaatgaacaactatcgtcgagccatgcagaaaatggctgaggacatcctgagcctgcgcagacaggcaagtattctggaaggagaaaacagaatcttaagatcccggctagcacagcaggaagaggaggaggggcaaggcaaggcaagtgaagcccagaatacggtgtcgatgaaacagaagctgttactgtcggaactggacatgaagaagctgcgggaccgggtgcagcaccttcaaaacgaactcatccgaaaaaatgatcgggagaaggagcttctgctgctctaccaagcccagcagcctcaggcagcactcctaaaacagtatcagggcaagttgcagaagatgaaggcactggaagagaccgtgagacaccaggagaaggtaattgaaaagatggagcgggttctggaggataggctccaggatcgatcaaaacctccacctctgaaccgtcagcagggtaagccatatacgggtttccctatgctgagcgcatcaggcctgccactcgggagcatgggggaaaacttacccgtggagttatacagtgtgttactggccgaaaacgccaaacttcgaaccgaacttgacaaaaatcgccaccagcaagcaccaattattctgcagcaacaggcattgccggacctgctgtctgggacaagcgacaagtttaacctgttggcaaaactggagcatgcacagagtagaattttgtccctcgagagtcaattggaggattctgccagacggtgggggagggagaagcaggatttagccacccgactgcaggagcaggaaaaggggtttagacatccctcgaatagtataatcatagagcagccatcagcactgacgcattctatggatctaaaacagccgtccgaattggaaccactgctgccatcaagtgactcaaaactgaataagccactcagcccgcagaaggaaaccgctaacagccaacagacatag

SEQ ID NO: 55122 - DNA, 1002 bp, Artificial Sequence
  Description of Artificial Sequence: Synthetic coding sequence
atgggggagccaggcccaccctctccacccgcaccgaaggccgctccgggtctgatcgactcgttttcagaaatgaacaactaccgtcgcgcaatgcagaagatggcagaggacatcctctccctgcggagacaggcgagcattctggagggagagaaccgcattctgagaagccgcctggcacagcaggaggaggaagagggtcaggggaaagcatccgaggcccagaatactgtaagcatgaagcaaaagttgctgcttagtgagctggacatgaagaaactgagggaccgcgtgcagcacttacaaaatgagctgatacggaaaaatgatcgcgagaaagaactgttactcctctaccaggcccaacaacctcaggcggcactcttgaaacaataccaaggcaaattgcaaaaaatgaaagcgttggaggaaacagtgaggcaccaagagaaagttatcgagaagatggagagagtcctagaagatcgcctccaagacaggtcgaaaccgcctccgctgaatcgtcagcagggtaagccatacactgggttcccaatgctcagcgcttccggactccctctgggttcaatgggcgagaatttgcccgttgagctctacagcgtactgcttgcagagaacgcaaagctgcggaccgagctcgataaaaaccgacatcagcaggcccctattatactccagcagcaagctttgccagaccttctgtcaggcaccagcgataaattcaaccttcttgccaaactcgaacatgcgcaatcaagaattttatctttagaatcacagctggaggattcagccagacgctgggggagagagaagcaagacctggcaactagattacaagagcaggagaagggatttagacatccatccaactctattattatcgaacaaccggtgagcgatccacccggagtggcccctcggggtagcggaggtggtgcgggatcccaccgcacgcccaaggtgaccggaccttag

SEQ ID NO: 55123 - DNA, 1785 bp, Artificial Sequence
  Description of Artificial Sequence: Synthetic coding sequence
atgaattttaatgtttggaatataaaagagatgttgtctattccgagcgggagcggtaacaagaagtcttccaattggaacaacaatcagaatgactacagtagtttaagcgatagccaattcttgtttgggtcacaattctgcccagaaaattcagaaacattaagcgcgcctctcgattttggcgctcacctcaggcactcaaaacaaagtcagcagaattaccttgagggagaaccgtcaattttcacaaaataccagaccaagcctcagctgtttgggggagacatcaaggacggcggactatttccacctccactttctgtgggtaaatcgaagggactcctcgagcagttcgaggaaaagaagaagcgcgctaaggacaaatgcgatagtgaaacattatacaatttcgtttctaatgtgcgcgagagtattttgaggctgcagacttctgtggaaaagtcagaggatcacctctccagccgcagccaaagcattctagactcactcgagaccgtggctaaaacacttcaagagactattcaggctcagaacgatttggtattcgaggccgtacaggacaaggggaatatggaacaggcaattctggaaatgaaaaaacggttcgaagcaagacagggtgagttcattgagatgaagagtaaccttaagcatttggaagttttggtggcccagcaatcacaggagttccagcagctgtgtgaacagctcggacagctcaatgtgcccagcgttctggccgagctcaagagactgatctcagtcccgcctgtcaaagattcagcatcacagacaagtccgcctctggcgcaaagcttgaatctgacaaggcaggaaaaatatacatcagaaaagccggtactgtggcaggcgcaggctctgccagctgcatggaaccctggtatgggcagcctgcaacccggtgagttcgacgtatggggggaaggcgctaagaacgatgacctgcaggaagaagctgcgctgcctgcctttggtagtcatgagagaaacagacatgtcaaggacaaggtagtccagacaaattgcaagaattgggccgttacaaagaccggggcaaagaatcatgggagttctgttcccggacacaagatcccgtcagatcgggacctggtgtctcaaggcgcatcccagctgacgagtctcgagattaatttctcgacctccatcaagaatgcatgccaaaagtatcaggcccagagtatgttcctgtgtgaccccagagagcatcttgtaattaaacagaaggacggtactgttgaaatgagggggaaagacaagaagcagcaacctcgaaaggcccaccgggctcatcgcggtagactgattgcatccaaacagaaacagattccaatccagacctgcaagttcaactcgaaataccagtcacctcaaccagcaatttcagtaccccaatctcctttcctgggacagcaggagccgagagcccagcccctgcacctgcaatgtccacgctcacctagaaaacctgtgtgtccgatcctgggcggaaccgtgatgcccaataagacagtccgagccgtccagggacgcctgctgcaactgtcgcgatgtagttcccaagacaattggttgctcagttcttcctcccagggtgaccaccagatgtcctggtttagcgatctgaacctgggctgctctgagacccctctgtgtaaggaggccggtaagaatctcttatatgacctgggattcgattcaagcgacgatgatggtttctag

SEQ ID NO: 55124 - DNA, 1725 bp, Artificial Sequence
  Description of Artificial Sequence: Synthetic coding sequence
atggccagagttgatgctaaggctaaagaagcacccagggccagtgaaggctgccagcacgctgtaacctcacaacggaacaaaaaaagtagtaattggaataataatcagaacgactacagttctctgagtgattcgcagtttttgttcgggtcccaattctgccccgagaattcagaaactctctccgcacccctggattttggagcacacctgaggcacagtaaacagtcgcagcagaactatctggagggggaaccatcaatttttactaagtatcaaacaaagccgcagttcgaagagaaaaaaaagagggcaaaagataagtgtgactcagaaactttgtacaacttcgtgtcaaatgttagagaatccattcttcgccttcagacttccgtggaaaaatccgaggaccacctgagctctcggagccagtcaattctcgatagtttggagaccgtggccaaaacgttacaggaaacaatccaagctcagaatgatctggttttcgaggccgtgcaagataagggcaatatggagcaagctatcctcgagatgaaaaagcgcttcgaagccaggcaaggcgaatttatcgaaatgaagagtaatctgaagcatctggaggtgctggttgctcagcagagtcaggagttccaacagctctgtgagcagctcggccagctgaacgtgccaagcgtcctggccgagttaaagcgactgatctcagtaccccctgtgaaggactcagcatctcagacttctcctcctctggcccaatcgttgaatctgactcggcaggaaaagtatactagcgaaaagcccgtcttgtggcaggcacaagcgttacccgctgcatggaatcctgggatgggtagcctgcaacccggagagtttgatgtatggggcgaaggagccaagaacgacgaccttcaggaggaggctgcgctcccagcatttggcagccacgagcggaataggcacgtcaaagacaaagttgtgcagactaattgtaagaactgggccgtgaccaagaccggggctaagaaccatggatcttccgtgccaggacataagattccatctgaccgtgatctggtcagccagggtgctagccaattgacgtccctcgaaattaacttctctactagtatcaaaaatgcttgccagaaataccaggcccagtccatgttcttgtgtgatcctcgagagcacctggttatcaagcaaaaagatggtacagtagaaatgcgcggaaaggataagaagcagcagccgcgaaaggcacacagagcacaccgaggccgtctcattgcctctaagcagaaacagattcctatccagacatgtaagtttaattccaagtatcaatccccacaaccagccatttccgttcctcagtcaccattcctagggcagcaggagccaagggcacagcccctgcatttgcagtgcccgaggtctccgagaaagccagtgtgcccgatattgggaggcaccgtgatgccaaataagaccgtgagagccgtccaaggcaggcttcttcaattgtcaagatgcagcagccaagataattggctactatcctcatcgagccagggggatcatcagatgtcttggtttagcgaccttaacctcggttgttccgaaactccattgtgtaaggaggctggcaaaaatctgttgtacgatttaggatttgacagctccgacgatgatggattctag

SEQ ID NO: 55125 - DNA, 612 bp, Artificial Sequence
  Description of Artificial Sequence: Synthetic coding sequence
atgaatttcaacgtgtggaacataaaggagatgctgagtattccatccggctctggcaacaagaaaagcagcaactggaacaataatcagaacgattatagctcactttctgacagccagttccttttcggctctcaattttgcccggaaaactccgaaacgctttcagcccctttagatttcggcgctcacctgagacatagtaagcaatcacaacagaactatctcgagggtgaaccatcaatcttcacaaaataccagaccaagcctcagttgttcggaggtgatatcaaggacgggggtttgtttcctcctccactcagcgtcggaaaatccaagggcctactggagcagtttgaggagaaaaagaaaagagctaaggacaagtgtgacagctgcagaagactctggaaatctttgcgtaccattagtgtgcaagaggccaatctcttttggatcctctggcggttgtggccgaggcacgtctctgcctcctgcctcagatatcagcagcgggctctggtcaatgatgagcacgagctttccgacccgtcattagttagctcaggcgaggtcccccatcgagtgtctgacgaacggatgggaatctag

SEQ ID NO: 55126 - DNA, 1785 bp, Artificial Sequence
  Description of Artificial Sequence: Synthetic coding sequence
atgaatttcaacgtctggaacatcaaagaaatgctcagtattccaagcggttccggcaacaaaaagagcagcaactggaataataaccagaacgactacagttccttatccgattcccagttcctgtttggaagccagttttgtccagaaaactcggaaacactatccgccccactcgacttcggagctcaccttcggcacagtaagcagtcccagcagaactacctcgagggagagccctcgatctttaccaaataccagacaaagccccagctatttggcggagacattaaagacggtggcctcttcccgccacctctctcagtgggcaagtctaaaggccttctcgagcagttcgaggaaaaaaagaagagggccaaggataaatgtgactccgaaaccctgtacaattttgtgagtaatgtgcgcgaaagcattctgaggttacaaacttcggtcgagaagtcagaagatcatttgtccagccggagccagagtatcctggactctttagaaaccgtggctaaaactctgcaagaaaccatccaggctcaaaacgacctggtcttcgaggcggtgcaagacaaagggaacatggagcaggcaattttagagatgaagaagcgctttgaggccagacaaggcgagttcattgagatgaagagcaacctcaagcatttggaggtgttagtcgcacagcaaagtcaagaatttcagcagttgtgtgagcagctcgggcaactgaacgttccatctgtcctggctgagctcaaacgactgatctccgtgccacccgtcaaagactctgcttcacagacgagcccaccgctcgcgcagtcattgaatctcacaagacaggaaaaatacacgtctgagaagcctgtcctgtggcaggctcaggccctcccagccgcttggaatcctggcatgggcagcctacaacccggagaattcgacgtgtggggggagggcgcaaagaacgacgatttgcaggaagaagcggcactgccagcttttggtagccacgagagaaacaggcatgtcaaggacaaagtggtgcagaccaactgtaagaactgggcagtgacgaaaacaggcgcaaaaaaccacgggtcgtccgttcccggtcacaagattccgtctgatcgcgatctggtctcccagggcgctagccaattaacatcgctggaaatcaacttttccaccagtataaagaacgcgtgccaaaaatatcaagcccaaagtatgtttttatgcgatcctagggaacacttggtgatcaaacagaaggatggcaccgtagagatgcgcggaaaagataagaaacagcagcctcgtaaagctcacagggcacatagaggtagactgatagcctcgaagcagaaacagattccgatccaaacctgtaagttcaactccaagtaccaaagcccccaaccagcaataagcgtgccgcagtctcctttcctcggccagcaagagccgcgtgcccagcctctgcacctacagtgtccaaggtctcctcggaagccagtgtgccccatactcggtggcactgtgatgcccaacaaaaccgtgcgtgcggtccaaggacggctgctccagctcagtcgctgttcatcccaggataattggctgctatcctcctcctctcagggcgaccaccaaatgagctggttctctgatctcaacttaggctgcagtgaaacccctctctgcaaggaagcgggtaagaaccttctttacgacctgggctttgacagctcagacgatgatggcttctag

SEQ ID NO: 55127 - DNA, 582 bp, Artificial Sequence
  Description of Artificial Sequence: Synthetic coding sequence
atgctgtcgacaccaaaatctcaagggaacaaaaaatcctctaactggaataataaccaaaatgactactcttcgttatcagactcgcagtttctgtttggctcacagttctgcccagaaaatagcgagacgctctcagcccctttagacttcggtgctcacctgagacatagcaagcagtctcagcagaactatctggaaggggagccctcaattttcacaaagtaccagacaaaaccccagctgttcggaggagatattaaagacgggggactatttcctccacctttgtccgtcggtaagtccaaaggtctgctggaacagtttgaagagaagaaaaagagagcgaaagacaaatgtgattcatgtcgtcggctttggaagtcccttcgcaccattagcgtacaggaggctaacttgttctggattttatggaggctctggcctcggcacgtgagcgcttcttgtctgagataccaacagagggccttagtcaatgacgagcacgagcttagcgatccttctcttgtcagttcaggggaggtgcctcatcgcgttagcgacgaacgtatggggatttag

SEQ ID NO: 55128 - DNA, 1785 bp, Artificial Sequence
  Description of Artificial Sequence: Synthetic coding sequence
atgaatttcaacgtgtggaatattaaagaaatgttgagcatcccatctggaagcgggaataagaagagctcaaattggaacaataaccagaatgactatagcagtctatctgatagccagttcttatttgggtctcagttctgtccggaaaacagtgaaacattaagtgccccacttgactttggggctcatctgaggcacagcaagcagagccaacagaattatctcgaaggggaaccatccatctttacaaaataccaaaccaaaccccagctgttcggcggtgatatcaaagatggaggcctatttccccctccactaagcgtggggaagtctaaggggctgcttgagcaatttgaggagaaaaagaagagggccaaggataaatgcgattccgaaactctatataatttcgtgtccaatgtgcgcgaaagtattctgaggttacaaacatcagtagaaaagagcgaagatcatctgtcctctcgctcacagtctatcttagacagcttagaaaccgtagccaagacactccaggaaaccatccaggctcaaaatgatctggtgttcgaggcggtgcaggacaagggcaacatggagcaagccatcctggaaatgaagaagaggttcgaagcccgacagggagagtttatagaaatgaagtcaaacctaaaacaccttgaggtcttggtggcccagcaatctcaagagttccagcaactctgcgaacagcttggccaactgaatgtgccaagtgtgcttgcggaactcaagcggctgatctctgtgcctcccgtgaaggattcagccagtcagactagtccacccctggcccaaagccttaatctgacgcgccaagaaaaatatacatccgaaaagcctgtcctgtggcaggcacaagccttacccgcagcctggaaccctggtatgggatccctgcagccaggggagtttgacgtctggggggagggtgcaaagaacgatgatctccaggaggaggcagcgctgcccgcattcgggtcccacgagagaaataggcacgtgaaagacaaggtagtccagacaaattgtaagaactgggctgtgaccaaaaccggcgctaaaaatcacggttcaagcgtcccagggcacaaaatcccaagcgaccgggacctggtcagccagggtgccagtcaattaacctccctggagatcaatttctccacatccattaaaaatgcttgccaaaaatatcaggctcagagcatgtttctgtgcgatcccagagaacacctcgtcatcaaacagaaggacgggactgtagagatgcggggaaaagataagaaacagcagcctaggaaggcgcaccgcgcacatcgcggtcgcttgattgcctccaaacagaaacagataccaatccaaacttgtaagttcaatagcaaatatcagtcacctcagcccgcaatctccgtcccccagtctcctttcctgggccagcaggagcccagagcacagcctctgcacctccagtgccccagatcccctcgcaagcccgtttgtccgattctgggtggtacggtaatgcctaacaagactgtgcgggcagtgcagggcaggctcttacagttgtctagatgctcttcccaagataattggttactctctagctcaagtcagggtgatcatcagatgtcttggttcagcgatctcaatctgggctgctccgaaaccccactgtgcaaagaagctggcaagaacctgctctatgacctcgggttcgactcctctgatgatgatggattctag

SEQ ID NO: 55129 - DNA, 1836 bp, Artificial Sequence
  Description of Artificial Sequence: Synthetic coding sequence
atgtcggagatccccagcacaatcgtctcaaaaaacatgactaatgataagaacagccttgaaagtatgaacatttcttcatcgtcttctaccgaagaaaaccccaaaaaacaagctcgtaaaaatgaagagcacgggccagatccctcggcaaaccccttccacctttcaggtgatgtagatttttttctgttgcgggatcaagagagaaacaaggcactctccgagagacagcagcagaagaccatgagggtgcaccagaagatgacctattcatctaaagtctcggccaagcacactagtttgagaagacagctgcagctggaagataaacaggaagacctcgaagctagggccgaagctgaacatcaacgggcttttagagactacaccacttggaagctgacactgactaaagagaagaacgtagagccggaaaacatgtccggctacattaaacagaagcgccaaatgttcctgctgcagtatgcattagacgtgaagagaagggagatacagaggttggaaacactggccactaaagaggaagccagattggaaagagcagaaaagtccctcgagaaagatgctgcgctgttcgacgaatttgtgagagagaacgactgcagtagcgtgcaagcaatgcgagccgcagaaaaggaaacaaaagcaaagatagagaaaatcctcgagattagggatctcaccacccaaatcgtgaacatcaaatccgagatcagcaggtttgaagacaccctgaaacactacaaggtgtataaagactttctgtataaactcagtcccaaagagtggctggaagaacaggagaaaaagcatagcttcctgaaaaaagctaaagaggtctccgaggctagcaaggaatcgagcgtcaattccacaccaggtgacaaaggtcccggtataaaagggaaggcatcgtcaatgtgggcaaaggagggccaaggcaccaaaaagccctggagatttctgcagactatgcgcctggggagaagtcccagttatctgtctagtccgcaacaggggagccagccgtcagagtcttccggtggagactcccgtggcagcaattcccccataccccctacccaggaagacacggatagtgatggggaagagcctcagctctattttacggagccccagcagctacttgatgtgttcagggagctcgaagaacagaacctgtcccttatccagaattcccaggagacagaaaaaaccttagaggagctctcccacacactaaaacatacacagatccgaatggatagggaagtgaatcagctgaaacaatgggttactactatgatgatgagcattaccaaagaggaggacacagctgcagaactggagcttaaggctagagtgtttcactttggtgagtacaagggcgaccagcaggacaagctgcttgaaagcctgaactgcaaggtgttggatgtctacaggcattgcacgggaacccagcaggaagccaatctgggcactgtgcagatgctgactatcattgagcatcaactcgatgagctgttagaaaatctcgaacacgtgccacaggttaagatagaacaggcagagcgggctaaggaaaaagaacggagaatacgcttacgagaagaaaagttgcagatgcagaagatcctgcaagaagagcacttgcaaagagcacgagcaagggcacaggccgagattaaaaaaaagagaggacgaactctggtctgcaggagcagaccccctgcgcaccggataaagcagcagtctgaacatacactaatggataaagaagaggaggaactgttatttttcttcacctag

SEQ ID NO: 55130 - DNA, 1839 bp, Artificial Sequence
  Description of Artificial Sequence: Synthetic coding sequence
atgtcagagattccctctacaatcgtgtccaagaacatgacaaatgataagaatagtctagagtctatgaacattagcagcagcagctccactgaggagaatcctaagaagcaggctcgcaaaaatgaggaacacggccctgatcctagtgcaaaccccttccacctttctggtgacgttgactttttcttactgagagatcaggagagaaacaaagccctgtctgagagacaacagcagaagactatgcgcgttcaccagaaaatgacatacagttctaaagtgtctgccaagcacaccagcctgagaaggcagctccagctggaggacaagcaggaagacctggaagctcgggctgaggccgagcatcagcgcgcattcagggactataccacatggaagttgaccttgacaaaggccgagaaaaatgtggaacccgaaaatatgtctggatatatcaagcagaagaggcaaatgttcctgttgcagtacgccctggacgttaagcggagggagatccagcgcctagagaccctcgcaacaaaagaagaagcaaggctcgaacgcgcagaaaagtccttggagaaggatgctgctctgttcgatgagttcgtcagagaaaacgactgctccagcgttcaggctatgagagccgctgagaaggagaccaaggccaagatcgaaaagattctcgaaattcgcgatctcactactcagatagtgaatatcaaaagtgaaatctcgcggtttgaggatacacttaaacactacaaggtttataaggactttctgtacaaacttagcccaaaggagtggctcgaagaacaggagaagaaacactccttcctgaaaaaggcgaaagaggtctcggaagcctccaaagaaagctcggtgaattccaccccaggcgacaagggcccaggaattaaaggcaaagccagtagcatgtgggcaaaggaggggcagggcacgaagaagccatggcgttttctccaaacgatgcgccttggtaggagccccagctatttatcgtctccccagcagggcagccagcccagcgagagcagtggcggagattctcggggttctaactctccaatccctcccacgcaggaagacacagattcagacggagaagagccacaactctactttaccgaaccccagcagctgctcgatgtatttagggagttagaggaacagaatctgtcgctgattcagaattctcaagaaaccgagaaaacactggaggaactgagccataccctgaaacatactcagattcgaatggaccgcgaagtgaaccagttaaaacaatgggttacaacaatgatgatgagtatcacaaaagaggaagatacagctgctgagcttgagcttaaggccagagtgtttcacttcggcgaatataagggcgatcagcaagataagctgttggaaagcctgaattgcaaggtattggatgtttatagacattgcactggtacccagcaggaggccaatcttggcacggtgcagatgctgactatcattgagcaccaactggacgagttgctggaaaacctggagcatgtgccccaggtgaaaatcgagcaggccgaacgggcaaaggagaaggagaggcgaatccgccttagggaagagaagctacagatgcagaaaatcctccaggaagagcacctgcagagggccagggctcgggcacaggccgaaattaagaagaaaaggggacgtactctcgtgtgcagatcccgcccaccagcgcacaggatcaagcagcagagcgaacacactctgatggacaaggaagaagaggaactgctctttttttttacttag

SEQ ID NO: 55131 - DNA, 1692 bp, Artificial Sequence
  Description of Artificial Sequence: Synthetic coding sequence
atgtcctccaatctgttgcctacactcaacagtggtggcaaggtgaaggatggaagcacgaaagaagatcgaccctacaaaattttcttccgcgacctgttcctggtgaaggagaacgaaatggctgcaaaggagacagagaaatttatgaaccgcaacatgaaggtttaccagaagacgaccttctcctcacgcatgaaaagccactcctatctcagtcagcttgctttctatccaaagagatccgggcgatctttcgagaaatttggcccaggccctgctcctatcccgaggctaatcgagggatcagataccaagagaactgtccacgagttcattaacgatcagcgtgaccgatttttactggagtatgccctgtcaactaaacggaacactattaagaaatttgaaaaggatattgctatgcgggagagacaactcaaaaaggcggaaaaaaaactgcaggatgatgccttggcattcgaagaattcttgagggagaatgaccagcgcagtgtcgacgcgttgaaaatggcggcacaggagaccatcaataaattgcagatgaccgccgagctaaagaaagcaagtatggaagtgcaggcggtgaagagcgagattgccaagacggaatttctgttgcgtgagtacatgaaatatggctttttcctgctccagatgagccctaagcactggcagatacaacaggcactgaaacgcgcacaggcctccaagagcaaggcaaatattatcctgcccaaaattttggccaagctctccctgcattcgagcaacaaggagggaatcttggaagaaagcggtaggactgcagtgctctctgaggatgcctctcaggggcgagatagccaggggaagccctctagatcactgacccgcactcccgagaagaaaaagagtaatcttgctgagtcattcggatctgaggattcgttggaattcctcttggatgatgagatggatgtcgaccttgaacccgcactttacttcaaggagcccgaagaacttttacaggtgctgagagagctggaggaacagaacctgactctattccagtatagccaggacgtcgatgagaatctcgaggaagtcaacaagagggaaaaggtcatccaggacaagacaaattcaaacatcgaattcttgctggagcaggagaagatgctgaaggccaactgcgtgcgtgaagaagaaaaggcagctgaattgcagctaaagagtaaattattctcatttggggagttcaatagtgacgcccaggagattctcatagactcgttgagtaagaagataactcaagtatataaggtctgcattggcgatgctgaggacgatggactgaaccctatccagaaactggtgaaggtcgagtcccggttggtggaactgtgtgatctcattgaatccatcccaaaggaaaatgtggaggccatcgagcggatgaagcaaaaagagtggcgccagaagtttcgggacgaaaaaatgaaagaaaagcagagacaccagcaggaacgattgaaggcagccttggagaaagctgtggcccagcctaagaaaaaacttggacggcgactagtgttccactccaaacctcctagtggaaacaaacagcaacttcccttggtgaacgagaccaagacaaagtcacaagaggaggagtacttcttcacgtag

SEQ ID NO: 55132 - DNA, 2106 bp, Artificial Sequence
  Description of Artificial Sequence: Synthetic coding sequence
atggtagtgtctacttttaccgatatggacacttttcctaacaactttcctccagggggagactccggtctgacaggttcgcagagcgaattccagaaaatgctcattgatgaaagacttcggtgtgagcaccataaggccaactatcagaccctgaaggctgagcacacacggctccagaacgagcacgtcaagctacagaatgagctgaagcatctgttcaatgagaagcagacacaacaagagaaactacagctgctgttggaggagctacgtggagagctggtggaaaagacaaaggatttagaggagatgaaactgcagatcctgacacctcagaagctggaactgctcagagcccaaattcagcaggaactggagaccccaatgagagaacgattccgcaatctagatgaggaagtggagaaataccgagccgtttacaacaagctgagatacgagcatacattcctgaagagtgaattcgagcaccagaaggaggaatacgcaagaatactggatgagggaaaaataaagtatgagagtgagatcgctaggcttgaggaggacaaggaagaactgcgtaatcagctcctgaacgtggacttgacaaaagattccaagcgtgttgaacagcttgcccgtgaaaaggtctatctgtgccagaaactgaaaggtttggaggctgaggtagcagaactgaaggccgagaaggagaactccgaagcccaggttgagaacgcacagcggattcaggttcgccagctcgcagagatgcaggccacagttagatcgcttgaagcggaaaaacagagtgcaaatttgagggccgaacgtttggaaaaggagctgcaatcatcctccgagcagaatacctttctgataaacaagttacataaggcagagcgtgaaataaatacactttctagcaaggtgaaggaattaaagcactccaacaagctggagatcacagacatcaaactggagactgccagagcgaaaagtgaactcgaacgtgaacgcaacaagatccaatccgagctggatgggctccaaagcgataatgagattctgaaggctgccgtggaacaccacaaagtgttgttggtggagaaggatagagagctgattcggaaggtgcaggccgcaaaagaagagggttatcagaaactggtcgttctgcaagacgaaaagctggaactcgagaaccgcctggccgacctggagaagatgaaggtggagcacgacgtgtggaggcagtccgagaaggaccagtacgaggaaaagctcagggcgagtcagatggctgaagagatcacaaggaaagagctacagagcgtccgcctcaagctacagcagcaaatcgtcaccatcgagaacgccgaaaaagagaagaacgaaaacagcgatttgaagcaacagatcagcagcctacagatccaagtgaccagcctggcccagtcagaaaacgacctgttaaacagcaatcagatgctgaaggagatggtggaacgactaaaacaagagtgtcgcaacttccgttcccaggcagagaaagcacaactggaagcggagaagaccttggaggaaaagcagatccaatggctcgaggagaaacacaaattacatgaaaggatcacggatagggaagagaagtacaaccaagcaaaggaaaagctccagagagccgcaattgcacaaaagaagagaaaaagtcttcacgagaataaactgaaaaggctgcaggagaaggtggaggtcctcgaggccaagaaagaagaactagagaccgagaatcaggttttgaatagacagaatgtgccttttgaggattatactagacttcagaaaaggctcaaagacatccaaaggcggcataacgaatttaggtcgttgatccttgtgccaaacatgcctccaaccgcatccattaatccggtctcctttcagtcttctgcaatggtgccaagcatggagctgcctttccccccacacatgcaggaggagcaacatcagagggagctgtccctccttcgtaaaagattggaggagctcgagactacgcagcggaagcagctggaagaactgggctcctccggggagtag

SEQ ID NO: 55133 - DNA, 1707 bp, Artificial Sequence
  Description of Artificial Sequence: Synthetic coding sequence
atgttgattgatgagaggctgaggtgtgaacaccataaggcaaattatcagacactcaaggccgagcacacacgcctgcagaacgagcacgtgaaactccagaatgagctgaagcacctctttaacgagaagcagacgcaacaggaaaaattgcaacttctcttagaggagctgcggggtgagctcgtggaaaaaaccaaggatctcgaggagatgaaactgcagattctcacgccacaaaagttggagcttctgcgtgcccaaatccagcaagaattggagacgccaatgagggaaaggtttaggaacctggacgaggaagttgagaagtaccgggcagtgtacaacaagctgagatacgagcacaccttcctcaagtccgagttcgaacaccagaaagaggagtatgcccgaatccttgacgaggggaagatcaagtacgagagcgagattgccagactcgaggaggacaaggaagagctgcgtaatcagctgcttaacgtggacctgactaaagacagtaagagagtcgagcagctggcacgagagaaagtgtatctttgccaaaagctcaagggacttgaagctgaagtcgccgagcttaaggccgaaaaagaaaacagtgaggcacaggtggaaaacgcacagcgcatccaggtcagacagcttgctgagatgcaggccacagtcaggtccctagaggctgagaagcaaagtgccaaccttcgagctgaaaggctcgagaaggagctgcagtcaagctcggaacaaaatacatttctgattaacaagctgcacaaggcagagcgggagatcaacacattatctagcaaagtaaaggaactcaaacatagcaataagctggagatcactgatatcaaacttgaaacagcccgagccaagtcagagctggaacgtgaaagaaataaaatccagtctgagctggatgggctgcagtccgataacgaaattttgaaggccgctgttgaacatcataaagtgctcctcgtggaaaaggaccgagagcttattagaaaagtgcaagctgcaaaagaagagggataccagaaattggtggtgctacaagacgagaagctggaactagaaaacaggctggctgatcttgagaagatgaaagtcgaacatgacgtatggcgtcagagcgaaaaggatcagtatgaagagaaactgcgggctagccagatggccgaagaaattactcggaaggagctacagtcagttcggctgaagctgcagcagcagatcgtaaccatcgagaacgctgaaaaagagaagaacgagaatagcgacttgaaacagcaaatctccagtctgcagatacaggtgacctccctggcgcagtcagagaacgatctcctgaatagcaatcagatgctaaaagagatggttgaacggctgaagcaggagtgtcgaaacttccgtagtcaagcagaaaaggctcagttggaggctgagaaaacactggaggagaagcagattcagtggctggaggagaaacataagcttcatgagcggattacagaccgggaagagaaatataaccaagccaaggaaaaactgcaacgggctgccatcgcacaaaagaaattagagcaagatcttgagctggggtgtccgagtgttacggacacttaccgggaaagcgtatttccacccccaccgctgaaacgcgacctcttgaagtag

SEQ ID NO: 55134 - DNA, 2106 bp, Artificial Sequence
  Description of Artificial Sequence: Synthetic coding sequence
atggtggttagtacattcacagacatggacacattccccaataactttcctcctggaggggactccggactgaccgggtctcaatctgagtttcagaaaatgctaattgacgagcggctgcgatgtgaacaccataaggccaactatcaaacattgaaagctgaacacacccgcctccaaaacgaacacgtgaagttacagaacgaactgaagcacctgttcaacgagaaacagacccagcaagaaaagctgcaactgttgctcgaggaactgaggggagagcttgtggaaaagacaaaggacctagaagagatgaagctgcagatcctgacgccccagaaattggagctgttgagggcccagattcagcaggaactggaaacgcccatgagagagaggtttaggaatctggacgaggaggtcgaaaagtaccgcgcagtgtacaataagcttaggtatgagcatacattccttaagagtgaattcgagcaccaaaaagaggaatacgccaggattctggatgaaggtaagatcaagtacgagagcgagatcgcaaggctggaggaggataaggaggagttgaggaaccaactgcttaacgttgatctcacaaaagatagcaagcgtgtcgaacaactggccagggagaaagtatacctctgtcagaagctgaagggtttggaggccgaggtggccgagctaaaagccgagaaagagaatagcgaagcacaggtcgagaacgcacaacggattcaggtaaggcagctggctgaaatgcaggccaccgtgagatctctggaggccgagaaacagagtgctaacctcagagccgagaggctggaaaaggaattacaaagcagcagtgagcagaatacttttctcatcaataagctgcacaaggccgaaagggaaattaatactttgtcttccaaggtgaaggagctgaagcattccaacaagctggaaattacagacataaaactggagactgcccgagctaagagtgagttagagcgtgaacgtaataaaatacagtccgagctggatgggttacagtccgataacgaaattctcaaggccgcagtggagcaccacaaggtgctgctggtcgaaaaagatcgcgagctcatccgcaaggtgcaagctgcgaaggaggagggatatcaaaaactggtagtcctgcaggacgagaagctggaactggaaaatcggcttgcagatctggagaagatgaaggttgagcatgatgtatggagacagagtgagaaggatcagtacgaagaaaagttgcgggcttcccagatggccgaggagataactaggaaggagctgcagtcagtgaggctgaagctacagcagcaaattgttactatcgagaacgcagagaaggagaagaatgaaaattccgacctgaaacagcagatctcatccctgcagattcaggtgacatcattggcccagagcgagaatgatctcctgaacagtaatcagatgttaaaggagatggtagaaaggctcaagcaggaatgtcggaatttccgctcacaggccgaaaaggcacagcttgaagccgaaaagactctcgaggaaaaacagatccagtggctggaagaaaagcataaactgcacgaacggattacggaccgggaggagaagtacaatcaagccaaagagaaacttcagcgggcagctatcgcccaaaaaaaaaggaagtcgctgcacgagaacaagttgaaacgcttacaggagaaggtggaggtcctagaagctaagaaggaggagctggaaaccgagaatcaggtgctgaaccggcaaaacgttccttttgaggactacacgcggctccagaagagactgaaggacatccagaggaggcacaacgaattccgtagtcttattcttgttcctaacatgccccctacagcatctattaatcctgtgagttttcagtcttccgccatggtaccctcaatggagctgccctttccgcctcatatgcaggaggagcaacatcagagagagcttagccttctgcgcaagagattagaggagctcgagacgacacagcggaagcagctggaggagctaggatcgagcggtgaatag

SEQ ID NO: 55135 - DNA, 9 bp, Artificial Sequence
  Description of Artificial Sequence: Synthetic coding sequence
atggtgtag

SEQ ID NO: 55136 - DNA, 951 bp, Artificial Sequence
  Description of Artificial Sequence: Synthetic coding sequence
atgtccctcgggataatggaggaggaagacctggctgaatacttcagacttcaatacggagaaagactgctacagatgctgcagaaattgccgaacgtggagggagcatctgaatcaccttctatttggctgttggagaagaagaaagagacggagatcatgcatcagacgatggtgcaaaagaagaagatgtttcagagacgcatggaaacattgaatcttcggtgggaagaattgggggtgaaagaagcccagctgaaagcacacattcaaaaaagcgaacaattcattcaagagaatgaccagaagagaatccgggctatgaagaaggctaataaagaacgggaactcaaatgccaacacatgcaagaattaacgaaacgaaagcaggaaatggtggctctgcgactggaacaccaacgcctatctgcaaaactgaaggattactacatctttaataagtatttagaaaaggtggtcgagaactccgagttcgaggaaattcatgaggtgatcgccagatataagactctggtgagtatgaggcatgatctcatgcagtccgcacaggaaggccaggaaaaaattgagagggcgaaagcgaggctcgccaggtatatggaagagaaggacgacgagattctgcagcagaacaacgagctcgccaggctgcaaatgaggttcgatagagcccgaagtaacgtgattttctgggaaagccgctgggcccatattcagaacacggccgctaaaaagaccctcctccttgggaccatcaagatggcaacgttaaatctgttccagatcgtatctaaacacctcaaggaagttaccgaggtggcactcgaagacacccacaaacaattagacatgatacagcagtttatccaggataggtcggacatatgggctgaagtcaagaaaaaggaacagcagagagtgcggatatag

SEQ ID NO: 55137 - DNA, 729 bp, Artificial Sequence
  Description of Artificial Sequence: Synthetic coding sequence
atgagcttgggtataatggaggaagaagatctcgccgagtactttagactgcagtacggcgagagacttttgcagatgctgcaaaagctgcccaatgtggaaggcgcttcagaatccccgtctatctggctgctggagaaaaaaaaagaaacagagatcatgcatcagactatggtgcagaaaaaaaaaatgtttcagcgaaggatggagacacttaaccttcggtgggaggagctgggggttaaggaagcccagctcaaagctcacattcagaagtccgaacagtttattcaggaaaatgatcagaaacggatccgggctatgaaaaaagccaacaaagagagggaattgaagtgccagcacatgcaggagctgactaaacgcaaacaggagatggtggctctgaggctggagcaccagcgtctgtctgctaaactgaaagattactatatctttaataagtacttggagaaggtcgtcgagaactccgaagaatccagatgggcccacatacagaataccgctgcaaagaaaactcttttgctgggtaccatcaagatggccaccctcaatctgtttcagatcgtgtccaaacacttaaaggaggtcaccgaagtggccctggaagatacccataagcaactggacatgatccagcagtttattcaggaccgctcagacatttgggctgaggttaagaagaaggagcagcagagggtacggatctag

SEQ ID NO: 55138 - DNA, 927 bp, Artificial Sequence
  Description of Artificial Sequence: Synthetic coding sequence
atggccgtgccatgggaggagtacttcaggctggctctgcaagaaaagttgtccacgaagctgccggaacaggcagaggatcacgtgcctccagtactccgactgcttgaaaagcgtcaggagcttgtagatgccgatcaggcccttcaggcccagaaagaggtgtttaggaccaaaacagctgccttaaagcagaggtgggagcagttggagcagaaagagagggaattaaaggggtctttcattcggttcgacaagttccttcaggacagcgaggctagaagaaaccgggctctgcggagggctgccgaagagcggcaccaggcaggccgaagagaggtggaggccctccgcctatggacgcagctccaggagctcaggcgggaacatgctcgtcttcaaaggaggctcaagcggttggagccatgtgcacgcctcctggaacaagccctggaactcttgccagggttccaggaggtgccggagcttgtggctcgcttcgatggactggccgaaactcaggccgctttgcggctgcgtgagagggaacagttggctgagctggaggccgctcgcgctcgactgcaacagctcagggatgcttggcctgacgaggtgttggcccagggacagcgtcgagcccaactgcaggaaaggctggaggccgctcgtgagagaacacttcaatgggagagcaaatggatacagatacagaacacagctgccgagaagacacttttactcggaagaagtcgcatggctgtgttgaatctgttccagctggtgtgtcagcaccaggggcagccacctacgcttgatatcgaagacacagaaggacaactggagcatgtgaagctttttatgcaggacctcagcgctatgttagccggactgggtcaggccgaacctgctgccccagccagctag

SEQ ID NO: 55139 - DNA, 675 bp, Artificial Sequence
  Description of Artificial Sequence: Synthetic coding sequence
atggccgctcctagcgaagtggccgcaatcgcgccaggggaaggagacggcggagggggaggtttcgggtcctggctggatggaaggttggaagccttaggagttgatagagccgtatatggcgcttatatcctgggtatcctgcaagaggaagaggaagaggaaaaactcgatgcactacaaggtatcctttcagctttccttgaggaggatagtttactgaacatttgcaaggagattgtggagcgctggagcgagacccaaaatgtggtgactaaggtgaagaaggaagacgaggtgcaggctattgctacacttatagaaaagcaagctcagatcgtggtgaagcccagaatggtgagcgaagaggagaagcagaggaaggctgcactgttggcgcagtacgccgatgttaccgacgaagaagatgaggccgacgagaaggacgatagcggagcaaccactatgaatatcggatccgacaaactcctcttcagaaatactaacgtggaggatgtgctaaatgctcgtaagcttgaacgggactcattgcgggatgagagccagcgtaaaaaggagcaggataaactccagagggagcgcgataagttggctaagcaagagcgtaaggagaaagagaaaaaacggacacagcggggagagaggaagcgctag

SEQ ID NO: 55140 - DNA, 465 bp, Artificial Sequence
  Description of Artificial Sequence: Synthetic coding sequence
atggccgctcccagtgaagtggccgctatcgcgcctggagagggcgacggtgggggtggtgggtttggatcatggttggacggtagactggaggcactgggcgtcgaccgcgctgtatacggtgcctatattttgggtatccttcaggaagaagaagaggaagaaaagctagacgctttgcaaggcattttatccgcgtttctggaggaagacagcttgctcaacatctgcaaagagatcgtggagcgatggagcgaaacccaaaacgttgtgacaaaggttaagaaagaggatgaggttcaggctattgcaacattaatcgagaaacaggcacagatcgtcgtgaagcccaggatggtcagcgaggaagaaaagcagcggaaggccgcactactggcccaatatgcagatgtgacggacgaagaggactccgtgcccaaacaccaatgcggccgttgtccctag

SEQ ID NO: 55141 - DNA, 486 bp, Artificial Sequence
  Description of Artificial Sequence: Synthetic coding sequence
atgacatacttcggccactttggaggcgctaatcacgcacataccctcggggagctcgaggcttgcattgctatgctggtggaacagttgaggactcaggggtgcggtggaagaaccctcgggacatccgaggaagaggctgagctgcagcagaaggtggaagagaacgaacacctgcggctggagctgcaaatggtggaaacggaacgggtgcgattgagcctgctggaggaaaagctggtcgatgttcttcagctgcttcagcgactgcgcgaccttaacattagcaagcgggctctgggcaaaattttgctgtctacccttgacgctttcagggacccaacacatgaaggaaggccatctccagctgcaattctggatgcattacaccaggccttagcggcttgtcagctgctgcggaggcagcctagtgcacctgccagcgcagccgcagcactgaccaatcccctcctggtgtcttgctag

SEQ ID NO: 55142 - DNA, 987 bp, Artificial Sequence
  Description of Artificial Sequence: Synthetic coding sequence
atgtacacactgcacacgaagcgcgtgaaggccgcagcccgacagatgtggacgtccaacttaagtaaggtgcggcagagcttgaaaaacgtttatcacaaatgtaagatccgccaccaagattccacaggctaccccactgtgacctccgacgactgcaaccaagatgatgactcatatgacggtaagatgaatttgcccgtcgtccttcaagatgtgaaaaccgctcaggttgaattgtttagccagatgaccgatatcgtgcacatgattccaaaagtccaagaaaaaaccgatttgtaccaaaagcaaatggaggtgctggagacccgcatgaacgtgaatgaagacaagcagtgtaccactactaaggacatcctgtctatgaaagaggacattaaggctttaaagaaaaaggtgaccgagctcgagattcagaatagctgttcaaccattcattgccttgagatcctcgagggcgagcgagggaaagagataacagagttgctctacaagctaatacaacccgctactctgaagaacaccctcgcaagtaccgatatggaaatctcaagcgccgagcccgaaaaagtgccaagttatccaaaatccacagaccacctggaaaagaagactattagcccccagatgaaaacgttgaaaaagaggaaccaccagaatgcctcaaggtcatttgagaaagccaagcccaatatctacatctaccctgatttcagtacttggatcaaactgactttcgtgcacggcggaaaatggacattttttctttccgccactaagcttgaagaatttatccagtggttattgtcaaggccgaccatcctgccggaggagccccaggtgattacccagaggtactgccccttcacgggacccattctcagccttaccacaatttgtctgtcaatattcaataatatctacgggttcatttgcagtctcaaagaagaagtgactagactttag

SEQ ID NO: 55143 - DNA, 906 bp, Artificial Sequence
  Description of Artificial Sequence: Synthetic coding sequence
atggggaaccgcttgagggcagagctcgggaggcccgagcggtggcttctccatcatgccttgcctccagccccagaagctcgcaagccgggagaggagcctcgtcgccctctggatcgctcgccgcctttgggccaggtgcaacctcacttcacgtctcaggacgctaaatcagcagaagatgaggctcccagccgacacttgggcaaacaccagccaagaagcgcgcaagtgggaagtaggcttgatgcactccaggggcctaaaactcagcacagcattcacaccgtcacttgcaagagccctcgtcagaaggaggaccgctctccgaagccgcctcaggcaccacagcatcctgaagagcacgggaggcagtcgcattcctcttcttctttcgcgtctggcactcttcaggacatgtggcggctcttggacctggggagctcaccatccggcgtgacatcccagggtgacagcaccccagaaatgggcagccactacgtgacgcaagcgggtctggaactcttaggttcttcgtcccctgctgctctggctagccagtctgcagagatgacaggggtcggccctaccccttccctcgcctggagcggggcactgcatcctaatatgaaccaagaagccagtctcgtacggagtacttgggcccctggtatgcggggtggaatgaatggaggctcgtcgtcggtgtgcaaaaatatgcagaggggccctcactggagcccctcccaacagccatgttccggtatacgcactgtgctgctgtcacgcaaggaaagaactctcctgagttgtttcagcttacccgctccggtagtgttggtgccactgctcctgtctggacaggccgtgacggagagagcgggacatgctggggacatcttatag

SEQ ID NO: 55144 - DNA, 2751 bp, Artificial Sequence
  Description of Artificial Sequence: Synthetic coding sequence
atgctgcccctggggagcgagcccgctctgaatgagctactgctccggaaggaggaagagtggcgggcactccaggctcatcggactcagctgcaggaagctgccttgcaggacacacgttcgcagttggaagaagctcagggtaagctgcggtgcctgcaggaagacttcgtctataacctgcaggtgctggaggaaagggacctggagctagaaagatacgatgctgcctttgcacaggccagagagtgggaagaggcacggagggccgaagtcagcgagctgaaaattgaagctgctaagctgcggcaagctctagcaagagaagcacggaaggtcgaggagctgcagcaacagcagcagcttgccttccaggagcacagactagaactggagcgagtacattctgataagaatggtgagatagaccaccatagggagcagtacgagaacctgaaatggaccttagagcggaaactggaagaactggatggcgagctggctctgcaacgccaggagctgctgctggagttcgagagtaagatgcgcaagagggagcacgagtttcggctgcaggctgacaacatgtctaacacagccctgtcccgggagcttaaggtcaaacttctccacaaggaactcgaggcactgaaagaagcaggagctaaggctgcggagagcctgcagcgtgctgaggcaactaacgccgagctggaacgaaaactacagtcaagggcaggagaattgcaggacttagaagccatgtcccgggcacgtgtcaaggacttggaggacaaactgcactccgttcagttgactagaaagaaggaggaagagaccttcaaacgcaagcacgaggagctcgatcggctggctcgcgaaaaggatgctgtgctcgttgccgtgaagggagctcacgtcgagcaattgcaggaactgcagactagagtgcttgagctgcaagcccactgcgaaacactggaagctcaactgcggcgagcagaatggcgccaggcggacacagcaaaggagaaggacgctgctattgatcagctacgggaagatgcatcaaccgttaaaagtgcttgggacgcccagattgcccagctctctaaagagatggtttctcgggatctgcagattcagacattgcaggaagaggaggttaaactgaaggctcaagtggcacgatctcagcaggacatcgaaaggtacaaacaacagttgtctctggcagtggagcgcgagcggtccctggaacgagatcaagtgcagctgggattggattggcagaggcggtgcgatgacatcgagcgggatcagatacaaaaatctgaggccttaatacaaggcttgtctatggcgaagtcccaggtcgctgcaaaactacaggagaccgaacaagcacttcaagaacaagaagtggtgctgaaggccgtaactctggaaagagaccaagccgtgcaggccttgcgcatgcatgggctgcccagacccggtgcccagatgttgctgcgccaacatgaggaggagatttcaaaagactttccatccagcgaaatacagcggttgcgtgagcagaacacatcccttcgaaatgccatcgctcagatgagaaaggaaatggaggccctgtcccatcagattccgccaccaatccaaaccgctgccgagtccacagacgctaatcagcctgaccctgaggccggaggagacgcagctactccagattacgtgctggctctggaggcggagatccggaccttaaaacataaatttaaaacgctggagaaacacctggaggatgtgctggacccccttaagatgagttctcctcacgcggagagtcaaccgagcgtgcgcacctccacggaaacaacaggaggttccgcccaagccggacaggctggagggagcgtgcaagcaggacaggcaggcggatccgttcaggcaggacctgtgtccagtggcctggccctgagaaaactcggcgatcgagtgcagctcctgaatttactcgtgaccaggctaaggcaaaaggtactacgcgaacccttggaacccgctgctctgcagagagagcttccccgagaggtggatcaggtgcacctggaggttttagaactgagaaaacaggtcgcagagctgggcaaacatctgagaatcgcacagcacgggggtgcggagcccagcgggaggaagcagccgccagcctcagatgccgtggccctaggtagggagcaggatgccaaaagcgctgaggacgaggcgccatcgcgccacctggggaagcaccagcctaggtcagcccaggtcggatcacgcctggatgcattacagggtccgaagacccaacatagcattcacactgtcacgtgtaagagcccaaggcagaaagaggaccgaagtccaaagcccccacaggctccccagcaccccgaggagcacggtagacagtcccactcatcttcttcgtttgccagcggtaccctgcaggatatgtggaggttgctggatctcgggagtagcccctcgggcgttacctctcagggagattccacccctgaattgcctgccccacccgctgccgaccggaggccagtaaagatgcaggctggtattgcaactcccggaatgaaaaccgctgcccaggccaaggccaagacgaccggggcatcccgatcacatcccgctaaggccaaaggttgccagcggccacccaagatccgcaattacaatataatggactag

SEQ ID NO: 55145 - DNA, 2751 bp, Artificial Sequence
  Description of Artificial Sequence: Synthetic coding sequence
atgttgccactgggcagcgagcccgctctgaatgagctgctgctaagaaaagaagaggagtggcgagcattgcaggcacaccgaacacagctgcaagaggcggctcttcaggataccaggtctcagctggaggaggcacagggaaaactgcggtgcctgcaagaggattttgtgtacaatctccaggtccttgaggaaagggacctcgagttggagcgttatgacgcagccttcgctcaagccagagagtgggaggaggccagaagagctgaagtgtccgaactcaaaatcgaggcagcaaagctacgccaagcactggcaagggaggcgcgaaaggtcgaggagctgcaacagcagcaacaattggctttccaagaacaccgcctggagctcgagcgagttcactctgacaagaacggagagattgaccaccatcgggagcaatacgagaacctgaaatggactctggagcgcaagctggaggaactggatggagagctggcccttcagcgccaggaactcctgttggagtttgagtccaagatgcggaaaagggagcacgagtttagactgcaggccgacaacatgtcaaacacagccctctcaagagaactaaaggtgaagctgctccacaaggagttagaggctctgaaggaggcaggggcaaaagcggctgagagcctgcagcgcgctgaggccaccaacgccgagctggagcgaaagctgcaaagccgcgctggagaactgcaggacctggaagccatgtcacgcgctcgtgtgaaagatttggaggataaactgcactctgtacaactaacacggaaaaaggaagaagagaccttcaaaagaaagcacgaggagctcgataggctggcccgagaaaaggatgcggtcttggttgccgtcaagggtgctcatgttgagcagttgcaggagctgcaaaccagggtcctggagctgcaggctcactgtgagaccctggaggcacagctccggagagcagaatggagacaggcggacactgccaaagaaaaagacgccgcaatagaccagctgcgcgaagacgcaagtacagtgaaatctgcttgggatgctcagattgcgcagctgagcaaggaaatggtctccagggacctgcaaatccaaacgctccaggaagaagaggtaaagcttaaagcccaggtcgctaggtcccagcaggacatcgagaggtacaaacagcagctgtcactagctgtggagagagagaggagtctggagagagaccaggtgcagctcggcctcgactggcagcgacgctgcgatgatatcgagagggatcagatacagaagtcggaggccctgatacaaggactatccatggctaagtctcaggtggcagcgaaacttcaggaaacagagcaggccctgcaggaacaagaggtggtgctgaaagcagtgaccttagagcgggaccaggccgtgcaggctctacgcatgcatgggcttccaaggcctggcgctcagatgctcttaagacagcacgaggaggaaatctcaaaggatttcccctcatcagagatacagagactgagggaacaaaatacctccctgaggaacgcaattgcccagatgcggaaggagatggaagctttgtctcatcaaatacccccacctatccagacagctgccgaatccaccgacgcaaatcaacccgaccctgaggccggaggcgacgcagctactcccgactatgtgctggcgcttgaggctgaaatccggacgctgaagcacaaattcaagacactggagaagcatctagaggacgttctggacccactcaagatgtcaagcccacacgccgaaagtcagccttctgtgcgcacttcaaccgagacaaccggtggaagcgcccaggccggacaggctggtggctccgtgcaggccggacaggccggaggtagtgtgcaggccggacccgtgtctagcggtctcgcacttcgaaaactgggggatcgggttcagttgcttaatctgctcgtgacacgtctacgacagaaggtcctgcgtgaacctctggagcctgctgccctccagcgggagctaccgagggaggtagatcaagtgcatctggaagtactagagcttaggaagcaggtagcagagctaggaaaacatctcagaatcgcacaacatggaggagcagagccctctggtcgcaaacaacctcctgcgtctgacgccgtcgccctgggccgtgagcaggacgctaagtctgcggaagacgaggctccgagtagacatctgggcaaacatcagccacgctccgcccaggtcggctcacgcctggacgcgctccagggcccaaagacccagcacagcatccatactgtgacctgcaagagtcccaggcagaaagaggatcggagcccaaaaccgcctcaggcccctcagcaccctgaagagcacggcagacagtcccactcatctagctcctttgccagcgggactctacaggacatgtggcgattactggacctgggttccagccctagcggagttacctcccagggcgactccacaccagagcttccagcaccccctgccgctgaccgaaggccagtaaagatgcaagctggtatcgcgacaccgggaatgaaaactgcagcccaagccaaggcaaagactaccggagcctcacgaagtcacccggctaaggccaaaggttgtcagagaccgccaaaaattcggaactataacatcatggactag

SEQ ID NO: 55146 - DNA, 1653 bp, Artificial Sequence
  Description of Artificial Sequence: Synthetic coding sequence
atgaccaaagttcccgcaacaaagaagctacagtcgagcccaaactccggcgcagtgcgaccattttacgcttccgagaatttgagacaggtgccagacaaaccaatgaaatcaatcaaatacatggacaaggaaatcatcaaccttaagaaagacctcatcagaagcaggtttctgattcaatccgtcaaaatcggtcggggatactttgcaatcctgagggaggagacagctaaaaaaaaaaagcagcagcagttgcagaaactaaaagaagaggagcgcaataagttccagcccgcagaaaagatctcagaaatccactacggagatacccttctgtccacatatgatgatgaaaagctgaaaacacttggcgcaagggtcacgcgacggccattcactccaattcatagctgcattatttccccctctttgacagaggcccacgtggagcctctgtttagacaactctgcgctctccattggctcctggaagccttgaccattgaccatacccaccataccatgaaacctgtgatcacttgttggaatccgaaagatcctgggggttctaagtcgaccattaagaagattaacaaggataagtctatggggcagaaatgggaacatttcattaccgctcccaaaactaaaaaatttaagattcccactatgcgtgtgactaaccgaaagcctagtcgaaggggaagcaccctctcgctgtcccgagcttctggagggagttcccctcaaagctctatgatctctgtgaatcctggaagcgatgagcctcctagcgtgaatacccaggttacatctagcaaagacattgaagataacgagtcgagttccactaagcctgatgaggagccactgtatatgaacttgcagaagttgttagagatggtccgtgaggacgcaagaaggactgtgactatcgagaacgggatgcagagaaaggcaccatctatcctttccgtcttgaagcagaacaaaagcaacagcgcctataaggaaatgcagaccactctcaaatcttcggagcgctccagctccactagcgctgaaagccatatacagcccgtgcagaaaaaaagtaaaaatcggacaaattgtgacataaacatccactataagtctggagtgtgtaatacaatgagagctaaattctacagcgtggctcaggaggctggattttgtctgcaggataaaatggagattctcatgaagagacaggaagagagaggaattcagaaattccgggcttttgtactcgtgagtaatttccagaaagatatcgcaaagatgcgtcatcatatttccgtggtcaagggagatgccgaggagatcgcggaccactggtatttcgatcttctcagcaaactgcccgaagatctgaaaaattttaggccagccaaaaagatcctggtgaagctccagaagttcggggagaacctggacttgcgcatcaggccgcacgtactgctgaaggtgctccaggacctccgcatatgggagctatgctcaccggacattgctgtcgccatcgagtttgtaagagaacacattatccatatgccccaggaggactacatctcttggctacaatcccgaatcaacattcctattggaccatactcagccctcaggtag

SEQ ID NO: 55147 - DNA, 1692 bp, Artificial Sequence
  Description of Artificial Sequence: Synthetic coding sequence
atgagtgtcctaaagaagaacaggcggaaggattcagacaccccgcaggagccatcggagaaagccaaagagcagcaggctgaagccgaactgaggaagctacgccagcaattcagaaagatggtcgagtccaggaaaagttttaagttcagaaaccagcaaaaaatagcatcccagtataaggaaattaagacactaaagacagaacaggacgagatcaccctgctcctatcactgatgaagtcatcgaggaatatgaacaggtcagagaagaattatatggaactgcggctgctgctgcaaaccaaggaggactacgaagcactcattaaaagcctaaaggtactgctggcagaactagacgagaagatcctgcaaatggagaagaagatcgcaaatcagaaacagatcttcgccaagatgcaagaagcaaataacccaagaaagctgcagaaacagatccacatactggagaccagactgaatctggtcactgtgcattttgataagatgctgaccacaaacgccaaactgcgcaaggagatcgaagacttgaggttcgaaaaggcggcttatgataatgtatatcagcagctgcagcactgcctattgatggagaagaaaacaatgaatctggcaatcgagcaaagttctcaggcttacgagcagcgagtggaagctatggcacgtatggctgcaatgaaagacagacagaagaaggatacaagccagtacaatctggaaatacgcgaattggagcgtctgtacgcgcatgagagcaaacttaagtccttcctgctggtgaaattgaacgatcggaacgaatttgaagagcaggcaaagcgcgaagaagcactgaaagcaaaaaagcatgttaagaaaaacaggggggagagtttcgaatcttacgaggtcgcacatttgaggttgctgaagctggcggaaagtggaaatctgaaccagcttatcgaggatttccttgccaaagaagaaaagaactttgcacggttcacatatgttactgaattaaataacgacatggaaatgatgcacaaaagaacccagaggatacaggacgaaataatactacttcggagccagcagaaattatcccacgatgataatcacagcgtcctgcgacagctggaggataagctgcggaaaaccaccgaggaggctgatatgtacgagagtaaatacggagaagtatcaaaaacactggacctccttaaaaacagtgtagagaaactgttcaaaaagattaactgcgacgccaccaagattctggtgcaactgggcgagaccggaaaagttactgacatcaacctccctcagtattttgctatcattgagaagaagacgaatgacttgctgctgttggaaacatacaggaggatattggaagttgagggcgcagaagcggagatccctccaccatttattaaccccttttggggagggtccgctctgcttaaaccccctgagccaatcaaagtgattccccctgtacttggcgcagatcccttctcagatcgtttggatgacgtagaacaacccctggaccactcctccctgagacagctggtcctggataattacatcctcaaagaaaataggagcaaggaggtcagaggtgattcgctgcccgaaaaagtggatgattttcgctcccgaaagaaggtcaccatgtag

SEQ ID NO: 55148 - DNA, 1527 bp, Artificial Sequence
  Description of Artificial Sequence: Synthetic coding sequence
atgtcatctcccgatggcccaagctttccaagcggccctcttagtggcggtgctagtccaagtggcgacgagggcttttttccctttgtgttggagaggagagattcgtttcttggagggggtcccggacctgaagagcctgaggatctggccctacagctgcagcagaaggagaaagatctgctgctcgcagctgagctgggcaaaatgttgcttgagaggaatgaagaactgagacggcagctcgaaactttatcagcgcagcatctggaaagggaggaacgcctgcaacaggaaaaccacgagcttcggagagggctggctgcacgaggtgccgaatgggaagctagagctgtagagctggagggagatgttgaagcacttagggcacagctgggggagcagcgcagtgagcagcaggatagtggtcgagaacgcgctcgtgccctgtctgagctctcagagcagaacctgaggctgtctcagcaactggcccaagcctcccagactgagcaggaacttcagcgtgagctcgatgccctgaggggccaatgccaggcccaggctcttgcaggggctgaactgcggacaagactggagagtctgcagggagagaaccagatgctccagtcccggagacaggatttggaagcccagattcggggtttacgggaggaagtggaaaaaggggagggcaggttgcaaactactcacgaggagctcctcttgctgaggcgcgaacgtagagagcattcactagagcttgaaagagcaagaagcgaagcaggcgaagcactctctgctctgcgccgtttgcaacggagggtttcagagttggaagaagagtcccggctgcaggacgctgacgtatccgccgcttcgttgcaatctgaattggcgcacagcctcgatgacggcgatcaggggcaaggcgctgacgcaccaggtgacactcccaccacccggagccccaagactaggaaagctagctcgccgcagccatcacctccagaagaaattctggagcctcccaaaaagcgtacgtctttgtcacctgccgagattctggaagaaaaagaggtggaagtcgccaaactgcaggatgaaatcagcctgcaacaagccgaacttcagtctctccgggaggaactacagaggcaaaaggagctccgagcccaggaggaccccggtgaggccctccacagtgccctgtccgatcgggatgaagcggttaataaggcgctggaattgtctctgcagctgaatcgggtgtccctggaacgagatagtctctctcgggaactgctcagagctattaggcagaaggttgctctgactcaggagcttgaggcctggcaggacgacatgcaggtggtaatcggccagcagttgaggagccagcgccagaaagagctgagtgccagtgcgtccagcagcacacctaggcgcgcagcgccaagattctcacttagactggggccagggccagcaggcggatttctttctaatttattcagacgcacgtag

SEQ ID NO: 55149 - DNA, 2745 bp, Artificial Sequence
  Description of Artificial Sequence: Synthetic coding sequence
atgggtaataaagccaaaattgcaaaatgtcctctgcgtaccaagactgggcacatcctgaaatccacacaagacacctgcatcggctcggagaaactgctgcagaaaaagccagtggggtctgaaacttctcaggccaaaggcgagaaaaatggtatgaccttttcaagtactaaggacctgtgcaagcagtgtatcgacaaggactgcctgcacattcagaaggagatatcgccagcaacccctaacatgcagaagactcgaaatactgtgaacaccagcctagtgggtaaacagaaaccacacaagaaacacatcacggccgagaacatgaaaagtagcctggtgtgcttgactcaggatcagctccagcaaattctgatgacagtgaatcagggcaatcggagcctctcacttaccgagaacggcaaagaagccaagagccaatattccctctacctgaattctattagcaaccagcccaaagacgaaaatatcatgggcctctttaaaaaaactgaaatggtaagttcagtgccagcagagaacaagtccgttttgaacgaacatcaggaaaccagtaaacagtgcgaacagaaaatcgccattgaaaacgaatggaagccagccgacatcttcagtaccctcggggagcgggaatgtgacaggtcatctttggaggccaagaaagctcaatggaggaaagagcttgacgagcaggtggctcttaaaaaaaaggagaaagaggtcagcgagaagtggaacgatccatggaagaagagcgagtccgataaaatcatctgggaaaaacatcagattctggatcagagcagagagacagttctgctcgagcaccccttctctgcggtgaagcaggagctgcagcgaaaatggatcgaggagctgaataagcaaatcgaagacgatcgccagaggaaaatcgaagagaagattatctatagcaagggtgaagaacacgatcgatgggctatgcattttgattcactgaaatcgtatccgggatctcaaagccagctcttttcacaatctacccacaagcaacctgagtacttctgcgtttctccagatactcaggagctagccgatgtttcttctgtgtgtacgcctactactggtagccaggtggaaccctcggaggaggagcatatcgccaagccaatcaaggatgtcgttatggccaactctaagaagaccaattttctccggtccatgactgccctgctggacccggcacagatcgaggagagagataggcgtcggcaaaagcaactcgaacatcaaaaggccatcacagcgcaagtggaggagaaacggcgtaagaagcagctggaagaggagcagagaaagaaagaggagcaggaagaagagcttcgcctggcccaggaaagggaggaaatgcagaaacagtacgaggaggatatcctgaagcagaaacagaaagaggaaattatgaccttgaaaaccaacgagctgttccaaactatgcagcgcgctcaggagctcgcacagagactgaaacaggaacagcgcattcgggagctcgctcagaaggggcacgatacctcgaggttgataaaaaaccttggtgtcgatacaatccagatggagtacaacgcatcaaacatttccaactcccgccacgatagtgacgaaatctcgggcaagatgaatacatatatgaacagcacaaccagtaagaaggatacaggggttcagacggacgaccttaacatagggatatttactaatgctgagtcccactgtggttctctgatggaaagggacataacaaactgttcctcccctgaaatctcagccgagctgattggccaattctctacaaaaaaaaataaacaggaactgacacaagataagggcgcttcactagagaaggagaacaaccgctgtaatgaccagtgcaaccagtttactcggattgagaaacaaaccaagcacatgaaaaaatatcctaagaggcccgactggaatatcaataagcctcccaaaaggtacatacccgcatcggagaagtaccccaaacagttacagaagcagcgagaggaaaaaaaagtaaggaggcaaatggaactgctgcacttagtggaaaaaaataacccgggacacctctctcaaaatcggggaatttcccccgaaatctttcacagtagccaccaagagacagagtccaagctccgctggcatctcgtgaagaaagaagaggaaccgctgaatatccactccttctccaaagaacgcagcccatctagtccagttccagtggtcaaaaaccggactcagcagacacaaaacaccctccacttgcctcttaagaattcgagctatgaacgcgagaacttgattagcggcagtaaccaaaccgagctgtcctcgggtatttccgagtcatcccattttatcccttacgtccgcaccaacgagatttactaccttgaccccgacgcgccactgagcgggccaagcactcaggatccacagtaccaaaattctcaggattgcggacagaagaggcaactgtttgactcagactgcgtacgcgatccattactcaacccgaacatggtcaaaaatcgcgatcgccagcaagccatcctgaagggcctatctgaactgagacagggcctgttgcagaaacagaaggagctggagtcctctttacttcccttggcggagaaccaggaggagtcattcgggtccagcttctag

SEQ ID NO: 55150 - DNA, 2847 bp, Artificial Sequence
  Description of Artificial Sequence: Synthetic coding sequence
atgaatctgggtgatgggctgaaactggagactgagctgctggatgggaaaaccaagctaatcttgagcccttacgaacataagtccaagatttcagtcaagatggggaataaagccaagattgcaaaatgcccactgcgcaccaaaaccgggcatatactcaagagcacccaagacacttgcatcggctcagagaagctcctccaaaaaaaacccgtcggctccgaaaccagtcaggcaaagggcgagaagaacggaatgactttctcttctacaaaggatctgtgcaagcagtgtatcgacaaagattgcctacacatccaaaaagagatttccccagctactcctaatatgcagaagacgcggaacacagtcaatactagcctggttggaaagcagaagccccacaagaaacatatcaccgctgagaatatgaagagctcactggtgtgtctaacacaagaccaattgcagcaaatactgatgaccgtaaaccaagggaatcggtccttgtccttgactgaaaatggaaaggaggccaaaagtcagtatagcctgtatctcaattcaatctccaaccagccaaaggacgagaatattatgggcctgtttaagaaaactgagatggtgtcctccgtaccagcggagaataaatcggtcctgaatgaacatcaagagacttcaaagcaatgcgaacagaagatcgccatcgagaacgagtggaagcccgctgacattttttcaacccttggggagagggagtgtgatcggtccagcctcgaggccaaaaaggcccaatggagaaaggagctagatgagcaggtcgccctgaagaagaaggagaaggaggtctcagagaagtggaacgatccttggaaaaagtccgaaagcgacaagattatctgggagaaacatcaaatcttggaccagagccgcgagaccgtactgctggaacaccctttttccgctgtgaaacaggaattgcagcgaaagtggatcgaggagctgaacaagcagatcgaggatgacagacagaggaagatagaggaaaaaataatttactcaaagggagaagaacatgatcgatgggccatgcatttcgactctttaaagtcctatcccggtagtcagagtcagctgttttcccagtctacccacaaacaacctgaatatttttgcgtctcgccagacacacaggagctggctgacgtctctagtgtatgcacacctactacaggctctcaggtggagccttccgaggaggagcacatcgctaagccaatcaaggatgttgtgatggctaatagcaagaaaaccaattttttaagatctatgactgctctgctggatcccgctcaaatcgaggaaagagacagacgccgacaaaaacagctggagcaccaaaaggcgatcacagcccaggtcgaggaaaagcgcagaaagaaacagctggaggaggagcagagaaagaaggaggaacaagaagaggagcttagactcgcccaggagagagaggaaatgcagaaacaatacgaagaggacatactaaagcagaagcagaaggaggagatcatgaccctgaagactaacgaactctttcagaccatgcagagagcacaggagctggcacagcgactgaaacaggagcagcggatacgtgagctagctcagaaaggacatgacacttccaggctgataaaaaatttaggagtggacacaatccagatggaatataacgctagtaatatctctaacagccggcatgacagtgacgagatctcggggaaaatgaatacatacatgaactctactacttctaagaaggacacaggtgtgcagaccgacgatctgaatatcggcatcttcactaacgccgagtcccactgcggatcattgatggaacgtgatatcacgaattgttcgagtcctgaaatatctgccgaattgatcggacaattttctaccaagaaaaacaaacaggagctgacacaggacaaaggggctagtctagaaaaggagaacaacagatgcaatgaccaatgcaaccagttcacaagaatcgagaaacaaacgaagcatatgaagaaataccctaagaggcctgattggaacatcaataagcctcccaagagatatatccccgcaagcgagaaatatcctaagcagctgcaaaaacagagagaagagaaaaaggttagacgtcagatggagcttttgcatcttgtagaaaagaacaaccctgggcatctgagtcagaatcgagggatttcccccgagatatttcattcatcacatcaggagactgaatccaagctgcgctggcatctggtcaagaaggaagaagaacctctgaatattcactcattctccaaggaacgtagtccgtcttctccagtgccagttgtcaagaaccgaacacagcagactcagaacaccttgcatcttcctcttaagaactcatcctacgaaagggagaacctgatctcaggctccaatcagaccgagctttcttcagggatctctgagagctcacactttataccctacgtaaggactaacgaaatttattacctggatcccgacgcacctctcagcggaccaagcactcaggatcctcagtaccagaattcacaggattgtgggcagaagcggcagctgttcgattcagactgtgttagggaccctctgttaaacccaaacatggttaaaaatcgagaccgccagcaagctatccttaaggggctgagcgaactgaggcagggcctgctccagaagcagaaagagttggagtcatcactgcttcctctggccgaaaaccaagaggagtcctttggtagcagcttttag

SEQ ID NO: 55151 - DNA, 2847 bp, Artificial Sequence
  Description of Artificial Sequence: Synthetic coding sequence
atggatttgctggatggtttaaagctggagactgaactgctggatggcaaaactaaactgatattgtctccttatgagcataagtctaagatctcagtgaagatggggaataaggcgaagatcgctaaatgccctttacgtaccaagaccgggcacatcctgaaaagcacacaggatacttgcattggttctgaaaagcttctgcaaaaaaagccagtcggctctgagacatcccaagccaagggagaaaaaaatggaatgactttctctagcacgaaagatttatgcaaacagtgtatagataaagactgcctgcacatccagaaagaaattagtcctgcgacaccaaacatgcaaaaaactagaaatacagttaatacgtccctggttggtaagcagaaaccgcacaagaagcatatcacggccgagaacatgaaatcctcccttgtctgtctaacgcaggatcagttacagcagattctaatgactgtgaaccagggcaaccggtctctgtccttgacagaaaatggtaaggaagctaagtcccaatactccctgtacctgaattctatctcgaaccaaccaaaagatgagaacatcatgggattgtttaagaaaaccgagatggtttcaagtgtccccgcagagaataaatccgtcctcaatgaacaccaggagacatctaagcagtgtgagcagaaaatcgcgattgagaacgagtggaagccagctgatatattcagcacccttggcgagcgagagtgtgaccggagcagtttggaggccaagaaggcccagtggaggaaggagctcgacgagcaggtcgctcttaagaagaaagagaaggaagtcagtgagaagtggaacgatccatggaaaaagagtgaaagcgacaaaatcatctgggaaaaacaccaaatattggatcagagcagggagacggttcttctggagcacccgtttagcgccgtaaaacaggaacttcagagaaaatggatcgaggagttaaataaacagatagaagatgacaggcagagaaaaatcgaagaaaagatcatctactcaaagggagaggaacacgatcggtgggcgatgcattttgatagcctcaagtcctaccctgggagccagtcccagctcttctcacagagcactcacaagcagcccgaatatttttgcgtttctcctgacactcaagaacttgccgatgtgagttcagtctgtaccccaaccacgggctctcaggtggagccatcagaagaggaacatattgcaaaaccaattaaagatgttgtcatggccaactccaagaagactaacttcctgcgcagcatgactgccctcctggaccccgcacaaatcgaggagcgtgataggcgacgccagaagcaattggaacatcagaaagctattacagcccaggtggaagagaagcgaagaaagaaacagctggaggaagagcaaagaaaaaaagaggaacaggaggaggagctacggttggcccaggaacgcgaagaaatgcagaagcagtacgaagaggatattctgaaacagaagcagaaagaggaaataatgacactcaagactaacgagctttttcagacaatgcagcgggcacaggagcttgcccaaagattgaagcaggaacagcgcatcagagagttagctcagaaaggacatgatacctcaaggttaatcaagaacttaggtgtagacaccattcaaatggagtataacgcttccaatatcagcaatagcaggcacgacagtgatgaaatctccggcaaaatgaacacctatatgaacagcaccacaagcaagaaggatacaggggttcagacagatgacctaaatatcggtatattcacgaacgctgagtcccattgcggaagcctgatggagcgtgatatcactaactgctctagccctgagatctctgctgagctgatagggcagttcagtactaaaaaaaataagcaggaattgactcaggacaaaggagcatcactggaaaaggagaataataggtgcaacgaccaatgcaatcagtttacccgtatcgagaaacagaccaaacacatgaaaaagtacccgaaaaggccagactggaacatcaacaaacctccgaagcgctacataccagcttcagaaaagtatccaaagcagctgcagaagcagcgcgaggagaagaaagtaaggagacagatggagttactgcaccttgtggaaaagaataaccccggacacctcagccagaatagaggtatttcacctgaaattttccacagctcccaccaagagacagaatccaagctccggtggcacctggtcaaaaaggaagaagagcctctcaacattcactccttttccaaggagaggtctccatctagtccagttcccgttgtcaagaatcggacccaacagacgcagaatacactgcatctgcctctgaaaaacagctcatacgagcgagaaaacttaatcagcggctcaaatcagactgagctgtcgtctggaattagtgagagctcacacttcatcccatacgtccgaacaaatgaaatctactatctcgacccagacgcaccactgtctggcccatccacgcaggatccacagtatcagaactctcaagactgcggccagaaacggcagctgttcgatagtgattgcgtccgagatcctctgctgaatccaaacatggtgaaaaacagagatcggcaacaagccattctaaaaggcctgtctgaactacgacagggactgttacagaagcagaaggagcttgaatctagcctacttccattagccgagaatcaggaggagagctttggttcatctttctag

SEQ ID NO: 55152 - DNA, 864 bp, Artificial Sequence
  Description of Artificial Sequence: Synthetic coding sequence
atggatctgctggacggactcaagctcgagaccgagctgttggatgggaagacgaagctgattttgtccccttatgaacataagagcaagatctctgtaaaaatgggtaataaagcaaagattgccaaatgtcccctgcggactaaaaccgggcacatcctcaagtctacccaggacacttgtattggcagtgagaagttgctgcaaaaaaagcccgtggggagcgagacgtctcaggccaagggcgagaaaaatggcatgacattttcatctaccaaggatctttgtaagcagtgtatcgacaaggattgtctgcacattcagaaagaaatctcccccgctacacctaatatgcagaagacccggaacactgtgaatacatcgctcgtggggaagcagaagccacacaagaaacacatcaccgccgaaaacatgaagagctccttggtgtgcctcacccaggatcagctgcagcaaattctcatgactgtgaatcagggtaatcgctcactgtccctgactgaaaatggcaaagaagcaaaatcacagtattccctttacctgaactctatctccaatcagcctaaagatgagaatatcatgggtttattcaagaagactgagatggtctcatcagttcctgctgaaaataagagtgtcctgaacgaacaccaggaaaccagtaagcagtgcgaacagaagattgctatcgaaaatgagtggaaacccgctgacatctttagcaccctgggagaaagggagtgtgacagatcctccctcgaggccaagaaagcgcaatggaggaaagaattggtgctgcagacagtgcaggcctggtatcaacacctcctgggcttctggtag

SEQ ID NO: 55153 - DNA, 1815 bp, Artificial Sequence
  Description of Artificial Sequence: Synthetic coding sequence
atggaaaaccaggcccataatactatgggaacatctccttgcgaagctgagcttcaggagctaatggaacagattgatattatggtgagtaataaaaaaatggactgggaacggaaaatgagggccctagaaaccaggctggatctcagggaccaagaactcgcgaatgctcagacttgtttggaccagaaggggcaggaggtgggccttctgaggcaaaaactggactcattggagaaatgcaacctcgccatgacccagaattatgagggccagttgcaatctttgaaggcgcagttctcaaaactgaccaataacttcgaaaaactccggctacatcagatgaagcagaacaaggtccccagaaaagaactgccacacctgaaggaggaaatccctttcgaacttagcaaccttaatcaaaaacttgaggagtttagggcgaagtcacgggaatgggacaagcaggaaatcctataccaaacccatctaataagcctggatgcccagcaaaaactgctgtccgagaagtgtaaccagtttcagaaacaagcccagtcttaccaaacgcaactgaatggaaaaaaacaatgtctggaggacagctcttccgagatacctcgactcatatgcgatcccgacccaaattgtgagattaatgagagagatgagtttattatcgaaaaattaaaaagcgccgtgaatgagatagcattgagcagaaacaagctgcaagatgaaaatcaaaaactcctgcaggaacttaaaatgtatcagcgccagtgtcaggctatggaagctggactcagcgaagtcaagtccgagctccaatccagggatgacctccttcgtattatcgaaatggaaagactccagctgcaccgggaactgttgaaaatcggggaatgccagaacgcacagggtaataagaccagactggagagttcttacttacctagcatcaaagaacccgagcgcaaaattaaggagctgttcagtgtgatgcaggaccagccaaatcatgagaaggagctgaataaaattagatctcagctgcagcaggtggaggagtatcataacagtgagcaggaacgcatgaggaatgaaatatccgaccttaccgaagaactacaccagaaagaaatcaccatcgccaccgtgacaaagaaggcggctctcttagagaagcagttgaaaatggagctggagataaaggagaagatgcttgccaaacaaaaggtgtccgatatgaaatacaaggccgtgaggaccgagaatacgcacctgaagggaatgatgggcgacctcgatcctggtgaatatatgtccatggattttaccaatagggagcagtctcggcacacaagcattaacaaattgcagtatgaaaatgagaggctcagaaatgatcttgcgaagttacatgtgaacggtaaatctacatggacaaaccagaacacttatgaagagaccggcagatatgcgtatcagagtcaaatcaaagtggaacagaacgaggagagactgagtcacgattgcgagccaaatcggagcactatgcccccattacctccttcaaccttccaggcgaaggaaatgacttcccctctagtctctgatgatgatgtgttccctctgtcacctcctgacatgtcgtttcctgcgtcattagccgctcaacacttcctgctcgaagaagagaaacgtgctaaagaattggaaaagttgctgaacacgcacattgacgagctgcaaagacacaccgagttcaccttgaataagtattctaaacttaaacagaaccgccacatctag

SEQ ID NO: 55154 - DNA, 990 bp, Artificial Sequence
  Description of Artificial Sequence: Synthetic coding sequence
atggagaatcaggcacataacactatggggacctccccctgtgaagcagaactgcaagaactcatggagcagattgatatcatggtctctaacaagaaaatggattgggagaggaagatgcgggctctcgaaacccgacttgatcttagggaccaggagctggctaacgcccagacttgtctggatcagaaggggcaagaagttggcctcctacgccagaaacttgatagcttggagaagtgtaacttggctatgactcagaactacgagggacagctgcagagtctcaaggctcaattctcaaaattaacgaataatttcgagaaactccggttacaccagatgaagcaaaacaaagtcccaaggaaggagctgcctcatttgaaagaagaaatcccattcgagctctctaacctgaaccagaagctcgaagagttccgggctaaatcccgcgaatgggataagcaggagatactgtaccagactcaccttatctcgttggatgcccagcagaagctcctctctgagaagtgcaaccagttccaaaagcaggcacagagttaccagactcagctgaatggaaagaaacaatgcttagaagactcctcatctgaaattcctcgccttatctgcgaccccgaccccaattgtgaaattaatgagcgggacgagttcatcatcgagaagctcaaatctgcagttaatgaaattgcattaagtcgcaacaaactgcaagacgagaatcagaagttactacaggaacttaagatgtaccaacggcagtgtcaggcgatggaagccggactcagcgaggtaaaatcagaattacaatcccgtgatgacttacttcgtatcatcgagatggagaggctacagttgcatagagagttacttaaaatcggggaatgtcagaacgcccagggaaataagacacgactggagagctcttatctgccctccataaaagagcccgagcgcaagattaaatag

SEQ ID NO: 55155 - DNA, 1815 bp, Artificial Sequence
  Description of Artificial Sequence: Synthetic coding sequence
atggagaaccaggcccacaataccatgggtacgtctccttgcgaagccgaacttcaggagctcatggaacagatcgatatcatggtctctaataagaaaatggactgggagaggaagatgcgggctctggaaacccgactggatttgcgggatcaggagttggccaacgcccagacatgtttagaccaaaagggtcaggaggtgggcctactccggcagaagctggacagcctggaaaagtgcaatctggccatgactcagaattacgaggggcagctccagtcccttaaggctcagttcagcaagctaactaataatttcgaaaagcttcggctgcatcagatgaagcagaacaaagtccctcgcaaggagcttcctcatttgaaagaggagataccattcgagttatccaacctgaatcagaaactagaagagttcagagctaaatccagggagtgggacaagcaagaaatcctgtatcaaacacatctcatcagcctggacgctcaacagaagttgctgtctgagaagtgtaaccagttccagaaacaggctcagagctatcagacacagctaaacggaaagaagcagtgcctggaagactctagcagtgagattcccagacttatttgtgatccagatcctaactgcgaaatcaatgagcgggatgaattcatcatcgaaaaattgaagagcgcagtgaacgagatagccttgtctcgtaataagttacaggacgagaaccagaagcttctgcaggagcttaagatgtaccagcggcagtgtcaagccatggaggcagggctttccgaagttaagtccgagctgcagtcccgagacgatctcctgcgaatcatcgagatggagcggttgcagctccacagggaactcctcaaaattggcgagtgtcagaacgcgcaaggtaataagacccgcctcgagagtagctatcttccctccattaaggaacctgaaaggaagattaaggaactgtttagcgtcatgcaagatcagccgaatcatgaaaaggagctaaataaaataagaagccagctccagcaggtggaagagtaccataattccgagcaggaaaggatgcgaaacgaaatttccgatttgacagaggaattgcatcagaaggagattacaattgctaccgtgaccaaaaaggccgctttgcttgagaagcagctgaaaatggagctagaaattaaggaaaagatgcttgccaagcagaaagtatccgatatgaaatacaaagccgtgaggaccgagaatacacatctaaagggcatgatgggggacctggaccctggggaatatatgtctatggatttcacaaaccgcgagcaatctcggcacacctctatcaataaactacagtatgagaacgaaagactccgcaatgatctggctaaactacacgttaacggtaaaagcacttggacgaaccaaaatacctatgaagagacaggcaggtacgcctatcagtctcagatcaaagtggaacagaacgaggagagactcagccatgattgtgagcctaacaggagcaccatgccccctctcccaccttccacattccaagcaaaagagatgacttcaccattggtcagcgacgacgacgtattccccctaagtccacccgacatgtcattcccagcgagcctggccgctcaacactttcttctggaagaggagaaaagagcaaaggagttggagaagctattgaacacgcatatcgacgaactgcagcgtcacacagagttcaccctgaataagtactctaagcttaaacaaaacagacacatctag

SEQ ID NO: 55156 - DNA, 1008 bp, Artificial Sequence
  Description of Artificial Sequence: Synthetic coding sequence
atgacaacggttactgtgaccacggagatccctcccagagacaagatggaagacaactcagccctctacgagtcaaccagtgctcatattattgaagagactgaatatgttaagaaaatacgaactacgctacagaagatccgcactcagatgttcaaggatgaaatccggcacgacagtaccaatcacaaactcgatgccaagcactgtggcaacctccagcaagggtcggactcggagatggacccctcttgctgtagtctggacctgctgatgaagaagattaaagggaaggaccttcagctgctggagatgaataaagagaatgaagtgctgaaaataaagttacaggcttcgcgcgaagccggagccgctgcgctgaggaatgtggcccagagattgtttgaaaattaccaaacacagtcggaggaggtcaggaaaaagcaggaggactccaagcaactgctccaggtgaataaactcgagaaagaacaaaagctgaaacaacacgtggaaaatctgaatcaagtggcagagaagctggaggaaaagcacagccaaatcacggaactcgaaaacttagttcaacggatggagaaggagaagcgtacgttgctggaacggaagctatccctagaaaataagcttctgcaacttaaatcgtccgcgacctatggcaagagctgccaggatctgcagagagaaatctctattttacaggagcagattagccatctgcagttcgtcatccatagccagcaccaaaacctccggagtgtcatccaggagatggagggtttgaaaaataaccttaaggaacaggacaaacggatagaaaatctacgagaaaaggtgaacatcctggaagcacagaacaaggagctaaagacccaggtagccctgtcaagcgaaacgccccgaaccaaagtgagcaaggcagtttccacatccgaattgaaaactgagggagtttccccctatctcatgttaatccggctcagaaagtag

SEQ ID NO: 55157 - DNA, 1008 bp, Artificial Sequence
  Description of Artificial Sequence: Synthetic coding sequence
atgaccaccgtgactgtgacaacggagattccacctagggataaaatggaagacaattcggcactctacgaatctaccagcgcgcacatcatcgaggaaactgagtacgtgaagaagattcggacaacactgcagaaaatcagaacacagatgttcaaagacgaaatccgacatgacagtacgaaccacaagctagatgctaaacactgtggtaatctgcagcagggatctgacagcgagatggacccttcttgttgctcactggatttgttgatgaaaaaaattaagggaaaggatctgcagctgctggaaatgaacaaagaaaatgaagttttgaagattaaattgcaggcttccagagaagcaggagctgctgccctacggaatgtcgcccagcggctgtttgaaaattaccagacacagagcgaagaggtgcgtaaaaaacaagaggattccaagcagttgctgcaggttaacaaactggaaaaagaacaaaagctgaagcagcacgtggagaaccttaatcaagttgcagagaagctggaggagaagcactctcagattaccgaactggagaacttagtccagaggatggagaaagaaaaacggactctactggagaggaagctctcactcgaaaacaagctgcttcagcttaagtcatccgcaacctatgggaagagctgccaagatttgcagcgcgagatctctatcctgcaggagcagattagccacctgcagttcgttatccactcccagcaccaaaacctcagatctgtgatccaggagatggaagggctgaaaaataatctaaaggagcaggataagaggatagaaaatctccgggagaaagtcaatatcctggaagctcagaacaaagaattaaaaacccaagtggctctgtctagtgagactcccagaacaaaagtttctaaagctgtgagcactagcgagctgaagacggagggggtttccccttatctgatgctgattcgtctccgaaaatag

SEQ ID NO: 55158 - DNA, 1008 bp, Artificial Sequence
  Description of Artificial Sequence: Synthetic coding sequence
atgacgactgtgacagtcaccactgagattccaccccgtgataagatggaagacaattctgctctttatgagagcacaagtgcccacatcattgaagagactgagtatgtcaaaaaaatcaggacgacacttcaaaagatccgaacacagatgttcaaggacgagatcagacatgattcaactaatcataaactggatgccaaacattgcggcaacctgcagcagggtagcgactccgagatggatcccagctgctgcagtttagatctcctgatgaagaagatcaaagggaaagacctgcagctgttggaaatgaataaggaaaatgaagtactaaaaattaagctccaggcctcacgagaagctggcgctgcagcgctcaggaatgtcgcccagaggctgttcgaaaattaccagacacagtctgaggaggtgagaaaaaaacaagaggattccaagcagcttttacaagtgaataagttggaaaaggaacagaagttgaagcaacatgttgagaacctgaatcaggtggcggaaaagttagaagagaagcatagtcaaatcaccgagctagagaatttggttcagcggatggagaaggagaaacggaccctgctggagaggaaactatcattagagaataaactccttcagctgaaaagttccgcaacgtatggtaaaagttgccaggacctgcagagagagattagcatcctgcaagagcagatctcacatctacagttcgtgatccactctcaacaccagaacctgaggtcagtgatccaggagatggaaggccttaagaataacctgaaggaacaggataagaggatcgagaaccttcgggagaaagtgaacatcctcgaggcccaaaacaaagagttaaagacacaggtggcattgtcgagcgagacccctcgcaccaaagtttcgaaggccgtttcgacatctgaattgaaaaccgagggggtgagcccctatttgatgctcatccggctccggaagtag

SEQ ID NO: 55159 - DNA, 891 bp, Artificial Sequence
  Description of Artificial Sequence: Synthetic coding sequence
atggggtgtcggcactcaaggctcagctcttgtaagccgccaaaaaagaagagacaggagcccgaaccggaacagcctccaaggccagagcctcacgagctgggacccctgaatggggacaccgccatcacggtgcaactgtgcgcctccgaggaagctgagaggcatcagaaagacattacacgtatcttgcagcagcatgaggaagagaagaaaaagtgggcccagcaggttgaaaaagaacgggaacttgagctgagggacagactggacgagcagcagcgggtacttgagggcaagaacgaagaggctttgcaggtgctgcgagctagttacgaacaggagaaggaggctctcacacatagcttcagggaagcaagtagtacacagcaagagacaattgacaggctaacatcccagcttgaagcatttcaggcaaagatgaaaagggttgaggaaagcatcctgtcacggaactataagaagcatatacaagattacggatcaccttcccagttctgggagcaggagctggagtcactgcactttgtcatcgagatgaagaacgaacggattcatgagttagacaggagactgatcttgatggagacagttaaagaaaagaacctgatcctggaagagaagatcacgaccctgcagcaggagaacgaggatctgcatgttcggtctaggaaccaagttgtgctttcccgtcagcttagcgaagatctactcctgacccgcgaggcactggaaaaggaagtgcagctaaggagacagctccaacaggagaaggaagagttgctgtatcgtgtgctcggcgctaatgcctcccctgctttccccctagctcccgtgaccccaacggaagtgagtttcttagcaacctag

SEQ ID NO: 55160 - DNA, 609 bp, Artificial Sequence
  Description of Artificial Sequence: Synthetic coding sequence
atgagaacatctatgagcgaagcggcaaccagatggtcttgccagggatcgtgtcaaaaaacgtgcttttccagggtgcgaccatggcgccgaaggtgctcgtgtggagatagctccagcagacgtagacggagctgttgcactgggagtctgggtcccatgcctcgcctgccctcactgtggccattgagccttcctctccgttcacttagcagcccgcatagggtgcaaggcctgggtccaccacgcagattgaaatcccaactgctgcctcggttcttttggcgcagacagcaagaacctctctcctcattccccggtcggaacgagggaggaagcgagatggagatcttgggagtctgccctgtcagtccgggagctctgtcctacatggaatctccaactgggttctggcgccctcgagaggcttcctccctggagcttgctaagggcatctccaagagacgccattttctgccagccccagccctctgccctaacccacgttctagcgaggctttcccaggccagagtgtcagcagatggcctttcgacattaaggaaacggcccctgggccatcgttatcagcgctacttcccacttgctag

SEQ ID NO: 55161 - DNA, 1461 bp, Artificial Sequence
  Description of Artificial Sequence: Synthetic coding sequence
atgaaaccggttaaacatctactgaccacctctaataaatctgcaaacgtgcccgcactgacgacaaaaaaagggctgcacaatctccccctgagcccagagctgaaagagaaacacaacgcgaaactgatccacgacaaaatcgaacccatggtgctccgttcaccgcctaccggagagtcaatacttcgctatgcactcccgattccctcaagtaagaccaaaaatctgctccctgaagatgagatgattggaaaaattatcaagcacctcaagatggtggtgtcaacactggaggaaacatatggacactgcgatcagaatggtgaggagcctttcgtcaaacatgagcacgaagagctttccctgtcagttggagacgatatgaacagcttcctgacatactgttcccagtttgcagcccaactggaggaggcgctgaaagaagaacagaacattctggaatcgctttttaaatggttccagtggcaagttaaccaaatggaagaaattagcaaggaccagacactcctccaagctgagcccccaaaacctgataaaaccgtcatccttaacattgccgaaatcgtccggctcgtgcagcgatttgaagaattgaagaacaggctgaagcagcggagtaaaagtagcgtgaaagtaatgctttctaaaaccatggacaaggaaaatagaccagaggcggtaaagagctgtgaagccctggcccagaaaatagaagagttccttgaggcccatagcacagatgagttcaaggatgttagtgctaccgaacctcaaactgctcacagcatgacgaacagatttaatgccatgctgaaggtatttgagaaccaggcaaatatgcttgaacgcgctgtgaatgaccaagtgctgttagacgctgaatacaagcagatgcagtgcgacttccagcttcttagcgaggagaagcttgtgttggagaatgagctgcagaaactcaaggataaagagaagactaaacctactaacaacagaaccaagaaggcagtcaagaccgtgaagaagaaggacaaggggaagagtgaagactcagaaaaaaaaatgtcgcccgagaaggagttcaagattaaggaagatctcgaccaggttcagaaggtggcccgactggagattgagaacaaggttctccaggaacagttgaagcaggcccttcaggaggccgagaaggctaaacatcagcttaactacttcttgaatcaggaaaaactactcaagtcagaagggaaaactgaaacaaccatgcaggtcggaaacagccagacaaaagtgaaaggagaagatagcaagaacattccactggaaaaggagactagaaagagcctggtatctgattccggcggacagaggacatcagacaagattcaggaataccctcagattactgcacagagtggccgattgatcgaaaagcggtgttag

SEQ ID NO: 55162 - DNA, 840 bp, Artificial Sequence
  Description of Artificial Sequence: Synthetic coding sequence
atgaagcccgttaaacacctattgaccacctcgaataagagcgctaatgtacctgccttgacgactaaaaagggcctccacaacctgcctctgagccccgagttgaaggagaaacacaacgctaaattaatacatgataaaatagagccaatggtcttacggtctccacctaccggtgaatccatccttcggtatgctctaccaatcccatcttcaaaaacaaaaaacctgctccccgaagatgagatgattggaaagatcataaagcacctcaagatggttgtgtcaaccctcgaggagacatacgggcactgcgatcaaaatggagaggaaccatttgtgaaacacgaacacgaggaactgtcactcagcgttggagatgacatgaattcatttttaacctattgttcccagtttgcggcacagctggaggaggctctgaaggaagagcagaatgtctgtatcctgtacatcttgagtatatttttaaaatggtttcagtggcaggtcaatcagatggaagagatatctaaggaccagactctgctgcaagccgaacccccaaagcccgacaagaccgtgatcttgaatattgcagaaatcgttcggctcgtccagaggttcgaggaactgaagaacagactgaagcagagatccaaatcctccgtcaaagtcatgctgagcaaaaccatggataaggagaacaggcctgaggcggtgaagtcttgtgaggcactcgcccaaaaaattgaagaatttttggaagcccactccaccgacgagttcaaggacgtctcagctaccgaacccagaaagttcccgctgataaaagctttgtag

SEQ ID NO: 55163 - DNA, 1461 bp, Artificial Sequence
  Description of Artificial Sequence: Synthetic coding sequence
atgaagccagtcaaacatctgctaaccacttcaaataagtctgcaaatgtgccagccctgactactaagaaaggcctgcataacctacccctgtctcccgagcttaaggaaaaacataatgccaagctgattcacgacaaaatcgaacccatggtactgcgctctccccctacaggagagtccatactgcgatacgcgcttcctatcccctccagcaagacaaaaaatcttctacccgaggatgagatgattggtaagatcatcaagcacctcaaaatggtcgttagcactttagaagagacctatggccattgcgaccagaacggcgaggagccattcgttaagcacgagcatgaggagctcagcctctcggttggggatgacatgaattcgtttctgacctactgctcgcagtttgctgcccagctggaagaggccctcaaggaagagcaaaatattctggagtcactgttcaaatggtttcagtggcaggttaaccagatggaggagatcagcaaggatcagacactgctacaagcggaacctcctaagcccgacaaaactgtgatcctgaacatcgccgagattgttcgcttagtccaacgattcgaggagttaaagaatcggttgaaacaaagatctaagagtagcgtcaaggtgatgcttagtaaaaccatggataaagagaaccgccctgaggccgtcaaaagctgtgaagctttagctcagaagatcgaggagtttctagaagctcactccacagacgaatttaaagatgtgagcgctacggaacctcagaccgctcactccatgaccaaccgctttaacgctatgctcaaggtgtttgagaaccaggctaacatgcttgaacgggcagtgaatgaccaagtgctgttggacgctgagtataaacagatgcagtgcgatttccagttgctctccgaggaaaagctggtgctggagaacgaactgcaaaaattaaaagacaaggagaaaactaaacccaccaataatcgaactaagaaggccgtgaaaacagtgaaaaaaaaggacaagggtaaaagcgaagattctgagaagaaaatgtctccagagaaagaattcaaaataaaggaggacctagaccaggtccagaaggtcgcaaggctggagattgagaacaaggtcctgcaggaacaactcaagcaggcactccaggaagccgagaaggcgaagcaccagctcaattatttccttaatcaggaaaaactgttaaaatcagaaggtaagactgaaactactatgcaggtgggaaacagccaaacaaaagtcaaaggggaggattcgaaaaatattccccttgagaaggaaacacggaaatccttggtgtcagatagtggagggcaaagaactagtgacaagattcaggaatatccccagatcaccgcccagagcggaaggctcattgagaagagatgctag

SEQ ID NO: 55164 - DNA, 483 bp, Artificial Sequence
  Description of Artificial Sequence: Synthetic coding sequence
aagacgaagccaaccaataatagaactaaaaaagcagtgaaaactgttaagaagaaagacaaagggaagtccgaggattcagagaagaagatgtcgccagagaaagaattcaagatcaaagaagacctggatcaagtgcaaaaggttgcgagactcgagatcgagaataaggtgttacaggagcaactcaagcaggccttacaagaggcagagaaggctaaacaccagctcaactatttcctaaaccaggagaaactcctgaaaagtgagggaaagactgaaaccacaatgcaggtgggcaacagccagactaaagttaaaggagaggattccaagaatatacccctggagaaggagacccggaagagtttagtcagtgactccggcggtcaacggactagcgataagatccaggagtaccctcagatgctgattgagtttctgaaatactttggcaaagtgtcccagaccttccgagaatag

SEQ ID NO: 55165 - DNA, 516 bp, Artificial Sequence
  Description of Artificial Sequence: Synthetic coding sequence
atgaaacccgtgaaacatctgctgacgacttccaacaagtctgccaacgtgccagccctcactaccaagaagggactgcataatctccccctctctccagagctcaaagaaaagcacaacgctaagctcatccacgacaaaattgagcccatggtcttaagatctccacccaccggggagtccatactgaggtatgcactgcctatcccttcgtccaagaccaagaacctgctgcctgaggacgaaatgattggcaagattataaagcacctgaagatggtcgtctccaccctggaggagacgtacgggcactgcgatcaaaacggtgaggaacctttcgtgaagcacgagcacgaggagctgagtctttctgtcggagacgatatgaattcgtttctaacatactgtagtcagttcgcagcgcagctggaggaggctctaaaagaagagcagaatattctcgaatctcttttcaagtggtttcaatggcaagtaaaccagatggaagagggctag

SEQ ID NO: 55166 - DNA, 528 bp, Artificial Sequence
  Description of Artificial Sequence: Synthetic coding sequence
atgaaacccgtgaaacacttactgactacgtcgaacaaatctgcaaacgtacctgccttgacaacaaagaaggggttgcacaacctcccactgtctcccgaactgaaggagaaacacaatgctaagctgatccacgacaagattgaacctatggtgcttcgctcgccacctaccggcgaatctattctacgatacgctcttcccatacctagcagtaagacaaagaatctactgcctgaggatgagatgatcgggaagatcattaaacacttaaagatggtcgtgtccacactggaagagacctatgggcactgcgatcaaaacggcgaggaacccttcgtgaaacacgagcacgaagagctttccttgagtgtaggggacgatatgaattcttttctgacatattgctcccagtttgccgctcagctcgaagaggctcttaaggaagagcagaacatcctggagtcattgttcaagtggttccaatggcaggttaatcagatggaggaaaagctgctgattcaatag

SEQ ID NO: 55167 - DNA, 522 bp, Artificial Sequence
  Description of Artificial Sequence: Synthetic coding sequence
atgaaacccgtgaaacatctcctgaccaccagtaataagagtgccaacgtgcccgctttgacaacaaagaagggcctgcacaatctaccgctttccccagagctgaaagagaagcataacgccaaacttatccacgataagatcgagccaatggtgctgagaagcccacccacaggcgaaagtatcttgcgctacgctctgcccattccatcatctaaaaccaagaatctgctccccgaggatgagatgatcggaaaaataattaaacacctgaagatggtcgtgagtactcttgaagagacctacggacactgcgaccagaatggcgaggaaccatttgtgaaacatgaacacgaggagctgtccctgtctgttggcgacgatatgaacagctttctgacatactgctcacagtttgcagcccagttggaagaggcattaaaagaagagcaaaacattctcgagtctctcttcaagtggtttcaatggcaagttaatcagatggaggagtcttgcaaatag

SEQ ID NO: 55168 - DNA, 516 bp, Artificial Sequence
  Description of Artificial Sequence: Synthetic coding sequence
atgaagccggtcaaacacttgctcaccacgtcaaataagagtgctaacgtgccagccctgaccactaaaaaaggcttgcacaatctgccactgtcacccgaactaaaagagaaacacaacgcaaaactcattcacgacaaaattgaacccatggtgctgcggagtcccccaacaggcgaatccatcctcaggtatgcgcttccaatcccaagctcgaagacgaaaaacctgctgccagaagacgaaatgatcggcaagatcattaagcacttaaaaatggttgtcagtacattggaggaaacatacgggcattgcgaccaaaatggcgaggagccatttgttaagcacgagcacgaggagctcagtctcagtgtgggggacgatatgaatagctttctgacttattgctcgcagtttgctgctcagcttgaggaggccttaaaggaggagcagaatatcttagagagcttgttcaaatggttccagtggcaggtgaaccagatggaggaagggtag

SEQ ID NO: 55169 - DNA, 1404 bp, Artificial Sequence
  Description of Artificial Sequence: Synthetic coding sequence
atgtcagtggttgtgcagcatgttgaggagaaggccgtccactcctggagcaggattagcaccgccggtaagaaggcacttgaggaggctcttttggtcttcaatcccatgtcacaggacttgagcgccaccgaagcccagcttgtcgcatttctccaaggcctgcgggacgatgggttccagccaacaatactcaggtcgggggatgtctacggttactctagttgcacagccaaccccccttcacagactaaactgcaggccagagctccaaacccgacagcaacttccccgccagcatcagcgcctcgtacggccatgcgtttgccggcagggagagctactctcctccctatgcctctaagcggccgtctggcgaaggcgtccacacccgctctagcaaagcacgccaccaccaatctgctattatctagcctgaaacagagctccgcctcgcacgctcgcggagccgctgtcggcttcccaacacacctgtaccctggtgtgtatcccgctatgaggctgagcgtggtgttggaggctttagtccccttgaagaccccaatgccctgcctgggagcaaagcataaggcccagagtctgcagctgagtctagccgactctcctcttaagctacgaaagtctagtggcaagggaccaggaaatcctcgacctaaggcccctcgtaagactacatccaaaggaccaaagtgcctgacacggaaaggccctggcgcagggccaagacgtggatcaggacatcagtcaaaaactaaccgagccacaggtagcccatccgtaagaaggatgaaaggcggaagtgcactgggcactaagaccgctcaggcaaaagtggcccgaacattggcgaaagccgctagggcacaggctaaagtggcccgaacacaggcaaaggcagccaaggcccgagctaaggctaaggctgcccaggtcaaggctaaagctaaggccaaagcagcacaggttaaagccaaagccaaagtgatggcagcttgggccaaagcgaaggccaaggctaaggctgtgcgggctaaagctaaagtcgctcgcacacagccccgaggccgtggccgtccgaagggaagtgccaaggctagaactacgaggaaaggccaaaaaaacaggccagagactgtaggtcaaaaacgcaagcgagcagaagaggcgaaagaccttccgccaaagaaaaggacgcggttgggtcctcgcagtccaaaggcctggttgggtccaggcacggccaaactgctcaagtttcgcgctataaaagttgaccggcgatcgtcagacgatgaggtgaggcagcgggctcagaggattctgagagtgaacctttcccccgtgattcgcttacagccactgctcccatactcagccgtctag

SEQ ID NO: 55170 - DNA, 708 bp, Artificial Sequence
  Description of Artificial Sequence: Synthetic coding sequence
atgcggaggtccatgaagaggagacggagacggaggcccgtcgctccagccacggccgcaagagggggagatttccgagcagaagatggcgctgggcttgaggccagagaggaaaaggtcgtgtattcacgcagccagctgtcccttgccgatagtacaaaagccctcggcgatgcctttaaactctttatgcctaggtcaaccgagtttatgtcctcagacgcggagttgtggtcgtttctctgttctctaaagcaccaatttagcccccacattctgaggtcaaaagacgtgtacggatactcctcttgtagggctctggttcccgacccccctggaccacccaccgcccgaggccaggccaggcgtcccgtccctagggccgcagccagacgaaggcgacgaggtgccagggccgcagctgctcgacggcgtaagccgagacctccacctccaccccctccccctcccgaagagtcttgccccgcaaagcctgtggctcccggtccttgcttcgggggtcgtacccttgaagaaatctggcgcgctgctacccctaccctcactacattccccaccattagagtgggaagcgatgtgtggggagagaggtccttagccgcagccagaagacgagccaggcaggtccttcgggtgaatctcgagccgatggtccgactgaggcgctttcctgtccctagggcatag

SEQ ID NO: 55171 - DNA, 195 bp, Artificial Sequence
  Description of Artificial Sequence: Synthetic coding sequence
atgtccggcagggaggggggaaaaaagaagcccctgaagcagcccaagaaacaagcaaaggagatggatgaagaggacaaggcattcaaacagaagcagaaagaagagcaaaagaaattagaagagctgaaagccaaagccgcaggtaaaggcccacttgctactggcggaatcaaaaagtccggcaaaaagtag

SEQ ID NO: 55172 - DNA, 1137 bp, Artificial Sequence
  Description of Artificial Sequence: Synthetic coding sequence
atgtcaggcgctggggttgcagctggcacaaggccccctagttctcccaccccaggaagccgcagacgcagacaacgcccatccgtcggggtgcagtccctgcgtccccaatccccacagctgcgtcaatcagacccacagaaaaggaacctggatctcgagaagagtctacagtttcttcagcagcagcacagcgagatgcttgctaaactccacgaggagatcgagcatctgaaacgcgagaacaaggatctgcactacaagctgatcatgaaccagaccagtcagaaaaaagatgggcctagcggtaatcacctgagtagagcttcagcgccattgggggctcgttgggtttgcataaacggagtgtgggtcgaaccaggcggaccatcacctgctcgcctgaaggaaggttcgagccgcacccacagacctggaggtaagcgcggtaggctggccggagggagcgccgatactgtgcggtcaccagctgacagcctatccatgagcagctttcagtctgtcaaaagcatcagtaatagtggaaaagccagacctcaaccagggtcctttaacaagcaggactccaaagccgatgtttcccagaaggcagacttagaggaggagccactgctgcataacagcaaactcgacaaggtccctggcgtgcaaggacaggctcgaaaagagaaagcagaagcctccaacgctggcgcagcctgtatgggaaattcacagcatcagggacggcagatgggagccggagcccacccacctatgatccttcccttgccactgcgcaagccaaccaccctgcgccaatgtgaggtgctaatacgcgaattgtggaacaccaacctgctccaaacacaggagttaagacacctgaaatccttgctggagggctcacagaggcctcaggccgcaccggaggaggccagctttcccagagaccaggaggccacccattttccaaaggtctcaacgaagtctctctccaagaagtgcctgtctccccctgtagccgagcgcgctatcttacccgctttgaagcaaacgcccaaaaataatttcgcagagagacaaaagagactgcaggccatgcagaaacggagactccaccgaagtgttctgtag

SEQ ID NO: 55173 - DNA, 993 bp, Artificial Sequence
  Description of Artificial Sequence: Synthetic coding sequence
atgggaagaaatccatgggactctccgtgcccagccaggagtttaccccaaatcgctgctgtcgcacggcctagaatctcttccccaatggccctttccccccacatgctcggcgctcaggggctctggactcacagtatccaaggaagtctgccggcaatctgggctgcaactatgggaaccaagggcggatctcgggtactgttcccatgccacctttccaaggctctgcctcatcccgactcgggccctcacccagcccaggacccaggactgtggagccaagcgcattttcccctgtccctgggcctcggtctgacatctgggggacacctgaccggtggttggtctcaacctgggaacattgctgccggagcggtaccacgagcactgccctcacagggtgacatggaaaagggagttgaaggcggtccattccccagcaggtgtggcaactccagcgagttgttctgggccaaatgtgggccttctcggcagccccagccatgcagcgctggggacgctgataggacacgggaagaagccatgttaagcctgggaacctgctgttccatgtgtccaaagcctagctgctttcccgacggaccatccggcaaccaccttagccgggcaagtgcccctctcggtgcccgttgggtgtgtattaatggagtgtgggttgaaccgggagggccaagccctgcccgactgaaggagggcagtagtagaacccatagaccaggagggaagagaggacggctcgccggtgggagcgccgacacggtgaggtctcccgcagatagtctgtcaatgtcttccttccagtctgtgaagtctatctccaacagtggcaaggcccgaccccagcccggttcctttaataaacaggattctaaagcggacgtgtcacaaaaggctgatctggaggaggagccgctgctgcacaacagcaagcttgataaggtgcccggagtgcaagggcaggccagatag

SEQ ID NO: 55174 - DNA, 939 bp, Artificial Sequence
  Description of Artificial Sequence: Synthetic coding sequence
atgtcaggcgcaggagtggcagctgggaccagaccaccaagtagcccgaccccaggttcccggcgacgccgtcaacgcccaagtgtgggggtgcagtctttgcggccacaaagtcctcaactaagacagtcagaccctcaaaagagaaatttagatcttgagaaatctcttcagtttctccaacagcaacattccgagatgttagctaagctgcatgaagagatcgagcatttgaaaagggagaataaagacctgcactataagctgatcatgaaccagacaagccagaagaaagactcactttccatgagctcttttcagtctgtgaagtccatttctaattccgggaaggccaggccccagcctgggtctttcaataagcaggactccaaggccgatgtcagccaaaaggccgacctcgaagaggagcctctgctgcacaatagcaagctggacaaagttccgggtgtgcaggggcaggccagaaaagagaaagccgaggcctcaaacgcaggtgcggcttgtatgggcaatagtcagcatcagggcagacagatgggagcaggagctcaccctccgatgatccttcctctgccacttcgaaagcccactactctgcgtcagtgtgaggtcttgataagagagctttggaacactaatctgctccagacccaggaactcaggcatcttaagtcactcctggagggcagccagcgacctcaggctgctcctgaggaggcatcgttcccacgggaccaagaggcaacccactttccgaaagtctcaacgaagtctctgtccaagaaatgtctgtctccgccagtggcggagagggccatcctcccagcactgaagcagactcctaagaacaatttcgcggagaggcagaagagattgcaagccatgcagaagaggcggctgcacagaagcgtgctgtag

SEQ ID NO: 55175 - DNA, 1143 bp, Artificial Sequence
  Description of Artificial Sequence: Synthetic coding sequence
atgagcggggcaggagtggctgctgggacacgccctccctcttcgcctactcctggttctagacgcagaagacaacgcccttctgttggcgttcagtccctgagaccacagagtccccagctgcggcagagcgaccctcagaaaagaaatctcgaccttgaaaagtcactccaatttctgcaacagcagcacagcgaaatgctcgccaagttgcatgaggaaatcgaacatctgaaaagggaaaataaggatctacgctataaactgatcatgaatcagacctcacagaaaaaggacggaccttcgggcaatcacctctcccgcgcttccgcacctttgggagctaggtgggtgtgtatcaatggtgtgtgggtggagcctggcggacctagccctgccagactcaaggagggctcctccaggacacacagaccgggaggcaagcacggtcggctggccggaggttctgcagataccgtcaggtccccagccgattctctgtctacctcatcatttcagagtgtgaagagcataagcaactcagggaaggcaagaccacagccaggatcatttaacaagcaggatagcaaggctgacgtgccccaaaaggccgatctggaggaggaaccactgctacataactcgaaactggacaaagtgccaggggtgcaggggcaggccagaaaagagaaggcagaagcctccaatgctggagctgcatgcatgggcaactcacagcaccagggcaggcaaatgggagctgctgctcatccgccaatgatccttcctcttccattaaggaaacctaccacactccggcagtgtgaagtgctgattcgggagctctggaacactaatctgttacagacacaggagttacaacacctcaagagcctgttagagggttcccagagacctcaggccgtccccgaagaagcaagttttcccagagaccaagaggcgactcactttccaaaggtaagtacaaaaagtttgtccaagaaatgtctgcttctgagtcctccagtcgctgaacgagcaatcctgccagcactgaaacagacccccaagaacaacttcgccgaacggcagaaacgacttcaagccatgcagaagaggcggttgcatcgcagcgtattatag

SEQ ID NO: 55176 - DNA, 1449 bp, Artificial Sequence
  Description of Artificial Sequence: Synthetic coding sequence
atggggagaaacccctgggacagtccgtgcccagcccgaagcctaccccagatcgctgctgtggcaagacccaggatttcaagccctatggcattgtcgccagacatgttgggcgctcaagggctttggacccatagcattcaggggtctctgccagctatttgggctgcaacgatgggcactaagggtggtagtcgcgtgctgtttccttgtcacctcagtaaggcactccctcaccccgattccggcccacacccagcccaggactctggcttatggtcccgggcacacttcccactgagcctgggcctcgggctgacttctggaggccacctgacgggcggatggtctcagcctggcaacattgtcgcgggtgccgttcccagggccctccctagccagagagatatggagaacggggtggaaggaggaccattcccaagcaggtgcgggaactcctcggagttgttctgggctaaatgcgggccaagcagacagccacaaccctgctccgcgggagacgccgatcgcactagagaggaggcaatgctatcgcttggaacttgttgttcaatgtgtcctaagccatcctgtttcccggacgggccatctgggaaccacctgtcccgtgcatcggccccactcggggcacgttgggtatgcattaatggcgtctgggttgaacccggaggtccaagcccagcacgtctaaaggaagggtcaagccggactcatcgcccagggggaaaacatggaaggctcgctggtggtagcgccgacactgtgcggagcccggctgactccctctccacatcctcctttcagtcggtgaagtccatctccaattccgggaaagccaggcctcagcccggaagcttcaataaacaggattccaaagccgatgtgccacaaaaggcagatttagaagaggagccacttctacacaatagtaaactcgacaaagtgccaggtgtgcagggacaggcacgcaaggagaaggcagaagcttccaatgccggagcagcctgtatgggcaattcccagcaccagggacggcaaatgggggctgctgcccatccgccaatgatcctgcccctgcccctgcgcaaacctactacactgaggcagtgcgaagtgcttatcagggagttgtggaatacaaacctgctacagacccaggagcttcagcacctgaagagcctgctcgaaggctctcagcgccctcaggcagtgcctgaagaggcctccttcccgagagaccaggaggctacccatttccctaaagtgtctacaaagagcttgtcaaagaagtgcctgctcctgagcccccctgttgccgaaagggccattctgcctgccttaaagcagacacccaagaataattttgccgagagacagaagaggctccaagctatgcagaagaggaggctacaccggagtgtgttgtag

SEQ ID NO: 55177 - DNA, 945 bp, Artificial Sequence
  Description of Artificial Sequence: Synthetic coding sequence
atgtcaggggcaggagtggccgcaggcactagaccaccctcatcacctactccaggtagcagacgacggaggcagcggccttccgtcggtgtgcagagcttgaggccacagagccctcagctccggcaaagcgatccccagaaacgcaatctggatctggagaagagcctacaattcctacagcagcaacatagtgagatgcttgcaaaactgcacgaagaaatcgaacacttgaaaagagagaataaggacctcagatacaagctcatcatgaaccagacaagccaaaaaaaagactccctgtccacttcatcttttcaatcagttaagtctatttctaactccggaaaagctagaccacagcctggtagctttaacaaacaggacagtaaggctgatgtccctcaaaaggccgacttggaagaggaaccgttactccataattccaaacttgacaaagtacccggagtgcagggacaggcaaggaaagaaaaggctgaggcgtctaacgcaggcgctgcatgtatgggcaacagccagcatcagggtcggcagatgggagctgctgcccatcccccaatgatcctgccattgccactaaggaagcccactacactgcggcagtgtgaagtccttatcagggaactgtggaataccaacctgctgcagacccaggaactccagcatctcaaaagtctgttagaaggcagccagcggccacaggcggtgccagaggaagccagctttcccagagaccaagaggccacgcatttccccaaggtgtctaccaagtccctcagtaagaaatgcctgcttctctctcccccagtggcagaacgcgctattctaccagctcttaagcagacccccaaaaacaacttcgcagagcgccagaagcgcctccaggctatgcaaaaaaggagactacaccggagcgtactctag

SEQ ID NO: 55178 - DNA, 618 bp, Artificial Sequence
  Description of Artificial Sequence: Synthetic coding sequence
tagtctggagccggtgtggccgctggaacccgcccaccaagctcccccacaccaggctcgagacgacgcaggcagagaccgtcagttggggttcagtccctaaggccacagtctccccagttgagacaaagtgacccacagaaacgtaatctggatctggagaagtctctgcaattcctgcaacagcaacactctgaaatgcttgcaaagcttcatgaagaaattgaacacctcaaaagggagaataagggtgaaccagcaaggggccctcgcccagctctgcctcctcaggctcactctacgcttccactgcctcagcaccgcaatacggctattaacagtagtacgaggctggggtcagggggaacccaggatgatctcaggtataagttaatcatgaatcagactagccagaaaaaagatggaccatcgggaaatcatctatctcgtgcctccgctccattaggcgctcgatgggtttgtataaacggagtgtgggtggaacctggcggtccttcccccgcaagactgaaagaaggttcgtcacgaacccacaggccgggaggcaaacacggacggttagcgggaggctctgcagatacagtcaggtccccctag

SEQ ID NO: 55179 - DNA, 471 bp, Artificial Sequence
  Description of Artificial Sequence: Synthetic coding sequence
atgagccgcaagtccgggattggtcacgaggcttccctgaagcgaaaggctgaagagaaactcgaaagctaccgcaagaaaatacacatgaagaaccaagccgaggaaaaagcagctgaacaatttcggatgagattgaaaaataagcaggatgagatgaagcttgaaggcgacttacgaagaagtcagcgcgcttgccagcagctcgatgtgcaaaagaatatccaagtccctagagaggcctggtactggctgcggctggaggaggaaacagaggaagacgaagaagaaaaagaacaggatgaagacgagtataagagcgaagacctgtctgtgctagaaaaactgcagattctcacaagttatctccgcgaggagcacttgtattgtatctggtgtggcacagcttatgaagacaaagaggacttgtcatcaaactgccccggaccaacctctgcagaccacgactag

SEQ ID NO: 55180 - DNA, 780 bp, Artificial Sequence
  Description of Artificial Sequence: Synthetic coding sequence
atggcagaagaagaggattacatgagcgattcctttattaacgtccaagaggacataagaccaggtttaccaatgcttcgccagatccgagaggcccgaaggaaggaagagaagcagcaggaggctaatttaaagaatcgccagaagagcctcaaagaggaagagcaggagcgacgtgatatcggcttaaaaaatgctctcggttgcgagaacaaggggtttgcgctgctgcagaagatgggatataaatccgggcaggcgttgggaaagtcgggaggtggcatcgtggagcctatacctcttaatatcaagacaggcaaatcaggcatcggccacgaggccagtctgaagaggaaagctgaggagaagctcgagtcctaccgcaagaagatccacatgaagaaccaggcggaggaaaaggctgctgaacagtttcggatgcgactcaaaaataagcaggacgaaatgaaattagaaggggacctgcggcgttctcaaagggcgtgccagcagttagacgtgcaaaaaaacattcaagtccctagagaagcctggtactggcttaggctcgaagaagaaactgaggaggacgaggaggaaaaagagcaggacgaagatgagtacaagtccgaggatctgtccgtactcgagaaactccagattttgaccagttacctgcgcgaagaacacctctattgcatatggtgtggcacagcgtatgaagacaaggaggatctttcctcgaactgccccggacctacatctgctgaccatgactag

SEQ ID NO: 55181 - DNA, 393 bp, Artificial Sequence
  Description of Artificial Sequence: Synthetic coding sequence
atggtagtcgcagccggaaaaaggttttgtggagaacacgccggagctgccgaagaagaggacgccaggaagcggattctctgtccgttagatcccaagcacaccgtgtatgaagatcaacttgctaagcatctgaagaagtgcaatagccgagagaagcctaagcccgatttttatattcaggacattaatgcaggacttcgcgatgagacagagatcccggagcagcttgtccctatctccagcctgtctgaggaacaacttgagaagctcatcaagaaactccgcaaagcctcggaagcactccacgatgctttaaatgacccaaagaacggcgactctgccacaaagcacctcaaacagcaagtctgtctgggctactccaattattag

SEQ ID NO: 55182 - DNA, 1446 bp, Artificial Sequence
  Description of Artificial Sequence: Synthetic coding sequence
atggctacctcagccacttccccccacgccccaggattccctgcagagggccgttgcggatactatgtcgaaaaaaagaagcggttctgtagaatggtcgttgctgctggaaagagattctgtggggagcatgccggagcagccgaggaagaagatgccagaaaacggattctgtgtccgcttgaccccaagcataccgtttacgaggaccaactcgcaaagcacctgaaaaagtgcaactcaagggagaagcctaaacccgacttctatattcaagacattaacgccggattgagggacgaaactgaaattcccgagcagctggtgccaatttcctctcttagtgaagaacagttggagaaactgataaaaaagcttcgtaaggcaagcgagggtctgaatagcactcttaaagatcacattatgagccatcctgctttgcatgacgctcttaacgacccgaaaaatggcgactctgcaactaagcacctcaaacagcaggcctctattttaggcaatatcgagaaccttaaactgctgggtcctcgcaggtgctttgtagaatttggcgcaggaaaaggtaaattatctcactgggtggacatcgcattgaaggatgccgagaaagtccactttatactggtcgaaaaggtcactacccgattcaaggtcgatggcaaacacagaaagaaaaactcagtatttgaacgtctgcaaatcgacattcaacacctgtgtttgaataagatacccgtccttcgtgaggaaaaactgccagttgtgggtattggtaagcatttatgcggcatggccacagaccttgcactgcgctgtttggtggagacttacgctgcaagtttcgaggaacgtaatgaggagcctctggccaaaaggattaaaaacgacaagaccgaaaaagagatttataccctcgctaaagaggggaacgaaaagaatgttccggagaaatggaaccctgtcgccggaattgtgatcgcattatgctgtcaccatcgatgtgactggaggcattacgtggggaaggagtatttcagagctttggggctgggagctgtggagtttcattacttccagcggatgtcctcgtgggcgacctgcggaatgaggaagacatccctggaaacaagcaactccaccacaaagcggcaggacaaccagaatgatgactccgaggaacacgacgatggcggataccgcattacagacgacggggctgattgtttacccggactgctgtccgtcgaggaaaagaagaagatcgggcatctgtgcaagctgcttattgaccagggcaggatccagtacctgcagcagaaggggttttctcccgcactgcagtactatactgatccattggtgagtctggagaacgtcttactcacggctttaccgaatcacagctcttcacccgaaacgacggcctag

SEQ ID NO: 55183 - DNA, 330 bp, Artificial Sequence
  Description of Artificial Sequence: Synthetic coding sequence
atggcgacatctgctacgagcccccatgcccctggctttcccgctgagggtagatgcggatattatgtcgagaagaaaaagcggttctgcaggatggtggttgccgctggtaaaaggttttgcggagaacacgctggcgcagccgaggaggaggacgctcggaaacggatcttgtgtcctctggatcccaagcacactgtgtatgaagatcagttggcaaagcacttgaagaagtgtaactccagggaaaagcctaagccagacttttacatacaggacataaacgccggactgagagatgagacggagatccccgaacagctggcctag

SEQ ID NO: 55184 - DNA, 1317 bp, Artificial Sequence
  Description of Artificial Sequence: Synthetic coding sequence
atggagcatgccgcaaccactggaccacggcctggccctccgtcacgccgtgtggaaaatgtggtgctccgagcgaaggattggctgccgggagcccctggcggtaccgcggtctgggctacaagccttgaagccgaggtccctcctgacttggcactgaataaggagcagcagctgcagatttcaaaggagctggttgacattcagattactacacatcatttacacgaacagcacgaagccgagatattccagcttaagtctgagatactgagactagagtccagagtactggaactggaactgcgaggagacggaaccagtcagggctgcgccgtaccagttgagagtgaccctaggcacccccgtgctgccgctcaggaactgcggcataaagcccaagttcccggtcactccgacgatcaccggtttcaggtgcagcctaagaataccatgaatcctgagaatgaacaacaccggcttggatcgggtctgcaaggcgaggttaagtgggcactagaacaccaagaggccaggcagcaagccctagtcaccagagtcgccactctcggtcggcagttgcagggggcaagggaagaagcacgagctgctggccagcgcttagcaacacaggcagtagtgttgtgtagctgtcagggacagcttagacaagcagaagcagagaatgctcggcttcaactgcagttgaaaaagttgaaggacgaatacgtgcttagattacagcattgtgcctggcaggccgtcgagcatgctgacggagccggtcaggcccctgccaccactgctttaaggacgttcctagaggccacactggaagatattcgtgccgcacaccgatcacgcgaacagcagttggccagggccgcacgatcctatcataagaggctggtggacctaagcagaagacacgaggagctcctggtggcgtatagggctccgggtaatcctcaggcaatatttgacattgcatcactcgacctcgaacccctccccgtccccctggttaccgatttcagccacagggaggatcagcacggcggtccaggcgcactgctgagcagtcccaagaaaaggcccggtggcgcttcacagggcggtacatctgaaccccaaggcctcgacgcagcttcatgggcccagatacaccagaagctgcgggatttctctagatcaacccagtcttggaacggctctggccacagttgctggtcagggcctcgttggcttaagtcaaacttcctaagctatcgcagtacatggacttcaacttgggccggtacttccaccaaaagctag

SEQ ID NO: 55185 - DNA, 864 bp, Artificial Sequence
  Description of Artificial Sequence: Synthetic coding sequence
atgcattctgtcgcccacccccatcccggagtaccaccgtgggtgccggcaaccctcattataacaggaaaacgaagaggagcagcggcaggcggtgctggcctcgagcatggtggctcaggaagggcgcacctaagggaggtgtcagccgagacttggagaacccgcggagtgggtgccggaagattagtgactggccctgctctggcatccgggcctccctgttcccaactgtataacgggcagggctccccccgaacgatttcatggggtcttggccacacccgggttggtgtagcatcattgctgatgctggagtctctgagcggtctggcactatggttttccccccctcctgccgctagcagaccgccaggcccaggactgagtctttataccgatggatcaaaagcctggggggcacctcaagagcacggcggagctcatgcttccctgactcattctcaggtgagccctcctgggagcggaaatttgacccagcacggccacgtttgcccatgcgtgacaatgccagccctgaagacaacaccaccattcctctcacctcaccgcggactggatgccgcttcctgggcccaaatccaccagaaactgagagacttttcgcgtagtactcaggttggagggaaggggtggccacgacctatccttacaccttgccccagttcttggctgacatctccttgccaggccgaattggaaagagagcgggctcagttgcttgttagggcaaccatggcagaggaacaactctctgagctgcaggagtatgtagaccagcacctgggcagatgggccgagggggcaggctgtgatccgagagccttggtatggctcgaatag

SEQ ID NO: 55186 - DNA, 1527 bp, Artificial Sequence
  Description of Artificial Sequence: Synthetic coding sequence
atggaatctgaagataccaaaaagacacaggagatgaaaacagacctgaatctgcttctcgagtgtctcaaataccaaatggacaacgctttttcccagaaggaggcactggtaactatacactctatctgccagcagaactccaatgcctccgtctacttccgcgaaattggagggctgatgttcgttaagaatctggccaagtccagcgagcactcgatggttaaagaagccgcactgtacaccctgggtgcaatcgccgaaaagaatgtatactgtcagcagactctgtgtacatcagaactgttcgaagacctgacttggttcctcagtaacgattccaatattaatctgaaaaggatgtccgtctatgtcatcctggtgctggtgtcaaataatcgcacagggcagacactagtgcgggaaaccggctgcattacagtgttgtctcggctgtttaggaccgtgatttctaagcacgagctggacctttctgacaaaaacgtgtttcagagctaccaactgtggagcagcgtatgctctacactatgcgtctgcgtgaacaatccccagaatgatgagaaccagatgttctgctgcagtctgttccctcatgccaacgagtggctgaagaactgcaccacacccgagataataagacccatctgctccttcattggactgactctcgctaataacacgtatgttcagaagtattttgtgagcgtagggggattggacgtcctgtcccaagttctgatgcagctcgagtccgactcccacgagacgctgagtagtgccaagcttgccgtcgtcgtgacgaagaccgttgatgcatgcattgccgataatcccacatttggtatcgtcctgagtaagtatcacatcgtgagtaaactgctggccttgctgctccacgagtctttggatagcggcgaaaaattttctataatgctgaccttaggacactgtaccgaggattgtgctgagaaattgtccctttctctgggagagtatccattcgacgagaacgagacccagcagttgaaggatataagtgtgaaagagaacaatctggaggagcactggcgcaaagctaaggagatactgcatcggatcgagcaattggaaagagaggggaatgaggaggaaattcagcgagagaactaccaagacaacatatctagcatgaatatcagtatccagaatacttggaagcacctgcacgccgaccgcataggtcgaggaagtaaagccgaggacgaggataaatcccattctcgacagctccagtcctacaagagccatggtgtcatgagtaaggcttgtactaatgacgaccagatgaaaacaccactgaagtctgcaaacccagttcacgcctgctatagggaaagtgagcagaacaagacactttataaagcaaagtccagttgcaatcagaatctccatgaggagacgacctttgagaaaaacttcgtgtcccaatctcggtcaatttatattatgttccggtacaataaatag

SEQ ID NO: 55187 - DNA, 2043 bp, Artificial Sequence
  Description of Artificial Sequence: Synthetic coding sequence
atggagtccgaagataccaagaagacccaggaaatgaaaacagacctgaacctgctgctggagtgtctaaagtatcagatggataatgcgtttagccagaaggaggccctggtgaccattcactccatctgccagcaaaactccaacgcctcggtctattttcgggaaattgggggactcatgtttgtgaagaatctggcaaagagctctgagcactccatggtgaaggaagccgctctgtacacattgggcgcaatcgctgagaagaatgtgtattgccaacagacattgtgcacttctgaactgtttgaggacctgacatggttcctgagtaacgattccaacatcaacctgaaaaggatgagcgtgtacgtcatcctcgtcctggtatccaacaatcgaactggacagacactcgtgagggaaaccggctgcatcacagtcctgagtcggctattcaggacagtgatctcaaagcatgagctcgacctgagcgataaaaatgtgttccagagctatcagctttggagttcagtctgctccactctttgcgtctgcgtgaacaaccctcaaaacgacgaaaaccagatgttttgctgtagtctcttcccccacgcaaatgaatggttgaagaactgtactacccccgaaataattcgccctatctgttcctttattgggctcaccctggcgaacaatacgtacgtccaaaaatactttgtcagcgtcggcggtctggatgtcttaagccaggtgctcatgcagcttgagagcgacagccatgagacgctctccagcgccaaactggccgtggttgtgaccaaaaccgtggatgcctgtattgccgataaccccactttcggaattgtcctgagcaaataccatattgtgagcaagttgctcgcccttctgctgcacgaatcattggatagtggggaaaaattttcaattatgctgaccctggggcattgtacagaagattgcgaggaaaatcagtatgacctgtttaagaacaatggactgcccctgatgatccaggcccttaccgagtcccaaaatgaagagctgaataaggcagctaccttcgtcctccataactgtaaaaaaatcacagagaagctgagcctcagcctgggggagtacccttttgacgagaacgagacacagcagctcaaagatatctccgtaaaagagaataacctggaagagcattggcgcaaggccaaagagattctgcaccgtatcgagcagctggaaagagagggaaatgaagaggagattcagcgcgagaattaccaagataacatatccagcatgaatatcagtatccagaacacctggaagcacctgcatgccgatcgcatcggccgaggatctaaagcggaagatgaagataaatcgcatagcagacagcttcaatcctacaaatcccatggagtcatgagtaaagcatgcaccaatgacgaccaaatgaagacgccccttaagagtgcgaaccccgtgcatgcttgctatcgagagtctgagcagaataaaacgttgtacaaagccaagagctcctgcaatcagaacctgcatgaagaaaccaccttcgaaaagaacttcgtttctcaaagtcgttactcacttattatagtgtgttgtattgcagtcgagaaatcattgaacagtagaaacttctccaaactgctccacagctgtccctaccaatgtgatcgccacaaagttattgtggaggctgaggacagatataaaagtgaattacgcaaatcccttatttgcaataagaaaatccttctgactccacgacggaggcaacgactatctaatgaaagcaccacgcccggtggaatcaagaaacggaggatcagaaagaatttcacagaggaggaggtgaattacctgttcaatggtgtgaagaaaatgggcaatcattggaattctattctctggtcatttccattccagcaggggaggaaagctgttgatctggctcacaaatatcataagttgactaaacaccccacttgtgcggcaagctag

SEQ ID NO: 55188 - DNA, 2184 bp, Artificial Sequence
  Description of Artificial Sequence: Synthetic coding sequence
atggaatcggaagacactaaaaaaacacaggaaatgaagacagacttgaacctactgcttgagtgtctaaaatatcagatggataatgcgttctcccaaaaggaagcccttgtgacgatacatagtatttgtcagcagaactcaaacgcaagtgtatactttcgggagattgggggactgatgttcgtgaagaacctggccaaatcttcagagcacagcatggtcaaagaggcagctttgtacactctcggggctatcgcagaaaagaatgtttactgccagcaaacgctctgcacctcagagctttttgaggatctgacttggtttctcagcaatgactccaatatcaacttgaaaagaatgagcgtgtatgtgattcttgtgctcgttagtaacaatcgtacggggcaaacccttgttagggaaacaggttgtattacagtgctgagccgactcttccgcaccgtgattagtaaacacgaactggatctgtccgacaagaacgtctttcagtcgtatcagctttggtctagtgtctgcagtacgctatgtgtgtgtgttaataaccctcaaaacgatgagaaccagatgttctgttgtagccttttccctcacgccaacgaatggttgaagaactgcacaacgcctgagattatccgaccaatttgttcctttatcggcctcactctggccaataacacgtacgtccagaaatactttgtgtcagttggcggtttggacgtcctgagccaagtgctgatgcagctagagtctgattcccacgagacactgagttccgcaaagctggcagtggtagtcacaaaaaccgtggatgcgtgtatagctgacaatcctacttttggcattgttctgtcgaaataccatattgtgtccaaactactcgccctcctcctacacgaatccctggatagcggcgagaaattttccattatgctgacacttggccactgtaccgaagattgtgaggagaaccagtacgacttgttcaaaaacaatggactccccttgatgatccaagcacttacagaaagtcagaatgaggagctcaacaaagcagctacttttgtactgcacaactgtaaaaagatcaccgaaaagctgtcgctgtctctgggtgaatacccatttgacgaaaacgagactcagcagctcaaagatatttcagtcaaagagaataacttggaggaacactggagaaaagccaaagagatcctccatcggatagagcagctggagcgggagggcaacgaagaggaaatccagcgcgagaactaccaggacaatatcagcagtatgaatatttctatccaaaatacatggaagcacttgcacgctgacagaatcgggcgtgggtctaaagccgaggacgaggacaagagccactccagacaactccaaagctataagtctcatggcgttatgtctaaggcttgcacaaacgacgaccaaatgaagaccccattgaaaagcgcaaacccagtgcacgcttgttaccgggaatccgaacagaataaaacactgtacaaagctaaatcatcttgtaatcagaatctacacgaagaaaccacatttgaaaagaactttgtttctcaatcttcagaccacgttttcaaacacccggtgcacatcgctaagaacattaagcagcaacttccagtcactgatccatttacactctgcagtgatattataaacaaggaagtcgtttctttcctcgctaccccctcttgcagcgagatgcttacctaccggtgtagcggctgcattgccgttgagaaaagcctgaattctaggaacttcagcaaactattacatagctgcccttatcaatgcgaccggcataaagtcattgtggaagcagaggaccggtataagtctgaattaaggaagtccctgatttgtaacaagaagatcttactgacacccagaaggcggcaaagactctcaaatgagtctaccaccccagggggaattaagaagcgacgaatccggaagaatttcacagaggaggaggttaactacctgtttaatggtgtgaagaaaatgggaaaccattggaactcaatcctctggtctttcccattccagcagggacgaaaggccgtggacctggcccacaagtatcacaagctgaccaaacatcccacatgcgctgcttcctag

SEQ ID NO: 55189 - DNA, 1653 bp, Artificial Sequence
  Description of Artificial Sequence: Synthetic coding sequence
atggagtctgaagatacaaaaaaaacccaagagatgaagacagatctgaaccttctcttggagtgcctcaagtatcagatggataatgccttttcccagaaggaggccttggtgacgatacacagtatttgccaacagaacagtaatgccagcgtttacttccgtgaaatcggcggactcatgtttgttaaaaacttggctaaaagttccgaacatagcatggtgaaggaggcagccctgtatacactgggagcaatcgccgaaaaaaacgtttactgtcagcagactttgtgtacatcagaattattcgaagatctgacttggttcctgagcaacgatagcaatatcaacttgaaacggatgagcgtttacgtcattttggtgctggtgagcaacaacaggacaggccagactctggtgcgggagactgggtgcattacagtcctgagccgcctgttcagaaccgtgatatccaagcatgagctggatctgagcgataagaacgtgtttcagagctaccagttatggtcttccgtctgctcaaccctctgtgtctgcgtcaataatccacagaatgacgagaaccagatgttttgttgttccctattcccccacgccaatgagtggcttaaaaattgtacaactcccgagatcatacgcccaatttgctcatttatcgggctgacactcgctaataacacgtatgtacagaagtattttgtgtcagtcggaggcctcgacgtgctcagtcaggttctcatgcagctagagagcgactcacacgagacactttccagcgccaagcttgcagtcgtggtcacgaagacggtggacgcctgtatagccgacaatcccacattcggcatcgtgttatctaaatatcatatcgtgtcaaagctgctcgctctgctactgcacgaatcgttggattccggagaaaaatttagcataatgctcacacttggacactgtactgaagactgtgaagagaaccaatacgatctatttaaaaacaacgggctgcctctgatgatccaagcgctgactgagtcacagaatgaggaacttaataaggccgctacttttgtcttacataactgtaaaaaaatcaccgagaaactgagtctctccttaggcgaatatccattcgatgagaatgagacgcagcaactaaaggacatctcagttaaagagaataatctcgaggaacattggaggaaagcaaaggagatcctgcaccgtatcgaacagctcgagagggaaggtaacgaggaggagatccagcgagagaactaccaagacaatatctcgagcatgaacatttcaatccagaatacttggaaacacctgcacgccgatagaatcggaagaggcagcaaggctgaggatgaggacaaatcccactctagacaattgcagagttataaaagccatggcgtcatgtcgaaagcgtgcaccaacgacgatcagatgaaaacgcctctgaaatcagcaaacccagtgcatgcttgctatagagaatcagagcagaacaagactctctacaaagcaaagtctagttgtaatcaaaatctgcacgaagagactacgtttgaaaaaaactttgtgtcccagtcaaggagcatttacatcatgttcaggtataataagtag

SEQ ID NO: 55190 - DNA, 1164 bp, Artificial Sequence
  Description of Artificial Sequence: Synthetic coding sequence
atggaaaacaaactgccaatggaaaccttggttgaggagtgtggggagaatagagagagaaagtgcaagttaaaggaccagtctgacaaggaggagggaacccgcgatatcagcagtcccaaacgcctgagagacaggcaggcgctctttcccgctaaggttaccaatgtgtccctgctcgaaaagtttgaacgtagcgagagtgggggtaaaattatgacacctgagagtctgagctatccttcatgcctaaagcacgattctgagatgaagccccagacctcaccagcttgccaagatcataacaaggctggtcagatgaagagcctggctacacgcgagcagaatcaaaagaatgccgcttacaaccttggcgtcgccgaggccattaggaaccataagaacgaaaagccagagttctacaaatccttcttgttcgataaacgaccattatctcccgctttgaatgctctgaaacaggaggagtacagccggagtctgctaaagcaaatggacaataggcaggagaacgagatcaagcaaaggcaatacagagagttgatggacagattggagcaggtgcagttaaccgaggagctcgcagctcaaagagccaagttcctgaaagacaaaatggaggaaactcaatgctataaacgggctcttgatgctcagatcaaaaacaagccgagtcgactcccgccttttgaacctgactcctcagagcctatcttcgggaagaatgaaggagagcttatggtcgagaaacaaaagagggagcagaactatatgaaacaccagctggaggccgcagcgaatcacaaaaggaaagctatccttcatcagctggtggaccagcggagagacctacagatgctacaaaggacgcagagggagcatctcgccgaccgaacagcagaacttgaacgagtcaatagagtgaatcagtgccttcaggaagactgggaaaggtccgcagcgatgaaaaaacagcgagacctcgaagacaaagcctttgagcgagctagcgacaagctcttcctgctcgatcagtgtgagaagtatagacgctgcaaacagtgccagcgtcgcacctccaacgtgggagagtcaaatttgtggcctctgaacaagttcctgccaggatctcggctactcgtctag

SEQ ID NO: 55191 - DNA, 1689 bp, Artificial Sequence
  Description of Artificial Sequence: Synthetic coding sequence
atgctggataccatcgctcgcgctttacaggatttgggtcgccaggtgctaccaaccctgcccagcctgtctcaggaggaagtatcaattatctggggtaatgtgagcgagttcgtccgtcgtcagcttacactacacaaaggagtccagattcctgcctttggtaccttcacgtttatccggcaaaagttggaagtaggtaacaataagttcattcttatccagcgcccagtgtttatcatggtggagaaacttgtgcagatacacggcctcaagcagaataaacgtcccggtacagttgactccgtcttgtccagtcgcgaggccctacgcaagtggccaagttctgtactagccttccctagaatcgagcttaaagaaatggaaaataagctgccaatggagacccttgtggaggagtgtggcgagaaccgcgaacgcaagtgcaaattaaaagatcagagtgataaagaagaagggacccgcgacataagctctccgaaacgtttaagagataggcaggcactcttccctgccaaagtcaccaatgtcagcctgctggaaaagttcgaacgctctgagtctggaggcaagatcatgactcctgagagcctgtcttatccttcatgcctcaagcatgattccgagatgaaacctcagacaagccctgcttgccaggatcacaataaggccggacaagagatgtgctatgtatgcctgcagagggcccagcgaaatagtctgctgtactactctgaggagaggcgccgtgagatcgaagatgaaaggcttattcagcagtatcagatgctgaaagatcaggaggcactatttcggcatcagatgaaaagcttagcaacaagggaacagaaccagaaaaacgccgcatacaacttaggagtcgcggaagctatccggaaccataagaacgagaaaccagagttctataagtcttttttgtttgacaagcgtcccttgagtcctgctctgaatgcactgaaacaggaagagtattcacgttccctcctaaagcagatggataatcgccaggagaacgaaattaagcagcgccagtatagagagctgatggatcgcctggaacaagttcaactaaccgaagaattggcagcccaacgggcaaaattccttaaggataaaatggaggagacgcaatgctataagcgtgcactggatgcacagatcaagaataaaccatcacggctgccacccttcgaacccgactcctccgaaccaatttttggcaaaaacgagggtgagctgatggtagagaagcagaagagggaacagaattatatgaagcatcaacttgaagccgctgccaatcacaaacgcaaggccattttgcaccagctggtagaccagagaagggacctgcagatgctgcaaaggacccagcgggaacatctggctgatagaaccgcggagctggagcgggtgaatcgggttaaccagtgccttcaggaagactgggagaggtccgcagcaatgaagaagcaaagagatctggaagataaagcgtttgagagggcaagcgataaactctttttactagaccagtgcgaaaaataccggcgttgcaagcagtgtcaaagaagaacctccaatgtgggagagtcaaatctgtggccattaaataaattcctcccagggtcaagactccttgtgtag

SEQ ID NO: 55192 - DNA, 1959 bp, Artificial Sequence
  Description of Artificial Sequence: Synthetic coding sequence
atgttggacactattgcaagagcattgcaggatctcggccgtcaggtgttacctacactcccgagcttgtcccaggaggaggtgagcattatctggggtaacgtaagtgagtttgttagacgccagctgactttacacaagggcgttcagattcctgcctttggcacgttcacgttcattaggcagaagctggaggtcggtaataataagtttattttgatccagagaccggtgtttattatggtggagaagcttgttcagattcacgggttaaagcagaacaaggtatacacccctggcgagattcctattgttcccttgaattttgtgatgataagcttggaaggtccatttaacagagatgtggttgaaggttgtgtaaaggagacactgctgtttctatcgagatccatttcaatgaagcagaacgtggagtttacgttcaaaggcataggcgtgcttatgatcagagatagtaaggtgaagatgcggttttacaaagatttcctgtgtacaatggacggttctggcgcattggccaaggcgctggccaaccgaccgggaacagtcgacagtgttctttcttcgcgggaagccctccggaagtggccatccagcgtcctcgcattccccaggatagaactgaaagagatggagaacaaactgcctatggagacactggtcgaagaatgtggcgagaacagggaacgcaagtgcaaactaaaggatcagagcgataaggaggaaggcacacgggatatctcctctcccaagaggctaagggatcggcaggccctgttccctgctaaggtcacgaatgtgtccctcctggaaaagtttgagagatccgagagtgggggaaagatcatgacaccagagtcgctgagctatccctcttgccttaagcacgatagtgagatgaagcctcagacaagccccgcatgccaagaccataataaagctgggcaggagatgtgctatgtgtgtctccagagggcccaacgaaattcactgctatactattcagaggagcgtcgtcgcgagattgaggacgagagattgattcagcagtaccagatgttgaaggaccaggaggccttgttcaggcatcagatgaaatcactggctactcgggagcagaatcaaaagaacgccgcttacaacctcggtgtggctgaagctatccggaatcataagaacgagaaacccgagttctataagtccttcctttttgataagcgaccgctgagtcccgcactgaatgctcttaaacaggaggaatatagtcgcagtttattgaagcagatggacaacaggcaggaaaatgagatcaagcagaggcagtacagggagctaatggatcgtctggagcaggttcaattgacagaggagcttgcggctcagagagcaaaattcctgaaagataaaatggaagaaacccaatgttacaagcgggctctcgatgcccagattaagaataaaccatcacggctcccgccttttgagcccgatagcagtgagccgattttcggcaagaacgagggagagctcatggttgagaagcaaaagcgcgagcagaactatatgaagcaccagttagaggcagccgcaaaccacaaacgcaaagcaatccttcaccaacttgttgatcagcgtcgggacctgcagatgctgcagcgcactcagagagagcacctggccgacagaaccgctgagctggagcgagtcaatcgcgtgaaccaatgccttcaggaggattgggaaagatcagctgcgatgaagaaacaacgcgatttggaggataaggcattcgagcgcgcatctgacaaactattcctcctagaccaatgtgaaaagtatcgacgctgtaagcagtgccagagacgcacatcaaatgtgggtgagtctaatctgtggcctctgaataaatttctgccaggtagcaggcttctcgtgtag

SEQ ID NO: 55193 - DNA, 1635 bp, Artificial Sequence
  Description of Artificial Sequence: Synthetic coding sequence
atgatacatgtcaggcggcatgaaactcgacgaaactccaaatcccatgtgcccgagcagaagtcccgtgtggattggcggagaaccaagagatcatctattagtcagctcttagactccgatgaagaactagattcagaggagtttgactctgatgaggagttggattccgatgagagcttcgagaacgatgaagaactggatagcaacaaaggaccagactgcaacaaaactccaggcagcgaaagagagctgaatctttcgaagattcagtctgagggaaacgactctaagtgcctcatcaacagcggcaatggctctacatacgaggaggagaccaacaagataaagcaccgcaatatcgatttgcaggaccaggaaaagcaccttagccaggaagataatgacctgaacaagcagaccgggcagattattgaggatgatcaggaaaaacacctcagccaggaggataatgacctcaataaacagactggccaaattattgaagatgatttggaggaggaggatatcaagaggggcaaacggaagaggctctcctctgtaatgtgtgacagcgacgagtcagacgacagcgacatcctggtgcggaaagtgggggtgaagcggcctaggagggtagttgaagacgaaggctcttccgtggaaatggagcagaagactccagagaagactctagcagcccaaaagagagaaaagctccagaagctgaaggaactgagcaagcagagaagccgtcagcgccgatcatccggacgcgactttgaggattcagaaaaggagtcgtgcccatcatcagacgaagtcgatgaggaagaggaagaagacaattatgaaagtgacgaagatggggatgactatattattgacgatttcgtcgtgcaggacgaagaaggtgacgaagagaataagaatcaacaaggagagaagctgaccaccagccagttgaagctggtcaagcagaatagcctctattcatttagtgaccactatactcatttcgagagagtcgtgaaggcactcctgataaacgccctagacgagagcttcctcggcaccctgtacgacggtaccagacagaagagctatgcgaaggacatgctaacatccctccactatttagataacagatttgtgcagccgaggttagaatccctggtgtcacggagtaggtggaaggagcaatacaaggagagggtcgagaactatagcaatgtgagcatccacctcaaaaaccccgaaaactgcagttgccaggcctgcggcttacatcgctactgtaagtattcggtccacctgtctggggaactatataacaccagaaccatgcagattgataactttatgagtcatgacaaacaggtgttcaccgtggggcgaatctgcgcctctcgtacaagaatctatcataagctgaagcacttcaagttcaaattatatcaggagtgttgcactatcgccatgactgaagaggtcgaagatgagcaagtcaaggagactgtcgaacggatttttaggcgctcgaaggagaacgggtggatcaaagaaaagtacggacagttagaagagtacctgaacttcgcagactattttcaggaggaaaagttcgaactttag

SEQ ID NO: 55194 - DNA, 1635 bp, Artificial Sequence
  Description of Artificial Sequence: Synthetic coding sequence
atgattcatgtgagacgccacgagactagaaggaatagtaagtctcacgttccggagcaaaagtcgagagtggattggcgtcggaccaaacgaagcagcattagccaactgctggatagtgacgaggaactggactcagaggagttcgactctgatgaggagctggattctgacgaatccttcgagaatgacgaggaactagacagcaataagggaccagattgcaataagacccctggctctgagcgggaactaaatctcagcaaaatacaaagcgaggggaacgatagtaagtgtttgatcaactccggcaacggatcaacttacgaagaggaaacgaataagatcaagcatcggaatatcgacctgcaagatcaggagaagcaccttagtcaggaagataatgacttaaacaagcagactggccagatcattgaggacgaccaggaaaaacatctgtcccaggaggataacgatctcaacaaacagaccggacaaataatcgaagatgacttggaggaagaggatatcaagaggggcaagaggaaacggctttcttccgtgatgtgcgacagcgatgagagtgatgactccgacatcttagtcaggaaggtcggtgtgaaacggcctaggcgggtggtcgaagacgaaggttcttccgttgaaatggagcagaaaacacctgaaaaaactttggcggcacaaaaaagggagaagctgcaaaagctgaaggagctgagcaagcagcgctctcggcagcggcgaagctcaggccgagatttcgaggactccgagaaggaaagctgtccatccagcgacgaggttgatgaggaagaggaggaagataactatgagtcagatgaagacggggatgattacattatcgatgatttcgtggtgcaggacgaagagggagacgaagagaataaaaaccaacagggtgagaagctgacaacttcccaacttaaactggtcaagcaaaattccctgtacagcttttcagaccactacacgcattttgagcgcgtagtaaaggcacttctgattaatgccctcgacgagagttttctggggaccctgtacgacggtaccagacaaaaatcctatgcaaaggacatgttgacatccctccattacctggataacaggttcgtgcagcctcgcctcgagtccctggtgagtcgatctcggtggaaggagcagtacaaggaacgcgtggaaaattactcaaatgtgtcgatccatttgaagaacccagagaattgtagttgccaagcctgtggacttcacaggtactgcaaatattctgtgcacctctctggggagctttataatactaggacaatgcaaatcgacaacttcatgtcccacgataaacaagtcttcactgtcggcagaatttgtgcttcccgaaccaggatttatcacaagctcaagcacttcaagttcaagctgtaccaagagtgctgtactatagcaatgaccgaagaagtggaggatgagcaagtgaaagaaacagtcgagagaatctttaggcgctctaaagaaaacgggtggattaaagagaaatatgggcagttggaggagtacctgaacttcgctgattatttccaggaggagaaatttgagctttag

SEQ ID NO: 55195 - DNA, 93 bp, Artificial Sequence
  Description of Artificial Sequence: Synthetic coding sequence
atgatccatgtccgacgccatgaaacccgcaggaactctaagtcccatgtgccggaacagaagagccgtgtcgattggcgcaggacaaaatag

SEQ ID NO: 55196 - DNA, 789 bp, Artificial Sequence
  Description of Artificial Sequence: Synthetic coding sequence
atgattcatgttcgcagacacgagacacggagaaactccaagagccacgtccctgaacagaagagccgagtcgattggcgcagaactaaacggtccagtatctcccagctgctagatagcgacgaggagttggactcagaggagttcgattctgacgaagagttggattctgacgagagcttcgagaatgacgaggaactggacagcaataaaggtcctgactgcaataagacccccggatcagagagagaactgaacctgagtaagatccaatctgagggcaatgacagcaaatgcctgataaatagcgggaacggctccacttatgaggaggagacgaataaaattaaacatcggaacatagatctgcaggaccaggagaaacatctgagtcaggaagacaacgatctaaacaagcagacaggacaaatcatcgaggacgaccaagagaagcatctgtctcaggaagataatgatctgaacaaacagactggccagatcatagaagatgatctcgaagaagaggacatcaagagaggcaagaggaagagactgtcatcagtgatgtgtgatagcgacgaatctgatgatagtgatatactggttcgaaaagtgggcgtaaaaaggccacgcagagtggtggaagatgagggtagcagtgtcgaaatggagcagaagactcctgagaaaactcttgccgctcagaaaagagagaagctgcaaaagttgaaggagctgagtaagcagagatctcggcaacgtagatcatccggtagggatttcgagtag

SEQ ID NO: 55197 - DNA, 1635 bp, Artificial Sequence
  Description of Artificial Sequence: Synthetic coding sequence
atgattcacgtacgcaggcatgagacaaggcgaaactccaagagccacgttcccgaacagaaaagccgggtagattggcgtcgtaccaaaaggagctccatttcccagctactcgacagtgatgaagaattagacagcgaagagttcgatagcgatgaggagttggactctgatgagagctttgagaatgatgaggaattggactctaataaaggcccagactgcaacaagacacccggatctgaacgtgagcttaacctgtctaaaattcagtcggagggaaacgactctaagtgtctgatcaactccggtaacggcagtacttatgaagaggagactaacaaaatcaaacatcgcaatatcgacctccaggaccaagaaaagcacctgagccaagaggataacgacctgaataagcagaccgggcaaattattgaggatgaccaggaaaaacacctctcccaagaggataatgatttgaacaagcagacaggccaaataattgaggatgacttagaagaggaagatatcaagcgaggtaagagaaagcgcctgagcagtgtcatgtgtgacagcgacgaaagtgatgattcagatattttggtgagaaaggtcggagtgaaaagacccagacgagtcgtggaagatgaaggcagttctgtcgagatggaacagaagacccccgagaaaacgttagcggcacagaagagggagaagcttcagaagctgaaagaattgtccaagcaacggtcaaggcaaagacgttccagcggcagggattttgaagatagtgagaaagagtcctgtcctagctccgatgaggtagacgaggaagaagaggaagacaattatgaatcagatgaagacggggacgattatattatagatgatttcgtggtgcaagacgaagagggcgatgaagaaaacaagaatcagcagggcgagaagctcacaacctctcagcttaaactcgtaaagcagaactcactgtatagcttcagcgaccactatacgcattttgaaagagttgtgaaagccctgttaatcaacgctctagacgaatccttcctgggcaccctttacgatggcacacggcagaaaagttacgccaaggacatgctgacgtctctgcactatctggataatcgattcgttcagcctcgcctcgagtcgctcgtctcgaggagtcggtggaaggagcagtacaaggaaagggttgagaactactccaatgtgtctattcacttaaagaatccagagaattgtagttgtcaggcctgcgggttacacaggtattgtaagtattctgtccacttgtctggtgagctgtacaacaccaggaccatgcaaatagacaactttatgagccacgataaacaggtgttcaccgttgggaggatctgcgcatcccgcacgcgaatttaccataaactgaaacactttaaatttaaactttaccaagagtgttgtaccattgcaatgacagaggaggtagaagatgagcaggtcaaggagaccgtcgaacggatattccggaggagcaaggagaacggctggattaaggaaaaatatggccagctcgaggaatatcttaacttcgctgactatttccaggaggagaaattcgaactatag

SEQ ID NO: 55198 - DNA, 1335 bp, Artificial Sequence
  Description of Artificial Sequence: Synthetic coding sequence
atggaaaactcaggtaaggctaacaagaaggacacacacgatggccctccaaaagagattaaactcccaacttctgaggcactgctggattaccagtgccagattaaagaggacgcggtggaacagttcatgtttcagatcaagacattgcggaagaagaaccagaagtaccatgaaaggaactccaggctgaaagaggagcagatctggcacattcgccacttgctcaaggagctgagtgaggaaaaggcagaaggcctccccgtggtaacacgtgaagatgtggaagaggccatgaaagagaagtggaagttcgaacgggaccaggagaagaatctgagagatatgaggatgcagatttctaatgccgagaagctttttcttgaaaaactttctgaaaaggaatactgggaggaatacaagaacgtggggagtgagaggcacgctaaactgatcacttctctgcagaacgatatcaacaccgtgaaggaaaacgcagagaagatgtcagaacattataagataacattggaagatacacggaagaaaatcataaaagaaacactgttacagctcgatcagaagaaagagtgggccactcagaatgcagtcaagttaattgacaagggcagctacctcgaaatttgggagaatgactggctcaagaaggaggtagcaatccacagaaaggaggtcgaggagttgaagaacgcaatacatgaacttgaggcagagaatctggttctgatagaccagcttagtaactgtagactggttgatctgaaaattcccagatatccagttctccactcatgcccaacgagtaatcctcggcacctgctgttgctccctctggagtcgtgtctgatatctgctcgacggtgctggagactgtacctcactcaggccgctgggcttgaagttcccccagaagagatgtctctcgagctccctgagactcacatcgaagaaaagagcgaactacagccaaccgaagtcgagtctcgcgatctaatgagtagctccgatgagtcaactatactccatctttcccatgagaactctatagaagacctccagtatgtcaagatcgataaggaagagaattcaggcacagaatttggcgataccgatatgaaatatctgctgtacgaggacgagaaagacttcaaagattatgtgaacctgggtcccctcggcgtgaagctgatgagtgttgaatccaaaaagatgcctatccactttcaggagaaggagattccagtaaagctgtacaaagatgtgagatcaccagagtctcacattacctacaagatgatgaagtcattcctttag

SEQ ID NO: 55199 - DNA, 1242 bp, Artificial Sequence
  Description of Artificial Sequence: Synthetic coding sequence
atggagaactctggcaaggctaataaaaaggatacccacgacggccctcccaaggagatcaagctccccacctcagaggccttgctcgactatcagtgtcagattaaagaggacgctgtggaacagttcatgttccagatcaaaacactgcgcaagaaaaaccagaagtatcacgagagaaattctagactgaaggaagagcagatctggcatatccggcacctcctgaaggagttgagtgaggaaaaggcggaagggttaccagtggtaaccagagaggatgtagaagaggctatgaaggaaaagtggaaatttgagagagaccaggaaaagaatttgcgggacatgagaatgcaaatcagtaacgcagaaaagctatttcttgagaaactgagcgagaaggagtactgggaagaatacaaaaacgttggatctgaacgtcacgcgaaactgatcacgtccctgcagaacgacatcaatactgttaaggaaaacgctgaaaagatgagcgaacactacaagatcactctggaggacactaggaaaaaaattattaaagagactctgctgcaactggaccagaagaaggagtgggcaacccagaatgccgtgaaactgatagataaaggaagctacctggaaatctgggagaatgattggctcaaaaaggaggtcgccatccaccgcaaagaggtggaggaactcaagaacgcaatacacgaactggaggccgagaacctagttttaattgatcagctgagcaattgtcggctggtggatcttaagattccccgacgcttgtacctgactcaggctgccggactggaggtgcctccagaggagatgtcgctggaactgccagagacccacatcgaagagaagtccgaactgcagcccactgaggtggagtctagagatcttatgagcagttccgatgagtcgaccatccttcacctcagtcacgaaaatagcatagaggacctgcagtacgtgaagatagacaaggaagagaacagcgggactgaattcggagacacagatatgaagtacctgctgtatgaggacgaaaaagattttaaagattacgtcaatctcggccctctgggagtgaaactgatgagtgtggagagtaaaaaaatgcctatccactttcaagagaaggagattcccgtgaaactctacaaggatgtcaggtccccagaatcacacatcacgtataaaatgatgaagagtttcctttag

SEQ ID NO: 55200 - DNA, 942 bp, Artificial Sequence
  Description of Artificial Sequence: Synthetic coding sequence
atgtttcaaataaaaactttgcgaaagaagaatcaaaagtatcacgaaaggaactcaaggctcaaggaggaacagatttggcatatacgtcacctcctcaaagagttgagtgaggagaaggcagaaggcctgcccgtggttactagggaagatgtggaggaagctatgaaggagaagtggaaatttgaacgagatcaggaaaaaaatctgagagagcattacaagatcacgcttgaggatacacggaaaaaaatcatcaaggaaacgctccttcagctggaccagaaaaaggaatgggccactcagaatgccgtgaagctgattgataaaggaagctatttggaaatatgggagaacgactggctaaaaaaggaagtagcaattcaccgtaaggaggtggaagaactaaagaatgccattcatgaactcgaggcggagaatcttgtcctaatagatcagctcagcaactgccgactcgttgaccttaaaatcccgagacgactgtacctcacccaggccgcaggcttagaggtgccaccagaggaaatgtccctcgagctgcctgaaacccacattgagaagtcagaattgcagccgaccgaggttgaatctcgcgacctgatgtccagctctgacgaaagtacaatcctgcatctcagccatgaaaacagcattgaagatttgcagtatgtgaagatcgacaaagaggaaaactccggtaccgaatttggggacacagacatgaagtacctattgtatgaagacgagaaagactttaaagactacgttaatctgggccctcttggcgtgaagctgatgagtgttgagtctaagaagatgccaatccatttccaggagaaagagattcccgtgaagttgtacaaagatgtaagatctcccgaatcccatatcacatacaagatgatgaagagctttctgtag

SEQ ID NO: 55201 - DNA, 999 bp, Artificial Sequence
  Description of Artificial Sequence: Synthetic coding sequence
atggctccggctcagcggtgtcccctgtgtcgccagaccttcttctgtggtagaggacatgtttatagcaggaaacatcagcggcagttgaaggaagccctagagcgtctgctcccccaggtggaagcagctcggaaggcaatcagggccgcacaggttgagagatacgttcccgagcacgagagatgttgttggtgcctctgctgcgggtgcgaggtacgcgagcacttgtcccacggtaatcttaccgtcctttacggaggtctgctcgaacatctcgcgtccccggaacacaaaaaggcaactaacaagttctggtgggaaaacaaagccgaggtgcaaatgaaggagaaattcctggttacaccgcaggattatgccaggttcaaaaagtctatggtgaaggggctggactcctacgaagagaaggaagataaggttattaaggagatggctgcccagataagggaggtggagcagtcccgccaggaagtggtacgctctgtgctggagcctcaagccgtacccgaccctgaagagggttcaagtgcccctcgtagctggaagggaatgaattctcaggtcgcctccagcctgcagcagcccagtaatctcgatctgccaccagcgcctgaactggactggatggaaaccggtccatcactcacctttattggacaccaagatattccaggggttggcaatattcactccggtgcgacacccccatggatgatccaagatgaagagtacattgcaggaaatcaagaaatcgggccttcttacgaggagtttttgaaggaaaaggaaaaacagaaactgaagaagctcccacctgatcgcgtcggcgcaaattttgaccacagctctcgaacaagtgccggttggctcccctcatttggaagggtttggaacaatggaaggagatggcagagtagacatcagttcaagactgaagctgccgctatgaaaaagcagagtcataccgagaagtcctag

SEQ ID NO: 55202 - DNA, 1662 bp, Artificial Sequence
  Description of Artificial Sequence: Synthetic coding sequence
atgagcaaggcagctggtggcgcagctgccgctgcggcagcagccgaatcctgctcccctgccccagctgggtccagcgccgcacccccagcccctgtcgaggatctaagcaaggtgtcagacgaagaactgctgcagtggtcaaaggaagaactgatcaggtcgctcagaagagctgaagccgaaaaggtgtctgctatgctagaccacagcaatttgattagagaggtgaatagacggctccaacttcatctcggggagatacgagggctgaaagacatcaatcagaagctgcaggaagataatcaggaactgcgggatctgtgttgttttctcgacgatgatagacagaagggcaaacgcgtgagtcgtgagtggcagcgactgggtcgctatactgctggagtgatgcacaaggaggtcgctctgtatctgcagaaactaaaagacctggaggtgaagcaggaagaagtggtcaaagagaacatggaactcaaagagctgtgtgtgctgttggacgaggagaagggagctggctgcgcaggtagcaggtgcagcatcgatagccaggctagcctctgtcagctaactgcttcaacggctccttatgtaagagacgtgggcgacggttcaagcaccagttctaccgggagcactgactccccggaccaccacaagcatcacgcttcgtcaggctctccagaacacttacaaaaacccagaagcgagggctccccggaacacagcaaacaccggagcgcctcccccgaacaccctcagaaacccagagcctgcggcacccccgaccgacccaaggctcttaagggcccttctcctgagcatcacaagccactgtgtaagggcagccctgaacagcagaggcaccctcaccctggctcttcacccgaaacccttcccaaacacgtcctgagcggcagtccagagcatttccagaagcaccgttccggatcttcccccgaacacgccagacacagcggagggagcccggaacacctgcaaaaacatgccctcgggggtagcttggaacatctgccgagggctcggggtacaagtcctgagcacctgaaacagcactatggaggatctccggaccacaagcacgggggtggctcaggaggctccggcggtagcggcggtggaagccgcgaagggacactccgccgacaggctcaggaggacggcagtccacaccaccgcaacgtttactcaggcatgaatgaatcgactctatcctacgtgcgccagctcgaggcaagggtccgtcagctggaggaggaaaacaggatgctcccccaagcctcacaaaaccgtaggcagccaccaacacgcaacagctcgaacatggagaagggttggggctcccgagcacggagggttttgcagtggtggcaaggttgccggggaatcggcaggtgccttcccaccctgcctggatcctttcgcctgtccagcggtgccgacggatcaaacagcagtcccaacagtgctgcctccttctcaggtcatgccactccttctcagcagcccgagcccgttgtgcactctctgaaggtcgtatggcgaaaactcggggatgctgctggtagctgtccgggtatccggcagcatttatcaggcaaccagtataagggacccatgtag

SEQ ID NO: 55203 - DNA, 1260 bp, Artificial Sequence
  Description of Artificial Sequence: Synthetic coding sequence
atggccaagccggcagccactgccgcagccgcatccgaggagctgagtcaggtgcctgatgaggagctattgagatggagcaaagaagagctcgctcggcgtctgcggagggcggaaggcgaaaaagttgggctgatgctagagcatggtgggcttatgcgcgacgtcaatagaagactccagcagcatctgctggagattcgaggtctaaaggatgttaaccaacgtctccaggacgataaccaagagctcagagaactctgctgtttccttgacgatgatcgtcagaaggggaggaagctggccagggagtggcagcggttcggaagacacgccgctggagccgtgtggcatgaggtggctaggtcgcaacagaaacttcgggagttagaagcacgccaggaagccctgctcagggaaaacctggagctcaaagagctggtgctcctgctagacgaagaacgcgcagccctagccgctaccggtgccgcaagcgggggaggaggaggtgggggaggtgcaggcagccgttcgtcgatcgactcccaggcctccctctcaggccctctgtctggtggcgcacctggcgctggggctcgcgatgtgggagacgggagcagcaccagtagtgcagggagtgggggttcacctgatcaccaccaccacgtccctccgccactccttccccctggccctcacaaggcccctgatggcaaggccggtgcgacacgacgctcgctggatgatctgtccgccccaccacaccaccgatcaatcccaaacgggttacacgacccttcatctacttacatacggcaactcgaatctaaggttagactgctggagggagataagttattagcacagcaggcgggatccggggaatttagaacactgaggaagggctttagtccgtaccactcagaatcccagctggcttctctgccaccatcatatcaagatagtcttcaaaatggcccagcttgtcctgctccagaattaccaagccctccttcggccggatactctcctgctggtcagaagccagaagcagtagttcacgcaatgaaagttctggaagtacacgaaaatctggacagacagctccaggattcctgcgaagaggaccttagtgagaaagaaaaggccatcgtgagggagatgtgtaatgtggtgtggaggaagctgggcgacgctgcgtcatctaagcccagtatcaggcaacatcttagcggcaatcagttcaaggggcctctgtag

SEQ ID NO: 55204 - DNA, 2550 bp, Artificial Sequence
  Description of Artificial Sequence: Synthetic coding sequence
atgatggaaccacctaaacccgaacccgagctgcagcgattttaccatcggcttctaaggcccctttctctgtttccaacccgcaccacctccccagaaccccagaaacggcctccacaggaagggcgtattttgcagagtttccctctcgctaagttgacagtggcatctctgtgttcccaggtagctaagctactggcagggtcagggatcgccgcaggcgtgccccctgaggcccgtttgcgtttgattaaggtcatcctggacgaactgaaatgttcttggcgagaaccgccagctgagctgagcctaagccacaaaaacaaccagaagctaaggaagcggctggaggcttacgtgctcctgtccagcgaacagttgttccttcggtatcttcacctgctggtcacaatgagcaccccaaggggcgtgttcacagaaagtgccaccctgaccagacttgctgcttcgctagcaagagactgtacactgtttttaacaagtccgaatgtttaccgagggcttctggctgacttccaggccctgctgagagcagagcaggcaagcggggacgtggataagctgcaccccgtctgtcccgctgggaccttcaagctgtgcccaattccctggccacactccaccggattcgcccaagtgcagtgttcaaaccttaatctgaactacctaatccagctctccagaccccctgagttcctgaatgagcctggacgcatggatcccgtgaaggagctaaaaagcattcccaggcttaagcggaagaaacctttccattggctgccgagtattggcaaaaagcgggaaatcgacatttcgtcttcacagatggtgagcctgccgagctatccagttgcgcctacaagccgcgctagtccgtccccattttgtcctgagcttagacggggtcagtctatgccatccctcagagagggatggcgtctggcggatgaacttggattgcctcctctgccgtcccggcctctgacacccctggtcctagctaccgaatcgaagcctgagctaacgggattgatagttgccgaggatctcaaacaactcattaagaagatgaaacttgaggggacacggtaccccccattagattctggcctgccccctctgcttggcgtagtgacgaggcacccagcggctggacatagactggaggaactggagaagatgttgcggaacctgcaagaggaggaggcttcaggccagtgggacccccaacccccaaaatccttccccctgcatcctcaacctgtgacaattacactgaaactccgaaacgaggttgtggttcaagcagctgccgtgagggtgagcgaccggaatttcctagatagtttccatatagagggagctggagctctctataaccacctggccggagagctggatcctaaagcgatagaaaagatggacattgataatttcgtcgggtccaccactagggaagtgtacaaggaactgatgtcccacgtttcttctgatcatctccatttcgaccagggccctttggttgagcccgctgcagacaaagactggtccacatttttaagctctgcctttctgaggcaggaaaaacagcctcagattatcaatcccgagttagtgggcctgtacagccaaagggccaacacactacaaagcaataccaagaagatgccttctttaccttcccttcaggccacaaagagctgggaaaagtggtctaataaggcaagcttgatgaattcatggaaaaccacgctgtctgttgatgactacttcaaatacctaaccaaccacgagaccgattttctccatgttatattccagatgcacgaggaggaagtgccagttgagattgtcgccccagccagagaaagccttgagatacagcacccccctccactgcttgaggacgaagagccagattttgtgccaggggagtgggactggaacaccgtgctggaacacaggctgggggctggtaagacaccacacttgggagagccccacaagattctgagcctccagaaacatttggagcagctgtggagcgttctggaagttcctgacaaggatcaggtggatatgacgataaagtattctagcaaggcacggttgcggcagctccccagcctcgtgaacgcatgggaacgtgctctgaaaccaatacaattgagggaggcactgctagcgaggctggagtggtttgaaggacaggcctcaaaccccaatcgattttttaaaaagaccaacctatccagtagccatttccttgaggagaaccaggttagaagtcacctgcacagaaaactcaatttgatggaaagctccttggtctctctgctggaggagatcgagctgatatttggggagccagttattttcaaggggagaccctatctggataagatgaaatccgataaagtcgagatgttatactggcttcagcagcagcggcgagtacgccacctggtttcagcactgaaagacccccatcagtccacgctatttaggtccagcgctgcgtccctgtag

SEQ ID NO: 55205 - DNA, 741 bp, Artificial Sequence
  Description of Artificial Sequence: Synthetic coding sequence
atgttgtccctgtctttgtgttcccacctctgggggcctctgatactgagcgcacttcaggccaggagtactgacagcctcgatggaccaggtgagggctccgttcaacccctgccaactgcaggcggaccaagcgtcaaaggaaaacctggcaagagactgtctgccccacgtgggccatttccacggctggccgactgcgctcattttcattatgagaacgtcgattttgggcacatccagctactcctatcaccagacagggagggccctagcttgtctggcgagaatgagctggtgtttggggtgcaagttacctgtcagggtcgttcttggcctgttctgagaagctatgacgatttccggtccctggatgcccacctgcacaggtgcatcttcgaccggcgtttcagttgtcttcctgagctccctcccccaccggagggcgctagagctgcgcagatgctggtacccttgctcctgcagtacctcgaaacgctatccggtctggtcgattccaatcttaactgcggcccagtcctgacatggatggaggtcggtctggggcgtggtcttggggacagcgagtgggtaagaggttgcgtgtgccaccatgcacaacaccgggaaattctggacggaaaccgcgttgcaagcgctgttgaggacgaaggtgcagaagtcgatggggaagcgtttcgctggggttcgctatgggtgggggagagctgggatatgtag

SEQ ID NO: 55206 - DNA, 1542 bp, Artificial Sequence
  Description of Artificial Sequence: Synthetic coding sequence
atggcagctacactggatcttaagagcaaggaagaaaaagatgctgagctcgataagagaatagaagctctgaggcgaaagaacgaggcgcttatacgcagataccaggagattgaggaggatcgcaagaaggcagagttggagggtgtcgccgtcacagccccaaggaagggaaggagcgttgagaaagagaatgttgccgtggagtccgagaagaacctcggcccttcgcgacgctcccccggtactcctcggcctccgggagcctctaagggaggaagaaccccgcctcaacagggagggagggcaggtatgggtagagcctcccgtagttgggagggaagccctggcgaacagcctcggggaggaggagcgggagatacatctatatctgaccgcaagtctaaggagtgggaggaacgcaggcggcagaatatcgaaaaaatgaacgaagaaatggagaaaattgctgaatatgaaaggaaccaacgggaaggtgtactggagcctaaccctgtcagaaattttctggacgatcctcgtcgaaggtctgggccattggaagagagcgagcgagataggcgagaggaatctaggcggcacggaagaaactggggcggtcccgacttcgaacgcgtgaggtgtggtttggagcatgagcgacagggacgaagggctggtctagggagtgcaggtgacatgactctgagcatgacaggcagagagcggtctgagtatcttagatggaagcaggaaagagaaaagatcgaccaggaaagacttcagagacaccgcaagccgacaggccagtggagaagagagtgggacgctgagaaaactgatggcatgtttaaggacgggcctgtgcctgcccatgaaccatcccacaggtatgatgaccaggcctgggccaggccccctaagccacctacctttggggagtttcttagccagcacaaggctgaggcttcttcaaggagacgtagaaagtcatcacgaccacaggctaaggctgcgcctcgcgcatattctgaccacgacgataggtgggaaaccaaggagggcgcagcgtcccccgcaccggagacacctcagcctacctctcccgagacaagtcctaaggagacccccatgcaaccgcctgagatccccgcaccagctcaccgaccacctgaagatgagggagaagagaacgagggagaagaagatgaggaatgggaggatatttccgaagatgaggaggaggaagagatcgaagtagaggagggagacgaagaagaaccagcccaggatcaccaggctccagaggctgcccctactggtatcccatgctccgagcaggcccatggcgtgcctttttctcctgaggagcctctgctcgaaccccaggctccaggcacgcctagcagcccgttttctcctccttccggccatcagccagttagtgattggggggaggaggtcgagctcaatagcccacgaacaacgcatcttgccggtgcgctgtcccctggcgaagcctggccattcgagtcggtctag

SEQ ID NO: 55207 - DNA, 996 bp, Artificial Sequence
  Description of Artificial Sequence: Synthetic coding sequence
atgacatcgccacacttctctagttatgacgagggtccactggacgtatcaatggccgcaacaaacctggaaaatcagctgcattctgctcagaagaacctgttgtttctgcaacgggaacatgcatcaactttgaagggactccacagcgagatccggcgactgcaacaacactgcaccgacttgacatatgaactgacggttaaaagtagcgaacagacaggagacggcacctcgaaaagctcagagttgaaaaagcgctgcgaagaattggaagctcagctgaaagtgaaggagaacgaaaacgccgaactgctgaaggagctcgaacagaaaaatgccatgatcaccgttctcgaaaacaccatcaaggaacgggaaaagaagtatctagaggagcttaaggcaaagtctcacaaattaaccttgctttcaagcgaactggagcaacgcgcttctacaattgcatacttgacgtcccagttacatgcggctaaaaagaaactgatgagctcgagtgggacaagtgatgcatcaccatctggaagtccagtactggcctcatataagcccgcaccccctaaagataagctaccagaaacacccaggcgcaggatgaagaaaagcctctccgccccactgcacccggagttcgaagaggtatatcgattcggagctgagagtagaaaactactgctacgtgagcctgtggacgctatgcccgacccaacccctttcttgctggcacgagagagcgccgaggtgcatctgatcaaagaaaggcccctggtaatcccgccaattgccagtgaccgctcgggggagcagcactctccggcacgagaaaagccacacaaggctcatgtgggcgtggcccacaggatccatcatgctacgcctccgcaagcacagccagaggtgaaaactctcgccgttgaccaggtcaacggaggaaaagttgttcggaaacactctggaactgacaggaccgtgtag

SEQ ID NO: 55208 - DNA, 291 bp, Artificial Sequence
  Description of Artificial Sequence: Synthetic coding sequence
atgacttccccacacttcagttcctatgatgagggcccattggatgtctcaatggcagctacaaatctagaaaaccaactgcatagtgcacagaagaacctgctcttcctgcagagggagcacgcatccactttaaaaggcttacacagtgagatccgaagactccagcagcactgtactgatcttacctatgaattaactgtgaagagcagtgagcagaccggggacgggacctctaagtcaagcgaactgaaaaaacggtgtgaagagctagaggcacagctgaaatag

SEQ ID NO: 55209 - DNA, 369 bp, Artificial Sequence
  Description of Artificial Sequence: Synthetic coding sequence
atgacaagccctcattttagttcctacgatgaaggcccacttgatgtatcgatggccgcaactaatctcgagaaccagctgcatagtgcccagaaaaacttactgtttctgcagagagagcacgcttcaactctaaaggggctacatagcgagattcgacgacttcaacaacactgtaccgatctaacgtacgaactcactgtgaagagtagcgagcagactggagacggcaccagcaaaagcagcgaattaaagaagcggtgcgaggaattggaggcccaactgaaagtgaaagagaacgaaaacgctgagctgctgaaggagctggaacagaagaatgccatgataaccgtgctggaaaacacgtag

SEQ ID NO: 55210 - DNA, 39 bp, Artificial Sequence
  Description of Artificial Sequence: Synthetic coding sequence
atgactagccctcacttctcatcgtatgacgagggctag

SEQ ID NO: 55211 - DNA, 1896 bp, Artificial Sequence
  Description of Artificial Sequence: Synthetic coding sequence
atggggcttcccagggggccagaagggcaaggccttccagaggtagaaacaagggaggacgaagagcaaaatgtcaaactgaccgagattcttgagttattggtagccgcaggttacttccgagccaggatcaagggtcttagccccttcgataaagtggtgggagggatgacttggtgcatcaccacctgtaactttgacgtggatgtggatctattgtttcaggagaacagtaccattggacagaagatcgccctgagtgagaagatcgtgagcgtgctgccaaggatgaagtgtcctcaccagctggagcctcaccagatacaggggatggacttcatacatatattccctgtcgtgcagtggctagtgaaaagagccattgagacaaaggaagagatgggcgactacatcagatcttactcggtctcccagttccagaaaacatactccctcccagaagacgacgactttatcaaaaggaaggagaaggccatcaagacagtggtggacctgagtgaggtctataaaccacggagaaagtataagcgccatcagggggcagaggaactcttggacgaggaaagccgcatccatgctactttactcgagtacggacggcgttatggcttctcccggcaatcgaagatggagaaagcggaagataagaagaccgccctccccgcaggcctcagcgccaccgaaaaagcagacgcccacgaggaagacgagctccgcgcagctgaagagcagcgcatccagtcattgatgactaaaatgacagctatggctaatgaggagagtaggctgaccgctagtagcgtgggacagatcgtcggtctgtgttcggccgaaatcaagcaaattgtatctgaatacgctgaaaagcaaagcgaattgagtgcagaagagtctccagaaaagctcggcacctcccagctgcatcgaaggaaagtcatctccctgaataaacagatcgcccagaaaaccaagcatctggaggaattgagagcttcccacacttctcttcaagcccgatacaacgaagccaaaaagaccctgaccgagctgaagacttattccgaaaagctcgataaagagcaggcagcccttgaaaagatagagtccaaagcagatcctagtatcctccagaatcttagagcattggtagctatgaacgagaatcttaagagccaggaacaggagttcaaagcccattgtcgggaggaaatgacccgactgcagcaggaaatcgagaacttgaaggctgagagagccccaagaggcgacgagaaaacactatcttccggcgagcctcctggtactttaaccagcgccatgactcacgacgaagacttggataggagatacaacatggaaaaagaaaagctctataagatccggctccttcaggccaggcgcaaccgagagatcgcgatccttcaccgcaagattgatgaggtcccctctcgggctgagttgattcagtaccagaaacgatttatcgaactgtatcgacagatctctgccgtccacaaggaaacaaagcaattttttacactatataatactttagatgataaaaaggtgtacttagaaaaggaaatctcactcctgaactcaatccacgagaatttctcccaagctatggcatctcccgcagccagggatcagtttttacgccagatggagcagatcgtggaaggtatcaaacaaagtaggatgaagatggagaagaaaaagcaggagaataagatgcggcgagatcagctgaacgaccagtatttggagctgttagagaagcaaagactctacttcaagaccgttaaggagtttaaggaggaaggaaggaagaacgaaatgctgctgtcaaaggttaaagctaaagcttcttag

SEQ ID NO: 55212 - DNA, 972 bp, Artificial Sequence
  Description of Artificial Sequence: Synthetic coding sequence
atgagcgagagaaaggtgttgaacaagtattaccctcctgatttcgacccatctaaaattccaaagctaaaactaccaaaggacaggcagtatgttgtccgccttatggccccattcaacatgaggtgcaaaacgtgtggggaatatatttataaaggtaagaaattcaatgccaggaaggagaccgtacagaatgaagtctatctcggcctccccatcttccgcttttatatcaaatgcaccagatgtcttgcagaaattacttttaaaacagaccccgagaacaccgattacaccatggagcatggagctaccaggaactttcaggccgagaaacttctggaggaggaagagaaacgcgtgcagaaggagcgggaagatgaagaattaaataaccctatgaaggtcctggaaaacagaacaaaagatagtaaactcgagatggaagttctggagaacctgcaggaattaaaggatcttaaccaacggcaggcacatgtggattttgaggctatgctgcgacagcataggctgtccgaggaggagaggagacgacagcagcaggaggaggacgaacaggagaccgcggctctactggaagaggctagaaaacgaaggctactggaggattctgatagcgaggacgaggctgctccttctccactccaaccagcactgcgccctaacccaaccgctattctcgacgaagccccaaaaccaaagaggaaagtcgaggtgtgggaacagtcggtggggagcctgggatcaaggccaccactgtctcgcctcgtagtcgtgaagaaagccaaagctgacccagactgcagcaacggtcagccacaggccgcaccaacccccggagcaccccagaaccgaaaagaagccaacccgacccctctgacaccaggcgcttcttctctcagccagctgggtgcttacttggactctgacgactcaaatggttctaattag

SEQ ID NO: 55213 - DNA, 1668 bp, Artificial Sequence
  Description of Artificial Sequence: Synthetic coding sequence
atggacgtgagtagtgagcatacaaaggacccgggaggagagggaggggacggggagtcattagcagctagaccctctaagatcaaggccagtagcggaccacctacaagtccagaacccggagagctggagagcgagcctgaggaggaggaggaggaacaggcagcatcacaagggggtacggcggcagacgagcaagccgaggccccaaaaggactcaccgccgctgaggccgcaggtgaggaagggccaggagagcccggaaggccggctgagccccagcccgaacctgaggaacccgctgaagttggcgctgaagaaccagctcagcctgagcccggtgctgggcctgaagagttggaggctgaagccggagctgaagagctggagcaagccgctgagggaaaggaggtgcggttccaggcctccttacccctcacgcgaattgacgaagaggaggcagctgccgctcctgaggccgagactgaacgtgtggaaggagaggaggaagacaaggaagagacacagcgggacggcgctgagtcaaaagagcgggacggcgaaggacgaccggcaaagagtcaggaagagggcaaacgcctctacggcagagacgagtttgaagacctggaatggagtgaagaggtgcaaaagcttcaggaacaacaactgcggtcggatctccttgatcagtacaggtctctgcttgtggaacggaacaggagccagcggtataacctgtacttgcagcataaaatctttgaagccctccgacgcaaaaaggggcttgaggccgcagaggtggcagatcgaggggcagaggccgaagcgcctgaaaaagagcaggcatatctgcgtcatctcggaatgcttgaggagctaaaaaagcagcaggctgatgacttacaatggtaccaccaggagctcggacaactaaaacggcagtgccaggaaaagcttactcgagtggaaaaggagtggcggaggtttcaggcactgaaaaaacaggttgttatgcaggctatggggagctgtcgcatgagaggaggcaggcaggctgccctcagggaggtggagcaaattcaagctctggaggacaagaaagaaaaagaaatgtcagccgtgaggctggaaaacatccagctcaagcagtccctggtgcactttgagacgcgcatgcgcactcaggaggacctgacacagggcctcctgctgattgacttcgagcaattaaagatagagaaccaaacattcaatgagaagatcgaggaaaggaatgaggaactgttgaaactgaggtccaaggtgactaactcagtacaagtgatcacccatgtcaaggaaaaacttcattttatggacatggaaaacgcatgcaagaaaactcagttggccgaaatcgaggcccaggctgctctaggacgggatatccttacaaaaacgaagcaagcccgtgagggcctcaggacagacaacatccggctcaaccagaagtgtggattgctcgggaaagacagcttgctgcgggatcttgaggaaaaagtggacaagaccgaactgttgcaccgcaggctggaatcccttaaaaggcaccatgcgagccttacgctctcatgccgcggtgtccggcagaaaattagagaagctaaagcttttctcccttcatag

SEQ ID NO: 55214 - DNA, 1032 bp, Artificial Sequence
  Description of Artificial Sequence: Synthetic coding sequence
atggaggccgtcgctacagccactgccgctaaagaacctgacaagggctgcatcgagcctggcccaggccactggggggaactgtcccgcactcctgtgccttctaagcctcaggacaaagtggaggcagccgaggccacccccgttgcgctagacagtgacacgtcgggagccgagaatgcagctgtgagcgccatgctccatgccgtggctgcgtcaaggctccctgtgtgctctcagcaacaaggcgaaccagatcttaccgaacacgagaaggtggcaattctggcccaactatatcatgagaagcccttggtattcttggagcgcttccgcaccggtctgcgcgaggaacacctcgcctgctttggccatgtgaggggggatcacagagcagatttctactgcgccgaggttgcgaggcaaggcaccgcacggccacgtaccctgcgcacacgcctccggaacaggcgatatgctgccctcagggagctaattcagggaggtgagtatttctcagatgagcagatgcgattcagggctcctttgctctatgaacagtatattggtcaatacctgactcaagaggagctcagtgctcgcacaccaacacatcagccaccaaagccaggttcccccggtcggccagcctgccccctgtcaaacttgctccttcaaagttacgaggagcgcgagctccagcaacgcctcctgcaacagcaagaagaggaggaggcgtgcctggaagaggaggaggaagaagaagacagcgacgaggaggatcagcgctcaggcaaagatagcgaggcatgggttcccgactccgaggaacggcttatcttaagggaggagttcactagtcgaatgcaccagaggttcttggacggtaaggacggggatttcgactatagtaccgtggatgataatccagatttcgacaatctggacattgtggctcgagacgaggaggaacggtactttgatgaggaggaaccagaggacgcaccttcccccgaacttgatggggactag

SEQ ID NO: 55215 - DNA, 462 bp, Artificial Sequence
  Description of Artificial Sequence: Synthetic coding sequence
atggagccactctatcaagccggaagcatattgatgactgtcaatacacttcagggcaagaaaatgattgaaagtggtctacagtcgggggattttagcctgtcccaatcatggccttcatgcctgcctccacctgccgacctcgagatcctccagcaaaaagttgcaggcgtccagagagagttagaggacttcaaaaaggaggctctgaaatccattcattacctggaggacgcattttgcgagatgaacggtgcccttgtccagcaagaggaacaggcagccagggttaggcagagattgcgtgaggaggaggatcggggaatcgttcgtaataaggtgctgacattcctgctgccaagggagaagcaactgagggagcattgcaagcgcttagaagacctcttgctggatcgtgggagggacgctctcagggctacgaaaaagtcgcaggcagactag

SEQ ID NO: 55216 - DNA, 333 bp, Artificial Sequence
  Description of Artificial Sequence: Synthetic coding sequence
atgcaggccgctctggaggtgacagcaaggtactgtggccgtgaactcgagcagtacggtcaatgtgtggctgccaagccagaatcctggcagagagattgtcattatctcaaaatgagcattgcccaatgcactagctcccatccaattattcggcagatacgtcaagcatgcgcacagccttttgaggcttttgaagaatgtctgcgtcagaatgaagccgctgtggggaactgtgccgaacatatgcgccgatttctgcagtgcgccgagcaggtccagcctccgagatccccggctaccgtggaggcacagccactccctgcctcctag

SEQ ID NO: 55217 - DNA, 708 bp, Artificial Sequence
  Description of Artificial Sequence: Synthetic coding sequence
atggggtcaactgagtcaagcgagggcagaagggtcagcttcggggtcgatgaggaggagcgagtgcgcgttctccagggcgtacggctgtctgaaaatgtggtcaacaggatgaaagaaccatcatcccccccaccggcacccacttctagcactttcgggctgcaggacgggaatctgcgcgctccccataaagaaagtaccctgcccagatccggctcgtccggtgggcagcagccatcaggcatgaaggagggcgtcaagagatacgagcaagaacacgcagctatccaagacaaactcttccaggtggctaagcgcgaaagggaagcggcaactaagcacagcaaggcatccctcccaacaggggaggggagcatcagtcatgaagagcagaaaagcgtgaggttggctcgcgagctggaatccagggaggccgagctccgaaggcgcgacacattttacaaggaacagctcgagcgcatagagcgaaaaaacgctgagatgtacaagctgtcctctgagcaatttcatgaggcggcatctaagatggagtcaactatcaaacctagaagagttgagcccgtttgttcaggcctccaggcacagattcttcactgctatcgcgataggcctcacgaggtgcttctgtgctctgacttggtgaaagcctatcagcggtgcgtgtccgctgctcataaggggtag

SEQ ID NO: 55218 - DNA, 501 bp, Artificial Sequence
  Description of Artificial Sequence: Synthetic coding sequence
tgaacgctgccgagatccggctcaagcgggggtcagcagccaagcggcatgaaggagggggtaaaaaggtacgagcaggagcacgcggctatacaagataaattgttccaagtggcgaagagagagcgagaggctgccactaagcattccaaagcatccctacctaccggtgagggttctatctcgcatgaggaacagaaatccgtccggctggccagagaattggagtctagggaagccgaactcaggagaagggacacattctataaggaacaactggagagaatagagaggaagaatgctgaaatgtataagttgtcctcagagcagttccatgaggctgcaagtaaaatggagtctacaataaaagtcgaacctgtgtgctcaggattgcaggcacagatcttgcactgttatagagatcggccacacgaagtgctcctgtgcagcgaccttgtgaaggcttatcaaaggtgtgtctccgcggcacacaagggatag

SEQ ID NO: 55219 - DNA, 600 bp, Artificial Sequence
  Description of Artificial Sequence: Synthetic coding sequence
atgctgttggagctgagtgaggagcataaagaacaccttgctttcttgcctcaggtagacagcgccgtggttgcagagttcggaaggattgcagtagaatttctgaggcggggagccaatcctaagatttacgaaggagccgctagaaaactgaacgttagcagcgatacagtgcagcatggagtggagggcctgacctacctgctgacggagtcgtccaagttaatgatcagcgaactcgatttccaggattccgtgttcgtgctcggtttcagtgaggagctgaataagcttctgctccagctctatttggataaccgcaaggaaatcagaacaattttaagcgagctggctccctccctgcccagttaccacaacctggaatggaggctggacgtgcaactggccagtcgctccctcaggcagcagatcaagcccgctgtgaccatcaagttgcatcttaatcaaaatggggaccataacaccaaggtgctgcaaacagacccggcaaccttgttgcacctcgtgcagcaactggagcaggcactggaggagatgaagaccaatcactgccgcagagttgtgcgtaatatcaaatag

SEQ ID NO: 55220 - DNA, 534 bp, Artificial Sequence
  Description of Artificial Sequence: Synthetic coding sequence
atggagctgtcagagtctgtgcagaaagggtttcagatgctggccgacccacggtcttttgatagcaatgcgttcacacttttgcttcgggctgcttttcagagtttactcgatgctcaggccgatgaggcggtcctggaccaccccgatctcaaacacattgaccccgtcgttctcaaacattgccacgctgccgcagccacatatatcttggaggccggtaagcacagggctgacaaatcaaccctcagcacttatttggaggactgcaaattcgaccgtgagaggatcgagcttttttgtacggaataccaaaacaacaagaattctctggagatcttgctggggagaactctgatcccacaccccatccaaagattagtgctcgtggctgcgtggaacaattacagaacttggtggggcaacttgaaaatgttgagaaaggcttggaaggagcagctctcttgcaacctgggaaaactaactatcaggccgtccgcggaggagaaccaaaaaagactggcattctcatag

SEQ ID NO: 55221 - DNA, 489 bp, Artificial Sequence
  Description of Artificial Sequence: Synthetic coding sequence
atggagctgagtgagtctgtgcagaagggcttccagatgcttgccgacccccgttccttcgatagtaatgccttcaccttgctcctccgggctgcctttcagtccctcctagacgctcaagctgacgaagctgtactggaccaccctgacctcaaacacatagatcctgttgtgctgaagcattgtcatgccgctgctgcaacctacatcctggaagcaggtaaacaccgcgctgacaaatcaacgctgtccatcggaagatcacttccacatataacggacgtttcatggagactggagtatcagattaaaacgaatcagctccatcgaatgtacagacccgcatacttagtgaccctctctgtgcagaataccgattctccttcatacccggaaataagtttcagttgctcaatggagcaacttcaggatcttgtgggaaagttaaaggacgcttctaaatcgctcgaacgcgcaacacagctgtag

SEQ ID NO: 55222 - DNA, 588 bp, Artificial Sequence
  Description of Artificial Sequence: Synthetic coding sequence
atggagctctctgagagcgtccaaaagggtttccagatgctcgcagatccacgctccttcgattccaatgcctttacactgctcctccgcgctgccttccagagtcttctggatgcccaggcagacgaagcagtgttagatcatcccgatctgaagcatatcgatcccgtagtgctcaagcattgccatgcggcagccgcaacctatatcttggaagcgggaaagcatcgggcagacaaatccacactgtccacttatctggaggactgtaaattcgatagagagcgaatcgagctgttctgtacagagtaccagaacaataagaacagcctcgagatacttctcggctccattggccgttcccttccacacatcacggacgtgtcctggagactggagtaccagataaaaaccaatcagctgcacaggatgtataggcctgcttacctggtcacacttagcgtgcagaacaccgacagtcctagttacccagaaattagctttagttgctccatggagcagttgcaagatctggtcgggaagctcaaagatgctagcaagagtctggagcgagccactcagctgtag

SEQ ID NO: 55223 - DNA, 534 bp, Artificial Sequence
  Description of Artificial Sequence: Synthetic coding sequence
tgagagttgtcggaaagcgtgcagaaaggctttcagatgcttgccgacccccgttctttcgactcaaacgcatttacattgcttctgagggctgcatttcaatcccttttggatgctcaggccgacgaagccgtgctcgatcacccagacctaaaacacattgatccagtggtgcttaaacattgtcacgcggctgctgccacctacatccttgaagccggaaaacaccgggctgacaagtccaccttgtctacgtaccttgaggactgcaaattcgaccgcgagcggatcgagctcttctgtacggagtatcaaaacaataagaatagtctggaaatactccttggcaggacgctcattcctcatcctatccagcgcctggtgctggtcgctgcatggaacaactataggacctggtgggggaacctgaaaatgcttagaaaagcctggaaggaacagttgtcatgtaatcttggtaagctcactatccgcccatccgcagaggagaaccagaagagattagccttctcatag

SEQ ID NO: 55224 - DNA, 450 bp, Artificial Sequence
  Description of Artificial Sequence: Synthetic coding sequence
tgactgccagatgcagggggttctccccttctgaggttgcagagactgcatgcatcaccccctggaggaattccagagtcagctggcaggcccggtgggcgagggagagtgagtacgtacctcgaagattgcaaattcgatagagaaagaatagagctattttgtacagagtatcagaataacaaaaactccttggagatcttgctgggatcgatcgggaggtccctaccccacattaccgacgtatcctggagactggagtaccagatcaagaccaaccaactgcataggatgtatcgcccagcctacctggttactctaagtgttcaaaatactgatagtccaagctatcctgaaatctcattttcatgttctatggagcagctccaggatctcgtggggaagctgaaggatgcttctaaatctctcgagagggcaactcagctctag

SEQ ID NO: 55225 - DNA, 492 bp, Artificial Sequence
  Description of Artificial Sequence: Synthetic coding sequence
tagatggaactgagcgaaagcgttcagaaaggattccagatgctggccgaccccaggagcttcgatagcaacgccttcaccctgctgctgagggccgcattccagtcactgctggatgcccaggctgacgaggcagtgctggatcaccccgacttgaaacacattgacccagtggttctgaaacattgtcatgctgctgccgctacgtatatacttgaagctggcaagcacagggctgacaagtcaaccctgagcatcggtcgcagcctgccgcatataactgacgtctcctggagactggaatatcaaattaaaaccaaccagctgcaccgcatgtaccgcccagcttacttggtaaccctgagcgttcagaacacagattccccctcttacccggagatcagcttctcttgctccatggaacagctccaggacctggtaggaaaactcaaggatgcctccaagtccttggagagggctacccagctgtag

SEQ ID NO: 55226 - DNA, 603 bp, Artificial Sequence
  Description of Artificial Sequence: Synthetic coding sequence
atgggacgcctgcactgtacagaagacccagttcccgaggctgtgggtggggatatgcagcagttgaaccaattaggggctcaacagttcagtgcactaactgaggtcctatttcacttcttaacagaacctaaggaagtggaaagattcctagcgcaactgtcagagtttgctacgacaaaccaaatttcccttggcagtctgcgcagcatcgttaaatcgctgctgctagtgcccaacggcgctctgaagaagtctctcaccgcaaagcaggtccaggccgatttcatcacgttgggattatcagaggagaaagccacttatttctctgaaaagtggaaacaaaacgctcctactctcgcccgatgggcgatcgggcagacgctgatgattaaccagctgatcgacatggaatggaaatttggtgtaacatcgggatctagcgagctggaaaaggtgggatctatttttctgcagctgaagctcgtcgttaagaagggaaatcagacagaaaacgtctatattgagctgaccctgccccagttctactccttcctccacgaaatggagagagtaagaacaagcatggagtgtttctgctag

SEQ ID NO: 55227 - DNA, 600 bp, Artificial Sequence
  Description of Artificial Sequence: Synthetic coding sequence
atggggagactgcactgtaccgaggaccccgtgccagaagctgttgggggtgatatgcaacaactaaaccagctcggggctcagttctcagccctcactgaggtgctgttccactttctcacggagcctaaggaggtcgagcggttcctggctcaactgagtgaatttgccacaactaatcagatcagcctcggctcactgaggtctattgtgaaatccctgttgctggtccccaatggcgcactgaaaaaaagtctgacagcgaagcaggttcaggccgactttattaccctgggcctcagtgaggaaaaagcaacgtactttagcgaaaaatggaagcagaatgccccaaccctggctaggtgggcgattgggcagacattaatgattaaccagttgatcgacatggagtggaagttcggtgtcacttcaggcagcagtgagctggagaaggtgggcagcatctttcttcagcttaagctcgtggtcaaaaaagggaaccagacagagaacgtctatattgagctgaccctcccacagttctactccttcttgcacgagatggaacgcgtgcggaccagcatggagtgtttctgttag

SEQ ID NO: 55228 - DNA, 552 bp, Artificial Sequence
  Description of Artificial Sequence: Synthetic coding sequence
atggagccagaggagggtaccccgctgtggcgtctgcagaaattgccggctgagctgggacctcaactgttgcacaagatcatagacgggatatgtggacgggcataccctgtttaccaggactatcacaccgtttgggagagtgaagaatggatgcacgtgctcgaggatattgccaagtttttcaaagccatagtcggaaagaatcttcccgatgaggaaatctttcagcagctcaatcagcttaatagcctgcaccaggaaactatcatgaaatgtgttaaatccaggaaagacgagattaagcaagctttgtctcgagaaatcgtggccatctcatccgcacaactacaggattttgattggcaggtaaagctggctctgtctagcgataaaatagctgctctacggatgcctctcctttcgctgcacttggacgtaaaagagaatggggaagtaaagccctatagcattgaaatgtccagagaggaattgcaaaatctcattcagtccctggaagctgcaaacaaagttgtgcttcagctgaaatag

SEQ ID NO: 55229 - DNA, 597 bp, Artificial Sequence
  Description of Artificial Sequence: Synthetic coding sequence
atggcagcactcacagctgagcattttgccgctctgcagtctctgctgaaggccagttccaaagacgtggtgaggcagttgtgtcaggaaagcttcagttcttccgctttaggattaaagaagctcctggacgtgacctgtagctctttgagtgtcacacaggaagaggccgaggaactgttgcaggccctccatcgcctcacacgcttagtggcatttcgggacttgtctagtgccgaggccatcctggccctttttccggaaaatttccaccagaacctgaagaacttgctaacaaaaatcattctagaacacgtgtcaacctggcgaaccgaggcacaggccaatcagatttcactccccagactggtggaccttgactggagggtagacatcaagacgtcatccgacagtatttctaggatggccgtgccaacgtgtctgctccaaatgaaaatccaggaggacccctctctttgcggtgacaaaccaagcatttcggctgtcacagtcgagctgtctaaagaaactctcgataccatgctggatgggctggggcgtatcagagatcagctttcagccgtggccagtaagtag

SEQ ID NO: 55230 - DNA, 510 bp, Artificial Sequence
  Description of Artificial Sequence: Synthetic coding sequence
atggccgctctcactgcagaacactttgcagcgctgcaatccctcttaaaagccagctctaaagatgtcgtgagacagttgtgccaagagtcgttctcaagctcagcccttggcttgaagaaactccttgacgtcacctgttcttccctcagtgttacccaagaagaggccgaagagctgttacaggctctacaccgcctaacaaggctggtggcctttcgggacctgagctctgcggaggctattctggccctcttccctgaaaacttccaccagaatctaaaaaaccttctgacaaagataattctagagcacgtgagcacttggagaacggaagcccaagccaaccagatcagtcttccgaggctagtagacctggactggcgcgtagacatcaaaacttcttcagactcaattagtaggatggctgtgcctacgtgccttctgcagatgaaaattcaggaggatcctagcctgtgcggcgataaaccatccatttcagcagtctag

SEQ ID NO: 55231 - DNA, 471 bp, Artificial Sequence
  Description of Artificial Sequence: Synthetic coding sequence
atggcagcccttactgcagagcactttgcagctttacagtccctgctgaagctgctgcaggcattgcatcggctgactcgacttgtcgcctttcgggacctcagcagcgcagaggcgatcctggctcttttccccgagaatttccatcagaatctgaagaatctgctaacgaaaattattctggaacatgtctcaacctggcggacggaggcgcaggcgaaccagatttctctcccccgtttagtggatctagattggcgagtggatattaagacctctagcgatagtatcagtagaatggcagtgcccacttgcctgttgcaaatgaaaatccaggaagacccttccctctgcggcgataagccctccatctcagcagtgactgtggagctgtccaaggaaacgctggatactatgctcgatgggctcggtcgaatcagggatcagctgtccgctgtcgctagcaagtag

SEQ ID NO: 55232 - DNA, 2067 bp, Artificial Sequence
  Description of Artificial Sequence: Synthetic coding sequence
atgtggtgtatcgtcctgtttagtctgctcgcatgggtctatgccgagcctacaatgtatggcgaaattctcagtcctaactatccgcaagcttatccatccgaggtggagaaaagctgggatattgaggttcccgaggggtatggaatacatttatatttcacccatctggacatcgagttgtctgagaattgcgcttatgatagcgtgcagatcatctcaggcgatacggaagagggaagattgtgtgggcagagatctagcaataaccctcatagtcccattgttgaagagttccaggtcccatacaacaagttgcaggtgattttcaagtctgacttctcaaatgaggaaagatttacaggatttgcagcctattatgtcgccacggacatcaacgagtgcacggactttgtggatgtcccttgcagccatttctgcaataatttcatcggagggtacttttgttcctgtcccccagaatacttcctgcacgatgatatgaagaattgcggggtgaattgttccggagacgtgtttacagctcttataggggaaattgcatctccgaattaccctaagccctatcccgaaaatagcagatgcgaatatcagatccgtctggagaaaggattccaggtggtagtgacgcttagacgggaggatttcgatgtagaagctgctgattccgccggaaactgtctagattctttagtcttcgttgccggagatcgccagtttggaccttactgtgggcacgggtttccaggaccactgaacatagaaacgaagtcaaacgccctggatattatcttccaaacggacctgaccggacaaaagaagggatggaagctcaggtatcatggcgacccaatgccctgtcctaaggaggatactccgaactctgtgtgggaaccagcaaaggctaagtacgtgtttcgggacgtggtccagatcacatgtcttgacggctttgaagtggtggaggggcgtgtgggcgctacctccttttactccacttgccagagtaacggaaaatggagcaactctaagttaaaatgtcagcctgtggattgtggcattcccgagtctatagagaatggaaaggtagaggatcccgagtctaccttgtttggttccgtcattcgctacacgtgtgaggaaccctactactatatggagaacgggggaggcggagaatatcactgtgcagggaatggctcttgggtgaacgaggttctgggaccagagctgccaaagtgcgttcccgtgtgtggtgtccccagagaaccgtttgaagagaagcagcggatcatcggaggatcagatgctgacatcaaaaatttcccctggcaagttttcttcgacaacccatgggcaggcggagctctgataaatgagtattgggtcctcactgcagcacacgtggtggagggaaatagggaacctacgatgtacgttggtagcacatcagtgcagacatcccgcctggcaaagtcgaaaatgctcaccccagaacacgtcttcatccatcctgggtggaagctactggaggttccggaaggccgaaccaatttcgacaatgacatcgcactggttagacttaaagatccagtcaagatgggcccaacggttagccctatttgcctgccagggacatcctccgattataatctgatggacggcgatctgggactcatctcagggtggggacgcacagaaaagcgggatcgggctgtgcggctgaaggccgcacggcttccggtggcaccgctaaggaaatgcaaggaggtaaaggtggaaaaacctacagctgatgccgaagcctacgtattcaccccgaatatgatctgcgctgggggagaaaaggggatggattcatgcaagggagattcaggcggagcatttgcagtgcaggatccaaacgacaaaactaagttctatgctgccggattagtctcgtgggggccacagtgcggaacgtatggcctctacacccgggtgaagaactacgtggactggatcatgaaaacaatgcaggaaaacagtacgccccgagaggattag

SEQ ID NO: 55233 - DNA, 2067 bp, Artificial Sequence
  Description of Artificial Sequence: Synthetic coding sequence
atgtggtgtatcgtcttgttctcactgctcgcatgggtatacgctgagcccacaatgtacggtgaaatcctgagccctaattacccccaggcctatccaagcgaggttgagaaatcttgggatatcgaggtacctgagggttatgggatccacctttacttcacgcacctggacatagagctctccgagaattgtgcttatgatagcgtacagattattagcggtgatacagaggaggggaggttgtgtggacaacgctctagcaacaacccgcactcacctatcgttgaggagttccaggttccgtacaataagctccaggtaatcttcaagagcgacttctcaaacgaagagcgattcacaggattcgccgcttattacgtagcaacagatataaatgagtgcacggacttcgttgatgtgccttgtagccatttctgcaacaatttcattgggggttatttttgcagctgccccccagagtatttcctccacgacgatatgaaaaattgtggggtgaattgttcgggggacgtctttactgccctgattggcgagatcgcttctcctaattacccaaaaccttacccagagaatagcaggtgcgaatatcagattcggcttgaaaagggctttcaggtcgtggttacgttgaggagggaggatttcgatgtcgaagccgcagattccgcgggaaattgtctggacagccttgtattcgtcgcaggcgatcgccagtttggtccatactgcggccacggcttcccaggtcccttgaatattgaaactaagtccaacgccttggacataattttccagaccgacctaaccgggcagaagaaaggatggaagctcaggtatcacggcgacccaatgccctgcccaaaggaggatacaccaaatagcgtgtgggagcctgcgaaggccaaatatgtgttccgggacgtggttcagatcacctgtctcgacggattcgaagtagtagaaggtcgggttggcgctacttctttctactcaacatgccagtcgaatggcaaatggtctaacagcaagctcaagtgccagcctgtcgattgcggcattccggaatccatcgaaaatggcaaggttgaggaccccgagagcactctcttcgggagtgttattagatatacatgcgaggagccgtactactatatggagaatggtggtgggggagagtaccactgtgctggcaatggcagctgggtaaatgaggtcctcggacccgagctgccaaagtgcgtgccagtttgcggggttccccgagaacctttcgaagaaaaacagagaatcattggaggttcagatgccgacatcaagaacttcccctggcaagtcttcttcgataacccgtgggcaggaggggctttgatcaatgagtactgggtactgacagcagctcatgttgtggaagggaatcgtgaacccacgatgtatgtgggttctacttctgttcaaacatccaggctagcaaaatccaagatgttaacccccgagcacgtgttcatacatccgggatggaagctgctggaagtgccagagggacgtaccaatttcgataatgacattgccttggtgaggctaaaagacccagtgaagatggggccaacagtgtctccaatctgcctgccaggtacgagtagcgattacaacctgatggacggtgatctgggtctaattagcggctgggggaggacagagaagagagaccgggctgtgaggctgaaagcagcacgcttaccggtcgcaccactgcggaagtgcaaggaggtcaaggttgaaaagccaaccgccgatgccgaggcctatgtttttacccccaacatgatctgtgccggaggcgagaaggggatggactcttgtaagggagactcaggaggagcttttgcagtccaggatccaaacgataagacgaagttttatgccgctggcctggtgtcttggggccctcaatgcggaacctatggactctacaccagagtcaagaactatgtggactggatcatgaaaacgatgcaggaaaattcgaccccgcgagaggactag

SEQ ID NO: 55234 - DNA, 483 bp, Artificial Sequence
  Description of Artificial Sequence: Synthetic coding sequence
atggcattcctgatgaagtccatgatttctaatcaggttaaaaaccttgggttcggcggaggctccgaagaaaacaaggaggaaggcggagcgagtgatccagccgctgcacagggcatgactcgtgaggagtacgaagaataccagaaacaaatgattgaagaaaaaatggaaagggacgccgcatttacccagaagaaggctgagagagcatgcctccgagttcacctgagagaaaagtatagacttcccaagtctgagatggacgagaatcaaatacaaatggctggcgacgatgttgacctgcctgaagacctccgtaaaatggtggatgaagatcaggaggaggaagaggataaagatagtatactgggccagattcagaatttgcaaaatatggatctggacactattaaggagaaagcccaagccacctttacagaaatcaagcagacagcggagcagaagtgctccgtaatgtag

SEQ ID NO: 55235 - DNA, 3924 bp, Artificial Sequence
  Description of Artificial Sequence: Synthetic coding sequence
atgggatccgtgactggggcagtcctcaagacacttttgctatccacacaaaattggaatcgagtagaagctggcaactcctacgattgtgacgatcctttggtgtctgctctacctcaggctagctttagttccagcagcgaactgagctcctcacatgggccaggatttgctagactgaaccgtagagacggagccggtggatggtctccgcttgtatccaataagtatcagtggctccagatcgacctgggggagagaatggaggtaaccgccgtggcaacacagggtggatacggatcgtccaattgggtgactagctatttgttgatgttcagcgattctggttggaattggaagcaatacagacaggaggacagcatatggggctttagtggcaatgcgaacgccgactccgtcgtgtattatcgcttgcaaccgagcatcaaggctcgtttcttgagattcattccattggagtggaatccgaaaggtcgaataggcatgcgtatcgaagttttcggatgcgcttatcggtcagaggtggtcgacttggacgggaagagtagcctcctatatcgcttcgaccagaagtctctgagccccattaaagatattatctctttaaaattcaagaccatgcagtctgatggaatcctgttacacagagagggtccaaacggagaccacattacccttcagttgagacgagctaggctgtttttgttgataaattccggggaggctaagctccccagcacctccacattggtgaatctcacgctcggatcccttctggacgaccagcactggcacagtgtcttgattcaacggttggggaagcaagtcaacttcactgttgacgagcaccgccaccacttccacgccagaggtgaattcaatttgatgaacctagattatgagatttcatttgggggaattccagcgccagggaaatctgtgtcttttccccaccgcaactttcacggttgcctcgaaaacctgtattataacggggtggacatcatcgatttggctaagcaacagaaacctcaaataatcgcaatggggaacgtttctttttcctgctcccagccacagagtatgccagtcacttttttgagtagtcgctcatacctggccctacccgatttcagtggcgaggaggaggtgtctgccacctttcagtttagaacctggaataaagccggtttgctgctgttcagcgaactgcagttgatctcagggggaatcctgctctttttgtctgatggcaagcttaaatccaatctgtatcagcccggaaagctgcccagtgatatcacagctggagtggagctgaatgacgggcagtggcactccgtgagtctaagtgcaaagaagaatcacctgagcgtggcggtggacggtcagatggcttccgctgcgcctctgctggggcctgaacagatttattccggaggaacatattatttcgggggatgcccagataagagtttcggttccaaatgtaagagcccactcgggggatttcaaggctgtatgcggttgattagcatatcaggtaaagttgttgaccttattagcgtccagcaagggagtctaggaaactttagcgacctccagatcgattcttgtggcatctcggataggtgtctcccaaactactgcgaacatggaggcgagtgcagccagtcttggtctaccttccattgcaattgcaccaatacgggttatagaggtgctacatgtcataatagtatatacgagcagtcttgtgaggcctacaagcacagagggaacacttctggattctattatatcgacagcgatgggagtggcccactggagcccttcctgctatactgcaatatgactgaaactgcctggacaatcatccagcacaacggcagcgatttaacaagggtgcggaataccaacccagaaaacccttacgctggattctttgaatacgtggctagtatggagcagttacaagccaccatcaacagggctgagcattgtgaacaggagttcacttactattgtaagaaaagcagactagttaacaaacaagatggaacccccctgagctggtgggtggggaggacgaacgagacccagacttattggggtggcagctcaccggacctgcaaaaatgtacctgtggcctggagggaaattgtatcgatagtcaatactattgcaattgcgatgctgatagaaatgaatggaccaacgatacggggttgcttgcctataaagagcatctgcccgtcaccaaaattgtcataacagatactggccgtctccactccgaagccgcttataaactcggacccctgctctgccagggcgatcgctccttctggaattcggccagctttgacaccgaggctagctatctccacttcccaacatttcacggtgagcttagtgccgatgtctcattcttttttaaaacgacagccagctctggggtcttcctcgagaacctcgggatcgctgacttcatacggatcgaactgagaagtcccaccgtagttaccttttcgtttgacgtgggcaacggcccattcgagataagtgtacagtcccctacgcactttaacgataatcaatggcaccatgtgcgggtggaaaggaatatgaaggaagcttcactgcaggtcgaccagttgacccctaaaacacagcccgcacctgcagacgggcacgtcctgttgcagctgaattctcagctgttcgtgggcggtacagccaccaggcaacggggttttctcgggtgtatacgttccctacaacttaacggcatgacgctcgacctggaggagcgggcacaggtgacaccagaggtgcagccgggttgccgcggacactgcagctcttacggtaagctgtgtaggaatggagggaaatgtcgcgagcgacctattgggtttttctgtgactgcacgttctcggcatatacagggccattttgtagcaatgaaatttcagcctatttcggttccgggtcatctgtaatatataactttcaagaaaattatttactctcaaagaattcctctagccacgccgcttctttccacggggacatgaagttgtctcgcgagatgattaagttctctttccgaactacacgtacaccctcgctgctgctctttgtatcaagcttttataaggaatatttgagcgttatcatcgctaagaacggcgatctgcagattcggtataagttgaacaagtaccaggagcccgatgtggtgaactttgattttaaaaacatggctgacggtcagctgcatcacattatgatcaatagagaggagggcgtagtcttcattgagattgacgataacagacgcagacaggtccatctgtcatcgggaacagagttctccgctgtcaagtccctcgtgctaggtagaattctggagcactcagatgtggaccaggataccgctctggcgggagcgcagggctttactggatgcctgtccgccgtgcagctgtctcacgttgcgcctttgaaagcagccctccaccctagtcaccctgatccggtcacggttactggccacgttacagagtccagctgcatggctcagccagggacagatgctacttctcgggaacgcacccactccttcgctgaccatagcggaaccatcgacgacagggaaccactggccaacgccattaagtcagacagtgctgttattgggggattgatcgcggtcgtgatttttattcttttgtgcataactgccatagcagtgcgcatctaccagcagaaacgtctgtacaagcggagcgaagctaagcgaagcgaaaacgtggattcagctgaggccgttcttaagtctgagctgaacatccaaaatgcagtcaatgagaaccagaaggaatatttcttttag

SEQ ID NO: 55236 - DNA, 3780 bp, Artificial Sequence
  Description of Artificial Sequence: Synthetic coding sequence
atgggatccgtgaccggagctgtcttgaaaaccctgttgctgtccacacagaattggaaccgcgtggaggccggaaactcttacgactgcgatgatccactggtcagtgcgctcccccaggcaagtttctcttctagcagcgaactttcttccagccatggcccaggtttcgctagactgaaccgaagagatggggctggcggttggagtcccctggtcagcaataaataccaatggctgcagattgacctgggcgaacgcatggaggtcactgcagtggccacacaggggggatacggttcgtctaactgggtcacaagttacctgcttatgtttagcgactccgggtggaactggaaacaatacagacaggaggacagtatttggggtttctcgggaaacgcaaatgctgattccgttgtctattatagactgcagcccagcataaaagctcgtttcctcagatttatacctcttgaatggaaccctaaaggaaggattggcatgcgaatagaggtattcggttgtgcctaccgatcagaagttgtcgacctggatgggaaaagcagcttgctgtaccggttcgaccaaaagtccttgagtccgatcaaggacattattagtctaaagttcaagacaatgcagtccgacggcattctgttgcatagggaagggcctaacggcgaccatatcacgttgcagcttcgccgtgcgcgactcttcctcctgatcaattctggagaggcaaaactgcccagtacctccacgctcgtgaatctcacattagggtctttactggacgaccagcactggcacagtgtgcttattcagcgcctcggaaaacaggtaaatttcacagtagacgaacaccggcaccactttcacgcaaggggggaattcaatcttatgaatctggattacgagggaaatgtgtccttctcctgttcgcagcctcaatccatgccagttacttttctgtcttcccgttcatacctggccctgccggatttttctggggaagaagaagtgagcgcaacattccagttcagaacttggaataaggccggtctgttgctgttttccgagttgcaactgatctccgggggaatcctgctgtttctctcagacggaaagctgaagagtaacctgtatcagcctggcaaattgccatccgacattactgccggagtggaactcaatgacggacagtggcatagcgtaagcctcagcgctaaaaaaaaccatttgtcagtggcagtggatgggcaaatggctagcgcggctccattactgggccctgagcaaatctattccgggggtacgtactactttggaggatgtcctgataaaagtttcggaagcaaatgtaaaagtcctttaggtggctttcagggctgtatgaggttaatctcaatctcagggaaagtcgtggacctaatctccgtccaacaagggagcctgggaaacttctccgacttgcagattgatagctgtggaattagcgatcggtgcctcccaaattactgcgagcatggtggcgaatgtagtcagtcttggtccacgtttcattgcaactgcacaaacaccggctataggggagccacttgccacaacagcatttacgaacagtcttgtgaagcatataagcacagggggaatacttctgggttctactacatcgattctgacggctctgggccattggaaccgttcctgctctactgcaatatgactgagacagcctggactatcattcaacacaatggatctgatcttaccagagtgcggaatactaaccctgaaaatccctacgcgggtttttttgagtatgtggcttccatggaacagttgcaggccaccatcaatcgggcagagcactgcgaacaagagttcacctactactgcaagaagtcaaggttagtgaacaagcaggacggcacaccactcagctggtgggttggaagaacaaacgagacacagacctactggggcggaagctcacctgacttgcaaaagtgtacttgcggtctggaagggaactgcatagattctcaatattattgcaactgcgacgctgacagaaacgaatggactaatgatacgggtctccttgcctacaaagaacatttgccagtaaccaagattgttatcaccgacacggggagactgcattctgaggctgcgtacaaactcgggccactgctgtgtcagggcgataggtctttctggaactcggcatccttcgataccgaggcttcctatctccatttccccacatttcatggcgaactgtcagccgatgtttccttcttctttaagactacagctagctcaggggtgtttcttgagaacctcggaattgccgactttatacgaattgagctccgcagccctacggtcgtgacatttagttttgacgtggggaacggaccatttgaaatatccgtacagagccccacccacttcaatgataaccagtggcaccacgtccgcgttgagaggaatatgaaagaggcttctctacaggtggatcaactgacaccgaagacgcaacccgctcccgcagatggccatgtgctcctgcaattgaactctcagttgttcgtggggggaaccgctacacgccaacgaggtttcttgggatgtatcaggagtctgcagctgaacggcatgaccttggacctcgaggaaagggctcaggtgacccccgaagtgcagcccggttgcaggggccactgctccagctatggtaaactgtgtcgcaacggtgggaagtgcagagaaaggcccataggattcttttgtgattgcacctttagcgcatatacgggcccattttgttctaacgaaattagcgcttacttcgggtctgggtccagcgtgatctataatttccaggagaattacctcctctccaagaactcctccagtcacgccgctagtttccacggcgacatgaaactgtcaagggagatgatcaagttttcgttccgaaccacacgcacgccatctctcctcctgttcgtcagctctttttacaaggagtatctgtctgtaataattgcaaagaacggagatctgcaaatcagatataaactcaacaagtatcaggagcccgatgtcgtcaattttgacttcaagaacatggccgacggacagctacaccacataatgattaatcgagaggagggggtagtgttcatagagattgacgacaatcggaggagacaggtgcacctctcttcgggaactgaattcagcgccgtaaagtccctcgtgcttgggaggatcctggagcactccgatgttgaccaggacaccgccctcgcgggagcacaaggctttaccgggtgcctcagtgccgtgcaactgagtcacgttgcccctctcaaagccgcactccatcccagccaccctgaccccgtgacagttaccggacatgtcaccgaaagctcttgcatggcacagcctggtacggatgccacctctcgggaacgtacacattccttcgcagatcactcagggacaattgatgaccgggaacctctcgccaatgcaatcaaaagcgatagcgccgtcatcggcggtctcatcgccgtagtcatctttattttgctatgtataaccgctatcgcagtgcgaatctaccagcaaaagaggctgtacaaaagaagcgaggcgaaacgttcagaaaacgttgactctgccgaagcagtgttgaagagcgaattgaatatccagaacgccgtgaacgaaaaccaaaaagagtacttcttctag

SEQ ID NO: 55237 - DNA, 3708 bp, Artificial Sequence
  Description of Artificial Sequence: Synthetic coding sequence
atgtggaactacgactgtgacgatcccttagtctcggcgctgccacaggcctcctttagttcatcctcagagctgtcctcaagccatgggcctggcttcgccagactgaaccggagggatggcgctggtggctggtccccattagtgagcaacaaatatcagtggctgcaaatcgatctgggggaacggatggaggttactgctgtggccacacagggtggctacggatcttccaattgggtcacttcgtatttactcatgttcagcgatagcggctggaactggaaacagtacagacaggaagattcaatttggggattttcagggaacgcgaatgctgacagcgtagtctattaccgacttcagccttctatcaaagctaggttcctcaggttcattcccttggaatggaatccaaaaggcaggatcggaatgaggatcgaggtcttcgggtgtgcgtacagaagcgaggtcgttgatcttgatggcaaaagttccctgctctatcgattcgatcagaagtccctgagccccatcaaagacataataagtctaaaattcaagacaatgcaaagtgatggcatcctactacaccgggaaggccctaatggcgatcatatcactcttcagctcagacgtgctcgtttgttcctgctgataaactcaggagaagccaagctgccaagcacctccaccctggtgaacttgaccctcggatctctgctcgacgatcagcattggcactcggtgttaattcagcgtctcgggaagcaagtcaacttcaccgtcgacgaacaccggcatcattttcatgccaggggggaattcaacttgatgaacctagattatgagggcaatgtctccttttcttgcagccagccacaaagcatgccagtaactttcctctcctccaggtcctacctagccttgccggactttagcggggaggaagaggtgtccgccacattccagttccgaacatggaataaagccggattgctcctcttcagtgagctgcagctaatcagcgggggtatcttgcttttcctctccgacggtaagctgaaaagtaatctttatcagccaggcaagctgccctctgacatcaccgccggagtggagctgaacgacggccagtggcattctgtgagtctgagtgccaaaaagaatcacctgagcgtggccgtcgacggccagatggcaagcgccgctcctttgctgggccctgagcagatctatagtggcggaacctactattttggaggctgtcccgataagtcgtttggctcgaaatgtaagagccccctggggggattccaagggtgcatgaggctgatctccatatccgggaaggtggtggacctcatcagtgttcagcagggcagtttgggaaatttcagtgacttgcagatcgattcctgtggcatctcagacagatgtctccccaattactgcgaacatgggggtgaatgttcgcagtcttggtccacatttcactgtaattgtaccaacaccggttataggggggcaacatgccataactccatttatgagcagagctgcgaagcgtataagcaccgagggaacaccagcgggttttattacattgatagtgatggaagcgggccactggagccctttctcctttattgtaacatgactgagaccgcgtggaccatcatacagcataacggctctgacctgacccgcgttcggaatacgaatccagaaaatccatatgcaggattcttcgagtacgtggcatcgatggaacagctccaggccactataaaccgagctgagcactgtgagcaggaatttacatactattgcaagaaaagtaggctagtgaataaacaagacggtacccctctgtcatggtgggtaggccgtacaaatgaaacacagacttactgggggggtagcagtccagatctgcaaaagtgtacatgcggactcgagggtaattgtatagattcccagtattactgcaattgtgacgccgaccggaacgagtggaccaacgatactggtctgctggcctacaaggagcacctgccagtgaccaagattgtaatcaccgataccggacgactccactcagaggccgcttataagctgggccctctgttatgccaaggagatcgcagtttctggaacagtgcttcttttgatacagaagctagctatttacacttccccacctttcatggcgaactttcagcagacgtttcctttttctttaagacaaccgcctcttctggagtcttcctggagaacctgggcattgccgattttatcagaattgaactgcggagccccacggtcgtcactttctcttttgacgtgggtaacggtcccttcgaaatctctgtgcagtctcctacccactttaacgataatcagtggcatcacgtacgggtggagcggaacatgaaagaagccagccttcaggtcgaccaactaacaccaaagacacagccagctcctgcagacggccatgtactcttgcagctgaacagtcagctcttcgtaggcggtacagccacaaggcaaagaggctttctaggctgcattcggagcctgcagctgaatggaatgaccctggacttggaagagagagctcaggttactccagaggtgcaacccggatgtcgtggacactgtagttcatacggcaaattgtgtagaaacggtgggaagtgtagggagcgccctatcggattcttttgcgactgcacattttcagcctatacaggacccttttgtagtaacgaaatatctgcctatttcgggagcggatcatccgtgatttataattttcaggagaactatctcctgagcaagaactcctcatcccatgcagcgagcttccatggggacatgaagctgagtagagagatgataaaattttcttttagaacgaccaggactccctctctccttctcttcgtcagcagcttctacaaggagtaccttagcgtgataatagcaaagaatggatcccttcagattaggtataagctgaataagtaccaggaacctgatgtagtgaattttgactttaaaaacatggccgacggtcaattacaccacatcatgattaatcgggaagagggtgttgtgtttatcgaaattgatgacaaccggcgtcgccaggtgcatcttagctctggtactgagtttagcgccgtcaaatccctcgttctggggaggatcctggaacactctgacgtggaccaggatacagctctggctggagctcaaggctttaccggatgtctgagcgctgtgcagctcagtcatgtggccccactgaaggccgctctgcatcctagtcatcctgatcccgtcaccgtgactggacacgtcacagaatcctcttgtatggcacagcccggtactgacgccacttccagggagagaacccattcatttgctgaccacagtgggactattgatgaccgcgaacccttagctaacgcaatcaaatctgactcagccgtaatagggggtctcatcgccgttgtaatttttattctcctgtgtataaccgccatcgctgtgagaatctatcagcagaagcgactctacaagcggagtgaagccaaaaggtcagagaacgtcgatagtgccgaagccgtattaaagagcgaactgaacattcaaaacgccgtcaacgaaaatcagaaggaatattttttttag

SEQ ID NO: 55238 - DNA, 1512 bp, Artificial Sequence
  Description of Artificial Sequence: Synthetic coding sequence
atgtctctcggcggagcgagtgagcgttctgtccccgctacaaagattgagataacggtgagctgtaggaacctgctagaccttgatacctttagtaaaagcgaccccatggtggtgctgtacacacagagccgggctagtcaggagtggagagaattcggcaggacagaagtgatcgacaacaccttgaaccccgatttcgtgagaaaattcgtgctcgattatttcttcgaagaaaaacagaacctgcgctttgatgtgtacaacgtggactctaagaccaacatttctaaacctaaagatttcctggggcaggctttcttggctttgggagaggtgataggtggacaggggtcccgggttgaacgtaccctgactggtgtgcctgggaagaaatgcggaaccatccttctgaccgccgaggagttatccaattgccgagatatcgctacaatgcagctctgtgccaacaagctcgacaagaaagactttttcgggaagtcagatccgttcctggtcttctaccgaagtaacgaagacggaacctttacaatttgtcacaaaacggaggtggtcaaaaatactctgaatccagtctggcagccattctcaattcccgtgagagctctgtgtaatggggactatgacagaacagtgaaaatagatgtgtatgattgggaccgggatggcagccacgattttatcggcgagtttaccaccagctacagggagctgtctaaagcccagaatcaattcactgtttacgaagtactcaatccaaggaagaagtgtaaaaagaaaaaatacgttaattccgggacagtgactctcctctcattcagcgtggacagtgagttcacctttgtggactatataaaaggcggtacacagctgaatttcactgttgcaatcgacttcactgcttccaatgggaaccctctgcagccaacgagcctacattacatgtccccatatcagctctctgcctatgcaatggctcttaaagctgtaggcgaaatcatccaggactatgattctgataaattatttcccgcttatgggtttggagctaagctccccccagaggggagaatctcgcaccaatttccattgaataataatgacgaagatccaaactgtgcagggatcgaaggagtgctcgaaagctatttccagtcgctgcgaacggtccagctctacggccctacatacttcgccccagttatcaatcaggtggctcgtgcagccgcaaagatcagcgatggaagccaatattacgtcctcttgattatcacagatggggtgatcagcgacatgacccagaccaaggaggccatcgttagcgcctcatcactgcctatgtccattattatcgtcggagtggggcctgccatgttcgaagctatggaggaattggatggcgacgacgtacgtgtgtccagccgagggaggtatgctgagcgggacatcgttcaggaggggtgttgctccctgggcacatctgtcgtgtag

SEQ ID NO: 55239 - DNA, 1662 bp, Artificial Sequence
  Description of Artificial Sequence: Synthetic coding sequence
atgagtctgggtggtgccagtgagaggagtgttcctgcaaccaagattgagattacagtctcctgccgcaatctccttgacctagatacatttagcaagagtgaccctatggtagtgttgtatacacagagcagggcgtcacaggagtggcgggagtttggacgaacagaagtcatagacaatactctgaaccctgacttcgtgcgaaaattcgtcttggactatttcttcgaggagaaacagaatttgcgtttcgatgtctacaacgtcgactcaaagactaacatatctaaacccaaggacttcctcgggcaggccttcctggcactaggggaagttatcggcggtcagggaagccgtgtggagcggactctgaccggggtgcctgggaaaaagtgcgggacaattttactcactgcggaagaactcagtaactgtagggacatcgccacgatgcagctgtgtgcaaataagctggataaaaaggactttttcgggaaaagtgacccattcctcgtgttctacagaagcaacgaagacgggaccttcaccatttgccacaagacggaggtcgtcaagaacacgctaaaccctgtgtggcagccattctccattcctgtccgcgctctctgcaatggagactatgatcgtaccgttaaaatcgacgtgtacgactgggatcgagacgggtctcacgatttcatcggagaattcactaccagctatcgggagctgagtaaggcacagaaccagtttactgtgtacgaggtgcttaaccctcggaagaagtgtaaaaaaaaaaagtatgtcaacagcggcacagttacactgctttctttctccgtggactccgagttcaccttcgttgattacatcaagggcggtacacagttaaatttcaccgtcgccattgatttcactgcttccaacggaaacccattgcagcctacttccctccactacatgtcaccttaccagctgagcgcctacgcaatggctctcaaagcggttggagagatcatccaggattacgattccgacaagctgttccctgcttatggattcggcgctaaactgccccctgagggcagaatttcccaccagttccctctcaacaataatgacgaggaccccaattgcgcaggcattgaaggcgttctggagtcttacttccagagcctgcggaccgttcaactgtatggacctacatacttcgcacctgtgatcaaccaggttgcgcgtgcagcagcaaagatttcagacggatcacagtactatgtacttctgattattacggacggcgttatttcagacatgacacagacaaaggaagcaatcgtgtcggcgtcctctctgccaatgtcaataatcattgtaggagtggggccagctatgttcgaggctatggaagaactggatggcgatgacgtaagagtgagtagtcggggacgatatgccgaacgcgacatcgtgcagttcgtccccttcagggactatgtggatcgcagtgggaatcaggtattaagcatggcccgtctggctaaggacgtgctggccgaaatccccgaacagctgctttcttatatgcgtactagagacatccagcctcgtcctcctcctccggctaacccctctccaattcctgccccagagcagccatag

SEQ ID NO: 55240 - DNA, 1614 bp, Artificial Sequence
  Description of Artificial Sequence: Synthetic coding sequence
atggcccattgcgtaacgctggtgcagctgagcatttcatgtgaccatcttatcgacaaggacatagggagtaaatctgatcctctttgcgtgcttctccaagatgtggggggtggctcctgggcggaattaggcaggactgagagagtccgaaattgctccagcccagagttctctaagactctccagctcgagtatcgttttgagacggttcaaaaactccgcttcgggatttatgatatagacaataaaacgcccgagcttcgagacgacgatttcctgggcggagccgagtgctcgctggggcagatagtttcctctcaggtcctgacactcccacttatgctgaaacccggtaagccggctgggcgaggcacaattaccgtgtctgcccaggagctcaaagacaacagggtggtgaccatggaagtggaggcccgtaaccttgacaaaaaagacttcctgggtaagtccgacccttttctggagttcttcagacagggcgatggcaaatggcacctcgtttacaggagcgaggtgatcaaaaacaacctgaaccccacatggaagcggttttcagttccagtgcagcatttctgtggtgggaacccttctactccgattcaggttcagtgttcagattatgacagcgacggttcacatgatctaattggaacatttcacacatccctggctcagctgcaagccgtcccagctgagttcgaatgcattcatcctgaaaagcaacagaagaagaaatcttacaaaaactctggcactatccgcgtgaagatttgccgcgtcgaaaccgagtacagctttctcgattatgtgatgggtgggtgccagattaacttcacagtgggcgtagacttcactggctccaatggcgacccaagcagtcccgactctctgcactatctctcacccaccggcgtcaatgaatacttgatggccttatggagcgtgggttccgtggtgcaggactacgattctgacaaactattccctgcctttggcttcggggctcaagtccccccagattggcaggtgtcacatgaatttgcactgaactttaatcctagcaatccctattgtgctggtattcagggcatcgtggacgcctaccggcaagcgttgccgcaagttcgactttatggccctactaatttcgcccctattataaaccacgtggctcgtttcgccgcacaggcggcacaccagggaaccgcttcacagtactttatgctgctgctgctaacagatggagcagtcactgacgttgaagcgacacgcgaagcggtggttcgggctagcaatctgccaatgagcgtgatcatcgttggcgtaggcggagctgacttcgaggccatggaacaactggacgctgacgggggaccgctgcacactcgctccggccaggcggcagcgcgagacattgtgcagttcgtcccatacaggcgttttcagaatgcccctagggaagcactcgcccagaccgtgctcgccgaagtgcccacccaacttgtatcctatttcagagcccagggttgggcgccactgaagccacttccacccagtgctaaggatccagctcaggcccctcaggcttag

SEQ ID NO: 55241 - DNA, 1629 bp, Artificial Sequence
  Description of Artificial Sequence: Synthetic coding sequence
atgaagatgatgcatatggcgcattgtgtcactctggtgcaactgtctattagttgtgaccacctcattgacaaagacatcggcagcaaatccgaccctttgtgtgtgttgttacaggacgttgggggtggttcgtgggctgagttaggaagaactgaacgagtgcgtaattgctcctcgccagagttttcaaaaaccttgcagttagagtaccgcttcgaaactgtccaaaagctccggtttgggatctacgacattgataataaaactccggaactccgcgatgacgatttcctgggtggcgcagaatgttcccttgggcagatagtctcgtcccaggttttaacactcccactgatgctgaagccaggcaagccagccggtcgtggtaccatcacagtgtcagcacaggagctgaaggacaatagggtggtgacaatggaggtggaagccagaaaccttgataaaaaagactttctaggcaagagcgatccctttctagagttctttcgtcagggtgacggcaaatggcatttagtttatagaagtgaagtgattaagaataacttgaaccccacctggaaaagattttctgtacccgtgcagcacttctgtggcggaaacccttccacccccattcaggtccagtgcagtgattatgactccgacggcagtcacgacctaatagggacatttcacacctctctcgcacagttacaagcagtgccagcagagttcgaatgcatccacccagaaaagcaacaaaagaagaaaagctataaaaactccggcactataagagttaagatttgtcgcgttgagaccgaatattcatttttagactatgtgatgggtgggtgccagattaactttaccgtgggtgtcgatttcaccgggagcaatggcgaccctagctcacctgatagtttacactatctttcgcctacgggcgtaaacgaatatctcatggcgctatggtctgtcggatcagtggtccaggattatgatagtgacaaattgttcccagcctttggcttcggcgctcaggttccaccggactggcaggtgtcacatgagtttgcactgaactttaatccatccaatccatactgtgcaggtattcaggggatagtggacgcctataggcaggcactgccacaagtcagactttatggtcctaccaattttgcccctattattaaccatgttgctagattcgccgctcaggctgcccatcaaggtacggcttcccaatactttatgctgctactcctgacagatggcgctgtgacggacgtggaggcgaccagagaagcagttgttcgggcatccaacttacctatgtcggtcatcattgtcggtgtgggtggcgctgatttcgaggccatggagcagctcgacgccgatggcggacctctccacactcggagcggccaggccgctgccagggacattgttcagtttgtaccttacagaaggtttcaaaacgcgccacgagaggcgctggctcagacagtgctcgccgaggttcccactcagctcgtaagctattttagagctcagggttgggccccactgaaacccttgcctccctccgccaaagacccagcccaagcccctcaggcctag

SEQ ID NO: 55242 - DNA, 1614 bp, Artificial Sequence
  Description of Artificial Sequence: Synthetic coding sequence
atggcccactgtgtgacattggtgcagctttccatatcctgcgatcatctgatagataaggatatcggaagtaagagtgaccccctatgcgtgttattgcaagacgttggcggaggcagctgggcagagctcgggagaacagagcgcgtgcgaaactgctcgtccccagaattcagcaaaacattgcagctggaatatcgatttgagactgtccagaagttgaggtttggcatctacgacatagataataagacacctgaactccgagatgatgactttctaggtggggctgagtgctcactggggcaaatcgtttcatcccaagtgctgaccctccccctgatgctcaagcccggaaaacctgccggacggggaactatcaccgtttccgctcaggagttaaaagataatagggtggtgaccatggaggtggaggccagaaatcttgataaaaaggattttcttgggaaatctgatccatttctggagttcttcaggcaaggagacgggaagtggcacctggtttacaggtcagaggtcattaaaaataacctgaatccgacatggaagcggttctcggtgcccgtgcagcacttctgtgggggaaacccctccacacccatccaagttcagtgttcagattacgattcagacggttcacacgacctgatcggtaccttccacaccagcctagcacagctgcaagcagtccctgcagagtttgaatgtatccacccagaaaaacagcagaaaaagaagagctacaagaacagcggcacaatacgggttaagatatgtagagtagagactgagtactctttcttagattatgtgatgggagggtgtcagattaatttcaccgtcggggtcgacttcaccgggtctaatggagatcctagcagcccagacagcctccactatctgagtcccaccggtgtgaacgaatatctgatggccttgtggagcgtagggtctgtggtgcaagattatgattcagataaactgtttcccgcatttgggttcggtgcccaggtaccaccagactggcaggtaagccacgaatttgccctaaacttcaacccatctaacccgtactgcgccggaatccaggggatcgtggacgcatatcgccaggccctgccccaagtgcgcctgtacggccctactaactttgcccctatcatcaatcatgtcgctcggttcgctgcgcaggccgctcaccaggggactgcaagccagtactttatgttactgctgctcacagacggagctgtaactgacgtggaggccactagggaggccgtcgttagggcatctaatcttcctatgtccgtgatcatcgttggagtggggggagcagactttgaagcaatggaacagctggatgccgacgggggacccctgcataccagatccgggcaggccgcagcacgagacatcgtccagtttgtcccttaccggcgttttcagaacgccccaagggaggcgctcgcccagactgtgctggcggaggtaccaacccaactggtttcatatttcagggctcaaggttgggctccattgaagcctctgcctccttcagcgaaagacccagcacaggccccacaggcttag

SEQ ID NO: 55243 - DNA, 1614 bp, Artificial Sequence
  Description of Artificial Sequence: Synthetic coding sequence
atggcgcactgtgtaaccttggtgcagctctccatctcttgcgatcacctaatagacaaggatatcggcagcaagtctgacccactgtgcgtgctactgcaggatgtcggcggaggctcttgggcagagctgggaaggaccgaacgggtgcgcaattgttcaagcccggaattctccaagacccttcagttggaatataggttcgagacagtgcagaagcttcgctttggcatttatgacatcgataacaagacacctgagctacgggacgacgatttcttgggcggagcagagtgtagtctgggacagatcgtatcctcccaggtgctgacattaccactgatgctcaaacccggaaagccagctgggaggggcactattaccgtatcagcccaagaactgaaggataacagggtggtgaccatggaagtcgaggctagaaacctggacaagaaggatttcctgggaaaatccgacccctttttagagttcttccggcagggcgacgggaaatggcacctggtgtaccgctcggaagtgatcaagaataatctgaacccaacttggaagcgcttctccgtacccgttcaacatttctgtggaggtaatccatcaacccctatccaggtgcagtgctctgattacgactccgatgggagccacgatctgattggcacttttcacaccagtctagctcagctgcaagccgtgccagccgaatttgaatgtatacacccggaaaaacagcagaagaaaaaatcttataagaattccgggaccatacgtgtgaagatatgcagggtggaaacggagtattccttcctagattatgtgatgggcggatgtcagatcaactttacagtcggggtcgatttcacaggctctaatggagaccccagcagtcctgatagtctgcattaccttagccctacaggcgtgaacgaatacctgatggccctttggtctgtgggtagtgtggttcaggactatgactctgacaaactgtttcccgctttcggctttggagcacaagttccaccagattggcaggtgtcacacgagtttgcactaaactttaatccatccaacccttactgtgctgggatccaaggcattgtggatgcctataggcaggcgcttccacaggttcgtctttatggcccaacaaactttgcccctatcatcaatcacgtcgcccgttttgcggctcaggctgctcatcagggaactgcatctcagtatttcatgctcttactgttgacagacggagctgttacagacgtggaggccacgagagaagccgtggttcgcgcttcaaatcttccaatgagcgtgatcattgtgggggttggcggagcggattttgaggcaatggagcagctggatgccgatggagggccactccacacccgatcaggtcaggctgccgctagggatatcgtgcagttcgtcccgtatcgtcggtttcagaatgccccacgcgaggccctggcccagacggtgctggcagaagtcccgactcaattggtgagttacttccgcgcacaaggttgggctcctctcaaaccactgcctccttccgccaaagaccccgcacaagctccccaagcttag

SEQ ID NO: 55244 - DNA, 1614 bp, Artificial Sequence
  Description of Artificial Sequence: Synthetic coding sequence
atggctcactgcgtgacactggtccagctatctatcagttgtgatcacctcatcgacaaagacattgggagtaaaagtgatccattgtgcgtgctgttgcaggacgtcggtggaggcagttgggcagagctggggaggaccgaacgcgtgcgtaactgttcgtccccagaatttagcaagacactccagctggagtatcgcttcgagaccgtgcaaaaattgagatttggcatatacgatatcgacaacaaaaccccagaactacgggatgacgacttcctgggaggagctgaatgcagtctgggtcagatcgttagcagccaggtgcttaccctgccgttgatgctgaaacctggtaagccagcgggaagagggacaatcactgtttcagctcaggagctgaaggacaatagagtggtcacaatggaggttgaggccagaaatctggataaaaaggattttctgggaaagtctgacccattcctcgagtttttcagacagggggacggaaagtggcacctggtgtacagatcggaagtaatcaaaaataatctcaacccaacctggaagcggttcagtgttcccgtacaacatttctgcgggggtaacccgtccacacctatccaggtgcagtgttcagattacgactcagacggcagtcatgacctgatcggaacttttcacaccagcctggctcagctgcaggccgtaccagctgagttcgaatgtatacaccccgagaaacaacagaagaaaaaatcctataaaaacagcggaaccattagggtcaaaatttgcagggtcgaaaccgagtactctttcctggactatgtaatgggtggttgccagataaattttaccgttggtgttgattttacaggttctaatggtgatccctctagcccagacagtctccattacttgtccccaactggcgtgaacgaatacttaatggccctgtggtccgtcggtagcgtcgttcaggattacgacagcgataaactctttcctgccttcggatttggggctcaggtcccccctgattggcaggtgtcccatgagttcgccttaaatttcaacccaagtaacccttattgcgccggaatacaggggatagtcgatgcatataggcaggccctgccccaggtccggctgtacggacccaccaacttcgcccctatcatcaaccacgtggcccgatttgcggctcaggcggcacatcagggaacagcaagccagtactttatgctgcttcttctcaccgatggcgcagttaccgacgtagaggccaccagagaagcagtggtgcgtgctagcaacttaccgatgtcggttattattgttggagttgggggtgccgattttgaggctatggaacagctcgatgccgacggtggccctctccacacacgtagcggacaggcagctgccagggacatcgtgcaattcgtgccctatagacgcttccagaacgccccacgtgaggctttggcacagactgtgctggccgaggtgccaacccaactggttagttattttagagcacaggggtgggcaccgctgaaacccctacctccatcagccaaagaccctgcccaggcccctcaggcatag

SEQ ID NO: 55245 - DNA, 1614 bp, Artificial Sequence
  Description of Artificial Sequence: Synthetic coding sequence
atggcccactgtgttaccctggttcagttaagtatatcctgtgaccacctcatcgacaaagatatcggcagcaagagtgacccactctgtgtgctcttgcaggatgtgggcggaggcagttgggccgagctggggaggacggagagagtccgcaactgctcatcaccagagttcagcaaaacgctgcagcttgagtataggtttgaaaccgtccagaaattgaggttcgggatatacgatatcgataacaagactccagaactgcgcgacgatgactttctcggcggtgctgagtgttccctgggccagattgtgtcatcacaggtgctaactctgccactgatgctgaagcccggtaagcctgccggaaggggtacgatcaccgttagcgcacaggagctgaaagacaatagagtcgtcacgatggaggtggaggcccgaaatcttgataagaaggattttcttgggaagagcgatccctttttagagttctttagacaaggagacggaaaatggcaccttgtctatagatcagaggtgattaaaaataatctgaaccccacgtggaagcggttctctgtgcctgtgcagcacttttgtggtgggaatccgtctacaccaatccaagtgcagtgcagtgactacgatagtgatgggagccacgatctgattggaactttccataccagcctcgcgcagcttcaggcagtgcctgctgaatttgaatgcatacacccagagaagcaacagaaaaaaaaatcttataagaacagcggaaccatccgggtcaagatttgtcgtgtggagaccgagtacagctttcttgactacgtgatggggggatgtcaaattaattttaccgtgggcgtggatttcacaggctcaaacggagaccccagctctcccgattccctgcactacctgagtcccacgggggtgaacgagtacctcatggcactctggagcgtcggctcggtggttcaggactacgacagcgacaaactgttccctgcttttggatttggtgcccaggtgcccccagactggcaagtgtcacacgagtttgccctaaatttcaacccatcaaatccttattgcgccggaatccaggggatcgttgatgcctacaggcaggccctgccccaggtgagactttacggccctacaaatttcgcccctatcatcaaccatgttgcccgatttgccgcacaggcggctcatcaggggacagcttcacagtattttatgctgctgctgttgactgacggggctgtgacagacgtcgaggccacgcgggaagcggtggtgagggcctccaacttgcccatgtctgttatcattgtcggggtggggggtgccgactttgaagctatggaacagctggatgctgacgggggtcctctccataccagatcagggcaggccgcagccagagacatcgtgcaatttgtgccgtaccgtcgcttccagaatgctcctcgcgaggctctggcacagaccgtcttggccgaagtccccacccagctcgtttcttacttccgggctcaggggtgggccccactcaaaccgctgcctccctcggcaaaggatcctgcccaggctccgcaagcctag

SEQ ID NO: 55246 - DNA, 915 bp, Artificial Sequence
  Description of Artificial Sequence: Synthetic coding sequence
atggcccactgcgtcacacttgttcagctctccattagctgcgatcatttaattgataaggacatcgggagcaagagtgaccccctgtgtgtcctgcttcaagacgtgggcggtggctcttgggcagaattgggccgaacggagcgggtgagaaactgcagcagcccagagtttagcaaaaccctccaactggaatatagatttgaaacagtccagaagcttcggtttgggatctacgacatcgataacaaaacacctgagcttcgcgacgacgacttcttaggcggagcagaatgtagcctgggccagattgtgagtagccaggtcctcacattgccacttatgttaaagcccggtaaacctgccggtaggggaactatcactgtgagcgcacaggaattgaaggacaatagagtggtcactatggaagtagaagctcgcaacctggacaaaaaggacttcctgggaaaatctgacccatttctagagtttttccgacagggcgacgggaagtggcacctcgtgtatcgctccgaggtgatcaagaacaacctcaaccccacctggaaacgtttcagtgtccctgtgcagcacttttgcggtgggaacccctccaccccaatacaggtgcagtgcagtgattacgacagtgacgggtcacatgacctcatcggcacattccacacgagcctggcccagctgcaggccgtgcccgctgaattcgaatgtatccatcccgaaaagcaacagaagaaaaaaagttacaaaaactccggtacaatccgggtcaaaatttgtcgcgtggaaaccgagtattctttcctggattacgtcatgggagggtgccagattaattttactgtgggcgtcgacttcaccggctccaacggcgatcccagctcccccgactcttag

SEQ ID NO: 55247 - DNA, 411 bp, Artificial Sequence
  Description of Artificial Sequence: Synthetic coding sequence
atggcgcactgcgtgacgctggttcagctctctatttcgtgcgaccatcttatcgacaaggacattgggtccaagagcgaccctctctgtgtactactgcaggatgttggcggagggagctgggccgaactaggaagaacggaacgcgtgcgtaattgctcctcgccagagtttagtaagacactccaactcgaataccggttcgagaccgtccagaagttgaggtttggaatttatgacatcgacaataagactccggagctgcgcgatgacgatttcctggggggagccgaatgctctctggggcagattgtgtcctcccaggtgcttaccttgcccctgatgttaaaacctggtaaacccgcagggagagggactattaccgtttcggcccaggagctgaaggactag

SEQ ID NO: 55248 - DNA, 630 bp, Artificial Sequence
  Description of Artificial Sequence: Synthetic coding sequence
atggctcactgcgttacacttgtccaactgagtataagctgcgatcatctgatcgataaagatatcggcagcaaaagcgatcccctgtgtgtgctgctgcaggatgtgggaggtggctcctgggcagagctggggcgaacggagcgcgtaaggaattgcagctcccccgaattcagtaagacactgcaactcgaatatagattcgagactgtgcaaaaactaaggttcggtatctatgatatagataataaaactccggagctccgggacgatgacttcctcgggggagccgaatgctcccttggacaaatcgtttcctcgcaggtgctcacccttccacttatgctaaaacccggaaagcccgctggcagggggacgatcacggtgagtgcccaggagctgaaggataatcgtgtggtaaccatggaggtcgaagcccgtaaccttgacaagaaagacttcttgggaaagtctgatccttttctggaattctttcgtcaaggagacgggaaatggcatctggtctacaggtctgaggtaatcaaaaataatcttaacccaacctggaagcgtttcagcgtacctgtccaacatttttgtggcggaaatccatcaacacccatccagtag

SEQ ID NO: 55249 - DNA, 609 bp, Artificial Sequence
  Description of Artificial Sequence: Synthetic coding sequence
atggcgcactgtgtcacacttgtccagctgtcgatttcctgtgaccacttgatcgataaggacataggcagcaaaagtgacccgctctgtgttctgctgcaggacgtaggaggcggatcctgggccgaactgggcagaactgaaagagtgagaaactgtagctctcctgaatttagcaagaccttgcaactggagtaccggttcgaaactgtacaaaagctgcgcttcggcatctacgacattgataacaaaactccagagctgagggatgatgacttccttggtggcgcagaatgctcccttggtcagatcgtctctagtcaagtgctgacgctccctctcatgctcaagcccggtaagccggctgggaggggcaccataaccgtctccgcccaggagctcaaggataatcgagttgtcacaatggaggtggaagcacggaacctggataaaaaggacttcttgggaaaaagcgatccattcctagagttcttccgtcagggggatgggaagtggcaccttgtttataggagcgaggtcataaaaaataacttaaatcccacttggaaaaggtttagtgtgccagtccaacacttctgcgggggttag

SEQ ID NO: 55250 - DNA, 204 bp, Artificial Sequence
  Description of Artificial Sequence: Synthetic coding sequence
atggcccattgcgtgactctggtccagctctctatatcatgtgatcaccttattgacaaggatatagggagtaaatctgaccccctgtgtgtactgctgcaggatgtcgggggtggatcttgggcggagcttggtcgtaccgaacgcgtgcgcaactgttcctcgcccgagttcagcaagaccttacagctagagtatagatag

SEQ ID NO: 55251 - DNA, 459 bp, Artificial Sequence
  Description of Artificial Sequence: Synthetic coding sequence
atggcacattgcgtaaccttagtgcagcttagcatttcatgtgaccacctgatagacaaagacatcggatctaaatctgaccccctatgcgtcctgctacaggatgtcggaggcggaagctgggcagaacttggaagaactgagagagtgcgcaactgttcatccccggagtttagcaaaacactgcagctggaatatcggtttgagactgttcagaaactccgatttgggatttatgacattgataataaaaccccagagctcagagacgacgattttctggggggtgctgagtgctcacttggccagattgtgtcaagtcaagtgttgaccttacccctgatgctgaaaccaggtaagcctgcaggtcggggaactattacggttagcgcacaggagctgaaggataatcgcgtagtgacgatggaagtggaggctcgtaatttagacaaaaagtag

SEQ ID NO: 55252 - DNA, 696 bp, Artificial Sequence
  Description of Artificial Sequence: Synthetic coding sequence
atggcacattgtgtgactttagtccagctctccattagttgcgaccatctcattgataaagatataggaagcaagtccgatccactgtgtgtgctcttacaggacgtgggcggaggatcatgggccgaactggggcgtaccgagcgtgtcagaaactgtagttcccctgaattctccaaaactctgcagttggagtacaggttcgaaacagtccagaagttacgcttcgggatttacgatatagataacaagacaccggaactccgggacgatgattttctcggcggtgccgaatgttcgctcggacaaatagtgtctagtcaggtactgacactacctttaatgttgaagcctggaaagccggctggccgaggtacgataactgtgagcgcccaggagctaaaagacaacagggtcgtgactatggaagtcgaggctaggaacttggacaagaaggactttctgggcaagagcgatcctttcttagaattttttagacagggtgatgggaaatggcacctagtctataggagcgaagtgatcaagaataacctcaaccccacgtggaagcgtttttctgtccccgttcaacatttttgcgggggaaacccttccacgcccatccaagtccagtgtagtgattatgacagcgatggttctcacgacctcattggtacttttcatactagcctgtag

SEQ ID NO: 55253 - DNA, 525 bp, Artificial Sequence
  Description of Artificial Sequence: Synthetic coding sequence
atggctcactgtgtcacgttggtgcaactgagcatcagctgtgatcacctgattgacaaggatataggtagcaagagcgaccccctatgcgtcttgttgcaggacgtgggagggggaagctgggcagaactgggcaggaccgagagggtaagaaattgttcctcccctgaattctccaagactttacaattggagtaccgtttcgagactgtccagaagttacggtttggaatttacgacatagataataaaacacccgagctcagggacgatgattttctcggcggtgcagaatgctcactcggtcagatcgtctcctcccaggtgttaaccttaccactgatgctgaaaccagggaagccggcaggacgtggcactatcacagtgagtgcccaggagctcaaggacaatagggttgtgacaatggaggtggaggcaaggaaccttgacaagaaggattttctcggcaaatctgatcctttcctggaattctttaggcaaggcgacggaaagtggcacctctag

SEQ ID NO: 55254 - DNA, 1647 bp, Artificial Sequence
  Description of Artificial Sequence: Synthetic coding sequence
atggctcacattcccagtggcggtgcaccggcagccggagctgcgcctatgggccctcaatactgtgtttgcaaagttgagctgtccgtgtctggccagaatctgttggacagggacgtcacatccaagtctgaccctttttgtgtgttgtttactgagaacaacggccgttggatagaatatgaccggaccgaaactgcaattaacaatctgaatcctgcattctctaaaaaatttgtcctggactatcacttcgaggaagtgcagaagctcaaattcgctctcttcgatcaagacaagtcctcaatgcggctggatgaacacgacttcttaggacagttttcctgcagcctgggcacaatagtgagctcaaagaaaattacacggcctctgcttctcctcaacgataaacccgctggcaaaggcctgattaccatcgccgcacaggaactgtccgataacagagtgataactctgtctctcgctggcagaaggcttgacaaaaaagacctgttcggcaaatccgatccttttctagaattctataaacccggagacgacggcaagtggatgctagtgcatcggactgaagtgattaagtacaccctcgaccccgtctggaagccattcacagttcccctggtgtccctgtgtgatggcgatatggagaaacccatccaggtcatgtgttatgactatgacaatgacggcggacacgactttattggcgaattccagacatccgtaagccaaatgtgcgaggcccgagatagcgtgccactggagtttgagtgtatcaatcctaaaaagcagcgcaagaagaagaactataaaaattctggtatcataattctacgatcctgcaagattaaccgggattattctttcttggactacattctcggcggttgccaactgatgttcaccgtcggcattgacttcacagcgagtaacggtaatccgttggacccctcctcacttcattacataaatccaatgggaaccaatgagtatctgagcgccatttgggctgtgggacagatcatccaggactatgactctgacaagatgtttcccgcactcggcttcggtgcccagctgcccccagactggaaagtgtctcatgaattcgccattaattttaacccaacaaatcctttttgctccggagtcgacggcatcgcgcaagcatattcggcctgtctgcctcacattcggttctatggacctactaacttcagtcctatcgttaatcatgtcgctagattcgctgcgcaggctacccagcagcgtacggccacccaatattttatcctgctgataattaccgacggagtgatctcagacatggaggaaacacgacacgccgtggtccaggccagtaagctccccatgtccattattatcgttggtgtcggcaatgccgatttcgccgcaatggagtttctcgatggcgattccagaatgttgaggagccacactggggaagaggctgccagggacattgtgcagtttgtgccatttcgcgagttcagaaacgctgctaaggaaacattggccaaggcagtactcgccgaactgcctcaacaagttgtgcagtacttcaagcacaaaaacttgccaccgacgaacagcgagcctgcgtag

SEQ ID NO: 55255 - DNA, 1647 bp, Artificial Sequence
  Description of Artificial Sequence: Synthetic coding sequence
atggcccacattcccagcggcggagctcccgctgcaggcgctgctcccatgggaccacagtactgcgtgtgcaaggttgagctgagtgtctccggtcagaacctgctggatagagatgttacctccaaatccgatcctttttgtgttctcttcaccgagaataatgggagatggatagaatatgacagaaccgaaaccgctataaacaacctgaatcctgccttttcaaaaaagttcgtgttagactaccacttcgaggaagtacaaaaactgaagtttgcccttttcgaccaagacaagtcttctatgaggctcgacgaacacgatttcctaggtcagttttcctgtagcctgggaaccattgtctcaagcaagaagatcacacggcctctgctcctgctgaacgacaaaccggcaggcaagggtctcatcaccatagctgcgcaggaactcagcgacaacagagtcatcacgctcagtctagcagggaggcgtctggacaagaaagacctcttcggtaagagcgaccctttcctagagttctacaagcctggcgatgatggaaagtggatgttagtacacaggaccgaggtgatcaagtacactttggatcccgtttggaaaccattcactgtacccctggtttcgctgtgcgacggtgacatggaaaagccaatccaggtcatgtgttacgactacgataacgatggcggacacgacttcatcggagaatttcagacttctgttagccagatgtgcgaggccagggactctgtcccacttgagtttgaatgcattaacccaaagaagcagagaaagaagaagaattacaagaatagcgggatcataattttaaggagctgcaagatcaatagagattactcatttctggactatatcctgggcggatgtcagctaatgttcaccgtggggatagacttcactgcgtccaatgggaatcctttggatcctagctctttgcactatattaatcctatgggtactaatgagtacctcagcgcaatttgggctgtgggacagatcatccaagactacgacagtgacaagatgtttcccgctttgggcttcggggcacaactaccccctgactggaaagtgagtcacgaatttgcaatcaattttaatcccaccaatcctttctgttccggcgtagatgggatagcgcaggcatacagcgcgtgtttgcctcatatcaggttctatggacccacgaatttttctccaatagtgaaccacgtagctcggttcgccgctcaagccactcaacagcgaacggccactcagtactttattctgctcatcatcacggatggagtgatctcagacatggaggagacaaggcacgccgtagtgcaggcttcgaagttgcctatgtctatcatcattgtgggcgttgggaatgcagactttgcagcaatggagtttcttgatggagattctagaatgcttcgtagccacaccggcgaggaggccgctcgggatatagttcagtttgtgcctttccgcgaattcaggaacgctgccaaggaaacccttgctaaggctgtgttggcagagctgccacagcaggtcgtgcagtactttaagcataaaaatttgcctcctaccaattcagaaccagcatag

SEQ ID NO: 55256 - DNA, 1341 bp, Artificial Sequence
  Description of Artificial Sequence: Synthetic coding sequence
atgcggttggacgaacacgatttcctgggacaattctcctgctcactcggcaccatcgtctcgagtaagaaaattacgcggcctctactcctcctgaacgacaaacccgcagggaagggattgatcaccattgccgcacaggagcttagcgataatcgtgtcattacactctccttggcaggtcgcagactggacaaaaaggatctgttcggcaaaagtgaccccttcctggaattttacaaacctggggatgatgggaagtggatgttagtacatcgcactgaagtgattaaatacactcttgaccctgtctggaaaccctttactgttccactggtctctctatgtgacggagacatggaaaagcccatacaagtgatgtgctacgactatgacaatgatggtggtcatgattttattggcgaattccagacctcagtgagccagatgtgcgaggcaagggatagtgtgccattggagtttgaatgtatcaacccaaagaagcagcggaaaaagaaaaattacaaaaactccggtatcataattctgagatcctgtaaaatcaaccgcgactatagttttctggactatatcctagggggatgccaacttatgtttacagtggggatcgattttactgccagcaatggaaacccactcgacccgtcatctcttcactacatcaatcctatgggaacaaatgagtaccttagcgccatatgggcagtagggcagatcattcaagattacgattctgacaaaatgttccctgcattagggtttggcgcacaattaccacctgattggaaggtgtctcatgagttcgccatcaactttaaccccacgaaccctttttgctcaggggtggatgggattgctcaggcttactctgcctgccttccccatatccggttctatggccctacgaatttctccccaatagtgaatcatgtggcacgctttgcggcacaggctacccagcagcggacggccacccaatatttcatcctgctgattattacagatggcgttatcagcgatatggaggagactagacatgccgtcgtacaggcgtctaagttgcccatgtctattatcattgtaggggtgggtaatgcagactttgcagcaatggagttccttgacggcgacagtcgcatgctgagaagtcacactggagaagaagctgccagagacatagtgcagtttgtgcccttccgggaattccggaatgctgcaaaggaaactttggctaaggcagtgctggccgaactgcctcagcaggttgtgcagtactttaaacacaagaacttacccccaacgaacagcgagccagcatag

SEQ ID NO: 55257 - DNA, 1674 bp, Artificial Sequence
  Description of Artificial Sequence: Synthetic coding sequence
atgaagaaaatgtctaatatctacgagtccgcagcaaatacactaggcatatttaattctccctgtctaaccaaagtggaactcagagtggcctgtaaaggtatatcagacagggatgcactgagtaaaccagacccctgtgtgattctgaagatgcagtcacatggacagtggtttgaagtggaccgcactgaagttatcagaacctgtattaatccagtttactccaaattattcactgtggacttttactttgaagaggttcagcgcctccgattcgaagttcacgacatcagctccaatcacaacgggttgaaggaagccgatttcctggggggtatggaatgcaccttgggccagatcgtgtcacaacgaaagctgagcaagagcctgctgaagcatggaaacacagcaggaaaatcctctatcaccgtgattgccgaggaactatcagggaacgatgactatgttgagctagcgtttaatgcacggaagctggacgacaaggacttcttttctaagagtgatcctttcttggaaatattcagaatgaatgacgacgcaacacagcagctggtgcatagaacagaggtggtgatgaataacttgagccctgcttggaagtcatttaaagtttctgtgaacagcctgtgctcaggggaccctgaccggagattaaagtgcattgtgtgggactgggatagcaatggaaagcacgactttatcggggaattcacctccaccttcaaggaaatgcgtggggctatggaagggaaacaagtgcagtgggaatgcataaaccccaagtacaaggcaaaaaagaagaattataaaaatagcggaacagtaatcctcaatctctgcaaaattcataaaatgcattctttccttgattacataatgggcggttgccaaatacagtttactgtagctatcgacttcacagcttccaatggggacccgaggaatagttgctctctccattatatacacccatatcagcctaatgagtaccttaaggcgctggtcgctgtgggggaaatctgtcaagattatgactctgacaagatgtttccagcatttggtttcggtgcacgcattccacccgaatacactgtcagtcatgactttgctattaattttaacgaggataatccagagtgcgctggcatccagggcgttgtcgaggcataccagtcttgcctgcctaagttgcaactgtatggcccaaccaatattgcgcctattattcaaaaggtggcaaaatccgcttctgaagaaacgaatacaaaagaggcaagccaatactttatcctcctcatccttaccgatggtgtaatcaccgatatggccgacacacgggaagcaatagtccacgcatcccatctgccaatgtcagttattatagtgggtgtcggaaacgccgacttttccgacatgcagatgctggacggcgacgatgggatactccgcagccccaagggcgagccagtgctacgtgacatcgtgcaattcgtcccatttcgcaactttaaacatgcctcccccgctgccctggcaaaaagcgtacttgccgaggtgccaaatcaagtggtcgattactataatggcaagggaatcaaacctaaatgtagtagcgaaatgtatgagtcaagcaggaccttggccccttag

SEQ ID NO: 55258 - DNA, 1728 bp, Artificial Sequence
  Description of Artificial Sequence: Synthetic coding sequence
atggcggtagagccaagctccagtgagagcattaagcggcgagcaggtcgcagaatgaaaaagatgtcaaacatatacgagtcggcagctaacaccctgggaatctttaattctccctgcctgaccaaggtcgagttaagagtggcatgcaagggcatcagtgacagagacgctctttccaagcccgatccatgcgttatcctgaagatgcaatctcacggccaatggttcgaggtggaccgcacagaggtgatccgcacatgcattaatcccgtctattccaaattatttaccgtagacttttattttgaagaggtgcagaggcttcgctttgaagttcacgacattagctctaatcacaacggcttaaaagaggccgactttttgggcggtatggagtgtaccttaggacaaatcgtaagccagcggaaactgagcaaatctctcctgaagcacggcaatactgcgggaaagagttccataacagtcattgcagaagaactgagtggtaatgatgattatgtcgagctcgcttttaacgcccgaaagctggatgacaaagactttttcagcaagagtgacccatttttggaaatcttcaggatgaacgacgacgccacccagcagcttgtgcatcggacggaggtggtcatgaataacctctctccagcgtggaaatctttcaaggtgtccgtaaacagtttgtgttccggggaccccgacagacggctgaaatgcatcgtctgggactgggattcgaatgggaagcacgatttcattggggaattcacctcaacattcaaggaaatgaggggcgcaatggagggaaaacaggtgcagtgggagtgcatcaacccgaagtataaagctaaaaagaaaaactacaagaattctggtaccgttatcctgaatctgtgtaagatccataaaatgcacagttttttggactacatcatggggggttgtcaaattcagttcacagtagccatcgactttaccgcgtccaatggcgaccccagaaattcttgctccttacactacattcacccctatcaaccaaatgagtacctgaaggctctggtggctgtgggcgagatctgtcaggattatgacagcgataaaatgttccctgcctttggcttcggggcacgaattccacccgaatatactgtttcccacgacttcgctataaactttaatgaagacaaccccgagtgcgcagggatccaaggcgtggtggaagcatatcagagctgtctgccaaaactccagctctacggccctacaaatatagcaccaatcatccagaaggtggcaaagtccgcgagtgaagagaccaatacaaaggaggccagtcagtacttcatactgctcatacttactgatggtgtgattaccgacatggcggacacgcgcgaggccatagtacacgcctcccatctccccatgtccgtgataattgtgggggtgggcaacgctgacttctctgacatgcaaatgctcgacggggatgatggcatattgcggagtcctaaaggagagcccgtgctcagggatatagttcaatttgtccctttcaggaattttaaacatgctagtccagctgctctggccaagtcagtgttagctgaagtgcctaatcaggtagtagattactataacgggaagggaatcaagccaaagtgtagctctgaaatgtacgagagtagtcggaccctcgcaccttag

SEQ ID NO: 55259 - DNA, 510 bp, Artificial Sequence
  Description of Artificial Sequence: Synthetic coding sequence
atgaaaaagatgtctaacatatacgagagcgccgctaatactctaggaatatttaactccccatgtctgactaaggtggaattaagggtggcctgtaaagggatttccgatcgggatgcactttccaagcccgacccatgcgtcatacttaagatgcagagccacgggcagtggtttgaagtggaccgcacagaagtgataagaacatgcatcaatcctgtgtatagcaaactattcacagtcgacttctatttcgaggaagtccaacggctgcgcttcgaagtacacgacatctctagtaaccacaacgggctgaaagaggccgactttctgggaggaatggagtgcacactgggacaaattgttagccagagaaagcttagcaaaagtttactgaaacacggcaatacggccggaaagagttctataacagtgattgctgaggaattgtcagggaacgacgactacgttgagctcgcattcaacgctcgaaagctcgacgacaagtag

SEQ ID NO: 55260 - DNA, 1674 bp, Artificial Sequence
  Description of Artificial Sequence: Synthetic coding sequence
atgaaaaaaatgtctaatatttacgaatcggcagccaacacacttgggatctttaattcaccgtgcctgactaaagtggaactgagagtggcctgcaaaggaatcagcgatagagacgccctctcaaaacctgacccttgtgtaattcttaaaatgcagagccacggacagtggttcgaggtggacaggacagaagtgattcggacttgcattaatccagtctactccaagctgtttacagtggatttttacttcgaagaagtgcagagactgcgcttcgaggttcacgatatatcgtccaatcataacgggcttaaagaggctgattttctgggaggtatggagtgcaccctgggacaaatagttagccaaaggaagcttagcaaaagcctcctgaaacacggaaatactgcaggaaagtcgtcgataacggtcatcgccgaggagttaagcgggaatgatgattacgtcgaactcgctttcaatgccagaaaattggacgataaggatttctttagcaaatcggacccgtttttggagattttccgcatgaacgacgacgctactcagcaactcgtgcacaggactgaagtggtcatgaataatctgtcccccgcatggaaatcatttaaggtgtcggttaactctctgtgttctggagatcccgatagacgactaaaatgtatcgtgtgggattgggacagcaatggaaagcatgattttattggagaattcacaagcacattcaaggaaatgaggggggctatggagggcaaacaagtgcagtgggaatgtattaatcctaagtataaggcgaagaaaaaaaactacaaaaactccggaactgtgatacttaatctttgtaaaattcataagatgcactcttttttggattatatcatgggaggttgccagatccagtttacagtggctatagacttcacggccagcaatggtgacccacggaatagttgctccttgcattacatccatccttatcaacccaatgagtatctaaaagcccttgtcgccgtgggtgaaatctgtcaggattacgactcggacaaaatgtttccagccttcggattcggggctagaatacctccagagtacactgtgtcacacgactttgccattaatttcaatgaggacaacccagagtgtgccggaatccaaggcgttgtcgaggcttatcagagctgcctgccaaagctgcagctatatggccctacgaatattgccccaattattcagaaagttgcaaaaagtgcctctgaggagacaaatacaaaagaggcgagtcagtatttcattttactgatactgaccgatggggtgattacagacatggcggacacaagggaggccatcgtgcatgctagtcatctgcccatgtccgtgattatcgttggggtcgggaacgccgatttctcagacatgcagatgctggacggcgacgacggaatactccgatcaccgaaaggcgagccggtgctgagagatatagttcaatttgtgccctttcgtaatttcaagcacgcgtctcccgctgcgctggccaaatcagtccttgctgaagtgcctaatcaggtggtggattactacaatgggaagggcatcaagccaaagtgttcctccgagatgtatgaaagttctcgcaccctcgccccttag

SEQ ID NO: 55261 - DNA, 1728 bp, Artificial Sequence
  Description of Artificial Sequence: Synthetic coding sequence
atggcggttgagccatcctcctctgagagtataaaacggagagccggaagaagaatgaaaaaaatgtccaacatctatgaatcggccgctaacaccttagggatattcaactctccctgcttaacaaaagttgaattacgtgttgcttgcaagggcatctcagatcgggacgccctgtcaaagcctgacccctgcgtgatcctcaaaatgcaatcccacggccagtggtttgaggtggacagaacggaagtaataagaacatgcattaatccagtgtactcaaaactattcaccgtagatttctactttgaggaagtccagcgcctgcggttcgaagtccatgatatttcatccaatcacaacggcctgaaggaggccgatttcctagggggaatggagtgcaccctgggacagattgtttctcagagaaagctttccaagagccttcttaaacacgggaacaccgctggcaaatccagcatcaccgtgatcgctgaggaactatcaggcaatgatgattatgtagagcttgccttcaacgccaggaagctggacgacaaagatttcttcagcaagtccgatcctttcttggagatttttaggatgaacgatgatgctacacaacagctagtgcataggacggaggtggtgatgaataatttaagccctgcctggaagtcctttaaggttagcgtgaattccctgtgctctggtgacccagatcggagattgaaatgcattgtgtgggattgggatagtaacggcaagcacgattttattggcgagtttacttccacatttaaagagatgcggggagcaatggagggtaagcaggtgcagtgggagtgcattaaccccaagtacaaagctaagaagaaaaactacaagaactccgggactgtgatcctgaacctgtgcaagattcataagatgcattcttttttagattacatcatgggcggttgccagatccagtttacggtcgcaatcgacttcaccgcgagcaacggagatcctcggaatagctgctcgctccactatatacatccttatcagcctaatgagtatttgaaggctcttgtagccgtgggggagatttgtcaagactatgactcagataaaatgtttccagctttcggatttggtgcaaggatcccaccggaatacacagtgtctcatgattttgccatcaactttaacgaagacaatcctgaatgcgcagggatccagggggtggtggaagcctatcagtcctgcctcccaaaattgcagctgtacggcccaacaaacatcgctcccattattcaaaaggttgctaagagcgctagcgaggaaacgaatactaaggaagcctcccaatacttcatcctcctgatcttgacggatggtgtgataacagacatggcagatacccgggaggcaattgtgcatgcgtcacacttgccgatgagcgttataatcgtgggagttggcaatgcagacttcagtgatatgcaaatgctcgatggcgacgatggtattctgcggtcccccaaaggcgagccggtcttgagggatatcgtgcagtttgtgccgtttcggaattttaagcacgcaagcccagccgcactggccaagagcgtgctggcagaagtgcctaatcaggtcgttgattattacaacggaaaggggataaagcccaagtgttctagcgagatgtatgaatcctctaggaccctagcaccgtag

SEQ ID NO: 55262 - DNA, 1695 bp, Artificial Sequence
  Description of Artificial Sequence: Synthetic coding sequence
atggattcgcggtacaacagtaccgccggaattggcgatcttaaccagctttccgccgctatcccagcaacccgcgtagaagtgagcgtcagttgccggaacctcctcgatagagatactttcagtaagagcgaccctatatgtgtgctctacgtgcagggggtgggtaataaggagtggcgggagttcgggagaacagaagtgatcgataatacgctcaaccctgattttgtgagaaaatttatcctcgactacttcttcgaggaaagggagaatttgcgctttgacttgtatgacgtggatagtaagagtcctaacttgtccaaacacgacttcctgggtcaggtgttctgtacccttggggagatcgtgggcagtcaggggtctagactggagaagcctatagttggaatccctggcaagaagtgtgggaccattattctaacggcagaggagctgaattgctgtcgcgacgccgttctaatgcagttctgtgcaaacaagctcgataagaaagacttctttggcaagtctgatccattcctggtgttctacaggagcaatgaggatggcagtttcaccatctgtcacaagaccgaagtggtgaaaaacacactgaaccctgtatggcaggccttcaagatctctgtgagagccttatgcaacggcgactatgaccgcaccataaaagttgaggtgtacgattgggatagggatggctcacatgactttatcggcgagtttactaccagttaccgggagctgtctcgaggacagtcccagtttaacgtctacgaagtagtgaatcctaagaagaagggaaaaaaaaaaaagtacacgaacagtggaacagtgactttgctgtccttcctggttgagacggaagtctccttcttagattacatcaaaggcggtacacagattaattttaccgtagccatagatttcacagcctcgaacggcaatcccgcacagcctacatctctccattatatgaatccctatcaactgaatgcctacggcatggctctcaaagccgtaggcgagatcgtccaggattacgattcagataaaatgttccccgctctcgggtttggggcaaagctgccgcctgacggcagaatctctcatgaatttgcacttaatgggaacccccaaaacccatactgcgacgggatcgaaggagtaatggaagcatattatcgaagtttgaagtccgtgcagctgtatgggcctacgaacttcgcccctgttattaatcatgtcgccaggtacgcaagttccgtgaaggacgggagccaatactttgtgctgctcattgtgaccgacggcgtgatcagtgacatggcccagaccaaggaaagtattgtgaatgccagcaagcttcctatgtctattattatcgtgggtgtcggacctgctgaatttgacgcgatggtggaacttgatggggacgatgttagggtaagtagccgaggcaaatacgccgaaagagatattgtgcaatttgtgcctttccgggattatatcgataggtcggggaatcatattttgagtatggcacggctggctaaagatgtgctcgccgagataccagagcagttcttgtcctatatgcgagcacgaggcattaaaccctccccggctccccctccgtacacacccccaacccatgtgctgcagacacaaatatag

SEQ ID NO: 55263 - DNA, 3786 bp, Artificial Sequence
  Description of Artificial Sequence: Synthetic coding sequence
atggacgcaccccgagcctccgccgcaaagccccctaccgggagaaagatgaaagctagggcacctccccctcctgggaaggctgccacgcttcacgtccacagcgaccaaaaaccgccacacgatggagctctcggctcccagcaaaatctagtccggatgaaagaagctctgagagcttccaccatggacgtgactgtggtgctgccttccggcttggaaaagagatccgtcctgaacggctcacatgctatgatggacctgctagtggaactgtgccttcagaatcatctcaatcccagtcatcatgccctagagataaggtcctctgaaacccagcagccattgagttttaagcccaacacactgataggaacactgaatgtacacaccgtcttcctcaaggagaaggtgcccgaggaaaaagtgaaacctggaccacctaaggtccccgaaaaaagcgtgaggcttgtggtcaactaccttcgcacgcagaaagccgtcgtgagggtatctcctgaggttccacttcagaacatcctgcctgttatttgcgccaaatgtgaagtttctcctgaacacgtggtgcttttgcgggataacattgctggagaagaactcgagctgagtaagtctctgaatgaacttgggatcaaagagctatatgcatgggacaaccgcagagaaaccttcagaaaaagcagtttaggaaatgacgaaacagacaaggaaaaaaaaaaattcctcggattcttcaaggtaaataaaagaagtaattctaagggctgccttacgaccccaaactcaccatccatgcacagtagatctctaaccctgggcccttcgttgtcactcggatctatttctggtgtctccgtgaaatcggagatgaagaagaggagagctccgccaccccctggctctggccctcccgtccaagataaggcgtcagaaaaggtttccctgggcagtcaaatagacctacagaaaaagaagcgacgtgcccctgccccaccaccaccgcagcctcctcccccatctccacttataccaaacaggacagaagacaaggaagagaaccggaagtcgactatggtgtctctgcccttaggaagtgggagtcactgttctcccgacggagcaccgcaggtcctctcagaggcggaggaaaccgtgtccgtgggttcctgctttgcctctgaagacactaccgaagacagtggcgtgatgagcagtccttccgatattgtttccttagactcacagcaagattctatgaagtataaggataagtgggcaacagaccaggaagactgctctgaccaggacttggctggaacccccgatctggggccacaaaagtcacctctgtgggaaaagaatgggtccgagaatagccacctccgcaccgagaaggccgtgaccgcttcaaatgacgaggaagaccttctcattgctggcgagtttcgcaaaaccctagcagagcttgacgaggacttggaggaaatggaagacagttatgagacagacacctctagcctgacttcttccatacatggagccagcaatcattgtccgcaagatgccatgattccacacggtgataccgatgccattcctgtaaccttcatcggcgaggttagcgacgaccccgtcgattcgggcctgtttagtaacagaaacaacaacgcagggagctttgactctgaaggtgttgcaagccgaagagacagtcttgcgcctctccaagcagagcattctcagcctcacgaaaaagcgagagaggaggtccctgctctgcaccccgcatctcatgatgtgggcaaaggcatcagagtggccctgagtaatattagcaaagacggcaacttgatggagaccgcaccgagggtgacatcattcgctagtaacctgcacactgacaatttgaatgccaaggtgaaggataaagtgtatgggtgtgcagacggggagaggacacaggcaactgagcgcgtcaactcccagccggtgaatgagaaagattcgaacgacaagaacgcagctctggccccaaccagttggcaccaacgcggtcagaatccaggcaagtcctaccgtctcaagcacggactgacaacgtacaaaattatcccacccaagagcgagatgaggtgctacgaccgtgacgtaagtctgtccacaggggctattaaaattgacgagctcggaaacctggtgtccccacacgccacgggcataagaatcataagcctttcatcctccgtccctgaggccgagtctcagccaattggcaaagtgcgagagttctggcgctgcaatagcgtcgaaaaacatctagggagaccctcggagagcagcgcacgtggccctccttctacaccagtgccgactcagacccagaatcccgagagtagactgcaggctgacccgaagcctataagtccgcagcagaaatcagctcatcacgaggggaggaatcccctcggggagggcagaaatcagcctcctacaatgggtatggggcatgttagagtgcccgcagcccatactacggaagtgacatttctgaaaccgcagcgcaggactagcagtcaatacgttgcctccgccattgctaagcgcataggagctcccaaggtgcacgctgatgtggtgcggcctcacgggtacgcggagaaaggctacgctggcaaggcgcctgtgctggcagctcctccagttacagtcaaagacgacaggaccagcagcccccactccgagactcagggctggaaagatggggctcagtggccgtgtgtgaccccgccaaacaatcacggtgaggacctggccgtgggggctcctccccgaggtgaggtgatcggtccgcacaggaagctctctactcaggacagacctgcagctatacatagaagttcttgcttcagcctggttcaaagctctcagagggacagggtctccgtaggccagagctgcggtttttccggcaaacaaagtactagttcccaggaagcgtcctctgctagcgaaccaaggcgggcacccgatggcaccgacccaccgccaccccatacttctgacacacaggcttgcagtcgagaacttgtcaatgggtccgtccgtgcaccagggcacggagaaccgtcacatcctccaggagggtcaggaactgaaagccatatacttctagaacgtgaagagaagcctagtgtcttctctacagacggcaacgagacagatagtatttggccaccttccatcttcggccctaagaagaagttcaaaccggtagtgcagcgcccagtgcctaaagacacatccctgcactccgccctcatggaggccattcattcagccggaggcaaggaccgactgcggaagactgctgagcacaccggggagggaagaccggctaaattatcatacactgaagcggagggtgaaaggtcggctcttctagctgctatcaggggacatagtggaacctgctctctgagaaaggtagctagctcggcttccgaggagttgcaatcatttagggatgctgcactctctgcacagggctctgaatcccccctgctcgaggatctggggctcttatcccctcccgctatccccccaccccctcccccacctagccaagccttgagcgcccctaggaccgcctcccggttttctacaggaactctatctaataccgccgatgctagacaggctctcatggatgcaataaggagcggcaccggagccgctcgcctgaggaaagtgcctctgctggtctag

SEQ ID NO: 55264 - DNA, 1410 bp, Artificial Sequence
  Description of Artificial Sequence: Synthetic coding sequence
atggatgctccacgggcttccgccgctaaaccgccaaccgggaggaagatgaaggctcgggctccaccgcctcccggtaaagccgctacactgcacgtacatagtgaccagaagccccctcatgatggcgctctaggatcacagcagaacctggtgagaatgaaggaggcactccgagcgtccacaatggacgtgactgtagtcctcccgagcggtttagaaaagagatctgtcctgaacggatcccatgctatgatggatttattggtggagctttgtcttcaaaatcatctaaatccctctcaccatgcactcgagatccgttcgtctgagacccaacagcccctgtctttcaaaccaaacaccctgatcgggaccctaaacgtccacaccgttttccttaaggagaaagtgcctgaggagaaggtcaaacccggtcctccaaaagtgccggaaaagtccgttcgattagttgtgaattatcttcgaacacagaaagctgtggtgcgggttagtccggaggttcctctgcagaacatcctccctgtgatttgcgccaagtgcgaggtatctcctgagcacgtggttttactccgagacaacatcgctggagaagagctagagctgtccaagtcccttaatgaactggggatcaaggagctttatgcatgggacaaccgcagggagacttttcgtaagtctagtttagggaatgatgaaacggacaaagagaagaaaaagtttttggggttttttaaagtaaacaaaaggagcaattctaaaggttgcttgacaacccccaactctccaagcatgcacagtaggagcctgacgctgggcccatctctgagtctaggatcaatcagtggcgtgtccgtgaaatccgagatgaaaaagcgcagggccccaccacccccaggctccggaccgccagttcaggataaggcttctgaaaaggtcagcttggggtctcagattgacctgcagaagaaaaagaggagggccccagccccacctcccccacagcccccaccaccttctccactgatacccaatagaacagaagacaaagaggaaaacagaaagtccacaatggtgtatggagcagcagaggctgtgatccgcctgttgagtctgctgctaaacactacagccccagggactgccaaaccacgcacgttatggatgtccgaagggagatcctctctccataacccagagatcaagtgtagttgcttttcctctagttctccttttccccaatccctgctttccttgttgctcggcctgagtagtatctgtgaatgcatgtgcacgctgaggcatacacatgctcatacacacaacccaagctgcgtcttacctacctctgagatcctggcatttgggaggcagagtctgatcagctag

SEQ ID NO: 55265 - DNA, 4032 bp, Artificial Sequence
  Description of Artificial Sequence: Synthetic coding sequence
atggacgcacccagagcgagcgcagcaaagcctccaacggggcgaaaaatgaaggccagggccccaccccctccaggcaaggcagccacgttacacgtgcatagcgatcagaaaccgcctcatgatggggcactaggttctcagcagaacttagtgcgaatgaaggaagctctaagagccagcacaatggacgtgacggtggttcttccatccggactggagaagcggagtgtgctgaatgggtctcatgcaatgatggatttgctggtagagttatgccttcagaatcatcttaacccatcccaccacgccctggagataagaagctcggagacccagcaacctttatctttcaagccgaatacactgataggcactcttaacgttcataccgtgttcctgaaagagaaagtgccggaagaaaaggtgaaaccaggccctcctaaggttcccgagaagtccgtccggttggtcgtgaactacctgcggacccagaaagcggttgtccgtgttagccccgaggtccctctccagaatatcctgccagtgatctgtgctaaatgcgaggtcagcccagagcacgtggtgctgctgagagacaatattgctggggaagagcttgagctgtccaagtctcttaacgaactcggtatcaaagaactgtatgcgtgggataaccggagggagacttttcgaaaaagcagtttaggcaacgacgaaaccgacaaagagaaaaaaaaatttctgggcttcttcaaagtgaacaagaggtccaatagcaaagccgagcagttggtactgagcggtgctgacagcgacgaggacacgagtcgagcggcacccggtcgcggtcttaacggctgcctgaccacccccaattcacccagcatgcattctcggagcctcacgctggggccaagcctctcattgggctcaattagtggggtgagtgttaaaagtgagatgaagaaacggagagcccctcccccaccaggatctgggcctccagtccaggacaaagccagtgagaaagtatctcttggatcccagatcgatctgcagaagaagaagaggcgcgcacctgcccctcccccacctcaaccacctcctcccagcccgctcatacccaatcggaccgaggataaggaggagaaccggaagtccacaatgggtggaggaaggcaggtgccacagaagccaccgcgaggcacagctagggggccacctcagcttgttctccctcctcctcctccctacccccctccagacacagacgtggtagaacccctgagtttccccggagagggggcaggttcagaagcctccgacccaattcccaaactcagcctcccactgggaagcggaagtcactgctcccctgatggcgcaccccaggttctctccgaggctgaggagacagtctccgtgggtagctgcttcgcaagcgaggataccaccgaggattctggagtcatgagctctccttccgacattgtgagcctagactctcagcaggactccatgaaatataaagataagtgggcaacggatcaggaagactgttcggaccaagatctcgccggaactcccgatctcggaccacaaaaatctccactttgggagaaaaatggttccgagaattctcacctcaggacagaaaaggctgtgacagcctcaaacgacgaggaggatctacttattgcgggagagtttaggaaaacactggccgagttggatgaggacctagaggagatggaggattcatacgaaacagacacatcctcattgacctcgtccatacacggggctagcaaccactgtcctcaggatgctatgatacctcacggggacacagatgcaatccccgtgacttttatcggggaggtaagtgatgaccccgttgactctggactgttttccaataggaataataatgcaggcagtttcgactctgaaggagtagcctcacgaagagactctctagcgcctctgcaggctgagcattcgcagcctcatgaaaaagccagggaggaagtgcctgcactgcacccagcatcccacgacgttggaaaggggattcgggttgccctatcgaatatcagtaaggatggaaacttaatggagactgcgccaagagtaacctcattcgcgtctaatttgcacaccgacaatctgaacgcaaaagtgaaggataaggtgtatggctgtgccgacggggaaagaacacaggccactgagcgggtgaattctcagcccgtaaatgaaaaggattcgaatgataaaaatgccgctctggctccaacgtcatggcaccagagaggacagaatcccggaaaaagctatcgactcaaacacggcctcactacctataagatcatcccacccaaatcagagatgcgctgctatgatcgcgacgtgagtctgtctactggagcaataaagatcgatgagctcggcaatttagtgagccctcatgcaacaggcatccgaattattagcttgtccagctccgtccccgaggctgaaagtcagcccatcggtaaagtgagagagttttggcggtgcaacagcgtggagaaacatctgggcaggccctctgaaagctccgccagaggcccaccttccacccccgttccaactcagacacaaaacccagagagtcgattacaggctgatcccaaacccatctccccacagcagaaaagtgcccaccacgaagggcgtaatccactgggcgagggcagaaaccagcccccaaccatgggcatgggacacgtgagggtacctgcagcccacacaacagaggtcactttccttaagcctcagagacggaccagtagccagtacgtggcctcagccatagctaagaggattggagccccaaaggtccatgctgacgtggtgcgaccacacggttacgccgagaaaggctacgccggaaaggcgcctgtattggccgctcccccagttacggtgaaggatgataggacgagcagtccacactctgagacccaagggtggaaagacggcgcacaatggccttgcgttacaccacctaacaaccacggggaggacttggccgtgggagcaccccctagaggagaagtcattggccctcatcgtaagcttagtacccaagatagaccggcagcaatccaccggtcatcctgctttagtctcgtccagagtagtcagcgagaccgggttagcgtgggacaatcttgtgggttcagcgggaagcagagcacatccagtcaagaggcctcatcagcatcagagcctcgacgggcaccagacggaacagatccaccccctccacacacctccgacacacaggcctgcagccgagagttggttaacggttcggttagagccccaggacacggtgaacccagccatcctcccggaggttcaggaacggaatctcatattctgctggaacgtgaagagaaaccttcagtgttcagtactgacggtaatgagacggactccatatggcccccttccatattcggacctaagaagaaatttaaacctgtagtgcagagacccgttccaaaggatacgtctctacattccgctttaatggaggccattcactccgccggagggaaggaccgcctgaggaagacagcggagcacaccggcgagggaaggcccgcaaaactgtcttatacagaagccgagggggagagaagtgccctactggctgcaattcggggacactcagggacatgttccttgcgaaaggtggccagttctgcttctgaagaattacagtctttccgagacgccgcactgtctgcacaaggctccgaatcaccgctcctggaagatctcggactgcttagcccacctgccatccctccccctcccccacctccaagtcaggcgctgtcagctccgcgaaccgctagccggttctcgaccggaactctttctaacacagcagacgcccgacaggccttaatggacgctattcggagcggtaccggggctgcaaggctgcgaaaagttcccctactggtttag

SEQ ID NO: 55266 - DNA, 3441 bp, Artificial Sequence
  Description of Artificial Sequence: Synthetic coding sequence
ctcagggataatatcgccggagaagaactcgagctgagcaaatctctgaacgaactgggcatcaaagagctctacgcgtgggacaatcgacgtgaaacctttagaaaatctagtctagggaacgacgaaacagataaggagaagaagaagttcctgggatttttcaaggtgaacaagcggtcaaactccaaagccgaacagctcgtgttatctggagctgactccgacgaagacaccagtcgcgcagctcccggtagaggcctcaatggctgccttaccactcctaacagcccatccatgcactcccgctcacttactctcggcccttctctgtcgctggggtcaattagtggagtctctgtgaaaagcgagatgaaaaagagaagagccccaccacctccaggaagcggccctcccgtgcaggacaaggctagcgagaaagtctctctagggtcacagattgatctccagaaaaagaaaagacgggctcccgctccccctccgccacagccccctcctccttctcccctgatacccaaccgcactgaggataaggaagaaaaccgcaaatccacgatgggtgggggacggcaggttccccagaaacctcccaggggtaccgctcgcggtccaccacagctcgtgctgccccctccgcctccctatccaccacctgatactgatgtagtggagcctctatcctttccaggcgaaggggcaggaagtgaggcctctgaccctataccgaagctgtctctccccctcgggtccggctcgcattgttctcccgacggagcaccccaggtgctcagcgaggcagaagagacggtcagtgtggggtcttgtttcgctagtgaggataccaccgaagacagcggcgtgatgtcgtctccctcagacatcgtatcactggacagccagcaggatagtatgaagtataaggacaagtgggctacagaccaagaagactgctcagatcaggacctggctggcacccccgatcttggcccacagaagagccccttgtgggagaaaaacggatctgagaattctcatctgaggaccgagaaagccgtgactgcatccaatgacgaagaagatctgctgatcgcaggggaatttagaaagacactcgccgagctggacgaggacttggaagagatggaagacagctatgaaaccgacacttcttctctcacgagcagcattcacggggcttccaatcactgtccccaagacgctatgataccccacggcgacactgacgccatccctgtcacctttattggcgaggtgagcgacgatccggtggactcgggcctcttctcaaatcggaacaacaatgctggaagcttcgacagtgaaggggtagcctctaggcgggattcattggcaccactgcaggcagagcactctcaaccccacgagaaggcccgtgaagaggtgccggcattgcaccccgctagtcacgatgtggggaaaggaattcgcgttgcgctcagcaacatctctaaggatggcaatttgatggagaccgcacccagggtaaccagtttcgcttctaatctgcatactgataacctgaacgcaaaggtcaaggacaaggtgtatgggtgcgctgatggggaacgaacccaggcaacagaaagagttaactcccaaccggtgaatgagaaagacagcaacgataagaatgccgcattggctccaacctcttggcaccaaaggggtcagaaccccggaaaatcctacagactgaaacatgggctgacaacatataagattatcccccctaaaagtgaaatgcggtgctatgatcgtgacgtgagtctgagcactggagccataaagattgacgaactaggcaatcttgtgtccccgcatgcaaccggcattcggattatttccctttcttccagcgtacctgaggccgagagccaacctataggtaaagtccgcgaattttggagatgtaatagcgtagaaaagcaccttggcagaccgagcgaaagcagcgctaggggccctccttcaacaccagtcccgacgcagacccagaacccagaatcccgattgcaggctgatcctaaaccgatttctcctcagcagaagtcagcccatcatgaaggccgtaatcccctcggcgaaggccgaaaccagcctcctacaatgggtatgggccacgtccgggtgccagctgcccacactacagaagttacattcctgaaaccccagcgaagaactagttcgcaatatgttgcaagcgccatcgcgaaaagaatcggcgctccaaaagtccatgctgatgtcgtgcggcctcacggatatgccgaaaaggggtatgctggcaaggcccctgttttggccgcacctccagtgaccgtcaaggacgatcgcacatcatccccacatagtgagactcaaggctggaaggacggggcacagtggccctgtgtgacccctcctaacaatcatggcgaggacttagcagtgggcgctccccctaggggggaggtgattgggcctcacagaaagctcagtacgcaggacagaccagccgctatccaccggagtagctgtttctccctcgtgcagtcatctcagagagatcgtgtgagcgtgggacagtcttgcggcttctctgggaagcagagcacctcaagtcaagaggcatccagcgcctccgaaccaaggcgagcccctgacggaacagaccccccacccccacatacttcagatacccaggcttgctccagggagctcgttaatggctctgtgcgcgctccagggcacggagagccctctcaccctccaggaggaagtggaaccgaatcacatatcctgctggaaagggaagaaaaaccttctgtgttctccacagatggaaacgagaccgacagcatatggccaccgtccatcttcggcccaaaaaaaaagtttaagcccgtcgtccagcgccctgttccaaaggacacctctctgcacagcgctctgatggaggcgatccactctgcaggaggtaaggaccggttacggaagaccgcagagcataccggcgaaggaagacctgccaagctgagctacactgaagcagaaggcgaacgctcagcactcctcgccgctatccggggacatagtggtacttgttctctccggaaagtggcctccagcgccagtgaggaactgcagtctttccgggacgccgcattgtccgcccagggatccgagtctccactcttggaggatttagggttactgtccccaccggcaatcccgcctcccccacctcctccatctcaggccctgtcagcacctcggaccgcaagccgattttccacaggcactttatccaacactgcggatgcgaggcaggctctgatggacgcaatccgttcagggactggagctgcaagactgcggaaggttccgctgttggtgtag

SEQ ID NO: 55267 - DNA, 1140 bp, Artificial Sequence
  Description of Artificial Sequence: Synthetic coding sequence
atggatgctccacgggcttctgccgcaaagcccccaaccggtagaaagatgaaagcaagggccccaccccctcctggaaaagcagccaccttgcatgtgcatagtgaccagaaaccacctcacgatggcgctctgggctcccagcagaacctggtgcgaatgaaggaggctttaagagcctcgactatggacgtcacggttgtcctgccaagcgggctggagaagaggagtgttctcaacgggagccatgccatgatggatttactggtagaactgtgtctgcagaaccacctcaatccatcccaccacgctctggagatcagatctagtgaaactcagcaaccactttcttttaaacccaataccctaatcggaactctgaacgtgcacacagtcttcctgaaggagaaggtgcctgaagaaaaggtgaaacctggtccgccaaaggtgcctgaaaagtccgtgcggctcgtcgttaattatctgagaacacaaaaagctgtggtaagagtgagtccagaagtgcccctgcagaatatcctgcctgttatctgtgctaagtgtgaggtgagccctgagcacgtggtgcttctgcgcgataacattgccggagaggagctcgaattgtcaaagagcctcaatgaactaggtataaaagagttgtacgcgtgggacaacaggcgggaaacctttaggaagagctccctgggcaatgatgaaactgacaaggagaaaaagaaatttctggggttttttaaggtgaacaagcgtagcaattctaagggttgtctgaccactccgaatagcccgtctatgcattcccggtctcttacccttgggccaagtctgagccttgggagcatcagcggggtttcagtcaaaagtgagatgaaaaagaggagagcccctcctcctcccggttcaggacctccggtgcaggacaaggccagcgagaaagtcagcttgggatctcaaatcgacctccagaagaaaaaaagacgcgctcctgcaccacccccaccgcagccacctccacccagcccattgatcccaaataggacggaggacaaagaggagaatcgtaagtctaccatggtctactgctgcgcttcatttccaacacaggccaagcggttttag

SEQ ID NO: 55268 - DNA, 825 bp, Artificial Sequence
  Description of Artificial Sequence: Synthetic coding sequence
atggaggacagctacgaaacagatacatcttccctcaccagctcaatccacggggctagcaaccactgcccccaggacgccatgatcccacatggcgacaccgatgctatccccgtcacatttattggcgaggtttccgacgaccctgtggatagcggattattctcaaaccggaacaacaatgcgggaagctttgatagcgagggggttgccagtcggcgtgactcactggccccactgcaagccgagcactcacaaccacatgagaaagcacgggaggaggttcctgcactccacccagcttcacatgacgtcgggaagggcattcgtgtggcactttcaaacatatccaaagacgggaacctgatggagactgcacctcgtgtgacctcatttgcctctaacctacatacagacaacctgaatgcgaaggtgaaggataaggtgtacgggtgtgcggatggcgagcggacgcaggccacagaaagggtgaacagtcagccagtgaacgagaaagacagcaatgacaaaaatgctgctcttgcccctactagctggcatcaacggggtcagaacccagggaaatcataccggttaaagcacggcctcacaacctataaaattattccccctaagtcagagagttctggcggtgcaacactttggaaaaatacctgggccgatccccagagggcactgcccggagaccccccacctcctctgtgtcccagacgtagacgcattcagcgggcagacagcaaacagactccgtctcagtatcgcccaagtaggtcactaccgaccatgcgcgcagggactccctag

SEQ ID NO: 55269 - DNA, 2523 bp, Artificial Sequence
  Description of Artificial Sequence: Synthetic coding sequence
atgaacagatttcgcgtctctaaattccgccacacagaagcccgtcccccacggagagaaagctggatctccgatatcagggcgggaacagctccatcatgcaggaatcatattaaaagcagctgttccctgatcgcttttaacagcgatcgcccaggcgttttaggaatagtgccgttgcagggtcagggcgaggacaagcggagagtggcacatctggggtgtcactcagaactggccgcacatggggatctggtgcagtccgccgtctggtcgagggacggagccctggtcggcaccgcatgtaaagacaagcagttacgcatcttcgaccccaggaccaaaccccgagcgagccagtccacccaggcccacgaaaacagtcgcgacagccgactggcttggatgggaacgtgggaacacctggtatccactggctttaatcaaatgagagagagagaggtgaaattatgggacacaagattcttctcatcagccctggcctctcttactctcgacacttcattgggatgcttagttcctctcctcgacccagattccggcctcctcgtcctagcaggaaagggcgaacgccaactttattgctatgaagtggtgccccagcagcccgctttgtcacctgtaacacagtgtgttttggagagtgttttgagaggcgcagctctcgtgcctcgccaggccctagccgtcatgtcatgcgaagtgttacgggtcttacagctctcagataccgcaatcgtacctatcgggtatcacgtgccgagaaaggccgttgagtttcatgaggacctttttccagataccgccggttgcgtcccagcgacagatccccattcctggtgggctggcgataatcaacaggtgcagaaggtgagcctcaacccagcttgtagaccgcatccatcctttactagttgcttggttcctccggctgaaccactgccggacacggcccaaccggctgtgatggaaacaccggtcggcgatgcagacgcatcagaaggcttctccagtccaccctcatctcttacatcacctagtactcctagttctttaggtccttcactgagctctacatcgggcatagggacatctccaagcctgcgctcactgcaatctctgttaggtccatcgagcaagttccgccacgcacaaggcaccgtcctccatagagactctcatatcaccaatttaaaagggctgaatctgactacacctggtgaatccgacggcttctgcgctaataagctaagggtagcggtgcccctgctgagcagcggcggacaggtagccgtcctggagctcagaaaacccggtcgcctgcccgacacagcgctgcccacactgcagaacggggctgcagtgacggacttagcgtgggacccgtttgatcctcataggttggccgtggccggtgaagacgcaaggatccgcctatggagagtccctgctgaggggttggaggaggtgctcaccacacctgagacagtcctgaccggacacacggaaaaaatatgcagtctgcgctttcaccctctggctgcaaatgtcctggcttcttcatcttacgacctgactgtgaggatctgggatctccaggcaggagcggatagactgaaacttcaggggcaccaggatcaaattttctccctagcatggtcccccgatggacagcaactggcgactgtgtgcaaggatggtagagtgcgagtgtataggcctcgctccggacccgagccactgcaggagggtccaggcccaaaaggaggtcgtggtgcacgaattgtatgggtatgcgatggtcgttgtctcctggtttcaggatttgattctcagagcgaacgccagctgctcctctatgaggccgaagcgctagcaggcggaccacttgcagtcctgggcttagacgtagcccctagcacacttctgccgtcatatgaccctgataccgggctggtactgcttacggggaaaggcgacacccgagtgttcttatatgaactgctccctgagtcaccgttctttttagaatgcaatagcttcacctcaccagatccccacaaaggtttggtactgttgcccaaaacagaatgtgacgtgcgtgaagtcgagctgatgaggtgcctgcgcctccggcagagttctctggaaccggttgcttttcgtcttcccagagtcagaaaagaattctttcaagatgatgtatttcccgatacagcagttatttgggagccagttcttagcgcagaggcttggctacagggcgctaatggccagccatggttactctctctccagcctccggatatgagtccggttagccaggcacctcgagaggcccctgcccgaagagctccatcttccgcacagtacctggaggaaaaaagcgaccagcagaaaaaggaagaactgctgaatgctatggtcgccaaactcgggaacagagaagaccccctgcctcaggactctttcgaaggagtcgatgaggatgagtgggactag

SEQ ID NO: 55270 - DNA, 246 bp, Artificial Sequence
  Description of Artificial Sequence: Synthetic coding sequence
atgtcaagcacttactgcggtaactcctccgccaagatgtcggtaaacgaagtgtctgctttctccctgactttggagcagaagaccgggttcgcctttgttgggattctttgcatcttcctgggcctgctgataatacgctgcttcaaaatcctgcttgatccttatagctcaatgccgtcgagcacctgggaggacgaagtggaagaatttgacaaaggtacatttgagtatgcactggcatag

SEQ ID NO: 55271 - DNA, 246 bp, Artificial Sequence
  Description of Artificial Sequence: Synthetic coding sequence
atgagcagcacctattgcgggaacagcagtgccaagatgagcgtgaacgaagtcagcgcattttcgctgactctagagcagaaaacggggttcgcctttgtgggtatactctgcatattcctcggccttctcataatccgctgcttcaagattcttttggatccttactcctccatgccaagctctacgtgggaggacgaagtcgaggagttcgacaaaggcacgttcgagtatgccttggcatag

SEQ ID NO: 55272 - DNA, 906 bp, Artificial Sequence
  Description of Artificial Sequence: Synthetic coding sequence
atgagctacccgaccaaagagggttctgacacggccggtaatgcgcacaagaactccgaaaatgagccacccaatgactgtagtacagacatcgaatcaccaagcgcggatccgaatatgatttaccaggtggaaacaaatcctataaatagagaacccggaacagcgacatcccaggaggacgttgtgccacaggccgctgaaaactctgagctcgagaccgagatccagaaggatcagcgagaggaggatctgaaagaagaacttctgttgctacagacccccattcctcggaagctagtaagtcacaaacccctgaacgacaggtcacgctctcactctgggaaagtcgagatgaaggcaaacaatttccctatcaaccacaagaccagatttagactgtccacatcctggcgggtgccatttatcaacagtcacgagattagaagcatgatcttgcacttgctctgcgaccgatatttttcccaagccgcaggttgccagaatactatgtgggtcaagaggaagtatatcgcgtgcttgtaccaccctaattcattcactcaccacgaacgggcaatcacctttcgacgaccctctagggtacactactacagaccgctgacagaaagaatgacaagcggtaaattctgtaagtccaccgacaccaaggggaaatgcagattccgggctatcgtcaggtccgtcttgttcgtgagccagattcaaatcgaatctatttttaacatcaaaggctttgtggacatactgacctatatccacacaatgaatgttatgattaccaacaccaataacggctggaagtacttctgcccaatatgtgggagactgttcaacacgtattcagagctgaggcagcatagctgcagttcaagtggtaactag

SEQ ID NO: 55273 - DNA, 906 bp, Artificial Sequence
  Description of Artificial Sequence: Synthetic coding sequence
atgagctacccaacaaaagagggcagcgacaccgctggtaacgcacataagaactctgagaacgagccaccaaatgattgtagtacagatatcgagtcaccctctgcagatccgaacatgatttatcaagtggaaaccaatccaattaatcgtgaacctggcaccgccactagccaggaggacgtggttccacaggcagcagagaacagcgagctagagaccgagattcagaaggatcagagggaggaggacctcaaggaagaactgctgcttctgcagactccgatacccagaaagctggtgagtcacaagccattgaacgaccgcagccggagtcatagtggaaaggtggagatgaaagctaacaacttcccaattaatcacaagacacgtttccggctatcgacatcatggcgagtgcccttcatcaactcacatgaaataagatctatgatcttgcatctgctatgcgaccggtacttctcccaggcagccggatgtcagaacacaatgtgggtaaaacggaaatacatcgcctgcctataccaccctaattctttcacacaccatgagcgggctataaccttcaggagaccttctcgggttcattactatagacctctgaccgaacgcatgaccagcggtaagttttgcaagtcaacggataccaaaggcaaatgtagatttagagccatcgtaagatcggttctgttcgtcagccaaatccagattgaatccatttttaatatcaagggtttcgtggacattttaacctacattcacaccatgaatgttatgatcacaaatacaaacaacgggtggaagtatttttgcccaatatgtggcaggctgtttaacacatattctgagctgcgtcaacacagttgctcctcttcgggaaattag

SEQ ID NO: 55274 - DNA, 1935 bp, Artificial Sequence
  Description of Artificial Sequence: Synthetic coding sequence
atgctgaggactgatgccggtgaggatcttgctgatgcaccagccgaggagttgcaggagaaggggtcgccagctgggcctccaccgtcacaagggcaaccggctgctaggcccccaaaagaagtccccgctagccggttagcccaacaactcagagaggagggctggaatttgcagaccagcgagagtcttactctcgcagaagtatacctcatgatggggaagcccagtaaactgcagctggagtatgactggcttgggcctggccgtcaagaccctcggccaggatctctgccaacagcactccacaaacagagactcctgagctgcttgctgaaactgatcagtactgaagtcaacccaaaactcgccctggaagctaatactatatctaccgccagtgtgcgccctgcccaggaggagcagtccatgacacccccagggaaggtagtcactgtgtccagccggagcccacggtgccctagaaaccaagcatccctcagatccagcaagacattccccccatcttccgcaccctgctccagcggacttagaaaccccccacgcccattattagtacctggccctagctccaccggctccaatgattctgatgggggactgtttgcagttccaactacactccccccaaacagccgacatgggaagctgttttcgccctcaaaagaggccgagctaacgtttcgccaacacctcaactctatctcgatgcagtccgactttttcctacccaaacctagaaagttgcggaatcgtcacctgaggaagccactggttgttcagagaacccttttacctcgcccttcggagaaccagtctcacaatgtgtgcagctttagcatcctcagtaactcatcagttaccggacgcggtagcttcagaccaatacaaagctccctaactaaggcggcattatcacgacccattgtcccaaaggtgttacctccacaggccaccagtcatctggcctctgcgattgacttggccgcaacttccgctggaatcctttctgggaatccactcccggctcttgatacagaaggcttgtccgggatttcacccctgagttccgatgaggttacaggcgctatctctgggcaggattccacaggcacccaccaggacggcgacacgcttccaactgtgggcggttcggatcccttcgtcagcatcccctcaaggccagaacaggaacccgtagcagattccttccaagggtcctctgtgctgtcattgtccgagctccctaaagccccactccaaaatgggctctctatcccactgtccagcagtgaaagcagcagcactcgcctttcaccccctgatgtgtcagctttgctggatatcagccttccaggacccccagaggacgccctatcacagggggaaccggctacgcatatcagcgattctatcattgaaatcgccattagctcaggcgaaggcgtgcctctgagcccggcaaagctgaatggctcagattcctccaagtctctacccagtccaagttcatcgccacagccccattggatcgcttccccaacccatgacccccagtggtacccttctgatagtacggacagctccctcagcagtctgttcgcatcctttatttcgcccgaaaagtcacggaagatgctccctacaccaattgggaccaatagtggcacctctttattgggcccttcattgcttgacggtaactcacgtgacagtttcgtgtctcggtcgctagccgatgtggccgaagtcgtggattcacagctcgtgtgtatgatgaacgaaaattccatcgattacattagccgcttcaacgatcttgctcaggaactgtccatcgcggagcccggacggagagaggcattgttcgacgggggtgggggtggacccgcagtgtcagacctgtcccagtag

SEQ ID NO: 55275 - DNA, 3810 bp, Artificial Sequence
  Description of Artificial Sequence: Synthetic coding sequence
atgacagtgaagctgggcgacggcggttctggggaagacggattgaaaaagctggggaaacgcgctgccgatgaggaatccctggagggagagggcgctggaggtgccgatgcagcagaggaaagtagtggcacaaagcgagacgagaagaccccccgtgcgggtgcggatgggccacccgctccacctggagctccccaagccccatcgccccctcaaggctctccccaagaccagcatcattttcttcggagctccgtgaggccgcaaagcaaacgtcctagaaaggatccaccatccgccgtgggatcaggcaatgctggcggatccggtcctcggggtaagggcgcagaagggggaggatctagcagcggaaacgtctccggagtggcgcctgccgcaccagcaggagggagtcggtcctccagccggaacctaggtagtagcggaggggagaaggaagaaggaaaaaaggttagacgccaatgggaatcatggagcacagaagataaaaacaccttttttgagggcttgtacgagcacggcaaggatttcgaagccatccagaataacatcgcacttaaatataagaagaaaggtaagccagcttctatggttaaaaataaggaacaggtcaggcacttctactataggacttggcacaaaattactaagtatatcgactttgaccacgttttttcgaggggcttgaaaaaatccagtcaggaactgtacggcctaatctgttacggtgagttacggaaaaagatcggcggatgcatggatgataagaatgctaccaaactgaacgaactgattcaggttggcgcaacgacagtgcggtacaaaggaagaaatctgcgtattaaggctcctatgtgccgcgctctgaaaaaactgtgcgatccagacgggctgagcgacgaggaagaccagaagccggtgaggctgcctctaaaagtccccatcgagctgcaaccacggaataatcacgcctgggctcgggtgcagtccttagcacagaatccccgtctacgaatgatcgtagaattgcatcgtaaggtaagcagcctgatcgaatttctaaaacagaaatgggccttgcacgaggtcagagtccggaagacactcgaggagcggcagctacaggacagctgctctgcaccgatgcaagagaaagtgaccctgcacctctttcctggtgaaaactgtacattgactccactaccaggcgtcgccagggttgtgcattctaaagctttctgcaccgtgcactggcaggaagggggaagatgcaagcaaagcgccaaggacgcccacgtgttaccacccgctcaaattttgggcatacaatctggccagggaacagccagaggccaggttaagtgtcccagatccggggctgagggcaagggcgttggcaggccccctcccgctgctgatgcgcttcagtcatctggcgagagttcacccgaatccgctcctggggaaggcgctgcactctctttgtcaagtccagacgcacccgacaggccccctccacgtcaccaagacacaggcccttgccttgagaagaccccagccgagggccgtgactctccgacccgtgagccaggggctctgccatgtgcgtgcggtcagctgccagatttagaggacgagttgtccctcctagaccccctacctcggtatctgaagagctgccaggacctgattgttccagagcagtgcaggtgtgctgacacgcggccaggcagcgaacaaccaccactgggcggagctgctagtcccgaggtgctcgctcccgtgagcaaagaggccgcagacctggctcctacgggaccaagtcccaggccaggacccggactgctgctggacgtgtgcactaaggacttggctgacgcccctgccgaggaactccaagaaaaaggatcacccgcaggcccaccaccttcacagggccagcctgctgcgagacctcccaaggaggtgcccgcatccagacttgctcagcagctacgagaggagggatggaatctgcaaacaagtgagtccctgacactggcggaagtctatctgatgatgggtaaaccatctaagcttcaactggaatacgattggctgggacctgggcgacaggatcctcggcctggaagcctgcctacggctctgcacaaacagcgcttactttcttgtttgctgaaactgatcagcactgaagttaaccccaaactcgccctggaagctaatacgatatccacagcatccgtgcgccctgcacaagaggaacagtccatgactccgccaggaaaggtggttaccgtgagttcaaggagtcccaggtgtcccaggaatcaggcaagcctaagatcctcgaagacttttcccccttcttccgcaccctgctcatctggcctgaggaacccacccaggccactgctggtgcctggtccttcctctacaggctcaaacgacagcgatgggggactgtttgcagtccccacaactcttcctcccaatagcaggcacggtaagctattctccccgagcaaagaagccgagctcacattccggcaacatctcaactcaatttcgatgcagagtgattttttccttcctaaacccaggaaactgagaaacagacacctccggaaaccactggtggtccagagaactctgctgccgagaccaagcgaaaatcaaagccacaacgtgtgcagtttttctatcctgtctaattcatccgtaacaggccgtgggagctttcgcccaattcagagtagtctaaccaaggctgccctatccaggcctatcgtgcccaaagtgcttccgcctcaggccacatctcatctggcgtcggctattgacctagcagccactagtgccggaattctttcaggaaaccccttgcccgcattggatacagagggactctctggcatcagcccactgtcatccgacgaggttactggtgccatatctgggcaggacagtaccggtacgcaccaggatggagatacgctgccaacagtagggggtagcgatccattcgtctccatcccctccagacccgagcaagaacctgtggctgactctttccagggcagctccgtgctaagcctgagtgagctcccaaaagcaccactgcagaatggtcttagtatccccttgtctagcagtgagagcagctccacgcgactctcaccccctgacgtctctgctttacttgacatcagccttccagggccaccagaagacgccctgagtcagggcgaacccgctacccacatcagtgactccatcatcgaaatagcaatttcctcgggccagtacggtgagggagttccattgtcccccgcaaagctgaacggaagtgattcttccaagagcctgccttcacctagttcttcgccccaacctcattggatcgcctcccccacccacgatccgcagtggtacccgtccgactctaccgactctagtctgagtagcctgttcgcatcattcatcagtcctgagaagagtcgcaaaatgctgcccactcccataggcacgaattccgggactagcctcctgggcccatccctgttggatggcaatagtagggatagcttcgtgtcccggtctctggccgacgtggcagaagtcgtggacagccagctggtatgcatgatgaacgagaattcaatcgactatatctctcgattcaacgatctggcccaagaactcagtattgcggaacctgggaggagagaagcactgttcgacggagggggtgggggacctgctgtatccgacctttctcagtag

SEQ ID NO: 55276 - DNA, 3810 bp, Artificial Sequence
  Description of Artificial Sequence: Synthetic coding sequence
atgacagtgaaattaggtgacggtggaagcggagaggacggcttaaaaaagctcggcaaaagagctgccgacgaagaatctctggagggtgagggtgctggcggagctgacgctgccgaagaatcctccggaaccaagagagatgagaaaacaccccgagctggcgcagacggcccacctgccccacccggagcccctcaggcacctagtccacctcaggggagtcctcaagaccagcaccactttctgcgttccagcgtcagaccccagtctaaacggccaagaaaggaccctccaagcgcggtggggtccggcaacgctggagggagcggtccgagaggcaagggtgctgaaggcggagggagctcctctgggaacgtgtcgggcgtagccccagccgcacccgcaggcggaagtcgctcctccagtcgcaacctggggtcgtccggcggtgaaaaagaagaaggcaagaaagtgaggcgacagtgggaatcctggagcacagaagacaagaatacttttttcgagggactgtatgagcacggtaaggactttgaagctatacaaaacaatattgccctcaagtacaaaaagaaaggtaagccagcttccatggtcaagaacaaggagcaggttcgccacttctactaccggacctggcacaagattactaagtacatcgattttgatcatgtattttccaggggcctaaaaaagagctcccaggagttgtacggactcatctgctacggagagttgagaaagaagattggaggctgcatggacgacaaaaatgcaaccaaactaaatgaattgatacaggtgggggcaaccaccgttagatataaggggcgaaacctgaggatcaaagcccctatgtgccgagcccttaaaaaactttgcgaccccgatggactatcagacgaagaggatcagaaaccagtccgactgccactgaaggttcctattgagctgcagcccaggaacaatcatgcgtgggcaagagtacagtcactggcacagaaccctagattgcgaatgatcgtggagctacatagaaaggtttccagcctgattgaattcctgaagcagaaatgggccctccatgaagtacgcgtgaggaagactctggaggaacgtcagcttcaggacagctgctcagcgccaatgcaagagaaggtgacgctccacctgtttcccggtgaaaactgtacactgacgcctctaccaggggtcgccagagttgtgcattccaaggccttttgcaccgtgcactggcaggagggcggaagatgtaaacagagcgctaaagatgcccacgtcctcccgccagcgcaaatcctgggtatacagtcgggacaaggcactgctcgcggacaggtgaaatgtcccaggagcggggctgagggcaagggcgtgggacgcccacctccagctgccgatgccctccagtcttcaggtgaaagcagtcctgagagcgcccctggagagggcgcagctttgtctctttcctcccctgatgcacctgatcgcccaccacctcgccaccaggataccgggccatgcctagagaagacccctgcagagggacgagacagtcccacacgtgagcctggtgcccttccctgcgcgtgtggccagctgcccgatcttgaagacgagctgtcactacttgatcccctcccgaggtacttaaagtcctgtcaagatctcatcgtgccagagcagtgtcgatgcgcagatacccggcctggttccgagcagcctcctctcgggggtgccgcttctccagaggtcctcgctcctgtctcaaaagaggccgctgacttagccccaaccggccctagtcccagaccaggcccaggccttctgctggacgtttgcacaaaagatctggcagacgctccagccgaggaactgcaggagaaaggctccccagccggacctcctcctagccagggacagcccgcagcaaggcccccaaaagaggttcccgcaagcaggttggctcaacagttacgagaggaggggtggaatctgcaaacttccgagtctcttaccctggcagaggtgtatctgatgatgggcaagccatcaaaactgcagctggaatacgactggctaggcccagggagacaagacccgaggcctggttccttaccgaccgctcttcacaagcagcggctgctgtcatgtttgctgaagctcatttctaccgaagtcaaccccaaactagctttagaggctaacacaatttccactgcatccgtccgcccagcacaagaagagcagtcgatgacaccgcctggaaaggtggtgacagtgagctctaggtctccaaggtgtcctagaaaccaggcttccctccgctctagtaagacattccccccatcctctgctccatgttcctccggactgagaaatccccctcgcccacttctcgtgcctgggccatcctccacaggctcgaatgactctgacggcggactatttgcagtgcctaccactctgccacctaacagtcgccacggcaagctgttctccccttccaaagaggccgagctgacttttcggcagcatctgaacagcattagtatgcagtcagacttctttctgccaaagcccagaaagctgcgcaacagacatctgaggaaaccactggtcgtgcagcgcaccctgctgcctaggcctagcgaaaatcagtcacacaatgtgtgctccttttcaatactcagcaactcctcagtcacgggaaggggcagcttccggccaatccagagcagtctgaccaaggccgctctcagccgtcccatcgtgccaaaagttctgcccccacaagccacttcacatcttgcttcagcaattgatctggctgcaaccagcgccggaatactgagcgggaacccactccccgctcttgatacagaagggctgtcaggaattagtcccctgtcctctgatgaagttacaggcgcaatttcaggacaggattccaccggtacacaccaagacggagacacactgccaacagtcggaggaagcgacccttttgtgagcattccgtcaagacccgaacaggaaccagttgccgacagcttccagggctcgtctgttctcagtctgtctgagttaccgaaagccccactgcaaaatggcttgtcaatcccgttgagttcatcggagtcttcttctactagactttctccccctgacgtgtccgccctgctggacatctcactccccggacctcccgaggacgcactgtcgcagggggaacccgctacacatatctccgattctataatcgaaatcgctatttctagcggtcagtacggcgagggtgttcctctttcccccgctaagctcaacggcagcgattctagcaaatctctgcctagcccttcatccagcccccagccccattggattgcttctccgacccacgatccgcagtggtacccttccgactctacggactcatctctctctagcctgtttgccagctttatttctcctgaaaaatcccgcaagatgcttcccacaccaatcggcactaattccggaacaagcctgctgggtccgtctttgctggatggaaattccagagatagcttcgtcagcaggtcccttgctgatgtggccgaagttgtggattcccagctggtgtgtatgatgaacgagaatagcattgactacatttctagatttaatgatctggcacaggaactgtccatcgcggagcctgggaggcgagaagccttattcgatggaggtgggggaggccctgccgtgtccgacttgtctcaatag

SEQ ID NO: 55277 - DNA, 3801 bp, Artificial Sequence
  Description of Artificial Sequence: Synthetic coding sequence
atgaccgtgaagctgggcgacggtggctccggagaggacggactcaaaaagctggggaaaagggctgcagacgaggagagtctggaaggggagggagccggtggcgcagacgctgccgaagaaagcagcggcaccaagcgggacgaaaaaactccaagagccggagcggatgggcctccagcaccacctggcgctccacaagccccttccccccctcagggcagtccacaagatcagcatcactttctgagatctagcgtgaggcctcaatccaaacgaccgagaaaggacccacctagcgcggtgggatccggcaacgctgggggttccggtcctcggggaaaggaccgacatctacctaaggcacagctttggctaagcattagtcgggttccttttggtggtagtaggtcctctagccgaaatcttggtagctccggcggagagaaagaggagggaaagaaagtgcgcagacagtgggaaagctggtctacagaggataagaacacgtttttcgagggcctgtacgagcacggaaaggatttcgaagctatccagaataacatcgctttaaaatacaagaagaaaggaaaacccgcttcaatggtcaagaacaaagagcaagtccgacacttttactaccgcacctggcacaaaattaccaagtatatagacttcgaccacgtgttttctcggggacttaagaaaagtagccaagagttgtatggtttgatctgctacggagaactgaggaagaagatcggcggatgtatggatgataagaatgctactaaacttaatgaactaatacaggtgggagcaactacagtacgatataaaggccgtaacctaagaatcaaagccccaatgtgtcgggctcttaagaagctgtgcgatcctgatgggctatccgatgaagaagatcaaaagcccgtcaggctgcccctgaaggtgcccatcgaactccagccgagaaataatcacgcctgggcaagggtgcaatcactggcccagaacccaagactgcgtatgattgtcgaactccaccgaaaggttagctcactgatagagttcctgaagcagaagtgggcattgcacgaagtccgggtgcggaagacattggaagagagacagctgcaggattcctgttcagcacccatgcaggaaaaagttactctccatctgtttccaggagaaaactgcacgctcactcctctgccgggagtggctcgggtggtacactcgaaggccttctgcaccgttcattggcaggagggaggacgctgcaaacagtcagcaaaggacgcacatgtgttgccacctgcacagatcctcggaatacagagcggccagggcactgcccgagggcaggtcaagtgcccacggtccggcgcagagggcaaaggtgtggggagaccaccgccagcagcagacgcacttcagagttcaggcgaaagcagcccggagtccgcacctggcgaaggagcagccctttccctgagtagtcctgacgctccagatcggcctccacctagacatcaagataccggcccttgccttgagaagactcccgctgagggcagggattcccctactagggagcctggtgcgttgccatgcgcctgtggccagttaccagacctggaagatgagctgagcctcctcgaccccttgccacgctatctcaagtcatgtcaagaccttattgtacctgaacagtgccgctgcgccgacacgaggccaggaagcgagcagcctcccctgggaggcgcagcctcgcccgaggtgctcgctcccgtgtcaaaggaagcagcagacttggcacccacaggtcccagccctcggccaggcccaggcttgctcctggacgtgtgcacaaaagacctagccgacgctccagcagaagaacttcaggaaaaagggagccctgctggtccaccaccatctcagggccaaccggcagcaaggccacccaaagaggtgcctgccagtcgcctagcccagcagttgcgcgaggaaggttggaatctacagactagcgaatccctgaccctcgccgaggtatacctgatgatggggaagccctccaaactacagctggagtacgactggttggggcctgggcgtcaggaccccaggcctggttctcttcctaccgctctgcataagcagagacttctgtcctgtctcctgaaactcatctcaactgaggtgaatcccaaattggccctcgaggctaatacgatttccaccgcctccgtccgtcctgctcaagaagaacagtccatgactcctccaggcaaggtcgtgacagtgagttcccgaagccccagatgtcctagaaaccaggcctctcttagatcgtctaaaacattccccccttccagtgctccctgttcgtcggggctcagaaacccccctcgccctctgctcgtccccggaccatctagtaccgggtctaatgactccgatggcggactgtttgctgtgcctacaaccctgccacccaatagcaggcacggcaaattattctcaccttctaaagaggccgagctcaccttcaggcagcatctgaacagtatctcgatgcagtccgactttttccttccaaaaccacggaaacttagaaatcgacacttgcggaagccactggtcgtgcagcgtacactgcttcccaggccttctgagaatcagtcccataatgtctgctctttctctatcctatccaactcctccgtgaccggccgaggatcatttagaccaattcagtcctctctaaccaaagcggctcttagtcgtcccatagtacccaaagtactgcctccacaggctaccagccacctggcatctgcgatcgatctggctgctacaagtgccggaatccttagcggcaaccctctccctgccttggacaccgaaggcctgtccggaatttcacctctgagctctgatgaagtgaccggggcaattagcggtcaggatagtactggaacgcaccaggatggagatacgctgcccactgtgggcggtagtgaccccttcgtgagtattccctcacggcctgagcaggagccagtggctgattcctttcaaggaagtagcgtcttgtccctgtctgaactcccaaaagctcctctccagaatggcctctctatccccctgtcttcctccgagtcatctagcactaggttatctccgccagatgtctcagctctcctggatatctcgctgccaggtccaccggaggacgccttgagtcagggagagcccgcaacacacatcagtgattccattattgagatagcaatatcaagtggacaatacggagaaggcgtacctctgagtcctgcaaaattaaacggatcggacagttctaaatccctgccatcgccttcaagttctcctcagccacactggattgccagcccaacacacgatccccagtggtatccttcagattcgaccgattcctccctgtcttccctctttgcatccttcatttctccagagaaatctcgcaagatgcttccgaccccaatcgggaccaacagcgggacgagcctgttaggccctagccttctagacggcaacagcagagatagctttgtctccagatctttggccgacgtggcggaggtagttgattcccaacttgtatgcatgatgaatgagaactcaattgattatattagtagatttaacgacctggctcaggaactgtccatcgccgaacccggtcgacgggaagctttattcgacgggggtggcggaggacccgcagtgagtgatcttagccagtag

SEQ ID NO: 55278 - DNA, 528 bp, Artificial Sequence
  Description of Artificial Sequence: Synthetic coding sequence
atggatatcgccatacaccacccttggattcgcaggccgttttttccttttcactctcccagtaggctgttcgatcagtttttcggggaacacttacttgaaagcgatctctttcccacttccacatctctatcacccttctatctccgacctccctccttcctcagagctcctagctggtttgatacggggctaagcgaaatgcgtttggagaaagatcggtttagcgtgaatttagacgtcaaacacttcagccccgaagaattgaaagtcaaagtcttgggcgatgttatcgaggtgcatgggaagcatgaagagcgccaagatgaacacggctttattagcagagaattccacaggaagtaccgaatcccagccgatgtcgatcctctgaccatcacatcatcccttagcagtgacggggtcttgactgtgaatgggccacgcaagcaagtctctggtcccgagaggacaatacctatcacaagagaggaaaaaccggctgtgaccgccgcacccaagaaatag

SEQ ID NO: 55279 - DNA, 528 bp, Artificial Sequence
  Description of Artificial Sequence: Synthetic coding sequence
atggatattgctattcaccacccatggatccgacgacccttcttccctttccactcgccttcccgtctgttcgatcagttcttcggcgagcacctcttagagtccgatctgtttccgacgtccacatcccttagcccattctacctacgtcccccttcctttcttcgggctcccagctggttcgatacaggcttgtccgagatgcgcctagagaaggataggttcagcgtgaacctagacgtaaagcatttcagtcctgaagaactaaaggttaaggtgcttggggacgtgatcgaggtgcacggaaagcatgaggagcgccaggatgaacacggctttatcagccgcgaattccacaggaagtatcgaattcctgccgacgtcgatccgctcacaatcacctcaagtttatcatcagacggtgtcctgactgtgaacgggccaagaaagcaggtgtcaggccctgaacgtacaattccaattaccagggaagagaagcctgcggtaacagcagcaccgaagaaatag

SEQ ID NO: 55280 - DNA, 528 bp, Artificial Sequence
  Description of Artificial Sequence: Synthetic coding sequence
atggatattgctatccatcatccctggatcaggagacctttctttccctttcacagcccatcccggctgttcgatcaattttttggcgagcaccttcttgaatcagacctattccccactagcacctccctatctccattttacctcaggccaccctcgttcctgagagccccatcctggttcgataccggactttcagagatgagactcgagaaggatagattttcagtcaatcttgatgtaaagcactttagccccgaggagttaaaagtgaaagtgctgggggatgtcattgaagtccacggtaaacacgaagaaagacaggatgagcacgggtttattagtagagagttccacagaaagtacaggatccccgcagatgtggatcctctgactatcactagctcattatccagcgacggggtgcttacagtcaacggcccacgcaagcaggtctccggaccagagagaaccatacctataacccgagaggaaaagccagctgtgacagctgcgcctaagaaatag

SEQ ID NO: 55281 - DNA, 549 bp, Artificial Sequence
  Description of Artificial Sequence: Synthetic coding sequence
atggctcagaggagcggtaagattacactctacgagggcaaacactttactggtcaaaaactggaagtttttggagactgcgataactttcaagataggggctttatgaatcgggttaactccatccacgtcgaaagcggagcatgggtatgtttcaaccatccagacttcagagggcaacagtttatcctggagcatggagactaccccgacttcttccgctggaatagccattcagaccatatgggaagctgccgtccagtaggtatgcatggagagcactttcggttggaaatcttcgagggctgcaacttcactgggcagtgcctggagtttctggaggatagcccgtttctgcagtcgcgaggatgggtgaaaaactgtgttaacacgattaaggtttatggagacggcgcagcatggagcccaaggtcttttggagccgaagactttcagctgagcagttctctccagtctgaccaggggccagaggaggcgactacaaagcctgccactacccagcccccttttctgacagccaacctgtag

SEQ ID NO: 55282 - DNA, 447 bp, Artificial Sequence
  Description of Artificial Sequence: Synthetic coding sequence
atgggaagagctggcccacggagcaccgccgatactcgacctagggctactgtgataaccacaaggagaccaaggccatggcaaaaacctacttctcccaggcggctacatcggagacggcctaggggccagcccgcttctgagaacgccgctgagccctcccaagtcgcaatatctaaaggcaaatctcccgattatgccaatggaggtaaagccgcaatggactctagagcaagcgacgctatcaacaagtcaaaagtggacacttctgcgtcgaacccatcacagaggcggccatcccgattacgtggtaaacgaagccttgccctaccaccgaggctcgaatgcctcttcccctcctcatgtggaagcaggagagccacgtcgcggcctgggtttcctcccctggaggggtcacacctaggatgccagttgctgccactgtag

SEQ ID NO: 55283 - DNA, 2415 bp, Artificial Sequence
  Description of Artificial Sequence: Synthetic coding sequence
atggaggagcccggagtgacacctcaaccatatttaggtctgctgctggaggagctgaggagagttgtcgcagctcttccagaagggatgaggccagactccaacctctacggatttccatgggagctggtcatctgcgcagcggtggtggggttcttcgcggtcctgttcttcctttggcgctcattccgcagcgtgcggagcagattgtacgtgggccgtgaaaagaaactagcgctcatgctatcgggccttatcgaggaaaagtctaagttactggagaagtttagcttagtgcagaaggagtacgaaggttatgaagtcgagagtagcctgaaggatgcaagctttgaaaaggaggcgactgaggctcagtctctcgaagccacctgtgagaagctgaatcggagcaacagtgaacttgaggacgagattctgtgtctggaaaaggaacttaaggaggaaaaatctaagcacagtgaacaggatgaattaatggcggacatctctaagcggatacagagcctggaggacgaaagtaagtccttaaagtcccaggtcgccgaggcgaagatgactttcaagatctttcagatgaatgaagaacggttaaagatcgctattaaggacgccctgaatgagaatagtcagctgcaggaatcccagaaacagctcctccaggaagcagaagtttggaaagagcaggtgtcggagctaaacaagcagaaggtgacattcgaggactctaaagtgcatgctgagcaggtgctgaatgacaaggaatcccacatcaaaacactcaccgaacgcctgctgaagatgaaggactgggctgccatgctgggcgaggacatcacagacgatgacaatttggagctcgagatgaatagtgagagcgagaacggggcatacctcgacaatcctccaaagggagcattgaaaaagcttatacacgccgcaaagctgaatgcatctctcaaaaccctggagggagaacgaaatcagatctacatccagttgtctgaggtggataaaacaaaggaggaactgaccgagcatatcaagaatttgcagactgaacaggcaagtctgcaaagtgaaaacacacacttcgaaaatgagaatcaaaaactgcagcagaagcttaaagtgatgaccgaattgtaccaggagaacgaaatgaagctccatcgtaaactgaccgtggaggagaactacaggctggaaaaagaggaaaagttatcaaaggtggacgagaagatctcccatgccacagaggagctagagacatacaggaagcgagccaaagatcttgaagaggaacttgaacggacaatccatagttatcaaggccagattattagccacgaaaagaaggctcacgataattggctggctgccaggaatgcggagaggaatcttaatgacttaagaaaggaaaacgcccacaatcgccagaagctgactgaaacggagcttaaatttgagttgctggaaaaagacccatacgctctcgacgtccccaatacagcttttggcagagagcatagcccatacggccctagtccactgggttggcccagtagcgagactagggcatttctgtcacccccaacattgctcgagggtcccctcagactctccccccttctccccggaggtggcggtcggggaagtcggggtccaggcaaccccttggatcatcaaattacaaatgagcggggtgagagtagttgtgaccggctcacagatcctcacagagctccttcagatactgggagcctgagcccgccttgggatcaagaccgcaggatgatgtttcctcccccagggcagtcctaccctgattcggcactgccaccgcaaaggcaagaccgcttctgctctaacagcggtaggctaagcgggccagccgagctgaggtcctttaacatgccatcccttgacaagatggacggctccatgccatctgagatggagtcatccaggaatgacacgaaggatgaccttgggaatctcaatgtcccagatagtagtttgcccgctgagaatgaggcgactgggccaggtttcgtaccaccaccattagcgccaatcaggggtcccctcttcccagtggatgccaggggcccatttctgcggcgaggccctcccttcccaccaccccctccaggtgccatgttcggggcatccagagattacttcccaccaggtgactttccaggacctcctccagcgccatttgccatgaggaatgtctatcctccaaggggctttcctccgtacctcccccctcgcccaggattctttccgcctccaccccacagtgagggtaggtcggaatttcctagcggtctaattccacccagcaatgagcctgcgacggagcaccctgaacctcaacaggaaacttag

SEQ ID NO: 55284 - DNA, 2316 bp, Artificial Sequence
  Description of Artificial Sequence: Synthetic coding sequence
atggaggaacctggcgtgacaccacagccctacctcggcctactgctggaagagctccgccgagtcgtggccgctctccctgaggggatgagacctgacagcaacctgtatggctttccttgggaattggtaatctgcgccgcagttgtgggtttcttcgcggtgctgttctttttgtggcggtcttttcgttcagtccggtcacgtctgtatgtaggtcgggaaaaaaaactggcccttatgctcagcggattgatcgaggagaagtcaaagctgctggagaagtttagcctggtacagaaagagtatgaaggctatgaagtggagagcagtttgaaggacgctagtttcgaaaaagaggctaccgaggctcagagcctggaggccacttgcgaaaagctgaaccgcagcaacagcgaacttgaggatgagattctctgtcttgagaaagagttaaaggaggaaaagagcaagcactccgagcaagacgagttgatggcagacatctccaaacgtattcaaagcctggaagacgaatccaaaagcctgaaatcacaggtcgctgaagctaagatgacatttaagattttccagatgaacgaggaaaggttaaaaattgccataaaagatgcactaaatgagaactcccagctgcaggagagccaaaaacaactgctgcaggaagccgaggtttggaaggagcaagtgtctgagcttaataaacaaaaagtcacctttgaggattctaaggttcatgccgagcaggtcctgaatgacaaggaaagtcacattaagacactgaccgagcgcctcctaaagatgaaagactgggccgcaatgctgggtgaagatattactgatgacgacaatctcgagttggaaatgaacagcgaatctgagaatggagcctacctggataatcctccaaaaggcgctctgaaaaagctcatccacgcggcaaaactgaatgcgagtctgaagactctagagggcgagcggaaccagatatatattcagttgtccgaggtggacaagactaaggaagagttaacggaacacattaagaatctccagacggaacaggctagcctgcagtcggaaaacacgcacttcgagaacgaaaatcagaaattgcaacagaaactgaaagttatgactgagctgtaccaggaaaacgaaatgaaactgcataggaagctcacagtggaggaaaattacagactagagaaggaggagaagctgtccaaagtggatgagaaaatctcgcacgctaccgaagaacttgagacgtatagaaagagagcaaaagatctggaggaagagctcgagagaactattcactcttatcagggacaaattatttcacatgagaaaaaggcgcacgataactggttggcggcacgcaatgcagaaaggaatcttaacgatttacggaaagagaacgcccacaatcgtcagaagctgactgaaactgaattgaaatttgagctcttggaaaaagatccatacgcactcgacgtccccaacaccgcgttcgggagggagcactcgccctatggaccttctcccctgggctggccctcctccgagaccagagcttttctgtcccctcctacattactcgagggccctctgaggctaagccctttacttcctggcggaggtgggagagggtccagaggcccaggcaatcctctggatcatcagatcacaaacgaacgcggagaatccagctgtgataggttaacagaccctcatcgagccccaagcgacaccggtagtttatcccctccatgggaccaagacaggaggatgatgtttccacccccaggccagtcgtatccggactccgcactgccccctcaacggcaggatcgattttgttccaatagcggccgactaagcggacccgctgagctgcgctcctttaacatgcctagcttggataagatggatgggagtatgcccagtgagatggagagctctagaaacgacaccaaggacgatctggggaatctgaatgtcccagacagttctctcccggctgaaaatgaagccacaggcccaggattcgtcccaccacctctggctcctatccggggaccgctgttccccgtggacgcacgcggtcctttcctccggcgtgggcctccatttcctcctcctcccccaggggcaatgttcggagcttctcgggattactttcctccgggagatttccctggtccccctcccgctccctttgcttcggcccgatctccccctggggcaggcgctcccgcatcagggagaggcctcggcggaccccagaagtag

SEQ ID NO: 55285 - DNA, 2379 bp, Artificial Sequence
  Description of Artificial Sequence: Synthetic coding sequence
atggagctcaagtcacccgaggaagaggtagtcgcagctctccccgaggggatgagacccgacagtaacctgtatgggttcccttgggagctggttatttgcgccgcagtcgtgggttttttcgcagtgctgttcttcctgtggcgttcatttagatccgtgaggtccaggttatacgtggggagagagaaaaagctggcgttaatgttgtctgggctaatagaggagaagtctaaactgttggaaaagttctccctggtccagaaagagtatgaaggatatgaggtcgagtctagcctgaaagatgcttcgttcgaaaaggaggccaccgaggctcagagcttggaagctacatgcgagaaattgaaccgctccaactccgagctagaagacgagattctttgcctggagaaggagctcaaagaggagaaatctaagcattccgagcaagatgaactgatggccgacataagtaaacggatccaatccctagaggatgagtccaaaagcctcaaatctcaggttgccgaggcaaagatgacttttaaaatttttcaaatgaacgaagaacgtttaaagattgcaattaaagacgcactgaacgagaacagccagctgcaagaatcgcaaaaacagctactgcaagaggccgaagtgtggaaggagcaggtgtccgaactgaataaacagaaggtgactttcgaggattctaaggtacacgcggagcaggttttgaacgataaagaatcacatatcaagactctaacggaacgtttgctaaaaatgaaggactgggcagcaatgctgggtgaagatatcactgacgacgacaacctcgaactagaaatgaactctgagtctgaaaatggcgcttacctggacaacccacctaagggtgctctgaagaagttaatccacgctgcaaagctgaacgcaagtcttaagaccctggagggcgaacgtaatcaaatttacatacagctttccgaagtggataaaaccaaggaggagcttacagagcacatcaaaaatctacaaacagaacaggcttcgctgcagtccgaaaatacccatttcgagaatgagaaccagaaattgcagcagaaactgaaggtaatgacggaactttaccaggaaaacgaaatgaagcttcataggaagctcaccgttgaagagaattataggctcgaaaaagaagaaaaacttagtaaagtagatgagaaaatttcccacgccacagaggagcttgagacatataggaagagggccaaggatctggaggaagaattggagcgaacaattcatagctaccaggggcaaatcataagtcacgagaaaaaagcacatgataactggcttgccgctcggaacgcagagaggaatcttaacgatctccggaaagagaacgctcacaatcgacagaagcttacagagacagagctgaagttcgagctgctcgagaaagacccatacgccctcgatgtccccaacaccgcatttgggagagagcattctccgtacggcccaagtccactaggctggccctccagcgaaacccgggcattcctgtctcccccaacactcctcgaagggcctctgagactgagccccctcctaccagggggtggagggcgaggctcaagggggccaggtaatcctctggatcaccaaatcacaaatgagcgtggagagtcctcctgcgatcgactgaccgatccccaccgagctccctctgacaccggcagtctttcccccccttgggaccaagataggaggatgatgttccccccaccaggccagagctaccccgatagtgcccttccccctcaacgccaagaccggttctgttccaactctggtcggttgtctggtccagcggaactcagatccttcaatatgccatctcttgacaagatggacgggagtatgcctagcgaaatggagagctctcgaaatgacaccaaggatgacctaggcaatcttaatgtgccagactcctctctgcctgccgagaatgaagcaactggacctggctttgttcccccaccactggccccaatccgaggcccactttttcccgtggacgccaggggccctttcctgagacgcggaccgccattcccaccccctcctccgggagcaatgttcggggcttcacgggactacttccccccaggtgatttccctggtcctccgccagcacccttcgcaatgcgcaatgtttatccacctcgaggcttccccccatatctgccaccgaggcccggtttttttcctccccctccacatagcgagggacgctcagaattcccgagtggtctgattccgccatctaatgagcctgccacagagcatccggagccacagcaagaaacatag

SEQ ID NO: 55286 - DNA, 2286 bp, Artificial Sequence
  Description of Artificial Sequence: Synthetic coding sequence
atggaggagccaggagtaactccccagccttatctcggtttgctcctggaggaactcagaagagtcgtggctgcactgccagaagggatgagacctgactcaaacttatacggcttcccctgggagctcgtcatttgtgcagcagtagtcgggttcttcgcagtgctgttctttctctggagatcttttaggtctgtaagatctaggctgtatgtcgggagagaaaaaaagctcgccctgatgctttccggtctgatcgaggaaaagagcaagctgctggagaaattctcccttgtccagaaggaatacgaagggtatgaagtcgagtccagtctgaaggatgcatcgtttgaaaaagaagccaccgaagctcagtcgttggaggctacttgcgaaaagttgaaccgttctaacagcgagctggaagatgagatactatgtctggagaaggagctaaaggaggagaaatctaagcactcagagcaggatgaacttatggcggacatcagtaagagaatacagtctctggaggatgaatctaaaagcctgaaatcccaggtggctgaggcaaagatgaccttcaagatctttcagatgaacgaggagagactgaagattgccatcaaagatgcactgaacgagaactcgcagttacaggaaagccagaaacagttgctgcaggaagccgaagtgtggaaggaacaggtttccgaactgaataagcagaaggtgacatttgaggacagtaaggtgcacgccgagcaggtgttgaatgacaaggagtctcatattaaaaccctgactgagaggctgctgaaaatgaaggactgggcagcaatgcttggcgaggatattaccgacgacgataatctggagctagaaatgaatagcgagtccgaaaacggagcatatctggataaccctcctaagggagcactgaagaaattgatacatgctgcaaagttgaacgcatcactaaagacactggagggggaaaggaatcagatctacatccaactgagcgaggtggacaaaacaaaggaggagctaactgagcacataaagaatctccagactgagcaggctagcttgcagagcgaaaacacacacttcgagaacgagaaccaaaaacttcaacaaaaacttaaggtaatgactgagctgtatcaggagaacgagatgaaactgcataggaagctcacagtcgaggaaaattatcgactggagaaggaggaaaaactgtccaaagttgacgaaaaaatttcacacgccacggaagaactagagacctaccgtaaacgcgcaaaggacctagaggaagagctcgaaagaaccatccactcgtatcaagggcaaattatctcccatgaaaagaaggcacacgacaactggcttgcggcaagaaatgccgagagaaacctgaatgatctgcggaaggaaaacgcccacaatcgtcagaagttaactgaaacagagctgaagtttgagctgctcgaaaaggacccttacgcacttgatgtaccaaacaccgcattcggccgaggatcccggggtcctggcaaccctctggatcatcagatcaccaacgaaagaggcgagagctcctgcgaccgcctcactgatccgcaccgcgcaccatctgacacgggctccttaagccccccttgggaccaagatcgccgtatgatgtttccccctccaggtcaatcctatcctgacagtgctcttccccctcagcgtcaggaccgtttctgcagcaattccgggcgtcttagtggacccgcagaactgagatccttcaatatgccttctctagacaagatggatggtagcatgcctagtgaaatggagtcctcacggaatgatacaaaagacgatctgggcaacctcaacgtgcccgacagcagcctgcctgctgaaaacgaagctacaggacccggattcgtgccgcctccactggcccctatcagaggcccactctttccagtggacgcgagaggaccatttctaaggaggggacccccatttcctccgccaccccctggagcaatgttcggcgcaagtcgagattactttcccccaggagacttcccaggccctccaccagctccctttgcaatgcgaaacgtctacccaccaaggggatttcccccttatctccccccacgtcctggatttttcccgccaccacctcactcagaagggcgatctgagttcccttccggcctgatccctcctagtaacgagcctgcaacagaacaccccgagcctcaacaggaaacttag

SEQ ID NO: 55287 - DNA, 2019 bp, Artificial Sequence
  Description of Artificial Sequence: Synthetic coding sequence
atggaattaaagtcacctgaagaggaggttgtggccgctctgccagagggcatgaggcccgactccaatctctacgggttcccatgggagctggtgatatgtgcagctgtagtcgggttttttgccgtcctcttcttcctgtggaggtctttccgttccgtaaggtcccggctttatgtcggcagagagaagaagcttgctctgatgttgtctggcctgattgaagagaagagcaagttgctggagaagttcagtcttgtccaaaaggaagctacgtgcgagaagctcaaccgtagcaactccgagcttgaagatgagattttatgcttggagaaggaattgaaggaggaaaagagcaagcattcagagcaggacgagctgatggccgatatctccaaacggatccagagcttggaggacgaaagcaaatccctgaagtctcaggttgccgaggctaagatgacattcaagattttccagatgaacgaagagcgactgaagatagccatcaaggatgcccttaatgagaacagccagctccaagagagtcagaaacagttactgcaggaggcagaggtttggaaggaacaggtgtcagaacttaataaacagaaagtcacattcgaagactccaaagtgcatgcagagcaggtcctgaacgacaaggaatctcacattaaaaccctgacagaaagacttctgaaaatgaaagactgggccgcaatgcttggggaagacattacagacgatgataatttagaacttgaaatgaactccgagagcgaaaatggggcttatctcgacaacccccctaagggtgcgctgaagaagctgatccatgcagcgaaactcaacgcctctctgaagacccttgagggggagagaaatcagatctatatccagctgtcagaggtcgacaaaaccaaggaggagctgactgaacacataaagaatcttcagaccgaacaggctagcctgcagtcagagaacacgcacttcgagaacgagaaccaaaagctgcagcagaaattgaaggtcatgacggagctgtaccaggaaaacgagatgaaattacaccgcaaacttactgtggaagaaaactaccgcctcgaaaaagaggaaaagctgagtaaggtggacgagaagatttcacacgccactgaagaactggagacctaccgcaaaagagccaaggatctggaggaagagctagagaggaccatacactcatatcaaggccaaatcatcagtcatgaaaaaaaagctcacgacaattggctggctgccaggaacgctgagcggaacctgaacgacttacgaaaagagaatgctcacaataggcagaagctcacagaaaccgaattaaaatttgagctgcttgagaaggatccatacgccctcgacgtgcccaatacggcattcggacgggaacattctccttacggcccttcgcctcttggatggccctccagcgaaaccagagccttcttaagcccccctaccttgctcgagggtccattgcggctgtcacccctgttgcctggcggaggtggtcggggttcaagaggccctggcaaccctctggatcatcagattacaaacgagagaggagagtccagctgcgataggctcactgacccccaccgagctccgtctgacacaggatcactcagcccaccttgggaccaggataggaggatgatgttcccccctccaggtcagtcatatcccgattctgctttaccccctcagaggcaggaccgtttttgctccaacagcggcaggcttagcgggccagcggagctgcgctcattcaatatgccacccggaccaccacccgcacctttcgcaatgcgcaacgtttatccccctcgcggattccctccttacctgccgcctcggcctggcttttttccacctccccctcactctgaaggcagatcagaatttccttccggcttgatacctccaagtaacgagccggcaactgaacaccccgagccccagcaggagacttag

SEQ ID NO: 55288 - DNA, 2430 bp, Artificial Sequence
  Description of Artificial Sequence: Synthetic coding sequence
atggaggaacccggagtcaccccccagccctaccttgggctcttgcttgaagaactgcgccgagttgtggccgcacttcctgagggaatgcgccctgactccaacctgtatgggtttccatgggagctggtcatctgtgccgctgtggtgggctttttcgccgtcttgtttttcctctggcgaagttttagatccgtcaggtccaggctctacgtgggccgtgagaaaaaactggctctgatgttgagtggcctgattgaggagaagtcaaagctactggagaaattcagcctggtacagaaggagtacgaagggtatgaggtggaaagctcgctgaaggacgcgtcctttgagaaagaagctactgaagcacagagccttgaggtggagaaccagatggcgacttgcgagaagcttaaccgctccaactctgagcttgaggacgagatcctgtgcctggagaaagaactcaaggaagagaagtctaaacactctgagcaggacgagctgatggccgatatatcaaaacggattcagtcactggaggatgaatccaaatccctcaagtcacaggtggcagaggccaaaatgacattcaaaattttccagatgaacgaagaacggctgaagatcgcaataaaagacgcacttaatgagaattctcagctccaggagagccaaaagcagctcttacaggaggctgaggtctggaaggagcaagtgtcagaattaaataagcaaaaggtcactttcgaagattctaaagtgcatgccgaacaggtgctcaatgataaggagtctcatatcaaaaccctgacggagcggttgctcaagatgaaggactgggctgccatgctgggagaagacattactgatgatgataaccttgaattggagatgaatagtgaatcagagaacggtgcctacttagataaccctcccaaaggcgctcttaagaagctcatccatgccgcaaagctcaatgccagcttaaaaaccctagagggcgagcggaatcagatttacattcaactgagcgaggttgacaaaacaaaggaggaactgaccgagcatatcaagaacttacagacagaacaggctagtctccagtcggagaatacacattttgagaacgagaaccaaaaactccagcagaaactgaaggtaatgactgagctttaccaagaaaacgaaatgaagctgcacagaaaattgacagtcgaggagaattataggctggagaaagaggagaaactttcaaaggttgacgaaaaaattagccatgcaaccgaagaactggaaacctatagaaaaagggcgaaagacctcgaggaggaactcgaacgaaccatccatagttatcaggggcagattatttcgcacgagaaaaaagctcacgacaactggttggccgctcgcaatgctgagaggaaccttaacgatctgcgaaaggagaatgcccacaaccgtcaaaaactgactgaaactgagctcaagtttgagctgttagagaaggatccgtacgctctggatgtacccaataccgcctttggacgcgagcactcaccctacggtccatctcctctggggtggccaagttccgagacacgtgcctttctgtccccaccaacccttctggagggtcctctgaggctgtcccccttgctgcctggcggtgggggaaggggtagtcgaggcccaggtaacccattagatcatcagatcacaaatgagaggggggagtcctcctgtgatcggttgactgatccgcacagagccccaagtgataccggatccttatcccctccatgggatcaggacagacggatgatgtttccccctcccggtcagagctaccctgatagcgctctcccgcctcagcgacaggaccggttctgtagcaactccggcaggttatcaggcccagctgagctgcggtctttcaatatgccatcacttgataagatggacggctccatgccatccgaaatggagtcttcccgcaatgatactaaagacgacctgggtaatttaaacgtacctgattccagcctgccagccgaaaatgaagccactggtcccggtttcgttcctccgcctctcgcgcctattcgcggacccctgttcccggttgatgccagaggcccattcctgagaagggggccacccttccccccacctccacccggagctatgttcggcgcaagtagagactacttcccaccgggtgacttccctggcccaccaccagccccatttgccatgagaaacgtttaccccccacgcggattccccccatatctgcctcccagacccggttttttccccccacccccacatagtgaagggagatctgaattcccctctggccttatacccccttccaacgaacctgcaaccgagcatcccgaacctcaacaagaaacatag

SEQ ID NO: 55289 - DNA, 2328 bp, Artificial Sequence
  Description of Artificial Sequence: Synthetic coding sequence
atgcggcctgatagcaatctctatggattcccttgggagctcgtaatttgtgccgcagtggttggctttttcgcggtacttttttttttgtggaggtccttccgctccgtgcgttcaaggctgtacgttggcagggagaagaaactggcgttaatgttatcaggtctcatcgaggaaaaaagtaagctgctagaaaagttcagcttggtccagaaggagtacgaaggctatgaggtcgagtcttcccttaaagatgcttcatttgagaaggaagctaccgaggcccagtctttggaggccacctgcgaaaagttgaataggagtaactccgagctagaagatgagattctctgcctggaaaaagagttaaaagaagagaaaagtaaacatagcgaacaagatgaactgatggccgacatttctaagcgaattcagtcacttgaagatgagagtaaaagtctcaagagtcaggtggcagaggcaaaaatgacctttaagatcttccagatgaatgaggaacgattaaagatcgcaattaaggacgcattgaacgaaaattcacagctgcaggaatcacagaaacagctgctgcaggaagccgaagtttggaaggagcaggtgtctgagcttaacaaacaaaaggtgacatttgaagacagcaaagtacatgctgagcaggttttaaacgacaaggagtcacatataaagaccttaacagagcgtctgctcaagatgaaggattgggcggctatgctgggggaggacatcactgatgatgacaacctggagctggagatgaacagcgagagtgagaacggtgcatacctcgacaaccctccaaagggcgctctgaagaaactcattcacgctgcaaagctcaatgcatcgctcaagaccttggaaggagaacggaatcagatttacatccagctgtctgaagtcgataagactaaagaggagctgacggagcacattaagaacttacagaccgaacaagccagcttgcagagtgaaaatacccatttcgaaaatgagaatcaaaaactgcagcagaaactgaaggtgatgacagaactgtaccaagaaaatgaaatgaagctccataggaagctgacagtcgaggagaactatagacttgagaaagaagaaaaattgagcaaggtggacgaaaagatctcgcatgcaacggaagagctggagacttaccgcaagcgagccaaggatctggaagaagagctcgaacgtaccatccattcctatcagggtcagatcatttcccacgagaagaaggcccacgacaactggttagcagcaaggaacgcagaaagaaacttaaacgatctccgaaaagagaacgcgcataataggcagaagctgacagagaccgagctgaagttcgaactgctagaaaaggatccatacgctctggatgtacccaatacagcctttggcagagagcattccccatacggaccatcccccctcgggtggccctcttctgaaactagagcttttctgagccctcccacactgctcgaaggccctctgcggctgagccctctactgccaggcggaggcggtcgtggcagtcgcggtcccggtaacccccttgaccaccaaatcaccaatgagagaggtgagtcttcatgcgatcggttgaccgacccacatcgagctccatcagatacgggaagtttgtcccctccctgggatcaggaccggaggatgatgtttccgccacccggtcaatcgtatccagattcagccctccctccccaacgccaggatcgcttctgctccaactccggacgcttaagcggccctgcggagctgcgttcctttaatatgccttcactcgataagatggatgggtctatgccatccgaaatggagtccagtcgcaatgacaccaaagatgatctgggcaatttgaatgtccccgactcatccctcccggcagaaaacgaagccacaggcccaggatttgtgccgccacctctcgcaccgatacgaggtcctctctttccagtggatgccaggggcccttttttgagaagaggacccccttttccccctccaccgcctggcgcaatgttcggagcgtcccgagactactttccaccaggagactttcctggccctcctcccgctccttttgctatgcggaacgtatatcctcccaggggtttcccaccataccttcctcccaggccaggattctttcccccaccgcctcatagtgaggggcgtagtgaatttccttccgggctcatcccgccatccaacgagccagccacggagcatccagaaccccagcaggaaacttag

SEQ ID NO: 55290 - DNA, 1401 bp, Artificial Sequence
  Description of Artificial Sequence: Synthetic coding sequence
atgcgcctccgaacccgcaaagcctcccagcaaagtaaccagattcagactcagcggaccgccagagcgaagaggaagtattctgaagtggatgatagcctgccctctggaggggagaagccaagcaaaaatgaaacgggtcttctgagcagcatcaagaagttcattaaaggatcgacccctaaagaagagagagaaaacccatctaaacgctcccgtatcgaacgtgatatcgataataacctgatcacctctacgccacgcgcaggagaaaagcctaataagcagatcagccgtgttcggcgtaagtcccaggtgaacggggaggccggaagttacgagatgaccaaccagcacgtaaaacagaacggaaaacttgaagataacccatcttcgggctcccccccaaggaccactcttctcggcaccatcttctctcccgtttttaacttcttctctcccgcaaataaaaacggaaccagcgggagcgatagccctggacaggcggtcgaagccgaagagattgtcaagcaactggacatggaacaggtggatgagattacaacaagtacaaccacttctacaaacggcgcagcatactcaaaccaggctgtccaggtacggccaagcttgaacaacggcctcgaagaagccgaggagacagtgaaccgggatataccgcctctcaccgctcctgtcacaccagactccggttattccagcgctcatgcagaagctacctacgaggaggattgggaagtcttcgacccatactactttattaaacacgtgccccctctgactgaggaacagttgaaccgcaaacccgctcttccattaaaaaccaggtccacacccgagttttctctggtgctcgacttagacgagacactggtgcactgctcgctgaatgagcttgaagatgcggctcttacctttcctgtgctgttccaggacgtgatataccaggtctatgtaaggctgcgacctttcttcagagaatttcttgagagaatgagtcagatgtatgagatcattctcttcactgctagtaaaaaggtttatgccgacaaactgctaaacatactggatcctaaaaaacagctggttcgccatcgtttgtttcgcgaacattgtgtgtgcgtacagggcaactatatcaaagacctgaacattcttggcagggacctttccaagaccattatcatcgacaattccccacaagcttttgcttaccagctgagtaacggcattccaatcgaatcctggttcatggataaaaacgacaatgagttacttaaactgatccccttcctggagaagttagtagagctgaatgaagacgtccgcccacacatcagggataggtttaggctacacgatctactgccaccggattag

SEQ ID NO: 55291 - DNA, 1185 bp, Artificial Sequence
  Description of Artificial Sequence: Synthetic coding sequence
atgcgcctaaggaccaggaaggcctcccaacagtcaaaccaaattcaaactcagaggaccgcaagagctaaacgtaaatattcagaggtagacgactcactccccagtggaggggaaaaaccaagtaaaaacgaaactggcttgctgtcgagtattaaaaaattcataaaggggtccacacctaaagaagagcgcgaaaatccctcgaagcgatcacgcatagagcgggatatagacaataatctgattacctctacgccccgagccggagagaagcctaataagcaaatctcaagggtcagacgcaaaagccaagttaacggtgaggctggatcttatgagatgacaaatcagcacgtgaagcagaacggcaagctggaagataaccccagttcgggatcgccccctcgcactactctgctcggaacaatattcagccccgtgtttaactttttctcccccgctaataaaaacgccccagtgacacctgattcggggtacagctctgctcatgctgaggctacatacgaggaggattgggaggtgtttgacccatattactttattaagcatgtcccacctttgacagaggaacagttgaatcggaagcctgcgctgcccctcaagaccaggtccacaccggagttctccctagtgctcgatctcgatgagaccctggtccactgttccctgaatgagttggaggacgccgctctcaccttcccagtgctctttcaggatgtcatttaccaagtttacgtacgactaaggccttttttccgcgagttcctggaacggatgagtcaaatgtatgaaattattctatttaccgctagcaagaaggtttatgccgataagctgttgaatatcctcgaccccaaaaagcagttggttagacaccggctctttagggaacattgcgtctgtgtccaggggaattatatcaaggatctgaacattctgggccgagacctcagcaaaaccatcatcattgataactccccacaggctttcgcttaccagctgtcgaacggcatccctatcgaaagctggttcatggataagaatgataacgaactcctgaaattaatccccttcttggaaaaactggtggagctcaatgaggacgtgagaccacatatcagagatcggtttcggctgcatgatttacttccccctgactag

SEQ ID NO: 55292 - DNA, 1185 bp, Artificial Sequence
  Description of Artificial Sequence: Synthetic coding sequence
atgcggttaaggactcggaaggcgagccagcaatccaatcaaatccagacccagcgcacggctagggcaaagcggaagtacagcgaggtggatgacagcttgcctagtgggggtgagaagccaagtaaaaacgagactggcttactgtccagtataaaaaagtttatcaaaggcagtacaccaaaggaagagcgggagaaccccagcaagcgcagtcggattgagcgcgacattgacaacaatctcattacctccactcctcgggcaggcgaaaaaccgaacaaacagatttccagagtgagaagaaagtcacaggtaaacggagaagcgggtagctatgagatgacaaaccagcacgtgaaacagaatggaaagctggaggataatccatcttccggcagccctccaaggaccactcttctgggcaccatcttctccccagtgtttaatttttttagtcccgcaaacaagaacgcaccagtgacccccgattccgggtattcaagtgctcacgccgaagccacctatgaagaggattgggaggtttttgacccgtattacttcattaaacatgtcccccctcttacagaggaacagttaaatcgcaagcctgctctgccactgaaaaccaggagtacacccgaatttagcttggtgcttgacctggatgagactctggttcactgttccctgaacgagctggaagacgccgcactgactttccccgtcctgtttcaagacgtgatttaccaagtgtatgttaggctgcggccatttttcagggagtttttagagaggatgtcccaaatgtatgagataatactcttcaccgcatctaaaaaggtatacgctgacaagctcctgaatatcctagaccctaagaagcaacttgtgagacaccgactgttcagggaacattgtgtgtgtgtgcagggaaattatattaaggacctgaacatcttggggagagacctgtccaagacgatcatcattgataacagccctcaagcattcgcttaccagctttccaatgggattcccatcgagtcctggttcatggacaaaaacgataatgagcttctgaaactgatccccttcctggaaaaactggtggaattaaatgaggatgttcgaccccacattcgggaccgctttaggctccatgatctgctgcctccagattag

SEQ ID NO: 55293 - DNA, 498 bp, Artificial Sequence
  Description of Artificial Sequence: Synthetic coding sequence
atgagactgagaacaagaaaggccagtcaacagtctaatcagatccaaacccaaagaacggcacgggctaaacggaaatattcagaagtggatgatagcctcccatccgggggtgaaaagccctcaaagaacgagacaggattgcttagttctatcaaaaaattcatcaaggggtctacccctaaggaggagcgtgaaaatccctccaagagatcacgcattgaaagggatattgacaataaccttatcacaagcactccacgggcaggcgaaaagcccaataagcagataagccgcgtcaggcgcaagagccaagttaatggcgaagcaggatcctacgagatgacaaaccagcacgtcaagcagaatggtaagctggaagacaaccccagtagtggttcacccccacgcacaaccctgctcggtacgattttttcacctgtctttaactttttctcccctgcgaataaaaatggcaccagcggaagcgactcctag

SEQ ID NO: 55294 - DNA, 1401 bp, Artificial Sequence
  Description of Artificial Sequence: Synthetic coding sequence
atgagattacggacccgaaaagctagccagcaaagcaatcaaatccagacacagcggacagcacgcgctaaacgaaaatactccgaggttgacgacagcttacccagcgggggtgagaagccgtctaagaacgaaaccggtctcttatcttcaattaaaaagtttataaagggttctactccgaaggaggagcgggagaacccgagcaaacgttctcgaattgagagggatatagacaataacctgattaccagtaccccacgggctggcgaaaaaccaaataaacagatctcaagggtccggaggaagtctcaggtcaacggcgaagctggtagttacgaaatgacaaatcagcacgtgaagcagaatggaaaactcgaagacaacccttccagcggatctcctcccagaaccacactgctaggcaccatattttctcccgttttcaacttcttttctcccgcaaataaaaatgggactagtggtagcgattctccgggacaggccgttgaagctgaggaaattgtgaaacagctcgatatggagcaagtcgacgaaataacgacctcaactacaacctctacaaatggagccgcttattccaaccaagctgtgcaggtgcgcccatccctgaataatggcttagaagaagctgaggagaccgttaatagggacatccctccattgacagcaccagtgactcccgactcaggatattcaagcgcgcacgcagaggcaacatatgaggaagattgggaagtgttcgacccttactatttcatcaaacacgttcctccccttaccgaagagcagctcaatcgaaagcctgccctgcctcttaagacacggtcgactcccgagttttcactggtgttggacctcgatgagacgctggtgcattgctcgctcaatgagctggaggacgccgcactgactttccctgttctgttccaggacgtcatttaccaggtttatgtgcggttgcggcctttcttccgtgaattcctggaacgcatgtctcagatgtacgagatcattctgttcacggccagtaagaaggtttacgcagataagcttctgaacatccttgaccctaagaaacagttagtgcgtcataggctcttccgggagcactgtgtgtgtgtgcagggcaattatatcaaagaccttaacattcttggtcgagacctgtctaagacgataatcattgataactcaccccaggcattcgcgtaccaactgtcgaacggaattcccatcgagtcatggtttatggataagaacgacaatgagctgctgaagctcattcccttcctggaaaagttggtcgagctgaatgaggatgtaaggcctcatatacgcgacagattcaggctgcatgacctgctcccacctgattag

SEQ ID NO: 55295 - DNA, 279 bp, Artificial Sequence
  Description of Artificial Sequence: Synthetic coding sequence
atgaggcttagaacccgaaaggcgagccagcaatcaaatcagatccaaacgcagcggactgcaagagcaaagcggaagtacagcgaagttgacgacagcctcccgagtgggggtgagaaaccctccaagaatgaaacaggcctgctcagctccattaaaaagtttattaaaggttccacaccaaaggaggaacgcgaaaacccaagcaaacgctcccgcattgaacgtgacatcgataacaatctgattactagcacacccagggccggagaaaagtag

SEQ ID NO: 55296 - DNA, 354 bp, Artificial Sequence
  Description of Artificial Sequence: Synthetic coding sequence
atgcgactgcggacgcgcaaggcctctcagcagagcaatcagattcaaacccagagaactgcgagggccaagaggaagtactcggaagtggatgacagcctcccaagcgggggagagaagcccagcaagaatgagaccggactcctttcctccattaagaagttcatcaagggcagtacccctaaagaagagagggaaaacccttcaaagagatctcggattgagagggatatcgataacaatctaatcaccagcacccctcgggcaggagaaaaaccgaataagcaaatcagtcgcgtccggagaaaatctcaagtgaacggtgaggcaggctcctacgagatgacaaattag

SEQ ID NO: 55297 - DNA, 522 bp, Artificial Sequence
  Description of Artificial Sequence: Synthetic coding sequence
atgggagacctgccatgggcacctccagaggcacaggccccatccaccgctggagctggagatgtagctgagcaccaggttgctcccgctcgttttctccaaggcgcttggaggcaggcagccggatggctttgtcgagagacaggagccgctcctggatcagctcaagcaggtcccccagagactgcccatgccgcagatccacaaccaagaggaccccaggcccctcccagattgccaccatcactgtccccagagagggtccatccgggacaacccgcagcgcctgctgaacccgctccaggagcaccggctcttcggagtgggccaagtcagcctcgcggtcttcggctgcctgtgcccgtgcccgcatgcgctggctcgagcgcacctggctcgcctgcagcgctgccggactcctacccctggcctccccctgcaagaaaccggccagcaaccctgccccctacttctcgcgtgtcccccttagctgcctttctggcctcggcaccccagcgctag

SEQ ID NO: 55298 - DNA, 252 bp, Artificial Sequence
  Description of Artificial Sequence: Synthetic coding sequence
atggcgtcgactcccatggggaatgagggtgaaaaaaaaagttcctggcccagtcaggccgctccaagcctccgcggaggtccagcaagcctctcccggtcagaagagtacctctcgcagatcagtgccgaactcatggaagaagccctttgtaccgcctgttgccacttaaaccccgttcccatcaagaagaaacagagccaggatcaggcaacacagatatcaaagagggcattctttacaaagacctag

SEQ ID NO: 55299 - DNA, 606 bp, Artificial Sequence
  Description of Artificial Sequence: Synthetic coding sequence
atgttcctggtggtggcagtgaatagtctgaccctctatcagccatctttccggccactgcttggcgacgcttgctgtctctgcgtggctgccgctgcgggtgccctctgccgggatctcggccctcaccacacgcacacgcgtggacctaacgacggctcatgtggactgtctagatggcgccataggcagcatggagattcaccggaggacttttttctggctagaggagcccacctcgcctcaacgaggggacgaaacgagcactctcctaaaggtagtttacagaagtgcctgttgtctattcgagtacagactacccggctttcacacctgcgtgctggcgttactttgcgctgcgtgctgctctgtgtctctgaaagccccgtcggcctgcggtcagtggcatgctcgggggacctgctgggcgacccacttaccggattcctggctttcctggtttcctgtctcaccccgtcaggcactccagggaatacctctttgacaaaacttagccccacctctagttcacagggactagcactcggacctctcagtcctagttcctgtgacgctgcctcaccaagcatcagtcttggtttatag

SEQ ID NO: 55300 - DNA, 645 bp, Artificial Sequence
  Description of Artificial Sequence: Synthetic coding sequence
atggaaccggctcgggaacctccttctagagcaagaccacccccaccccttgctgcacgtccagcccctgcacccgctgcccctcgccctaggtcccccgctgaggctgaagccagagggccagaaggcttactgcgacggagtggtagcggttacgaggggtctacatcctggaaggcagccctggaggataccactaccagactcctgctcggggctattgcagttctgttattcgccatactcgtggtgatgtcaatcctcgcaagtaaggggtgtataaagtgcgaagccccttgccccgaggactggcttttgtacggcagaaagtgttactttttcagtgaggagcctcgagattggaacacgggcaggcaatattgtcatacgcacgaagcagtgctcgcagtgatccagagccaaaaagaattagagtttatgttcaaatttactaggagagagccatggattgggctgagacgcgtcggcgacgaattccactgggtcaatggggacccattcgatccagatactttcactatcgccggacccggagagtgtgtcttcgtggagcctacgaggctggtgtccaccgaatgtcttatgacacgtccctgggtgtgttcaaagatggcctacacctag

SEQ ID NO: 55301 - DNA, 1824 bp, Artificial Sequence
  Description of Artificial Sequence: Synthetic coding sequence
atggaactggttagaaggctcatgcccctcactttgctcatcctttcctgtctggccgagctgacaatggcagaggcggaggggaacgcttcctgcactgtgagcctcggtggagccaatatggccgagactcataaggctatgatattgcaactgaacccttcggagaattgcacatggaccatagagcggcctgagaacaaatccattcgaatcatcttttcctatgtgcagctagaccccgatggctcttgcgagtcggagaacatcaaagtgttcgacggtacttcctccaatggccctttgcttgggcaggtttgtagcaaaaatgactacgtgccagtttttgaatcctcatctagcacgttaacttttcagatcgtgacggattctgcaagaattcagagaaccgtcttcgtgttctactatttcttctcacctaatatcagcattccaaattgcggcggatacctagacacactggaaggatcctttacaagtcccaattatcctaaacctcaccccgagctggcatattgtgtgtggcatattcaagtggaaaaggattataagattaaattgaattttaaagagatctttctggagatagacaagcagtgtaagttcgacttcctcgccatttatgacgggccttcgacaaactcaggtctgatcggccaggtttgcggcagagtcacgccaactttcgagagcagctcaaactcactcacagtagtgttgtcaaccgattatgctaattcatatcgcggattcagtgcatcttacacctccatctacgctgaaaatataaacaccacctctttgacttgtagctcagaccgcatgagagtgatcatctcaaagtcctatctggaagcttttaattccaacggtaacaatctgcaattgaaggacccgacctgtcgtccaaagttgtccaatgttgtcgagttcagtgtgccattaaacgggtgcggtaccatcagaaaagttgaagatcaaagcattacatacaccaatatcataacattctccgcatctagtacctccgaggtgatcactagacaaaagcagctgcaaatcatcgtaaagtgtgagatgggacataattcgaccgtcgagatcatatatattactgaggacgacgtgatacagtcacagaacgcattaggaaaatacaatactagtatggcgctctttgaatcaaacagcttcgagaagaccatcttagagtccccatactacgtggatctgaaccagaccttatttgtccaggtgagtctgcatacctcagatcctaatttggttgtgttcctcgacacttgcagggccagccctacctctgatttcgcctcacccacctacgatctgatcaagtcaggatgctctagggacgagacttgcaaggtttatccactcttcggacactacggtaggtttcagttcaatgcattcaagttcctgagaagtatgtcgagcgtctatttgcagtgtaaagttctgatttgcgacagtagcgaccaccagtcccgctgcaatcaaggatgcgtgtcacggtcgaagagggacatctcctcctataaatggaaaactgacagcataattggcccaatccgtctcaagcgcgatcgaagcgcttccggaaactccgggtttcaacacgagactcacgccgaagagactcccaatcaacctttcaactctgtgcacctgttctccttcatggtgctcgctctgaacgtcgtcactgtcgctactatcaccgtcagacatttcgtcaaccaaagagccgactataagtatcagaagctgcaaaactactag

SEQ ID NO: 55302 - DNA, 1824 bp, Artificial Sequence
  Description of Artificial Sequence: Synthetic coding sequence
atggagctggtgcgtaggcttatgccgctaacgctcctgatccttagttgcttagcagaactaacaatggcggaggcagagggaaacgcaagttgtaccgttagcctaggaggggctaacatggccgaaactcacaaggcaatgatccttcagctcaatccctctgaaaactgcacatggacaattgaacgacctgagaataagtcaatacgtattattttctcttacgtccagctggatcctgatgggtcctgtgaatccgagaatattaaagtgtttgacggcacctcttcaaatggacctctcctgggccaggtgtgttccaagaacgactacgtaccagttttcgaaagttcatcatccacactgaccttccaaatcgttaccgactctgccagaatacagcgcaccgtgttcgtgttctactacttcttttccccgaatattagtatccctaactgcggaggctatttggacacactagaaggttcatttacctctcctaattatccaaagccccaccctgaactggcctattgcgtatggcacatccaagtggaaaaagattacaaaatcaagctgaactttaaggaaatctttctcgagattgataagcagtgtaaatttgattttctggccatctatgacgggccaagtacaaactccggtcttatcggccaggtttgcggcagagtgacccctacctttgagtcttcaagcaactcactcacagtcgttctcagtaccgactacgctaatagttatcgaggattttcggcgagctatactagcatctacgccgagaatatcaataccacatctctgacctgttcgtctgatcgtatgcgcgtgattatcagcaaatcttaccttgaggctttcaatagtaatggcaataatctacagctgaaggatccaacttgccgccctaaactttctaacgtggtagaattcagtgtgcccctcaacggctgcggaacgatccggaaggtcgaggaccaatctataacctacacaaacattatcacattttccgcttcctctacgagtgaggtaattacaagacaaaagcaactgcaaattattgtcaaatgtgagatgggccacaatagcacggtcgaaattatttacataacagaggacgacgtgatccagagccagaacgccctgggtaagtacaacacatccatggcgttgtttgaaagcaactccttcgaaaaaacgatcctagaatctccatactacgtcgacttgaaccagactctcttcgtgcaggtgagtctccatactagcgaccccaatctagtggtgttcctggacacatgccgtgcatcgcctacctccgatttcgcatcacccacatacgacctaattaaatccggctgctcccgcgacgagacatgcaaagtgtatccactgtttggccattacgggaggttccaatttaacgcatttaaattcctgcgtagcatgtcctcagtgtaccttcaatgtaaagtgctgatctgcgattccagcgaccatcagtcacggtgtaatcagggctgcgtgtcccggtccaaaagggatatatcgtcatataaatggaaaaccgattccattatcgggccaattcggttgaagagagacaggagtgcctctggcaactcagggtttcaacatgagactcacgctgaagagactcccaaccagccatttaatagcgttcacttattttctttcatggtcctcgctctcaatgttgtgacagtcgcaaccatcaccgtccgtcactttgtcaaccagcgcgcagattacaagtatcaaaagctccagaattattag

SEQ ID NO: 55303 - DNA, 1161 bp, Artificial Sequence
  Description of Artificial Sequence: Synthetic coding sequence
atgacgtccctgttcaggcgatccagcagcggctccgggggaggtggcactgctggcgcacgtgggggtggcggtggtacagcggcaccccaggaactgaacaattctcgtccggcacggcaggtcaggcgcctcgaattcaaccaggccatggatgacttcaagacgatgttcccaaatatggattatgacataattgagtgcgtgttacgggctaattcaggggctgtggatgctacgatcgatcagctgctccagatgaatctggagggaggcggaagtagcggcggagtgtacgaagatagttccgatagtgaagatagcattcccccagaaattttggagaggactctcgagccagattcatcagatgaggagcctcccccagtctacagtcctccagcttatcatatgcacgttttcgaccgtccataccctctggcccctcccactcccccaccacgtatcgacgctctgggctcaggtgctccgacttcgcagagacgctaccgtaattggaatcccccattgctggggaacttgcccgatgacttcttgcgaatccttccccaacagctcgattccatccaggggaatgcgggaggaccaaaacctggttcaggcgaggggtgccctcctgctatggccggtcccggaccaggtgatcaagagtccaggtggaagcagtatcttgaggatgaacgtattgcattattcttgcagaacgaagagtttatgaaggagctgcagaggaacagagattttcttctggccttggaaagggaccgactcaagtatgagagccagaagagtaaaagtagctcggtcgcggttgggaatgatttcggattctcctctccagtgcctggaacaggcgacgccaacccagccgtgtccgaagacgcgcttttccgtgacaagctgaaacacatgggaaagtctacccgaaggaagctgtttgaattggcgcgagccttctcggagaaaaccaaaatgaggaagtctaagaggaaacatcttttaaaacatcagagcctgggggctgctgcgtccactgctaatctgctggatgatgtggagggccacgcatgtgacgaagactttcgaggacgtcggcaggaagcccctaaggtcgaggagggacttagggagggtcagtag

SEQ ID NO: 55304 - DNA, 1161 bp, Artificial Sequence
  Description of Artificial Sequence: Synthetic coding sequence
atgaccagcctctttagacgctcttcatctgggtcaggaggtgggggaacggcaggggctcgcggaggcggagggggaactgccgcaccacaggagctaaataactcccggcctgcccgacaggttaggagactggagtttaaccaggccatggatgatttcaagaccatgttccctaatatggactatgatattattgagtgtgtgcttcgtgcaaattccggcgctgtcgatgcaacgatcgaccaactgctccagatgaaccttgaaggaggcggaagcagtggcggtgtgtacgaagattcttcagatagtgaggatagcattccgccagagatcctggaacgcacgctggagcctgattctagtgacgaggaacccccaccggtgtattccccgcctgcctaccacatgcacgtctttgacaggccataccctctagccccacccacgccacctccacggattgatgctctggggtcgggtgcaccgaccagccaaagaaggtatcggaattggaatccaccgctgcttggcaatcttccagatgatttccttcggattctgcctcagcagcttgactctatacagggaaacgctggaggcccaaagcccggatctggggaggggtgtcccccagctatggccggacccggtcctggtgatcaggagagtcggtggaagcaatatctggaagatgaacgaatcgcactcttcctgcaaaatgaggagtttatgaaagagctccagcgtaaccgagactttctcctggccctcgagagggatcgtctgaagtacgagtcacagaagtccaagagtagcagtgtggccgtgggaaatgacttcggctttagctctccagttccaggcaccggcgatgccaaccccgctgtatccgaagacgctctgttcagagacaagctgaagcacatgggaaaaagcactaggcggaagctttttgaactggccagagctttctcggagaaaacaaagatgcgcaaatctaaaagaaaacatctgctgaaacaccagagcctaggggctgccgctagcaccgcaaacctactagacgacgtagaggggcatgcatgtgacgaggactttcgcggtcgtaggcaggaggcccctaaggttgaggagggactgagggaaggccagtag

SEQ ID NO: 55305 - DNA, 471 bp, Artificial Sequence
  Description of Artificial Sequence: Synthetic coding sequence
atgcccgcattgctgcctgtggcttctcgcctgttgctccttcccagagttctgctcactatggcaagtggatcccctcccacccagccctctcctgcctccgacagcggcagtggttacgtcccgggatctgtgtctgcggctttcgttacatgccccaatgaaaaggtggccaaggaaatagctcgggctgtggtcgagaagcggcttgctgcctgtgtgaacctcatcccacagattacgtctatctatgagtggaagggcaagatcgaagaagattcagaagttctcatgatgattaaaacccagtctagcctcgtgccagccctgaccgacttcgtccggtctgtacacccttacgaagtggccgaggtgattgccctgccggtggagcagggaaattttccctacctgcagtgggtacggcaggtaaccgagagcgtttcagatagtataaccgtgttaccctag

SEQ ID NO: 55306 - DNA, 597 bp, Artificial Sequence
  Description of Artificial Sequence: Synthetic coding sequence
atgattggcagcggcttggcaggctcagggggagccggtgggcctagctctaccgtgacatggtgtgctctgttctccaaccacgtcgccgcaactcaggctagcctcctcttaagctttgtttggatgccagccctcctcccagtggcatccagactattgctccttcctagagttctgttgactatggcatcaggttcccctccaacgcagcctagccctgctagcgactcaggcagcggctacgtgcccggatccgtgtcagcggcttttgtgacttgccctaatgagaaggtcgcaaaagagattgccagagcagtggtagaaaagaggttagccgcatgtgtgaatctgataccacagatcacctctatttatgagtggaaggggaaaatcgaagaggattccgaggtcttgatgatgattaaaacccagagttcattggttcccgcactaacagactttgttaggtccgtgcatccgtacgaagttgcagaggtcattgcacttcctgtggagcagggaaacttcccatatttgcaatgggtgagacaggtgaccgaaagtgtgagtgattccatcaccgtccttccctag

SEQ ID NO: 55307 - DNA, 471 bp, Artificial Sequence
  Description of Artificial Sequence: Synthetic coding sequence
atgcccgctctgctccctgttgcctcccgactcttactactgcctcgagtgctgctgaccatggcatcgggctcgccccctactcaaccatcccctgcctccgattcagggtccggttatgttcctgggagcgtgagcgctgccttcgtaacctgtcccaacgagaaagtggccaaggaaatcgcccgtgccgtcgtggaaaaaagactggccgcatgtgtgaatctgatccctcaaatcacgtctatctacgaatggaagggcaaaatcgaggaagatagtgaagtactgatgatgatcaagacccagtcaagtcttgtacctgccttgaccgatttcgttcggtccgtgcatccatatgaggtcgcagaagtaatagcgttacccgtcgagcagggtaatttcccctacctgcaatgggttcgacaggtgaccgaatctgtcagtgacagtatcaccgttcttccgtag

SEQ ID NO: 55308 - DNA, 540 bp, Artificial Sequence
  Description of Artificial Sequence: Synthetic coding sequence
atgtcaggaggtagggccccagccgttctgctggggggagttgccagcctcctgctgtcctttgtttggatgccggctctgcttccagtggcatcgcgcctgcttctccttccgagagtcctcctgactatggccagtggatccccaccaacccagccgtccccggcaagcgactctggcagcgggtatgtgccagggtctgtctctgctgcattcgtgacctgtcccaacgaaaaggtggccaaagagatagcacgggctgtagtggaaaaaagattagccgcttgcgtaaatctgataccccaaattacatctatctacgaatggaaaggaaaaatcgaggaagatagtgaagtgttgatgatgattaagacgcagagctcactggtgccagcacttaccgattttgtacgcagcgtgcacccttacgaggtggctgaggtcatcgctttacccgttgagcaaggcaatttcccctacctgcagtgggtgcgccaggttactgagagcgtctctgatagcataacagtgctgccatag

SEQ ID NO: 55309 - DNA, 540 bp, Artificial Sequence
  Description of Artificial Sequence: Synthetic coding sequence
atgtctggtggcagagctcccgctgtactgttgggcggtgtggcttcgctcctgctaagctttgtctggatgcccgcactcctaccagtggcatctagactgctgcttctgcccagggtactgctgactatggcaagcggttctcctcctactcagccctcacccgcaagcgatagcggatcagggtatgtgccaggcagtgtctctgctgccttcgtgacttgtcccaacgagaaggttgctaaggagattgcacgagccgtggtagagaagcgtctcgccgcttgcgtcaacctcatacctcagatcaccagcatttatgagtggaagggtaagatcgaggaggacagcgaggtgctcatgatgataaagactcagtcctctctggttcccgcactcacggactttgtgagaagcgtgcatccatacgaagtggctgaggtaatagctctaccggtagagcaagggaacttcccctacctgcagtgggtgcgtcaagtaacggagtctgtgagtgatagtattacagtcctgccatag

SEQ ID NO: 55310 - DNA, 129 bp, Artificial Sequence
  Description of Artificial Sequence: Synthetic coding sequence
atgtccggaggtcgagcgccagcggttctcctgggaggagtggtgagtgaccgccctcgcccagccccatccggccctcggtctctcgacagatacccacaccctaaatcacagagactcgccccttag

SEQ ID NO: 55311 - DNA, 690 bp, Artificial Sequence
  Description of Artificial Sequence: Synthetic coding sequence
atgaccacagcggctcggccaacatttgagcctgccagagggggtagggggaagggtgaaggagacctttctcagctcagtaagcagtattctagcagagaccttcccagtcacacgaagatcaagtacagacagactacacaggatgcccctgaggaggtaagaaaccgcgattttaggcgcgagttagaagagcgtgagcgtgccgctgctagggaaaagaaccgcgatcgaccaaccagggaacatacaacttcctcaagtgtgtccaagaagccgagactggaccagattcccgctgctaacctggacgcagacgaccctttgaccgatgaggaagatgaggacttcgaagaagaaagtgacgatgatgatactgccgctctcctggccgagcttgagaagattaagaaagagcgggctgaggagcaagcacgtaaggaacaggagcaaaaagccgaggaagagcgcatcagaatggaaaatatactttcaggcaaccctctcttgaacctgacaggacccagccaaccacaagccaactttaaggtgaagcgcagatgggacgatgatgtggtctttaaaaactgtgctaaaggggtggacgaccagaaaaaggacaagcggttcgtcaatgatacgcttcggtcggagttccacaagaagttcatggagaagtacatcaagtag

SEQ ID NO: 55312 - DNA, 618 bp, Artificial Sequence
  Description of Artificial Sequence: Synthetic coding sequence
atgtcaattatgtcgtataacggaggcgctgtgatggctatgaagggtaagaactgtgtagccatcgccgctgacaggaggtttgggatccaggcacagatggtgaccacagatttccagaagattttcccaatgggtgaccgactctatataggattggcgggactcgctaccgatgtccagacggtagcacagcgcctgaagttcagactaaacctgtatgagttgaaggaagggagacaaatcaaaccctatactttgatgagtatggtggcgaacctgttgtacgaaaagcgatttggtccctattacaccgagcccgtgatagccggtctcgatccgaagacattcaaaccatttatttgctcccttgatttgatcggttgcccaatggtaactgacgattttgtggtgagtggcacttgcgctgagcagatgtacggcatgtgcgagtctctttgggaaccgaacatggacccggatcatctgttcgaaactatttcccaagcaatgcttaacgcagttgatcgcgacgccgtttcggggatgggggtaattgtgcatatcattgagaaagacaaaataaccacgagaactttgaaggcacgaatggactag

SEQ ID NO: 55313 - DNA, 1089 bp, Artificial Sequence
  Description of Artificial Sequence: Synthetic coding sequence
atgaagaaagaggagaagctggattggatgtatcaagggcctggaggaatggtcaatcgggacgaatatttgctgggcaggcccattgataagtacgtgtttgagaagatggaggagaaggaagccggatgttcgagtgagacaggcctgttgccgggtagcatatttgctcctagcggagccaatagcttgctggatatggcgagtaaaattcgagaggatcctctgttcatcattcgtaaaaaagaagaggaaaagaagcgtgaagtacttaacaacccagtcaagatgaaaaaaatcaaagagttgctacaaatgtccctggaaaaaaaggaaaaaaagaagaagaaggagaaaaaaaagaaacacaagaagcacaaacataggtcctctagctcagataggtctagtagtgaagacgagcactcagccggtcggtcccagaaaaagatggctaacagctcccccgtgctaagtaaggttccgggttacggcctacaagtaagaaatagtgaccgaaaccaagggctgcaggggccattgacggcggaacagaaacgcggacacgggatgaagaatcactccaggagccgcagctctagtcattcaccgcctcgacacgcctcgaagaagagcacccgggaggctggctcccgagacagaagatcaagatctctggggagacgttcgcgcagcccgagaccaagcaagttgcacaacagcaaagtgaataggagggagacaggccaaacaagaagcccaagcccaaagaaggaggtatatcaacgccgacatgcacctgggtacacacgaaagctctctgctgaggaattggaaaggaaacgccaggagatgatggagaatgccaaatggcgcgaggaagaacgacttaacattttgaagcgccatgctaaagacgaggagcgggagcagcggctggagaaactggattcacgggatggaaaattcattcaccggatgaaattggagtccgccagcacttccagcctggaggatcgcgttaagcggaatatatatagccttcagcggacctcagttgcactagagaagaatttcatgaagcgatag

SEQ ID NO: 55314 - DNA, 1617 bp, Artificial Sequence
  Description of Artificial Sequence: Synthetic coding sequence
atggcccagaagcctcttaggctgttggcttgtggtgacgtcgagggcaagtttgatattctgttcaaccgggtgcaagctatccagaagaaatccggaaactttgacttgctcctgtgcgttgggaacttttttgggtcaactcaagacgccgagtgggaagagtataaaaccgggataaaaaaggctcccatccagacgtacgtgttgggagcaaacaatcaagaaactgttaagtactttcaggatgcagatggatgcgagctcgcggagaatataacctacctagggcgtaagggaatcttcacgggtagcagcggacttcagattgtatatctctccggcaccgaaagcctgaatgaaccagttccaggatacagctttagtcccaaggatgtttccagcttgagaatgatgctgtgtaccacatctcagtttaaaggcgtggatattctgctgacttccccctggccaaagtgtgtgggaaatttcggcaattcctcaggggaagtggacacgaaaaagtgtggatccgccttagttagttctctcgctactggccttaagccaaggtatcatttcgcggctctagaaaagacctactacgaaaggctgccgtatcgtaatcacatcattctgcaggaaaatgctcagcacgcaacaaggtttatagccctcgcaaatgtcggtaatcccgagaagaaaaagtatctatatgctttttcaatagtgccgatgaaattgatggacgcggcagagctagtgaagcaaccacctgacgttacggagaacccttatcggaaatcaggacaggaagctagcattgggaagcagatcctggccccagtggaagagtcagcctgccaatttttctttgacctcaacgaaaaacagggtcgtaagcgctcaagcacgggtagagactctaaaagttcccctcacccaaagcaaccgaggaagcccccacagccgccaggcccttgctggttctgtctcgccagccccgaggttgaaaaacatctagtggtgaacatcggaacccactgctatctggcgcttgcaaaaggagggttgtcagatgaccacgtgctaatactgccaattgggcactatcaatctgttgtggagctatccgccgaggtggtagaggaagtggagaagtataaggctaccctgagaaggttttttaagtcacgtggcaagtggtgtgtagtgttcgagcgtaattacaaatcacatcacctccaactccaggttatcccggtcccaattagctgttcgactaccgatgacattaaagatgcattcattactcaggcacaggaacagcagattgagctactggagatccctgaacatagcgatattaagcagatagcacagccgggagctgcctatttctacgtcgaattggacacaggcgaaaagctgtttcacagaattaagaaaaactttccgctgcaattcggacgagaagtccttgcttcagaagctatcctcaacgtcccagacaagagtgactggagacagtgtcaaatcagtaaggaagatgaggaaactctggccaggcggttccggaaagattttgaaccctatgacttcacactcgacgattag

SEQ ID NO: 55315 - DNA, 762 bp, Artificial Sequence
  Description of Artificial Sequence: Synthetic coding sequence
atgaagttgatggatgcagcagaactcgtgaaacagccgcctgacgtgaccgaaaatccatacaggaagtccggtcaggaggctagcatcggcaagcagatcctcgctcccgtggaggaatccgcatgccaattcttttttgatttgaatgaaaagcagggaaggaagcgaagtagtaccgggagagattctaaatcttctccccaccccaagcaacccaggaagccccctcagcctccagggccttgctggttctgtctggcttcccctgaagtggaaaagcacttggtggtgaacatcgggacccactgttatttggcactggctaaggggggactgagcgatgatcatgtcctgatattgccgatagggcactaccagtcggtggtagagctctccgccgaagtggtggaggaagtcgaaaaatacaaggccaccctaagaaggttttttaagtcacgcggaaagtggtgtgtggtttttgagcggaactataagagccaccatcttcagctccaaatcgctcaaccaggagcagcatacttttacgttgagctggacacaggtgagaagctcttccataggattaaaaagaatttccctctgcagttcgggagggaggtgctggcaagtgaggccattttgaacgtacctgataaatccgattggcgacagtgccagatttccaaggaggatgaagaaactttggccaggaggtttcgtaaggattttgagccctacgactttaccctggacgactag

SEQ ID NO: 55316 - DNA, 1617 bp, Artificial Sequence
  Description of Artificial Sequence: Synthetic coding sequence
atggcgcagaagcccctgagactgttggcgtgcggcgatgtggaggggaaattcgatattctattcaaccgagtgcaggcgatccaaaagaagtctgggaacttcgacctgctactctgcgttggcaatttctttggaagcacacaagacgcagagtgggaggagtacaagaccgggatcaagaaggccccaatccagacttacgtgctgggggcaaataaccaggagactgtcaagtactttcaggatgcggacggatgtgaactagccgaaaacattacctacctaggccgtaaagggatctttaccggaagttccggcctgcagattgtctatttgagcggcacagagagcctcaatgagcctgttcccggttacagtttttcccccaaagatgtgtccagcctgcgcatgatgctctgcacaacatctcagttcaagggagtcgatatcttgctcacgtctccatggcccaagtgcgttggcaatttcggaaactcctctggggaggtggacactaaaaagtgcggatctgctttagtctcttcgttggctaccgggctgaagcccaggtaccatttcgcggctttggagaagacatactatgagcggttaccatatcggaaccacatcatcctgcaggagaacgcacaacatgcaacgaggttcattgctctggccaatgtggggaatccagagaagaagaagtatttatacgcttttagcattgtgcccatgaagttaatggacgctgctgagctggtcaaacaacctcccgatgtgaccgaaaatccgtaccgcaaaagcggacaagaggcctctatagggaagcagatccttgcccctgtggaagaatccgcctgccagtttttcttcgatttaaacgagaagcagggcaggaagagaagcagcacgggccgagattccaagtctagccctcatcccaagcaaccacgcaagccacctcagccaccgggtccctgttggttttgcctggcgagccctgaagttgagaagcacttggtcgtaaatatcggaactcactgctaccttgctctcgctaagggcggtctaagtgacgaccacgtgttgattctgccaattggacactatcaatcagtggtggaactttctgcggaagtggtagaagaggttgaaaaatataaagccacccttcgcaggttttttaagagcagaggaaaatggtgtgtggtcttcgagcggaactacaagtcgcatcatttacaactacaagttattccagtgcctatcagctgctcgacaaccgacgacataaaagatgcctttatcactcaggctcaggagcaacagattgaattgctggagatccctgagcacagcgacatcaagcaaatagctcagcccggagcggcttatttttatgtcgagctggatacgggagagaaactgttccatcgaatcaaaaaaaatttccccctgcagttcggtcgggaggtcttggcgtcagaggctatcctgaacgtacctgacaaatcagattggaggcagtgccagatcagtaaagaagacgaggaaacactggcgagaaggttcaggaaggatttcgaaccctatgactttactctggacgactag

SEQ ID NO: 55317 - DNA, 2685 bp, Artificial Sequence
  Description of Artificial Sequence: Synthetic coding sequence
atggccactagcatggccgcagcatctgggagattcgagtccgccaaatctattgaggaacgaaaagaacaaacacgaaatgccagggccgaggtgctgcgacaagcgaaagccaacttcgagaaggaagagcgccgaaaagaactgaaacgcctgaggggcgaggacacttggatgctgcccgacgtgaacgaacgaatcgaacaattctctcaagaacactccgttaaaaagaaaaagaagaaggataaacactcaaaaaaagcgaagaaagagaagaagaaaaagtccaagaagcagaaatatgaaaagaataatgaatcctccgattcttcaagctcaagcgaggatgagtgggttgaagctgtaccttcgcagactccggataaggagaaggcctggaaagtgaaagacgaaaagtccggaaaagacgatacacaaatcatcaaaagggacgaatggatgaccgtggatttcatgtccgtcaagactgtgagttcatctagtttgaaggccgaaaaggaaacaatgagaaaaatagagcaggaaaaaaaccaggctttagagcagtctaaactcatggagcgcgagctcaatccttactggaaggatgggggtaccggtctgcccccagaggactgttccgtgagcagcattactaaagtgtctgttgtcgaggatgggggactcagttggctccgtaaatcctacctcaggatgaaagagcaggcagaaaagcagagcaggaacttcgaggacatcgtggccgagcgctacggtagtatggagatctttcaatccaagctggaggatgctgagaaagcagcatcaactaaagaagattataggagggaacgatggcgcaaacctacttattcagataaagcacagaattgtcaggaatctagggaatctgatctggttaagtacggtaacagtagtagagacaggtacgctacaactgatacggccaagaattccaacaacgagaagtttatcggggacgagaaagacaaacggcctggctccctagagacctgtcgtagggagagcaaccctagacaaaatcaggagttcagcttcgggaacttgcgcgcaaaatttctgcgcccatcggatgacgaggagctgtcctttcattctaaaggccgtaaatttgaaccgctgtcctcgtcctctgcactggtggcccaggggagtttgtgttccggctttaggaagcctaccaagaactcagaggaaaggctcacctcctggagtaggagtgacggtcgaggcgataagaagcactcgaaccagaaaccatccgaaacatctaccgacgagcatcaacacgtgcccgaagatcccagagaaaagagtcaagatgaggtgcttagagacgatcctccaaagaaggaacacctgcgcgataccaagagcacttttgccggtagccctgaaagagaatcgatccacatcctgtcagtcgacgaaaagaataaactcggagcaaagattattaaggctgaaatgatggggaacatggagctggctgaacagttaaaggtgcaattggaaaaggctaacaagtttaaagaaactatcacccagatcccaaaaaagtcgggggtagaaaacgaagaccagcaggaggtcatcctcgtgagaacagatcagagcggccgagtgtggcccgtgaatacccccggaaaatcattggagtcgcaaggtgggagacggaaaaggcagatggtcagtactcatgaggagagagaaagggtccgatattttcatgatgacgacaacctctcgctgaatgacctggtcaagaacgaaaagatggggacagcggagaatcagaacaagttgttcatgagaatggcctctaagttcatggggaaaaccgacggagactattatacattggatgatatgttcgtgtccaaggccgctgaacgtgagcggctaggtgaagaagaggagaaccagcggaaaaaggccatcgcagagcaccggtccctggccgcacaaatggaaaagtgcctgtattgtttcgactcatctcagtttcctaagcacttaatagttgcaatcggggtgaaggtgtacctgtgccttcccaacgtacggtctctgacggagggtcactgtttgatcgttcccttacagcaccacagagcggctacacttcttgatgaagacatctgggaggaaattcagatgttccgcaaaagtctggttaaaatgttcgaagacaaggggttggactgtattttcctggaaactaacatgtctatgaagaagcagtaccatatggtttatgagtgcatcccactgccgaaggaggtgggagacatggcccctatttacttcaagaaggcgatcatggagtcagatgaggaatggagtatgaataagaaattaatcgacctttcctccaaggatatcagaaagtctgtgccacgtgggctgccatatttcagcgttgatttcggacttcatggcggattcgctcacgtgatcgaagaccagcataaatttccccactactttggaaaagagattatcgggggaatgctggatatagagcctcgtctttggaggaaaggcatcagggagtcatttgaggatcagagaaaaaaggccctccagttcgcacagtggtggaagccttacgactttacaaagagcaagaactattag

SEQ ID NO: 55318 - DNA, 291 bp, Artificial Sequence
  Description of Artificial Sequence: Synthetic coding sequence
atgttcgaagataagggtctagattgcattttcttggagacgaatatgtcaatgaagaagcagtatcatatggtctatgaatgcattcctctccccaaagaagttggagacatggctcctatatacttcaaaaaggctatcatggaaagcgatgaggaatggtctatgaacaagaaactcatcgatctgtcatctaaggacattcggaaatcggtgcctcgaggactcccatatttctctgtggacttcggcctgcacgggggttttgctcacgtcatcgaggatcagtag

SEQ ID NO: 55319 - DNA, 2229 bp, Artificial Sequence
  Description of Artificial Sequence: Synthetic coding sequence
atggctacttcaatggccgcagcaagcggaagattcgaatcagctaaatccattgaggaacgaaaagagcagacaagaaacgctcgggcagaggtgcttcgacaggcaaaagctaacttcgagaaggaggagaggcgaaaggagctgaagcggctacgtggtgaagacacctggatgcttccagatgtgaacgagcggattgagcaattttctcaggagcattccgtgaagaagaaaaagaagaaggataaacatagcaaaaaagctaagaaggagaagaaaaaaaaatcgaaaaaacagaagtacgaaaaaaataacgagagctctgatagctcttccagctcggaggatgagtgggtagaagccgtgccatcacagactcccgataaggagaaggcctggaaggttaaggacgagaaatctggaaaggacgacactcagataataaaacgggacgagtggatgaccgtggattttatgagcgtcaaaactgtctcatcatcttcattgaaggcagagaaggagactatgaggaaaatcgagcaggaaaaaaaccaagctctcgaacaatcgaaactgatggaacgggagttgaacccctactggaaggacgggggaactgggctcccaccggaagactgtagcgttagctctattactaaagtgtcggttgttgaagatggaggactgtcttggttacgtaagtcttacctgaggatgaaggaacaagctgagaaacaatccagaaacttcgaggatatagttgcagagcggtatggttcaatggagattttccagtctaaacttgaagatgcggaaaaagccgctagcactaaggaagactaccggcgagaaaggtggcgaaagcccacttattcagacaaagcccagaactgtcaggaatccagagaatctgatctggtgaaatacggtaatagcagcagagatagatacgcgacaacagatacagctaaaaattctaacaacgaaaaattcataggggatgaaaaagacaagcgccctggaagcctggagacatgcagacgggaatcgaatcccagacagaaccaggagttctcctttggtaacctgagggcaaagtttcttaggccaagcgatgatgaggagctgtcttttcactccaagggcaggaaattcgaacctctttccagctccagcgctctggtcgctcaggggtcattatgttccggctttagaaagcctactaaaaactctgaagagagactcacaagctggtctaggtcagacggtcggggagataagaaacattccaatcagaaacccagcgagacctccacagacgagcatcagcacgtgcccgaagacccacgggaaaagagccaggacgaagtgctgcgggatgatcccccaaaaaaggagcacttacgggatactaagtcaacattcgccggaagccccgaaagagaatctatccacattctttctgtggatgagaagaataagctcggagctaaaattataaaagctgagatgatggggaatatggagttggccgagcagctcaaggtgcagcttgagaaggccaataaattcaaagaaacaataactcagatcccaaaaaagtccggcgtagaaaacgaggatcagcaagaggtgattctcgtgcgtaccgatcagtcagggagagtgtggcctgtgaatacaccaggcaagtcactagaaagtcagggtgggcgacgcaaaagacagatggtgtccactcacgaggagcgtgagagagtgcgctacttccacgatgacgacaatctaagtctgaatgatctcgtgaaaaatgaaaaaatgggcacagccgaaaaccagaataagttgttcatgaggatggcaagtaaatttatggggaaaaccgatggtgactactacaccttggatgacatgttcgtaagcaaggcagccgagagagagagactgggggaggaggaagagaaccagaggaagaaggccatcgcagaacatcggtctcttgccgctcaaatggaaaaatgtttgtactgttttgattcttcccaattccccaaacatctgattgttgctataggagtcaaggtttacctctgtttgccaaatgttagaagcctgactgaagggcactgtctcatcgtgccattgcagcatcaccgagctgccaccctcctcgacgaagatatttgggaggaaatccagattaaatccagaacggttatacagtag

SEQ ID NO: 55320 - DNA, 207 bp, Artificial Sequence
  Description of Artificial Sequence: Synthetic coding sequence
atgccacaaaaggatccgtgtcagaagcaggcttgcgagattcagaagtgcctgcaggccaactcctatatggagagcaaatgccaggccgtgatccaagaactgcgtaaatgctgcgcacagtatccgaagggaaggtccgtggtgtgttcaggcttcgagaaggaggaagaggaaaaccttactaggaagtccgcctccaaatag

SEQ ID NO: 55321 - DNA, 1311 bp, Artificial Sequence
  Description of Artificial Sequence: Synthetic coding sequence
atgcccatgagctcactgcctgccgcaattctatctcatatgaccgctatcaataatgtacccccaccccctctccactccataccgaacctgaagaagtcaaaacatattaactatgggcaacttaatgcactttgtcacatccgtggtcaacacagtcggtctatgtccaacatcctgtccgcccatgataccttcatgaagcagtatcctaaggttttcctccaccaaaaaccacgcctacctaaacttttcaagcaggaagagcagcgagaactgaacgagggaaaggaagaaagtcagcatcagcaacccgacgattctaataacatcgcagtccacgtgcagagagcccacggcggtcacatactttaccggccaaagagagcgacagagaaattcgaagagttcctcgcaattctgaaaaaactgcccatccatcgaactccgtacgagcacaagacggtctggaagtttctgaaaacaatcccagatctgacctttcagttaaatgataaacacttaaagactttgtccaagacagtctttagtgaaacttggttgaaagggtcaaccgtggtggccaatgacggtttttatgtgatcttaaaggggctggccaggccccagaccaatgtgtacaagaatctcatcgaggggtcggatagtcctgacagctttatcagccagtcctttcactcttttatctggtcagaagagttcaaaaattctacccttgcagaaatgtacctcccctcgtatgattccatgctgtcaaagtggagcaccttcggaacactggaagtaatgcctcaaaatgaatccgaaactcagatgttcagtgtcgtgacagaagatgattgtgaaatcctgaaaatccctgcgaaggggtacgcgaaaattaaggaggaaaagatcaagctggagaacatgcaaaagctgaaactcatacgaatgtgtccttactacgaggagtggcctaccctttcaatctacgaacttatcgcattacttaaatggaaaaagttccccccaggtcatgtgattgtcgagtccggcaacataatttctttcgtgggttatatcaattcaggatgctgtaatatatacagaagtatcatcggattcgttaaactgcgtagtaataaagtcaagcgctcccagaaactagtgtacatgggtaagcttaaggagaaagaaagctttggagagatatctgtgctgctgcaggtaccctttacatgcaccattatcacaaagaaggaggtagagatggcaatcatagaggataaggatctgtttgtggcctag

SEQ ID NO: 55322 - DNA, 876 bp, Artificial Sequence
  Description of Artificial Sequence: Synthetic coding sequence
atgctgctcccccttcctccacagagctctaagccggtgcctaagaaaagtcaatcctccaaaatcgtgccctcccaccatgatccctctgagaagaccggggagaattgtcagactaagatctccccgtcctccctccaggagtctcccagcagcctgcaaggggcactcaaaaagaggagtgcatttgaagatttgaccaacgttagtttcgagatgactcacgagaccctctacttggctgttaagttagtggacttatatcttatgaaagcagtgtgcaagaaagataagcttcagctcctgggggctacagcatttatgattgcggcaaagtttgaagaacataacagtccgagggtggacgactttgtgtacatatgtgacgataattaccagcggtctgaggtgctctctatggagatcaatatactgaacgtgcttaaatgcgatattaatattcctatcgcctaccactttctgagacggtacgccaggtgtatccatacaaacatgaagactttaaccctatcgcggtacatctgcgagatgaccttacaggagtaccattatgttcaagaaaaggcatcaaagcttgccgcagcctcattgctgttagcactttacatgaagaaactgggatactgggtgcccttcctcgaacattactcaggctactcaattagcgagctgcatccccttgtgcgccagttaaacaaactgctaacatttagtagctatgattccctcaaggctgtctactataaatatagccaccccgtcttcttcgaggtggccaagatcccggctttggacatgttgaagcttgaggaaatattgaactgcgattgcgaggctcagggtttggtcctctag

SEQ ID NO: 55323 - DNA, 4188 bp, Artificial Sequence
  Description of Artificial Sequence: Synthetic coding sequence
atgctgctgcctctgcccccacagtcatcaaaaccggtgcccaagaagtcccagagttccaagatcgtcccctcccatcatgatcccagtgaaaaaaccggtgagaattgccagacgaaaatcagtcctagctctctgcaggagtcccctagcagcctacagggcgctctgaagaagaggagtgccttcgaagatctcactaacgccagtcagtgtcagcccgttcagcctaagaaagaggccaacaaggagtttgtaaaggtggtgagcaagaagatcaaccggaatacacatgctctgggtctggctaaaaagaataagcgcaacctcaagtggcataagctggaggtgacacctgtggtggctagtaccacggtggtccccaacattatggaaaagcctctgatcctggatatctccactacttccaaaacccctaacaccgaggaagcttccttattccgcaaaccacttgttctgaaggaggagccaacgatcgaggacgaaacacttatcaataaatccttgagcttaaagaagtgtagcaatcatgaggaagtgagcctgctggaaaagctccaacctctccaggaggaatccgacagtgatgatgccttcgtgatagagcccatgaccttcaagaagactcacaagaccgaggaagctgctatcaccaaaaagaccctgtcgctgaaaaagaagatgtgtgcatctcagaggaaacagtcctgccaggaggagagcttagcagtgcaggatgtaaacatggaggaagattcattctttatggagtccatgtcttttaagaaaaaacctaaaacggaagaaagcattcctacccataaattgagttccctgaagaaaaagtgcaccatctacggaaagatttgtcatttccgtaaacctccagtactgcaaacgactatatgcggggctatgagctcgatcaagaaacccacaacagagaaggagacactgtttcaggagttgagcgtgctccaggaaaaacacactactgagcatgagatgtctatactaaagaagtcgttggcactgcaaaagacaaactttaaggaggattctttggtcaaggaatcattggcctttaagaagaagccgagtacggaagaggcaatcatgatgccagtgattctcaaggagcagtgtatgacagaagggaagcggtctagattaaagcctctcgttctacaggagatcactagcggggaaaagtccctaatcatgaaacccttaagcatcaaggagaagccctccaccgagaaggagagcttttcccaagagccgagcgcactgcaaaaaaagcatacgacacaggaagaggtcagcatcctcaaggagccttcatccttgctgaaatctcctacggaagaatcaccatttgacgaggctctggcatttacgaaaaagtgcactatcgaggaggcccctccaaccaagaagccactgattcttaaaaggaaacatgccacccagggaactatgtcccacctaaaaaagccactgattcttcaaacaaccagcggggaaaaaagtttaattaaagagcctctaccattcaaagaggagaaagttagtctgaaaaaaaagtgcacaactcaagagatgatgagtatctgcccagagctcctcgacttccaggatatgatcggcgaagacaaaaatagtttcttcatggaaccaatgagtttcaggaagaaccccacaacagaagaaacggttttgactaagaccagcttgtcacttcaggagaaaaaaatcacccaagggaagatgagccaccttaagaagccattggttctacagaagatcacatccgaagaggagtccttctacaagaaactactcccttttaagatgaagagtacaaccgaggagaagttcttaagtcaagagccttctgctcttaaggaaaagcatacaaccctccaggaggtctcgctcagcaaggagtcgcttgccatccaggagaaggctaccaccgaggaggaattctcgcaagagctgttctctctgcacgtgaagcacactaacaaatctggttccctctttcaagaagccttagtattacaagagaagactgatgcagaggaagactcattgaagaatcttcttgcgctccaggaaaagagcacaatggaggaggagtcactcatcaataaactcttagcgttgaaagaggagctgtctgccgaggcagccactaatatccagacacagctgagcctgaagaaaaaaagcacatcacacggaaaggtgttcttcctcaagaagcagctagccttgaacgagacgataaatgaagaggagtttctgaataagcagcctttggccctagaagggtatccgtctattgctgaaggcgaaactctgtttaaaaagttactcgcgatgcaagaggagccatccatcgagaaagaggcagttctgaaagagcctactattgatactgaggcgcacttcaaagaaccacttgctcttcaggaagaaccctccacagaaaaggaagcggttcttaaagaaccgtcagtggatactgaagcacactttaaagagacgctggccctacaggagaaacccagcatagagcaggaagcactcttcaaaagacacagcgccttgtgggagaagccttccaccgagaaagagaccatctttaaagaaagtctggatctccaggaaaagccttctattaagaaggaaacgctcctcaaaaaacccctcgccctaaaaatgagcacaattaacgaggcagtgctcttcgaagacatgatcgctctaaacgagaaacctacaacgggaaaggagctttcttttaaggaacccctcgccctgcaggaatcccccacatacaaggaagatacctttcttaaaactctgctcgtcccccaggtcgggacgagccccaatgtgtcgagtaccgctcccgaatccatcaccagtaaatcgtctatcgccacaatgacatccgtgggtaagtctgggaccatcaatgaagccttcctgtttgaggacatgatcaccttgaacgagaagcccacaacaggaaaggaactatcgtttaaggagcctctcgccctgcaggagtcccctacctgtaaggaggacacgtttctggagaccttcctgattcctcaaatcggtacttccccttacgtgttcagtactacacctgagtctattaccgagaagagttccatcgccactatgacctctgtaggcaagtctagaaccactactgagtcttccgcttgtgaaagcgcatccgacaagcctgtatccccccaggcgaagggaacccccaaagagattactccacgagaggacatagacgaagatagttcggatccttctttcaatccaatgtatgccaaagaaatatttagctacatgaaagagcgggaggaacaattcatcctgaccgactacatgaaccgtcaaattgaaatcactagcgacatgcgagcaatcctggttgactggttggtggaagtacaggtgtcattcgaaatgacacatgaaactctttatctcgcagtgaagttggtggacttgtatctgatgaaagccgtttgcaaaaaggacaaactgcagctcctgggcgcaaccgcgttcatgatcgccgcaaagttcgaggagcacaattctcccagagttgatgattttgtgtacatctgcgatgacaactatcagcggagcgaagtgctgtccatggagattaacatcctaaacgtgctgaagtgcgatattaatattcctattgcttatcacttcctccggcgatacgccagatgcatacacaccaatatgaaaacactgaccctgagcagatatatatgtgaaatgaccctgcaggaataccattatgtgcaggagaaggcttcaaagctcgctgcggcatcactcctacttgctctgtatatgaaaaaactggggtattgggtgccatttctcgagcactattcgggctattccattagcgaactgcatccattggtccgtcagctcaataagcttctaacgttttcaagttacgacagcctcaaggccgtgtactataaatatagccacccagttttcttcgaagtggccaagatacctgcactggatatgcttaagttggaagagattctgaactgcgattgcgaggctcagggcctggtgctgtag

SEQ ID NO: 55324 - DNA, 4188 bp, Artificial Sequence
  Description of Artificial Sequence: Synthetic coding sequence
atgctcctgccactccctcctcaatccagcaagcccgtcccgaaaaagagtcagtcatccaagatagtgccgtcccatcacgatccatcagaaaaaacaggcgaaaattgtcaaactaagatctctccgtccagcctgcaagagagcccttcttcgttacagggagcccttaagaaacggtccgcattcgaggacttaacaaatgcctcccagtgtcaaccagtacagcctaagaaagaggctaataaggagtttgtaaaagttgtgagtaaaaagatcaataggaacacccacgctttggggttagcgaaaaagaacaaacgaaacctcaagtggcataagttggaggttacccccgtcgtggcatcaacaacagtcgtgcccaatataatggaaaagcctctcatactggacattagcacgacttccaaaacaccaaataccgaagaagctagcctttttaggaaaccgctggtgctcaaggaggaaccaacaatcgaggacgaaacccttataaacaagtccctgtccttgaaaaagtgcagtaatcacgaggaggtatccctgctcgaaaagcttcagcctctacaggaagagtcagatagcgatgacgctttcgtcattgagcccatgacctttaaaaaaacacataaaacagaggaggccgcaatcaccaagaagacattgtctctcaagaaaaagatgtgcgcgtcgcaacgcaagcagtcttgccaggaggaaagtttggcagtgcaagacgttaatatggaagaggacagtttcttcatggagtccatgagttttaagaagaagccaaaaactgaggagagcatacctacccataagctgtcttctttaaagaaaaagtgcacgatctacggtaagatctgccactttagaaagcccccagtcctccagactaccatctgcggcgcaatgtcttcaatcaagaagcctactaccgagaaggaaacactgtttcaagagctgtctgttctgcaggaaaaacacaccacggagcacgaaatgtccatcctgaaaaaatccctggcactgcaaaaaaccaattttaaggaggattctcttgtgaaagaaagtctggcatttaaaaagaagcccagcacagaagaagcgattatgatgcctgtaatcctcaaggagcagtgtatgacagagggaaagcgctctcgcctgaagccactggtgctccaggagattacctctggtgagaagtccctcattatgaagcctctttccataaaagagaagcccagtacagaaaaagaatcttttagccaggagccaagtgccctgcaaaaaaagcatacaacccaggaggaagtctcaatcctgaaggaaccctcttcgctgctcaaaagccccactgaggagtcaccttttgatgaggccttggccttcacaaagaaatgcactatcgaggaagcaccaccgacaaaaaagcccctcattctgaaacgcaaacacgcgactcagggcacaatgtcccatctgaaaaaacccctcatcctccagactactagtggggagaagagtctgatcaaagagccactcccctttaaggaggagaaagtgagtctgaaaaaaaagtgtacaactcaggagatgatgtctatctgtccagagctgcttgacttccaggacatgatcggagaggataagaactcattttttatggagcctatgtctttccgcaaaaatcctacaacagaagagaccgtccttaccaaaaccagcctatcactgcaagagaaaaagattactcaggggaaaatgtcccacctgaagaagcccctggtgctacagaaaatcaccagcgaggaagaatctttctacaaaaagctactaccattcaaaatgaagagcaccacggaagaaaagttcctgtctcaggagccctcagccctgaaagaaaagcacactactctgcaggaggtgagcctgtccaaagagtccttggctatacaggaaaaggccactaccgaagaggagtttagccaggagctcttttctctgcacgtcaagcacaccaacaaatcaggaagtctgttccaagaagcccttgtactccaggaaaaaaccgacgccgaggaggactcgctcaagaatcttttagcactacaggaaaagtcaacaatggaggaggagtctctgatcaacaagcttctcgccctcaaagaagagttgtcggccgaggctgccaccaatattcagactcagttatcgttgaaaaagaagagcacttcacacgggaaagtattttttttgaaaaaacagctggcccttaacgaaaccattaatgaggaagaattcctcaacaagcagcctctggccctagaggggtaccccagtattgctgagggagagacccttttcaaaaagctccttgctatgcaggaggaacctagcatcgaaaaggaggcagttttaaaagaacctactattgataccgaagctcacttcaaagagcctttggccctgcaagaggagcccagtactgagaaggaggcagtgctgaaggaaccaagtgtcgacacagaggcgcactttaaagaaacactggccttacaggaaaagccatctatagagcaggaggctcttttcaaacgacacagtgctctgtgggaaaagccgtccaccgaaaaggagacgattttcaaagagtctttagatttgcaggagaagcctagcattaaaaaggagacactgctgaaaaaacctcttgcgctgaagatgagcacaatcaatgaagccgtccttttcgaggatatgatagcactgaacgagaagcccaccacgggcaaggaactatcatttaaagagcctcttgctttgcaggaatcacctacatataaggaggacactttcctcaagacccttctcgtaccacaagtgggaacatctccgaacgtatcttcaacagctcccgaatcaatcaccagtaaatcatctatcgctacaatgacatccgtagggaaatcaggaacaattaacgaagcatttctttttgaggacatgatcacattgaacgaaaagccgaccaccgggaaagaactctctttcaaggaacctctcgcactacaggaatcacccacctgtaaggaggacacattccttgagaccttcctgattccacagattggtacctctccttatgtgttctctacaacccctgaatctataaccgaaaagtcttcaattgctaccatgacaagcgtaggaaagagccgcacgacaacggagagctctgcatgcgaatccgcaagcgataagccagtgtcgccacaggctaagggaacaccaaaagagatcactccaagagaagatattgacgaagattcttctgatccctcctttaaccctatgtatgccaaggaaattttcagttacatgaaggaacgtgaggaacagttcatcctgaccgactacatgaaccggcagatagagattacaagcgacatgcgagcaatcctcgtggactggctggtagaagtgcaggtttcgttcgagatgactcatgaaacgctgtacttggctgtcaagctcgtggatctctatctaatgaaagccgtgtgcaagaaagataaactccagctgctcggtgccacagccttcatgatagcagctaagttcgaggaacacaattctccaagagtcgatgatttcgtctatatttgtgatgacaactaccaacggagcgaggtgctttcgatggagataaacattctgaacgttctgaaatgcgatatcaacattcctattgcttatcacttccttcgcaggtacgcccgttgcattcacactaatatgaagaccctgaccctgagccggtatatatgcgaaatgacgctccaagaatatcattatgtgcaggaaaaagcaagcaagttggccgcagcctctctactgctggcactctacatgaagaagctggggtactgggtgccctttttggagcattattctggatacagcatctcggaattacaccctctagttagacaattgaacaagttactgaccttttcctcctacgattcccttaaagcggtatactacaagtattcccaccccgtctttttcgaggtcgccaagataccagccttagacatgctgaaattagaagaaattctaaactgcgattgcgaggcgcaaggtctggtgctctag

SEQ ID NO: 55325 - DNA, 4188 bp, Artificial Sequence
  Description of Artificial Sequence: Synthetic coding sequence
atgcttcttcccctccccccacagtcatcaaagcctgtgccgaagaagagccagtcgagtaaaattgtgccatcacatcacgacccttctgagaaaactggcgagaactgtcagactaaaatctcaccaagcagcctgcaagaatcccccagtagtctgcagggagcactgaagaagcgctcagcattcgaggacctgaccaatgcttcccaatgtcagcctgtgcagcccaaaaaggaggcaaataaggaatttgtgaaagtagtgagcaaaaagatcaaccgaaacactcacgccctgggcctggcgaagaagaataagaggaacctgaaatggcataaattggaagttaccccagtggtggctagcaccacagtggtgccgaacatcatggaaaagccgctaatcttagacatttcaaccactagcaagaccccaaacacggaagaggcttcgctttttaggaagcctttggtgctgaaggaagaacccacaatcgaagacgagactctcatcaacaagtcactgtcacttaagaagtgcagtaatcatgaggaggtttccctcctggagaaacttcagcctctgcaggaagagagcgacagcgacgatgcattcgtaatcgagcctatgaccttcaagaaaacacataaaacggaggaggccgctatcaccaagaagactttaagcttaaagaagaaaatgtgcgcctctcagagaaagcagtcctgccaggaagaatctctcgctgtgcaggatgtaaatatggaagaagattccttctttatggagtccatgagtttcaaaaaaaagcccaaaaccgaggagtctattcccacccacaaactatcttctctcaagaaaaagtgtacgatctatgggaaaatatgtcactttcgtaaacccccagtactgcagaccactatctgcggagctatgtctagcatcaagaaacctactacagagaaagagacattgtttcaagagctatctgtgttacaagaaaagcatacaaccgaacacgaaatgagcattcttaaaaagtctctggcgctgcagaagacgaatttcaaggaagactctttggtgaaggagagtttggcattcaaaaaaaagccttccaccgaagaggcgatcatgatgccagttatcctaaaggagcagtgcatgacagaaggcaagagatccagactgaagcctcttgtgctgcaggaaattaccagtggggaaaaaagcctgatcatgaagccactctcaattaaggaaaaaccttcgacggagaaagagtccttctcccaggagccatcggccctgcaaaagaagcataccacccaggaggaagttagcattttgaaggaacccagtagtctcctcaaatcacccaccgaagaatctcccttcgacgaagccctggccttcactaagaaatgtacaattgaggaagcgcctcccacaaagaaacctctgattcttaagcgcaagcatgctactcaggggaccatgtctcacctcaagaagcctctgatactccagaccaccagcggagagaaatccttaattaaagaacctctgccctttaaggaagagaaggtttccctgaagaagaaatgcaccacgcaagaaatgatgagcatctgtccagagttactggacttccaggacatgattggagaagataagaatagttttttcatggagccaatgtcctttagaaaaaacccaacaaccgaggagacggtactcactaaaactagcctgtcccttcaggaaaagaaaattacacaaggcaaaatgtcacatctcaagaagccgctggtactgcagaagataacttctgaagaagagtccttttacaagaagctgctcccattcaaaatgaagagtaccacggaggaaaagttcttaagtcaagaacctagcgcgctgaaggagaagcacaccactctgcaggaggtctcacttagtaaggagtccctggccatccaggagaaggctacaaccgaagaggagttcagccaggagctgttctctttacatgtcaaacacaccaacaaatctggaagcctctttcaggaagctttagtgctgcaggaaaaaactgacgccgaagaggacagtcttaagaatctgttagccctacaggaaaagtcaactatggaggaagaaagtttgattaacaagctgttagcactgaaagaggaactctcagccgaggcagcaacaaatatacagactcaactgagcttaaagaaaaaatccacctcacacggtaaggtgttttttctgaagaaacaattggctctcaacgagaccataaatgaagaagaattcctgaataaacaaccgctcgcacttgaaggttatccatctattgcagagggagaaactttgtttaagaaacttctggcaatgcaggaggaacctagcattgaaaaggaagctgtgctcaaggaacccacaatcgacactgaagcacacttcaaagagccattagctctccaggaggagccgtcgaccgaaaaagaagccgtacttaaagaacccagcgtggatacggaggcccatttcaaggaaacgctggctctgcaggaaaagcctagcattgaacaggaagccctatttaagcgccacagcgcactgtgggagaaacctagcaccgaaaaagaaactattttcaaagaatcattagatcttcaggagaaaccttccataaagaaagagactctgctgaagaagcctctcgcactcaaaatgagcacaataaacgaagctgtactgttcgaggacatgattgctcttaatgaaaagcctaccacagggaaagagttgagcttcaaggagcccctagctcttcaggaatctcccacgtataaggaagatacgtttctgaaaacccttcttgtcccacaagtaggcacttcaccgaatgtgtcgtctaccgcccctgagtccatcacctccaagtcctccatcgccacaatgaccagcgtcgggaaatcagggactattaatgaggcattccttttcgaggacatgataacccttaacgagaagcctaccaccgggaaggagctctcctttaaggaacctctggctttgcaggaatcccccacatgcaaggaggatacctttctggagacctttctcataccacaaattgggacttctccctatgtattttctacgactcccgaaagtatcacggagaaatcctctatcgctaccatgacgtccgtggggaagagtcggactactaccgagagctctgcctgcgagagtgcatcggataagcctgtgtcaccccaggccaagggaacacctaaggagattacacccagagaggacatcgacgaggatagcagtgacccaagctttaatcctatgtacgctaaggaaatcttctcctatatgaaggagcgcgaggagcagtttattctaactgactacatgaacaggcaaattgaaattacttctgatatgagagccatcctggtcgactggctagtggaggttcaagtgtctttcgaaatgacacacgaaaccctctacctggctgtgaagctcgttgatctgtacctaatgaaggctgtgtgtaaaaaagataagctgcagcttcttggcgcaaccgctttcatgatcgcggctaagttcgaagagcacaactcaccacgggtcgatgattttgtttacatttgcgatgacaactatcaacggtccgaggttctgtcaatggagattaacatactgaacgtgctgaaatgtgatatcaatattcctattgcataccatttcttgcgacgctatgcccgatgcatacataccaatatgaaaacgttaaccctgtctcggtacatatgtgagatgaccctgcaggagtatcactacgtgcaagaaaaggcttccaagctcgcagcggcttctctgctgcttgcactgtatatgaagaaactgggatactgggtgccattccttgagcattactcaggatacagtatttccgagcttcaccccctggtacgtcaactcaataagctcctgaccttctcaagctatgactcccttaaggcggtctattataagtatagccatcctgtgtttttcgaagtcgccaaaatcccggcactcgatatgctgaaattagaagagatcctgaactgcgactgcgaggcccaaggactggttttgtag

SEQ ID NO: 55326 - DNA, 876 bp, Artificial Sequence
  Description of Artificial Sequence: Synthetic coding sequence
atgctgttacccctgcctccgcagagctccaagcctgtgccaaagaaatcacagagttccaaaatcgtgccatctcatcacgatccctctgagaagactggagaaaactgtcaaactaagatttccccatctagccttcaagaatcaccttcttccctgcagggcgctctgaaaaagcggagcgcttttgaggatctgaccaatgtgtctttcgagatgacccatgagactctatacctagctgtaaaactggtagacctatatctgatgaaagctgtgtgcaagaaggataaactccaactgctgggcgctacggccttcatgattgccgctaaattcgaagagcacaacagccctcgagtcgacgattttgtttacatttgtgacgataattatcaaagaagtgaggtattgtcgatggaaattaacatattaaacgtcctgaagtgcgacatcaatattcccattgcttatcactttctgagacggtacgcacgatgcattcataccaatatgaagacccttaccctcagtaggtacatatgtgaaatgacgctgcaggagtatcattacgttcaggagaaggcgagtaagctcgctgccgcaagtctcctgcttgctctgtatatgaagaagctggggtactgggtgcccttcttggaacactatagtggctatagcatttccgaactccaccctcttgtgaggcagttaaataaactgttaaccttcagcagctatgactctcttaaagccgtatattataagtactcccaccctgtttttttcgaggtggctaagattcccgctctggacatgttgaagttggaggagattttgaactgcgactgcgaagctcagggtcttgtgctgtag

SEQ ID NO: 55327 - DNA, 4188 bp, Artificial Sequence
  Description of Artificial Sequence: Synthetic coding sequence
atgctgcttccactgccgcctcagtcttcaaaaccagtgccaaaaaaatcccagtcttctaaaattgtaccttcacaccacgacccctccgagaaaaccggtgagaattgccaaacgaagattagtccttcttctctacaagagtcaccttctagtttgcagggtgcactgaaaaagcggtccgctttcgaagaccttacgaacgcatctcaatgccaacccgtgcaacctaagaaggaggcaaacaaggaattcgtcaaagtggtgagtaagaagatcaatagaaacacccacgccctcgggctcgcgaaaaaaaacaagcgcaacctcaagtggcataaactggaagtaacccccgtcgtcgcttcaaccacagtcgtaccaaacatcatggagaaacccctgatcctcgatatatcaactacctctaaaacccccaacacagaagaagccagtttgtttagaaagccccttgtgctcaaagaggaacccacaatagaggatgaaacgctgattaacaagagcctgtcactgaaaaagtgcagcaaccacgaagaggtatccctactcgaaaagctgcagccactacaagaagaaagtgatagcgacgatgcattcgtcatcgagccaatgactttcaaaaaaacgcacaaaaccgaagaagccgctattactaaaaaaacactatccctcaagaaaaaaatgtgcgcgtctcaacgcaaacaatcctgtcaggaagaatctctagccgtccaagacgtgaacatggaggaggattccttttttatggagtcgatgtcattcaagaaaaagccaaagacggaggaaagcataccaacccacaagctgagctccctgaaaaaaaaatgtacaatttacggcaagatttgtcattttcgtaaaccccctgtgctccaaactaccatctgcggcgcaatgagctcaattaagaagccaactacagaaaaagaaaccctgtttcaggaactgtctgtgctgcaggagaagcacacaaccgaacacgagatgtcaatcctgaagaaatccctagccttgcaaaaaacaaatttcaaggaggattccctcgtgaaagagtctctagcctttaaaaagaaaccgagcaccgaggaggcaattatgatgcccgtgattttgaaggaacagtgtatgacagaaggcaaaagatcccggctcaagcctcttgtcttgcaggagattacctcgggagagaagtccctgatcatgaaaccgctctctattaaggagaaacctagcactgagaaagaaagctttagccaggaacccagcgctctgcagaagaagcacactacccaggaagaagtttccattctgaaggaacccagcagcctgctgaagtctccgacagaggagagccccttcgatgaggcactggcctttacaaaaaaatgtacaattgaggaggccccacccactaagaagccactgatcttaaaacgcaaacacgctactcaaggaacaatgtctcatctgaaaaagcctctgatccttcagactacatcaggagaaaagagcctgatcaaagagccattgccattcaaagaggagaaggtaagcttaaagaaaaagtgtactactcaggagatgatgtccatctgccccgaacttcttgattttcaagatatgataggcgaggacaaaaattccttcttcatggaacctatgagctttaggaagaaccctacaactgaagaaacagtgctgacaaagacttccctcagcttgcaggagaaaaaaatcacccagggcaagatgagtcatctgaagaagcctcttgtgctccagaagataacctcagaagaagaatccttttacaagaagttactcccattcaagatgaagtccaccactgaagaaaagtttctcagccaggagccatcagccctgaaggaaaagcacacaaccctacaggaggtgagtctctctaaagaatccctcgccatccaagaaaaggccaccactgaggaggagtttagccaggagttgttcagcctccatgttaagcataccaacaagtccggtagcctgttccaggaggcactggttctccaggagaaaacggacgcggaggaagatagcctcaaaaacttactagccctccaggagaaaagcacaatggaagaagaatctctgatcaacaaactccttgctcttaaggaggagctttctgcggaagcggcaaccaatatacagacacagttgtcactgaagaaaaaatccacttctcacgggaaggttttttttttgaaaaaacagctggctctcaatgagactatcaacgaagaagaattcttgaacaagcagccccttgctttggaaggatacccctcaatcgcggagggtgagacattattcaagaaacttctggcgatgcaagaagagcctagcatcgaaaaggaagcagtgctgaaggagcccacaatcgacactgaagcacatttcaaagaaccccttgcgctccaggaggagcccagcacagaaaaagaagccgtccttaaagaaccttccgtggacactgaggctcatttcaaggaaacgctggcactgcaggagaaaccttcaattgagcaggaggccttgttcaaacgacactctgcattatgggaaaagccatccacagagaaggagacaatcttcaaagaaagcctggatctccaggagaaaccaagtatcaagaaggaaactctgctcaagaagcctctcgccctcaagatgtcaacaattaacgaggccgtattattcgaggatatgattgccctgaacgagaaaccgaccacaggcaaagagctctcctttaaggaacctcttgctctgcaggagtcccctacctataaggaagataccttcctgaaaaccctgctcgtgccgcaggtcgggacctctccaaacgtctcttcaactgcccctgagtcaattacatctaagtcatctattgccacaatgacatctgtcggcaagtctggaacgatcaatgaagctttcctattcgaggacatgattacattgaacgagaaacccacgaccggtaaagaattgtcattcaaggagccattggcacttcaagaatcgccgacctgtaaggaggatacgttcctggagacattcctgatacctcagattgggacctccccatacgtctttagtaccacccctgagtctataacagaaaagtcttcaattgctaccatgacgtccgtcggcaaatcccgcacaactaccgagagttcagcttgcgagtctgcatccgataagcctgtctccccccaggccaaaggaactccaaaggaaatcacgccccgtgaagatatcgatgaggactcgagcgacccttccttcaaccctatgtatgccaaggagattttctcttacatgaaagaaagagaagaacagtttattctcactgactacatgaataggcagatagaaatcacttctgatatgagagcgatactggttgattggttggtggaagtccaggtttcattcgaaatgactcatgagacactgtacctggccgtcaagctggtggacctgtatctgatgaaagcagtttgtaaaaaagacaaactgcagctgttgggagctacagccttcatgattgcagcgaaatttgaagaacataactctcctagagtggacgactttgtgtacatctgcgacgataactaccagagatccgaggtcctgagtatggaaatcaatattctcaatgtgttaaaatgtgacataaacatccccatcgcttatcatttcctgcggcgttacgctagatgcatccacaccaatatgaagacattgaccctaagtcggtatatctgcgagatgaccctgcaagaatatcattacgtgcaggagaaggcgtctaaactagcagccgcatccctgttgttagctctgtacatgaagaagctcggatactgggtaccttttctggagcactacagcgggtattctatatctgagctccacccccttgtgcgtcaattgaacaaattgttaaccttctctagttatgattccctcaaggctgtttactataagtatagccatccggtgttcttcgaagttgccaaaatccccgctctagacatgcttaaattggaagagatactcaactgcgactgtgaggcgcaggggttggttctgtag

SEQ ID NO: 55328 - DNA, 876 bp, Artificial Sequence
  Description of Artificial Sequence: Synthetic coding sequence
atgctactgccactcccacctcagtcctcgaagccggtcccaaagaagagtcagagtagtaagattgttccttctcaccacgatccaagtgagaaaacaggggaaaactgtcaaacaaaaatatcaccctcatcactccaagagtccccatctagcctgcagggggcactgaagaagagatcagccttcgaagaccttacgaatgtttccttcgagatgacacatgagactctctatctggccgtgaagcttgtagacctctacctcatgaaagcagtgtgtaaaaaagataagttacagttgctcggggcaacagctttcatgatcgccgctaagttcgaagagcacaacagccccagagttgacgattttgtgtatatctgcgacgacaactaccagagatcggaggtcctgagcatggagattaacatactgaatgttctcaagtgtgatatcaacatacccatcgcttatcactttcttagaaggtacgcacggtgtatccacaccaatatgaagaccttgaccctgtccaggtatatttgcgaaatgaccctccaggagtaccactacgtccaggaaaaggctagcaagctagctgccgcttcattacttctagctctgtacatgaagaaactaggctattgggtcccgttcttggagcactattccggctactccatttctgagctacaccctttagtccgtcaactgaataaactactcacgtttagttcgtatgattcactgaaggcagtatactacaagtattcacaccccgtgttctttgaggtggcaaagatccccgcactcgatatgttgaagctcgaggagatactgaactgtgactgcgaggcccaagggctggtgctttag

SEQ ID NO: 55329 - DNA, 876 bp, Artificial Sequence
  Description of Artificial Sequence: Synthetic coding sequence
atgttgctgcccctaccacctcagagctccaagccagtcccaaaaaagtcacagtcctccaagatcgtcccttcacaccacgatccatcagaaaaaactggcgagaactgtcagactaagatttctccttcatctctacaggaatcgccgagcagtctgcaaggtgctttaaagaaaaggagcgcctttgaggacctgactaacgtctccttcgagatgacccacgagactttgtatctagccgtcaaattggtggatttataccttatgaaggcagtgtgtaagaaagacaagcttcagctgctgggcgctaccgcctttatgattgccgcaaagtttgaggagcataattcccctcgagttgatgatttcgtatatatctgcgacgacaactaccagcggtctgaagtgctttccatggagatcaacattcttaacgttctcaagtgtgacatcaatattccgattgcttatcacttccttagacgttatgctagatgtattcacaccaatatgaagacactgaccttatctcggtacatctgcgagatgactctgcaggaataccactatgttcaagaaaaagccagtaagctcgccgctgccagcctcctgctggctctgtacatgaaaaagctgggttactgggtgcccttcttggaacactattccggatactcaattagcgagttgcatcctctggtgagacagctcaacaagctactgacattcagctcctacgattccctgaaggcagtttactacaaatacagccatccggtgttcttcgaagtggctaaaattcctgcccttgatatgctgaagcttgaagagatcctgaattgcgactgcgaagcacaaggccttgtcctctag

SEQ ID NO: 55330 - DNA, 1215 bp, Artificial Sequence
  Description of Artificial Sequence: Synthetic coding sequence
atgtctagaaggtcctcccgtttgcaagccaagcagcagcctcagccttctcaaaccgaaagccctcaggaagcccaaattatccaggccaagaaaaggaagacaacgcaggatgtaaagaagcgtcgagaagaagtaactaagaaacatcagtacgagataaggaattgctggccccctgtcctttctggcggaatcagcccatgtatcattattgagacgcctcacaaggagatcggaacctccgattttagtcgttttacaaactatcggttcaaaaatctgtttattaatccttccccattgcccgatttgagttggggctgctctaaagaggtgtggctcaacatgctaaagaaggagtcaagatacgtgcacgacaaacattttgaggtgctgcattccgacctcgaaccacagatgcgatccatcttattagattggctcctggaagtgtgtgaagtatacacactacacagagagaccttctacttagcccaggatttctttgaccgatttatgttgactcaaaaagatattaacaaaaacatgttgcagctgatagggattacttccctgttcattgcctctaaactagaagagatctacgcacccaagctgcaggagttcgcctacgtaactgacggagcctgcagtgaagaagatattcttcggatggagcttatcattttgaaggcactgaaatgggaactgtgtccagtgaccatcatctcctggctcaatctgtttctccaggttgatgctctgaaggacgcaccaaaagtcttactgccacaatattctcaagagacatttatccagatcgcccagctcctggacttatgcatactggccatcgacagcttggagtttcagtacaggattctcacagccgcagcgctgtgccacttcacgtctattgaagtggttaagaaggcatcaggtttggaatgggactccatttctgagtgcgtggactggatggtgccctttgtaaatgtagtcaaatccacttcacccgtcaaactgaaaacgttcaaaaagatcccgatggaggacagacataatattcagactcatactaattatctcgccatgttggaggaggtgaattacatcaacacattcaggaagggcggtcagttgtcgcctgtttgtaacggtgggattatgactcctcccaaaagtaccgagaaaccccctgggaaacattag

SEQ ID NO: 55331 - DNA, 1125 bp, Artificial Sequence
  Description of Artificial Sequence: Synthetic coding sequence
atgtcgcggcgttctagtcgccttcaggctaaacagcagccccagccctctcaaacagagtctcctcaggaggcacagataattcaggcaaagaaaagaaaaactacacaagatgtaaagaagcgccgtgaagaagttacgaagaaacaccagtacgagatccgcaattgctggcctcccgttctcagcggtggaattagcccctgtataatcattgagactccccacaaagagattgggacatctgacttctcgaggttcacaaactatcgcttcaaaaacctgtttattaacccgagtcccctccccgacctgtcatggggatgctctaaggaggtttggctgaatatgctcaaaaaagaaagcagatacgtgcatgacaagcatttcgaggtgctccacagcgacctggaaccccagatgaggagtatcctcctggactggttgcttgaggtgtgcgaagtgtacacactgcatagagaaaccttttacttagcccaggatttcttcgatcggttcatgctgacccagaaggatataaataaaaatatgctgcaactcattggcatcacaagtctcttcatagcatcgaaactggaggagatctacgcccctaaactgcaggagttcgcttacgttaccgatggggcttgtagtgaagaggacattctgcgcatggagctgatcattctcaaggctcttaagtgggagctgtgccccgttacgattatcagttggctcaatctgtttctccaagtggacgcactcaaggatgcgccaaaggtcttactcccacagtacagtcaggaaactttcatccaaatcgcccagctcctcgatctttgcattctggccatcgactctttagaatttcagtaccgcattctgaccgcagcagcactgtgccatttcacaagcatcgaggtcgtaaaaaaggcctccggcttggaatgggacagcatatctgaatgcgttgactggatggtcccttttgtaaacgttgtaaaaagtacctctccagtgaagctcaaaacatttaaaaagatcccaatggaagaccggcacaacattcagacccacacaaactacttggctatgttgtgcatgatttcctctcacgtttag

SEQ ID NO: 55332 - DNA, 1215 bp, Artificial Sequence
  Description of Artificial Sequence: Synthetic coding sequence
atgagccgcaggtcctcccggctgcaggccaagcagcagccccagccaagccagaccgagtctcctcaggaggcgcaaataatccaggccaagaaacggaaaaccacacaagatgtgaaaaagcgaagagaggaggtcacaaaaaagcaccaatacgaaattagaaactgttggccccctgtattgtcaggcggaatttctccttgcatcatcattgaaactccccacaaggagataggcacttctgacttctcccgtttcacaaactataggtttaagaacctgtttattaatccttcccctctgcctgatctgtcctgggggtgttcaaaggaagtgtggttgaatatgctaaagaaagagtctagatacgtccatgacaaacatttcgaagttctgcatagtgacttagagccgcagatgcggagcattcttctggattggttactggaggtctgtgaggtctacacattgcaccgggagactttttatttggcccaagattttttcgatcgattcatgctaacccaaaaggatatcaataaaaatatgttgcagcttatcgggatcacaagtctcttcattgcctcaaagctggaagagatttacgctcctaagcttcaggagttcgcttatgtcaccgacggtgcctgtagcgaagaagacatcctcagaatggagctaatcatcctgaaggccctgaagtgggagctgtgcccagttaccataatctcttggttaaatttgtttcttcaggtggacgctctgaaggatgccccaaaagttctcttaccccagtactcccaggagacattcattcagattgctcagctactggacctctgtatcctcgcaattgattcactcgaatttcagtatcggattcttaccgccgctgcgttatgtcactttactagtatcgaggtggtcaagaaagcctctggcttggagtgggactcaatttccgaatgtgtagattggatggtccctttcgtgaatgttgtgaagagcactagcccagtgaagctgaagactttcaagaagatacctatggaggacagacataatattcaaacacacacaaattaccttgccatgttagaggaggtgaactatatcaataccttcagaaaaggcggacaactcagtccagtctgtaatgggggaatcatgaccccccctaagagcacggaaaagccgccagggaagcactag

SEQ ID NO: 55333 - DNA, 891 bp, Artificial Sequence
  Description of Artificial Sequence: Synthetic coding sequence
atgagtaaggaagtatggcttaatatgctcaagaaggagagccgatacgtacatgacaaacattttgaagtcctgcactcagatctggaaccccagatgagaagcatactgcttgactggctgctggaggtgtgtgaagtttacactcttcatagagaaaccttttatctggcccaggatttctttgatcggtttatgctgactcagaaagatattaacaagaacatgctacagctcatcggtatcacctctctgttcattgcgtctaagttggaggaaatctacgctcctaagttacaggagtttgcctatgtaaccgacggggcttgtagcgaggaggacattctccgcatggaacttatcatacttaaggctcttaagtgggagctgtgcccagtcaccatcatttcctggctgaacctgttcttgcaagtagatgcactgaaagacgcaccgaaggtgctgcttccacagtactcacaggagacatttatacagattgcacagttactggatctgtgcatcctcgctatcgactcattagagttccaatacaggatactgaccgcagcagctctatgccacttcacgtccatcgaagttgtgaagaaagctagtggtttagagtgggactcaatctcagaatgtgtggactggatggtaccgttcgtgaacgtggtgaaatctacatcgccagtgaagctgaaaaccttcaaaaagatccccatggaagatcgtcataacattcaaacacataccaactacctagctatgctcgaagaagttaattacataaatacattccggaaaggtggtcagctctcacccgtatgtaacggaggcatcatgacacctcctaaatccaccgaaaagcccccagggaaacattag

SEQ ID NO: 55334 - DNA, 1134 bp, Artificial Sequence
  Description of Artificial Sequence: Synthetic coding sequence
atgaagtttcctgggccactggagaaccagcggctgtccttcctgctggagaaggctatcacccgagaggctcagatgtggaaggtgaacgtgaggaagatgccatccaatcaaaatgtgtcaccctctcagcgtgacgaggtgatacaatggttagctaagctgaagtatcagttcaacctctacccagagacattcgctctcgcctcctcactcttggatagatttttagccacagtgaaagcacaccccaagtatctgtcctgcattgccatttcctgtttcttccttgcagcaaagaccgtggaggaagatgagaggattcccgttctgaaggtcttggccagagacagcttttgcggatgtagcagctctgaaatcctgagaatggaaagaatcattctggataagctgaactgggatcttcatacagcgacaccccttgactttttacatatttttcacgcaatagccgtgagtacacgtccacagttactgtttagcctgcctaagctctccccttcccagcacctggccgttctgaccaaacaactgctacactgtatggcgtgtaaccagctgctccaatttcgcggatctatgctggctctggccatggttagtctggagatggagaagttgatccccgactggctctccctgaccattgagcttctgcagaaggcccagatggatagctctcagctgatacattgccgagaattggtggctcatcatctctccacccttcagtctagcctgccactgaattcagtttacgtctaccggcctcttaaacacacactggtgacctgcgacaagggagtgtttcgactgcatccttcttctgttcccggacccgatttcagcaaagacaattccaaaccagaggtgccagtgagaggcactgccgcattctatcaccaccttcccgctgcctctggctgtaagcagacctcgaccaagaggaaagtcgaagagatggaagtggatgacttctacgacgggatcaagcgattgtataacgaggataacgtgagcgagaatgtgggcagtgtgtgcggtaccgacttaagccggcaggagggccatgccagcccctgcccccctctgcagccagtgagcgtcatgtag

SEQ ID NO: 55335 - DNA, 378 bp, Artificial Sequence
  Description of Artificial Sequence: Synthetic coding sequence
atgaaattccctggcccactggaaaatcagcggctttctttccttctggaaaaggctattacgagagaggctcagatgtggaaggtcaacgtccgcaagatgccttccaaccaaaacgttagcccctcccagagggatgaagtgatccagtggctggctaagctcaagtaccagtttaacctgtacccagagactttcgctttagccagttcacttcttgaccgctttctggcaaccgtcaaggctcacccaaagtatcttagttgcatcgccatatcatgcttttttctcgcagccaaaaccgttgaggaggacgagagaattcctgtcttaaaggtgttggccagggacagtttctgcgggtgctcttcctcctag

SEQ ID NO: 55336 - DNA, 243 bp, Artificial Sequence
  Description of Artificial Sequence: Synthetic coding sequence
atgaagttcccgggaccacttgagaatcaacgcctctccttcctgctcgagaaggcaatcacccgtgaggcacagatgtggaaagtgaacgtgcgaaaaatgcccagtaatcagaatgtgtccccatcccaacgcgacgaagttatccagtggttggcaaaattgaagtatcagtttaacctgtaccccgagaccttcgccctggcatcgtctctgcttgacagattcctcgcgacagtctag

SEQ ID NO: 55337 - DNA, 1092 bp, Artificial Sequence
  Description of Artificial Sequence: Synthetic coding sequence
atgacgcctcggcaccactgtgaagcatattcctccgcaggagaagaagaagaggaggaggaggaggaaaaaaatgtgtcccccagtcaaagagatgaggtaatccagtggctagccaaacttaagtatcagttcaacctgtacccagaaacttttgcattggcctctagtctgctcgaccgcttcctggccacagttaaagcgcacccaaagtatttgagttgtatcgccatctcttgtttttttctcgccgctaaaacggtggaggaggacgagcggatcccagtgcttaaagtacttgcgagagacagcttctgcggatgcagctccagcgagatcctccggatggagcgtattatcctcgacaaactcaactgggacctgcataccgccacccccctggattttcttcatatctttcacgccatcgccgtttctacgcggccacagttactgttttctcttccaaaacttagtcccagtcaacatctggctgtgttaacaaagcagctccttcattgcatggcctgcaaccagcttttacaattcaggggcagcatgctggccctagctatggttagtctggagatggagaagctcatcccagactggctgtcactaaccatcgagctgctacaaaaagcgcagatggacagcagccagcttatccactgcagagagttggtggctcaccacctgagtacactgcaatccagtctgccactgaactctgtttatgtttatcggcctcttaaacataccctggtgacttgcgataaaggtgtcttccgcctgcaccccagctctgtaccaggccctgactttagtaaggacaactcaaagccagaggttccagtaagaggcaccgcggctttctaccatcacctcccggctgcctccgggtgcaaacagacatctacgaagaggaaggtagaagagatggaggttgacgatttttacgacggtatcaagaggctgtataatgaagacaacgtcagtgaaaacgtcggctccgtctgtgggacggacctgtccaggcaagagggccatgcttctccctgcccaccactgcaacctgttagcgtgatgtag

SEQ ID NO: 55338 - DNA, 1110 bp, Artificial Sequence
  Description of Artificial Sequence: Synthetic coding sequence
atggcctcgggcgctcaactcccaccgcagcccagctctagtgaggttagtgccgtccagtctcctgggggaaggcccggagccggactcgaagaaaccgcgctcggggtgccattgccaccctctcctggcgaggctccgctcccgaggtccaatcggagtcgctgtccgggaaccagacagcccggagcagcttctctgcatgctgctagtgctgccgtgcctgttaggccgaggcgcggaactgccccagccggtaaaacagcagatgcagtccccgctgccgctcccgaacaggccccacgccctgctcctcagagtcgcaaacccagaaatttggagggcgatctggatgaaagaaggctcctgtgccatctacagctcgctcaagatcgagaagcacgcctctggcggggtggcaagccccaggatgaaatttgcgatgccttcgaggaagtggttctgtggctgttaagactgcagaatacattctatttctcacagtccacatttaacttggcactcacaattttcggcagacttctcatcagcgtgaaagtaaaggaaaaatatctgcattgtgccaccatcactagcctcaggctggcggctaaggtgaatgaagaggaggaattcatcccccaggtaaaggattttactaaacattatggcagtgattattctcccaatgagctcctcagaatggaattggctatacttgaccgcctacactgggatctttatatcggcaccccactggactttctgaccatcttccacgctctggtcgtactgtcttggcctcatgtgctcgaacttctgcctcagcggaatccaagccttcatgtcgcaagtcttacacggcagctccagcactgtatggccggacatcaactcctgcagttcaaaggcagtactcttgcattagtgattattacacttgagctagaacggctgatgccaggctggtgcgcgcctattagcgatctgcttaagaaggctcaggtgggcgatatgcagtattcttgctgtaaggagttggtgatgcagcagctgcgttcactgcaaagtagtagttgtacagataacttcgtctctcccgcaaactag

SEQ ID NO: 55339 - DNA, 993 bp, Artificial Sequence
  Description of Artificial Sequence: Synthetic coding sequence
atggacggcccaatgcggccaaggtccgccagtctcgtggactttcaattcggcgtcgtggccacagagaccatagaggacgcactgctccatctggcccagcagaacgaacaggccgtgcgagaagcatctggcaggctcggccgatttagggagcctcaaattgtggaatttgtgtttctgctttctgagcagtggtgtctggaaaagagcgtctcttatcaggcggtggagattttggaaagatttatggtcaagcaggctgagaacatttgcagacaggctactattcagccacgggataacaaacgggagtcccagaattggcgggcattaaaacagcaactggtaaacaagttcacactgcgcctggtgagttgcgtgcagcttgccagtaaactgtcttttcgcaataagattatctccaacattaccgtcctgaatttcctgcaggccttgggctatttacatacaaaagaagagctcttggaatctgaattggacgttctaaagtcactgaacttccgaattaatttgcccacgcctctggcctacgtcgagacattactcgaggtattagggtacaacggatgcttggtgccggcaatgcgtctccacgcaacttgcttgacactgttagaccttgtttacctgctgcatgaacccatctacgagagcctgctgcgagcgtccatcgagaattctaccccatcgcaactgcagggggaaaaattcacatctgtcaaggaggactttatgctgttagccgtcggcataattgcagcttccgcctttatccagaatcacgaatgttggagccaggtggtaggacacctgcaatcaatcactgggattgcactagcatccatcgccgagttcagctatgccatcctcacacatggtgtgggggctaatactcctggcaggcagcagtctatccctccgcatctggctgccagggccctgaaaacagtggcatcctcaaacacttag

SEQ ID NO: 55340 - DNA, 993 bp, Artificial Sequence
  Description of Artificial Sequence: Synthetic coding sequence
atggacggcccaatgagacctcgatctgcctcactggtcgactttcaattcggggtcgtcgccaccgaaacaatcgaggacgccttactgcacctcgcacagcaaaatgagcaggccgtgcgcgaggccagcggtaggctgggccgatttagagagcctcaaattgttgagtttgtgttcttactaagtgagcaatggtgtcttgaaaagtccgttagctaccaggccgtggaaatcctcgaaagattcatggtaaagcaggctgagaacatatgtcgccaggcaacaatccagccacgggataataagcgggagtcccagaattggcgcgctctgaaacagcaactagtgaacaaatttacactgaggctcgtgagctgtgtgcagctcgctagtaaactgtctttccgcaacaaaatcatcagcaacatcactgtgttgaactttttgcaggcactgggctacctacatacaaaggaggaactgctcgagtctgagttggacgtgctgaagtcactcaactttcgcatcaatctccctacccctctggcttacgtcgagaccctcttggaggttctcggctacaatggatgtctagtccccgcaatgcgactgcacgcaacgtgcctgacgctcctcgatttagtgtacctgttgcacgagcccatctacgaatctctgctacgggctagtatcgaaaatagcaccccgagccagcttcagggcgagaagtttacatcagttaaagaggactttatgctccttgctgtgggcattattgcagcctcggctttcatacaaaaccatgagtgttggtctcaagtcgtcggccacctccaatcgatcaccggtatcgcactggccagtattgccgaattcagctatgccattctgacacatggtgtgggcgcaaacacccccggacgacagcagtctattccaccccacttggccgcacgggcattgaagactgttgccagctcgaacacatag

SEQ ID NO: 55341 - DNA, 924 bp, Artificial Sequence
  Description of Artificial Sequence: Synthetic coding sequence
atgctggttcgcggtagggatcaagggtctggctcgaggcttggtccaattgtgcggaggtgggcacccagaccctccccgcttcagtctcttgcagcctcactggatgctgaaccttcgtccgctgccgtaccggacgggttccccgcaggaccgactgtaagccctaggcgtctggcacgcccacctggacttgaggaggcgttaagcgctttaggtctgcagggtgaacgggaatatgccggtgacatcttcgccgaagtgatggtctgtagggtgctgcccttaagagctctgcccagagccgtcacccccgaaatgcgggctctggtggttgactggctggtccaagtccacgaatacctggggctggccggagataccctatatctcgctgttcacttgttggatagttatttaagcgctggcagagttcgtctgcatcgtctgcagcttctgggggttgcctgcctgttcgtggcctgcaaaatggaggaatgtgtgttgcctgaaccggcattcctctgcctcttgagtgctgattcattctccagggcggaactcttacgcgctgaaagaaggatactgagccgacttgatttcaggcttcatcatccaggccctctgctgtgcctaggattgttggccgcactagccggttcaagccctcaggtaatgctgctggctacatatttcctggagctctccctcctagaggccgaggccgctggctgggagccaggccgacgggctgccgctgctttgagcctagcccataggctcctggatggcgctgggagccggctgcaacccgagctgtataggtgctccctgggaggagggagcgtgtgggggcacagatccttcagggaccttccaagctggagcttcttgagaagtagacgcatgcgggataactactag

SEQ ID NO: 55342 - DNA, 468 bp, Artificial Sequence
  Description of Artificial Sequence: Synthetic coding sequence
atgctcgttcgtggcagggatcagggctctgggtctagacttggccctatcgttcggagatgggccccacgcccatcacccttgcaaagtctagctgcctccctggacgccgaaccctctagcgccgctgtgcccgatggattccccgcaggaccaacggtgtcaccgagaaggctcgcacgcccacccggactggaggaggcactctcagccctgggcctgcagggtgagagggaatacgccggtgatattttcgctgaggtgatggagtacttggggttagctggagatacactttatctcgctgtgcaccttctggactcgtacttgtctgccggtcgcgtacggctgcaccggctgcagcttttaggcgtcgcctgtttgttcgtcgcttgcaagatggaagagtgtgtgctcccagaggaaactgaagtgcgaaacctgggcccatttcagggccgagagtag

SEQ ID NO: 55343 - DNA, 1080 bp, Artificial Sequence
  Description of Artificial Sequence: Synthetic coding sequence
atgggtaatactctgacctgttgcgtatcccctaatgcttccccgaagctcggtagaagggcaggctctgccgagctctactgcgcttctgatatctacgaggctgtgtctggcgacgccgtcgcagttgcgcctgcagtcgtcgaacccgctgaactcgatttcggggaaggtgagggacaccatttacagcacataagtgatagagaaatgcctgaagacctggcattggaaagtaacccttccgatcaccccagagcctccactatattcctcagtaagtcacaaactgatgtgcgagaaaagagaaaatccaatcatctgaaccatgtgtctcctggtcaattgacaaagaagtatagcagttgctctaccatatttctggacgactctacagtgtctcagcccaacctgcggacaactgtgaaatgtgtgactctggcaatctactatcacatcaagaatagggacgcgaatcgctctcttgatatcttcgatgagcgctcacaccccttaacaagggaaaaggtgcccgaggagtatttcaagcatgaccctgagcataagttcatctatcgattcgtgaggacacttttcagcgcggctcagctcaccgcagaatgtgcaatcgttaccctggtatatttggaaaggcttctcacttatgcggagatagatatatgtcctactaattggaaaaggatcgtcctgggcgcaattcttctagctagcaaagtgtgggatgaccaagcagtctggaatgtggattactgccaaatccttaaggatatcacagtggaggacatgaacgagatggagcgtcatttcctggagcttttgcagttcaacataaacgtccctgcttccgtctacgctaagtattacttcgacctgcgttcccttgccgacgataacaacctcaattttctcttcgcccctctctcaaaggagcgcgcacagaatttagaagccatttctcggctatgtgaagacaaggatctttgcagggccgctatgcgacgctccttctccgctgataattttatcggaatccagcgctcaaaggcgatcctgagctag

SEQ ID NO: 55344 - DNA, 927 bp, Artificial Sequence
  Description of Artificial Sequence: Synthetic coding sequence
atgggcaatactctgacttgttgtgtgagtccaaatgcttcccccaagttgggcagaagagccggatcggctgagctgtattgtgcctcagatatctacgaggctgtatctggcgatgccgtggcggtggcaccggctgtagtggagccagccgaattggactttggcgagggtgaaggccatcatcttcagcacatttctgacagagagatgccagaggatctggcattagagtccaaccctagcgaccaccctcgggctagcactatctttttgtccaagagccaaactgacgtccgggaaaaacgtaagtccaaccacctgaatcactgtgacctgtcgaatattctccctcacaaggagcagcgcgagaaagtgcccgaggaatacttcaaacacgatccagagcacaagtttatctatcgtttcgtgaggactctcttctctgctgctcagttgaccgcagaatgtgcaatcgtgactcttgtctacctggagcgtctgttaacgtacgccgagatcgatatttgccccaccaattggaaacgtattgtgcttggcgctatcctgctggcttcgaaagtctgggacgaccaggcagtctggaatgtggattactgccaaatacttaaagacatcaccgtggaggacatgaatgagatggagcgccactttttggagttattgcagttcaacattaacgtgcctgcttcggtctatgccaaatattacttcgacttgagaagtttagccgatgacaacaatctcaattttctgtttgcacctcttagcaaggagcgggcacagaacttagaggccattagcagactgtgcgaggataaggacctgtgcagggcagccatgagacgtagttttagcgccgataacttcatcggtatccagagatctaaagccattttgtcctag

SEQ ID NO: 55345 - DNA, 870 bp, Artificial Sequence
  Description of Artificial Sequence: Synthetic coding sequence
atgcccgaagacctagcgctggagtccaatccctctgatcatcccagggccagcacgatcttcctgagcaaaagtcagacagatgtgcgagagaaacgtaagagtaaccaccttaatcatgtcagccctggacagctcacaaaaaaatacagtagctgttcaaccattttcctggacgatagtacagtgagtcagcccaatctgcgcacaacagtcaaatgtgttactctggctatttattaccatattaagaacagagacgccaatcgttcactggacatttttgatgaaagatctcatcctttaactcgagagaaagtccctgaagaatattttaaacacgatccagaacataagtttatttacagattcgtccggacgctgttttcggcagcgcagttaaccgccgagtgcgccatcgttaccttagtctaccttgagaggctactcacatacgccgaaatagacatttgtccaaccaattggaagcggatagtgctaggagccatcctgctggcatctaaggtttgggatgatcaggcagtctggaatgttgactattgccagatactgaaagatattacagttgaggacatgaatgaaatggagaggcactttctcgagcttctccaattcaacatcaacgtgccggcaagtgtttacgcaaaatactattttgacctgcgtagcctagctgacgataacaaccttaatttcctattcgctccactgtctaaggagagagctcaaaaccttgaggccatttcacggttgtgtgaggataaggacctctgcagggccgcaatgagacggtcattctcagcagacaatttcatcggaatccagaggagcaaagccatcctctcatag

SEQ ID NO: 55346 - DNA, 1086 bp, Artificial Sequence
  Description of Artificial Sequence: Synthetic coding sequence
atggggaacatactcacctgctgcgtgtgccctcgtgcctcaccaggccttcaccaacaccaaggactggtgtgccactgcgagagcgagatctatgaagctgctgcaggagaccttattgcgggtgtgcccgttgctgctgcagttgagcccggagaggtcacttttgtcgctggagaggggctgcacatgcaccacatttgtgaaagagagatgccagaggatattcctttggaacccaacccctccgatcacccgaaggcttcgactattttcctgcgtaagtcgcaaactgatgtgcaggaaaaaaagaaaaagcaactgtgtaaagtgtccactgaacacttcactcagcaatatagctcttgttccacaattttcctggacgatagtatcgccagccagcctcatctgaccatgacactgaagagctgcgacctgggcactatcttgtcttatcaggcaaagagagatgcccaccggtcccttggaattttcgatgagcagctgcaccccctgacagtgcggaaggaggtgctcgaagaatactttaagtatgaccctgagcataaactgatcttcaggtttgtcaggacacttttcaaggctatgcgcttaacggccgagtttgccatcgtgagcctgatctacattgagaggcttgtgtcttacgcagatattgatatttgccctaccaattggaaacgcattgtgctcggggctatccttctggctagcaaagtctggagtgacatggccgtgtggaatgaggattattgtaagctttttaaaaacatcactgtggaagagatgaacgagctggaacggcaatttctcaaacttattaactataataacagtatcaccaatagcgtctacagccgcttctattttgacttgagaacgctcgcccacaacaatggtttatacagtccagtatatcttttagacagagagagggcgtggaaacttgaggccttcagtagaatggaacaagacaaggtgttctactctgctgccaagaacggttccctctctgccgacgacctaatccatttgcaacgggctaaggccatactgttctag

SEQ ID NO: 55347 - DNA, 864 bp, Artificial Sequence
  Description of Artificial Sequence: Synthetic coding sequence
tgaattcctctcgagcctaaccctagtgatcaccctaaggcgtcgaccatctttctccggaagtcacagaccgatgtccaagaaaaaaaaaaaaaacagctgtgcaaggtgagtaccgagcacttcactcagcagtactcatcttgtagtacaatcttcctggacgactcaatagcctctcagccgcacttgacaatgacattgaagtcgtgcgaccttggtactattctaagctaccaagcaaagcgggacgctcaccggagccttggaatctttgatgagcagctccaccctttaactgtgaggaaagaagtactggaagaatattttaagtacgatccagagcacaaactgatctttagatttgtgcggaccctgttcaaagctatgcgcttgaccgcagagtttgctattgtctctttaatttacattgagcggttagtcagctatgcggatattgatatctgtcctaccaattggaaaaggatcgttctcggggcaatcctgctggcctccaaagtctggtctgatatggcagtgtggaacgaggattactgcaagttattcaaaaatataacagtcgaagagatgaatgagctcgagagacagttcttgaaactgatcaactataacaattcaatcacgaatagcgtgtattccagattctactttgacttgcggacactcgcacacaacaatggcttgtactctcccgtgtacctgctcgaccgagagcgtgcttggaaacttgaggcattcagcagaatggaacaggacaaggtgttttactcagctgctaagaacggcagcctgtccgccgacgaccttattcatctccagagggccaaagcgattttgttctag

SEQ ID NO: 55348 - DNA, 1032 bp, Artificial Sequence
  Description of Artificial Sequence: Synthetic coding sequence
tcttgtgttgtgattcagatcccaccatggcatttggataggaaatacggttcatgttcgaccatactcctagacaattccaccgcttcacagcccgacttgcggcatacattagaacggtacgctaaccggtccctggcaatctttgaagagcctgtgcaccctttaccccaagaaaagctccccggaaaaagcttcaagcatgatccaaaaaggaactgcatctttcggcacttttgtacgctctttcaggtcataaagttgactgccccttgcgctatcgtagctttggtctacatcaagaggctgcttaccagcgcaaatatcgatctgtgtccgaccaattggaagaagatcgtcctcggaacgatgctgctggcctccaaagtctggaggaatcacggcttgtggtcagttgacgatagccaaaattcaaaggacaccgcggtggagaacatgagcaagatggaaaagtgctttctcgagctactggaattcaacattcatgtgagcgcttcagtgtatgccaagtactactttgatctctgtgccctggccaacgatcacgatctgtacttcctgttctccttcctgcacaaggataaggcccagaagttggagggccacacttctcagcacagcctcagcctgggaccttgtagggtgggcatggagaattatgccacctactcccccttaagctctcagcctgtcctaggtgcactgtcactggctgaagtcctgccccaggaaataaagcaggaaattcaccaggtattgatggaccacggcgtgccttgtcactatacatgtttcctgctccatcccgaagattctacactcgagcgattcttggtgcttcactctattcaggggttgcaggaggactctgttctctgtaaggtggagatccatggactgtcccctcagccacagacctaccagtcccactttaggtctcccagcctcgccgagttgttaaacagaatcagcgggacatgccggaaccatttcgccggtatgcaaaaatag

SEQ ID NO: 55349 - DNA, 1155 bp, Artificial Sequence
  Description of Artificial Sequence: Synthetic coding sequence
atgacctcattccaccctagggggctgcaagccgctcgcgctcagaagtttaaatcaaaaaggccaaggtcaaacagcgactgttttcaggaggaggatctacggcagggtttccagtggagaaaaagcttgccgtttggcgcagcttcatcctacttaaatctggagaagctgggcgaaggctcctatgccactgtctataagggaattagccgcatcaatggacagctagtggcccttaaagtcattagcatgaatgccgaagagggggtgccattcacggctattcgcgaggctagcctcctgaagggcctcaagcacgctaatattgtgctactccatgacataattcacaccaaagaaacgctcaccttcgtgtttgaatatatgcacacagatcttgcgcaatatatgtcacaacacccaggtggattgcacccacacaacgttagactgtttatgttccagctgctaaggggcctggcatatatccaccatcaacatgttctgcatagggaccttaagcctcaaaatctgctcatttctcatctcggtgagttaaaactcgcagacttcggccttgcaagggcaaagtccatcccttcccaaacatattcaagtgaggtcgtgaccctgtggtaccgaccccctgacgcccttctgggcgctacagaatacagcagtgagctggacatctggggagcaggatgtattttcatcgagatgttccagggccagccactgtttcccggagtgagtaacatcctggagcagctggaaaagatctgggaggtgctgggcgtgccaaccgaggacacttggcccggagtctccaagctgccgaattacaaccccgagtggttccctctgcccacaccgaggagcctgcacgtggtgtggaatcgtttgggccgagtgcccgaagccgaagatttggcctcacagatgctcaaaggcttccccagagacagggtatccgcacaggaggccctagttcacgactacttcagcgctctgccaagccagctgtatcaactgcccgacgaagagtcactgttcaccgtcagcggggtccgtctcaaacccgagatgtgcgacctcctggccagctaccaaaaagggcatcacccagcccagttttcgaagtgttggtag

SEQ ID NO: 55350 - DNA, 1308 bp, Artificial Sequence
  Description of Artificial Sequence: Synthetic coding sequence
atggggcaggaactgtgtgcaaagactgttcagcctggctgtagctgttatcactgttccgagggcggagaagcacattcatgtcggagaagtcaacctgagaccacagaagctgcgttcaaattgacagacctcaaggaagccagttgctccatgaccagtttccaccctcggggactacaggctgcccgagcccagaagttcaagagcaaaaggcctcgttccaattcagattgctttcaggaagaagatctgcgccagggatttcagtggcggaagtcactccccttcggtgcagcctcttcatacctgaatctggagaaactaggagagggctcctacgcgacagtttacaaggggatctcgcgaattaacggccaattagtggccctgaaggtcatttccatgaacgcagaggagggggtccctttcaccgctatccgggaggcaagcttgctgaaagggctaaaacacgctaatattgtcctgctgcacgacatcatacacactaaggaaacactgactttcgtctttgagtatatgcacactgaccttgctcaatatatgagccagcatcccggaggtcttcatcctcacaatgtgcggttgttcatgttccagctcctcaggggactggcctacatacaccatcaacatgtgctacatcgggatctgaagccccagaatttgctaatttcacatcttggagagcttaaactggccgacttcgggctggcaagagccaagagtattccttcccagacttactccagcgaagtcgtgactttgtggtaccggcctccggacgctctcctaggggcaacagaatactcctccgagcttgatatttggggggcaggctgcattttcatcgaaatgtttcagggccaaccactcttccctggcgtatctaacatactcgagcagttggagaagatctgggaggtgctaggcgtgcctaccgaggacacgtggcccggagtgagtaagctgcccaactataatcccgagtggttccccttgccaactccacggtcactacatgtggtgtggaacagacttggcagagtaccagaggctgaagaccttgccagtcagatgctcaaaggttttcctagggatcgcgtaagtgcccaggaagccttagttcacgactatttttctgccctgccaagtcagctgtaccaactccccgatgaggaatctttgtttactgttagcggggtcaggctgaaacctgaaatgtgtgatttactcgcctcttaccagaagggtcaccatccagcgcagttttcgaagtgttggtag

SEQ ID NO: 55351 - DNA, 1155 bp, Artificial Sequence
  Description of Artificial Sequence: Synthetic coding sequence
atgactagtttccaccctaggggcctgcaggctgcaagggcacagaagttcaagagcaaaagaccacgctccaacagcgactgtttccaggaagaagatctgcgacagggttttcagtggagaaaatcgctcccatttggagcagcttcctcataccttaatttagaaaaattgggcgaaggctcatatgcaactgtttataaggggataagtaggatcaatggccagctcgttgctttaaaagtgatatcaatgaatgccgaagagggcgtgcctttcaccgcgattcgtgaggcatctctgctcaagggactaaaacatgcgaatattgtgttattacacgatatcatccacactaaggagacactcacattcgtcttcgagtacatgcacaccgatctcgctcagtatatgtcacagcacccgggtgggttacaccctcacaacgtacgccttttcatgttccagcttttgagaggcctggcgtatatccaccatcagcacgttttgcatcgtgacctgaaaccacaaaatctgttgatttctcacttgggagaattaaaattggccgatttcggcctggccagagcgaagtccatacccagtcagacatattcttccgaagtcgtgactctttggtaccgcccaccagacgctttattaggtgcaactgagtacagcagcgaactcgacatctggggggctgggtgtatttttatcgaaatgtttcagggccagcccctgtttccaggggtgtctaacattctggaacaacttgagaaaatctgggaggtgcttggggtgccaactgaagacacctggcctggggtctccaagctcccaaactataatcccgagtggtttccactgccaactccacggtctctgcacgtggtgtggaataggctgggacgcgtgccagaagctgaggatctagcctcgcagatgctgaaaggcttcccaagggatagagtgagcgctcaggaagcgctggtccatgactacttttcagcactcccaagtcaactctatcagttgcccgacgaggaatcactgtttaccgtgtccggggtccggcttaagccggaaatgtgcgacctgcttgctagctatcagaagggtcaccacccggcacagttttccaagtgctggtag

SEQ ID NO: 55352 - DNA, 1203 bp, Artificial Sequence
  Description of Artificial Sequence: Synthetic coding sequence
atgggccaggaattatgtgctaaaactgtacagcctggatgtagttgctatcattgcagcgagggcggtgaggcgcatagctgcaggagatcccaacccgagaccaccgaagccgctttcaaactgactgatctcaaggaggccagctgctctatgacctctttccaccccagggggctccaggctgcaagggcacagaaattcaaaagtaagaggccaaggtccaacagcgattgtttccaggaagaggatctgcggcagggcttccagtggcggaagtcactccccttcggagcagcttcatcatatttaaacctggagaaattgggggagggcagctacgcgacggtctataagggaatttcaaggattaatggccaactggttgcactgaaagtcatcagtatgaacgcagaggaaggggttccgtttactgcaatccgggaggcgtcgctgttgaaggggctgaagcacgctaatatcgtcctccttcacgacattatccatactaaagagactttgaccttcgtgtttgagtatatgcacactgatctcgctcagtatatgtcgcagcaccctggaggactgcacccccacaacgtaagactgttcatgtttcagctcctgaggggtctggcttatattcatcaccagcacgtgctccatagggacttaaaacctcagaaccttctgatcagccaccttggtgaactgaagctggcggacttcgggttagcaagggccaaatcgatacccagccaaacatatagctcagaggtggtgaccctgtggtacaggcctcccgacgctttgctcggggctaccgaatactcctctgaactagatatctggggcgcaggatgcatattcattgaaatgtttcagggacagcccttattcccaggcgtgagcaatatactggagcagctggagaaaatttgggaagtgctgggagtgcctacagaagatacatggcctggagtttctaagctgccgaactataatccggagtggtttcccctgcccacaccacgttctttacacgttgtgtggaaccggcttgggagagtgccagaggctgaagatctggccagtcagatgcttaagggattcccacgagacagagttagtgcacaggaggccctggtccacgactattttagcgccctaccctcacagctgtaccagctgccagatgaatag

SEQ ID NO: 55353 - DNA, 1290 bp, Artificial Sequence
  Description of Artificial Sequence: Synthetic coding sequence
atgggtcaggaactgtgcgccaaaacggtccagcctggttgttcatgctatcattgctctgaaggcggagaggcccactcgtgtcgcagaagccagccagagaccactgaggccgctttcaagcttacagatttgaaggaagcatcctgctcaatgacatctttccacccccgagggctgcaggccgctagggcccagaaatttaagtccaaacgccctagatcgaactctgactgcttccaagaagaggacctccgccaaggatttcaatggagaaaatcactgccattcggcgcagcatcttcataccttaacctggaaaagttaggtgagggtagttacgcaaccgtatataaggggatcagcaggataaatggccaactagttgccttaaaggtcattagtatgaacgctgaggaaggggtgccgttcaccgccatcagggaagcttcactgttaaaagggttgaaacatgctaatatagtgttgctgcatgacatcattcacaccaaagaaacccttaccttcgtgtttgaatacatgcacaccgacctcgctcagtatatgtcccagcatcctggcggattgcatccccacaacgttcgtctttttatgttccagcttctaagggggctcgcatatatccaccaccagcatgtgctgcatcgagatcttaagccacagaacctcctcatttcacatttgggcgaactcaaacttgccgactttggccttgcaagggcgaagtcgatcccgtcccagacctatagctcagaagtggttaccctctggtaccggccacctgatgcgcttctcggtgccacagagtacagctccgaacttgacatatggggagcaggatgtatttttatagagatgttccagggccagcctctgttcccaggggtgagcaatatccttgaacagctcgagaaaatctgggaggttctcggcgttcccaccgaagatacctggcccggagtgagcaagctgcccaattacaaccccgagtggttccctctaccaaccccaaggtctctccacgtggtatggaaccgtctagggcgtgtaccagaggccgaggacttggctagtcagatgttgaagggatttcctcgtgatcgagtctccgcccaggaagctctggttcatgactacttctccgctctgccatcacagttatatcagctgcccgatgtgagcggtgtacgactcaagcctgagatgtgcgatcttctggcttcctatcaaaaaggccaccatccggctcagttctctaagtgttggtag

SEQ ID NO: 55354 - DNA, 1713 bp, Artificial Sequence
  Description of Artificial Sequence: Synthetic coding sequence
atgccactatacggtagggctcgggatcatgtgacacatcctagtatcctgggaacacggccaggaaggcccatggctggtcctattactgcagccgtgccagagaaaatttgtaacggggctttctgttcttgttctggggctttccccctcgaccctaataatccaagcctgggccctctcccatctatttcccacctgaaccttaggacacagatagctatggaccggatgaaaaaaatcaagcgacagctgtcaatgaccctgcgaggcggaagggggattgataagacaaacggcgctcccgaacaaatcggtctggatgaatccggaggaggcggtggcagcgatcccggagaggccccaacacgtgccgcaccaggcgagctccggagtgccagaggaccactgtcctccgcgccagagatcgttcacgaggacctgaagatggggtcagatggcgagtctgatcaagccagcgccacgagctcagatgaagtgcagagtcctgttagagtgcggatgaggaatcatccccctcggaagatcagcaccgaagacattaataagcgcctgagccttcctgcagacatccggctgcccgagggatacctggagaaattaaccttgaattcaccaatattcgataagccacttagtcggaggctacgacgagtgtccttaagtgaaatcggatttggcaagctggaaacttatataaaactggataaattgggtgagggaacctacgccaccgtgtacaaggggaagagtaagctgacagataatttggtggccttgaaggaaatccgactcgaacatgaggaaggcgcaccctgcaccgcgatccgcgaggtgagcctcctcaaagacctgaagcatgcgaacatcgtcaccctccacgatatcatccacacagagaagagcctgacattggtatttgagtacctggacaaagatttgaagcaatacctggatgactgtggtaatattattaatatgcacaacgttaagctattcttattccagctcttaagggggctggcatattgccaccgtcaaaaggtactgcatcgggatctgaagccgcagaatttactgattaacgaacgtggggagctgaagcttgccgacttcggactcgcaagagctaagagtataccaaccaaaacttactcgaacgaagtcgttacgctgtggtacaggcctcctgatatcctgctaggttccaccgattacagcacccagatcgatatgtggggggtgggttgtattttttacgaaatggccaccggccgacccctgttccctggaagcacggtagaagagcagctgcacttcatttttcgaattttgggaacccccactgaggagacttggcccggtatactgtccaacgaggaattcaagacatataactacccaaaatatcgtgctgaagccctgctgagccatgcccctcggttagactccgatggcgctgacctgctgacaaagctgctgcagtttgagggtcgtaatcggatctccgctgaagatgccatgaaacaccctttctttctgtcattgggcgaacgcatccacaagctgcccgacactacatcaatttttgctctgaaggagatccagctacaaaaggaggctagccttagatcctcaagcatgcccgactcaggcagacccgcatttcgggtcgtggatacagagttttag

SEQ ID NO: 55355 - DNA, 1491 bp, Artificial Sequence
  Description of Artificial Sequence: Synthetic coding sequence
atggaccggatgaaaaagataaagaggcagttgagcatgacgctgaggggcggtaggggtattgacaaaacaaacggagctccggaacagattggcttagatgagagtggcggaggcggtggcagcgatccgggagaggctcctacacgcgctgccccaggtgagctcagatccgctcgcggaccactgagttcagcccctgaaattgtgcacgaggatctcaagatgggcagcgatggggagtcagatcaggcatcagcaacgtccagcgatgaagttcagtctcccgtaagggtccgaatgagaaaccatcccccaagaaaaattagcactgaggacataaataagcgtctgagcctaccagctgacattagactccccgaggggtatctggagaagcttaccctcaacagccctatcttcgacaaacccctctcaaggaggcttaggcgagtaagcctgagcgaaatcgggttcggcaagctcgagacctatataaagcttgataaactaggcgaggggacatacgccactgtctataaggggaagtccaaactgacagacaatctagtcgccctcaaagagattcgactagagcatgaagaaggagcgccttgtacagctattagagaagtgtctctcctcaaggatttaaaacatgcaaacatcgtcaccctgcatgatataatccatacggagaaaagcctgaccttagtattcgagtaccttgacaaggatctgaagcagtatttggacgattgtgggaatatcattaatatgcacaatgtgaagctgtttctgtttcagctgctccgaggacttgcctactgtcaccggcagaaagttcttcaccgtgatctgaagccacaaaatctgctaatcaatgagagaggggaactaaaacttgcggatttcgggctggcacgagctaaatctattccgacaaaaacgtatagtaacgaagtcgttacgttgtggtacagaccccctgacattttgctgggcagtacagactacagtactcagatcgacatgtggggagtcgggtgcatcttctacgaaatggctaccggaaggcccctgttcccaggatcaacggtggaggagcagctgcattttatctttcggattctgggtacccccacagaagagacgtggcccggaatcctgagcaatgaagagtttaaaacctacaactatccgaaatacagggccgaagccctgctgtctcacgcacccagacttgacagcgacggtgccgatcttctgacaaagttgctgcagttcgagggcagaaaccgcatctctgccgaagatgcaatgaaacacccatttttcttatcactaggggaacggatacataagctgccagacaccacctctatattcgccctgaaggagatccagctgcagaaggaagcgtcactgagaagctctagtatgccagacagcggtcggcctgcatttagggtcgtagacacagagttctag

SEQ ID NO: 55356 - DNA, 1509 bp, Artificial Sequence
  Description of Artificial Sequence: Synthetic coding sequence
atgcaatctgaaattgccatggaccgtatgaagaagataaagcgccaactgtccatgacactgcgcggaggccgaggaattgacaagacaaacggcgcacctgaacaaataggactggacgagtcaggtggcggaggaggatcagaccctggcgaggcacccactagagcggcaccaggggaattgaggtcagccaggggcccactctccagcgccccagagattgtccacgaggacctaaagatgggtagtgacggagaaagtgaccaggcctccgcaacatcaagtgatgaagtgcaatccccagtgcgggttcgaatgaggaaccacccaccacggaagataagcacagaggatatcaacaagagactatctctccccgctgacatacgtcttcccgagggatatcttgagaagctcaccttaaacagtcctatctttgacaaaccactgtctcgtaggctcagaagggtcagtctctcggaaatcgggtttgggaaactcgagacctatataaagcttgataaactgggagaaggaacttacgctacggtttacaaggggaaaagcaagctcaccgataatctggtggctctaaaagagatccgcctcgagcatgaagagggtgcaccctgtaccgccatcagggaagtgtcattgttgaaggatctaaaacatgccaacatagttacattacatgatatcatacacactgaaaaaagcttgacccttgtgttcgagtatttagataaagacctcaagcagtacctggatgattgtggtaacattataaatatgcacaacgtgaaactcttcttgttccaactgctgcggggattggcctattgtcacaggcagaaggtgctgcaccgcgatcttaagcctcagaacttactcattaacgaacgcggagaattgaaactcgccgatttcggtttagctcgagccaaatctattcccaccaagacttacagcaacgaggtggtgacactgtggtataggccccctgatatcctccttggctcaacggactactccactcagattgacatgtggggcgttgggtgtattttttatgagatggcgaccggaagacctctcttcccaggatccacggtagaggagcaacttcactttatctttagaattcttggcacccccacagaagaaacttggccaggaattctgagcaatgaagagttcaaaacttacaactacccgaagtatcgcgctgaggccctattatctcacgcccctcgtcttgattctgacggagccgatcttctgactaaactgctgcaatttgaggggcgtaaccggatcagtgctgaagatgccatgaagcatccattctttctgtctctgggcgagaggattcataagctgcctgacacaacttctattttcgctctgaaagagatccagttgcagaaagaggcctccctgagatcaagctctatgcctgacagtggcaggccagcatttagagtggtggacacagaattctag

SEQ ID NO: 55357 - DNA, 1491 bp, Artificial Sequence
  Description of Artificial Sequence: Synthetic coding sequence
atggatcgcatgaagaagattaagcgacagctcagcatgacactgcgcggagggagaggcatcgataagactaatggagcacccgagcagatcgggctcgacgaatctgggggaggcggtggctctgaccctggcgaagcccctacacgagccgctcccggtgagctgcgttctgccaggggacccctgtcatcggcacccgagattgtgcatgaagatcttaaaatgggctccgacggggagtccgatcaggcaagcgcaactagcagtgacgaggtccagagtcccgttagagtgagaatgaggaatcacccccctcggaaaatcagcacagaagacatcaataaaagactgtcactgccagccgacatacgcctgcccgagggctatctggagaagctcacactgaacagtcctatattcgataagccgctctcccgtagactgcgcagagtgagcctttcagagataggttttgggaaacttgaaacttatatcaagctggataagctgggcgagggaacttatgctactgtgtacaaaggaaagagtaaactcaccgataacctcgtggccctgaaggagatacgtctagagcatgaggagggtgcaccatgtaccgcgatcagggaggtttctcttctgaaagatctgaaacacgctaacatcgtcacccttcacgacattatccacaccgagaaatcactcacactcgtgttcgagtacctcgataaagatttaaaacagtacttagacgactgtggcaacattattaacatgcataacgtgaaactgtttctgtttcagttgctccggggactcgcctactgtcacagacagaaagtactgcatcgggatctcaagccgcagaatctattaatcaatgagcgaggagaactgaaactggctgatttcggcctggcccgagccaagtcgattcccaccaagacctacagtaatgaggtggttactctttggtaccgaccccctgacatccttttaggctcaacagactatagcacccaaatcgatatgtggggggtcggatgtatattctacgagatggcaactggcagacctctcttccctgggagcactgttgaggaacaactccacttcattttcaggatcctggggactcctacagaggagacgtggcctggaatccttagcaatgaggagttcaaaacctacaattatcctaaatatcgggctgaagcccttttgtcacacgcaccgagactcgattccgacggcgctgacctgttaacaaagctgcttcagttcgaggggagaaatcgaatttcagctgaagacgcgatgaaacaccctttcttcctgtccttgggcgagcggatccataagcttccagatacaacatccatctttgccttgaaagaaatccagctccaaaaggaggccagtctcagatcttcatctatgcctgattcaggacgcccagctttccgggtcgtggatactgagttttag

SEQ ID NO: 55358 - DNA, 570 bp, Artificial Sequence
  Description of Artificial Sequence: Synthetic coding sequence
atggatcgtatgaagaaaattaagcggcagctgagtatgaccctgcgcggaggtcggggaatagacaagacaaacggggctcctgaacagattgggctggacgagagcggaggaggaggaggttctgaccctggcgaagcacctacccgcgctgctcccggtgagctccgatccgcccgtggcccattgtcctctgcccctgagattgtgcacgaggacctaaaaatgggctcggatggtgaaagcgatcaagcttcagctacctcgagtgatgaggtccagtcccctgtccgggtacggatgcgaaatcaccctccgaggaaaattagcaccgaggacataaacaaaagattatctctccctgcggacatacgcctgccggagggctatctcgagaaactcaccctgaattctcctatatttgataagcctctgtcaagacggcttcgccgtgtgtctctcagtgagatcggcttcggaaagctggagacctatattaagctcgataaattgggggaaggaacctatgctaccgtgtataaaggaaaatccaagctgacagacaattag

SEQ ID NO: 55359 - DNA, 453 bp, Artificial Sequence
  Description of Artificial Sequence: Synthetic coding sequence
atggatcgcatgaaaaaaatcaagcggcagttgagcatgacactgcgcggaggccgaggaattgataagaccaacggtgccccagaacagattggtcttgatgagtccggcggtgggggaggctcggatcctggagaggctcctacgcgagcagctcctggcgagttgcgttccgctcgaggccctttatctagcgctccagaaatcgtacacgaagatctcaaaatgggctctgatggcgagtctgatcaggcaagcgccaccagctccgatgaagttcagagccccgtgcgggtgaggatgagaaaccatcccccaaggaaaatcagcaccgaagacattaacaagcgtctttcactgcccgctgacatcaggcttcccgaaggctaccttgagaagctcactctaaatagcccaatcttcgataaaccactatcacgaaggctgagatag

SEQ ID NO: 55360 - DNA, 462 bp, Artificial Sequence
  Description of Artificial Sequence: Synthetic coding sequence
atggatcgtatgaagaagatcaaaagacagctgagtatgacattacgcggaggaagaggaatcgataaaactaacggcgcacctgaacaaatcggactggatgaaagtgggggaggaggcggaagtgatcccggagaagcccctacccgcgctgctcctggcgagcttcgctcagcacggggacccctttcttccgctcctgaaatagtgcatgaggacttgaagatgggttccgacggcgaaagcgatcaggcatctgcaacttcaagcgatgaggtacaaagccccgtacgcgtgagaatgcggaatcatcctccgaggaaaatttcgactgaggacatcaataaaaggctttccctgccagccgacatcaggctgccagagggctatctcgagaagctgactctgaactcgcccatcttcgataagcctctgtcaagacgcctgcggagggtttcatag

SEQ ID NO: 55361 - DNA, 174 bp, Artificial Sequence
  Description of Artificial Sequence: Synthetic coding sequence
atggaccgcatgaagaagatcaagcggcagctttctatgacgctccgcggtggcagaggcatcgataaaacgaatggcgctcctgagcagattgggcttgacgaaagcggtggcggtggtggtagtgaccctggagaggcgccaacgcgggctgccccaggagagctgcgttag

SEQ ID NO: 55362 - DNA, 1347 bp, Artificial Sequence
  Description of Artificial Sequence: Synthetic coding sequence
atggatcgcatgaagaagattaaacgacaactttcaatgacgttaagatccgctccggagattgtccatgaggatcttaaaatgggaagcgatggtgagagcgatcaggctagcgccacctcatcagacgaggttcaatcgccagtccgcgtccgcatgagaaatcaccccccacgcaagatctcaacagaagacataaacaaacgcctgtcattaccagcggatatcagactacccgaaggatatctggaaaaactcacactgaattctccaatattcgacaagccactatccaggagactgaggagagtgagcctctcagagataggattcggaaaactcgagacctatattaagctggacaagctcggagaaggcacatatgcaactgtttacaaaggcaagagtaagctaacagataaccttgtggcgcttaaagagattcggctggagcacgaggaaggcgctccctgcacggccatccgcgaggtatcactgctgaaggatctgaagcacgccaacatcgtcactctacacgatatcatccacactgagaagtcattaacactagttttcgagtacttagacaaggatctgaaacagtatctggatgactgtggcaacatcatcaacatgcacaatgtcaagctgtttctctttcagcttctacgaggtcttgcctactgccataggcagaaagtcctccatcgagacctgaaaccccaaaacctcctcataaacgagcggggtgagttgaagctcgcagactttggactcgctagagctaaatctattccaaccaagacctatagtaacgaagtggtcaccttatggtatcgaccccctgacatactcctgggctctacagattattccactcagatagatatgtggggggtgggatgtatattctacgagatggctacaggcagacccctgtttcctggctcaactgttgaagagcaactgcatttcatctttcgtatcctcggcacgccgacagaagagacttggcccggtatcctaagtaatgaagagtttaagacttataactatcccaaataccgcgctgaagccctactttctcacgcaccgcgactcgattctgacggtgctgacctattgaccaaacttctgcaattcgaggggaggaatcggatttcagcagaggacgcgatgaagcatccctttttcctgtccctgggtgaacgcatacacaagctgccagacacgaccagcatctttgctttaaaggaaatccagctccagaaagaggcaagcctgaggagtagttctatgccggattcagggaggccggctttccgtgtggtagacactgaattctag

SEQ ID NO: 55363 - DNA, 1806 bp, Artificial Sequence
  Description of Artificial Sequence: Synthetic coding sequence
atgagaggcgcaagaagagcgagacggctcggccgatggctgttcgggcctgggataaggaggcattctgctatcagaccattatgtgcagctagcagacgtgagcactctgacagcagtcgccgtcagagagtgaggggtcaccgccctcaaagacccagtagttggcccgctgagcgggacgctgcgagcgccagcgcgactgccgcagcagcagcctccagtagctcagcaggcggaggtccaggaccggcaaccatggccgaggtcgcacgagcccctccacccatcgccatggataggatgaagaagataaagcggcagctgagcatgaccttaagggggggtagagggattgataaaacaaatggtgccccagagcagatcggtctggacgagtccgggggaggcggagggtcagatccgggagaagctcccactcgggcagctcccggagagctgcgcagcgcacgcggacctctgtcaagcgcccctgagatcgttcatgaggatttaaaaatgggttcggatggggaatccgatcaagcgtccgccacctctagcgatgaagtgcagagccctgttcgagtccggatgagaaatcacccaccgaggaagatttctacagaggatattaataaacgcctgtccctgccagccgatatccgcctcccggagggatatcttgagaaacttacccttaactccccaatcttcgataaaccactgtctagacgcctccggagagtctctctgagcgaaatcggctttgggaagttggaaacttacatcaaactggacaagctgggtgaagggacctatgctacagtgtataaggggaaaagcaaactgactgataacttagtcgccctcaaggaaattcgcctggaacacgaagaaggcgctccgtgtactgctatcagagaggtcagtctgttgaaagatttgaagcacgccaacatcgtcactctgcacgatatcatccatacggagaagagtctgaccctcgtctttgaatacctcgacaaggatctgaagcaatacttggacgactgtggtaacattattaatatgcacaacgtcaaactgttcttatttcaactgcttaggggcctggcctactgccaccggcagaaggtgctgcatcgggacctgaaaccacaaaatttgctgattaatgaacgtggggaacttaagttggctgatttcggactggctcgcgctaaaagtattccaacaaaaacttacagtaatgaggtagtgacactctggtacaggcccccagacattcttctcggctcgaccgactacagcacccagatagacatgtggggcgttggctgtattttctatgagatggcgacgggacgacccctgtttccagggagcacagtggaggaacagctacatttcatttttagaatcctgggtacaccgaccgaggagacttggcccggtatcctcagcaatgaggaattcaagacctacaactatcccaagtaccgggctgaagccctgctgtcacatgccccaaggtccctgtgtccctgcggccgtctggacagtgatggtgcggatctgcttactaagctgttgcagttcgaaggcaggaatcgcatcagcgcagaggatgccatgaagcacccttttttcctctccctgggcgaaagaattcacaaactgcctgacaccacatcaattttcgccctgaaagaaatccaactgcagaaagaggcaagtttacggtcctcctctatgcctgactcaggtaggcccgcttttcgtgtggttgacactgagttctag

SEQ ID NO: 55364 - DNA, 1572 bp, Artificial Sequence
  Description of Artificial Sequence: Synthetic coding sequence
atgaagaaatttaaacgtagactgtccctgacgctcaggggctcccagacaatcgacgagagtctcagcgaattggccgagcagatgaccattgaagaaaactcttctaaagataatgaaccaattgttaagaacggacggccacccacctcccatagcatgcacagcttcttacatcagtatacagggtcatttaaaaagcccccattacgaaggccacattcagtgatcggaggctctttagggagctttatggcaatgccacgaaacggttcccggctcgatattgtgcacgagaatctaaagatggggtcagatggcgagagcgaccaggcatcaggcacctcaagtgacgaagtgcagtctccaaccggcgtgtgcctccgaaaccgaatccaccgtcgtatatccatggaggatctgaacaaacggctatctctgcctgctgatataaggatcccagacggctaccttgaaaaactgcagatcaactccccacccttcgaccagccaatgtcccgcagatcacgtagggcctcactgtccgaaataggcttcggcaagatggagacttacattaaactggaaaagttgggggagggcacctacgcgaccgtgtataagggacggtccaagttgacagagaatctcgtggctcttaaagagattcgactggaacacgaggaaggggcaccgtgcaccgctattagggaagtgagtctactcaaggacctaaaacacgctaacattgttacgctgcacgacattgtacacaccgacaaaagcctaaccctcgtgtttgagtacctggacaaggacctgaaacaatacatggacgattgcggaaatatcatgagtatgcacaatgtgaagttgttcctgtatcagattctcaggggtctcgcctattgccaccgcagaaaggtgctgcaccgggacttaaaacctcagaaccttctgattaatgagaaaggggaactgaaacttgcagatttcgggttggccagagctaagtcagttcccacaaaaacctatagtaacgaggtggtcacactgtggtataggccccctgacgtacttctcgggagttccgagtattcgactcagattgatatgtggggggtcggatgtattttctttgagatggcatcagggcgtcccctttttcctggcagtacggttgaagacgagctgcatctgatctttcgcttactcgggacacccagccaagagacgtggcctggcataagtagtaatgaagaattcaagaactacaactttcctaaatataaaccccagccgctgataaaccatgcacctagactggactcagaaggaattgagttgatcaccaagttcctccagtatgagagtaagaaacgggtgagcgccgaagaggctatgaagcacgtgtactttcggtcactgggccctcgtattcacgcgctgcctgaatcagtgagcattttctctctgaaggaaattcagctccagaaagacccgggtttccggaattcctcttacccggagaccgggcacggaaagaacagacgccagtctatgctgttttag

SEQ ID NO: 55365 - DNA, 1572 bp, Artificial Sequence
  Description of Artificial Sequence: Synthetic coding sequence
atgaagaaattcaagagacggctgtccttgactttgcgaggatcccagaccatagacgaatccctgagcgagttggcagaacagatgaccatcgaggagaattcttctaaggacaatgagcccatcgtcaaaaacggaagaccacctacttctcactcgatgcacagctttctgcaccagtacactgggagcttcaaaaaacccccattgcgacggcctcattccgtgatcgggggtagcctgggctcctttatggccatgcctcgcaacggttctagactagatatcgtgcacgagaacctgaaaatggggtcagacggggagagcgatcaggcgagcggtacatcttctgacgaagtgcagagccccacgggggtgtgccttcggaaccggatccatagaagaatcagtatggaagatctgaacaagaggctgtcactacctgccgatataaggattcctgacggttatctcgagaagctccagataaactcgccacctttcgatcagcccatgtctcgcagatccagaagagcgtctttgtctgagatcgggtttggtaagatggagacctacattaagcttgaaaaactcggtgagggaacttatgcgaccgtgtacaagggacgcagcaagctgacagaaaacctcgtagcactaaaggagatccggctcgagcacgaagagggcgctccctgtaccgccatccgggaggtcagcctattaaaggacctcaagcatgcgaacatagtgacccttcacgacatcgtgcacactgacaaaagcttgaccctggtcttcgagtaccttgacaaagatctgaaacagtatatggacgattgtggcaacatcatgtctatgcacaatgtgaagttgtttctgtaccagatcctgagaggcctcgcctattgccatcgtcgaaaagtgctgcaccgggatctcaaaccccagaacctcctaatcaatgagaagggtgagctcaagcttgcggattttggattggctcgggctaagtcagttcctaccaagacttactccaatgaagtggttaccctatggtatagaccccctgacgttctgctgggatctagcgaatacagcacacaaatcgatatgtggggagttggatgtatcttctttgaaatggcctcaggacgcccactgtttccaggttcaaccgtggaggatgagctccacttaattttccggctgctgggtaccccaagccaagaaacatggccaggcatttcttccaatgaggagtttaagaactataattttcccaaatacaaacctcagcctctgattaatcacgctccacgactggattccgaagggattgagttgataaccaaatttctgcaatatgagtccaaaaaaagggtatccgcggaagaggccatgaaacacgtgtacttccgctctttagggccaaggattcacgcactgccggagtccgtatccatcttctcgctcaaggaaatccagctgcagaaggacccaggatttcgaaatagctcttatcctgagacaggggtatttgtgatcaaccatttcacctgcaggtcctag

SEQ ID NO: 55366 - DNA, 540 bp, Artificial Sequence
  Description of Artificial Sequence: Synthetic coding sequence
atgaaaaaattcaagagaaggctatccttaaccctgagaggctcacaaacgatcgacgagagtctgtcggagcttgcagagcagatgacaatcgaagagaattcctcaaaagataatgagccgattgtcaagaatggacgaccccctaccagtcacagtatgcattcatttttgcatcagtacaccggatcgttcaagaagccgcctctaaggagaccccacagcgtgatcggcggtagcctggggagctttatggctatgcccagaaacgggtcccggcttgatattgtccacgagaacttgaaaatgggaagcgatggagagtccgaccaggcctctggcaccagcagtgatgaggtgcaatcaccaaccggcgtctgtctccgcaatcgcatccacagaaggatcagcatggaggatctcaataagaggctatccctgccagccgacataaggattcctgacggttacctggaaaagctccagattaattcccctccttttgaccaaccgatgagccgacggtcacgtagagcctag

SEQ ID NO: 55367 - DNA, 267 bp, Artificial Sequence
  Description of Artificial Sequence: Synthetic coding sequence
atgaaaaagttcaagcgcagactgtccctcaccttgagaggatctcagactatcgatgagtccttaagtgagctggcagagcagatgacaatagaagagaattcatctaaagataatgagccaatcgtgaaaaacgggcgacctccgacaagccatagtatgcacagttttctccaccagtataccggcagcttcaagaagcctccactcaggcgaccacatagtgtcatcggtggaagtctgggctcgttcatggccatgccatag

SEQ ID NO: 55368 - DNA, 486 bp, Artificial Sequence
  Description of Artificial Sequence: Synthetic coding sequence
atgaagaagtttaaaagacggctctcactaacccttagaggaagccagaccattgatgaatccctgagcgaattagcagagcaaatgactatcgaggaaaattcaagtaaagataacgaacctatagtcaagaatggtaggcctcccacatctcacagtatgcattccttcctgcaccaatacaccggatccttcaaaaagccaccattaagacggccacactctgttatcggtgggagtctgggcagcttcatggcaatgcccaggaacggtagccggctcgacattgtccacgagaatctgaagatgggctcggacggcgagagtgatcaagcttcagggacctcctctgatgaagtgcaatctccaacaggcgtttgcttgcggaacagaattcacagacgtattagtatggaggacctgaacaagaggttgtcactgcctgctgacataaggattcccgacgggtaccttgagaaactctag

SEQ ID NO: 55369 - DNA, 1425 bp, Artificial Sequence
  Description of Artificial Sequence: Synthetic coding sequence
atgattatgaataaaatgaaaaattttaaaaggaggttttctctttctgtgccccgaactgagacgatcgaagaatccttagccgaattcactgagcagtttaaccagttacataaccggcgaaatgaaaacctccagctgggcccactcggaagagaccctccgcaagaatgttccactttttcacccactgattccggtgaagagcccggtcagctatctcccggagttcaatttcagagaagacagaatcaaagacgcttttcaatggaggacgtctcaaaacgactgagcctgcccatggatatcagacttccacaggagttcctgcagaagctgcagatggagtctccagatctacctaaaccactgagtcgtatgtccagacgggctagtctatctgatatcggttttggaaaactggaaacctacgtaaaacttgacaaactgggtgagggtacttacgccactgtctttaagggtcgttcgaagctcacagagaatttagtggctcttaaagagattcggctagaacatgaagagggggctccctgtaccgccattagggaggtctcattgctcaaaaacctcaaacatgctaacattgtaacgctgcatgacctgattcacaccgaccgctctcttacgttggtcttcgagtacctcgactctgacctgaaacagtaccttgaccactgtggaaatctcatgagtatgcataatgtgaaaatatttatgttccaattgctgcggggattggcttactgtcaccacaggaaaattctccacagggacctgaagccccagaacctcctgatcaacgagcggggagaactgaagcttgccgatttcggtctcgccagagctaaaagcgtgccgaccaaaacctacagcaacgaggtggtcacattatggtaccgtccgccagatgtcctcctcgggtctactgaatactctacccccattgacatgtggggcgtcggctgtatccattacgaaatggccacaggcagacccttattccctgggtccaccgtgaaggaagaattacacctgatcttccggttgctgggcaccccaactgaggagacatggcctggggtcacggcgttttctgagtttcggacatacagcttcccctgctatctgccacagcctctcataaaccacgcaccgcgtttagatactgacgggattcacttgctgtcttctctactactgtacgagtctaaaagtcgtatgtctgcagaagctgccctgagtcattcctattttaggagtctaggtgagagggtgcaccagttagaggataccgcgagtatttttagcctcaaagagatccagctccagaaagatcctgggtatcgtggcctggcatttcagcagcctgggaggggtaagaaccggagacagagcatcttttag

SEQ ID NO: 55370 - DNA, 855 bp, Artificial Sequence
  Description of Artificial Sequence: Synthetic coding sequence
atgatcatgaacaaaatgaaaaattttaaaagacggtttagcttaagcgtgccgcgaacagagaccatcgaggagtccttggctgagttcacggaacagtttaaccagctgcacaatcggaggaatgaaaacctccagttggggccacttggcagggaccctccccaagaatgcagtactttctctccgaccgattcgggagaagaaccgggacagttgtcacccggtgttcagtttcaaaggcgacagaatcaaagaagattttctatggaagttcgcgctagcggagcgctcccccgtcaggttgccggatgcacccacaagggggtccatcgccgtgccgcagcactccagccagatttcgatgtttctaaacggctctcactgccgatggacatccgacttcctcaggagttcttgcagaagctacagatggagtcgcctgatctgcctaagcccctgagtaggatgtccaggcgcgctagcctgtctgatatcgggttcggaaagctcgaaacctatgtcaagctcgacaagctgggagagggcacttatgcgaccgtcttcaaaggcaggtctaaactcactgaaaatttggtggcactgaaggagatacgattagagcatgaggaaggcgctccttgcaccgccatacgggaagtgtcactgcttaaaaacttaaagcacgccaatattgtgacattgcacgatctgatccacaccgataggagcttgacactggttttcgaatatctggatagtgacctcaaacagtacctggatcattgtgggaaccttatgtctatgcacaatgtaaagatcttcatgtttcagctgctcagaggactggcatag

SEQ ID NO: 55371 - DNA, 1425 bp, Artificial Sequence
  Description of Artificial Sequence: Synthetic coding sequence
atgataatgaacaagatgaagaatttcaagcgcagattcagtttgtctgtgcccaggacagaaacaattgaggagtcgcttgctgaattcaccgaacagtttaaccaactgcataaccggcgaaatgaaaacctccagttaggccctctggggagggatcctccacaggagtgctccacgttcagtccaaccgactctggggaagaacctggacaacttagccctggtgtccagtttcaaagacggcagaatcagcggagattcagtatggaggacgtcagcaaacgcctcagcctgcccatggacatccgcctaccccaggaattcctccagaaactgcaaatggagtcccccgatctcccaaagcccttgtcacgtatgagccggcgtgcatcactgtctgacatcggattcggaaagctggaaacctacgtgaagctggacaagttaggtgagggtacatacgccaccgtatttaaaggcaggtcaaagctgactgaaaatctcgttgcattgaaggagattagactggaacatgaagagggcgctccctgcactgccatccgggaagtttccctcttaaagaaccttaaacatgcaaacattgtcacccttcatgacttgattcacaccgataggtcactcacccttgtgttcgaatatctggactctgacttgaaacagtaccttgaccactgtggcaacctgatgagtatgcacaacgtgaagatcttcatgtttcagctgcttaggggcttggcttattgtcaccatagaaaaatcctacacagggaccttaagcctcagaaccttctcataaacgaacgcggtgagctgaaactggccgacttcggattggcgagagcaaaaagcgtgcctactaaaacctattccaatgaggtcgtgacgctctggtacaggcccccagatgtcctgctgggctcaacggaatactctacacccatagatatgtggggggtaggctgcattcattatgaaatggctacaggaaggcccctattccctggttctacagtgaaggaggagctgcatctgatatttcgtctgctcggcacacctacagaggagacttggcctggtgtgaccgctttttctgaattccgcacctactctttcccctgttacttaccacagcccttaattaatcacgcgccaagattggatacagacggaatccacctgctgagttcccttttactgtatgagagcaagtcacgcatgtccgccgaggccgctttatctcatagttactttcgctctctgggcgagagagtacaccagctcgaggacactgctagcatcttctcactcaaggagattcagcttcaaaaggatcccggttatcgaggattggctttccagcagcccggtcgcggaaagaaccgtcgacagagcatcttttag

SEQ ID NO: 55372 - DNA, 474 bp, Artificial Sequence
  Description of Artificial Sequence: Synthetic coding sequence
atgagcatgcacaatgtcaagatcttcatgttccaactactcagaggcctggcctactgtcaccatagaaagatcctgcaccgcgatttgaagccccagaatctcctgatcaacgagagaggcgagttgaagctcgccgacttcgggttagcacgggctaagtctgttcccacaaagacctactccaacgaggttgtgactttgtggtaccgaccccctgacgtactgctgggtagcacagagtattctacccctatcgatatgtggggggtgggctgtattcactatgaaatggcgactggcaggcctctttttccagggagcaccgtgaaagaggagctgcacttgatcttccggttactggggacgcccactgaggagacctggcctggagtcaccgcattttcagagtttagaacatattcttttccatgctacctgccacagcctcttatcaaccatgccccacgttag

SEQ ID NO: 55373 - DNA, 1515 bp, Artificial Sequence
  Description of Artificial Sequence: Synthetic coding sequence
atgatcatgaataaaatgaagaacttcaaaaggagatttagtttatcagttcctcgcaccgaaacaatcgaggaaagcctggcggaattcacagaacagtttaaccagctacacaatcgtcgaaacgaaaacctgcagctaggtcctctcggcagagacccgccacaggagtgctcaactttttcgcctaccgatagcggagaggaacccggtcaattatctcccggagttcagtttcagagaagacagaatcagagacggtttagcatggaggtgcgtgccagtggcgctctgccacgccaggtcgccggatgtacgcacaagggagtccatcgacgggcagctgctctgcaaccagattttgatgtcagcaagcgcctgagtttaccgatggatatacggctacctcaagagttccttcaaaagctgcagatggagagccccgatctacccaaacctctgtctcgcatgtcccgtagggcatccctttcagatattggttttggcaagctggagacgtacgtcaaactcgacaaactcggagaaggaacttacgctacagtcttcaaaggacgctctaagttaacggagaatctagtagccctcaaagagatccggttggagcacgaggagggtgcaccatgcactgctattcgtgaagtgtctcttttgaagaacttgaagcatgcaaatattgtcaccttgcatgatttaatccatacagatcggtcgttgaccctggttttcgaatatcttgacagcgatttaaagcagtatctagatcattgcggtaacttaatgagcatgcataatgtcaaaattttcatgtttcaactgcttcgaggtctcgcctattgccaccaccggaagatcctgcacagagatctgaaaccacagaacttgctaattaacgagagaggagagttgaagctagccgacttcggcctggcgagggccaaatcggtgccaaccaagacatactcgaatgaagtggtgaccttgtggtatcgaccaccagacgtgctcctgggctctaccgagtacagtactcccatagatatgtggggtgtaggatgtatacactatgagatggcaacaggtagacccctcttccccggatccaccgttaaagaagaacttcatctgatctttcgactccttggcacccctaccgaggagacctggcccggagtgacggccttcagcgaattccggacctacagttttccgtgctacctgcctcaacccctaatcaatcacgcacccaggctggatacagatgggatccatttgctcagctcactcctgctgtacgaaagtaaatcacgtatgagcgccgaggcggctctgtcccatagttactttaggtccttaggcgaaagagtgcaccagctcgaggacacagcatccattttttccctgaaagagatccagctgcagaaggacccgggttatagggggcttgcttttcagcagcccggaagaggcaagaatcgcagacagagcattttctag

SEQ ID NO: 55374 - DNA, 1329 bp, Artificial Sequence
  Description of Artificial Sequence: Synthetic coding sequence
atgagcgcatgtagagagatcgccctgttgcgggaactcaagcaccccaatgttatcgccctgcaaaaggtgtttctcagccacagtgataggaaggtgtggctactgttcgactatgccgagcatgatctgtggcacatcatcaaattccatcgggcttccaaagctaacaagaaacctatgcagttgccgcgatctatggtgaagtctctgctgtaccagatcctggacggcatccactacctgcatgctaactgggtgttacaccgcgatctgaagccagccaatattctggtcatgggcgaaggccctgaacggggacgtgtcaagatagcagacatgggtttcgcgaggctgtttaattctcctttgaaaccccttgcagacctggatcctgtggtcgttacattttggtaccgggcacccgagttgctgttgggtgcaaggcactacacaaaggcaattgacatctgggccattggttgcatctttgctgagctgctgacaagtgagcccatttttcactgccgacaggaggacattaagacatccaaccccttccaccatgaccaactggaccgtattttttcagtcatgggctttcccgctgacaaggactgggaggatatacgcaagatgccagagtaccctacactgcagaaggatttcaggcgcactacgtacgccaatagtagtcttataaagtatatggagaaacacaaagtgaagccggactcaaaagtctttctgctgttacagaaactgctgaccatggatcccaccaaaaggattacctccgaacaggccttacaagatccatacttccaagaagatcctctgcccacattggatgtatttgccggatgccagattccctacccaaagcgcgagttcctcaatgaggacgatcctgaggaaaaaggggataaaaaccagcagcagcagcagaaccagcatcagcaacccactgcgccaccgcagcaagccgcagccccaccacaggcacccccaccccagcaaaattcaactcagactaacggaaccgcgggaggcgctggagcaggcgtgggaggaaccggcgcaggcctgcagcactcgcaggacagctctctgaatcaggtgcccccaaataaaaaaccacgcctggggccaagcggcgctaatagcgggggacccgtcatgccttcagactaccagcactcctcctcgcgactcaattaccaatcgtctgtccagggaagcagccaaagccagtcaactcttgggtattcctccagcagccagcagagctcccaatatcacccttcacaccaggctcataggtattag

SEQ ID NO: 55375 - DNA, 1509 bp, Artificial Sequence
  Description of Artificial Sequence: Synthetic coding sequence
atggattacgacttcaaggccaagttggctgctgagcgagaaagagtagaagatctattcgagtatgaagggtgcaaagttggacgcggtacctacgggcacgtgtataaggcacggagaaaagacggtaaggacgagaaggagtatgccctgaagcagattgaaggtacaggtatcagcatgtcagcctgtagagaaattgcccttctgagggagctgaaacatcccaacgtcattgccctccagaaggtattcctgtcccattccgatcgaaaggtatggttactcttcgattatgccgagcatgatctgtggcacattataaagtttcacagggcttcaaaggccaataagaagcctatgcagctccctagatccatggtcaagagccttctgtaccagatcttggacgggatccattatctccacgctaattgggtgttgcaccgcgaccttaaacccgctaatattctggtaatgggagaaggtcctgagcggggaagggtaaaaattgcggacatgggcttcgctcgtctttttaacagccccctaaagccactcgctgatctggatccagtggtggtgaccttctggtacagggcaccagagctactgttgggcgctagacattacacgaaagccatcgacatatgggcaataggttgcatcttcgccgaacttctcaccagcgagcccatatttcactgtcgacaggaggatataaaaactagcaacccttttcaccatgatcagctggatcggattttcagcgtaatgggattccctgcagacaaggattgggaggacatacgcaagatgcccgaatatcccactctccaaaaggacttcaggaggaccacctacgccaacagctctttaatcaaatacatggaaaagcacaaggttaagccagatagtaaggtatttctgttgttgcagaagctgctcaccatggatcctactaagagaatcacttcagagcaggcgctgcaggacccttatttccaagaagaccctctacccactctggacgtttttgcagggtgtcaaattccgtatcccaagagggaatttctcaacgaggatgatcctgaagaaaagggggataaaaaccagcaacagcagcagaaccagcaccagcaacccactgctcctccccagcaagctgcagcaccacctcaggccccacctccccagcagaattctacccagaccaacggaacagccggtggggctggcgctggtgtgggaggaaccggggcaggcctgcagcatagccaggacagttccctaaaccaagtgccacctaataagaagcccagactaggccctagcggtgctaactccggagggccagttatgccaagcgactaccaacacagctcctctcgcttaaactaccagtcaagtgtgcagggctccagccagagccagagcacccttggctattcgtcatcttcgcagcaatctagccagtatcacccctctcatcaggcccaccgatactag

SEQ ID NO: 55376 - DNA, 1326 bp, Artificial Sequence
  Description of Artificial Sequence: Synthetic coding sequence
tcactcacaagaaacattcagctactgcgggagctaaaacaccccaacgtcatagcactccagaaggtgttcttgtcgcacagcgatcggaaagtgtggcttctcttcgattatgcagaacatgatctctggcacattattaaatttcacagagcctccaaagccaataagaagcccatgcagctcccgcgttctatggtgaagagcttactttatcagatattagatgggattcactatctgcacgccaattgggtactccatagagatctgaaaccagcaaatattctggtaatgggagagggtcccgagagagggagggtgaaaatagcagatatggggttcgcccgactctttaattcacctcttaagcctttagccgatttagatccagttgtggtgactttctggtacagggctcccgagttgttgctcggagctagacactatacaaaagcgatcgacatttgggctattggatgcatctttgcagaattgctgacaagtgagccaattttccattgtcgccaggaggatatcaaaacctccaatccatttcatcacgatcagctggatcggatcttttctgttatgggatttccagcagataaagactgggaggatattagaaaaatgcccgagtatcccactctgcagaaggacttcagacggacaacctacgctaattcctcacttataaaatacatggagaagcacaaggtgaagcccgactccaaggtgtttttgctccttcaaaaacttctaacgatggacccaacaaaaagaattacttccgagcaggcgttacaggatccctattttcaggaagaccctttgcctaccctcgacgtgttcgctggttgtcagattccatatccaaagagagagttcctgaatgaagacgatcctgaggagaaaggtgataaaaaccagcagcagcagcagaaccagcatcaacagccaactgctcccccacaacaagccgctgccccaccccaagcaccccctcctcagcaaaacagcactcagactaatggaaccgctggcggagccggagccggtgtgggcggaactggcgcagggttgcagcactcccaggactcttccctgaatcaggtcccacccaacaagaagccacgattgggcccaagcggggctaattccggcggtcccgtcatgccttccgactaccagcatagctcttcccgcctcaattatcagagctcggtgcagggcagcagccagagtcagtccacccttggctattcttcttcaagccaacaatccagtcagtaccacccttctcaccaggcccatagatattag

SEQ ID NO: 55377 - DNA, 1137 bp, Artificial Sequence
  Description of Artificial Sequence: Synthetic coding sequence
atggactttgtcttcaaccctctctggaagtatttgtgtctcttagctgggaagtgtatcgtgttactggttcgccctaagttgaagcctgctaatatcctggtgatgggcgaaggacccgagagaggccgtgttaaaatcgcagatatgggttttgccaggctgtttaatagtcctctgaaacccctggccgacttggacccggtcgtcgtaaccttctggtacagagctcccgagctcctgttgggcgctcgccactacacaaaagcgattgacatatgggctatcggctgcatatttgcagaactgcttacatcggagcctatcttccactgtcgacaggaggacattaaaacctccaaccccttccatcacgaccaactggatcggatcttctctgtcatggggtttcctgccgacaaagactgggaggacattaggaagatgccagagtatcccaccctccagaaggacttccggcgaacgacttacgccaatagcagtctaatcaaatacatggaaaagcataaggtcaaacccgattcaaaagtatttctcctgttgcaaaagttgctcactatggatcctactaagcgcataacaagcgagcaggccctgcaggatccgtattttcaggaagatccccttccaaccctggacgtgttcgccggatgccagatcccatacccaaagagggagttcctgaatgaagatgatcctgaggagaagggcgataagaatcagcagcaacagcaaaaccagcaccaacagcctactgccccaccccaacaggctgctgcgcctcctcaggctccacctccacagcagaatagtacacagaccaacgggacagccggtggggctggcgcaggagtggggggtacgggagccggtctacaacattcgcaggattcatcccttaatcaagtccctcccaataaaaagccccgtctaggccctagtggagcaaactctggcggacccgtgatgcctagcgattaccagcattcatccagccgcttgaattatcagtcatccgtgcaaggaagcagtcagagtcagtccactctgggctacagttcctcaagtcagcaaagtagccagtatcaccctagccaccaggcacatcggtactag

SEQ ID NO: 55378 - DNA, 756 bp, Artificial Sequence
  Description of Artificial Sequence: Synthetic coding sequence
atgtcagcgtgcagggagattgctctgctgcgagagttgaagcaccctaatgtcattgcactacagaaggtatttcttagtcacagtgacaggaaagtgtggttgctctttgactatgcggagcatgatctgtggcatatcattaagttccacagagccagcaaggccaacaagaagcccatgcaactgccacgctctatggtcaaatccctcctataccagatcctggacggcattcactatttgcatgctaactgggtcctccacagagacttaaagccagctaacatcctggtaatgggcgaaggacccgagagaggcagagtaaagatagccgacatgggttttgcgagactgtttaatagccccctgaagcccctggcagacctggaccctgtagtagtgaccttctggtatagagccccagagttgctgctgggtgccagacactatactaaagccatagatatatgggctataggttgtatctttgccgagctgctcacaagcgagccgatatttcactgtcggcaggaggatatcaagacctcaaatccatttcaccacgatcagctcgatcgaattttcagtgtcatggggttcccagccgataaggattgggaggatattcgcaagatgcccgaatatccaaccctacagaaagattttcggagaaccacatacgcgaatagctcactcattaagtatatggaaaagcataaagtgaaacccgatagcaaggtttttttattgtag

SEQ ID NO: 55379 - DNA, 381 bp, Artificial Sequence
  Description of Artificial Sequence: Synthetic coding sequence
atgtcttataagcccattgcccctgcacccagctcaactcctggctcctccacaccagggccaggcacacccgtacccactgggtctgtcccgtctccctccgggtcggtgcctggggcaggagctcccttcagacctctcttcaacgacttcgggccaccatctatgggctatgtccaagcaatgaagcctccaggagcccaggggagccagtccacatacacggatttgttatccgtgatcgaggagatggggaaggagatacgccctacttacgccggatcaaaatcagccatggaacggctgaagaggggaataattcacgcaagggccctagtgagagaatgcttagcagaaacagaacggaatgcgcgtacatag

SEQ ID NO: 55380 - DNA, 1077 bp, Artificial Sequence
  Description of Artificial Sequence: Synthetic coding sequence
atgatggagaaatatgagaagattggcaaaattggggaaggctcatacggtgtggtattcaaatgtaggaatagagacaccggtcagatcgttgccatcaagaaattcctcgagtccgaagatgacccggtgataaagaaaatcgcccttcgcgagatacggatgctaaagcagctgaagcacccaaaccttgtgaacttattagaagtctttagacggaagcgacgattacacttagtgttcgagtactgcgatcacaccgttctgcatgaacttgaccggtatcaacgcggagtgcccgagcatctggtgaaatctataacctggcagaccttgcaggccgtgaacttctgccacaagcacaactgcatccaccgcgatgtgaagccggaaaatatccttatcacaaagcactccgtgataaaactgtgtgactttggcttcgcaaggctgttgaccggcccatcggattattataccgattacgttgctactcgttggtacaggtcaccagaacttttggtgggggacacgcagtacgggccaccagtggatgtctgggccataggctgtgtgttcgctgagctcctctccggcgtgccgctgtggcccggaaagagcgacgtggaccagctctatctgattcggaagacactgggcgatctcatccctcgtcaccaacaggtcttttcaaccaaccagtatttttctggtgtcaagatacctgatcctgaggatatggagccattggagcttaagttccccaatatcagctatcctgccctgggtcttcttaaaggatgcctccatatggacccgactcagcgccttacatgcgaacagctcttgcatcacccatactttgagaatattcgggaaattgaagacctagcaaaggagcacaataagccaacaaggaagacactccggaaaagccgtaagcatcattgcttcaccgagacctccaagctacaatacttgcctcagctcaccggaagctctatacttcctgccctggacaataaaaaatattactgcgacaccaagaaacttaactatcgttttccaaatatctag

SEQ ID NO: 55381 - DNA, 747 bp, Artificial Sequence
  Description of Artificial Sequence: Synthetic coding sequence
atggaggcacccgagggagggggtgggggtcctgctgccaggggaccagagggacagccagcccctgaagcacgcgtacattttcgcgtggctcggttcatcatggaagcgggagtgaagctgggtatgcgaagcatccccatagccactgcctgcacaatctatcacaagtttttttgcgagacaaacctggacgcatatgacccctacctaatcgctatgagcagcatatacctcgccggtaaggtagaagagcagcatctcaggactagagacatcatcaatgtgtctaataggtacttcaacccctccggcgaaccactggaattggatagtagattctgggaattgcgagattccatagtccaatgcgagctcctcatgctgcgcgtgctcagatttcaagtatcttttcagcacccccacaagtacctgttgcactatttggtgtcgctgcaaaactggctaaacaggcacagctggcagcgaacgcccgtggctgttaccgcatgggcactgctgagagactcttaccatggtgctctgtgtctgcggtttcaggctcagcacatagctgtggctgtcctgtatcttgcgttgcaggtgtacggcgtggaggtgcccgcagaagttgaggcagaaaaaccttggtggcaggtctttaacgatgacttaaccaagcccatcatcgataatatcgtatcggatctgatacagatatacacaatggacacagaaatcccttag

SEQ ID NO: 55382 - DNA, 1134 bp, Artificial Sequence
  Description of Artificial Sequence: Synthetic coding sequence
atggagttgagcgtccttctgttcctcgcactcctgactggcctcctgcttcttctcgtgcagcggcaccccaactcccatgggacgcttcccccaggcccacggcctcttcctcttctaggaaacctgctgcagatggaccgcaggggccttctaaagtccttcctgcgattccgggagaaatatggcgatgtgtttacagtccatctgggccctagaccagtggttatgctctgcggcgtcgaggccattagagaagcactggtcgataacgcagaggccttctctggtaggggtaaaattgtgatcatggacccagtctatcaaggttacggcatgctgttcgccaacggcaaccgatggaaggtcctccgcagattttcagttaccactatgagagactttggcatgggtaaacgttcggtggaggaacggatccaggacgaagcccagtgtctgatcgaagaactcagaaagtcaaagggtgctcttgtcgatcccacattcttattccattccataaccgctaacatcatctgctctatcatctttgggaagcgcttccactaccaggaccaagaattcctcaagactctgaatctgttttgccaaagcttcttgctgatatcctcaatctctagtcagttatttgagctgttctctggctttctcaagtattttcctggcgcacataggcaagtgtataaaaacctgcaagagattaacgcatacatcggacactctgttgagaaacatagggagaccttggatcccagcgcgccacgggacttaattgacacgtatctgcttcacatggaaaaagaaaagagcaatccgcacagcgaattttcccaccaaaatctcataattaacaccctttctctatttttcgctggcactgagacaaccagtaccacgctgcgatatggctttcttttgatgttgaagtacccacatgtcgccgaacgtgtttataaggaaatcgagcaggtggtgggtccgcaccgtcctcctgcactcgacgatcgggctaaaatgccttacacagaggccgtcattcgagagatccagcgtttcgcagacctgctccctatgggagtaccccacatagtcacccaacatactagtttctag

SEQ ID NO: 55383 - DNA, 999 bp, Artificial Sequence
  Description of Artificial Sequence: Synthetic coding sequence
atggcattgttgtgttacaaccggggttgcggtcagagattcgaccctgaaaccaactctgacgacgcctgcacataccaccccggtgtgccagtgttccacgatgcgttaaaaggatggtcctgctgtaagcggaggaccacagatttctcagatttcctgagcattgtgggatgtaccaaagggagacataattccgagaagccgccagagcccgtgaagccggaagtcaagacgactgagaagaaggagctgtgcgagcttaagcccaagttccaagagcatatcattcaggcccctaagcccgtcgaggctattaaacggccaagtcccgatgaaccaatgaccaacctggaattaaaaatcagcgcctcgctgaaacaggcactagacaaattgaaacttagctcgggcaacgaagagaacaagaaggaggaggataatgacgaaataaagatcgggacctcttgtaaaaacggtgggtgtagtaagacatatcaaggccttgaatctctagaggaggtttgtgtgtaccatagcggagtccccatctttcacgagggcatgaaatactggtcctgttgcaggcggaaaactagcgatttcaatacattccttgcacaggaaggatgtaccaaggggaagcacatgtggacaaagaaagatgcgggaaaaaaggtcgtaccttgtaggcatgactggcatcagactggcggagaagtgactatcagcgtgtatgcaaaaaattcactgccagagctttctcgagtcgaggccaacagcacactgctgaacgtccacattgtatttgagggtgagaaggagttcgatcaaaacgtcaagctgtggggagtgatcgatgttaaaagaagttatgtcaccatgacagctacgaaaatcgagatcacgatgcgcaaagcagagccaatgcagtgggcatctcttgaactcccggcagctaaaaagcaagaaaaacagaaggatgctacaaccgactag

SEQ ID NO: 55384 - DNA, 942 bp, Artificial Sequence
  Description of Artificial Sequence: Synthetic coding sequence
atggcgctgctttgttacaatcgcggatgtgggcagagattcgacccggagacgaacagtgatgatgcctgcacttaccaccccggtgtgccagtgttccacgacgcgttgaagggctgcactaagggtaggcacaatagcgaaaaaccgcctgagcccgtcaaacccgaagtaaagacaacagaaaagaaggaactttgcgagctgaaacccaaatttcaggaacatattatacaagcacccaaaccagtggaagctattaaacgacccagccctgacgagcctatgactaatctggagctgaagatttccgcttccctgaagcaggcattggataagcttaaactcagtagtgggaacgaagagaacaagaaagaagaggacaatgatgagattaaaatcggaacgagctgcaagaacggtgggtgtagtaagacgtatcaggggctagagtcactggaagaagtgtgcgtgtatcattctggcgtgcccattttccacgagggcatgaagtattggtcatgctgcaggcgtaagacctccgattttaatactttcttggctcaggaggggtgtacaaaagggaaacatatgtggactaaaaaggacgctggcaaaaaggtcgttccctgcagacatgattggcaccagactgggggagaagtcacaatttcggtatacgcgaagaatagtttgccagagctctctcgggttgaggctaactcaacactcttaaatgtccatattgtattcgagggggagaaggagtttgaccaaaacgttaagctgtggggagtgatcgacgtgaaacggtcctatgtaacaatgactgctacgaagatcgagataacaatgagaaaagcagaacctatgcagtgggccagcctcgagttgcctgccgctaagaaacaggagaagcaaaaagatgccaccacagactag

SEQ ID NO: 55385 - DNA, 1563 bp, Artificial Sequence
  Description of Artificial Sequence: Synthetic coding sequence
atgtctataccactgaagtcgtcattcctgctgtcctacctgtgcactctgccccctgccttactgtcacgagaaatcctgatggcagacagtgaggcactcccgtcccttgccggagatcccgtggccgttgaggccctcttgcgggctgtcttcggcgttgtggtggacgaagccattcagaaggggacctcagtatcccaaaaggtctgtgagtggaaagaaccagaagaactgaagcaactcctggatctggagctccggtctcagggcgaaagccagaagcagattctggagcgatgtagggccgtcatcagatacagtgtgaagaccggccacccaaggttttttaaccagctgttttcagggttagatccacacgctctggcgggtagaatcattacagaatcacttaatacatctcagtacacttatgagatcgcaccagtatttgtgctgatggaggaggaagtgctgaggaaactgagggcactggtcggctggagcagcggcgacgggattttctgccccggtggcagcatttcaaatatgtatgcagtgaatctcgcccgataccaaaggtaccccgactgcaagcaacgtggccttaggactctgcctcccctggccctgttcacaagtaaggagtgtcattattcgattcaaaagggagcggcttttctggggctcgggacagattcagtgagggtcgtcaaggcagacgagagagggaagatggtcccagaggacctcgagcgacaaattggaatggccgaagcggagggagccgttcctttcctggttagcgcaacctcgggtacaactgtgctaggcgcattcgatccactggaagcaattgccgatgtgtgccagagacatgggctgtggctccacgtggacgctgcctgggggggttctgttcttctgagccaaacacataggcacctgttagatggaatccagcgagctgactctgtcgcttggaacccacacaagctattggctgccggactgcagtgctccgcattactgcttcaggataccagtaacttgttgaagagatgtcacggtagccaggcgtcctacctgtttcaacaggacaagttttatgacgttgctctcgacaccggtgacaaggttgtgcagtgcggcaggagagtagactgcttgaagctctggctgatgtggaaagctcagggcgatcagggacttgaaagacggatcgaccaggcctttgtgctggctaggtatctggtggaggaaatgaagaaaagggagggatttgagctcgtgatggagccggaattcgtgaacgtttgcttctggttcgtgcccccaagcctgcgcggaaaacaagaatcccctgactatcacgaaaggttatcaaaggtggcaccagttctgaaggagcgcatggtgaaggagggttcaatgatgatcggataccaacctcatggaactcggggaaacttctttcgggttgtggtggccaacagcgctctaacctgcgctgatatggattttctgctgaacgaattagaaaggttgggccaggatctctag

SEQ ID NO: 55386 - DNA, 1749 bp, Artificial Sequence
  Description of Artificial Sequence: Synthetic coding sequence
cacggtttaagggcgacagaggcgctgccttctgtgcggacaacgctcaggagtctcgggctcgccccaacctgccaggccagacctcctgccggaagcttagccgctcgcaggctgctccaggcccctgcgcacccagctaatcctacagccgcagccgctccaacgggcactgaggccacctcacaaatgtgggccacgcatagcggcagaccaagatcatatctatgtacattaccgcctgctctgctttcaagagagatcctgatggcggattctgaggcgctgccttctctggcgggtgaccccgttgccgtcgaggcactcttgagggctgtgttcggggtcgtggtggacgaagcgatacagaaagggacgagcgtgtctcagaaggtttgcgaatggaaagagcctgaagagctcaaacagcttttggacctggaactcaggtcgcagggagaatcccagaagcagatccttgaacggtgccgcgctgttatcaggtactctgtaaaaactggacacccacgctttttcaatcagttgtttagtggtctagacccacacgccctggcaggtcggatcataactgaatctctaaacactagtcagtacacctacgagattgctcccgtatttgtacttatggaggaggaagtcctgcggaaacttagagcgcttgttggttggtcctctggtgatggtatcttttgtcccggaggatccatatcaaatatgtacgctgtcaacctggcccgatatcagcggtacccagactgtaagcagcggggtcttaggactctcccgccattggctttattcacctccaaagagtgccactattccatccaaaagggggctgcattcctgggcctaggaaccgactctgtccgcgtggttaaagctgatgagcgcggtaaaatggttcccgaagatcttgaaaggcaaatcggcatggctgaggcagagggggcagtgccattcctcgtcagtgctaccagcgggacaaccgtgctgggggcattcgatcccctggaagccattgccgacgtctgtcaacgtcacggtctgtggctgcatgtcgatgcagcgtggggtggcagcgtcttactttcccagactcacaggcatctcctggatggtatacagcgcgctgacagcgtggcatggaatccccacaaactactcgcggctggcttacaatgttctgccttgctcctgcaagacacgagtaaccttttgaagagatgtcatggaagccaggcctcttatctctttcagcaagacaagttttatgatgttgcgctggatacaggagacaaggtagtgcagtgtggacgcagagtggactgtctgaagctgtggttaatgtggaaggctcagggtgaccagggtttggaacgcagaattgatcaagcatttgtgctcgctaggtatttggtggaggagatgaaaaagcgtgaaggtttcgaactagtaatggagcctgaattcgtgaatgtgtgcttctggtttgttcctccaagcttaaggggaaaacaggaatcccccgattaccacgagcgcctttctaaagtggcccctgttctcaaggaacgaatggtcaaggaagggtccatgatgatcggctatcagcctcacggtacacgtggcaatttttttcgggtggttgtcgcaaattccgcactcacttgcgccgacatggattttctgttgaatgaacttgaacgcctcggacaggacttgtag

SEQ ID NO: 55387 - DNA, 1041 bp, Artificial Sequence
  Description of Artificial Sequence: Synthetic coding sequence
atggctgactctgaagctcttcccagtctggccggtgatcccgtcgctgttgaggcacttctgagagccgtattcggagttgtggtggacgaagcaatccagaaagggacatctgtgtctcaaaagtgccactatagtattcagaagggtgcagcttttctggggctgggaacagattccgtccgggtcgtgaaagctgacgagagaggtaaaatggtccccgaagacctggagagacaaattgggatggcagaagccgagggagcagtgccctttctggtgtccgctacctccgggaccaccgtactaggtgctttcgaccccctcgaagctatcgcggatgtctgtcagcgtcacggactgtggctgcatgtggacgcagcttggggaggtagtgtgctcctttcccaaacacatagacacttgctggatggaattcagcgggcagatagcgttgcatggaatcctcataagctgctcgcagccggactccagtgtagtgcactactgctccaggatacctctaacctacttaaaaggtgccatgggagtcaggcctcgtatttgtttcaacaggacaaattttacgacgttgcattggatacaggagataaagtggtgcagtgcggcaggagggtggactgcttaaaactctggctgatgtggaaggcacagggggatcagggtctcgagcgcaggatagatcaggccttcgtgctagctaggtacttggtggaggagatgaagaagcgggaggggtttgaactggtaatggaacctgagtttgttaacgtgtgtttttggtttgtacctccttctcttaggggcaagcaggaaagcccagactatcacgaaagactttcgaaagtggccccagttttgaaagagcgaatggtcaaggaaggctctatgatgatcggataccagccacacgggaccagagggaacttttttcgagtggtggtcgccaactccgcgctcacttgcgctgacatggatttcttgttgaacgagctagagagattgggacaggacctgtag

SEQ ID NO: 55388 - DNA, 1041 bp, Artificial Sequence
  Description of Artificial Sequence: Synthetic coding sequence
atggcggacagcgaagccctgccctctctggctggggaccctgttgcagtggaggctctcttgagggcggtgtttggagtggtggtcgatgaagctatccagaaaggcacctctgtaagtcagaaatgccactattctatccaaaagggggcagctttcctcgggctgggtacagatagtgtcagggtggtgaaagccgatgagcgcggtaagatggtgcccgaggatctcgagaggcagatcggcatggcagaagcagagggcgctgtacctttcctggtaagtgcaacgtccggcacgaccgtgctcggtgcctttgatccactggaggccatcgccgacgtatgtcagagacatgggctctggctgcatgtggacgcggcatggggcggttcagttttgctgagccagacgcatagacacctcttggacggcatccagagagctgacagtgtagcctggaacccgcacaagctcctggccgcaggacttcagtgctccgcacttctgctgcaggatacctcgaatctcttaaagaggtgccacggctcacaggcgtcctatctcttccagcaggataaattctacgacgtcgctctcgatacgggagataaagtagtgcaatgcgggagaagggtcgactgtctaaagttgtggctgatgtggaaggcccaaggcgatcaaggccttgaaaggcggatagaccaggctttcgttctcgctcgataccttgtggaggaaatgaagaaaagagaaggctttgagctcgtcatggagcctgagttcgttaatgtgtgcttctggttcgtgccacctagcctccgcggtaagcaggagtcccctgattatcacgagcggttgtctaaggtcgctcccgtgttaaaggaacggatggtaaaggaaggctcgatgatgatcggataccaaccacacgggacccgagggaacttcttccgagttgtggtggcaaactcagccctgacttgcgcagacatggatttccttttaaatgaactggagagattgggccaagacctctag

SEQ ID NO: 55389 - DNA, 1365 bp, Artificial Sequence
  Description of Artificial Sequence: Synthetic coding sequence
atggcagattcagaagcgttgcccagcctggccggagacccagtcgccgttgaggcgctgttacgtgccgtgtttggagtggtggttgatgaggccattcagaaaggaacttctgtttcccagaaggtttgcgagtggaaggagccggaggagcttaagcagctcctggatctcgagctgcgctctcagggggaatctcaaaagcagatcctagaaaggtgcagggcagtcatcaggtattcagttaagacagggcaccccaggttctttaatcaattattttctggcttggatccccatgctctggccggacgaattataaccgaatccctgaatacctctcagtacacctacgagattgcaccggttttcgtcctcatggaggaagaagtgctgcgaaagctgagggctctcgtggggtggtcatctggcgacggaattagtgccctctgccactactcaatacaaaagggagcagctttcctgggattggggaccgatagtgtgcgagttgtaaaagccgacgaaaggggcaagatggtgcctgaggacctggagaggcagatcggcatggctgaggctgagggggctgtcccgttcctggtgtctgcaactagcgggaccaccgtgctcggagcctttgatcccctggaggctatcgccgatgtatgtcagaggcacggactttggctgcacgtcgacgcggcttgggggggtagcgtcctcctgtcccagacccaccggcacctgttagatggcatccagagagccgacagcgtcgcctggaaccctcacaagctcctcgccgcaggactgcagtgctccgctttgcttctgcaagacacttccaatctgctgaagagatgtcacggatcccaggccagctacctgttccagcaggacaaattttatgacgtggcccttgacacaggagacaaagtggtccaatgcgggagaagagttgattgcctaaaactttggttaatgtggaaggcccagggtgaccagggactggagcggagaattgatcaagcattcgtgctggcgaggtatctggtggaagagatgaaaaaaagagaagggtttgaattggtcatggaaccagagttcgtgaacgtttgcttttggtttgtacccccttctcttagaggtaaacaggaatccccagattatcatgaaaggctgagtaaagttgcacctgtgctcaaggagcgaatggttaaggagggatctatgatgatcggttaccagcctcacggaacacgcggaaatttctttagagttgtggtagccaatagtgcccttacttgcgccgacatggattttctcctgaacgagctggaaaggctggggcaggatctctag

SEQ ID NO: 55390 - DNA, 1482 bp, Artificial Sequence
  Description of Artificial Sequence: Synthetic coding sequence
atggccgacagcgaggctctgccgagtctagctggggaccctgtggccgtggaagctctacttagggcagtgtttggcgtggtcgtggatgaagctatacaaaaagggacctctgtatcacaaaaggtgtgcgaatggaaggaacccgaggaattaaagcaactgctggatctggaacttaggagtcagggcgaatcccagaagcaaattttagaaaggtgtagggcggtcatccgctatagcgttaagaccggtcatcctaggttcttcaaccagctgttttctgggctcgacccacacgctctggctgggcgaatcatcaccgagagtctcaatacaagtcaatacacatatgagatcgcccctgtttttgtactcatggaggaagaggtgctgcgaaagctgcgcgctctcgtggggtggtcttcaggcgacgggatattctgccctggaggcagcatcagcaatatgtacgcggtgaacctggcacgctatcagaggtaccctgattgtaaacagaggggcctgaggaccctgcccccactcgctctattcacttcaaaagagtgccactattcaatacagaaaggcgcagcatttctggggctagggactgattccgtgagggtggtcaaggcagacgagcgaggaaagatggtccccgaggacctggaaagacagattggcatggctgaggctgaaggggcagtcccctttctagtctccgccaccagcggcacgacggtgctaggagcttttgacccactagaagcgatcgccgacgtctgtcaacgtcacggtttgtggcttcatgtagacgcggcatggggcggaagcgtgctcttgtcccagacacaccgccacctgttggacgggatccagcgtgcagattcagtggcatggaatccccacaaactactagccgctggcctccagtgctctgcgctgttgctacaggacactagtaatctgcttaagagatgtcacggatcgcaggcgtcatacctctttcaacaggataaattctacgacgtggcactagacacgggggacaaagtggtccagtgtgggcgtagagtggactgtcttaagctttggctgatgtggaaggcccaaggggaccaaggcctggagcgcaggatagatcaggccttcgttctcgctcggtacctggtagaggaaatgaagaagcgggagggcttcgagctggtgatggagccagagtttgtgaacgtgtgcttttggttcgttccacctagtctgaggggcaagcaggaatcacctgattaccacgaacggctctccaaggttgcacccgtcctgaaggagagaatggtcaaggaggggagcatgatgatcggataccagccccacggcacaagaggcaacttctttcgcgtggtggtggcgaacagcgctctaacttgcgcggacatggatttcctgctgaatgagctggagcggttgggccaagatctgtag

SEQ ID NO: 55391 - DNA, 459 bp, Artificial Sequence
  Description of Artificial Sequence: Synthetic coding sequence
atggctgactcagaggccctgccaagtctggccggagatcctgtcgcagtggaggctctgctgagggctgtgttcggcgtcgtggtggacgaggcgattcaaaagggcacaagcgtcagccaaaaggtgtgtgaatggaaggagccagaggagttaaagcaactcctggacctggagctgaggtcacagggagaaagtcagaaacagattttggaaagatgccgcgctgtgatccgctattctgtgaaaactggacaccccagattcttcaatcagctgttctccggcctagatccgcacgcactggcgggtcgcataattactgagtcgctcaatacatctcaatacacgtatgagatagcgccagtttttgtcttgatggaagaggaggttctccgaaagctgcgagccctggtgggctggagttcaggcgacggaatcttctgccccggattgtag

SEQ ID NO: 55392 - DNA, 804 bp, Artificial Sequence
  Description of Artificial Sequence: Synthetic coding sequence
atggctgatagcgaagccctcccgagtctggccggagacccagtcgccgtagaagcactgttgagggccgtatttggggttgtcgtcgacgaggcgattcagaaaggtacttccgtctctcagaaggtgtgtgagtggaaggaacccgaggagcttaaacagcttctggatttggagcttcgttcacagggggagtcccagaaacagatcctagaacgctgtcgggctgtgatccgctattccgttaagacaggtcaccctcgcttcttcaatcagctgttctccggtctggatcctcacgccctggctggtcgcattattacagaatcgctgaatacatcccaatatacttacgagatcgcccctgtattcgtgctaatggaggaggaagtgttgaggaagctcagagccttggtgggctggtctagcggagatggcatcttctgccccggagggtctatttcaaatatgtatgccgtgaatctcgccaggtatcagcgctatcccgactgtaaacaaagggggcttcgcactttgcctcctctcgcattgtttacttctaaagaggttgggaaaaggcatcgtccgaaccccggactcctgattctaataagcagccacgtgactactccctcccgcagagagctgcggttctgggatctcgctcccaccgttagcgaatggtccagacttatgagagagggtaagtggagtccacgaatctggaggggcaggctggtctggcccagactgagagtactctgtcgatcgtggagcgtcccacctctggcccctctttgttag

SEQ ID NO: 55393 - DNA, 300 bp, Artificial Sequence
  Description of Artificial Sequence: Synthetic coding sequence
atgtcgtcccagcaaagtgccgtttctgccaagggcttttccaaaggttctagccagggacctgcaccatgtcccgcaccagctcctacccccgctcctgcctccagttcttcatgctgcggtagcggcagggggtgctgtggagattctggctgttgcgggtcgagttctacctcctgttgttgcttccccaggagaagacgcagacagcgttctagtgggtgctgttgttgcggaggaggcagtcagagaagccaacgtagcaataatcgctcatccggatgctgcagtgggtgctag

SEQ ID NO: 55394 - DNA, 372 bp, Artificial Sequence
  Description of Artificial Sequence: Synthetic coding sequence
atggcaagccacgtggagtgtcgacccttgggcgtgtttgaatgcgaactgtgcaccctgacagctccgtatagttacgtaggccaaaagcccccaaacacacagagtatggtcctcctcgaagaatcctacgtaatgaaagaccctttcacaagcgacaaagatcgtttcctggtcctgggttcctgttgtagcctctgtagccgccttgtgtgtgtggggccagaatgttccctgttttactcaaaacgcttctgcctcccctgtgttagggagaatatcaacgcattcccgcaggaaatccgtcaagacctggagaaaagaaaggctccaagcaaaaggacaccttcccagccgggatctcgcacctag

SEQ ID NO: 55395 - DNA, 1545 bp, Artificial Sequence
  Description of Artificial Sequence: Synthetic coding sequence
atgaaagaagctggccagatgcagaacctagaatccgcgagggccggaaggagcgtgtcaacccagactggtagcatgacaggtcagatcccgcgtctgtccaaggtcaatctgttcacactgctatcactgtggatggagctgttccccgctgaggctcagagacagaagagtcagaagaacgaggaggggaagcatggccctttgggcgacaatgaagagcgaacaagagtttccaccgacaagcgtcaggtgaaacggacagggttggtggttgtaaagaatatgaaaatagtggggctgcactgtagcagcgaggacctacatgccggacaaatagctctaatcaagcacggatctagactcaaaaactgtgatttgtatttctcacgtaagccgtgctccgcatgccttaaaatgattgtgaacgcaggggtcaacagaatttcttattggcccgctgacccagagatcagtcttctgaccgaggctagtagttcggaggacgcaaaactggacgctaaagcagtcgaaaggctgaagagcaactcccgggcacacgtttgcgtcctcttgcagccattagtctgctatatggtccagtttgttgaggagaccagctacaaatgcgattttatccagaaaattaccaaaactctgcctgacgccaacaccgacttctattacgaatgtaaacaggagaggatcaaggagtacgagatgctgttccttgtcagcaatgaggagatgcataagcagattctgatgaccatcggattagagaatctgtgcgagaacccctatttttctaacctgcgtcaaaacatgaaagacctgattcttctactcgccacagttgcatcctctgtaccaaacttcaaacacttcgggttctacaggtcgaatcccgagcagatcaatgagattcataaccagagcctgcctcaggaaatcgcgagacattgtatggtgcaggccaggttgctggcctaccgcaccgaagatcataaaacaggtgtgggggctgttatatgggccgaagggaagtctaggagctgcgacggcaccggggctatgtatttcgtcggatgcgggtataatgcctttcccgtggggagtgagtatgccgactttccccacatggatgataagcagaaagaccgggaaatccggaaatttcgctatataatccatgcagagcagaatgccttgacctttaggtgtcaggaaatcaagccagaagaacgatctatgatatttgttacaaaatgtccctgcgatgagtgcgtgcccttgattaagggcgctgggatcaagcagatttacgcgggagatgtggatgtaggcaagaagaaggcggacatatcctacatgaggtttggcgagttggagggtgtttctaagttcacgtggcagcttaatccatccggtgcatacggcctggagcagaacgagcccgaaaggagggagaacggcgttctgcggccagtgcctcagaaggaggagcaacatcaggacaagaagcttcgcctcgggatccattag

SEQ ID NO: 55396 - DNA, 951 bp, Artificial Sequence
  Description of Artificial Sequence: Synthetic coding sequence
atggtgcaattcgtggaagagacttcatacaagtgcgacttcattcagaagattaccaaaacactgccagatgctaacacggacttttactacgagtgcaagcaggaaaggatcaaggaatatgagatgcttttcctggtctcaaacgaagagatgcacaagcaaatactgatgacgatcggcctggaaaacctatgtgaaaacccatacttcagcaacttgcgacagaacatgaaagatctgatcttactgctggccaccgttgcaagctcggttcctaatttcaaacactttggcttctacagaagcaatcctgaacagataaacgaaattcacaatcaaagcttaccccaggagattgccagacactgtatggtacaggcacggctgcttgcataccgtacggaggatcacaaaacaggggtgggcgcagtcatttgggcagagggaaagtctcgatcctgcgatggtacaggtgccatgtatttcgttggctgtggttacaatgcatttcctgtgggaagcgagtatgccgatttcccccacatggacgacaagcagaaggatcgggaaattcgtaagttcaggtacatcattcacgcggaacaaaatgctcttaccttccgatgccaggagatcaagcccgaagaaagatcaatgatctttgtaaccaagtgcccatgcgacgagtgtgtgcctctcatcaagggtgcagggataaaacagatatacgccggagatgttgatgtggggaagaagaaagccgacattagttacatgaggttcggagagttggagggcgtgtctaaatttacatggcaactgaaccctagtggtgcctatggcctcgagcagaatgagcctgagcggagggagaacggtgtgttacggccagtgcctcaaaaggaggagcagcaccaggacaagaagctgcgactcggcatacactag

SEQ ID NO: 55397 - DNA, 462 bp, Artificial Sequence
  Description of Artificial Sequence: Synthetic coding sequence
atgaaagaggcgggtcagatgcaaaatctggagagtgcccgtgcaggaagaagtgttagcactcagacaggaagtatgacgggccagattcctcgcctttctaaggttaatctttttactttgctgtcactgtggatggaactctttccagccgaggctcagcggcaaaagtcccagaaaaatgaggaaggtaaacacggccctttaggcgataatgaggagagaacccgcgtcagtaccgataaaagacaggtaaagcggaccggacttgtcgtggtgaaaaatatgaaaatcgtggggctgcattgtagctcagaggatctgcacgcgggacaaattgccctcataaagcatgggagccgcctgaaaaactgcgacctctatttttccagaaaaccctgcagcgcctgcctgaagatgattgtgaatggattactcgaggctgctaagatgccaaggtag

SEQ ID NO: 55398 - DNA, 1506 bp, Artificial Sequence
  Description of Artificial Sequence: Synthetic coding sequence
atggacgagaataacggacttcttctgctggagctgaatcctccgaacccatgggacctgcaacccaggagcccagaagagctcgccttcggagaggtgcagataacttatctaactcacgcttgtatggacctgaaactcggggataagcggatggtgttcgacccgtggctcatcggaccagcatttgctcggggttggtggctgctccacgagcccccttctgattggctagagcgcctatgccaggcagacctcatatacatctctcacctgcacagcgatcatctgagctaccccacactgaagaagctggctggacgtaggccagacatacccatctacgttggcaacaccgagcgccctgtattttggaatctaaaccagagcggtgtgcagctgactaatataaacgtcgtaccattcggaatctggcaacaagttgataaaaatttgagatttatgatactaatggacggagtccatcccgaaatggacacctgcatcatagtggaatacaagggccacaaaattttaaacatcgtcgactgcacccgacccaacggaggacgcctgcccatgaaagttgctttgatgatgtccgatttcgccggaggtgccagcgggttccctatgactttttctggagggaaattcactgaggaatggaaagcccagtttatcaaaacagaaaggaagaagctcctgaactacaaggcgaggttggtaaagaacctacagcccaggatttactgcccgttcgccggatactttgtcgaatcccacccaagtgataagtacattaaagagacaaacacaaaaaatgacccgaacgagctaaataacctgatcaaaaagaacagcgacgtgatcacctggactccacggccaggagccaccctggacctgggtagaatgcttaaagaccgcaccgacagcaaggggattattgagccccctgaaggcaccaaaatctataaggattcatgggacttcgagccctacctagagatcctcaacgcagcattgggtgacgaaatttttctgcattcatcttggatcaaagagtattttacctgggcgggtttcaaagactacaatttagttgtgaggatgattgaaacagacgaggatttcaatccctttccaggagggtacgactatctcgtggattttctcgatctttccttccctaaagagaggccacagagagaacacccctacgaggagattcattcacgcgtggatgtgatccgccacgttgtgaaaaacggtctcctgtgggatgagctgtatatcggcttccaaacacgtctccagcgtgatcccgatatatatcaccacctattctggaatcatttccagatcaaactgcccttgactccacccaattggaagagtttcctgatgtgttgtgagcaaaatggtcccgtgattttgcaattctcaactgaacgtactaacgaaccaaacaggaacaaattctcagtcgaaaacaaagcttag

SEQ ID NO: 55399 - DNA, 1461 bp, Artificial Sequence
  Description of Artificial Sequence: Synthetic coding sequence
atggacgaaaataacggtctcctgctgctggagttgaacccgcctaacccgtgggacctccagcccaggtctccagaggaattagctttcggagaagtgcagataacttacctcactcatgcatgtatggatttaaagctgggcgataagcgcatggtgtttgacccttggctaatcggtccagcctttgctaggggatggtggctccttcatgagccgccaagtgactggctcgagaggctgtgccaggctgacttgatctacatctcacatttgcatagtgaccatctgagctatccaactctcaagaagctggccggtcgacgcccagatatcccaatctacgtgggtaatactgaaagaccagttttctggaacctcaaccagtctggggtccagttaactaatatcaatgtcgtccccttcggcatttggcaacaggttgacaaaaacctgaggttcatgatcctcatggatggcgtccatcccgaaatggatacctgtattattgttgagtataaggggcacaagattcttaatatcgtggactgtacaagaccaaacgggggtcgcctccccatgaaggtggccctgatgatgtcagactttgcgggaggcgctagcggattccccatgacattctctgggggtaagttcacggaagaatggaaggctcagttcatcaaaaccgagaggaagaagcttttgaactacaaggcacgcctcgtaaagaacctccaaccaagaatttattgcccgtttgcagggtacttcgtggagtcccatccgtctgacaagtacatcaaagaaaccaacaccaaaaacgacccgaacgagcttaataaccttattaaaaaaaacagcgatgtgatcacctggacgccccgaccaggcgcaaccctggacttaggcaggatgctcaaggatcggacggattctaagggcatcatagagccacctgagggaacaaaaatttataaggactcttgggatttcgagccctacttagaaattctgaatgcagctctcggagacgagattttcctccactcttcctggattaaagagtatttcacttgggccggttttaaggattacaacctagttgtgcgtatgattgagactgacgaagactttaaccctttccctggcggatatgattatttggtcgacttccttgacctgtcattcccaaaagagaggcctcaacgagaacacccatacgaggagatacatagccgcgtcgacgtgatccgacacgtggtcaaaaacggactgctgtgggacgagctgtatattggctttcagacccggctgcagagggatcctgacatataccaccatctgttctggaaccatttccagataaaacttccactcactccgcctaactggaaatcattcctgatgtgctgtgaacagaatggtccagtgatcctacaggaatgtaagacgacgtag

SEQ ID NO: 55400 - DNA, 663 bp, Artificial Sequence
  Description of Artificial Sequence: Synthetic coding sequence
atggatgagaataatggcctgctcctgctcgagttgaacccaccgaacccttgggatctgcagccccgtagcccagaagaactggcgttcggcgaagtccagatcacgtatctgacacacgcttgcatggacttgaaactgggtgataagcgcatggtctttgacccatggcttattgggccagcgtttgctcgtggctggtggctgttgcatgagcctcccagtgattggcttgagcggctgtgccaggcagacctgatttatatttcacacctgcactccgatcacttaagctaccccactcttaagaaactggcaggacgcagaccagacatacctatctacgtcggtaacaccgagagacccgttttctggaacctcaaccaaagtggggtacagctcaccaatatcaacgttgtgccgttcggtatctggcagcaggtagacaagaatctgcgctttatgatccttatggacggcgtacaccccgaaatggacacttgtataatcgtggaatataaaggccataagatcctgaatattgtcgactgcacacgtcctaacggtgggagactgcccatgaaagtcgccctcatgatgtccgactttgccggaggggcaagcggttttcctatgacattctccggtgggaagtttacttag

SEQ ID NO: 55401 - DNA, 681 bp, Artificial Sequence
  Description of Artificial Sequence: Synthetic coding sequence
atggatgagaacaatggtctgctcctgcttgagctgaatccccctaacccttgggacctccaacctcggtctccagaggagctcgcgttcggcgaggtgcagataacctatctgacacatgcttgtatggacctgaagctcggtgacaagaggatggtattcgatccatggctcatcggtcccgcttttgctcggggttggtggctgttgcacgagccaccgagcgattggcttgagcgactctgtcaagccgacctcatttacattagtcacctgcactcggaccacctgtcttacccaactctgaagaaattagcagggaggaggccagacatacctatctacgtgggtaatacagagcgccctgtgttctggaacctcaatcagagcggtgttcaactgactaatatcaatgtagtgcccttcgggatttggcagcaggttgacaaaaacctgaggttcatgatcctgatggacggcgtccaccctgagatggacacatgcatcattgttgagtacaagggtcacaagatcttgaatatcgtcgattgtaccagaccaaatggcggaagattgccaatgaaggtcgctcttatgatgtccgactttgcgggtggggcatccgggtttcccatgaccttttcaggcggaaagttcacagccgaagagactctgatctag

SEQ ID NO: 55402 - DNA, 1506 bp, Artificial Sequence
  Description of Artificial Sequence: Synthetic coding sequence
atggacgagaacaatggccttctcctgctggaattaaatcccccaaacccctgggacctccagccaagatctcccgaagaactcgcttttggggaggtccaaattacctacctcacgcacgcctgcatggatctcaagctgggcgataaaagaatggtgtttgacccctggctgatcgggcctgcatttgcaaggggctggtggctgctgcacgagcccccatccgattggctcgagagactgtgccaggcagatctgatatacatttcccacttacattctgaccatctttcgtacccgaccctgaagaagctggcaggccgacgccctgacatcccaatctacgttgggaacaccgagcgtcctgttttctggaatttaaaccagagcggggtgcaactgacaaacatcaacgtcgtaccttttggaatctggcaacaggttgacaagaatcttaggttcatgattctcatggatggagttcaccctgagatggatacgtgcattatcgtggagtacaagggccacaaaatcctgaatatcgtcgactgcacaaggcctaacgggggtagactgccaatgaaggtcgcccttatgatgtccgacttcgccggaggggcaagtgggtttcccatgacctttagtggcggaaagttcactgaggagtggaaggcccagtttattaagacagagaggaaaaagcttctaaactacaaagccagactggttaagaatctccagcctcgaatctattgccccttcgcaggctattttgtggaatcgcatccctccgataaatacatcaaggagacgaatacaaaaaatgatccaaatgagttaaataacctaataaaaaagaactctgatgtgatcacttggacgccgagacccggagccacgttggacctggggagaatgctaaaggaccgaaccgacagcaaagggattatcgagccccctgaagggacaaagatatacaaggacagttgggacttcgagccctacctggagattctgaatgccgcactaggagacgagattttcctgcatagcagctggattaaggagtatttcacatgggccggatttaaggattataatctggtggtgcgaatgattgagaccgatgaggacttcaacccttttccaggtggatatgattatctcgtggatttcttggatttgagcttccccaaagagcgtccccagcgagagcacccgtacgaggaaatacatagtcgagtggacgtgataagacatgtggtaaaaaatggactcctgtgggacgaactttacatcgggtttcagacacggctgcagcgcgatccagacatctaccatcacctgttctggaatcactttcagattaaactgcccctcaccccacctaattggaagtccttcctgatgtgctgtgaacaaaatggacccgtcatcttgcagttttcaaccgagcggacaaacgagcccaatcgaaacaagttttcagtggagaacaaggcctag

SEQ ID NO: 55403 - DNA, 522 bp, Artificial Sequence
  Description of Artificial Sequence: Synthetic coding sequence
atggatgagaacaacgggttgcttctcctagaattgaacccacctaatccatgggacctgcagccaagaagccccgaagagcttgcctttggagaggttcagatcacatacttaacccatgcatgcatggacctcaagctgggggacaaaaggatggtgttcgacccctggctgatcgggccagccttcgcccgaggttggtggctactgcatgagccacccagcgactggctggagagattgtgtcaggccgacctcatctatatcagtcacttacacagcgatcacctgtcctatcctaccctgaaaaaactggccggacgcaggccggatattcccatatatgtcgggaatacagaaaggccagtgttttggaacctaaaccaaagcggggtccaacttaccaatatcaacgtggtacctttcgggatctggcaacaggttgacaagaacttgcggttcatgattttgatggatggggtgcacccagaaatggacacatgcataatcgtcgagtactag

SEQ ID NO: 55404 - DNA, 687 bp, Artificial Sequence
  Description of Artificial Sequence: Synthetic coding sequence
atgcccaggcggggtcttgtcgccggacctgatctcgagtatttccagaggcggtattttacacccgctgaagtggctcagcacaatcgccctgaagacctgtgggtatcctatctggggagggtgtatgacttaacatctctcgcccaagagtataaaggaaacttactgctgaagcccatcgtggaagtggccggtcaggacatcagccactggttcgatccaaagacacgcgatattagaaaacacattgacccactgacgggatgcctgcggtactgtacaccgagagggcgatttgtgcacgtgcccccacaactgccttgttctgattgggctaatgattttggcaagccatggtggcagggcagctactacgaggtgggaaggctaagcgctaagacgagatcaatccggattattaacaccctgaccagtcaagagcacacgcttgaagtgggcgtgctcgagtcaatttgggaaatactccaccggtacttaccttacaactcacatgccgctagctacacttggaagtacgagggaaagaacctgaatatggattttactctggaagagaatggaatcagggacgaggaagaagaattcgactatctctcaatggacgggacactgcacaccccagctatcctcctttacttcaatgacgacttaactgagctgtag

SEQ ID NO: 55405 - DNA, 474 bp, Artificial Sequence
  Description of Artificial Sequence: Synthetic coding sequence
atgccccgaagagggttagtcgccggaccagacttggagtacttccagcggaggtacttcacgcccgctgaggtagcccagcataatagacctgaagatctttgggtttcttatctggggagggtttatgatcttacatccctggcccaggagtacaaaggaaatctgctgctcaagcctatcgtggaagtcgcaggacaagacatcagtcactggtttgatccgaagacaagagacataagaaaacacatcgacccgctgactggatgcctccgctactgtacacctcggggtagatttgtccacgtaccgcctcaactgccatgctcagactgggctaacgatttcggcaagccttggtggcaaggctcgtattatgaggtagggaggttaagtgcgaaaactcggtctattcggatcatcaacacactgacatcacaggagcacaccctagagattcatgaagagttatag

SEQ ID NO: 55406 - DNA, 744 bp, Artificial Sequence
  Description of Artificial Sequence: Synthetic coding sequence
atgatggctgagcgggaggaagatgatgatactgaggaggcatggatgcagctgcgcccaacagagccactgccctcccaatgttgcggctcagggtgctccccctgtgtattcgacctgtatcacagagacttggcaagatgggaggctgcccaggcgtcgaaggaccggagcttactgagaggacccgagagccagtcgtgccccagcaaactgaaccccgagaccttcgttgcattttgtatcattgccatggacaggctcactaaagacacgtatcgcgtccggttcgccttgcccggtaattctcagctggggctcagacctggtcagcatctgatactgcgaggcattgttgacgatctggaaatccagagagcctacacacccatctcacctgcaaacgccgagggctatttcgaggtgctcatcaaatgttaccaaatgggattaatgagccggtatgtggagtcgtggcgcgtgggcgacacggcattctggcgtgggccatttggagacttcttctacaaacctaaccaggaaagctctagcgaacagctgccgtggtcctaccaggagaagacgcattttggccatctggggcaggacctcattaaagaactcgtgtcctgctgccgaagaaagccttttgcccttgtgtgcggaagcgcggagtttacaaaggacatcgctagatgcttgctctgtgcaggcctcacagaagactcttactttctattctag

SEQ ID NO: 55407 - DNA, 504 bp, Artificial Sequence
  Description of Artificial Sequence: Synthetic coding sequence
atggggctgatgagcaggtacgtagaaagctggcgtgttggcgatactgctttctggcggggaccattcggagattttttctataaaccgaaccaatatggtgagttgctgctgctggccgctggtacaggcctggcgcctatggtgcctattttgcagagtattactgacaacgagaacgatgaaaccttcgttactctcgtgggctgcttcaaaacattcgagtccatctatttaaagaccttcctgcaggaacaggccaggttctggaacgtccggacattctttgtactgagccaagaaagcagtagcgaacagctgccttggtcctatcaggaaaagactcattttggccacctgggccaggacctcatcaaggagctggtctcctgttgcagacgcaagccgtttgccctggtatgcggcagcgctgagttcaccaaggacattgctcggtgcctgctgtgtgcgggtttgactgaggactcatactttttgttttag

SEQ ID NO: 55408 - DNA, 948 bp, Artificial Sequence
  Description of Artificial Sequence: Synthetic coding sequence
atgatggccgaaagggaagaggacgatgacactgaggaggcttggatgcagcttcggccaacggagccactcccttcccagtgttgtgggtcaggttgttctccttgtgtattcgacctgtaccatagggacttggctaggtgggaggcagcacaggctagcaaggacaggagtttgctccgcggtccagaatctcagtcctgtcccagcaaactgaaccctgaaaccttcgttgccttttgcattatcgccatggataggttgaccaaggacacctaccgagtgcgcttcgctctgcctgggaactctcagctgggcctaagacctggccagcatttgatcctccgcggaatcgtagacgacctcgaaatccagcgcgcttatacaccgatttctcccgcaaacgccgagggttattttgaagttttaatcaaatgttatcagatggggttgatgtcacgatatgtcgaatcatggcgcgtgggggacacggccttctggcggggtccctttggcgatttcttttataagccaaaccaatatggggaattactgctgctcgcggctgggaccggtctagcgccaatggtccccattctacagagtatcactgacaatgaaaacgacgagacgttcgtcaccctggtcggctgcttcaagacctttgaatccatttatctcaaaacctttctacaggagcaggccagattttggaacgttaggacgttctttgtcctgtcccaggagtcatccagcgagcagctgccttggtcctaccaggagaagacacacttcgggcatctgggccaggatctgataaaagagctcgtgagctgctgccgccgtaaaccttttgccctcgtgtgcggaagcgccgagtttaccaaggacatcgccagatgtctgttgtgtgccggtctcaccgaagactcttactttctgttttag

SEQ ID NO: 55409 - DNA, 417 bp, Artificial Sequence
  Description of Artificial Sequence: Synthetic coding sequence
atgatggcagagagggaagaagatgacgacactgaggaggcctggatgcagcttcggccaacagagccactcccttcccagtgctgtggctctggctgttcgccatgcgtgttcgatctttaccatcgggatctcgcacggtgggaggctgctcaggccagtaaggaccgctctcttttgagaggacccgagtcccaatcctgtccctccaaactgaatccggagaccttcgtagctttctgtatcattgccatggaccggctgaccaaagatacctaccgagtccggttcgctcttccaggcaattctcagcttggcctcaggccaggtcaacacttaatcctcaggtatactcaggtggccggagggccaaagttgcatagccctgccctgcttttcgcctcctgttggccctag

SEQ ID NO: 55410 - DNA, 948 bp, Artificial Sequence
  Description of Artificial Sequence: Synthetic coding sequence
atgatggctgagagagaggaggatgacgataccgaagaagcctggatgcagctccgccctaccgaacccctgccttctcagtgttgtggatctggttgttctccgtgtgtgtttgacctgtatcatcgggacctcgccaggtgggaagcagctcaggcctctaaagatagatccctgctgcggggaccagagtcccagagctgtcctagcaaactcaatccagagacattcgtggcattttgtattattgccatggatcgactgacaaaggacacctaccgggtacggttcgctctgccaggaaatagccaacttggactccgtcctggccagcatttgattttgcgaggaatcgtagacgatctcgagatacagcgcgcttacacgccgatttcccccgctaatgcagaaggctacttcgaagttcttatcaaatgttaccagatgggtttgatgtccaggtacgtcgagtcctggagggtgggagatactgcgttttggagagggccattcggggactttttttacaaacctaatcagtatggagagttgcttctacttgcagctggcacagggttggcgcctatggtgccgatcctgcagtccatcaccgacaatgagaatgacgaaacttttgtgaccctcgtgggttgcttcaaaaccttcgagagcatttacctgaaaaccttcctgcaggaacaggcacgcttttggaatgtgcggacttttttcgtcctgtcgcaggaatcctcaagcgaacagctaccatggagctaccaggagaaaactcatttcggccatttggggcaggatctgattaaagagttggtcagctgctgtagacggaagccctttgcgctggtctgcgggagtgccgagttcacgaaggatattgctagatgcttgctgtgtgccggattgaccgaagatagctactttctgttctag

SEQ ID NO: 55411 - DNA, 744 bp, Artificial Sequence
  Description of Artificial Sequence: Synthetic coding sequence
atgatggccgagcgtgaggaggacgatgataccgaagaggcttggatgcagttacgacccacagagcccctacccagccaatgctgcggcagcggttgcagcccatgtgttttcgatctgtaccacagagacttagctcggtgggaggcagcccaggcctccaaggaccgctcactcctgcggggacctgagagtcagtcctgcccgtcgaagctgaatcctgagacttttgtcgcattttgtattatagcaatggacaggctgactaaggacacttacagggtgagattcgcgctgcctggcaacagccagcttggtctacgaccgggacaacatcttatactgagggggattgtggatgatctcgaaatccagcgagcctatacaccaatctctccggcaaacgcagagggctacttcgaagtcctcatcaagtgttaccagatggggctgatgtccaggtacgttgaatcttggcgagtgggcgacaccgccttctggcggggacccttcggcgactttttttataagcctaatcaagaaagcagcagcgagcagctgccgtggtcctaccaggagaagacccacttcggccatcttgggcaggatctcatcaaagaactggtttcctgttgcagaagaaaaccatttgctctagtctgtggaagcgctgagtttaccaaggatatcgcccgatgtctgttgtgtgcaggactgaccgaagatagctattttctgttctag

SEQ ID NO: 55412 - DNA, 948 bp, Artificial Sequence
  Description of Artificial Sequence: Synthetic coding sequence
atgatggccgagagggaagaggacgatgatactgaagaagcttggatgcagttaagaccgactgagccactgccaagccagtgttgcggtagtggctgctccccctgcgtgttcgacctctaccacagggacctggccagatgggaggcggctcaggcaagcaaggaccggtctttgctgaggggcccagaaagccaatcctgcccgagtaaattgaacccagagacttttgttgcattttgcatcatcgccatggatagattaaccaaggatacgtaccgggtgcgctttgcccttcccggtaattcccagctcggcctgaggccaggacagcacctgatcctccgagggattgtagatgaccttgagatccagcgagcttatacgcctatttcacccgctaacgccgagggctattttgaagtactgatcaaatgctatcaaatgggcctaatgagccggtatgttgagagctggcgtgtgggagacacagcgttttggcggggtccttttggggatttcttctataaaccaaatcagtacggggagcttctgctcctggccgctggaacgggattggctcccatggtccctattctacaaagcataactgacaatgaaaatgatgaaacttttgtgaccctcgtaggctgttttaagacttttgagagcatctatctgaagacatttctgcaggaacaggctcggttttggaatgtccgaaccttctttgttctgtctcaggaatccagcagcgagcagctcccttggtcttaccaggagaaaacgcacttcgggcaccttggacaggaccttatcaaagaactggtctcttgttgccggaggaaaccattcgccctcgtgtgcgggagcgcggaattcactaaggatattgcaaggtgcctattgtgcgctggtctgaccgaggactcttacttcctcttctag

SEQ ID NO: 55413 - DNA, 246 bp, Artificial Sequence
  Description of Artificial Sequence: Synthetic coding sequence
atgtctagaagcagcaaggtcgtgctcggactcagcgtgcttctgaccgccgcaaccgtagccggagtgcacgtgaagcagcagtgggaccagcagcgtttacgcgatggggttattcgggacatcgaacgccagattcgtaagaaggaaaatattcggctcctcggggagcaaattatactgaccgagcagctggaggcggagcgggagaagatgttgctagccaaaggcagccagaagagctag

SEQ ID NO: 55414 - DNA, 810 bp, Artificial Sequence
  Description of Artificial Sequence: Synthetic coding sequence
ggtctgctcctggtggctttactggcatctcttacagtgatggtcttaatgagcgtgtggcagcagagaaagtcccgcggaaagctcccactaggcccaactcccctgttgttcataggaaactacctgcaacttaacacagagcatatctgtgacagcattatgaaaatctcagaacggtacggtcccgtcttcacgattcacttaggacccagaagagtggtcgtgctgtgtggacacgacgctgtgaaggaggccctcgtggaccaggcggaggaattcagcggcagaggcgagcaggcgactttcgattggctcttcaaagggtatggcgttacctgccgtacgtgggagcgaaccaagccactgcggaggtttagtattgctactctcagggattttggagtaggtaaaagagggatcaaagaaattcaggaaaaggcaggcttcttgataaaagctcatcagagcagtgacagcagtatttatcccacctttttcctgtccagaaccacttctaatgttattagtagcattgtgtttggcgacagatttgattatgaggacaagtttctgagcttactgtgcatgatgctcgaatccttccagtttactgctccctccactggacagctgtacgagatgttttccagcgtaatgaagcacttgcctggccctcagcagcaagctttcaaggagctccagggccttgaagacttcattgctaagaaggtggagcataaccaatgcacactcgatccaaactccccaagggatttcatcgattccttcctgatccggatgcagtag

SEQ ID NO: 55415 - DNA, 1338 bp, Artificial Sequence
  Description of Artificial Sequence: Synthetic coding sequence
atgggtctcgaggcactggtacctctggccatgattgttgctatttttttactgttagtcgatctgatgcaccggcaccagaggtgggctgcgaggtatccacctgggccactgcctctaccgggtttgggtaacttgcatgtggactttcagaatactccttactgcttcgatcagctgagacgcagatttggagacgtctttagtttgcagctggcttggacaccggttgttgtccttaacggtctggctgccgtgcgcgaagctatggtgacccgcggagaggataccgctgataggcctccagcgcctatctaccaggttctggggtttggccctcgctcacagggcagaccattcagacctaacggtctcttagataaagccgtaagcaacgtgattgctagtctgacgtgcggtcggaggtttgaatatgacgatcctcgttttctgagactgcttgacttagcacaggagggcctgaaggaagagagcggatttctcagggaggtgctgaatgccgtaccggttcttcttcacataccagcactcgctgggaaggtcctacggttccagaaggcattcttgacacaactcgacgagttgctaacagagcacaggatgacctgggatcccgctcagccgcctcgagatctcacagaggcctttttggcaaagaaggaaaaggcaaaaggttctccagagtcaagttttaacgatgaaaacctccgcattgtcgtgggaaatctatttctagctggcatggtgaccactctgacgactcttgcttggggactgctgctgatgatactccatctggatgtgcagctgcgtgtgcaacaggaaatcgatgatgtcatcgggcaggtgcgaagacctgaaatgggcgaccaagcacacatgccatacaccacggcggttatacatgaagttcaacgcttcggggatatcatccccttgagtgttactcatatgacctctcacgatatcgaagtgcagggcttccgtatccccaaagggacgacactaattaccaatctaagctcggtgttaaaggacgaggcagtgtggaaaaagccattcagatttcatcctgagcatttcttggatgcccaaggccacttcgtaaagcccgaggcattcctcccatttagtgccggacgacgggcttgcctgggagaaccattagctcggatggagctgtttctcttttttacctccctgcttcaacacttttccttctcggttgctgccggtcagcctcgcccaagtcacagccgcgtggtgagctttctagtgacgccttctccttacgagctgtgcgctgtgcctcgctag

SEQ ID NO: 55416 - DNA, 1332 bp, Artificial Sequence
  Description of Artificial Sequence: Synthetic coding sequence
caagaggcacttaccctccccctgcagctgagaagaagattcggcgatgtgttcagcctgcaattggcctggacacctgtggtggtgttgaatggcctggccgcagttcgcgaggcaatggtgactagaggggaggataccgccgacagaccccctgccccaatttatcaggttctgggattcggccctcgagaacagtgggtttttctgagccggtacgggcctgcttggcgagagcagaggagattttcagtaagtacgctcagaaacctgggcctaggaaagaaaagcctcgagcaatgggtgacagaagaagccgcttgcctgtgcgccgcttttgccgaccaagacgctccgttcgcacccaccgtctcctggactaaacctaatgtcattgcctctctgacctgtggcaggaggttcgaatatgatgatccaaggttcctcaggttgctcgacttggcacaagagggcctgaaagaggaatctggttttttgcgggaggtgctgaacgccgtcccagtcctgctgcatataccggcactggctgggaaggtgttgcgcttccagaaggccttcttgacccaactcgacgaacttcttacagaacatcgcatgacatgggatcccgctcaacccccaagagatctgaccgaagcctttttggctaagaaggaaaaggcaaaaggaagccccgaatcctcatttaatgatgagaacctgcggatcgtggtaggtaacctgttcttggccggaatggtaacaacccttaccacacttgcctggggcctgctgttgatgattctgcatctggacgtccagctcagagtgcaacaggaaattgacgacgtcattggacaggtcagaagacctgagatgggtgatcaagcacatatgccttacaccacggcggtgatccacgaagtccagcggtttggagatattatacctctgtcagtgactcacatgacgtcacacgacatcgaggtgcagggattccgtatcccaaagggcaccacactgatcacaaatttgtcttcagtcctcaaggatgaggctgtttggaaaaagcccttccggtttcaccccgaacacttcctcgatgctcaaggacacttcgtgaaaccagaagccttcttgcccttctccgcaggcaggcgagcttgcctgggcgagcccttagcccgaatggagctgttcctcttcttcacgtccctcctccagcactttagtttctcagtggctgccggacagcctcgtcctagtcattcccgagtcgtgtcttttcttgtcaccccaagtccatacgagctttgcgcagttccgagatag

SEQ ID NO: 55417 - DNA, 1491 bp, Artificial Sequence
  Description of Artificial Sequence: Synthetic coding sequence
atggggctggaagctttggttccgcttgcaatgattgtcgctatttttctgcttctcgtcgacctcatgcacaggcaccagagatgggcagcacggtaccctccagggcctctgcctcttcccggacttggcaatcttcatgtggacttccagaatactccctactgttttgaccagctgcgacgacggtttggggacgtattctccctccaacttgcttggacgcccgttgtcgtgttaaatggccttgcagcggttcgtgaggctatggtcacccgcggtgaagacaccgcggacagaccacccgctccaatttatcaggtgcttggttttggcccaagggaacagtgggtgttcttgagcaggtatggtccagcctggagggagcagcgccgattcagtgtgtcaacgctgaggaatctaggattgggaaagaagagtctggaacagtgggttacagaggaggccgcatgcctctgcgctgcatttgctgatcaggccggtaggcccttccgccctaatgggctcctggacaaagctgtgagcaacgttattgcctctctaacctgcggaagaaggttcgagtacgacgatccacgctttctccggctgttagatcttgctcaggagggactaaaagaagaatccggcttcctccgcgaagttcttaatgccgtacccgtgctcctgcatattcccgctctggccggaaaggtgcttaggttccagaaggcctttttgacccagttggatgaactcctcactgagcacagaatgacctgggatcctgcccagcctcctagagacctcactgaagccttcctcgcaaagaaagagaaggcaaaggggtcccctgaatcctcctttaatgacgagaatcttagaatagtcgtgggtaacttgtttcttgccggtatggtaaccaccctcaccacccttgcttggggcttgcttttaatgatcctacaccttgatgtgcaacttagggtgcagcaggagatagatgacgttattggacaagttcgtaggccagaaatgggggaccaggcacatatgccttacacgaccgccgtcatccacgaggttcagcgctttggagacatcatcccacttagtgtgacccatatgacgtcccatgatatagaagtgcagggctttaggataccaaaaggcacaaccctcatcacaaatttgtcttccgtgctcaaggatgaggcggtatggaagaagccatttagattccacccagaacacttcctggatgcccagggtcactttgtgaagcccgaagccttcctcccgttctcagcgggtcggagagcttgcctcggcgaacccttagccagaatggaactctttctcttcttcaccagcctactgcagcatttttcttttagcgtggcagcgggacagcccagaccctcgcactctcgggttgtgtccttcctggttactcctagtccatacgagctgtgtgcagtgcctcgatag

SEQ ID NO: 55418 - DNA, 1224 bp, Artificial Sequence
  Description of Artificial Sequence: Synthetic coding sequence
atggtaacacgaggagaggacaccgccgataggccgccagcacccatctaccaggtgctgggctttggccctcgatctcagggggtgttcctttccaggtatgggccagcctggcgggaacagcgcagattcagtgtgagcaccctgcgtaacctgggattgggaaaaaagtcacttgagcagtgggtcacggaggaggccgcttgcctgtgcgctgcctttgccgaccaggctgggaggccatttcggcctaacgggctcctggacaaagctgtgagcaatgtaatagcgagtttgacatgcggacgccgatttgagtatgacgaccccagattcttgcgtctgctggacctggcccaggaaggactgaaggaggagtctggattccttcgagaagtcctgaacgctgtccccgtgctgctgcacataccagccctagccggtaaagtgctgcggttccagaaggcgttcctcacccagctggatgagctcctaactgagcatcgcatgacctgggatccagcgcagcctcccagggacctaactgaggcattcctggccaagaaggaaaaggccaaaggaagtcctgagtcaagcttcaacgatgaaaacttgagaatcgtagtgggcaacctgttcttggccggtatggtcactacgcttaccactctggcttggggtctccttctcatgattctgcatttggacgtgcagctcagggtacagcaggagatcgatgacgtgatcggtcaggtgaggagacctgagatgggcgaccaggcacatatgccatatacaaccgctgtgatccatgaggttcagaggtttggtgatatcatcccgctgagcgtgacacacatgacttcacacgacattgaggtgcagggatttaggatacccaagggtacaaccttgataaccaaccttagtagcgtgttgaaagatgaggcagtttggaagaagcccttcaggttccaccccgaacatttcttggatgcccagggccacttcgttaaaccagaggccttcctgcctttctcggctggcagaagggcttgtctaggagaaccgctggctagaatggagctttttcttttctttacctctctgttacagcacttcagcttcagtgtcgccgctggccagcctcggccaagtcattcaagggttgtttcctttctggtcacgccatcaccctatgagctgtgtgccgttcccagatag

SEQ ID NO: 55419 - DNA, 429 bp, Artificial Sequence
  Description of Artificial Sequence: Synthetic coding sequence
caacttcggaggcgatttggggatgttttctctttgcagctcgcttggaccccagtggtagtgcagtgggccggtggaagggctagaggggacggcgaccccagacggggtcatgggcgtccgcctgcgtgtgctcacctccccggtgatccactgccggcaagccctaccccaaggaccccgttgtctccacaacggagcctggggcagtctagagagcagcgcgataggcttccccacttgagagcaccacttcgtgtaagaagacctagcctcccacaagctgccggtccctcaagcggcggaactgaaggaggcgttgggctgccagctagaggagctgagtgctgcccccgaccacccgcacacccctctgccggatggcaaggccctaccctccccaagggatttccagaccctgcaggttag

SEQ ID NO: 55420 - DNA, 510 bp, Artificial Sequence
  Description of Artificial Sequence: Synthetic coding sequence
aaaatacatgaagagatcaatcaggttatcggccctcatcgactcccaagagtcgatgaccgggttaagatgccctatacagacgtggtaattcacgagatccagcgtctcgtcgacatcgtccctatgggtgtccctcacaatatcatacaggacacccagtttcgcggatacctgttgcctaaggggactgacgtattccctctcctcggttcagtgctgaaggatcctaagtactttagatacccagatgcattctatccacagcacttcctcgacgaacaaggaagatttaagaagaatgaggcctttgtccccttttcgagcggcaagagaatttgtctgggcgaagctatggcccgtatggagctattcctatattttacttccacactgcagaatttttccttgtgttccctggttcctctggtcgatatcgatatcacccccaagctgagcggatttgggaacatcactcccacttatgagttatgtttggtcgcacgctag

SEQ ID NO: 55421 - DNA, 1119 bp, Artificial Sequence
  Description of Artificial Sequence: Synthetic coding sequence
atgcgcagcgtcctccgtcagcgaatcctaaaaccaaaagatgtggccatttacagtggggaggtcaatcaagttattgctgatcttatcaaacgtatctacctgttaagatctcaggctgaggatggtgaaaccgtgacaaatgtgaacgacttattcttcaagtattctatggaaggagtggcaaccatcctctacgagtcccggctggggtgcctggagaattccattccacaacttacagtggaatacatcgaggctttggagctcatgttctcgatgtttaagacctccatgtacgcaggcgcaattcctcggtggctgaggccatttatacctaaaccatggcgcgagttctgcagatcctgggatggattgttcaagttttctcagatccacgtggataataagttgcgggacattcagtatcaaatggaccgtgggaggcgggtgtccggagggctgctcacgtacctgttccttagccaagccttaacgctccaagaaatatacgccaatgtaacagaaatgctgcttgccggtgttgacaccacttccttcacactgagttggactgtttacctgcttgctaggcatcccgaggtgcaacagaccgtgtacagggaaatcgtcaagaacctgggcgaacgccacgtgcctactgcagctgacgtaccaaaggtaccccttgtaagggcactactgaaggaaactctccgcttattcccagttctgcctggaaacggcagagtcacgcaggaagacttagtaattggtgggtacctcattcccaagggcacccagcttgccttgtgccattacgcgaccagttatcaggacgagaattttcctcgcgctaaagagttcagaccagaaagatggctccgtaaaggagatctggatcgtgtggataactttggtagcattccttttggccatggggtgcgaagctgcataggcagaaggattgccgagctggagattcatctggtagtaatacaactcctccagcacttcgagattaaaactagctcccagaccaatgcggtacatgctaagacccatggtcttttaacgccaggcggtcccatccacgttcgctttgtgaacaggaaatag

SEQ ID NO: 55422 - DNA, 1119 bp, Artificial Sequence
  Description of Artificial Sequence: Synthetic coding sequence
atgcgatctgtcctgaggcagcgaatccttaagcccaaggacgtcgcaatttactcaggagaggtcaatcaggtgatagctgacctcataaaacgcatctatcttctgagaagccaagcagaggacggagagacagttactaatgtgaacgacctgttttttaaatatagtatggagggcgtggctacaattttatacgaatcacgactggggtgcctcgaaaattccatcccccagctgacagttgaatacattgaagctctagagctcatgttctctatgttcaaaaccagtatgtatgcaggcgctattccacgttggcttcgccctttcattcccaagccgtggagagaattctgccggagctgggatggtctgtttaaattcagccagattcatgtggacaacaagctgcgggacatccagtaccagatggatcggggaagaagggtgtctggtgggttgctgacatacctatttttgagtcaggccttgacactacaggagatctacgccaatgtgacagaaatgctccttgctggtgtcgatactacctcattcactctgagttggaccgtatatctactggctaggcatccagaagtgcaacagaccgtgtatcgggagatcgtgaagaatcttggcgagagacacgtgcccactgccgcagacgtgccgaaagtcccactggttagggcgctgcttaaggagaccctgcggctcttccccgtgctgccagggaacgggagggtgacccaggaggacctggtcatcggtggctacctgattcctaagggtacgcagctagcactgtgccattacgcaacaagttatcaggacgaaaacttcccccgagccaaagagttccgacctgaacggtggttgaggaaaggtgatctcgatcgcgtagataattttgggtctataccttttggacacggagtaagatcctgtataggacgaagaatcgctgagcttgaaatccacctggttgttatacaattgctgcagcactttgagatcaagacttcatcccagaccaacgcagtgcacgctaaaacacatggcttactcactccgggtggacccatacacgttaggttcgtcaaccggaagtag

SEQ ID NO: 55423 - DNA, 357 bp, Artificial Sequence
  Description of Artificial Sequence: Synthetic coding sequence
atggtaaccccagcaggctgtctcggtgggcgaaatcaaggtcctcgagagatccccggaacagcattccctcgatcttctcgggctggacagactgggcaggccgtgagcggggctcaggtaagctcatggcgggaaaggcagccctgcagtggtagccgaggacctctacacatccttgggactgacggcaacgttgacaccaccggcaaattggggttagtgcctacaccccctcgaatccagaaggagactaaacaaggtgccctttgtggaatgaagcctccattcctgcccgaggcattgctaattgtttggtggctcccgttcgttgctgtgagtccttgccttttctag

SEQ ID NO: 55424 - DNA, 1194 bp, Artificial Sequence
  Description of Artificial Sequence: Synthetic coding sequence
atggaagaggatgactcttacgtgcctagtgacctaaccgcggaggagaggcaggagttagagaacattcgaagaagaaagcaagagctgctcgcagatatccagagacttaaagatgaaatcgctgaagttgccaatgaaatcgagaatctgggatcaacggaagaaagaaagaacatgcagaggaataagcaggtggcaatgggccgtaaaaaattcaacatggacccaaagaaagggattcagtttctgattgagaatgatctgctgaagaatacatgcgaggatatcgctcagttcctctacaagggggaagggctcaacaaaaccgcaatcggcgattatctcggtgaaagagatgagtttaatatccaggtgctgcacgctttcgtggagctccacgagttcactgatctcaatctcgtccaggctctcagacagtttttgtggtcttttagattaccaggggaagcgcagaagatagaccgtatgatggaagccttcgcacagagatattgtcaatgtaataatggagtttttcaatccaccgatacgtgttatgtgctatcgttcgccatcattatgcttaatacaagcctccacaatcctaacgttaaggacaaaccgacagttgagagattcatagctatgaaccgcggaatcaacgacggcggagacctccccgaggagctcttgagaaacttgtatgagtcaatcaagaatgagccattcaaaatacctgaggatgacggaaacgatctcacccacaccttctttaatcccgatagagaaggctggttgctaaaactgggcggaagggtcaagacctggaagcggaggtggttcatcctgaccgataattgtctgtactactttgaatacactactgacaaggagcctcgcggtattatccctctagagaacttatctataagggaggttgaggactctaaaaagccgaattgtttcgagctgtacattcccgacaataaggatcaggtaatcaaagcatgcaagacagaagcagacgggagagtggtcgagggaaatcacactgtctaccggataagtgcccctacccccgaggagaaggaagaatggatcaagtgcatcaaggctgcaatcagtcgcgatccattctatgaaatgctcgcggcaaggaaaaagaaagtgagctccacaaaacgacactag

SEQ ID NO: 55425 - DNA, 465 bp, Artificial Sequence
  Description of Artificial Sequence: Synthetic coding sequence
atggatctctgtcacccagagcccgctgagctctcctcaggcgagacagaggagttacagagaatcaaatggcacaggaagcaactgttggaagatattcagaaactgaaggatgagatcgctgacgtctttgctcagatcgattgtttcgagagcgccgaagaatctagaatggctcagaaggagaaggagctgtgtataggaagaaagaagttcaatatggatcctgccaagggtatccagtacttcattgagcataaactcctgactccagacgtgcaggacattgctcgcttcctctataagggtgaaggtcttaacaagactgccattgggacgtatctgggcgagagggacccaataaacctgcaggtgcttcaagcctttgtggactgtcacgaatttgctaacctgaacctcgtgcaagcgttgcgggtggttaagacgaaatgggaaagtgtgtag

SEQ ID NO: 55426 - DNA, 777 bp, Artificial Sequence
  Description of Artificial Sequence: Synthetic coding sequence
atggctgagtatagctatgttaagagcactaagctcgtactgaagggaaccaagaccaagagcaagaagaaaaagagcaaggataagaagaggaagcgagaggaagatgaagaaacccagctagatattgttgggatttggtggaccgtgactaacttcggagaaatctccggcactattgccattgaaatggacaaggggacgtacatccacgccctggataacggattatttacgttgggagccccacataaggaggtcgacgaagggccttcccccccagaacagttcaccgccgttaaactgtccgactctcgcatcgctttgaaatctgggtacggcaagtatctcgggatcaactctgatggacttgtggtcggtcgcagtgacgctatagggcctcgtgagcagtgggagccagtgtttcaaaatggcaaaatggcacttttggcctccaattcctgttttattcgatgtaatgaggcaggtgatatagaagccaagtcaaaaactgccggagaagaagagatgatcaaaattcggagttgcgccgagcgagagacaaaaaaaaaagacgacattcccgaggaagataaaggcaacgtgaagcagtgtgaaatcaattacgtgaagaaattccagtccttccaggaccacaaactgaaaatatccaaggaagatagcaagattctaaagaaggcaagaaaggacggcttcctgcacgagactctgttagatcggagagctaaactcaaagctgacagatattgtaagtag

SEQ ID NO: 55427 - DNA, 1179 bp, Artificial Sequence
  Description of Artificial Sequence: Synthetic coding sequence
atgaatccaaggggcaaccgaaagacaaccaaggaaggctctaacgacctgaaatttcagaatttctcactccctaagaatcgaagctggcctcgcattaatagtgctactggacagtatcagaggatgaataagccgctactcgattgggaacgcaattttgctgccgttctggatggtgcgaagggccattcggatgacgattatgacgacccagaactgcgaatggaggaaacttggcagagcatcaaaatattacccgcacggcctatcaaggagtctgagtacgccgatactcactattttaaagtggcaatggatacacccctccccctggataccagaacaagcatttccattggccagcctacatggaacacacagactcgactggaaagagttgacaagcccatctccaaggacgtaagatcacaaaatataaggccacccttgtcccaaaggcacactttcccggaagttcaacgcatgcctagtcaaattagtctgcgcgacctatctgagtcccttgaggccaaaaaagtcccccacaaccagcgcaagcccgaatcaactcatcttctggaaaatcagaatacccaggagatcccactggcgataagctcctccagcttcacaactagcaaccatagtgtccagaaccgagaccatagaggaggaatgcagccatgctcgcctcagaggtgccagccccctgccagttgctcgccccacgagaatattctaccttacaaatacacaagctggaggccgccatttccaaaacgaagtgatcggaaggacgtgcagcacaacgagtggtatataggagagtactcacgacaggcagtggaggaagccttcatgaaagaaaacaaggacggctctttcctggtgcgggactgttccaccaaatcgaaagaagagccatacgtgctcgccgtgttctacgagaataaagtgtataatgtaaagattaggtttcttgagaggaaccagcagttcgccctgggcactggcctgcggggagatgagaagttcgactccgtggaagatattattgagcactacaaaaattttcctatcatcttgatcgatggcaaagataagaccggagttcacagaaaacagtgtcacctcacccagccgctccccctaactcgacatctcctccccctctag

SEQ ID NO: 55428 - DNA, 510 bp, Artificial Sequence
  Description of Artificial Sequence: Synthetic coding sequence
atgaataagccgctgctcgattgggagagaaacttcgccgcagttcttgatggcgcaaaaggccattccgatgacgactacgacgatccagagctgaggatggaagagacttggcagtccataaagatcttgcctgctaggccaatcaaggagtccgaatatgcagacacacattactttaaagtcgcaatggacacgccactgccgctggatacacggacttctatcagcattggccagcctacttggaacacccagactcggttagaaagagtcgacaagcccatcagtaaggacgtccgaagccagaatatcaagggggacgcaagcgtgagaaaaaataaaatccccctcccgcctccgcgtcccctgattaccctgccaaaaaaatatcagccactcccccctgaaccagagagctctcgcccacctctgtcacagaggcacacgttcccagaagtgcagagaatgcctagccaaatatcgttaagagacctgagcgagccctag

SEQ ID NO: 55429 - DNA, 510 bp, Artificial Sequence
  Description of Artificial Sequence: Synthetic coding sequence
atgaacaaacctctcttggactgggaaagaaactttgccgctgtcctggacggcgctaagggacatagcgacgacgactatgatgacccagagctacgcatggaggagacctggcagtctataaagattctgcccgctcgcccaatcaaggagtctgaatatgctgatactcattatttcaaggttgcaatggatacaccgctgccactagacacccggactagtatttccatcggtcagcccacttggaacacacagactcgcctcgagagggttgataagcccatttcgaaagacgtgcgttcacagaatatcaagggcgatgcctcagtaaggaagaataaaatccccctccctcctccaagacctctgataaccttacccaaaaagtatcaacctctgccacctgagcccgagtccagtaggcccccactttcccagcgacacacctttccagaagtgcaaagaatgcccagccagatctccctgcgagatttgtccgaaccttag

SEQ ID NO: 55430 - DNA, 1695 bp, Artificial Sequence
  Description of Artificial Sequence: Synthetic coding sequence
atgcccgagtgcttgtggacccagggcgtcctgcaggaggtgctcaacagctacttttgcggcagtatcatcctatccactctgccatgggaggtccccggaggccatgcttccagaatctgccttcttttgcttgctacgggtgagaataagcaggtcgaatgttatcagctgtcccccggtctgtcttcgctgccagatttccaggactctgaagaaacggtgacctccaggatgcttttcccaactagtgcccaggagagtagccggggactgccagacgcgaatgatttatgcctcgggctccagtcgttatctctgacaggatgggatcgcccttggagtacccaggactcagatagcagtgcgcaaagttcgacccattcagtcctcagcatgctgcacaatcccttgggcaacgtcctcggtaaacccccactttcttttctccccttggatccccttggatctgacctagtggacaagttccctgccccatccgtgcgagggagcaggctggacacaagacctatattggactcaagatcaagctcacccagcgattcagatacatcgggattcagttctggaagtgaccacttgtccgatctcatctcgtcactgagaatcagtccaccattaccatttctgtccttgagcggcggaggcccacgcgacccactaaaaatgggggtgggatcgcgtatggaccaagagcaggccgcactggccgcagtgaccccttctcccacgtcagcttctaagagatggcctggagctagcgtgtggccttcttgggacctgctggaggcccctaaagatcccttctctatagagcgtgaagccaggctgcaccgtcaggccgctgcagtcaacgaagctacctgcacctggagcggtcaactacccccacgaaactacaagaaccccatctattcctgcaaagtgttcttaggcggagtgccgtgggacataaccgaggcaggattggttaacacgttcagagtgtttggcagcctgagtgtggagtggccaggcaaggacggcaaacatcctaggtgccctcccaagggttacgtttatctagtgtttgaactggaaaaaagtgttcgctccctgttacaggcttgtagccatgatcccctctctccagacggcctttccgagtattacttcaagatgagtagtaggcgcatgcgctgcaaagaggttcaggtgatcccttgggtactggctgactcaaattttgttcgcagccccagtcaaagactggacccatccagaacagtcttcgtcggggctctgcatgggatgcttaacgctgaagccctggcggcaatattgaacgacctgttcgggggagtggtgtatgctggcattgatactgacaagcacaaataccctatcggtagcggcagagttacgttcaataaccagagaagttacctgaaggccgtttcggccgcatttgttgagattaagactaccaaattcacaaagaaggttcagatagatccttacctggaagattctttgtgccacatctgctcttcacagcctggccctttcttttgtagggatcaggtgtgttttaagtacttctgcagaagttgctggcattggcggcactctatggaaggactccgccaccatagtccacttatgcgcaatcagaaaaatagggattctagctag

SEQ ID NO: 55431 - DNA, 1476 bp, Artificial Sequence
  Description of Artificial Sequence: Synthetic coding sequence
atgctgttccctacatccgcacaagaatcttcgagaggcctcccggacgctaacgatctctgcttggggctgcaatcattatcacttaccggctgggataggccatggtccacccaagattctgacagttctgctcagagtagtacccactcggtccttagcatgctccataatcctctcggcaatgtgctgggaaaaccacccctgagtttcctcccacttgaccctctggggtctgacctggtagataagtttccagcgccaagcgtgcgcggttcaaggctagatacgaggcccattttagattcccgcagctcttccccttccgacagcgatacgtccgggtttagcagtggcagcgaccatctatcggatctgatctcatcactaagaatctccccgcctctcccattcctgtcattgagcggaggaggtcctcgggaccctttgaagatgggtgttggttcccgcatggaccaagagcaggccgctttggctgcggtgaccccctccccaacctctgcttcgaagagatggccaggggcttcagtctggcccagctgggacttgctggaggctccaaaagaccctttttctatcgaaagagaggccagattgcatcgccaggctgcagccgtgaatgaagccacctgtacctggtcagggcaacttccaccccgtaactataagaaccccatctactcatgtaaggtgttcctgggcggagtgccctgggatattaccgaggcaggactggtcaataccttccgggtgttcggctccctgtccgtggagtggccgggaaaggatgggaaacaccccagatgtcccccaaagggcaatatgccaaagggatacgtgtatctggttttcgagctggagaagtccgttagatcccttctgcaggcctgctcccatgaccctctgtccccggacgggctctctgagtattacttcaagatgtcttctcgcaggatgagatgcaaggaggtccaagtcatcccttgggtgttggccgatagtaacttcgtgcgatcgccttctcagcgacttgacccctcaagaacagtctttgttggagctcttcatggcatgctgaatgcagaggccctggccgcaatccttaatgacctgtttggtggcgtcgtgtatgcgggtatcgataccgacaaacataaatatcccataggctccggaagggtgacattcaataatcaacggtcatacctaaaggccgtctcagcggctttcgtcgagatcaagactaccaaatttacaaagaaggtgcagattgatccctacctggaagactccctatgccatatttgttcgagtcagccgggacccttcttctgtagagatcaggtctgcttcaagtacttttgtcgctcatgttggcactggcggcacagcatggaagggttgagacaccatagtccactgatgaggaaccagaagaatagggactcctcttag

SEQ ID NO: 55432 - DNA, 1008 bp, Artificial Sequence
  Description of Artificial Sequence: Synthetic coding sequence
atgggggtgggaagtcggatggaccaggaacaggcagccctggccgcagtgacaccatctccaactagcgcgtcaaagcgctggccaggggcatccgtgtggcccagttgggacttgctggaagcgcctaaagatccattttctatcgagagggaggcacgtctgcaccgacaggccgcagctgtcaacgaagcgacctgtacctggagtgggcagcttccacccaggaactacaagaacccaatctatagttgtaaagtcttcctgggcggtgtcccttgggatatcactgaagccggactggtaaatacttttcgggtgttcggtagcttgtccgtggaatggcccggaaaggacggcaagcaccctagatgccctcccaagggctacgtatatcttgtattcgaactcgagaaaagcgtaaggtccctcctacaggcatgctcccacgatcctttgagtccggacggtctctctgaatactattttaagatgtcatctcgcaggatgcgttgcaaggaggtccaggtgattccgtgggtgctcgccgactcaaatttcgtgcgctccccgtctcagcgccttgaccctagtaggacggtcttcgtaggggcacttcacggcatgcttaatgccgaggctcttgccgcaattctcaacgatttgttcggcggtgttgtctatgcaggtatcgacacagataagcataaataccccatcgggtcaggacgtgttacatttaataaccagcgcagctacttaaaggccgtcagcgccgcttttgttgaaattaaaaccactaagtttaccaagaaagtgcaaatcgacccatacttggaggacagtctctgtcatatatgctcgtcacagcccggaccctttttttgccgcgaccaggtctgcttcaagtatttttgccgttcttgctggcactggcggcattcaatggagggtttgagacatcactccccactgatgaggaatcagaagaaccgggacagcagctag

SEQ ID NO: 55433 - DNA, 1686 bp, Artificial Sequence
  Description of Artificial Sequence: Synthetic coding sequence
atgtccatgccgctggaggaggaagctggcagaatcaaagactgttgggacaatcaggaggccccagccctgtctacatgtagcaatgctaatattttcaggcggataaacgcaatcctcgacaactccctcgacttctcccgcgtgtgtacaacacctatcaataggggtattcacgatcatctcccagacttccaggactccgaggaaacagtgacttcccgcatgctctttccaacttcagcacaggagagcagccgcggtctcccagacgctaacgatctatgtctgggactgcaaagcttgtcactgacgggctgggatcggccttggtccacccaggactccgactcaagtgcccagtcttccacacactcggttttgtccatgctgcataatccactgggtaacgtgctgggcaagccgccattatccttcctgcctcttgacccacttggttctgacctcgtagataagttccccgctccctccgtacggggatcaagattagacacaaggccaattctggactccaggtcttcatccccctccgacagcgatacttccggtttttcatccggcagcgaccatctgtccgacctcatttctagcttaagaattagcccgcctcttccctttctctcactgagtggcggtggcccaagagacccactgaagatgggcgtagggtcacgtatggatcaggagcaggccgcactcgccgcagttactccctctccaacgagcgccagtaagcgatggcctggagctagcgtgtggccatcctgggatctgttggaggcccctaaagacccattctcaattgagcgcgaagccagattacataggcaggccgcagcagtgaacgaggccacctgtacgtggagcggccagctcccccctcgaaactacaagaatcctatttactcctgcaaagtgttcctgggaggagttccatgggacattaccgaggcaggtctggtgaacacgttccgcgtttttggtagcctgagtgtagagtggccgggaaaagatggcaagcaccccagatgtccaccaaaagggtatgtgtacttagtgtttgagcttgaaaagagcgttcggagtttgttacaagcctgcagtcatgatcccctttctcccgatggattatccgaatactattttaagatgtcttcccgaagaatgcgctgtaaggaggtacaggtcatcccatgggtgctcgcggatagcaacttcgtgagaagtcccagccagagattggatcccagccggacagtcttcgtgggagcactccacggtatgctaaatgcagaggccttggcagcaatcctcaacgacctgttcggtggcgtggtctacgcaggtattgatactgacaaacataaataccctatcggcagcggcagagtcacctttaacaatcagcgttcctatttaaaggccgtgtcagcggctttcgttgagatcaagaccaccaaattcactaaaaaagtacagatcgacccttatctcgaggacagtttatgccacatttgctcttcgcagcccggaccgttcttctgtagggatcaggtttgctttaagtacttctgtaggtcctgttggcactggcgacattctatggagggactgcggcaccacagccccctgatgaggaatcaaaagaaccgggattcatcatag

SEQ ID NO: 55434 - DNA, 1461 bp, Artificial Sequence
  Description of Artificial Sequence: Synthetic coding sequence
atgctgtttccgacctcagcccaggaatctagccggggactgccagatgccaacgatctgtgcctgggactccagagcctctctctgaccggctgggacaggccgtggtcgactcaggattctgattcttctgcccagagcagtacacatagcgttctcagcatgctgcacaaccccttggggaatgtactggggaaaccccctctcagtttcctgccgctggatcctctgggctccgacttagttgacaaattcccagccccatcagtcagaggatcacgattagatacccgcccaatcctcgacagcagatcttcgtcaccaagcgattcggacacaagcggatttagcagcggaagtgaccatctgtcagatctgatttcctcactccgcataagcccacctctgcccttcctgagccttagcgggggaggcccacgggatccccttaaaatgggcgtgggatcccgcatggaccaggagcaggccgcattggcggctgtgacaccttctcccacttccgcttcaaaacgctggcctggcgcatccgtatggcccagctgggatctgctagaagcccctaaagatcccttctccattgagagagaagcccgactacaccggcaagctgccgcagttaacgaggctacatgcacgtggagcgggcagctcccaccaagaaactacaagaaccctatctatagttgtaaagttttcttgggcggagtgccatgggacatcaccgaagccggtctggtcaatacctttagagtgtttggtagccttagcgtagagtggccagggaaggacggaaaacacccgcgttgtcctcccaagggctatgtgtatctggtgtttgagctggagaagagtgtcaggtctctgctccaggcttgtagccatgatccactcagtcccgacggtctctcggagtactattttaagatgagttccaggaggatgcggtgtaaggaggttcaagttataccctgggtactcgccgacagcaatttcgtccgatccccaagccagcgactggacccaagccggacagtgttcgtcggcgcactgcatggtatgctcaacgctgaggcgctcgctgccattctgaatgatctgtttgggggtgttgtctacgcaggtattgataccgataagcataaatatcccatcggcagcgggcgagtgacctttaacaaccaaaggagctatctgaaggccgtgagcgcagccttcgtcgagatcaagaccactaaattcacgaaaaaagtgcaaatagatccgtatctggaagactctttatgccatatttgtagtagccagcctggcccattcttctgtcgagatcaggtgtgcttcaaatatttctgtcgctcctgctggcattggagacattccatggagggcctgagacatcatagccctctaatgcggaatcagaagaatcgagacagcagctag

SEQ ID NO: 55435 - DNA, 1686 bp, Artificial Sequence
  Description of Artificial Sequence: Synthetic coding sequence
atggccttcccactggaagaggaagcgggacgcatcaaggactgctgggataatcaggaggcccctgcccttagcacttgctctaacgcaaacatcttccgccgtattaacgcaatattggacaatagcctggacttctctagagtgtgtactacacctatcaatagagggattcacgatcacctgccagacttccaggattcggaggagacagtgaccagcaggatgctcttcccgacctcagcacaggaatcttctcgagggttgcccgacgccaacgatctatgtctcggcctgcagagcctgagtctgactggttgggatagaccttggtcaacccaggacagtgacagctccgcccaaagctccacccatagcgttctgagtatgctgcataatcccctgggcaacgtgctaggaaagcctcctctaagctttctgccattggatcccttgggctctgacctcgtggataagtttcctgcgccttctgtgcggggaagtaggctggatactaggccaatcctggactctaggagtagcagtccaagcgactccgatacatcagggttttctagcggtagcgatcatcttagtgaccttatttctagtttgcggatttctccaccgctcccttttctgtcgctgtcgggagggggtcccagagatcctctgaaaatgggggtcggatcacgaatggaccaagaacaggccgcattggcggcagtgactccatcaccaacgtccgcttccaagcggtggcccggtgccagcgtatggccttcatgggatctgcttgaggcccctaaagatccgttcagcattgaacgggaggctaggctgcaccgccaggcagcagccgtaaatgaagccacctgtacatggtccggtcagctgcctccgaggaactataagaacccgatatactcatgcaaggtgttcttaggaggcgtgccctgggatatcacagaggcgggtttagtgaatacctttcgagtatttggctccctatcggttgagtggccaggtaaagacgggaagcatccacggtgcccaccgaagggctacgtgtacttagtatttgagctggaaaaaagtgtgcggtcgcttttacaggcatgttcacacgaccctctcagcccagatgggctttcggagtactatttcaaaatgagcagtaggcgaatgcgatgcaaagaagtccaggttatcccctgggttctcgcggatagcaacttcgtgcgtagtccttcacagcgcttggacccaagtcggactgtgtttgtgggcgctttgcacgggatgcttaacgctgaggctctggctgccattctgaatgacctattcggaggggttgtgtatgcagggatagatacagacaagcacaaatatcccatcggctcgggtagagtgaccttcaataaccagcggtcatatctgaaggcagtttcagctgccttcgtggagattaaaaccacaaagtttacgaagaaggttcagatcgatccgtacctggaagattctctatgtcatatctgttccagccagccaggaccatttttctgccgcgaccaggtgtgttttaagtacttctgtaggagctgttggcattggaggcactccatggaggggctacgccaccactctcctctgatgagaaatcagaaaaaccgcgattcctcgtag

SEQ ID NO: 55436 - DNA, 1686 bp, Artificial Sequence
  Description of Artificial Sequence: Synthetic coding sequence
atggcctttcctctagaagaggaagcaggacgtattaaggactgctgggacaatcaggaggctccagcattgagcacatgttcgaacgcgaacatatttaggaggattaacgcaattctggacaattcattggatttctcgcgcgtgtgtactactcctataaaccggggtatccatgaccacttgccagattttcaggattccgaagagacagttaccagtcgcatgcttttccccaccagcgcacaagagtctagcaggggactcccagacgcaaacgatctgtgtctgggcctgcagagcctgtcacttactgggtgggatcgtccctggtcaacgcaggactcagactcaagcgctcagtcttccactcatagcgtcctgtccatgctgcataaccccttaggaaatgtcctggggaaaccccctttaagctttctgcctcttgaccccctaggatcagacctcgttgataaattccctgccccaagcgtccggggatccagattggacacaagacccatcctcgatagtagaagctcttccccctcagactcagatacgtccggattttcatctgggagtgaccatttgtcagacctgatatcttcactgcgcatctctccaccccttccattcctctctttgtcaggagggggaccaagagaccctcttaagatgggtgtgggcagcagaatggatcaggagcaggctgccctggcagctgtaaccccctccccaacatccgcaagcaagagatggcccggagcttcggtgtggcctagttgggacttactggaagctcccaaggacccattctcaatcgaaagagaagctcgcttgcataggcaggccgctgcagtaaacgaagctacctgcacctggtccggacaattgccacccagaaattataagaatcctatctatagctgcaaagtgttcctgggaggcgtgccctgggacattacggaagcgggattggttaacacttttagagtctttggatctctgagcgtggagtggccaggcaaggacggaaagcatccccgatgtccaccaaaaggctacgtgtacctcgtcttcgagctcgaaaaaagtgtgagatcgctgcttcaggcctgctcccacgatcccttgagccccgacggtctgtccgagtattacttcaaaatgagcagtaggcgcatgcgatgtaaggaagtgcaagtaatcccctgggttctggctgatagcaattttgtccgctctccctctcagcgcctggatccatcccgcacagtgttcgtcggggcactgcacgggatgttgaatgctgaagccctagcagctattctgaacgatttatttggtggtgtggtttatgccggtatcgacaccgacaagcataaatatcctatcgggtcaggacgagttaccttcaacaatcagagaagctatctgaaggctgtatccgccgcatttgttgaaattaagactaccaagttcaccaaaaaagtgcagattgacccatacttagaggattcgctgtgtcacatttgcagttcccagccgggaccctttttttgtagagaccaggtgtgttttaaatacttctgccggtcttgttggcactggcgacattccatggagggattacggcaccattctcccctgatgagaaaccagaaaaaccgcgatagctcctag

SEQ ID NO: 55437 - DNA, 1131 bp, Artificial Sequence
  Description of Artificial Sequence: Synthetic coding sequence
atgctgaccttcctgcagcaactgcgggtcgattggccagcagcgtctgaaagagcatcttcccacaccttgaggtcccatgccctcgaggaactgacaagtgcgaatgatgggagaaccctgtcccccggaatcctaggcagattgtgcctcaaggaacttgtcgaagaacaggggaggacagccggatacgaccccaacctcgataattgcctggtgacagaggacttgctctcagtgctcgcagagctgcaggaagctctgtggcactggccagaagatagccacccaggcttagcaggggctagtgacaccggtacgggaggctgtcttgttgtccacgtggtcagttgcgaggaggaattccagcagcagaagctggacttactgtggcagaaactggtcgataaggctccactgagacagaagcatctgatatgcggtccggtcaaagttgccggtgccccaggcacgttaatgacagccccagagtattacgaatttagacatacacaggtgtgcaaggcatctgctcttaagcatggaggcgacttggcacaggacccagcctggaccgagatcttcggtgtgctttccgtggccaccatcaaatttgagatgttgagcaccgccccacagtcccagctgttccttgccttagccgacagctctatttctaccaagggaaccaaaagcggaactttcgtgatgtacaattgcgcacggctggccacactgtttgagtcttacaagtgtagtatggagcagggtctataccctaccttccccccagtgtctagcctggatttttcactgcttcacgatgaaggggagtggctcttactgttcaacagcattcttcccttcccagatctgctgtcacgcacagctgtgcttgactgcacggctcccggattgcacatagctgtccggaccgagatgatctgtaaattcctggtgcagctgtccatggactttagcagttactacaatagggtccacatactgggggaaccccgacctcacctgttcggacagatgttcgtgcggttgcagctactgcgcgcagttcgcgaagtcctccacactggattggccatgcttggtctaccccctctgagccacatttag

SEQ ID NO: 55438 - DNA, 1551 bp, Artificial Sequence
  Description of Artificial Sequence: Synthetic coding sequence
atggccactaggcgcctcggtgttggggagaccctcggggctcttaatgcggctttaggcccaggcggacccgtgtggataaaggaaacccggacccggcacttgaggagtcgcgacttcctcgctccacaccgagccctgcaggcccgatttgatgatggtcaggttcccgagcatctgttacacgcactcgcctgtctccagggccctggtgtcgcccctgtgcttaggtgtgcgcctaccccagcaggtctctctctccagctccagcgatccgctgtgttcgaaagagtgctgtcagctgtggctgcttacgccacccccgcttctcccgcatcactcggccagcgtgttttgcttcattgtccagccttgaggagcagcccatgtgccctaagactgagtcagctgaggaccgtgctggtagccgatcacctcgcacgagcgttacgggctcatggggtgtgcgtcaggctcgtacccgctgtcagagatccacacatgctaacttttcttcagcagctgagggtggactggcctgccgctagcgaaagggccagtagccacacccttcgaagccacgcactcgaggagttgacttctgcgaacgatggccgtaccctctccccaggaattttaggacggctgtgcctgaaggaattagtagaggaacagggccgtaccgccggatatgacccaaatctcgacaactgcttggtgactgaggacttgctgtcagtgctggctgaactccaagaagctctgtggcattggcctgaggactcccaccctgggttagcgggagcctccgacacgggcaccggcggttgcttggtcgtccacgtcgtaagttgcgaagaggagttccaacagcaaaagctcgacctcctctggcaaaaattggtcgacaaggccccacttcgccagaagcacctaatctgtggcccagtcaaagtagctggggcacctggaactctgatgaccgcccctgagtactatgagtttcggcatacacaagtgtgtaaggcttccgccctcaaacatggaggggacttggcacaagacccggcttggaccgaaattttcggagttctttccgtggccaccatcaaatttgagatgttgtccaccgccccacagtctcagcttttcctggcgctggccgatagctctatcagtactaagggtaccaagtccggaacattcgttatgtacaattgcgcccgactggctaccctcttcgagagctacaagtgctctatggaacagggactgtatccaactttcccacccgtgtcatctctggattttagtctgttgcacgatgaatatcccccactgagcgggtccgccgagccagacagctcggccggtctgcatagcccaggtgcaccacactgttgcacccatagggacgacatgcaggtccctggtaccgcccaacatggatttcagcttctgctccagccaggaacccaccctggaggagcaagtacgacacctctgtggtctgatgttagacctccggctgcctctgaatcctgtgcttag

SEQ ID NO: 55439 - DNA, 507 bp, Artificial Sequence
  Description of Artificial Sequence: Synthetic coding sequence
atgaacagtaagggccagtatccaacccagcccacttatccggtccagccgccaggtaaccccgtgtaccctcagacactgcatctgccgcaggcccctccttataccgatgctccacccgcatactccgaactgtataggccaagctttgtgcatccaggcgctgccaccgtaccgaccatgtccgccgcttttccaggagccagtctctacctcccaatggcccagagtgtggcagtcggcccactcggctcgactattcctatggcctattatcctgtcggtccaatttatccgcctggcagcactgtgctggtggagggaggctatgatgccggtgccagatttggagccggagctaccgcaggcaatattcccccaccgccaccagggtgtccccctaacgccgctcagcttgcagtgatgcaaggcgcaaatgtgctcgtgacccagaggaagggaaacttttttatgggcggatccgacggaggttataccatttggtag

SEQ ID NO: 55440 - DNA, 462 bp, Artificial Sequence
  Description of Artificial Sequence: Synthetic coding sequence
atgaactcaaagggacaataccctacccagccaacctatccggtgcagcctcccggaaatccggtctatcctcagaccctgcatcttccccaggcccctccttataccgacgcccctccagcatacagcgagctgtatcgaccaagcttcgttcatccaggcgcagctaccgtgccaactatgtctgccgctttcccaggcgctagtctgtacctgcccatggcccagtctgtggccgttggccctctcggcagcactatacctatggcttactacccagtcggtccaatttatccccctgggtccacagtccttgttgaagggggatacgacgctggcgcacgtttcggggctggcgcaactgcagggaacatccccgtcaaagaggatcaggaccatgatagagaacaaggcgaggaagataatggggataataatctcgagagaaggggcaaaatgtag

SEQ ID NO: 55441 - DNA, 261 bp, Artificial Sequence
  Description of Artificial Sequence: Synthetic coding sequence
atgaacagcaaaggccagtatccaacccaacctacgtaccctgttcaaccacccggaaatcctgtttaccctcagacccttcacctcccacaggcgccaccatatacggacgccccacctgcttatagtgaacccccaccccctggatgccccccaaatgccgcacagctcgccgtaatgcagggtgccaacgtgctggttacccagcgtaagggcaatttcttcatggggggatctgacgggggttatacaatctggtag

SEQ ID NO: 55442 - DNA, 441 bp, Artificial Sequence
  Description of Artificial Sequence: Synthetic coding sequence
atgaactcaaaaggacaataccccacacagcctacttaccctgtccaacccccaggaaatcctgtgtatccccagactttacacctgccccaggccccaccctatactgacgcccctcccgcttactccgaactttaccgcccatctttcgtgcatcctggcgctgccacagtgcctactatgtccgccgcaatacccatggcttactaccccgtagggcctatctaccctcctggctcaaccgtgctagtagagggcggttacgatgccggtgcccgattcggcgctggagccaccgccggaaacatccctcctccacctcccggatgcccacccaacgccgctcagctcgccgtgatgcagggggctaacgttctcgtgacccaacgtaaaggaaatttcttcatggggggatctgacggaggctacaccatctggtag

SEQ ID NO: 55443 - DNA, 624 bp, Artificial Sequence
  Description of Artificial Sequence: Synthetic coding sequence
atgaatagtaaagggcagtacccaacccagccaacataccctgtccaacctcccggtaatcctgtttacccacagactctgcatctaccacaggcgcctccctacaccgacgcaccccctgcttatagcgagctatatcggccatcattcgttcatcctggggctgcaaccgttccaactatgtcagctgcttttccaggagccagtctgtacttgccaatggctcagtctgtcgctgtgggcccacttgggtcaactatacctatggcatactatcctgtgggccctatctaccctcccgcatcaacaagctggatgcccagtcagtgctgctccgcctgcagccatgccggtagtcaacgaccgaggaacagcgctgaaggagagttgctccacggctggttccgatggtggctgcatcatttggtaaggaatcagggacatttgtgcgcgggtaaggatattacgtatctccagcacttttcccagtgcaattgcttttctcacataaatctcaagcttcaattccgtcatatgttactgggttgtctgtctggagcccagactttccgacatttcagtaatctgatacggaatcacgttatggtagccgtcccaccatag

SEQ ID NO: 55444 - DNA, 411 bp, Artificial Sequence
  Description of Artificial Sequence: Synthetic coding sequence
atgaatagcaaaggccagtacccaacacagcccacatatcctgttcagccgcctggcaatcccgtgtacccacagactctgcacctccctcaggccccaccatacacagatgctccgcctgcctacagcgagtccgtggcggttggacccctggggtctaccattcctatggcctactatcctgttggacccatttatccaccagggtcaacagtactggtggagggaggttatgatgcaggtgcacggtttggcgctggggcaacagccggaaatattccaccccctccgccaggatgtccccctaatgcagctcaactagctgtcatgcagggcgcaaacgtgctcgtgactcaacgcaaaggaaattttttcatgggcggatctgatggtggctacactatttggtag

SEQ ID NO: 55445 - DNA, 2304 bp, Artificial Sequence
  Description of Artificial Sequence: Synthetic coding sequence
atgcagtctcccgctgctacagccgaaggactttcaggacctctgttcggggcttatacctttccaacttttaaatttcagccaagacacgattcgatggattggcgcaggatctcgaccctggacgtagatcgtgtagctcgggaactcgatgtcgcgaccctccaggagaacatagcaggaatcacgttctgcaacctagaccgggaggtttgttcccgatgcgggcaacccgtcgaccctgccctcctgaaagttttaaggctggcccagctgattatagagtatctgctgcattgccaggattgccttagcgcttcggtcgcgcagttggaagctcgactccaaacatccctgggccagcagcaacgcggacagcaagagttagggcgtcaggcggatgagttaaagggtgtccgggaggagtcgaggcgacggcgaaagatgatttcaactctgcaacaactcctcatgcaaactggtacccacagttaccacacctgtcacctttgtgataagactttcatgaacgccacatttcttagaggtcatatacagcggaggcatgcaggagttgccgagggtggaaagcagaagaagcaggagcagcccgtcgaggaagtgctggaagagctccgagccaagctcaagtggacacagggcgaactggaagctcagagggaggccgaaagacaaaggcagttgcaggaggccgaactcatccatcaacgtgaaatcgaggccaagaaagaattcgacaagtggaaagaacaggaatggacaaagctgtatggcgagattgacaaattaaagaaactgttctgggacgaattcaaaaatgttgccaagcaaaattccaccctggaggagaaactccgtgctcttcagagtcattccgtgatggagtccaagctaggcagcctaagggatgaggaaagtgaagagtggctaagacaggcgagggagttgcaggcactgcgcgaaaaaaccgagatccaaaaaacagaatggaagaggaaagtgaaagagctccatgaggagcatatggcagaaaaaaaagagctccaggaggagaaccagaggttgcaggcatccttatcccaggatcagaaaaaggctgctgcacaatcccaatgccaaataagcactttaagagcgcagctacaggaacaggctcgaataattgccagccaggaagaaatgattcagtccctaagccttcgtaaggtggaaggcattcacaaagtccccaaagcagtggatactgaagaggactcgccagaggaggagatggaagattcacaggatgagcaacacaaagtacttgcagccctcagaagaaacccgactctgctcaagcacttccgcccaattctggaagacacgctggaggagaaacttgagagcatgggtatccgaaaagacgcaaagggcatatcgatccaaacactgcgtcatctcgagagcctgttacgggtgcagagggagcaaaaagccagaaagttcagtgagttcctctcattacggggtaagctggttaaggaagtgacgagtagggcaaaggagaggcaggaaaatggcgcagttgttagtcagcccgacggccagccgagcgttaaatcacaacagtctacactggtgacaagggaggcacaaccaaagactcggaccttgcaggtcgctttgcccagtacacccgctgagccacctccacctaccaggcagagccacgggtcccacggctccagcctgactcaggtgtctgctcccgcaccgcgaccgggtttgcatggcccaagcagtactcccccatcctccggtcccggtatgagtacgccaccttttagttcagaagaggacagtgagggggatcgtgtgcagagagtcagtctgcaaccccctaaggtgcctagtcggatggtgccacgacccaaggatgattgggactggagcgacaccgaaaccagcgaagagaatgctcagccacctggccaaggcagtggtactctggtacaatcaatggtcaaaaatttggagaagcagttggaggccccagcgaaaaagccagcaggaggagtatccctttttttcatgccgaacgccggaccccagcgcgctgcgactcctggaagaaagccacagctttctgaggacgaaagtgatctggaaattagttctctggaggatctcccactggatcttgaccaacgcgagaaacccaagccgctatcccggagtaagcttccagagaagttcggtaccgggcctcagagcagcgggcaacccagggtacctgcatggtag

SEQ ID NO: 55446 - DNA, 204 bp, Artificial Sequence
  Description of Artificial Sequence: Synthetic coding sequence
atgcaaagccccgctgccaccgccgaaggactgtcaggtccgttatttggagcctacactttccccacgtttaagttccagccccgacacgactccatggattggcgcaggatctcaactctcgacgtcgatagggtcgccagggagctggacgttgcgacgttgcaggagaatatagccggtatcacattttgcaatctctag

SEQ ID NO: 55447 - DNA, 1620 bp, Artificial Sequence
  Description of Artificial Sequence: Synthetic coding sequence
atgcaaagcccagctgccaccgccgagggcctgtctgggccactgttcggtgcctatacatttcccacctttaagtttcaacccaggcatgatagcatggattggaggcgtatcagcacattggacgtagaccgggtcgcaagagagcttgatgttgctacgttgcaggagaacatcgcaggaattaccttttgtaacttggaccgagaagtgtgctccaggtgcggccagcccgtggatccggctctccttaaggtgctgagactggctcagctgattatcgagtatctgctgcactgtcaggactgcctttcagcgtctgtagcacagctcgaagcaagactccagaccagcctgggacagcagcaaagggggcagcaggaactaggcagacaggctgatgagctgaagggagtcagggaggagtccagacggagacggaaaatgattagcacactccagcagttactgatgcagaccggaactcacagttaccacacctgtcatctgtgcgacaaaactttcatgaatgcgaccttcctgcgaggccacatacagcgcagacacgcgggtgttgctgagggcggaaaacagaaaaagcaggaacaaccagttgaagaggttcttgaggaactccgcgcaaagttgaaatggacccagggcgagttagaggctcagcgggaagctgagcggcagagacagttgcaggaggcagaattgatccatcagcgcgaaatagaagccaagaaagaattcgacaaatggaaagagcaggaatggactaagctgtatggcgagattgacaagttgaaaaagcttttctgggacgagtttaagaatgtcgcaaaacagaacagcaccctggaggaaaaactgagagctcttcagagccatagtgtgatggagagcaaattaggcagcctgcgcgatgaggaaagcgaggagtggctgcggcaggccagagaactgcaggccctacgggagaagacagaaattcagaagactgaatggaagcgaaaagttaaggagctacacgaagagcacatggccgaaaagaaggagcttcaagaggagaaccagaggcttcaggcttcgctctcgcaggatcagaagaaggccgctgcacagtcgcagtgccagatttcaacccttcgggctcagctacaagaacaggcccgaatcattgcgagccaagaggaaatgatccaatccttgtcactaagaaaagtcgagggtatccataaagtcccaaaagccgtcgatacagaggaggactctcccgaggaggaaatggaggacagccaggacgagcaacacaaggtgctcgccgctctgagaagaaacccaaccttactaaaacactttcgtcctattctggaagataccttggaggaaaagctggaatccatgggaatacggaaagacgccaaggggatatccatccaaacgctgcggcacctggaatcgcttctgagggtgcagagggaacagaaggcaagaaagtttagcgagttcctgtcactgcggggaaaactggtgaaggaagtcacatctcgagcaaaagagagacaagagaatggcgcagtagtgtcccagcccgatggtcagccatcaggctag

SEQ ID NO: 55448 - DNA, 120 bp, Artificial Sequence
  Description of Artificial Sequence: Synthetic coding sequence
atgcagagccctgctgccacggccgaaggcttgagcggaccactgtttggggcttacacttttccaacatttaagtttcaaccacgacacgactcaatggattggaggagaattagctag

SEQ ID NO: 55449 - DNA, 1620 bp, Artificial Sequence
  Description of Artificial Sequence: Synthetic coding sequence
atgcagtccccagccgctaccgccgaaggccttagtggaccactctttggtgcatatacatttccaacattcaaattccagccaaggcacgacagcatggattggaggcgaatctcgaccctggatgtagacagagtggcacgggaactggacgtcgccacactgcaggaaaatatcgcaggtatcaccttttgcaacttggaccgtgaagtgtgcagtaggtgcggccagcccgtggacccagctctgctcaaggtattgcgcctggcccagctgataattgaatatctgcttcattgtcaagattgtcttagcgcgagcgtggcccagttagaggcgcgtctgcaaacgagtctcggacaacaacagcgtggccagcaggaactgggtcgtcaggcagatgaacttaagggtgtccgggaggagtcccggaggcgtaggaaaatgatatccacactgcagcagttattgatgcagaccgggacccactcatatcatacatgccacttatgcgacaagacctttatgaacgctacctttctcagaggacacatccagaggagacacgcaggggtggcagaagggggaaaacaaaagaaacaggaacaacctgttgaggaggtgttggaagaactgcgggcaaaactgaagtggacccaaggcgagctggaggctcaacgcgaagccgagagacagcgccagttacaggaagcagagcttattcaccagagggaaatcgaggcgaagaaggaattcgacaagtggaaagagcaagaatggacaaaattgtatggcgaaattgacaagttgaaaaagctgttttgggatgagttcaaaaatgtcgctaaacagaattcgacactggaagaaaagttaagagcactgcagagtcactcggtaatggaaagcaaactgggtagcttgcgggacgaagagtccgaggagtggctccgacaagctcgagaactgcaggccctaagggagaagaccgagatacagaaaacagagtggaaaaggaaggtgaaggagctacatgaagaacacatggccgagaaaaaagaactgcaggaggagaaccagaggctccaagcttccctgagccaggaccagaaaaaggcagccgcacagagtcagtgccagatctccacattgcgggctcaactgcaggaacaggcccgaattatcgcttctcaggaggagatgattcagtcattgtcgctgaggaaagtggagggcatccataaggtgcccaaggcggttgataccgaggaggacagccctgaggaggaaatggaggatagccaggatgaacaacacaaagtgctcgccgcactgcggagaaacccaaccctcctgaagcatttccggccaattctagaggatactctcgaggagaagctcgagagcatgggtattcgaaaggacgctaaggggatatcaatacagaccctgcgtcatctcgagtctctgttgcgggtacagcgggagcagaaggccaggaagttctccgaattcttaagcctgcgtgggaaactggttaaagaggtcacctctcgcgctaaggagagacaggagaacggtgctgtagtgagtcaacctgacggccagccttcggggtag

SEQ ID NO: 55450 - DNA, 561 bp, Artificial Sequence
  Description of Artificial Sequence: Synthetic coding sequence
atgcataagttgaaatcatctcaaaaagacaaagtgagacaattcatggcgtgtactcaggccggagagagaacggccatctactgtttaactcagaatgaatggaggctggacgaggccaccgatagcttttttcagaaccctgattctcttcatagggaatccatgagaaatgcagtggacaagaagaaactggaaaggctgtacggccgatacaaggacccacaagacgagaataaaatcggagtggatgggattcagcagttctgtgatgatctcagcctggatcccgcttccatttcggtcctagtaatcgcttggaagtttcgagccgctacccaatgcgagttcagcaggaaagagttcctggatggcatgactgagctcggctgcgactctatggagaagctgaaagcgctcctccctcgtctcgagcaagaactgaaggatacagccaagtttaaagacttctatcaatttaccttcaccttcgccaagaaccctggccagaaaggcttgggctccccacctttcctgaatgtgaaggccctgcatcactag

SEQ ID NO: 55451 - DNA, 780 bp, Artificial Sequence
  Description of Artificial Sequence: Synthetic coding sequence
atgcacaaacttaagtcctcacagaaagataaagtgcgccaatttatggcctgcacccaggcgggtgaaaggactgcaatttactgtctgacacagaatgagtggcgcctagacgaggccacggactcttttttccaaaatccggacagcttacatagagagtctatgagaaatgctgtggacaaaaagaagctggagcgactgtatggacggtataaagacccacaggacgaaaataaaatcggcgttgatggcatacaacagttttgtgacgatctgtctctggatcctgcctccatttccgtgttagtgattgcctggaagttccgggctgctacacagtgcgagttttcccgtaaggagttcctggatggaatgacagagcttggttgtgactccatggaaaagctgaaggctcttttacctagactggagcaggagctgaaggatactgccaagttcaaagacttctatcaattcacgttcacctttgctaagaatccagggcaaaagggtctcgatctggaaatggctgtggcttattggaagctagtgctctcaggaaggtttaagtttttagacctctggaatacctttctcatggagcaccataaaaggtcaattccacgagatacgtggaaccttcttctcgacttcggtaacatgattgcagacgacatgagcaactacgacgaggagggcgcttggcctgtattgattgacgacttcgtggaatatgccaggcctgttgtgaccggaggaaagcgctccctgttttag

SEQ ID NO: 55452 - DNA, 714 bp, Artificial Sequence
  Description of Artificial Sequence: Synthetic coding sequence
atgccagtcaagaagaagcgtaagtcgcccggagtggcagcagccgtggccgaagatggcggtttgaagaaatgtaaaatctcatcctactgccggagccagcctcccgcaagattaataagtggcgaagaacactttagctcaaagaaatgtctagcctggttctacgaatatgccggacccgacgaggtggtgggcccagagggcatggagaagttctgcgaggacatcggtgttgaaccagagaacataataatgctggtactagcgtggaagctggaggccgagagtatggggttctttacaaaggaagaatggctgaaagggatgacatctctgcagtgcgattgcaccgaaaagcttcagaacaagttcgacttcctacgatctcagttgaacgacattagcagttttaagaacatctacaggtatgcttttgatttcgccagagataaggaccaacgcagccttgacattgacactgctaagtccatgttagccctactgcttggtcggacctggccacttttctccgtattctatcaatacttggagcagtcaaaatatcgggtcatgaacaaggaccaatggtacaatgtgctggaattctctcgaactgttcatgccgacctgagcaactacgacgaagacggagcctggcctgtcctgctcgacgagtttgtggagtggcagaaggtccgacagacaagctag

SEQ ID NO: 55453 - DNA, 1749 bp, Artificial Sequence
  Description of Artificial Sequence: Synthetic coding sequence
atggaggctcttagcagagcaggtcaggagatgagcctggccgcattgaagcagcacgatccttacattaccagcattgctgatttgaccggacaggtggcactgtatacattttgccctaaggcgaatcaatgggagaagacagatatcgaaggcaccttgtttgtctacagaagaagtgcttcgccttaccacggattcacaatagtgaaccggttgaatatgcacaatctggtggagccagttaataaggacctcgagtttcagctacacgagcctttcctgctctaccgcaacgcttctctgtctatttactctatttggttttatgacaaaaacgattgtcaccgaatagcgaagctcatggcagatgtggtggaggaggagacaaggcggtcgcagcaggccgcacgagacaaacaaagtccaagccaggccaacggctgctcagaccacagacccatagacatcttggaaatgttgagcagggcaaaagacgagtatgagagaaaccagatgggtgatagcaacatttcatcccccggtctgcagccctcgacgcagctgtccaacctcggatcaactgaaactttggaagaaatgccgtctggctcgcaagataagtccgccccaagtggccacaagcatctgacagtcgaagagctgtttggaacatctctccctaaagagcagcccgcagtggtaggtcttgattctgaagagatggagaggctgcccggtgatgcatcgcagaaagagcctaatagtttcttaccgtttcctttcgaacagctcggcggagcgcctcagtctgagacccttggtgtgcccagtgctgcacatcatagcgttcaaccggaaattacaactccagtgctgattacacccgcttctatcacccaaagcaacgaaaagcacgctcccacatacacgattccactctcacccgtgttatcacctacgctaccagcggaagccccaacagcgcaggtgccacccagcttgcccaggaactcaacaatgatgcaggcagttaagaccactccccgacagaggagcccgctgctgaatcagccagtgccagaacttagccacgcatctctgattgctaatcagagcccttttcgcgcacctctcaatgtcaccaacaccgctggaacctcgttacccagcgtggacctgcttcagaaactgcgactgacacctcagcatgaccagattcagacccaacctttgggtaagggcgctatggtagctagtttctcaccagcggctggtcagctggcaaccccggagtctttcatcgagcccccttccaaaaccgctgccgcaagagtcgcagcctctgctagtcttagtaacatggtgctggccccactgcagtcaatgcaacaaaatcaggaccctgaggtgttcgttcaacccaaagttttgagctctgcaaaacgggtggcaggagccccattagtgactgctacaaccacagctgttagtagtgtgctcctcgccccatccgtgttccagcagaccgtgactcgtagctccgacctcgaacgaaaagcttcttccccttcccccctcacaatcggcacgcctgagtcacaacgaaaacctagcatcattctcagcaaaagccagctccaggatacactgatccaccttattaaaaacgacagctcttttctgtccactctgcacgaggtttatttgcaagtgttaacgaaaaacaaagataatcacaatttgtag

SEQ ID NO: 55454 - DNA, 1569 bp, Artificial Sequence
  Description of Artificial Sequence: Synthetic coding sequence
atgttccctttcggtccccattctcctggaggggatggttccgctggtgccggtgccgaagagccaacaccccacgaggggcaggccgcagctaccggcccacccagccccctgcaccccggagcagacgctactcaccctccccctcccgctcgaagtccaaggcgaccaggggctccctctctgtcgccagcgccaaggagcggcgagctcgggctcccaggagccccagagtcatccactgcatctgctcctggagaaccgtctcccccttccccgccttgcaggcgccctggtcccgactgccgcgctaagtcacgcggaagacatggcttgggcgctggacttggcggaccaggggcacgcctgtttggctggctcaaagagagatccctggggaggggcctgttcgtggaccccgcaagagacaattttcgcaccatgacttccctgtatggcagcattcaccccgctgactctgtatatctgtccaccagaacccacggtgccgtgtttaaccttgagtattcccccgacgggagtgtgctcaccgtggcttgcgaacagactgaagtgttgctctttgatccaatctcatccaagcacatcaagaccctctcagaagctcacgaggattgcgtgaataatatccggtttcttgataatcgccttttcgcaacatgctccgacgacactacaatcgcactgtgggatctgagaaagctgaatacaaaagtttgcacattacatggccacaccagttgggttaagaacatagaatacgacaccaacaccagactgctggtgacaagtgggttcgatggcaatgtcatcatttgggatacaaatcgttataccgaagatggttgcccccataagaagttcttccatacacggtttctcatgcggatgagactgacacctgattgctccaagatgctgatcagcaccagctctggatatttgttgattctacacgaccttgacttgactaagtccctggaggtggggtcatacccaatattgcgggctagacgtactacttcgtcctcaggcgtgtcacccagaaattctctggaggtggtgacccctgaggttctcggggaatcagaccacggaaactgcatcacctcccttcaactccatcccaagggatgggccaccttgttacggtgtagcagcaattcagacgatgaagagtgtacttgcgtatatgagttccaggaaggggctccagtgcgccctgtgtccccgcgatgttcactcaggctcactcactatatcgaagaggccaatgttggtcggggatacatcaaggagttatgtttttcgcctgatggtcggatgatctcatcaccgcacggctatgggatacggttactcggcttcgataaacagtgctctgaactggtggactgtcttcctaaagaagccagcccattgcgcgtgattcgatccctctacagtcataacgatgtggtactcactactaagttctcgcccacccattgccagattgcgagcgggtgcctctcaggtagggtctccctataccagccaaaattttag

SEQ ID NO: 55455 - DNA, 1680 bp, Artificial Sequence
  Description of Artificial Sequence: Synthetic coding sequence
atgttccctttcggtccacactcacccggaggagacggctcggcaggggctggcgcagaggagccgactcctcacgagggtcaagcagctgcgaccggcccaccaagcccgttgcacccgggagcggatgctacgcatcctcctccacccgctcgctcacctagaagacctggcgctccgagcttaagcccagcaccaaggagcggcgagctcggcttacctggggcacctgagagcagtactgcctcggcgcctggtgaacctagtcccccttctcctccttgcaggcgtcctggacctgactgccgtgctaagtcgaggggcagacacgggctgggcgctggccttggtggccctggagctcgcctcttcggctggcttaaggagcgcagtctcggaagaggactcttcgtagacccagcacgcgataattttagaactatgacctccttgtatggttcaattcacccagcagacagtgtataccttagtacacggacacacggtgctgtcttcaacctagagtatagtccagatggttccgtcctgaccgtggcatgcgagcaaaccgaggtgttattatttgatcccatttcttccaagcatattaagacactatccgaggcacacgaggactgtgtaaacaacatacgctttctcgacaatcgtttgttcgccacatgtagtgacgataccactatcgccctgtgggacctaagaaagctgaacacaaaggtgtgcacgctgcacggacacacaagctgggtcaagaacattgagtatgatactaacacgcgcctgctggtcacttctgggtttgacggaaatgttattatctgggatactaaccggtacactgaagacggatgccctcacaaaaaattctttcacacgaggttcctgatgcgcatgcgtctcacacctgactgttccaaaatgctgatcagcaccagcagtgggtacctcctgattcttcacgatctggatctgacaaaaagccttgaagtggggtcttatccaattctgagggcccgtagaaccacatcctcatccgatctaaccacatcttcttcatcctctggcccacgggtgagcggcagcccatgccatcactcagatagtaattcatcagagaagcacatgtctcgggcttcacagagggagggcgtgtctccacggaattctctggaagtggtgactcccgaggtactgggcgagagtgaccacggtaactgtataaccagcctccagctgcaccctaagggatgggctaccttactacgatgtagctcaaattcagacgacgaggagtgtacctgtgtgtacgagtttcaggaaggcgctcccgtaagacctgtaagtccaaggtgcagcctgcgtctcacccactatatagaggaggccaatgttggtcgcggatacatcaaagagctgtgtttctcacctgacggtcgtatgattagctcaccgcacggttatggcatcaggctcctagggtttgacaagcaatgcagcgagctcgtcgattgcttacccaaagaagcctcccctttacgagttatccggtccctgtattctcataacgacgttgtactgaccacgaaattcagtcctactcattgccagatagcctccggctgtctatccgggcgagtgagcctctatcagccaaaattctag

SEQ ID NO: 55456 - DNA, 1392 bp, Artificial Sequence
  Description of Artificial Sequence: Synthetic coding sequence
atggctcaacagcagacagggagccggaagcgaaaagcccctgcggttgaggccgacgctgagtccagccccagccaagggttggctgctgctgacggcgaaggcccactgctcttgaaaagacaaagaaggccagctacatacagaagcatggcccactatctcaaagtgcgtgaggtgggtggatggggcccagctcggctgcaggggttcgatggcgagttgcgcggatatgcagttcagaggttaccagagctcctcactgagagacagttggaactaggaaccgtgaataaggtctttgccagccagtggcttaactctaggcaggtggtttgcggaactaaatgcaacactcttttcgttgtggacgtagaatctggacatattgctcgcatccccctcctccgagattctgaggcacgcctagcacaggaccagcagggatgcggtatccacgccattgagttgaacccaagcaagacccttctcgctaccgggggagaaaaccccaactcactcgcaatctaccaacttccttcattagatccgctctgtctaggtgatcgccacggacacaaggattggatcttcgccgtggcctggttgtcagataccgtggcagtgtcggggagtcgagacgggacagtagccctgtggcgcatggaccctgataagttcgatgacacggtggcatggcactccgaggtcggactccctgtgtacgcccacatcaggcccagggatgtcgaagctattcccagagccatcattaatccatctaaccgaaaggtgcgcgcactggcttgtgggggtaagaaccaagagcttggcgctgtttcactcgacggttattttcacctatggaaggcgggatccgccctctcccggctcctgagtattcgtctgccatacttccgcgacaacgtgtgcttgacctattgcgacgacatgagcgtatatgccgtaggctcacattcacatgtgagctttctcgacttgcgacaagatcagcagaatataagacccctgtgctctcgcgagggcggaaccggtgttagatcccttagcttctatcggcatatcatcaccgtcggtactggccaggggagcttgttgttctacgacgtgcgcgctcaaaagttcctggaggaacgagcgagtgcaacactggagtcttctagcggcccagccaggaggaagctgaggctggcctgtgggaggggctggctgaaccataatgacttttgggtcaactactttggcggaatggaagtcttccccaacgctctgtatacccactgctataactggcctgagatgaaactgttcgttgctggcggacctctgccagctggcttgcatgggaattacgctgggctgtggtcctag

SEQ ID NO: 55457 - DNA, 1392 bp, Artificial Sequence
  Description of Artificial Sequence: Synthetic coding sequence
atggcacagcagcagactggaagtcgcaagaggaaagctcccgctgtggaagcaggcgctggttcttcgtcatcccagggcctcgccgctgcagatggcgagggtccactgcttccaaaaaagcaaaagcgccctgccacccgacgcagactcgtgcactaccttaagggcagggaagtcggagctaggggtccagccggactccagggatttgaaggagagctaaggggctacgctgtccagcggcttcccgagttgcttacggagcggcagctggacctaggaaccctgaacaaagtgttcgcatcacagtggcttaatgcccgacaagtagtctgcgggacaaagtgtaatactctgttcgttgtggatgtccagtccggtcacataactagaattcccttaatgcgggacaaggaggctgggctggcacaagcacaccaaggctgtggtattcatgccattgaacttaacccttctaagacccttctggctaccgggggtgagaatcctaactcgctcgccatttaccaactgccaaccctggacccactgtgcctgggggatcggcacggacacaaagattggatcttcgctgtcgcgtggctgagtgataccgttgctgtgagtggcagtcgggatggcacggtagccttgtggcggatggatcccgacatgtttaatggctcaattgcttggcattccgaggttggcttgccagtgtatgctcatattaggcctagagacgtggaggccatacctcgcgcatcaaccaaccccagtaatcgcaaggtgcgcgcattggccttctcaggaaagaaccaggaacttggagctgtgtccctggatggctacttccacctctggaaagctcgttccacgctgagtaggctgctgagtatccgacttccctactgcagagagaatgtgtgtttgacttactgtgacgaactgtctctctatgccgtgggctctcaatcccacgtgagcttcctggaccctcggcagaggcagcagaatattcgcccactttgcagccgcgagggaggcactggcgtcaggtcccttagcttctatcaacacattattactgtgggaactggacatgggagtctcctgttctacgatattagagcccagaaattcctggaagagcgcgctagtagttccctcgactccatgccaggccctgctggcagaaagttgaagttagcatgtggtcgtgggtggctcaatcaggacgatgtctgggttaactatttcggcggtatgggggagttccccaatgccctgtacacccactgctacaattggcctgagatgaagctgtttgttgctggaggccctttaccttcaggcctgcatggaaattatgcagggctttggagctag

SEQ ID NO: 55458 - DNA, 1392 bp, Artificial Sequence
  Description of Artificial Sequence: Synthetic coding sequence
atggcccaacaacagacgggatcccggaaacggaaagcaccggctgtcgaggcgggagcaggttcttcgagttctcagggcctcgcagccgcagatggagaagggccactgctcccgaagaagcagaagaggcccgcaactcgacgcagactggttcactacctgaaggggcgagaagttggcgcaagggggcctgccggtttacaaggattcgaaggggaactgcgcggttatgcggtgcagagactgccagagctgctgacagagcgtcagcttgatcttgggaccctcaacaaggtgttcgccagtcagtggctcaacgcacgccaggtggtctgcgggaccaaatgcaacaccctgtttgtggttgacgttcagtccggtcatattacacgcatcccgttaatgcgtgacaaagaagctggactggcacaggcccaccaaggctgtggcatccacgcgatagagctgaacccctcaaaaacattgctggcaacgggcggagaaaaccccaactccctggcaatctaccagctcccgaccctggaccccctgtgcttgggtgacagacacggccacaaggattggatttttgcggtggcctggttgagcgatactgtagctgtgtccggttcacgcgatggcactgtcgccctgtggcgcatggatcccgatatgttcaatggttctatcgcctggcatagcgaggtgggactgcccgtatacgcccacattcgaccaagggatgtcgaggccatcccccgagctagtacaaaccctagcaatagaaaggtgagagcccttgccttcagcggtaagaatcaggaactgggggcagtctctctcgacgggtattttcatctctggaaggccaggtcaactctctccaggcttttgtctataagactgccgtattgtcgggagaacgtctgtttgacatattgtgacgagctcagcctatatgcagtgggttcgcagtcccatgtcagctttttggatccacgtcagcgacaacagaatatccggccactatgtagccgtgagggaggcacaggcgttcgaagtctgtccttctatcagcatattataacagtgggcactgggcatggcagcctgctcttctacgacatcagagcccagaagttccttgaagaacgtgcgtcgagttctctggacagcatgcccggaccagcaggacgaaagctgaaactcgcctgcggaaggggctggttaaaccaagacgacgtttgggtgaattacttcggcggaatgggggagttcccaaatgctctgtacactcattgctataattggccagagatgaagttgttcgtggctggcggacccttaccctctggcctgcacggcaactacgccggtctttggagttag

SEQ ID NO: 55459 - DNA, 1803 bp, Artificial Sequence
  Description of Artificial Sequence: Synthetic coding sequence
atggccccatcctcaaagtcagagcggaatagcggggctggatccgggggagggggtccaggtggtgctggagggaaaagggctgcaggaagacgtcgagaacatgtcctgaaacaactcgagcgggtgaagattagtggccagctgtctcctcgtttgtttaggaagctgccaccaagggtctgcgtgtcgttgaagaacattgtggatgaggacttcctgtacgcgggacacatatttctgggcttcagcaagtgcggccgatacgttttatcctacaccagctcgtctggagatgacgacttcagcttttacatctaccatctctattggtgggagtttaatgtgcatagcaagctgaagctggtgaggcaggttcggctgtttcaggacgaagagatctatagcgacctctacctcactgtttgtgaatggccatcagacgcctctaaagtgatagttttcgggttcaacacaaggtcagccaacgggatgctcatgaatatgatgatgatgtccgacgaaaaccatagagatatctatgtatcaaccgtcgcagtacccccacccggtcggtgcgctgcctgtcaggatgcgtcaagggcacatcccggagacccaaatgcccagtgtttacgccacggctttatgctgcacacaaaatatcaggttgtgtatcctttccccaccttccaaccagccttccagctcaaaaaagaccaggttgtgttactgaacacatcctactcgctcgtggcctgcgccgtgagtgtccattcagctggcgacagatctttctgccaaatcctctatgaccatagtacctgccccttagcacctgcaagccctccagagccccagtctccagaacttccccctgctctgccatcattctgtccagaagccgctcctgcccgttcgtcaggatctccggaaccatcccccgcaattgccaaagcaaaagagttcgttgctgatatcttccgaagggccaaggaagctaaaggaggagttcctgaagaagcacggccagccctctgccccggaccttctggctcgcgatgtagagcccacagcgaacctttggcactgtgtggagaaactgccccacgcgactccccacctgcctctgaggcgcctgccagtgagcctggatacgtcaactataccaaactttactatgtcctggagtccggggagggaacagagcccgaggacgagttggaagatgataagatctccttaccattcgtggtgacagatctgaggggtaggaaccttcgcccaatgcgcgagcggactgctgtgcagggtcaataccttacagtggaacagctgacccttgactttgagtatgtgattaacgaagttatccgccacgatgcgacttggggacaccaattctgttcctttagcgactacgatatcgttatcctcgaggtttgccccgagacgaatcaggtgctgatcaatattgggctgcttttactggcattcccatcccctactgaagagggccagctgcgccctaagacctaccatacaagtctcaaggttgcctgggacctgaacaccggcatcttcgagaccgtgagcgtaggggacctcacagaagtcaaagggcagacaagcgggagcgtgtggtcttcctaccgaaaatcatgtgtagacatggtaatgaagtggttggtgcctgaatcctcaggtcgctatgtgaaccggatgacgaacgaagcacttcacaaaggttgttcccttaaagtcctagcagactctgagaggtacacctggatcgttttgtag

SEQ ID NO: 55460 - DNA, 651 bp, Artificial Sequence
  Description of Artificial Sequence: Synthetic coding sequence
atggggcctaggaacccttcgcccgatcacttatctgagtccgagagcgaagaagaagaaaacatttcctacctgaatgagagttcaggggaagagtgggattccagtgaggaggaggacagtatggtgcctaatctttctccattggaatcattggcttggcaggtgaaatgcctgctgaaatactcaactacgtggaagcccctgaaccctaactcatggctttaccacgcaaagttactcgacccgagcacccctgtccatatacttcgggagatcggcctgagactgtctcactgctctcactgcgtacctaagctggagccgattccagagtggccacccctggcctcctgcggtgtccctccattccagaaacccttgacttcacccagccggttaagcagggatcacgctacactgaacggcgctctgcagtttgctacaaagcaactgtcaaggaccctgtctagagctacccctatccctgaatatctgaaacagatacctaatagctgtgtgtctggctgttgctgtggatggttaactaaaaccgtgaaggagacaaccaggacggagcctatcaacacaacttactcatataccgattttcagaaagcggtcaacaagctgttgacggcatccctgtag

SEQ ID NO: 55461 - DNA, 651 bp, Artificial Sequence
  Description of Artificial Sequence: Synthetic coding sequence
atgggccctcgcaaccccagtcccgaccacctctccgaaagcgaatccgaggaagaggagaatattagctatctcaacgaaagttctggtgaggagtgggattctagcgaagaggaggactccatggtgcctaacctctctccccttgagtcactggcctggcaggttaaatgcctgctcaagtactccacgacatggaaacctctcaatcctaactcctggctctatcacgccaagcttctcgacccatccacaccagtccacattctgagagaaattgggctgcgcctctcccactgttcccattgcgtgccaaaacttgagcctatccctgagtggccacctctggccagttgtggcgtgcctcctttccaaaagccactgacgagtccttccagactgtccagggatcatgctacgctgaacggcgctctgcagtttgccaccaaacagctgtccagaaccctgtctcgtgcaactcctattcctgaatacctgaaacagatcccaaatagctgcgtgagtggctgctgctgcggttggctgacgaagacagttaaggagaccactcgaactgaacctattaacaccacttattcttacactgatttccagaaggcggtgaataagctgctgactgctagtttgtag

SEQ ID NO: 55462 - DNA, 1488 bp, Artificial Sequence
  Description of Artificial Sequence: Synthetic coding sequence
atgaataagtcccgatggcaatcaaggaggcggcatggaaggcgctcccaccagcagaatccatggttcaggctgcgggactcggaggatagaagtgacagtcgcgcagcccagcccgctcatgattcagggcacggtgacgacgaatccccttccacgagttcaggaactgcgggtacatctagcgtccccgaactccctggcttttattttgaccctgagaagaaacgttactttcgattactgccaggccataacaattgtaaccccctcacaaaggagtctatccgtcaaaaggagatggaatcgaagcggctgcgtctgctgcaggaagaagatcgcagaaagaaaatcgcccgaatgggcttcaacgctagcagcatgctcagaaagtcacagctgggatttttaaatgtgaccaattattgtcacttggcacatgagctcaggctctcttgcatggagcggaagaaggttcagatcaggtctatggacccgtccgcactggcatccgatagatttaacctgatcctcgcggacactaatagcgataggcttttcacagtgaacgacgtcaaggttggcggtagcaagtacggcatcattaacctgcaatcactgaagacccccactctcaaagtgttcatgcacgagaacctgtatttcacaaacaggaaggttaattctgtgtgctgggcaagcctgaatcacttggattctcatatcctactgtgtctcatgggtctggctgaaactcctggctgcgctactctcctccccgcttcactctttgttaacagccaccccggtattgatcggcctgggatgctgtgtagtttccgaatacccggagcctggtcttgcgcttggtccctgaacattcaggcaaataattgcttctcaaccggactaagtcgacgagttctgttaacaaatgttgtcactgggcacaggcagtctttcggcactaattcggacgttttggcacagcagtttgccctcatggcaccactcctgtttaacgggtgtagatcaggagaaatcttcgccatagatctgcgatgcggcaaccagggtaaaggctggaaggccacacggctatttcatgattccgcggtgacaagcgtcagaatattacaagacgaacagtacctgatggctagcgatatggccggaaagatcaaattatgggacttgaggactaccaaatgcgttcgccagtacgaaggtcatgtgaacgagtatgcttatctgcctcttcacgtgcacgaggaagagggaatccttgtcgctgttggccaggactgctatactcggatatggagtctccacgacgctcgactgctacggacaatccccagcccctatcccgcttccaaggcagatattcctagtgtggcattcagctctcgcctgggcggatcccggggtgcaccaggcttactcatggccgttggccaggatctgtattgctactcatactcttag

SEQ ID NO: 55463 - DNA, 1188 bp, Artificial Sequence
  Description of Artificial Sequence: Synthetic coding sequence
atggagtccaaaaggctaagactgctccaggaagaggatagacgtaaaaagattgcccgtatgggattcaacgcgtcatctatgctgagaaaaagtcagctcggctttttgaacgtcaccaactattgtcacctcgctcatgagcttcgtctttcatgtatggagagaaaaaaggtgcaaataaggagtatggatccctccgcactagcatctgaccgattcaatctgattctcgcagatacgaatagcgatcgtctgttcaccgtgaatgatgttaaggtcgggggatctaagtacggaatcatcaatctgcaaagtctgaaaactccaactttgaaagtgttcatgcacgagaacttatatttcactaatcgcaaggtaaattccgtatgttgggctagcttgaaccacctagactcccatatcctcttatgccttatgggcctggctgagacgccagggtgtgcaactctgctgcctgctagcttgtttgtgaacagtcaccccggaatcgataggccaggaatgctgtgctcttttcggatacctggggcatggagttgcgcctggtctctgaacatccaggcgaataactgtttctcaacagggttaagccgacgtgttctcctcacaaacgtcgttacgggccatcgacagtccttcggcacgaatagtgatgtgctagctcaacagttcgcactcatggccccactgctgttcaacggatgcaggtcaggggagatatttgctattgacttacgatgcggcaaccagggcaaggggtggaaagccacacgactgttccatgatagcgccgttacttcagtccgaattctccaggatgaacaataccttatggcctcagatatggccggaaaaatcaagttatgggacctgcggacaactaaatgtgtgagacaatatgaaggccacgtcaacgagtatgcatatcttcctctgcacgtgcacgaggaggaagggatactggtcgccgtcggacaggattgttacactcgcatctggtccttgcatgatgcacgtcttttaaggactatacctagcccctacccagcctccaaagccgacatcccgagtgtggcttttagcagccgcctcggaggcagccggggagcccctgggctgcttatggctgtcggccaggacctctactgctactcctactcatag

SEQ ID NO: 55464 - DNA, 1308 bp, Artificial Sequence
  Description of Artificial Sequence: Synthetic coding sequence
atgaataaatcaagatggcagagcaggcggcgacacggtcggcgtagccatcagcagaacccttggttccgactcagagattcagaggaccgcagtgacagcagagccgctcagcccgcacatgactccggccatggggacgatgaaagtccctctacctcttccgggaccgcgggaactagcagtgtccctgaattgcctggattctacttcgatcccgagaaaaagagatattttaggctactcccaggccacaacaattgcaacccccttacaaaggagagtattcggcagaaggaaatggagtctaagcggcttaggttgttacaggaggaagaccgccgtaaaaaagctgatactaactctgataggctgttcacagtcaatgacgtgaaagtcgggggaagcaaatatggtattatcaacctgcaatccctcaaaacaccaacactgaaggtctttatgcatgaaaacctctactttactaatcgtaaagtgaatagtgtttgttgggcctcattaaatcacctggattctcacatcctgctatgcctgatgggtttggcggaaacccccggttgtgccaccctgcttcctgcctcattgttcgtgaactcccaccccgctggcattgacagacctggaatgctgtgcagtttccgtatcccaggggcatggtcatgcgcctggagccttaacatccaggcgaacaactgcttcagcaccggcctgtcccgcagagtgttactcactaacgtggtcacggggcatcgccagagcttcgggactaattccgacgtgctggcccagcagttcgccctgatggccccactgcttttcaacggctgtcgtagtggtgaaatttttgccatagatctgcgttgcggcaatcaaggcaagggctggaaggccacgcgtctttttcatgactctgctgtgaccagcgtgagaatcctgcaagacgaacagtatctcatggcatcagacatggccggaaaaataaaactctgggacctgaggactactaagtgcgtgcgacagtatgaaggccacgttaatgaatacgcatacctgccattgcacgtgcacgaggaggagggtatcctcgtcgctgtgggacaggactgttacactagaatttggtcactccacgacgccagactgcttaggaccattccgtcaccttacccggcaagcaaggccgacattccgtctgtggccttttctagcaggctgggcggttcgaggggtgccccaggcctgctgatggccgttgggcaggacttgtactgctattcatacagttag

SEQ ID NO: 55465 - DNA, 1470 bp, Artificial Sequence
  Description of Artificial Sequence: Synthetic coding sequence
atgaacaaatccagatggcagtccaggcggaggcatggcaggcgttctcaccagcagaatccatggttccggctccgcgattctgaagacagatccgacagtcgagctgcacagcctgcccatgacagcggacacggcgatgacgagtcacccagcacaagcagtggaactgcgggaacatcctccgtgcctgagcttccaggtttctattttgatcccgagaaaaaacgttattttcgactgcttccgggacataacaactgtaacccgctgactaaagagagcatccgccagaaagagatggagagtaaacggctcagactgttacaggaagaggaccgacggaagaaaatcgcaaggatgggattcaacgcctcgtctatgctgcggaaatcccagctaggattcctgaatgtgaccaactattgccatctcgcacacgagctaagactgtcatgtatggagcgaaaaaaggtgcagatcagatcaatggatccatctgcactggcctccgatcggttcaacctcattctcgccgacacgaattcagacagattatttactgtgaatgacgtgaaggtgggcggatcgaagtatggcataatcaatttacagtcccttaagacgccaaccctgaaggtgtttatgcacgaaaatttgtactttactaacaggaaagtgaactctgtctgttgggcttctctgaaccatttagacagtcacattcttctatgtttgatgggtctcgctgagacgcccggatgcgctaccctgctccctgcgagcctgttcgtgaacagccacccggctggcatcgaccgacccggaatgctgtgcagcttccgtattcccggagcctggtcgtgcgcttggtcactgaacattcaggccaacaactgttttagtaccggactgtcacgtagggtactcctgacaaacgtagtaactgggcacaggcagtcttttgggacaaacagcgatgtgctcgctcccctgctgtttaatggctgtcggagtggcgagatctttgcgatagatctccgctgcggcaaccaggggaagggatggaaagcgactcgtcttttccatgatagcgctgttacaagcgtgagaattctacaggatgaacagtacttgatggcgtccgatatggctggcaagataaagctgtgggacctcagaaccaccaagtgcgtgagacaatacgagggccacgttaatgaatatgcttatctccctttgcatgttcatgaggaggagggcatcctggtagccgtcgggcaggattgctacactcgcatctggtccctccatgatgcacggctgttgaggacaattcctagcccctatccggctagcaaagccgatattcccagtgtggcgttttctagccgactaggcggtagccggggagcgccaggactgctgatggcagtaggacaggatctctattgctattcgtactcatag

SEQ ID NO: 55466 - DNA, 1191 bp, Artificial Sequence
  Description of Artificial Sequence: Synthetic coding sequence
atggaagcagagcgcctaaggctgttagaggaggaggcaaaactgaaaaaggtggccaggatgggatttaatgcttctagtatgctgcgaaaatcgcagctgggattcctgaacgttaccagctatagcaggttggccaatgagctgagagtgtcatgcatggagaggaagaaagtgcaaatccgctcattggacccttctagcctggctagtgaccgttttaactttattctcgccagtaccaatagtgatcagctgtttgttgtgaatcaggtggaggtggagggctccaaatatggcattatttcactcagaactctgaaaatcccgtccttccatgtttacgtcctgcgaaacctatatgtgccaaaccgtaaggttaaatccttatgttgggcatcactaaaccagctagactcacacgtgctgctatgctttgaagggatcactgacgcccctagctgtgcagtgctactgcccgcttcccgctttctgagtgtgcacacacgagtgaaccagcccggaatgctgtgcagcttccaaattcctgaggcgtggtcgtgcgcctggagccttaacactagggcttaccattgcttttcagctggactctcccagcaggtgcttttaacatccgtcgccaccggccaccagcagagctttgacacatcttccgacgttctcgcccaacaattcgccagcactgcccctctcctcttcaacggctgcaggagcggggaaatcttcgctattgaccttaggtgccggaatagaggtaaaggctggcgcgcaacccggctgtttcacgattctgcagtgacatccgtccaaattttacaggaggagcaatgcttaatggcttcagacatgactggtaaaattaagctatgggatctgcgggcaactaagtgcgtcaggcagtatgaaggccacgtgaatgagagtgcctacctgcctctgcatgttcatgaggaggagggaatcgtagttgccgtcggccaagattgctatactaggatctggtctctgcacgatgcccaccttttgagaaccatccccagcccatatagtgcctcggaagacgatatcccaagcgtggcattcgcttctaggctggggggtatccgtggagcagcaccgggtctcctcatggctgtgcgccaggacctttattgtttccccttttcttag

SEQ ID NO: 55467 - DNA, 1188 bp, Artificial Sequence
  Description of Artificial Sequence: Synthetic coding sequence
atggagagtaaaaggcctcgccttctcgaagaggctgacaagcagaaaaaaaccgtccgggtgggactgaatgcaccttccatgctgcggaagaaccagctcggttttctaagattcgccaattactgccgcatcgcacgggagctgcgggtgagttgcatgcagcgcaagaaagtgcagatccactcatgggaccctagtagcctggcctcagacaggtttaacagaatattggccaataccaatactgatcagctgtttactgtgaatcaggtggaggcgggagggagtaaatatggaattattaccatgcgcggactgactactccagagttacgtgtatatccacataaaacactatatgtgccaaacagaaaagtgaatagtatgtgctgggcaagtttgaaccatttggacagccatctcctcttgtgttttgtggggctggcagacacgccatcttgtgccgtgctgctgcccgcttccctgtttattggctccttcccgggaatgcgcaggcctggaatgctgtgtagctttcagatccctgacgcttggtcctgcgcgtggtctctcagcatccacgcttatcactcgttctccactggcctgtcacaacaagtgttactaaccaatgtagttactggccaccaacaatccttcgggacgtccagcgacgtgctggcccaacagttcgcgatcatgacacctctgctgttcaatgggtgccggtcaggcgagatattcggaatcgacctgcgttgtggaaatcagggctccgggtggaaagccatctgccttagccacgatagcgcagttacctcactacaaatcctccaggatggccagttcctggtcagctcggacatgaccggcacaatcaagttgtgggatctgcgggctaccaagtgcgtgactcagtatgagggacacgtgaataatagtgcgtatctgcccgtgcacgtaaatgaagaggagggtgttgtagccgctgtgggacaggactgttacaccaggatctggagtctccggcatggccacctgttaaccactattccatctccataccctgcctccgagaatgatattccctctgtggctttctcctcaagactgggcggatttcgcggagctccagggctcttgatggctgtgcgggaggatctatattgcttcagctatgggtag

SEQ ID NO: 55468 - DNA, 1803 bp, Artificial Sequence
  Description of Artificial Sequence: Synthetic coding sequence
atgtcccatcaagagggctcgaccggcggattgcccgacctggtgacagagtccctcttctcgagtccggaggagcagagcggggtggcagcggtgacagctgcatccagcgatatagagatggccgcaacagaaccctctacaggcgatggcggagacacccgagatgggggttttctgaacgacgcctctacagagaatcagaatactgattctgaaagttcttccgaagacgtcgaactggagtctatgggcgagggccttttcgggtaccctctggttggagaggagacggagcgcgaggaggaggaagaggagatggaagaagaaggtgaggaagaggaacagcctcgcatgtgcccgaggtgtggaggaacaaaccatgatcagtgtctactggacgaggaccaggcactggaagaatggatttctagcgagacttccgcccttcccaggtcccgttggcaggtcttgacagcactgcgccagagacaactcggcagttctgctagattcgtgtacgaggcatgcggcgctaggacattcgtgcagaggttcaggctgcaatacctgctgggcagccatgcgggaagtgtgagtaccatacactttaaccagcgcggtaccagactggcttccagtggggacgacctgagggtgatcgtgtgggattgggtgagacaaaagccagtactcaattttgaaagcggacacgatatcaatgtgatccaggctaagttttttccaaactgcggtgattccaccctggctatgtgtggacatgacggacaggtgagggtggcggaattaattaacgcttcttattgcgaaaacaccaaaagagttgccaaacatagaggaccggcacatgaactggcactggagccagattccccctataagtttctcacctctggcgaggacgccgtcgtgtttaccatcgatttacgacaggataggcctgcttctaaggtggtcgtgactagggagaacgacaaaaaggtcgggctgtacaccattagtatgaacccggcaaacatctaccagtttgccgtcggcggacacgatcagttcgtgaggatctatgaccaaaggcggatcgataaaaaagaaaataatggcgtgctaaagaaattcacacctcatcatttagtgtattgtgactttccaaccaatattacatgtgttgtgtatagccacgatggcacagaacttctcgcttcctacaacgacgaagatatatatttgtttaatagcagcctgagcgacggcgcacagtacgtcaaacgctacaaggggcatcgtaacaatgacacgatcaagtgcgtaaatttttacgggccacgatcagagtttgttgtcagcggatctgattgtggccatgtattcttttgggaaaaatcctctagtcaaatcatccagtttatggagggagaccgtggcgacatagtcaactgcctggagccccatccataccttcctgtcttggcaacatctggcctggaccagcacgtgcggatatggacccctacagcaaagacggccaccgaactcactgggctcaaagatgttattaaaaagaataaacaggagagggatgaggacaatttaaactacacagatagcttcgacaatcgcatgctgagatttttcgtccgccatctgttgcaacgggctcaccagccaggttggagggatcatggtgctgaatttcccgatgaagaggaactagatgagagctcatcaacttcagatacaagtgaagaagaggggcaggatagggtacaatgcatcccctcttag

SEQ ID NO: 55469 - DNA, 1896 bp, Artificial Sequence
  Description of Artificial Sequence: Synthetic coding sequence
atgagtcaccaagaaggcagcactgacgggctacctgatttgggaaccgaatcactcttttccagccccgaagagcagagcggagctgtggccgcaaccgaggctagctccgatattgatatcgcaacgtccgagctgagcgttactgtcaccggtgacggcagcgattcacgagatgggggattccctaatgacgcctcaaccgaaaaccgctcatccgaccaggaaagcgcatcagaagatatcgaactagagagcctggaggatttcgagcactttctcatgagcggagagagtctgtttcattacccccttgtcggggaggaagagaccgagcgtgaggaggaggatgaagagattcaggaagagggaggcgaggaagaagaagaagaggaggaggaggaagaggaggaagaagaggaagaggaagaagaagaggagcagccgagggcaggtccacaagggagcggtggcaatcatgagcagtattcgctcgaggaggatcaggcactggaagagtgggtctccagcgaaacttccgcattgccaaggccccgttggcaggttgtgaccgctctgcaccagaggcaactgggatctcgcccacgctttgtgtatgaagcctgtggggcacgtgcatttgtgcagagatttcggctgcagtacagactagcagaccacgtgggttgcgtaaatacggtgcacttcaatcaacgaggaaccaggttagcttcgtccggggacgacctgaaagtgattgtctgggattgggttcggcagcggccagtgctgaactttgagagcggccacacaaacaacgtgtttcaggcaaagtttctgcccaattgcggcgatagtactctagcaatgtgtgcgagagatggccaggtacgggtggcggagctgatcaacgcaagctacttcaataatacaaagtgcgtcgcacagcaccggggacccgctcacaagcttgccctcgaacccgatagcccctacaagttcctcacaagtggcgaagacgctgtggtgtttacaattgatctgaggcaggaccgaccggcaagcaaagtcgtcgttacaagagagaacgataagaaggtgggcctgtacaccatcacagtgaatcctgctaatacataccagttcgctgtaggcggtcaggaccaattcgtcagaatatatgatcagcggaaaatcgacaagaaggaaaataacggggttctgaagaagtttaccccccaccacctggtgaactgtgattttccaaccaatattacctgtgtcgtctattcgcatgatgggactgaactgttggccagctataacgacgacgacatctacttgttcaattcgagtcattcagatggggcacagtacagcaaaaggtttaagggtcaccgcaataacactaccgtgaaaggtgtcaacttttatggccctcgatccgaatttgtggtgtctggatcggattgtgggcatatcttcttctgggagaaatcaagttgtcaaatcatccagtttctcaagggaagcagggaagggactataaattgtctggagccccacccctacctacctgtactcgcctgttctggccttgaccacgatgtcaaaatctggacaccaactgccaaggcggctactgagctaaccggtctgaagaaggtgattaagaagaacaagtgggagcgcgacgaggatagcttgcaccacggttcattgtttgatcagtatatgctgtggtttctgcttcggcatgttacacagagaggaagacaccaggattggcgcagcggtgaggctgaatttcccgacgaggagagtgatgagtccagctcaacttcagagacgtccgaagaggaagttcaggatcgcgtccagtgtatgccctcgtag

SEQ ID NO: 55470 - DNA, 1452 bp, Artificial Sequence
  Description of Artificial Sequence: Synthetic coding sequence
atgagcaccgccagaactgaaaacccagtcattatggggctgtcctctcagaacggacagcttagagggccagtcaaacccacggggggaccgggaggagggggaactcagactcagcagcagatgaaccaactgaagaacacaaatacaatcaataatggcactcagcagcaggcacagtcaatgacgacaacgatcaaacccggagatgattggaagaagacactcaaactccccccaaaggatcttcggatcaagacttcggatgtgacctccaccaagggcaatgaattcgaggactattgtttgaaaagggagctcctgatgggcatatttgagatggggtgggagaagccaagtcctatccaagaggaatccattccaattgcgctcagtggcagagacattcttgctcgcgctaaaaacggaacagggaaaagcggtgcctatttaatcccactgctagagaggcttgatttaaaaaaggacaacattcaggccatggtgattgtgcctacccgcgagctcgccctccaggtgtcacagatttgtattcaagtctccaagcacatggggggagccaaagtgatggccacaacgggcggaacgaacctgcgagacgacatcatgagactggacgataccgtccatgtcgtaatcgccactcccggtagaattctggaccttatcaagaaaggagtggctaaggttgaccatgtccaaatgattgtcttggacgaggccgataagctgctgagtcaggacttcgtccagatcatggaggatatcatcctgaccctgcccaaaaaccggcaaatactgctgtactcggctacttttccactttccgttcagaaattcatgaactcacacctgcagaaaccatatgagataaacctcatggaggaactgactctcaagggcgtgacacagtactacgcttacgttacagaacggcagaaggtgcactgcctgaacacccttttcagccgtctgcagatcaaccagtcaataatcttttgcaattcaagccaaagggtagagttactcgccaaaaagatctcccagctgggctattcctgtttttatattcatgctaaaatgaggcaggaacaccgtaacagagtgttccacgactttaggaacggactgtgtaggaatctggtgtgcaccgatctgttcacgcggggaatcgacatccaggccgtcaatgtggtgataaacttcgactttccgaaactggccgagacctacctgcatcgcatcgggagaagcggaagatttggacatctcgggttagcaatcaacctgattacctatgatgaccgcttcaatctgaagtccatcgaggaacagctgggaacggaaataaaaccaattccgtcgaacattgacaagagtttatacgtggccgagtatcacagcgagcctgttgaggacgaaaaaccctag

SEQ ID NO: 55471 - DNA, 1452 bp, Artificial Sequence
  Description of Artificial Sequence: Synthetic coding sequence
atggcaggattcgccgaattggggttgagcagctggctcgtggaacagtgccgccaactgggcctcaagcaacccaccccggtacagctcggttgtatccccgctatcttagagggtagagattgcttgggatgtgcgaaaacaggatctggcaagactgctgccttcgttttgccaatcctgcaaaaactgtccgaggacccatatggaatcttttgcctggtactcaccccaactcgggaattggcttatcagattgccgaacagtttcgggtgctgggcaagcccttaggactgaaagactgcatcatcgtcggcggtatggacatggtggcgcaggccctagagttatcgcgtaagccacatgtggtgatagcaacccccggacgtctggcggaccatctccggtcgtccaacaccttttcaattaagaagatccgttttctcgtgatggacgaggctgaccgactcttagagcagggatgtactgatttcaccgtagatctggaagccattctggccgcagtgcctgctagacggcagaccctcctcttttccgccacccttaccgacaccttgcgggagctgcaaggtctggctacaaaccagcccttcttttgggaggcacaggctccagtgtcaacggtagagcaattggaccagcggtatctgctagtgcctgaaaaagtcaaagatgcctacctggtacatttgatccaacggtttcaggacgagcacgaagactggtcaattataattttcaccaacacatgtaaaacatgtcagatcctgtgtatgatgctgcgcaagtttagctttcccactgtagctttacattctatgatgaagcagaaagaacgcttcgcagccctagcaaaatttaaaagcagtatatatagaatcctcattgctacggatgttgcgtctaggggattggacatccctactgtgcaggttgtgatcaaccacaacacaccgggactccctaagatttacattcatagagtcggtagaactgccagagccggtaggcagggccaggctattacactcgtcacccagtacgatatacacttagtgcatgccatcgaagagcaaattaaaaagaaactagaagagtttagtgtggaagaggctgaggtcctacagattctgacccaggttaatgtggtccggagggagtgcgaaataaagctggaggctgcccatttcgacgagaagaaagagatcaataaaaggaagcagctcatactcgaaggtaaggatcctgacctcgaagccaaacggaaagctgagcttgcaaagattaaacagaagaatcgcagattcaaggagaaggtggaggaaacgcttaagagacagaaagcaggccgagctggtcacaagggcagacctccacggaccccaagtggaagtcattcaggcccagtgccaagccaggggttagtgtag

SEQ ID NO: 55472 - DNA, 765 bp, Artificial Sequence
  Description of Artificial Sequence: Synthetic coding sequence
atggatatggtcgcacaggctcttgagcttagccgtaagcctcacgtagtcatcgctaccccagggaggctggctgatcacctaaggtcctccaacacgttttccatcaagaagattagatttttggtcatggatgaggctgaccggctgctcgagcagggatgcaccgactttactgtggacttagaggctattctggccgctgttcccgcacgtagacagaccttactcttttccgcaactctgaccgatacacttagggaactgcagggtctcgctacaaaccagccattcttctgggaggcccaggcgcctgtgtctactgttgagcagttggaccagagatacctactcgtgcctgagaaagtgaaggatgcctatctcgtgcacctgatacagagatttcaagacgaacacgaggattggtctattatcatttttactaatacctgcaaaacttgtcagatactgtgtatgatgcttcgaaaattttcattcccaacagtggcactgcacagtatgatgaaacagaaggaacgtttcgccgctctggccaaatttaagtcatccatttaccgtatcctcattgccactgatgtagctagtaggggcgcagaccagccacccctgccacctggcgcttggacaagtctgcgttaccggtggtcctctaccaccacccccccaggcagccctagatctacctccacagagagcgcgggacgcccagtgcagggcggtcgagtccgacccagtaggtggtag

SEQ ID NO: 55473 - DNA, 1803 bp, Artificial Sequence
  Description of Artificial Sequence: Synthetic coding sequence
atggagcacgtcaccgagggcagttgggagtctctgcccgttccactccatccccaggtgctgggggctttgcgggagctgggcttcccttatatgacccctgtccagagtgccacaatccctctgttcatgaggaataaggacgtcgctgctgaggccgttactggctctggcaagactctagcctttgtcatccctatcctggagatcctgctcagacgcgaagagaagctgaaaaaatcccaggtgggcgctattattattacacccaccagggagctggctatccagatcgacgaagtgttgtcgcatttcaccaaacactttcctgaatttagtcagatcctctggattggcggtagaaaccccggtgaagacgtggagagattcaaacagcaagggggtaatatcattgttgccacacccggacggctggaagatatgtttagaaggaaggccgagggactggatttagccagttgtgtgcgttcgttggacgtgttggtgctagatgaagccgataggcttctcgacatggggttcgaggctagcataaacaccatccttgagtttctgcccaaacaacgtcgtacgggtctgtttagcgccacccaaactcaagaggtggagaacctggtgcgagccggattgcgcaatcccgtgcgggtgtcggtgaaggaaaagggggtggctgcaagctctgctcaaaaaacgccctctaggctggagaactattatatggtgtgcaaagcagatgagaagtttaatcagctcgtacattttctcaggaaccataagcaggaaaagcatctggttttttttagcacatgcgcttgtgtggaatactacgggaaggctcttgaggtcttagtgaaaggagttaaaattatgtgtatacacggtaagatgaaatataaacggaataagattttcatggaatttcggaagttacagagtggcatcctggtgtgcacagatgttatggcacgcggaatcgatattccagaagtcaattgggtgctccagtacgatcccccttctaatgccagcgcgttcgtgcaccgatgcgggcgtaccgcacgcatagggcatgggggatcggccctggtctttctgctgcccatggaagaatcttatatcaattttcttgccattaaccaaaagtgcccccttcaggagatgaagcctcagaggaataccgccgatttgctgccaaagctcaagtccatggctttagcagaccgagctgtctttgagaaaggaatgaaggcctttgtcagttacgtgcaggcttacgcaaagcatgagtgcaacctgatctttcggcttaaggatctcgattttgcaagcctggctaggggatttgctctgttacgcatgccaaaaatgcccgaattacggggaaagcagttcccagattttgtgccagttgacgtcaacactgacaccatcccatttaaggataagattcgggagaaacagcgacagaaactcctagagcagcagaggagggaaaagacagagaatgagggcaggagaaaattcattaagaacaaagcttggtctaagcagaaagcgaaaaaggagaagaaaaagaagatgaatgaaaagcgcaagagagaagaggggtccgacatagaggacgaggacatggaggagctcctgaacgacaccagattgcttaagaagctcaaaaaaggtaaaatcaccgaggaagaatttgaaaagggtctgctgacgactggaaagcgtacgattaagactgtagatcttgggatctcagatctggaagacgactgttag

SEQ ID NO: 55474 - DNA, 1062 bp, Artificial Sequence
  Description of Artificial Sequence: Synthetic coding sequence
atggagcatgtcaccgaaggatcctgggaatcgctgcctgtccctctacatcctcaagtgctgggcgcactgagggaacttggcttcccatatatgactcctgtgcagtcggcaacaatcccactctttatgcggaataaagacgttgccgctgaggccgtcactggctctggaaaaaccctggcatttgtaattcctatcctggagatcctgctgaggcgtgaggagaaactcaagaagagccaggtcggtgctataataataacaccaactcgtgaactggccatccagatcgatgaagtgttgtcacacttcacaaagcacttccctgaattttcccagatcctgtggatcggcggacgaaaccccggagaggatgttgagagatttaaacagcagggtggaaacatcattgtcgctactcccggacggctcgaggatatgtttcgccgaaaggccgagggtctggacctcgcatcttgtgtcaggagcctggacgtcctcgtcttggacgaagcagatcggctcctggatatgggcttcgaagctagcattaacactattctcgagtttctgccaaagcaaagaagaacggggctattctctgctacccaaactcaggaggtggagaatctcgtgcgtgctggactgcggaatccggtgcgggtatccgtcaaagaaaagggtgtggccgcttcgagcgcccagaaaacaccctcaagactggaaaactattatatggtatgtaaagcagacgagaagtttaatcagctcgtgcacttcctgcggaaccataagcaggagaagcatctggtgtttttcagcacctgtgcctgcgttgaatactacggcaaagcgctggaagtgctcgtaaagggcgttaagattatgtgtatccacggtaaaatgaagtataagcggaataaaatttttatggaatttagaaaactgcagtccgggattcttgtgtgcactgatgtcatggcccgtggaatagacatcccagaggttaactgggtgttacagtatgatcctcctagcaacgctgtcttgccatgttag

SEQ ID NO: 55475 - DNA, 1860 bp, Artificial Sequence
  Description of Artificial Sequence: Synthetic coding sequence
atgtttgtccccaggtctctgaagataaaacgaaatgccaacgacgacggaaagagctgcgtggccaagataataaaacctgatcccgaggatttgcaactggacaagagtcgggacgttcccgtcgacgccgtagctaccgaggccgcaacgattgacaggcacatatctgaatcctgccccttcccgtcaccgggtggccaactcgccgaagtgcatagcgtttcaccagagcagggcgctaaggactcacacccatctgaggagccggtgaagtcctttagcaagacccagcgctgggcagagcccggagagccgatatgcgtggtgtgcggacggtatggggagtacatctgtgacaagaccgatgaggatgtgtgctccctggaatgcaaggcaaaacatttactgcaagtgaaggagaaagaggagaagtccaagcttagtaatcctcagaaggcggattcagagcctgagagccctctgaacgcaagctatgtgtataaggagcaccctttcatcttaaatctgcaggaggaccagattgagaatttgaaacagcagctcggtatcctggtgcaagggcaggaggttacacgccctataatcgactttgaacattgtagccttccggaagtgcttaatcataatttgaaaaagtcgggatacgaggtgcccaccccgatacagatgcagatgatccctgtcggcctacttggcagagatatcctggccagcgccgatacagggtccggtaagacggctgcattcctgctaccggtaattatgagggctttattcgagagtaagactccctccgcccttatactaacgccaacgagggagctggccattcagattgagagacaggcgaaagagctgatgtctggcctccctcgcatgaaaaccgtgcttctggtcgggggtctcccactgcctccccaattgtatagactgcagcagcacgtgaaggttatcatcgccaccccagggagactcctggatattattaagcagtcatctgtggaactgtgcggcgtcaaaatcgtggtggtggatgaggccgacactatgctaaaaatgggttttcaacagcaagtgttagacatactggagaatatccccaacgattgccagacaattctcgtctcagctacaattccaacttctatcgagcagcttgctagtcagctgttacacaatcctgttagaatcatcaccggggagaaaaacttgccatgtgccaacgttcggcagattattctttgggtggaagacccagcaaagaaaaaaaagctttttgaaatcctcaacgacaaaaaactgttcaaaccccctgtgcttgtgttcgtcgactgtaaactgggcgctgacctcctgagcgaagcagtccagaaaataaccgggctcaagagcatttctatacattctgaaaagtctcagatcgagcgaaagaatatcctaaagggtttgctggaaggtgactatgaggttgtggtgtcaactggggtcctgggaaggggcctggacctcatctccgtgaggctcgtggttaacttcgatatgccttcaagcatggatgaatatgtccatcaaataggccgagtcggacgcctgggccagaatgggaccgccatcaccttcattaacaacaattcaaaaagattattctgggacatagcaaaacgagttaagccaaccgggagtatcctgccgcctcagttgttaaattctccttacctgcatgaccagaagaggaaggagcaacagaaagacaaacaaacccagaacgacttggttactggggcaaatctgatggacattataaggaagcatgacaagtccaactctcaaaaatag

SEQ ID NO: 55476 - DNA, 618 bp, Artificial Sequence
  Description of Artificial Sequence: Synthetic coding sequence
atgaaaacagtgctgctggtgggaggcctgcctctgccacctcagttgtacaggctgcagcagcacgtcaaagacaagaagctgtttaaaccccctgtattggtttttgtggactgtaagctgggagcagatctgctgtctgaggcagtgcaaaaaataacaggactgaagtccataagtatccacagcgagaagtcccagatcgaacggaaaaacatcctgaagggactccttgagggggactacgaggtggtcgtgtctacgggagttcttggtcgtggtctcgatctcatatcggttcggttagtcgttaatttcgatatgcccagcagtatggatgaatacgtgcatcagattgggagggtagggcgtttgggccagaatggaactgctatcacattcataaataacaacagtaagagacttttttgggacatcgcgaaacgagtgaagcccacgggcagcatcctcccaccacaattgctgaactccccttatttgcacgatcagaagcggaaggaacagcagaaggataaacagacccaaaatgatctagtgaccggtgctaatctgatggatatcatacgcaagcatgataagtcaaactcacagaaatag

SEQ ID NO: 55477 - DNA, 1704 bp, Artificial Sequence
  Description of Artificial Sequence: Synthetic coding sequence
atgtttgttccacggagcttgaaaatcaaaaggaacgccaacgacgacgggaagagctgtgtagcaaagattattaaacccgatcccgaggatctccagctggataaaagtcgggacgtacctgttgacgcagtggctacagaagccgcaactatcgatagacatatctcagaatcttgtccatttcctagccccggtggccagctcgcagaagttcacagcgtcagcccagagcagggagccaaagatagccacccgtctgaggagcctgtgaagtctttcagcaaaacacaacggtgggcggagccaggcgaaccaatctgtgtggtgtgtggaaggtatggggagtacatctgtgacaaaactgatgaggacgtgtgcagcctcgagtgtaaggctaaacatctactgcaggtaaaagagaaagaggagaaatctaaactgtctaacccccagaaggccgattctgaacctgagtcacctttgaatgccagctacgtgtataaagaacaccctttcatcctcaacctccaggaagatcaaatcgaaaacctcaaacagcagctcgggatcttagttcagggacaagaagttaccaggccaattatagacttcgagcactgctccctgcctgaagtgctcaatcataatctgaagaaaagcggatatgaggttccgacgcccattcagatgcagatgatccccgtgggcctcctgggcagagatatcttagctagtgctgatactggtagcggaaagactgccgcatttctccttccagtcattatgcgggcattgttcgaatctaagactcctagcgcgctgatcctaacacccacacgagaacttgctatacagattgagaggcaggcaaaggagctgatgagcgggctgcccaggatgaaaaccgtcttgttggtcggtggcctcccacttccacctcagctgtacaggctgcagcaacacgttaaggtcattatcgctacacctggaagacttctggacataatcaagcaatcaagtgtggagctctgtggagttaagatagtagttgtggatgaggcagacactatgctaaagatgggtttccagcaacaggtcctcgacatcctcgaaaacataccgaacgattgccagaccattcttgtatctgctactataccgacctcaattgaacagctggccagccagttgctgcacaaccccgtacgaataatcactggcgagaaaaaccttccctgcgctaacgtgcggcagatcatcctgtgggtagaagacccagctaaaaagaaaaaactgttcgaaatcctgaacgataaaaagttattcaaacccccagtcttggtgttcgttgattgcaaacttggcgctgacctgttatctgaagcagtccaaaaaattacaggcctgaagtctatcagcatccatagtgagaagtctcagattgagagaaaaaatattcttaaagggctgctggagggggactacgaggtggtggtttcaactggagtgttgggcaggggattagacctcatcagcgttaggctggtagttaactttgacatgcccagctcgatggatgaatatgtgcatcaactgaacattatctgggtggtgcccttctcaggcattaacattaacgctagtcttatcgctctgttgtacagcttactgacaactattaacatgaagtttacaccatag

SEQ ID NO: 55478 - DNA, 486 bp, Artificial Sequence
  Description of Artificial Sequence: Synthetic coding sequence
atgtttgttccaagatccctgaagatcaaaaggaacgctaatgacgatggaaaatcctgcgtggccaagatcattaaaccggacccagaggatcttcagcttgacaagtcacgagatgtgccggtcgacgcggtcgccactgaggctgccacaattgaccgccacatatctgaaagctgtccttttccgagtcctgggggtcagcttgccgaggtgcacagcgttagccctgaacagggcgcaaaggattctcacccctcggaagagccggtaaagtccttttccaaaacccagaggtgggcagagcccggagagccaatctgcgttgtctgcgggcgttatggagagtatatttgcgacaaaaccgacgaagatgtctgtagcctggaatgcaaggccaaacatctgctgcaggtgaaggagaaggaggagaagtcgaaattgtcaaatccccagaaagccgatagcgagcctgagtccccttag

SEQ ID NO: 55479 - DNA, 1743 bp, Artificial Sequence
  Description of Artificial Sequence: Synthetic coding sequence
atgtttgttcctcggagcctaaagatcaagcgcaatgccaacgacgatggtaagtcctgtgtagctaagatcataaagcccgatcccgaagatctccagctggataaatcaagagacgttccagtcgacgcagtggcaaccgaggcagcaactattgacaggcatattagtgagagctgtcctttcccctccccaggagggcaactggcagaagtccactccgtctcgcccgaacagggcgctaaagattcgcacccctccgaagagccagtgaaaagtttctctaaaactcagcgctgggccgagcccggagagcccatttgtgtggtgtgtggtagatacggtgagtacatatgcgacaagacggacgaagacgtctgctccctggaatgcaaggcgaagcaccttctgcaagtgaaggagaaagaagagaaatcaaaactgtcaaacccccaaaaagccgactcagaacccgaatctcccctgaatgcttcttatgtctacaaagagcacccgttcattttgaatctacaggaagatcagatagagaatcttaagcagcaactgggcatattggtgcagggacaagaagtgacccggccaatcatcgactttgagcactgcagcctgcccgaggtgctgaatcataacctcaagaagtcgggttatgaagtcccaacccctattcagatgcagatgattccagtcggcctcctgggacgggatatcctagcctcggccgatacaggcagcggtaagacagcagcttttctgcttcccgtgatcatgcgagcattattcgaaagcaaaacaccctcagccctgatcctcacgcctacgagagagctggccatacagattgaacgccaggccaaggagctgatgtccggactccccaggatgaagacggtgcttctcgtgggcggtttacctctgccaccccagctgtaccgactccagcaacacgtgaaggtcataatcgccacacccggacggctgctcgatattattaagcagtcatccgttgagctctgtggtgtgaagatagtggtggtggatgaggccgatacaatgttgaagatggggtttcaacaacaggtgctcgacatcctggagaatatccctaacgattgtcagaccattctggtgtccgccaccattccaacaagtatcgaacagttggcgagccagctgctgcacaatcccgtgcggataatcacaggcgagaagaatctcccctgtgcaaatgtccggcagatcatcctctgggtggaggacccagcgaaaaagaaaaagctgtttgagatcctgaatgacaaaaaactctttaagcctcctgtgctggtgttcgttgattgtaagctgggggctgatctccttagtgaagccgtacaaaagataaccggcctgaagagcattagcatccattccgagaagtcccagatagagcgaaaaaatatcctgaagggcctcttggaaggcgactacgaagtggttgtctccacaggcgtcctaggacggggactggacctcatcagtgtccggctagtcgtcaactttgacatgcctagctccatggacgaatacgtccaccaggagaacacttacaaatcaacatggaggaacccccagcattttcaacaggacgtcaggatgactcttggatatgtagggaaggcccagtgggaggaagacaaccagctgaaggttaagctggggctgaaaaagaactgttcaagctag

SEQ ID NO: 55480 - DNA, 5120 bp, Artificial Sequence
  Description of Artificial Sequence: Synthetic coding sequence
atgggaagtaaggatcacgcagtcttctttcgagagatgacccagctgatactcaacgagatgcccaaggccggttatagctcaatcttaaacgacttcgtggaatcgaattttttcgttatcgatggggactcattgttggtgacctgtctgggtgtaaaaagctttaaatggggacagaaccttcacttcttttacctagttgaatgctaccttgtcgatttgctaagcaacggcggtcagttcactattgtgttttttaaagacgccgaatacgcctacttcgatttcccagagctgctttctctgcgcactgccctgatcctgcatcttcagcacaacacgaatatagacgtgcagactgaattttcgggttgcctctctcaagattggaagttattcttagagcagcattacccttattttcttattgtgtccgaagagggactgagtgacctacagacctatctgttcaactttttgattatacatagctggggtatgaaagtgaatgtagttctcagctccggtcacgagagtgacactctaaggttttacgcttacactatggaatccaccgatagaaaccagacgttctctaaagaaaacgagaccgtgattcaatctgcatacaaatccctgattcagcacctcgaggaaataagagtgctggtgcttgcaactcatttcgagcatttgaagtggaacgatatgatggaagaggcctaccagactttgttcttactgcagcacttatggtctgagggtagcgatattcagcgagtattgtgtgtaacaagctgtagcctgtccctgcgcatgtaccatcgggtcctggttcactcaaattgtctgtcactacaggaggtcgaagacttctgtaggctcagatgcctctgcgttgctttccagctccatctgcccctgtcccagcgtgcctgcagtagggtcattacttgctcatggatccgaaactctgacagcttccttaagatgaataaatggtgcgaatattttattctctccaacctgaacgtcttcggatgctggaatttgaatttaaatcatgtgtccgatctttacgacgagcagttgctcaagaacatcgctttttactatgagttcgagagcactcaggagccgcatctgaaccttggggacagcattagaagagactacgaggacctgtggaacgtggtgagtcatctggtcaaagagtttaacgtagggaaaagctttccactgagaactaccaggaggcacttccttaggcaggagaagtccgtgatccaggaaattagtctggaaaagatgccgagcgttggcttcatacctatgacatctgccgtgatagacgagttcgttggagacatgatgaaagatttgcccattcttaagagcgacgatcctgtggtcccatcattatttaagcagaaaacatctgacgaactgctgcattggcatgctcagcggctactttccgacgattatgacaggatcaagtgccatgtagatgaacagagcagggatccccacgtgctggatttcctgaagaaaatccaggactaccaacaattctatggcaagagtctggaatccattagcacgaaagttatcgttacccagacaactaggccgaaagaagatagctccggagcttctggtgagattctgcagaataccaaaccacatcagataactaaaaagtctaagaaaaagtctttcctcaaggaggaccaaaataaggcccagcagaacgatgatttgctgttcagcatagaggaggaaatgaaaaataacttgcattcaggaatccgaaagcttgaggattatcttacttcttgtgccagcaacagtgtcaaattcggggtcgagatgttaggtttgatcgcgtgctttaaggcgtggaagaaacactgtaggggtgagggtaaaatcagcaaagacctttcaatagcggttcagatgatgaaaaggatccactccctgctcgagcggtaccctgaaatcctggaggccgaacaccatcagtacattgcaaagtgcctcaaatatctagggtttaatgatttggctaattcgctggaccccaccttaattggcgatgacaagaacaaaaagaagtacagcattgatattggaccagctcggttccagctccagtatatgggacattatctcatcagggatgagaggaaagatcgggacccgagggtgcaggatttcatccccaatgcttggcagcaggagctgctggacgttgtggataagaatgaaagcgccgtgatagtggcacccaccagctctgggaagacttacgctagctattattgcatggaaaaggtcttgagagaaagcgacgtgggggtggtcgtttacgtagcacccgcaaagtcgcttgtcggacaggtggccgctactgtagaaaaccgctttacaaagaccctacccgctggcaggaccctgtgcggggctttcacacgtgattattgccacaatgtgttaaactgtcaggtactgattaccgtgcccgagtgtttcgaaattttgctactcgccccacacagacaaaaatgggtggagaggatcagatacgtaatcttcgatgaggttcactaccttggacgggaagtgggcgcaaagttctgggagctactgctcgttatcatccgttgcccctttttagtgctgagtgcaaccataaacaatcctaatctgcttacaaagtggctgcagagcgtaaaacaatactggaagcaggcagataaaattatggaggaaaagtgtatctccgaaaagcaggctgataagtgcctcaactttttacaggatcatagctataagaatcagtcatacgaagttcgactggttctttacggggagcgatataatgatctggagaaacacatttgtagcgtgaagcatgacgacgtgtatttcgaccactttcacccgtgcgccgcacttacaactgacataatcgagaagtacggctttcccccagacctcactctgacgccccaagagtccatccagctgtacgatactatggcccaggtgtgggagacctggcccagggctcaggagctgtgcccagaggagtttattctcttcaagaacaagattgttatcaaaaaactcgatgcgcgaaagtacgaggagaatttaaaagccgagctgaccaactggatcaagaacgggcaagtcaaaaaagtgaaaagggtgctcaaaaatctgtctcctgacagcctctcttcctctaaggatatggtgaagatgtttcctcttcttgtcgaaaaactgcgccagatggataaacttccagccatctttttcctgttcaagaacgatgacgtggggaagcgcgcaggctcggtctgtacgtttctggagaaaactgagacaaagagccatcctcacacagaatgccatagttacgtctttgcaattgacgaagtgttagagaaggtgcgaaagacacaaaagcgtatcacaaagaagaaccccaagaaggctgagaaacttgagcgaaaaaaagtgtatcgcgcagaatatataaatttcctcgagaatctaaagatactggagatctccgaggattgtacctatgcagacgttaaggcgctccatacagagattacccgcaataaagactcgacgctggagcgagttctcccccgtgtgcggttcacacggcacggcaaggaattgaaggccctggcccagaggggaatcgggtaccatcactctagcatgtactttaaagagaaggaatttgtggaaatactttttgtcaaaggccttattagagtggtgacagccaccgagaccctggcactggggatacacatgccatgcaagagcgtagtctttgcacaagatagcgtgtatctggacgccttgaactaccggcagatgtccgggcgagcgggtagacggggacaggacttactcggtaatgtgtacttcttcgacatccctctgccaaagattaaaagacttctggcttctagtgtgccagaacttcggggacagtttcctctcagcattacccttgtgctgagactcatgctccttgcttctaaaggtgacgatcctgaggatgctaaggctaaggttctatcagtgcttaagcatagcctcctcagtttcaagcgtcggagagcgatggaaacacttaagctctattttcttttttctctgcagctcttaatcaaagaagattaccttaataaaaagggcaaccctaagaaatttgcgggacttgccagctacctccacggacacgagccttcaaaccttgtatttgtgaatttcctgaaaagaggactgtttcacaatctgtgcaaaccagcctggaagggtagtcagcagttctcccaggatgtgatggaaaaactggttctggtcctggcaaacctctttgggagaaaatacatccctgcaaaattccagaatgctaatctgtcatttagccagtctaaggtgattcttgcagaactgcctgaggactttaaagcagctttatatgaatataatttagccgtcatgaaagactttgcgtcatttctgctcattgcatccaagagcgtgaatatgaaaaaggagcaccaactgcccttgagcagaattaaatttactggaaaagagtgtgaggactctcaactggtgagccatcttatgtcctgcaaaaagggacgcgtagccatttcacccttcgtgtgtctgtcaggcaacactgacaatgacttactgcggccagaaaccataaaccaagtgattcttcgaacggtgggcgtgagtggtactcaggctcctttattgtggccgtggaaactcgataaccgaggaaggcggatgcctctgaacgcatatgttctcaacttttacaaacacaactgcctgacaaggctggaccagaagaatggcatgcggatggggcagcttctcaagtgcttgaaggattttgccttcaatatacaagccatctctgatagcctgtcggagctctgcgagaacaaacgtgataacgtcgtcctggcattcaagcagctatcccagacattctacgaaaagttgcaggagatgcagattcagatgagccagaaccatttggagta

SEQ ID NO: 55481 - DNA, 378 bp, Artificial Sequence
  Description of Artificial Sequence: Synthetic coding sequence
atgggctccaaagatcacgcagtgtttttcagggagatgacccagctgatacttaacgagatgcccaaggcagggtacagttcgatactgaacgacttcgtcgaatccaatttttttgtaatcgatggggacagcctccttgtgacttgcttgggggtgaagtcttttaagtggggccagaacctgcacttcttttacctggtggagtgctaccttgtggatctccttagtaatggaggacagttcaccatcgtgttcttcaaggatgccgagtatgcgtatttcgactttccggagctcctctccttgcggacagctctcattttgcacttgcagcacaataccaacattgatgtccaaaccgagtttagcggctag

SEQ ID NO: 55482 - DNA, 3927 bp, Artificial Sequence
  Description of Artificial Sequence: Synthetic coding sequence
atgggatccaaggaccatgcagtcttcttccgcgaaatgacacaactcatactgaacgagatgccgaaagccggatatagttctatcttaaacgatttcgtggaatctaatttcttcgtgatcgatggagactcactattagtgacctgccttggcgtaaagtcgtttaagtggggccagaaccttcattttttttacctggtggagtgctatctcgtggacttgctgtccaatgggggacagtttacaattgtgtttttcaaggacgccgaatatgcctatttcgattttcctgaactgcttagtcttcggaccgctctgattctgcaccttcagcataacactaacattgacgtgcagacggagttcagcggctgtctctctcaagactggaagctctttcttgaacaacactatccctatttcctaatcgtctcagaagaggggctatcagacctgcagacttatctgtttaatttcctgattattcatagctgggggatgaaggtgaacgtcgtcttatccagcgggcacgagagtgatacactgcgattctacgcctataccatggagtcgaccgaccggaaccagacatttagtaaggaaaacgaaaccgtcatccaatccgcttacaaatctctgatccagcacttagaagagattcgagttctggttcttgccacacacttcgaacacctgaagtggaacgacatgatggaggaggcttaccagaccctttttctcctgcagcatctgtggtctgaaggtagcgacattcagcgcgtcttgtgcgtaacctcttgtagcctgtcactccggatgtatcaccgggttctggtgcattctaactgtctgagtctccaagaagtcgaggacttttgtaggcttagatgcctgtgcgtggccttccagctacacctccctctcagccagagggcgtgctcccgagtcattacctgcagctggatacggaattccgatagctttctgaagatgaacaagtggtgtgaatacttcattctctcaaatttaaacgtgttcgggtgctggaacttgaatttgaatcatgtctcggacctgtacgatgaacagttactgaagaatatcgctttttactacgagttcgagtcaacacaggaaccccacctgaatctgggggactctatcagaagagattacgaggatctctggaacgtcgtgtcacatctagttaaagagttcaacgtggggaaaagcttccctcttcgtacgacccgccgtcattttttgcgccaggaaaagtccgtgatccaggagatatcgctggagaaaatgccctcagtgggattcattccaatgacctccgctgtgatcgacgaatttgttggcgatatgatgaaggacttgcccatccttaagtccgacgatccagtcgttccgtcacttttcaagcagaagacttctgatgagctgctgcactggcatgcccagaggctgctgtcagacgactacgaccggatcaagtgccacgttgatgagcagtcgcgcgaccctcacgtgttagactttctaaaaaagattcaggattatcagcagttttacggaaaaagtctggaaagcatttctacgaaagtgatcgttacacagaccaccagacccaaggaagatagttcaggggcaagcggcgagatactccagaatacaaaacctcaccagatcaccaagaagtcaaagaagaagtctttccttaaggaggaccagaataaggcacagcagaatgacgacctcttgtttagtatcgaagaagaaatgaaaaataatctccatagtggaatccggaaattggaggactaccttacatcttgtgcctcaaattccgtcaagttcggcgtagaaatgctcggcctcattgcttgctttaaggcctggaaaaaacactgcagaggtgaaggtaagatcagcaaagacctgtcaatcgctgtccagatgatgaaaagaatacactcgttgcttgagcggtacccagagatactggaagccgagcaccatcagtatattgccaagtgcctgaaatacctgggatttaatgacctggcaaattcattagacccgactcttatcggagatgataagaataaaaaaaagtactctattgacattggccctgctaggtttcagctacagtatatgggacattatctgataagagatgaaagaaaagacagggatccaagagtccaggattttattccaaatgcctggcagcaggaactgctcgacgttgtcgataaaaatgaatctgccgtcattgtggcacctacttcttccgggaagacctacgcttcctattattgtatggaaaaggtgctccgagaatctgatgtgggggtggtggtctacgtcgccccagccaagtcactggtgggtcaggtggcagcgactgtggaaaaccggttcaccaagaccctgcccgctgggaggacgctgtgcggtgcttttacgagggattattgtcacaacgtcctgaattgccaggtcctgataacggtccctgaatgttttgagatactgcttctggccccacacagacagaaatgggtggagcggatccgatatgtgatttttgacgaggttcattatctgggacgggaggtcggggctaaattctgggagttgctcctcgtgattattaggtgcccattcctcgtgctgagcgccacaatcaataacccgaatcttcttacaaaatggctacagtccgtgaagcagtattggaagcaagccgacaagataatggaggaaaaatgcattagtgagaaacaagcagataagtgtctgaatttcctccaggaccactcctataaaaatcagagctacgaggtgcgtctggtgctctatggcgagcgctacaacgacctcgagaagcacatttgttcagtgaagcacgacgatgtatatttcgaccatttccacccttgcgccgcattaacgactgatattattgagaagtacggctttcctcctgacttaactttgactccacaggaaagtatacagttgtacgacaccatggcccaggtttgggaaacatggccaagagcccaggagctttgtcctgaggagtttattctgtttaagaataaaatagtcattaaaaagctcgatgcccgtaagtatgaggaaaacctcaaggcggagctgactaactggataaagaacgggcaggtgaaaaaggtcaagcgggtattgaagaacctgagccccgacagcctaagcagtagtaaggacatggtcaagatgtttcctctactggtggagaaattgaggcagatggataagctgcccgcaatattttttctgttcaaaaacgacgacgtgggtaagagagctgggtcagtgtgtacgtttttggaaaaaactgagactaagtcccaccctcacaccgagtgccattcatatgtatttgcaatcgatgaagttcttgagaaggtaaggaagacacaaaagcgaattagcaccaagaaaaatcccaagaaggcagagaaactggagcgaaagaaggtgtatcgtgcagaatacattaatttcctagaaaatcttaaaattctggaaatttccgaagactgtacgtacgctgatgtcaaagcactgcacacagagatcacacgcaataaggattcaaccctggagcgcgtcctgcctagggtccgtttcacccggcacggaaaagagttaaaggcattggctcagagggggataggttatcatcactcatccatgtacttcaaagaaaaggaatttgtagaaatcctgttcgtaaagggcctgatcagagtggttaccgcaacagaaacgctagcgcttggcatacatatgccctgcaagtctgtggtgttcgcacaggattcagtatacctggatgcactcaattacagacagatcatgtag

SEQ ID NO: 55483 - DNA, 5120 bp, Artificial Sequence
  Description of Artificial Sequence: Synthetic coding sequence
atggggtccaaggatcatgcggtgttcttccgcgaaatgacgcagctgattctgaacgagatgccaaaggccggatatagcagcattcttaatgatttcgtggaaagtaatttttttgtgatcgacggcgacagcctactggttacgtgcctgggtgtgaaatcattcaaatggggacagaatttgcatttcttctacctcgtggagtgttacctagtagatcttctctctaacggcggtcaatttactattgtcttttttaaagatgccgagtatgcatactttgattttcctgaactgctgagtctgcgaacagcactgatcctgcatctgcagcataatacaaacatagacgtgcagactgagttttctggatgcctgtcacaggactggaagctctttctcgagcagcactatccttatttcctaatagtgtccgaagagggcctgagcgacctgcagacatacctattcaactttctcataatccacagctggggcatgaaggtaaacgttgttctgtcttcggggcacgagtcggataccctgagattttatgcgtacacaatggagtccacagaccggaatcagaccttttcgaaagaaaatgagactgtgattcagtccgcatacaaatcacttatccaacacctagaggaaattcgggttttggttctggcaacccactttgaacatctcaagtggaacgacatgatggaagaggcgtaccagactttgttcctgttacagcacctgtggtcagagggatctgatatccaacgtgtgctgtgcgtgacatcttgttctctgtcactgcgaatgtaccacagagtattagtgcattccaattgcctatctttgcaggaagttgaggacttctgtaggcttcggtgtctgtgtgtagccttccagctgcatttacccctctcgcaacgggcttgtagccgggtaattacctgtagctggattcggaatagcgacagtttcttgaagatgaacaagtggtgtgagtactttatccttagtaatttaaatgtgttcggctgttggaatttgaatttaaaccatgttagcgatttatatgacgagcagctgctgaagaatattgccttctactatgagtttgagagcactcaagagccgcacctgaacttaggtgatagcattaggagggattatgaagacttgtggaatgtggtatcccatttggtcaaggaattcaatgtgggcaagagctttcccttgaggactacacgccgacatttcctgcgacaggagaagagcgtgatccaggaaatttctcttgagaaaatgccctcagtgggttttattccgatgacttctgcagttatcgacgaatttgtgggtgatatgatgaaagatttacctattctcaagtctgacgaccctgtggtgccaagcctgtttaagcaaaagacctccgatgaactactgcactggcacgcacagagactccttagcgacgattacgacaggataaaatgccatgtagatgaacagtcccgggacccccatgtactcgactttctgaaaaaaatccaggattaccagcaattctacggcaagtcactggaatcaatttctaccaaggtcatcgtgacccaaactaccagaccaaaggaggatagcagcggagctagcggagagattttgcagaacaccaaaccccaccagatcaccaagaagtcgaagaaaaagtcattcctaaaagaggaccagaacaaggctcagcagaacgacgacctcctgttctccatcgaagaggaaatgaaaaacaatctgcattctggcattcggaagctcgaagactacctgacatcctgcgcttcaaatagcgtcaaatttggcgtggaaatgctggggctcatcgcctgttttaaggcatggaaaaagcactgtaggggcgagggaaaaatttccaaagacctgtccattgccgtccagatgatgaagagaatccacagtcttttggaacgatatcctgagatcctggaggccgaacatcatcaatacattgcaaagtgccttaagtatctgggatttaacgacctggccaatagcctggaccctactctgattggcgacgacaaaaataaaaaaaagtacagcatcgacatcggtcctgccagatttcaactccaatatatggggcactacttgatccgcgacgagcgaaaagaccgagacccaagggtgcaggactttattccgaatgcatggcagcaggagcttttagacgttgtggacaagaatgagtctgccgtgatagtggccccaaccagcagcggaaagacgtatgcctcctactactgtatggagaaggttctgcgggagagcgatgtgggagttgtggtgtacgttgctcccgcaaagtcattggtcggacaggtggccgcaactgtagagaatagattcacgaagaccctaccggcagggaggactctttgtggtgccttcacccgggactattgccacaacgtgttaaactgccaagtgctgataacagtacccgagtgcttcgaaatacttctgctggcgccacacagacagaagtgggttgagagaatcagatatgtaatcttcgacgaggttcactacctgggacgagaagtgggggctaagttctgggaactgctgctggtgatcatccgatgcccttttctggtgctttctgctaccatcaacaatccaaatctgctgacaaagtggctccagagtgtcaaacagtactggaaacaggcagataagattatggaagagaagtgtataagcgagaaacaagccgacaagtgccttaattttcttcaagatcattcttacaagaaccagagttacgaagtaagactggtcctttacggagagcggtataacgatttagagaagcacatttgttctgtcaaacacgacgacgtgtacttcgaccatttccacccatgtgccgcactgactacagatatcattgaaaagtacggctttcctcctgatttgactctgactcctcaagaatctattcagctttatgacactatggctcaggtgtgggagacttggcctagagctcaagaattatgccccgaggagttcatcctgttcaagaataaaatcgtaattaagaagcttgatgcaagaaagtatgaggagaatctgaaggcagagctgaccaactggattaagaacgggcaggtaaaaaaagtcaaacgtgtgctgaagaatctgtctcctgacagcctgtcgtcatcaaaggacatggtgaagatgttccctctgctagtcgagaaattgcgccagatggataagctgcctgcgatttttttcttatttaaaaacgatgacgtcgggaagagggcagggtccgtctgcacgttcctggaaaagaccgagacaaaatctcaccctcacaccgagtgccattcctacgtgttcgccatagacgaggtcttggaaaaggtccggaaaacacagaaacgtatcaccaagaagaatcccaaaaaggcagagaagttagaaaggaagaaggtctacagggctgaatacatcaatttcctggaaaacttgaagattctcgagatctctgaggattgtacttatgccgacgtaaaagctctgcatacggagatcacccgaaataaagacagtacactggagagggtccttccaagggtaaggtttactagacatggaaaggagctgaaggcccttgcccagcggggaattgggtaccatcatagcagcatgtactttaaagagaaggaatttgtggagatactgttcgtgaaaggtcttatcagagtggttactgccacagagaccctcgcgttggggatccacatgccttgcaagtccgtggtgttcgcacaagattccgtttatcttgacgcattaaattatcgccaaatgagcggcagagccggacgcagggggcaggatctgctggggaacgtgtacttcttcgatatccccttaccaaagatcaagcggctcctcgccagctctgtcccagagctgagaggtcagtttccactctccatcaccttggttctcagacttatgttgttggcatccaagggggatgacccagaggacgccaaggctaaggttctttccgttctgaagcattctctgttatccttcaagcgccgaagggctatggagaccctgaagctttattttttattttccttgcaactactgataaaggaggattacctgaataaaaagggtaacccgaaaaaatttgctgggcttgcctcatatttgcatggtcacgagcctagcaaccttgttttcgtcaattttctgaagcgaggactttttcataacctgtgtaagccggcatggaaaggctcccaacagtttagtcaagatgtgatggagaaactggtgttagtgttggccaaccttttcggacgcaagtatatccccgcaaagttccagaatgccaatctgtctttctcacaatccaaggtgatcctggctgagttgcctgaggacttcaaagccgctctctacgaatacaatctggccgtgatgaaagatttcgcctcttttctactgatcgcttccaagtcagtgaacatgaagaaggagcaccagttaccgttaagccgcattaagtttacaggcaaagagtgcgaagacagtcagctcgtgtctcacttgatgtcctgtaaaaaaggacgtgttgccatatctccttttgtctgtctcagcggaaataccgacaatgacctactacgcccagaaaccatcaaccaggttatccttaggactgttggcgtatctgggacccaggcccctctgttatggccgtggaagctggacaaccgcggacgccgtatgcctctgaatgcctacgtgctaaacttttacaagcataattgtctcacccggctcgatcaaaaaaacgggatgagaatgggccagttgctcaagtgcttgaaggatttcgctttcaacatccaggctatcagcgatagtctatccgagctatgcgagaacaagcgtgacaacgtcgtgctggccttcaaacaactctcccagacattctatgaaaaactgcaggagatgcagatccaaatgtcacagaatcacctggaata

SEQ ID NO: 55484 - DNA, 234 bp, Artificial Sequence
  Description of Artificial Sequence: Synthetic coding sequence
atgggctcgaaggatcacgcagtgttttttcgagaaatgacacagcttattttaaatgagatgccaaaggcaggatactccagcattttgaacgactttgtcgagtccaacttttttgtgatcgatggtgacagtctgcttgttacatgcctgggtgttaagtcctttaagtggggacagaatttacatttcttctaccttgttgagtgttacctagtggacctgctatcttag

SEQ ID NO: 55485 - DNA, 297 bp, Artificial Sequence
  Description of Artificial Sequence: Synthetic coding sequence
atggggagcaaggatcatgctgtgttcttccgtgagatgacccagctcatattgaatgaaatgccgaaagcaggctatagcagtatcctaaatgatttcgtcgaatctaacttcttcgtgatcgatggagactcactgctggtcacatgcctgggagtgaagtctttcaaatggggacagaatctccactttttctacctggttgaatgttacttggttgatctgctctcaaacggcggtcagtttactattgtatttttcaaagatgcagagtacgcgtatttcgattttccctag

SEQ ID NO: 55486 - DNA, 2586 bp, Artificial Sequence
  Description of Artificial Sequence: Synthetic coding sequence
atgcccatcttgctttttttgattgatacaagcgctagcatgaaccagcggacagaccttggcaccagctatctcgacatcgccaagggcgcagtcgaactgttcttaaaattacgagcgagagacccagcctcaagaggagataggtacatgttggtgacatatgatgagccaccctattgtataaaagctggctggaaagaaaaccacgctactttcatgagtgaactgaagaacctgcaagcctcaggactgaccaccctgggccaagccctgagaagtagctttgacttgttgaatcttaacagactgattagtggaatcgacaactacggccagggacggaacccattcttcttagagccgagcattctgattaccataaccgacgggaataaactaacatctaccgctggggtgcaggaagaactgcacctgccccttaactcacccttacccggatctgagctaacgaaggagccattccgctgggaccagaggcttttcgcattggtactcaggctgccaggagtcgcctccactgaacctgaacagctgggctctgtccccacagacgaatcagcaatcactcagatgtgcgaagttactggtggccgtagctattgtgtgcgtacgcagcgcatgctgaaccaatgccttgaatcgcttgtccagaaggttcagtcaggtgtcgtcatcaacttcgagaaaacaggccctgaccctctccctataggggaagacgggctcatggactcgtctagacccagcaactctttcgcggctcagccctggcacagttgccataagttgatatacgttcggccaaacagcaagactggcgttcccgtgggtcattggcccattccagagtccttctggccagatcagaatctgccctcactgcctcccagaactagtcaccccgtggtgcggtttagctgtgtcgattgcgagcccatggtcatcgacaagttgcctttcgacaagtacgaactggaaccttctcccctgactcagtacatcttagaaaggaaatcaccacacacttgttggcaagtctttgtgacaagttctggaaagtacaatgagctggggtaccccttcggatatctcaaagcaagtacaacgctgacatgtgtgaatctatttgttatgccttataactatcccgtgctcctgcccctgcttgatgacctgtttaaggtgcacaagttgaagcccaatctgaagtggaggcaggcgttcgactcttatttaaaaactctgcctccttactacctgcttaccaagctagaaagcgaaagaatcctcgcctctgtgggaaagaaaccaccccaagaaatcggaatcaaagtgaagaaccactctggcggaggtatgagccttacacacaataaaaatttccgtaaacttctcaaggaaatcacaggcgaaacagctcttcggctcacagagctgaatactaaggagtttgcaggctttcaaataggactgctgaacaaggatcttaagcctcagacttaccgcaatgcctacgatatcccacggcgagggttactagatcaactgacaagaatgcgcagtaacttgctcaagacccacaaattcatcgtaggacaggacgaagattcactgcattctgttccagtggctcaaatggggaattaccaggaatatctgaaaacgctcgcctcccccctgcgggaaatcgatccggatcaacccaagcgcctccatacctttggcaacccattcaagcaggacaaaaagggaatgatgatcgatgaggccgacgaatttgtggccggaccccagaataaagtgaaaaggcctggggagcctaactccccaatgtctagcaagcgcagacgaagcatgtcccttctgctcagaaagccccagaccccaccgaccgtcaccaaccatgtgggaggcaaaggcccaccatctgccagttggttcccctcctatcctaatttaataaaacccactctggtccacaccgacgctacaattattcacgatgggcatgaggaaaagatggagaacgggcagatcacacccgacgggtttctctccaaatcggctccgtccgaactcataaacatgactggtgacttaatgccaccgaaccaggttgactctttaagtgatgacttcacttcacttagtaaggacggtctgatccagaagcccggttccaacgccttcgtaggaggtgctaagaactgcagtttatctgttgatgaccagaaagaccccgtagcctccaccttgggtgctatgccaaacactctgcagataactccagctatggctcagggaatcaacgccgatatcaagcatcagctgatgaaagaggtaaggaagttcgggagaaagtacgaaaggatcttcattctgctggaagaggttcaggggccactagagatgaagaaacagtttgtggagtttaccatcaaagaggctgcccgatttaagagaagggtcctgatccagtacttagagaaggtgctggaaaaaattaacagtcaccatctgcataacaatatctcacatataaactctaggagttcctgttag

SEQ ID NO: 55487 - DNA, 4161 bp, Artificial Sequence
  Description of Artificial Sequence: Synthetic coding sequence
atgtcgagcagcgtgaggcgcaaagggaagcccggtaaaggaggaggaaagggcagcagtcggggaggaagggggggaaggtctcacgcatccaaaagccacggcagtggaggtggaggcggaggtggcggaggagggggagggggaaatcgcaaggcttcgtcgagaatctgggacgacggcgatgatttctgtattttctcagagagtagacggccatctaggcccagcaacagtaacataagtaagggagaatcccgacccaaatggaaacccaaggctaaggttcccctgcagaccctgcacatgacttccgagaatcaagagaaggttaaggcacttcttcgcgacctccaggaacaggatgccgacgcaggatccgagaggggactgtccggggaggaagaggacgatgagcccgattgctgcaacgacgagaggtactggcccgctgggcaagagccatctcttgtcccggacctggatccgctggaatatgctggtctcgcctcagtggaaccttatgttcctgagtttaccgtctcacctttcgcggttcagaagttgagtagatatggcttcaacactgaaagatgccaggccgtgttaagaatgtgtgacggcgatgtgggggctagtttagagcatttactcacccagtgttttagcgagactttcggcgagaggatgaagatcagcgaggctgttaaccaaatctcattggatgagtgcatggaacagcgacaggaggaggcctttgctctgaaaagcatatgtggtgagaagttcatcgagaggattcagaatcgggtttggacaatagggctcgaactcgaatatttgactagcagatttcgcaagtcaaaaccaaaggagagcaccaagaacgttcaggagaacagtctggaaatctgcaaattttaccttaaagggaactgtaagtttgggtccaaatgtaggttcaagcatgaagtaccgccaaaccagatcgtgggtaggatcgagcggagcgtcgatgattctcacctgaacgctatcgaggacgcctcattcctgtatgagctggagatacggttctccaaagaccacaaatatccctatcaggccccactcgtcgccttctatagtactaacgagaatttgcccctggcttgtcgactgcacatcagcgaatttctgtatgataaagctctgaccttcgctgagacttctgaacctgtggtttattcgctgattaccctgctggaggaggagtccgaaatcgtgaaactgctcactaacacacatcacaagtacagcgacccacccgtgaattttttacccgtgccctctagaacgagaataaataatcctgcttgtcacaagaccgtgattcctaataatagttttgtgagcaatcagatccctgaagtggaaaaggcctccgagtccgaggaatcagacgaggatgatggacccgcacctgtgattgtggagaatgaaagttatgttaatctcaaaaagaagatctctaagagatatgattggcaggcaaagagtgtgcatgccgaaaacgggaagatctgcaagcaatttaggatgaagcaggctagccgacaatttcaatcaatcctccaggaaaggcaaagtttacctgcttgggaggaacgcgagactattctgaacctactccgtaagcaccaggtggtcgtcatatctgggatgacaggctgtgggaaaactacccagatcccacagtttatcctggacgacagcctgaatggtccaccagagaaggtggcgaatatcatctgtacccagcctaggcgcattagcgccattagcgttgctgaacgggtcgcaaaagaaagagccgaaagggtaggactgactgtggggtatcagatcaggctggagtccgtaaaaagcagcgccacacggctgctgtactgcacgaccggcgtccttctccgcaggctggagggagatactgctctgcagggtgtgtcacacattattgtggatgaggttcatgaacggaccgaggagagtgactttttacttttagtcctcaaggacattgtttcgcagagacccggactccaggttatcctgatgagcgcaactctgaacgctgagctgttttccgattatttcaatagttgtccggtgatcaccattcccggtaggacttttccagtcgatcagttcttcctggaggatgccatcgcggtcacaaggtacgtcctgcaggacggtagcccttatatgagaagtatgaagcagatcagcaaagagaagttgaaggcacgaagaaaccggactgcttttgaagaggtggaagaggatctccgcttgtcactgcacttgcaggaccaggactctgtaaaggacgctgttccagatcagcagttggatttcaagcaactgcttgcaagatacaagggtgtgagtaaatccgtaataaagacaatgagcattatggatttcgaaaaggtgaatctggagcttatcgaagccctgctagagtggatcgttgacggcaagcatagctatcccccaggcgctatcctggtgtttctgcccggtctcgcggagatcaaaatgttatacgaacagctccagtcaaattccctctttaacaacagacgttcgaataggtgtgttattcaccctctgcacagttctctgagttccgaggagcagcaagcagtgttcgtgaagccacccgcaggcgtaaccaagattatcatttcaacaaatatcgcggaaacgtctatcactatcgatgacgtggtttacgtaatagacagcggcaagatgaaggagaaaaggtatgacgcctcaaaaggtatggagtcccttgaggacacttttgttagccaggccaacgcccttcagcgcaagggcagggccggtagggtagcaagtggcgtctgctttcacctgttcacgtcccaccactataatcaccaactccttaagcagcagttacccgagatccagagggtgcctctggaacaattatgcctgcgaattaagatcttggagatgttctccgctcataatcttcagtcagtcttctctagactaatcgagccgccacacacagattctttgcgggcaagcaaaatcaggcttagagaccttggggcactgactccagatgagcggttaaccccgctgggataccatttagccagcttgcctgtggacgtcaggattggcaagctgatgctatttggcagcatcttccgctgtttggatccagctctcaccatcgcagccagcctggcattcaaaagccccttcgtgtctccttgggacaaaaaggaggaagcaaatcagaagaagctggagttcgcatttgccaactccgactatctggctctcctccaagcatacaaggggtggcaattaagcaccaaggagggtgtccgggcttcttacaactactgtagacaaaattttttgtcaggcagagtactgcaagaaatggcatctctcaagagacagtttaccgaactgttgtcagacatcgggttcgcacgcgaaggactgcgggctcgagaaatcgaaaagagggctcaggggggagacggggtgctggatgccacaggcgaggaggcgaatagcaatgcagaaaacccaaagttaattagtgctatgttatgcgctgctctctaccctaacgttgtgcaggtaaagtctcctgaagggaagttccaaaaaactagtacaggagccgtaagaatgcagccgaaatcggccgaactgaagtttgtgacaaagaacgacgggtacgtccacatccatccctccagtgtgaattaccaagtgagacacttcgacagcccgtacctgctgtatcacgagaaaatcaaaacatcccgggtctttattagggactgcagcatggttagcgtctatcccctggtcctttttgggggtggtcaggtcaatgtgcagcttcaacgcggtgaattcgtggtgagcctggacgatggatggattaggtttgtagcagcttcccaccaggtggccgagttggtcaaggaactgagatgcgaattggaccagctactgcaagataaaatcaaaaaccctagcatagatctgtgcacatgtccgaggggtagcaggatcatttccactattgttaaactcgtgaccacccagtag

SEQ ID NO: 55488 - DNA, 1302 bp, Artificial Sequence
  Description of Artificial Sequence: Synthetic coding sequence
atgacgtccgaaaatcaggaaaaggtgaaggccttgctgagggatctgcaggaacaggacgccgacgccggtagtgagcggggactgtctggtgaggaggaggatgatgagccggactgctgtaatgacgagcgctactggcccgcagggcaagagccctctttagttcctgatctggaccccctagaatatgccggactcgctagcgttgagccatacgtgcccgaattcaccgtgtcgccatttgccgtgcagaagctatctcggtacggattcaacacagagaggtgccaggctgttctgcgtatgtgtgacggcgacgtgggagccagcctggaacacttgcttactcagtgcttctccgagacttttggggagaggatgaaaatatcagaagccgtcaaccagatttcattggatgaatgcatggagcagaggcaggaagaagcctttgctctcaagtctatctgcggagagaagttcatcgagaggattcagaatcgggtttggacaattggacttgagctcgaatacctcacctcacggttccgcaagtccaaaccgaaagagtccacgaagaatgtgcaagagaatagccttgagatctgcaagttctatctgaaggggaattgcaaatttggctctaagtgcaggtttaagcacgaagtccccccaaaccagattgtcggacgcatcgagcgttccgtcgacgactcacacttaaatgcaattgaggacgcttcgttcctctatgagctggagatcagattcagtaaagaccacaagtacccgtatcaggcccctcttgtcgcattctattctaccaacgaaaacttgccactagcctgtagactgcatataagcgaattcctttatgataaagccctgaccttcgccgaaacttctgagccagttgtttatagtctcattacattacttgaggaggagtccgagattgtgaagcttctgactaatacgcatcacaaatattcagaccctccagttaacttcttgccagtcccatctcgcacccgtatcaataatcctgcatgtcataaaacagtaatcccgaacaattcttttgtatcaaatcagatccctgaggtcgaaaaggcctcagaatcagaagagagtgacgaagatgatggccctgcccctgtgatcgttgaaaacgaatcgtatgtcaatctcaagaagaagatcagcaagagatatgactggcaggctaagtctgtccacgctgaaaacggcaagatttgtaaacagttccgcatgaaacagattctccagagtcatctgtag

SEQ ID NO: 55489 - DNA, 1731 bp, Artificial Sequence
  Description of Artificial Sequence: Synthetic coding sequence
atgccccctccgcgaaccagggaggggagagacagaagggatcaccatcgcgctcctagtgaagaggaggccctcgagaaatgggactggaattgtcctgaaactcgtcggctcctggaggatgccttcttcagggaggaagactacatccgccaaggcagcgaggaatgccagaagttctggaccttcttcgagcgactgcagcggtttcagaatcttaaaacaagcaggaaagaagagaaagatcctgggcaacctaagcacagtataccagccttggccgacctacctagaacctatgatccccgttaccgtattaacttgtctgtcctgggaccagctactcggggaagtcagggcctaggacgacatttacccgctgagagggtggcggaattcaggcgcgctcttctgcactacctggacttcggccagaaacaggctttcgggaggcttgctaagcttcagagggaacgggcagcgctgcctatagcccagtatggaaaccggatcctgcagacccttaaagaacaccaggttgttgtcgtggcaggtgatactgggtgcggcaaaagtacgcaggtgccccagtacctcctggctgccggattctctcacgtagcatgcactcagccacgaaggattgcttgtatctcactggcgaagcgagtggggtttgaaagcctttcacagtacggcagccaggtgggctatcagatacgatttgagagtacaagatccgcagctacaaagatcgtattcctaactgttggccttctgctccgccagatccaacgggaaccgtctctcccgcaatatgaggtgctgattgtagatgaggtccatgagaggcatctccacaatgatttcctgttaggcgttcttcagaggctgctcccgacgcgccctgacctgaaggtgatcctgatgtcagctacaatcaatatctctttgtttagttcatactttagtaacgcccctgtcgtgcaagtacccggacggctattccccatcacagttttcgatgtggctcccccaggggtaagaaagtgcattcttagcaccaacattgctgagacctcagtcaccatcgatgggattcggttcgtggtcgactcaggcaaagtaaaagaaatgtcctacgacccacaggccaaattgcagcgtctccaggagttttggatttcacaagcctctgcagaacaacgcaaggggcgtgcagggcgtactggaccaggggtatgctttcggttatacgcggaatccgattacgatgctttcgctccttaccccgtgccggaaatcaggagggtagcgctggactccctcgtcctgcaaatgaagagtatgtccgtcggagaccctagaaccttcccattcattgaacctccaccccctgcctccctggaaacagctatcttgtacctccgtgatcagggggcattagacagttctgaggcacttactccaatcggcagcttgttggcccagctacctgtggatgtcgtgatcgggaagatgctgatcctggggtccatgtttagtctggtggaacccgtcctcacaatcgccgcagcactcagtgtacagagcccctttacccggtctgcacagagcagccctgagtgctgcacgcctcccgctagctctctcgccgcacctagatgctgcacccaccggtcctggaggcctgctacagcaactgaggcagaaactactagaacaagatag

SEQ ID NO: 55490 - DNA, 3432 bp, Artificial Sequence
  Description of Artificial Sequence: Synthetic coding sequence
atgcctcctccacggaccagggaagggagagatcggagggaccaccaccgggcaccctccgaggaggaagcactcgaaaagtgggattggaactgtccagaaacccgccgtctgctggaggacgcattctttagggaagaggactatattcgccaggggagtgaagaatgtcagaagttctggacttttttcgagcgactgcaacgtttccagaacctgaagacctcccgaaaggaagaaaaagaccctggccagccgaagcactccataccagctctagccgatctcccgcgtacctatgaccctcgttatcgcattaaccttagcgtgctcgggccagccacgcgagggagccaagggttgggcaggcatctaccagccgaaagggtggccgagtttcgacgggctctcttgcattacctggactttggacagaagcaggcctttgggagactggccaagctgcagcgagagcgcgctgccctgcctatcgcccagtatggaaataggatactacagactcttaaagaacaccaggtggttgtggtcgctggagacactgggtgcggaaaatccacccaggtgcctcagtacttgctcgcggcagggttcagccacgtggcatgcacgcagcctagaagaattgcttgcatcagtctggccaaacgcgtgggatttgagtcgctgtcccagtacggaagccaggtaggataccagatcaggttcgaaagtacccgtagcgcagctacaaaaattgtgtttttgactgttggcctgctcctgaggcaaatccagcgggagccttcactgcctcagtacgaagtgctgatcgtggacgaagtacatgagcggcacctacacaatgatttcttattgggcgtgctgcagagactgttgccaaccagaccggatttaaaagtgatcctgatgtctgcaaccatcaatatttctctcttctcgtcttatttttctaacgctcctgtcgtgcaagtgcctggtcgactgtttcctattactgttgtgtatcagccgcaagaagctgagccgacaacgagtaagtccgagaagctcgatccccgaccattcctgcgcgtgctggagtccatcgatcacaaatatccacccgaggagcgaggggacctgctggtgttcttgtcaggcatggccgagatatcagccgtgctggaggccgcacagacgtacgcctctcatacccagagatgggttgtgctgcccctgcactcagcactgagtgtcgctgatcaggataaggtcttcgacgttgcacctcccggagtgcgaaagtgcatcctgtccaccaatatagcagagacatcagtgacaatagacggcataaggtttgtcgtcgatagcggcaaggtaaaagagatgagttacgatccacaggctaaattgcagcgcttgcaggaattctggatttcgcaggccagtgctgagcagcggaaggggcgtgcgggtcgaactggacccggagtgtgttttagactttatgctgaatcagactatgatgctttcgctccatacccagtaccagagattcggagagtcgcacttgactctcttgtcctccagatgaaatcaatgagcgtgggagaccctaggacttttccttttatagaaccaccaccccctgccagcttggagactgccattctctatctgcgagatcagggagccctcgattcttctgaagctttgacaccaattggatctctcttagcccagctcccagtagatgtggtcatcggaaagatgttgatcctgggctctatgtttagcctggtcgagcctgtgctgacaatagcagccgcattaagtgtacagagccccttcacacgttcagcacagagtagcccggagtgcgccgcagccaggaggccattagagagcgaccagggcgacccctttacactctttaatgtgtttaacgcgtgggtgcaggtgaaatctgaacgctcccggaactcaagaaaatggtgtagaaggcgaggcattgaagagcaccggctgtacgagatggccaacctcaggaggcagttcaaggaactcctggaggaccacgggctcctagcgggtgcccaagccgcacaggtgggggacagttattctaggctccagcaacgcagggaacgaagagccctgcaccagcttaagcggcaacatgaagagggagcaggcaggaggcgcaaagtgctgcgcctgcaggaagaacaggatgggggatcctccgacgaggacagggcaggacccgcaccccctggggcaagtgatggggtggacattcaggacgtgaaatttaagctgagacacgacctggcccaacttcaggcagctgccagtagtgcacaggacctcagtagggagcagctcgccttgttaaaactggtgcttgggagaggtctctaccctcagttggccgtgccagacgccttcaactcatcccggaaggatagtgatcagatctttcacacacaggctaaacagggggctgtgctgcaccccacatgtgtgtttgccggatcaccggaagtgctgcatgcacaggagttggaagcctcgaattgtgacggatcaagagatgataaagataagatgtcatcaaagcatcaactgcttagtttcgtgagtctactggaaaccaacaagccatatctcgtaaactgcgtccgaatacccgcactccagtcgcttctgctctttagcaggagtttggataccaatggagactgtagcagactggtggccgacggctggctagaattacaattagcagatagtgagagtgcgatacggttgctggcagcgtcactgcgcctgagggctcgctgggaatccgcgcttgatcggcagttagcacatcaggcacagcagcagttggaagaggaagaggaagatactcccgtgagtcccaaagaggtggcgacactgagcaaagagctgcttcagtttaccgcgagtaagataccctattccctcagacgcctaacgggcttggaggtccagaacatgtatgttggtccccagacgatacccgcaacacctcacctcccaggtttattcggatcatctaccctctctccacacccaaccaaaggtggctacgccgtgacggattttcttacatacaattgcctgaccaacgacactgatttatattccgattgtctaaggaccttctggacctgtccgcactgcggtcttcatgccccactgactccgttggaacggattgcccacgaaaacacatgtccccaagcccctcaggacgggcctccaggcgctgaggaagccgcactggagacccttcaaaagaccagcgtgctccagcggccttaccattgtgaagcctgtgggaaagactttctcttcacacccactgaggtgctcaggcaccgcaaacagcacgtctag

SEQ ID NO: 55491 - DNA, 3474 bp, Artificial Sequence
  Description of Artificial Sequence: Synthetic coding sequence
atgggcaagctcagacggaggtataacataaagggacggcagcaggccggacccggaccatcaaaaggaccccctgaacctccccctgtgcaactcgagctcgaggacaaggatacccttaaaggggtggatgcctctaacgctcttgtgctccctggcaagaagaagaagaagacaaaagctcctcccctgagcaaaaaagagaagaaaccactgaccaagaaggagaagaaggtgttgcagaagattcttgagcagaaggaaaagaaaagccagcgtgctgagatgctccaaaaattatccgaggttcaggcctctgaagcagaaatgaggttgttttatacaacgtccaagctgggcacgggaaacaggatgtaccacacaaaagagaaggccgatgaagtggtcgctccagggcaggaaaagattagctcccttagtggagcccatcggaaacgcagaagatggccctccgccgaggaggaggaggaagaagaagaggagtctgagtctgaactggaggaagagagcgagctggacgaagaccccgctgccgagcccgctgaagccggagtcggcactactgtggctcctctgccacctgcccctgcccctagctctcagcctgtgcccgctggaatgaccgtccctccgccacctgctgctgctcctccactcccgcgtgctctagctaaaccagccgtgttcatccccgtgaacagaagtcccgagatgcaggaggaaaggctgaagctgcctatcttgtctgaggagcaggtgatcatggaggccgtagcagaacatccaatagttattgtatgcggtgaaactggtagtggcaaaacaacacaggtgccccagttcctatatgaggccggatttagctctgaggacagcatcattggcgtcaccgagccacgacgagtggccgcagttgccatgtctcaacgcgtcgccaaggaaatgaatctcagccagcgagtggtctcttatcaaatcaggtatgagggcaatgtgaccgaggagacaagaattaaattcatgactgacggtgtcctgctgaaagagattcaaaaggactttttgctgctgcggtataaggtggtcataatagacgaagcccatgagcgcagtgtgtatacagacatcttgattgggttactgagccgcatcgtgaccctacgtgccaaacgcaatctgccactcaagcttctgatcatgtcagccaccctgagggttgaggattttacacaaaaccctcgcttgttcgcgaagcctcctcctgtgatcaaagttgagtcacggcagttccctgtcacagtccacttcaataaaaggactcctcttgaggattacagcggcgagtgtttcagaaaagtctgcaaaatccaccgcatgttgcctgccggtggcattctggtttttttaaccggacaggcagaggtgcacgccctgtgtcgacggttacgtaaggcgttcccaccaagtcgcgctcgccctcaggagaaggatgacgatcagaaggacagcgtggaggagatgaggaagttcaagaagagccgagctagagcgaagaaggcccgtgccgaggttctgcctcagatcaacttggatcactactctgtcctccctgcaggagagggcgatgaggatcgggaggccgaagtcgacgaggaagagggcgcactcgattccgacttagacctggacttgggcgatggtggtcaggacggcggagaacagcctgacgcaagcttgcctctgcatgtgttgccactgtatagtcttctggcccctgagaagcaagctcaagtgtttaagccacctccggagggtactcggctctgcgtggtggcgacgaatgtcgccgagacttctctcacaatacccggaatcaagtacgtagtggactgcgggaaagtaaaaaaaaggtattatgatagagtcaccggggtttcctccttcagggtaacgtgggtgagccaggccagcgccgatcaacgagctggtcgagcaggcaggaccgaacccggacactgctatcgactctatagcagcgccgtattcggtgactttgaacaatttccccctccagaaatcactaggcgaccagttgaggatctaattttgcaaatgaaggcactcaacgtcgagaaggttattaacttcccttttccaacacccccttccgttgaggctctgctcgcggcagaggaactgctgatcgcccttggagcgctccagcccccacagaaggctgaacgggtcaaacagctgcaggaaaacaggctttcgtgccctataaccgccctgggcaggaccatggctacgttcccagtggcacccagatatgcaaaaatgcttgctctttcgaggcagcacggctgcctcccctatgctataactatcgtcgccagtatgaccgtaagagagctgttcgaggaattggaccggccagccgcaagtgacgaggaattgacgaggctgaagagcaagagagccagagtggcccagatgaagcggacatgggcaggtcaaggggcatccctcaaactgggcgaccttatggtcttactcggagctgtgggcgcttgcgaatatgccagctgcacacctcagttttgcgaggctaatggtcttcgttataaggctatgatggagatccggagattacggggacaactgactacagcagtgaatgctgtctgcccagaagctgaattgttcgtcgacccgaagatgcagccacctaccgaaagtcaagtgacatacctgcggcaaatcgtgacggccggactaggcgatcatctggcaagacgagttcagtccgaagaaatgctggaggataaatggcgaaacgcctacaagactccactactcgacgaccctgtctttatccatccttcaagcgtgctcttcaaggaactccctgagtttgtagtgtaccaggaaattgtcgagactactaaaatgtatatgaagggcgtgtcctccgtggaagttcagtggataccggcactgttgcctagctactgccaatttgacaaacctttagaggaacccgcaccgacttactgccccgagaggggcagagttctgtgccatcgtgcttcagtgttttatcgagtgggttggccgctgcctgcaatagaagttgattttcctgagggtatcgataggtataagcattttgcgcgattcctgcttgagggccaggtgtttcggaagctggccagctatagatcatgtttgctgtcatctccaggcaccatgctgaagacctgggcccgactccagccaaggaccgagtctctgctcagggcccttgtagctgaaaaggcagattgccatgaagcgctcttggctgcttggaagaaaaaccccaagtatctgctggccgagtactgtgagtggctcccacaggctatgcacccagacatcgagaaggcctggccgccaacaacggtccactag

SEQ ID NO: 55492 - DNA, 1851 bp, Artificial Sequence
  Description of Artificial Sequence: Synthetic coding sequence
atgtgccttgagaaacgatacctcgatgtccttagcgatgttaccggccctcaggtcagctgttacattactgctccctcttatgtgctccagcagctagagtgtagaatcatcaaccatatgagtagtctgatcgtgggggacaatgaggaactcgtttccaacgtaataaccatcgaatgcagcgacaaggaaaagagagttccctttcctatcggaattgccatacccttcacagcaagatacaggggaaattacagagatataatggtgaaggtgtgcgatataaacttacaatcatcgtacctgaaccctaattctctggaggggatgaagggcggttacaaggggacctgcgcttcggtgaaggtgtataaattgggcatttttagcgtagttagctgccttaaaaaagagtccttcactgttactaaaaaggggctggctctgaagtcctctatggactctcgaatttccttaaattatccccctggcgtcttcacgagccctgtgctggtccagctcaaaattcagcctgtcgacccggcattagtcgcccatcttaaggcccagcaggataccttttactccgtacagagcacctctccgctgattcacattcagcatccctcaacatatcctttccagaaaccagtcactcttttcctgccgtgttccccttatctagacaagaacaatctcggttctgagattgaccacaagagaagagcatccgcgacaatcaatagaattacccctagctacttcaatcgtaccaagatagcctctattcgcaagccacgtaagaatgcaagcgaatgtctaaaactgctggggtttagatctcaagatagcgggtggtgcgggctggatgatgtggtgaagacgattcagagcgggttagtgagcgtggagctgtacgaacatctcgagagattcattgttctgcacttgtctagtaccatggataattcacatctggtgactttcgtgaaaagcctggaagaagcaatgctgagcaccaccgcttgtatcgtgctctcccatcagaaagacaaccctcatcggatagctgtgctggtggtcccctccaaagatttgtcacaggtcctaaaagatctgcacctcgagggctttggagggccacccgaaccctcccgccactttcaggtgcgcgaaggggaacagctgttgctgaggttcacgggaaacatcttcgcgagctcaaacggaaaagattacgggaaagactatacactgatcttccacctccagaggaagccgcgactcgaacttcagattaaagaagtagacgaatttggtaattatagctgcccgcactacaaaggaactatcgtggtttacaaagtccccaaaggaaaaatcgtgcccaatctgaaccagagcctggttattaatgagaaccattcacagctacccatttgcaagcttcccctgaagctccctaagcacaagaaactcattaataggcctcaaagcacaaagagagtgtccaaagatcctgtagaggccttgtgggacaatctcctgcactggctggctgaggagctctccgaagaaaatgcggagtctctttcgtccaccctgccattgcgccgtagcacaattcagctaattaagctgaaaaaccccgacgatctgactgagcagattcatgagttcttatgtttttggaagaagagcttgccaacctttaccgataagttgaggctgctagcacgacacttgaggaagatcggcaggagcgacctcgccgaagagctcaaattcaaatgggagaacaaggtcttcactgaacctcagcagtgctttgatgtggcacccgagtag

SEQ ID NO: 55493 - DNA, 2346 bp, Artificial Sequence
  Description of Artificial Sequence: Synthetic coding sequence
atgcatgatgaatgcactccacagcagactatgtcctcaatccaggatactaaagccgctgatattgccgctcgcggagaactcaatgttatcgaaacagccaccgtgtcgccgactaatggggaagaatctcattacaccaatcaagtccagctagaaaagaataagacccatatgtctagtgctctggtggagaaagagaacaatacaagccttaacggccgagtgctcggtcaggaggagagccagaataagatgtttcctgataacgccgagaacgaggatgacaagcagattgagcacatgacagtagagaacattaatggcaatagggaagaaacccatggaatcattcagactactgaaaccgaaatacaagaaacatccgagtcccccagggaggaaatgactacaagcagcattatctgcgacatctcaaagaagtatatcaattctacgcttcccaatgactccgagaacatcaagcataagaacaacattatggaaaaggaatatctggatgtcctatcagacgtaacagggccacaggtttcatgctatataaccgcaccatcgtatgtgctgcaacaattagagtgccgtataatcaatcacatgagttcgctaatcgtaggtgataacgaagagttagtgtcaaacgtgattaccatcgagtgcagtgataaggagaaacgggtgccctttcctattggcatcgccattccattcacagctcgttatcggggaaattaccgtgatataatggtgaaggtctgtgatataaacctgcagtcaagctacttgaatcccaactcccttgagggaatgaaaggtgggtacaaggggacctgtgccagcgtaaaggtatacaagctgggaatcttctccgtagtcagctgccttaagaaagaatctttcaccgtgacaaagaagggccttgctttgaagtctagcatggatagcaggatttccctgaactacccccctggtgtgtttacttctccggttttggtacaacttaagatccagcccgtcgacccggcactagtcgcccacctcaaagcccagcaggacactttctactcagttcagtccacaagccccctaatacacattcagcaccccagcacttacccatttcagaaacccgtcacactctttcttccttgcagcccctatctagataaaaataacctggggtctgagatcgaccacaagcgcagggccagtgccacgataaatagaatcacaccttcttacttcaatcggactaaaatcgccagtatccggaagccgcgaaagaacgcctcagagtgtctcaagctgttgggctttcggagtcaggatagcgggtggtgtggcttagacgacgtagtaaaaaccatacagagcgggctcgtgagtgtagagctatacgagcacttggaacgctttatcgtgctgcacttatcctctactatggataattcccatttagtgacatttgtgaagagcctggaggaggcaatgctgtcaacaaccgcctgtatcgtactcagtcaccagaaggacaaccctcaccgcattgcagtgctggtggttcctagcaaagatctgtctcaggtcttgaaggacctgcatcttgaaggcttcggaggaccccctgaacccagccgccatttccaggttagagagggcgagcagcttctgctgcggttcaccggaaatatctttgcatctagcaatgggaaggactatgggaaagactacaccttgatcttccacctccaaaggaaacctagactggagttgcagattaaagaagtcgatgaattcggaaactattcctgcccacactacaagggaactatcgttgtgtataaagtgccgaagggaaaaatcgtccccaatctcaaccaatcacttgtgatcaacgagaaccattcacagctgccaatctgtaagcttccactgaaactgccaaagcataagaagctgataaaccgcccacaaagcacaaagagggtcagtaaggatccggtcgaggccttatgggacaacctgctgcattggctggccgaagagctgagcgaggagaacgccgagtccctctcatctacactcccacttcgtcggagtacaattcaacttatcaagctgaagaaccctgacgacctcacagagcaaattcacgagtttttatgtttttggaaaaaaagtctgcctaccttcacagacaagctcaggctcctcgcccgtcaccttagaaagattggcagatctgatctcgctgaggaattaaaatttaagtgggaaaacaaagtgtttacagagccccagcaatgcttcgatgtggcccctgagtag

SEQ ID NO: 55494 - DNA, 6390 bp, Artificial Sequence
  Description of Artificial Sequence: Synthetic coding sequence
atggctgagagaagggcttttgctcaaaaaatctccaggaccgtggcagcggaagtgagaaagcagatctccggacagtattccgggtctccacagctcctgaagaatctgaacatcgtagggaatatcagtcatcatacgactgtgcccttaacggaggcggtcgatcccgtcgacctggaagactacctgatcacccaccccttagccgtggacagcggccctctccgcgatctgattgaattccccccagacgatattgaagttgtctactccccccgtgattgcaggaccttggtgtctgccgtgcccgaagaatcagaaatggatccccacgtacgggactgcatccgatcttacaccgaagactgggccatcgttattaggaagtaccacaagctcggtacagggtttaatcccaacaccttagataaacagaaagaaagacaaaagggtctgcctaagcaggtgtttgagtcagacgaggcccctgacggtaactcttatcaggacgaccaggatgaccttaaaagacggagcatgtcaatcgatgataccccaaggggcagctgggcttgttcaatttttgatttaaaaaactcccttccagacgccctgcttcctaacctgctagaccgcactcccaacgaggagattgaccgacagaacgatgaccagagaaaaagcaatcgtcacaaagagctttttgccctgcatcctagcccggatgaggaggagccaatcgagaggctgagcgtgcctgacatacccaaggagcactttgggcagagactgctggtcaagtgcttgagccttaaattcgagattgaaattgagccaatcttcgcgagtctggctctctatgacgttaaagaaaagaaaaagatcagcgagaatttctatttcgatctcaactccgagcaaatgaaaggtcttttgagaccacacgtgcctccagctgccatcactaccctggcaagatctgccatctttagcatcacatacccttctcaggatgtgtttctcgtaattaaattggaaaaggtgcttcaacaaggggatattggtgaatgtgcggagccgtatatgatctttaaggaagcagatgcaaccaaaaacaaggagaaactggaaaaacttaaaagtcaggcagaccagttctgtcagcgactgggtaaatatcggatgcccttcgcctggacagcaattcatttaatgaatatcgtgagttccgctggatccctcgagcgagacagtacagaggtggagattagcacgggggagcgaaaaggaagctggtccgagcgtagaaattctagcattgtgggacggaggtccctggagcggacaacttccggcgatgatgcgtgtaacctcacctcttttaggcctgctaccttgaccgtcacgaacttttttaagcaggaaggtgacagactgagtgatgaggacctttacaagtttctggctgatatgcgcaggccctcaagtgtactgaggcggcttcggccaataacggcgcaactaaaaatcgatatctcacccgctccagagaacccccattattgtctgacccccgagctcctccaggtgaaactctaccctgattcaagggttcgtcctacccgggagattctggaattccccgcaagagatgtctatgtgcctaatactacatacaggaatctgctgtatatctacccccaaagtcttaattttgcgaatagacaaggatccgccagaaatataaccgtgaaagttcaattcatgtatggagaggacccatccaacgccatgcccgtaatcttcggtaagtctagctgttcggagtttagcaaggaggcatatactgcagtggtgtatcataatcgctctcccgactttcacgaagaaatcaaggtaaagttgccagctacattgaccgatcatcaccacttgctgttcacgttctatcacgtatcctgtcaacagaaacagaacacacccctggagaccccagtggggtacacatggatcccgatgttacaaaatggtaggcttaagaccggccagttctgtctgccagtgtcattggaaaagcctccccaagcctacagtgtgctttctcccgaagtgccactaccagggatgaagtgggtcgataaccataagggcgtgtttaacgttgaagtggtggccgtgtcgagcatccatactcaggacccatacctagataaattttttgccctcgtaaatgctctcgatgagcatctcttccctgttaggataggcgacatgcggataatggaaaacaatctagagaacgagctcaagagctccatatctgctcttaactccagccagctggaacccgtcgtccgattcctgcacctgctgctggataaactgatcctgctcgtcatcaggccaccagtgattgcagggcagattgtcaatttaggccaggcgagtttcgaagccatggcatcaatcatcaatcgcttgcataagaacctggaaggaaaccacgatcagcacgggagaaacagtctgttggcctcttacatccattacgtgtttaggctgcctaacacatacccaaacagcagcagcccgggtccaggcggactcgggggaagcgtgcattacgccactatggctcgcagcgcagtccggccagcttcccttaacctgaaccgctcacgctctctgtctaactcaaaccctgacatttcaggaacgccaacttcccccgacgacgaagtccgcagcattatcggtagcaaaggactggaccgctccaattcttgggtgaacactggagggccaaaggctgccccttggggttccaatccttctccaagtgccgaatctacccaggctatggatagatcttgcaaccggatgagtagtcacaccgagacttcttcattcctacaaacacttaccgggagactccctactaaaaaactcttccacgaggagctcgcattgcaatgggtggtgtgcagcggcagtgtgagagagtccgcattacagcaagcttggttctttttcgagttgatggtgaaatcaatggtccatcacctctactttaacgataagctcgaggctcctagaaaatccaggttccccgagcggttcatggatgatattgctgcccttgtgagcaccatcgcaagcgacatcgtaagcaggtttcagaaggacacggagatggtggagaggctgaacacgagcctggcttttttcctgaacgatttactgagcgtaatggatcgtggatttgtgttctctttaataaagagttgttataaacaagtgtccagcaaattatattcactgccaaatccttcggtgctggtgtcactgcggttggactttctacggatcatctgcagtcatgagcactacgttaccttaaatctcccctgttccttgctgactccccctgcatccccaagtccatccgtttcaagcgccacttcgcaaagtagtggtttctccacaaacgtgcaggaccaaaagatcgctaacatgtttgaattgagcgttccctttcggcaacaacactacttagccggactggtgcttacggagctggccgtgattttggacccagatgctgagggtctctttggccttcacaagaaagtcatcaacatggttcataacctactgtcatcccacgactccgacccaaggtactccgatcctcagattaaggcgagggtagcgatgctatatctcccgctcatcggcatcataatggagacggtgccccagctctatgactttaccgaaacacataaccagagagggagacctatctgtattgccaccgatgactatgagtcggaaagcgggtcaatgatcagccagactgtcgctatggcaattgccggaaccagcgtacctcagcttacaaggcccggtagcttcctgctgactagtacaagcggacgtcaacatacaacattcagcgccgaaagttcccgtagtttactgatatgcctcctgtgggtgctgaagaatgccgacgaaaccgtcctacagaagtggtttaccgacttgagtgtgctccagttgaaccgcctgctggatctgctttatctgtgcgtgtcgtgttttgaatacaagggaaagaaagtctttgagagaatgaacagcctcacctttaaaaagagcaaggacatgcgtgccaagctggaggaggccattctcggtagcataggagcacgccaggaaatggtgagaagatcacggggacaactcgaacggagtccaagtggaagcgcctttgggagccaggagaacctacgctggaggaaggatatgacccactggcgtcaaaacactgagaaattggacaaaagtcgtgcagagatagagcacgaggcactgatcgatggaaatctcgccacagaagcgaatctgatcatcctggacactttggagatagtggtgcagaccgtgtccgtgacggagagtaaagagagtatcctgggaggcgtgctgaaagtactcctgcacagcatggcttgcaaccagtctgctgtgtaccttcagcactgttttgccacacagagagccctcgtctctaaattccctgaactgctctttgaagaagagaccgagcagtgtgcagatctgtgcctgaggctgctccggcactgtagcagttctatcgggaccatccggagtcatgcttcagcctctctttacctgttaatgcggcagaattttgagatcggcaataacttcgcgcgagtgaagatgcaagttacaatgagcttatcttcattagtgggcacgagccagaactttaacgaggagttcctgcggagatccctgaagacaatcctgacctacgctgaggaggatctggaactgcgcgagaccacgttcccggaccaggtgcaggacttagtcttcaatctgcacatgatcctctccgatacggtgaaaatgaaagagcatcaggaagacccggagatgctgatcgatctgatgtatcggattgccaaggggtaccagacgtcccccgacctgaggctcacctggctccagaacatggccggtaaacattccgaacgcagtaaccatgccgaagccgctcaatgcttggtacactctgccgcactggtcgcagagtatctctcaatgttggaggaccgcaaatacctgcctgttgggtgcgtgaccttccagaatatcagctctaatgtactggaggaaagtgccgtcagcgatgacgtcgtgtctccagacgaagaaggcatttgttccgggaagtatttcacagagtctggcttagtgggccttctggagcaggcggctgcctccttttccatggccggtatgtacgaagcggttaacgaagtgtataaggttctgatcccaattcatgaagccaatagagatgccaaaaaactctccacaattcatggcaagttgcaagaggctttttctaagatcgtccatcaggatgggaagaggatgttcggcacgtactttcgagtcggcttctatggaaccaaatttggcgacctggatgaacaggaatttgtatataaagagcccgcaattactaaactggccgagatctctcatcgacttgagggcttctacggcgaaaggttcggagaagatgtagttgaggtgatcaaagactctaacccagtcgacaagtgcaagctggaccccaacaaagcttacatccagatcacgtacgttgagccctatttcgacacttacgaaatgaaggaccgcattacctattttgacaagaattataacctgagaaggtttatgtactgtactccgtttacactggatggcagggctcatggcgagttgcatgagcagttcaaacgtaagacaatcctgacaacctctcatgcgttcccatacatcaaaacccgtgtgaacgtgacccacaaagaagagattatcctcaccccaatcgaggttgcgattgaagacatgcagaagaagacccaggaactcgcctttgctactcaccaggatcctgcagaccctaagatgctccaaatggtgctgcaagggtctgtaggaactacagtcaaccagggacccctggaagtggctcaggtgttcctgtcagaaatccctagcgatcctaaactattccggcatcataacaagttgcgcttatgttttaaggacttcaccaagagatgcgaggatgctctgaggaaaaacaaatctctaattggacccgaccaaaaggaataccagcgggagcttgagaggaactatcaccgactgaaagaggccctgcagccgttaatcaatcgcaagataccgcaactgtataaggctgtcctacccgtcacatgccatcgagactcattctcccgtatgtccctcagaaagatggatctgtaa

SEQ ID NO: 55495 - DNA, 6329 bp, Artificial Sequence
  Description of Artificial Sequence: Synthetic coding sequence
atggccgagcggcgtgctttcgcacaaaagatctcacgtaccgtggcagctgaggttcggaaacagatcagcgggcaatattctgggagtccacagctcctcaagaacctcaatatcgtcggcaatatcagccatcataccaccgtgcccttgactgaggcagtcgaccctgtggatcttgaagattatcttatcacacacccactggctgtggactccggaccattacgagacctcatcgaattccctcctgacgacattgaggtggtttacagcccgagggattgccgcacattggtatctgcagttcccgaagagtcggaaatggacccccatgtgcgggattgcatccggtcttatacggaagactgggccattgtaattcgaaagtaccataaactgggcaccggctttaacccaaacacacttgacaagcaaaaggagagacaaaagggccttcccaaacaggtgtttgagagcgatgaggccccagatggtaattcttatcaagatgatcaggacgatctgaagcgaagatccatgagtatcgatgacactccccgtggttcatgggcttgctccattttcgacttgaagaatagcctgcctgacgctctcttacctaacttgctggacagaaccccgaatgaggagatcgatcggcaaaacgacgatcagcggaaaagcaataggcacaaagaactctttgccttgcatccctcgccagacgaggaagaacctatcgagaggctttctgttccagacatcccaaaagagcatttcggccagaggctgttggtcaaatgtctttctctcaaatttgaaatcgagatcgagccaattttcgcatccctggcactgtacgatgtgaaggaaaaaaaaaagatcagcgagaacttttattttgatctgaactccgaacagatgaagggcttacttcgccctcatgtcccacccgctgccattactactttagcaaggagtgctatttttagcatcacgtatccaagccaagatgtttttctggtcatcaagctggagaaagtgctccagcagggggacatcggagaatgtgccgagccttatatgatttttaaggaggctgatgccaccaaaaataaagagaaactggaaaaactcaaatcacaggcagatcagttttgccaacgccttggcaagtacagaatgccattcgcgtggaccgcaattcacctaatgaatatcgtgagcagcgccggttcccttgaacgggattcaactgaagtggagatctccacaggagagcggaagggaagttggtcagaacgtaggaattcttccattgtgggacgccgatccctggaaaggacgacaagtggagacgatgcctgcaatctgacatcttttcgacccgcaactctcactgttacaaatttcttcaaacaggaaggagacagactttctgacgaggacttatataagttcctcgcagacatgcgcaggccctcctccgtgctcagaaggcttaggccgattaccgctcagttgaagattgacattagccctgcccctgaaaacccgcactattgtctcacccccgagttgctccaggttaaactctaccctgactctagggtacgcccaacacgggaaatcctcgaattccctgcccgtgatgtgtatgtgcctaatacaacctacagaaacctgctgtacatttatcctcagtccctgaattttgccaaccggcaggggtcagcacgaaatatcaccgtcaaggtgcaattcatgtacggcgaggacccctccaacgcaatgccagttatctttggcaaatccagctgtagtgagttttcaaaagaagcatatacagccgtggtgtatcacaacagatctccggacttccacgaggagatcaaggtaaaacttcctgctactttaaccgatcaccaccacttactgtttaccttttatcacgtgtcttgccagcaaaaacagaacactccccttgagactcctgtaggttacacttggatcccgatgctgcagaacgggagactgaagactgggcagttttgtctaccagtgagcttagagaaaccgcctcaggcatactctgtcctttccccagaggtgccgttacccggaatgaaatgggtagacaaccataagggcgtgtttaatgttgaagtagtcgctgtatcatccattcacacacaggacccgtacttggataagtttttcgctctggtcaatgctttagacgaacatctgtttcccgtgcgaattggcgatatgcgtatcatggagaataatctagaaaacgaattgaagtcaagcatcagtgcgctgaattcttcacagttagaacctgtggtgcgatttctgcaccttctgctcgataaattgatactgttggtgattcggcctcctgtgatcgctggccaaatcgtgaacctgggacaggccagcttcgaggcaatggcaagcataattaaccgactacacaaaaatttggaggggaaccatgatcaacatggacgcaatagcttgctggcttcttacatccactacgtgttccgcctgcctaacacttacccaaatagtagctcaccaggcccaggaggactcggaggatctgtgcactacgcaaccatggcacggagtgcagttcgccctgcctcactaaatcttaaccggagcaggagcctgtctaactctaaccccgacatttctggcacccctacctcaccagacgacgaagtgcgctctatcatcggaagcaaggcaatggacagaagctgcaacaggatgtccagccatacggagacaagcagctttctgcagacactcacgggacgcctgccgacaaagaagttgttccacgaagagctagcgctgcagtgggttgtttgtagcggctctgttcgagagtccgcgttgcaacaggcttggttcttttttgagcttatggtgaagtccatggttcaccacctttactttaatgacaaactggaggcacctcgtaaatcccggttccccgagagatttatggacgatattgccgctcttgtgagtaccatcgcatctgacatcgtaagccgttttcagaaggacactgagatggtcgagcggctcaataccagcctggccttttttctcaacgatctgctgagcgtgatggaccgcggttttgtgtttagtctcatcaaatcttgctataaacaagtcagtagtaagctttactctcttccaaatccctctgtgttagtgagtctccgactggatttcttgcgaataatttgttctcatgaacattacgtgacactcaatctaccttgctccctgcttacaccgccagccagcccatctcctagcgtgagttccgcaacttctcagtcttctggcttttctactaacgtgcaggaccagaagatagctaatatgttcgagcttagtgttcctttccgccaacagcactacctggcaggactggtgctcaccgaactggcagttattctggaccccgacgcagaaggtctcttcggtctccacaaaaaggtgattaacatggtgcacaacttgctgtcaagccacgacagtgacccaagatactctgacccgcagatcaaggcacgtgtcgccatgctgtatttacccctgattggtataatcatggaaacagtaccgcagctgtatgactttaccgagacccataatcaacggggacgccctatatgtatcgctactgatgattatgagtcagagtccggcagcatgatctctcaaacagtggctatggctattgcgggaactagcgtgcctcaactgactcggcctggctccttcctcctgacctctacttccgggagacagcacaccacattctcagccgagagcagtcgtagtttgctgatctgtctgttgtgggtcctgaagaatgcagacgaaactgtgctgcagaaatggtttactgacctaagcgtgctacagctcaatcgtctgttagacttgctgtacttatgtgtgtcctgtttcgaatacaaaggaaagaaagttttcgagaggatgaactccttgacatttaagaagtccaaggacatgagagctaagctggaagaagcgatccttggaagcatcggggctcgccaggaaatggttcggaggagtcgaggacagttggggacctacacaatcgccagccccccagagaggtctccctcaggaagcgccttcggatcacaggaaaacttacgctggaggaaagatatgacacattggaggcaaaatacagaaaaactggacaaatccagagctgagatcgaacacgaagccctgatcgacgggaacctggctaccgaggctaatctgatcatcttagacactttggaaattgtggttcagacggtgagcgtgacagagagcaaggaaagcattcttggtggggtccttaaggtacttctgcactctatggcatgcaatcaaagcgctgtttacttgcagcattgcttcgccactcaaagggcgctcgtgtccaaatttccggaattgctgttcgaggaggagaccgaacagtgcgccgacctgtgtctccgcctattgcgtcactgtagctcctccataggaaccatccgttctcatgcctctgctagtctgtatttgttgatgcgacaaaacttcgaaataggcaataattttgccagagtgaaaatgcaggtgacaatgagcctcagttccctcgtagggaccagtcagaacttcaacgaggaatttctcagacgttctcttaagacaatcctgacttacgccgaagaggacctggaattacgcgaaaccacctttccggaccaggtacaggacttagtgttcaatctgcacatgatcttaagtgacacagttaagatgaaggagcaccaagaagacccagagatgctgatcgacctgatgtacaggatcgctaaggggtaccaaacttcaccagatcttcggcttacctggctccagaacatggctggtaagcactccgagcgaagcaatcatgctgaggcagcacaatgccttgttcattcggctgctttggtggccgaatacctgtccatgcttgaggatcgcaaatatctgccagtagggtgcgtgaccttccaaaacatttcatcaaacgtcctcgaggaatccgctgtgagtgacgacgtggttagtccggatgaggaaggcatatgcagcggcaagtactttaccgaatctggccttgtgggattgctggaacaggcagcggctagcttctctatggccggtatgtatgaagctgtcaatgaagtgtacaaagttctgatacccattcacgaggctaatcgagatgccaagaaactctctacaattcatggaaagctgcaggaggcattctccaaaatagtgcaccagagtacgggatgggaaaggatgttcggaacctacttccgggtcggattttacgggactaagttcggtgacctagatgagcaagaatttgtgtataaagaaccagctatcactaaactggccgagatctctcaccgacttgaagggttctacggtgaacgctttggcgaagatgtagtcgaggtaattaaggattctaaccccgtcgacaagtgcaagctcgacccaaataaagcatacatccaaatcacttatgtggagccctacttcgacacctacgagatgaaagaccgcattacctatttcgataaaaactacaacctgcgacgtttcatgtactgcaccccgttcacactcgatgggcgagcccacggcgagctgcatgagcagttcaagcgaaaaacaattctcactacttcgcatgctttcccatacattaaaacacgggtgaacgtgacacacaaggaggagattatcctgactcctatagaagtcgcaatcgaagacatgcagaaaaagacacaggagctcgcgttcgcaacccatcaggatccggcagatcccaagatgctgcagatggtgctgcagggcagcgtgggcacaactgttaaccagggtcctctggaagtagcacaggtgttcctgagtgagatcccctccgaccctaaactctttcggcatcataataaactaaggctctgtttcaaggattttacgaaaaggtgcgaggacgccctcagaaaaaataaaagcttaattgggcctgaccagaaagagtaccagcgtgaactcgagcggaactatcatcgactgaaagaagcattacagccgttgatcaaccggaaaatccctcagctgtacaaagccgtcctacccgtgacatgccaccgcgattcattcagtaggatgagcttgcgcaagatggacctgta

SEQ ID NO: 55496 - DNA, 6422 bp, Artificial Sequence
  Description of Artificial Sequence: Synthetic coding sequence
atggccgaaaggcgggcattcgcccaaaagattagcaggaccgtggccgctgaggttcgtaagcagattagcggacagtatagtggatcaccacaactactgaaaaacttgaacatcgtgggcaacatctcccaccacacaactgtaccgcttaccgaagcagtggatcctgtagatttggaggattacctaatcactcacccactcgccgtggacagtggacctttgagggatctgattgaattcccccctgacgatatcgaagtcgtttattctcccagggattgcaggactctggtttccgccgtaccggaggaatccgaaatggaccctcatgtaagagactgtatccgatcgtatacggaagattgggctatagttatccggaagtaccacaagctgggcactggttttaaccctaatacccttgacaagcagaaggagagacagaaaggcttgcccaagcaggtgtttgaatcagacgaagcacctgatggaaactcctaccaggacgaccaggatgatttaaagcggaggtccatgagcattgacgatactcctagggggagctgggcatgcagtatcttcgacctcaagaactccctgccagacgcgctcttacccaacctgctggatcgcactccgaatgaggaaatcgaccggcagaacgatgaccaacgaaagtccaacaggcacaaagaactgtttgctcttcatcccagcccagatgaggaagagcctatagagcgcctgagtgtgcccgacattccaaaagaacattttggacaacggttattggtcaagtgccttagcctcaaattcgagattgagattgagcccatctttgccagtctagctctctatgatgtgaaagaaaaaaagaaaatttctgaaaatttctatttcgatctcaattccgaacagatgaaaggcctgctgcgaccccatgtccccccagcggcaattaccaccctggctagatcagccatcttcagcattacgtacccctcccaggatgtgtttctggtaataaagctggagaaagtcctacagcagggggatatcggcgagtgtgctgaaccttacatgatattcaaggaagcggacgccaccaaaaataaagaaaaacttgagaaactgaaaagtcaggccgaccaattttgtcagaggctcgggaagtaccgcatgccattcgcatggacagcaattcaccttatgaacatcgtctcttcggcgggtagcctcgaacgagatagcacagaggtggagatttccacgggggagcgtaaaggcagttggagcgagagaagaaatagcagcatcgtagggaggcgtagtctggagagaacaactagcggcgatgatgcctgtaacctgaccagcttccggccagcgactctcaccgtgaccaattttttcaagcaagaaggtgaccggctatcagatgaagacctgtataagtttctggctgatatgcgtcggcctagttcagtgctacggcgactccgcccaatcacagcccaactgaagatcgatatctctcctgcccctgagaaccctcattattgtctgacccccgaattgctccaggtgaagctttaccctgatagccgtgtgaggcctaccagagaaattctggagtttcccgcaagagatgtctacgtgcccaatacaacctataggaacctgttatacatttatcctcagtctctgaatttcgctaatcggcaaggtagtgccagaaacatcaccgtcaaggttcaatttatgtatggggaagatcccagcaacgctatgcctgtgatcttcggcaaaagctcctgcagtgaatttagcaaggaggcatataccgcagtggtttaccacaaccgctccccggactttcacgaagagattaaggtcaagctgcctgctaccttgactgaccatcatcacctgctctttacattttatcacgtcagctgccagcagaagcagaacacccccttagaaacacccgtgggatacacatggatcccgatgctgcagaacgggagactgaaaaccggccagttttgtctgcctgtgtcccttgagaagccccctcaggcctactccgtgctaagcccggaagttccattgcccggaatgaagtgggtggacaatcacaaaggcgtcttcaacgtggaagtggtggctgtctcaagcatccacactcaggatccttatttagacaagttcttcgctcttgtcaatgcactcgatgagcacttgttccccgtgcgaatcggcgacatgcgcatcatggagaacaatcttgagaatgagctcaaatccagcatttctgccttgaactctagtcagctggaaccggtggtgagattcctgcacctgctactggataaactgatcctcctggtaattcggccaccggtgattgctggtcagattgtgaaccttgggcaggcttcgtttgaggctatggcaagcatcatcaatagattacacaaaaacctggaaggaaaccacgaccagcatggcagaaactcactgctagctagctatatccactacgtgttccggctgccgaacacttatccaaattcatcctcccccggacctggcggactggggggaagcgtgcactatgctactatggccaggtccgctgtgcgccctgcatcactgaacctgaaccgctcccggtccctgagcaacagcaacccggacatcagtggcactcccacatcacctgatgacgaggtgcggtccataatcgggagcaaagggcttgatagaagtaatagctgggttaacaccgggggtcctaaggcagccccttgggggtccaatccatctccctcagctgagagcacccaggccatggacagatcttgcaatcgaatgagcagtcataccgaaactagctcattcctgcagaccttgaccgggagattgccgactaaaaagctgtttcatgaggagctagccctgcagtgggtcgtgtgtagcggctctgtgcgagagagtgcactgcagcaggcctggtttttttttgagctaatggtgaagtctatggtccatcatctatactttaatgataaattggaggcccctcgtaagagtcgattccccgagaggttcatggacgatatcgcagctctcgtgagcacaatcgcctcagatatagtctctaggtttcagaaggacaccgagatggttgagaggctgaacaccagtctggctttttttctgaacgatctgctttcggtgatggacaggggattcgtcttctctctgataaaatcgtgttacaagcaggtgtcaagcaagctttattctctgccaaacccctctgttctagtgtcccttcgtttggacttcctcagaatcatctgcagccatgaacactatgtgacactgaatttgccgtgcagcctgctgacccctcctgcctcaccgtccccctctgtgagttcagctacctctcagtcttccgggttctccaccaacgttcaggatcagaaaatcgccaacatgtttgagcttagcgtgccgttcagacagcagcattatttggcagggttagtgcttacagaactggccgtaattctagaccccgatgccgaagggctgtttggcctgcacaaaaaagtaattaacatggttcacaatttacttagctctcacgactcggatcccagatactcagatccacagataaaggcgcgtgtagcgatgctgtacctgccactcataggaattataatggagacggtacctcagctgtatgatttcactgagacacacaatcagcgcggaaggccaatttgtatagcaaccgacgattatgagagtgaatcagggagcatgataagccagactgtggctatggccatcgccggaaccagtgtgcctcagctgacccgcccaggatctttcttgctgacctccacgagcggccgtcagcacacaactttctccgcagagtcatcaaggagcttgcttatctgtctcctctgggtattgaagaatgcggacgagactgtcctgcagaagtggttcacggatctgagcgtattgcagctgaacaggctactggacctgctatacctgtgtgtttcatgcttcgagtataaggggaaaaaggtcttcgagaggatgaacagtcttacttttaagaagtcaaaggatatgcgcgcaaagctcgaggaagccatcctaggatccattggggcacgacaggagatggtacggcgtagcagaggtcagctgggtacctacactattgctagccccccagagcgcagcccttctggcagtgctttcgggagccaggagaacctgcgatggaggaaggacatgacacactggcgtcagaataccgaaaagcttgataaaagtagagcggaaattgagcacgaagcactgatcgacggaaacttagcaaccgaagcaaacctcatcatccttgataccctagagattgtggtgcagacagtgtcagtcaccgagtcgaaggaatctattctaggtggagtgctaaaggtgctgctacatagcatggcctgtaaccagtccgctgtatatctccagcactgcttcgctactcaacgggcattagtttccaaattccctgaactccttttcgaagaggaaaccgaacagtgtgcggacttgtgtctgcgtctcctccggcattgctcatcgtccatcggaaccatccgaagccatgcctcggcatccctttacctgctgatgcgccagaacttcgagataggaaacaattttgctagggttaagatgcaggtgactatgtccctatcaagcctagtgggtacgtcccagaactttaacgaggaattcctgcgacggtctcttaaaaccatcctgacttacgctgaggaggacctcgaattacgggagactaccttcccagaccaagtgcaggacctggtctttaaccttcatatgattctgtccgatactgtcaagatgaaagagcatcaggaagatcccgaaatgctcatagatctgatgtaccgcattgccaaaggatatcaaacctctcccgacctgagactaacctggttgcaaaacatggccggtaagcatagcgaaagaagtaatcacgctgaggctgcccagtgcctggtccattctgccgcactggtggccgagtacttatctatgctggaggaccggaaatatctgccagttggttgcgtgacatttcagaacatctcctctaatgtgctagaggaatccgccgtgtctgacgatgtggtcagtcccgatgaagaaggtatctgttctggtaagtattttacagagtcgggtttggttgggctgctggagcaagccgctgcatcattcagcatggccggaatgtacgaggcagtgaacgaagtatataaggtgttgattcccatccacgaagccaatcgggatgccaaaaagttgtctaccatccacggcaaattgcaggaagcctttagtaaaattgtgcaccagaccaccatctggaagagaatgttcggcacctattttagagtgggattctatgggaccaagttcggagacttagatgaacaggagttcgtctataaagagcctgccattacaaagttggctgagatctcacaccggttggagggcttctacggggagcgatttggggaggatgttgtcgaggtcattaaggattccaatcccgtcgacaaatgcaaactggacccaaataaagcgtatatccagattacatacgtcgagccctattttgacacgtacgaaatgaaggatcgcattacctatttcgataagaattacaacctacgaagattcatgtattgtactcccttcacattggacggtcgcgcacatggcgagctccacgaacagtttaagcgaaagactatcttgacgacaagtcatgcattcccatatatcaagacgagggtcaacgtgacccataaagaggagattattctcacgcccatcgaagtggccattgaggacatgcagaagaaaacccaggagctagctttcgccacacaccaagatccggcagatccaaagatgctacaaatggtgctgcagggcagcgtaggaaccacagtgaatcagggccctctcgaagttgcccaggtgtttctgtcggagatcccatccgatcctaagttattcagacatcacaataagctgaggctctgtttcaaagattttacgaaaaggtgcgaagatgctctccggaagaacaaatccctgatcggcccagatcagaaagagtaccaacgggaactggagcgcaattaccaccggctcaaggaggcactccagcctctgattaaccgcaaaatcccccagctttataaggcagtcttgcccgtaacttgtcaccgggatagctttagccgtatgtccctgcggaagatggacttgta

SEQ ID NO: 55497 - DNA, 2799 bp, Artificial Sequence
  Description of Artificial Sequence: Synthetic coding sequence
atgtttgagctctcagtaccatttagacagcagcactatctggccggattggttctgaccgagttggctgtgatcttagaccccgatgccgaggggctgttcggcctgcataagaaagttataaacatggttcataacttgctgtcatctcacgattcagaccccagatatagcgatcctcagattaaggccagggtggcaatgctgtacttgcctctcattgggattattatggagacagtgcctcagctctacgatttcaccgatctctcggttctgcagctgaatcgcctcctggatttgctgtacctgtgcgtgtcttgcttcgagtataagggcaagaaagtgtttgagcgaatgaattctcttacttttaagaaatcaaaagatatgagagctaaactcgaagaagccatcctcggctcaataggtgccagacaagagatggtgcgtcgttcaaggggccagttggaaaggtctccgtccgggagtgcattcgggagccaggagaatttgaggtggcgcaaggacatgactcattggaggcagaacaccgagaagttagataaatctcgtgccgaaattgagcacgaagccctcatagatgggaatttagccactgaggccaacctgattattctcgacaccttggagatcgtcgtgcagaccgtatccgttacggagtcaaaagagtccattctgggaggcgtcctcaaggtcctgctgcactctatggcttgtaaccagagcgcagtgtacctccagcattgctttgctacccaaagggccctcgtttcaaaattccctgaactgctgtttgaagaggagacggagcagtgtgcagacttgtgcctcagactgcttcgacactgctcaagtagtattggcaccatacgcagtcacgcctccgcaagcctgtacttgctcatgcgccagaattttgaaatcgggaacaacttcgcgagggttaaaatgcaggttacaatgagtttatcctctttggtgggaacatctcagaactttaatgaagaattccttagaaggtccttaaaaacgatcctgacctacgccgaagaggatttggaattgagggagactacgtttccagaccaggtgcaggatctggtttttaacctgcacatgatcttatcagacaccgttaagatgaaagagcaccaagaagacccagagatgttgatcgacctgatgtatagaatcgctaagggctatcagacctctcctgacctgcggttaacctggttacagaacatggccggaaagcatagcgagaggtcgaatcacgctgaggcggctcagtgtctggtacactctgccgctctggttgctgaatacctgtcaatgctagaagaccgtaaatacctcccagtcgggtgcgttaccttccagaacatcagctcaaatgtcctggaagagtccgctgtctctgacgacgtcgtgagtcccgacgaagaggggatctgctccggaaagtactttaccgagtccggtctcgtgggcctgctggagcaagccgctgcaagcttttccatggccggtatgtacgaggctgtcaacgaggtttataaggtgctcattcccattcatgaggcgaaccgggacgctaaaaaactgtccacaattcacggcaagttacaggaggcttttagtaagatcgtgcatcagtctactggatgggagcgcatgttcggcacctactttcgagttgggttttatgggaccaaatttggtgatctggatgagcaggaattcgtctacaaagaaccagccattacgaagcttgcagaaataagccaccgtctggagggtttctatggcgagaggtttggcgaggacgtcgttgaggtgatcaaggactccaacccagtagataagtgtaaattggatcccaacaaggcctatattcaaatcacttacgtggagccctactttgatacatacgagatgaaagaccgcattacatatttcgataaaaattacaacctcagacgctttatgtactgtacccctttcacacttgacgggagggcccacggggaactgcatgaacaattcaaacggaaaacaattctaaccacctcgcatgcattcccctatatcaaaactagagtgaatgtaactcacaaggaagagataatcctaacccctattgaggtggccatcgaggacatgcagaaaaagacccaggagctagcatttgctacgcatcaggatccagccgaccctaaaatgctccaaatggtactgcaggggtccgtgggcaccactgtgaatcagggccctttggaggtggcccaagtttttctgtctgagatcccttccgaccccaaactgttccggcatcataacaagctgaggctctgcttcaaagacttcactaaacggtgtgaggacgcacttcgaaaaaataagagtttgattggcccagatcaaaaggaataccagcgcgaactggagcgaaactatcaccggctcaaggaggcactacagcccttgatcaacagaaagataccacagctttataaggcaactaactacgttctgagctttttctcccagcgattccttcaaagtaacgagccaagtcagaatgggtctcttgaatgcacgtgctttatccaccttcagcgcgctatgtactctacctcctcggtgaagcgatctataggcaaacagcacggcatggagttttggaagctgctcttcatagaggaatgctccgggcaggaaaatatcaaatgccgtctgctaacactcgaaaaccacggttatggattttag

SEQ ID NO: 55498 - DNA, 1899 bp, Artificial Sequence
  Description of Artificial Sequence: Synthetic coding sequence
atggctgagaggcgagccttcgcacagaagattagtaggaccgtagcagccgaggttcgaaaacagatttctgggcagtatagtggtagccctcaactcttgaagaacctgaatattgtcgggaatatcagtcatcacaccacagtacctctaaccgaagcagttgatcctgtggatctagaagactacctgattactcaccctctagctgtggattctgggcctctgcgggatttgatcgaattcccacccgacgacattgaagtggtgtacagccccagggactgccggaccctggtgtctgccgtgcccgaagaaagcgaaatggatccccatgtgagggattgtatacgatcctacaccgaggactgggccatcgtcatcaggaagtatcacaagctaggcactgggttcaaccctaataccctggataaacagaaggagcggcagaagggccttcccaagcaagttttcgaatctgacgaggctcctgacggcaattcctaccaggacgaccaagacgatctaaaacggagatctatgagcattgatgacaccccgagggggtcatgggcctgctctatcttcgatctgaaaaactcactccccgacgccctgctgcccaacctcctggaccgcaccccaaacgaggagattgatcgccagaatgatgaccagcggaagtccaacaggcacaaggagttgtttgcgcttcatccctctcccgatgaggaggagcccatcgagcggttgagtgtcccagatatacctaaagaacactttggccagcggttactcgtaaagtgtctcagtctcaagttcgagatagagatcgagcccatctttgcaagtctcgccctctacgacgtgaaggagaaaaagaaaatcagcgaaaatttctatttcgatcttaatagcgagcagatgaagggcctgctgaggccccacgtaccaccagccgcaatcactaccctggctagaagcgctattttctccatcacttatccgtcacaggatgtctttctggtaatcaaactcgagaaagtgttgcaacaaggggatattggtgagtgcgcggagccatatatgatctttaaggaagctgatgccaccaagaataaagagaaactagagaagcttaaaagtcaggcagaccagttctgtcagcgtcttggcaagtatcgtatgcccttcgcctggacagccatccatctgatgaacatcgtttcgagcgccggttccctggagagagacagtactgaggttgagatctccaccggggagagaaagggctcttggtccgaacgcagaaactccagcatcgtcggcaggcgttctctggagcgaacaactagcggcgacgatgcctgtaacctcacttcctttcgcccagcaaccctgactgtaactaatttttttaagcaggaaggagatagactgagcgacgaggatctctataagtttctggcagacatgaggagaccatcgtcagtcctgcggagactccgccctattactgcccagctgaaaatcgacattagtccggcacccgaaaatcctcactactgtctgaccccggaactcctgcaagtcaagctctatccagatagcagagttcggccaaccagggagattctggagttccccgctagggatgtttacgtgcctaataccacctatcgcaacctcctgtacatctacccacaaagcttaaattttgcaaatcgccaggggtcagcaagaaatattaccgtcaaggtccagtttatgtatggcgaggatccgtcaaacgctatgccttccccctcctgcacacatccaatccccacggtccgcccactacctctgtggtgttaccacagtattttttctttacttagctgggacttcatcacatag

SEQ ID NO: 55499 - DNA, 3912 bp, Artificial Sequence
  Description of Artificial Sequence: Synthetic coding sequence
tgaaaaaacctagaggggaatcacgaccagcacggcaggaattcacttctggcctcttacattcattatgtgtttcgcctgcccaacacttatcctaactcatccagccctggaccgggtgggctcgggggtagtgttcattatgcaacgatggccaggtcagccgtgaggccagcctcactgaacctgaacagatccagatcactgtccaatagcaatcccgatatcagtggcacgcctacatcaccagatgatgaagtccgctccataatcggcagcaagggtctcgatagaagcaacagttgggttaatacggggggacccaaagccgctccttggggttccaatccttcaccttccgccgagtctacccaagccatggaccgctcctgcaatagaatgtctagtcacactgagaccagttccttcctgcagaccctgactgggcgtctcccaacaaagaaacttttccacgaggaactcgcattgcaatgggtcgtgtgttcaggctctgttcgagaaagcgcgctgcagcaagcatggtttttcttcgagctgatggttaaaagcatggttcatcacctgtactttaacgataaactcgaggcgcctcggaaatcacggttccccgaacgatttatggatgatatcgctgctctggtatcaacaattgcctccgacatcgtgagcagatttcagaaagatacagaaatggtcgagcggctgaatactagtttagcattctttctgaacgacctcctttccgtgatggatcgtgggtttgttttctctctgattaagtcatgttacaagcaggtgtcctcaaaattatacagtctgccaaatcccagcgtcctggtatctctgcgcttggattttttgagaattatctgttctcacgagcattacgtgaccttaaatctgccttgttctctgctgactcctcccgctagtccatcaccatcagtgagctctgctacctcacagtcatccgggttcagcactaatgtccaggatcagaagatcgctaatatgttcgaactgagtgtcccatttcgacagcagcattatctggcaggcctcgtactgaccgagctggctgtgatcctagaccccgatgccgagggactctttggactccataaaaaagtgattaacatggtgcacaatttgttgtcaagccacgacagcgatcctcgctactccgatccacaaatcaaggccagagtcgcaatgttgtacctcccattgattggcatcattatggagacagtcccacagctttatgactttacagaaacacacaatcagcggggacgcccaatctgcatcgcaacagatgactatgagtcagagtctgggagcatgatatcccagactgtagcaatggcgatcgcgggaacctcagtgcctcaattaacccgacctggatccttcttactgacatccacatccggacgacagcataccactttcagcgccgagagcagccgtagtttactgatctgtctcttatgggtgttgaaaaacgctgatgaaaccgtccttcagaagtggttcaccgatttgagtgtgttgcaactcaaccgactgctcgacctcctctatctctgcgtttcatgttttgagtacaaaggaaaaaaagtgttcgaacgaatgaacagtctaacgtttaagaagtctaaggatatgcgagccaaactggaggaagccattctgggctccatcggtgctagacaggagatggtgagaaggagccgcggacaactcgagcggtctccctctggaagcgcttttggcagccaggagaacttgaggtggaggaaggatatgactcattggcggcaaaataccgaaaagctggataagtctagagccgagatcgagcatgaggccctgattgatgggaaccttgctacagaagctaatctgataatacttgacacgctggagatcgtggtccagacagtgtccgttaccgaatctaaagagagcattcttggcggtgtgcttaaagtgttgctgcattccatggcctgtaatcaatctgcagtgtatctccagcactgcttcgccacccagagggcactggtcagcaagttccccgaattactgttcgaggaggaaaccgaacaatgcgcagacctgtgtctgcggctgctgagacattgctcctcttctattggcaccataagatcacacgccagcgcttccctctacttgcttatgaggcagaactttgaaattgggaacaactttgcgagagtgaagatgcaagtgacaatgtcccttagtagcctggtagggacaagtcagaatttcaacgaggagtttctgcgccgaagcctcaaaaccattctgacctacgccgaggaagacttggaattgagagaaactactttcccagaccaggtacaagatttggtgttcaatctgcacatgattctgagcgacaccgtcaaaatgaaggagcaccaggaggacccggaaatgctgatagatctcatgtaccggattgccaaaggctatcagacatccccagacctgcggctcacctggctgcaaaacatggcagggaaacatagcgagaggtcaaaccatgccgaagccgctcagtgccttgtccacagcgcagcactcgtggctgaatatctaagcatgctggaagatcgaaagtatctacctgtgggatgcgtgactttccagaatatatcttctaatgtccttgaggagtctgcagtgagtgacgacgtcgtctctcccgatgaagaagggatttgtagcgggaaatatttcactgaaagcgggcttgtgggccttctggaacaggccgcagcttcattttcaatggcgggaatgtatgaagccgtgaatgaggtttacaaggtgctcatccctatccacgaggcgaatagagacgccaagaaactgagcaccatccacggaaaacttcaggaggctttttccaaaatcgtgcaccagagtactggctgggagcggatgtttggaacatactttagagttggtttttatggaacgaaattcggggacctggacgaacaggagtttgtgtacaaagagcctgccattacaaaacttgcagagatttcacaccgactcgaagggttttatggggaaaggtttggcgaggacgtggtggaggtgatcaaagacagcaaccctgtcgacaaatgcaagctcgacccaaacaaagcatacattcaaataacgtatgtcgagccatacttcgatacatacgaaatgaaggataggataacttactttgataaaaattataatttaaggcggttcatgtattgtacaccttttactctcgacgggcgtgcacacggcgaattacacgagcagttcaaaagaaagacgatcctcaccacgtctcatgcatttccttatataaagaccagggtgaatgtaacacacaaggaagagatcatcttgaccccaatcgaagtcgcaattgaggatatgcagaagaaaactcaggagctggccttcgccacccaccaggacccggctgatcctaagatgctgcagatggtgctgcagggaagcgttggtaccacggtgaaccagggacccttggaggtggcccaagtctttctttccgaaattccttcagatcctaaactgtttcgccaccacaacaagctccgcctgtgctttaaggatttcacgaagcgatgtgaagatgccctccgcaaaaacaaatcgctaattgggccagaccagaaggagtaccaaagggagctcgagcgaaactaccacaggctaaaggaagctcttcaacctctaatcaatagaaaaattcctcagctctataaggccgttctgcccgttacctgccatcgggactcattcagtcgaatgagccttcgcaaaatggatctgtag

SEQ ID NO: 55500 - DNA, 6281 bp, Artificial Sequence
  Description of Artificial Sequence: Synthetic coding sequence
atgtcgcagcccccacttctcccagcatccgcggaaacccgaaagtttacacgggctctgtccaagcccggtaccgccgcagagctccgccagtcagtgagtgaggtggtgcgtggctcagttctcctagcaaaacctaagctaatcgagcctttggactacgaaaatgtgattgtacagaaaaagactcaaatcctgaacgattgtttaagagagatgctcctgttcccgtatgacgactttcagacagccattctccgcagacagggccgttacatttgttctactgtaccggcaaaggccgaggaagaggctcaatctcttttcgtaactgagtgcatcaaaacatataatagcgactggcatttggttaactataagtatgaagattattcaggtgagttcaggcagctccctaataaggtggttaagcttgataagctgccagtccatgtgtacgaggtagatgaagaggttgacaaggacgaagacgccgcatccctgggctcccagaagggcggtattaccaagcacgggtggctgtataaaggcaacatgaacagtgccatctcagtgacaatgcgatcgtttaaacgcaggttttttcaccttattcagttgggggatggcagctataatctgaacttctacaaagacgagaaaatttccaaggagccgaaaggaagcatttttttagattcttgtatgggcgttgtccagaacaataaagtcagacgtttcgctttcgaactgaaaatgcaggataaatcctcctacttacttgctgcagactctgaagtggagatggaagaatggatcacaatacttaacaagattttgcagctgaattttgaagcagctatgcaagagaaaaggaacggagactcacatgaggacgatgagcagtcaaagctcgagggttcgggctcagggctcgactcctatctgcccgaacttgcaaaatcagctagagaggctgaaatcaagttgaaatccgagtcacgagtgaaactattctatctggaccccgacgcccagaagctcgacttcagctcagccgagcctgaggttaaatcttttgaggagaaatttggaaagcgcatattggttaaatgtaacgatctgtctttcaatctgcagtgctgtgtcgctgagaatgaagaggggcctaccaccaatgtggaacctttttttgtgaccctgtctttgttcgatattaagtacaatcgcaaaatctctgccgactttcacgtagacttgaaccacttctccgtgagacagatgctcgcgaccactagccccgctctgatgaatggttcaggtcaaagccccagtgtcctgaaaggcatactacacgaggccgctatgcagtatcctaagcaggggatcttttctgtaacttgcccacaccctgacatattcttggtggcccgtatcgagaaagtactccaaggatccataacacactgcgctgagccctacatgaaatcttccgactcatctaaggttgcccagaaagtcctgaagaacgcaaaacaggcctgtcagagactcgggcaataccgaatgccctttgcctgggccgctagaactctcttcaaagatgcctctggtaatcttgacaaaaatgcaagattctcagctatatacagacaggattcaaacaaattgagtaacgacgacatgcttaagctgctggcggatttcagaaagccagagaaaatggcaaagcttccggtcatactgggcaaccttgacattactatcgataacgtatcttctgatttccctaattacgttaactcctcatatatccccactaaacagttcgaaacttgctcaaaaacccctatcaccttcgaggtggaagagtttgtgccctgtatcccaaaacacacgcagccatacactatttatacaaatcacctgtacgtttacccaaaatatttaaagtacgatagccagaagtcttttgcaaaggcccgaaacattgcaatctgcatcgaattcaaggactcagatgaagaggattcccagccactaaagtgcatttatgggaggccgggaggaccggtgttcaccaggtccgcattcgcagccgtcctgcatcaccaccagaatcctgagttttatgacgagatcaagattgagctcccgactcaattacacgagaaacaccatctgttactgactttcttccacgtgtcttgcgataactctagtaaaggatctaccaaaaagagggacgtggtggagacccaggtgggttattcctggttaccccttctaaaagacggacgtgtcgttacttcagagcagcacatccccgttagcgctaatctcccatcaggctatctaggatatcaggagctgggtatgggtcgccactatggccctgaaataaagtgggtggacgggggaaagcccctgctcaaaatctcaacccacttggtgagtaccgtctatacacaggatcagcatctgcataacttcttccagtattgccagaaaaccgagtccggcgcacaggcactgggtaacgagctagtgaaatatctaaaatctttacacgctatggaaggccatgtgatgatagctttcttacccaccatactcaaccaactctttagagtgctgacccgtgcaacccaagaagaagtggctgtcaacgtgacacgcgtgattatccatgtggtcgcccagtgccacgaggagggtctggaatcgcacctgaggtcctacgtaaagtacgcttacaaagccgaaccgtatgtagcttctgaatacaaaacagtccatgaggagttgactaagtccatgactactatacttaagcctagcgctgattttctgacaagcaacaagttgctgaaatatagttggttcttctttgatgtgttaatcaaatcgatggcccaacacctcattgagaactccaaggttaaattactcaggaaccagcgcttccctgcgagctatcaccacgccgtggagactgtggtgaatatgttgatgcctcatattacacagaaattccgtgacaaccctgaagcttcgaaaaacgcgaaccactcacttgctgtcttcattaagcggtgttttaccttcatggataggggatttgttttcaaacaaatcaataattatattagttgtttcgctccaggcgatcctaaaaccctcttcgaatacaagtttgaattcctccgggtagtctgtaaccacgaacattatatacctttaaacctaccaatgcctttcggcaaaggcaggattcagaggtaccaggatctccagctggactacagcttaactgacgagttttgccgaaatcactttttggtgggactcctccttcgtgaggtgggcactgcgctgcaggagttccgagaggtgaggttaatcgccatctcggtgctcaaaaatctgctgattaaacattctttcgacgaccggtacgccagccgctcccaccaagccagaattgctactctgtacctgccccttttcgggctcctcatcgagaatgtgcagcggattaacgttagagacgtgagtcccttcccagtgaacgccggaatgacagtcaaggatgagtcccttgccctccccgcagtaaacccccttgtgactccacagaaaggaagtacattagacaacagcctccataaggatttgcttggcgctatctccggaatcgcctcaccttatactacttccacccctaacataaatagcgtgaggaacgccgactcccgaggcagtttgatctcaacagattccggcaatagcctgcccgaaaggaactctgagaagtcgaattctttggataaacaccagcaatccagtaccctaggaaacagcgtggtgcgttgcgacaagctagatcagtctgagatcaagtcactcctgatgtgcttcctttacattcttaaatctatgagtgacgacgcgctctttacatactggaataaggcatccacctctgaactcatggatttctttacaatctccgaggtgtgcctgcaccagttccagtacatgggcaagcggtatatcgccagaactgggatgatgcacgctaggctccagcagctgggctccctggataattcattgacatttaaccattcttacgggcattcagacgctgacgttctgcaccagagtttacttgaagcaaacatcgccaccgaagtgtgtctgacagcattagataccctgagcttgtttaccctggcatttaaaaaccagcttctcgctgaccacggccataatccgcttatgaagaaggtgttcgatgtatacttgtgtttcttacagaagcaccaatctgagaccgcgctgaaaaatgtctttacagccttgaggagtcttatttacaagtttcccagcaccttctatgagggacgcgctgacatgtgtgctgccttgtgttatgagatccttaaatgttgcaactcgaagctaagttctatacggaccgaggcatcccagttactatacttcctgatgcgcaacaatttcgattatacgggcaaaaagtcctttgttcgaacccatcttcaggtgattatttccgtatctcagctgatcgccgatgtcgttgggatcgggggtacgaggttccagcaaagtctgtccattatcaataattgcgccaactccgaccggcttatcaaacacacaagtttttcatcggacgtcaaagatttaaccaagcgcattcggaccgtcctgatggcgaccgctcagatgaaagagcacgaaaatgaccctgaaatgctagtcgatctgcaatattctctcgccaaatcctacgcatctactcccgagttaaggaaaacatggttggacagtatggcacgaattcatgttaaaaacggagatctgtcagaagcggcaatgtgctatgtgcatgtcacggctctggtcgctgagtatctgacccggaaggaggctgtgcaatgggaacccccattgttgccacacagccattccgcttgcctgagacgctctagagggggagtatttcgtcagggttgcactgcttttagggttatcacgccaaacattgatgaggaagcgtccatgatggaggatgtgggcatgcaggatgtgcattttaacgaagatgtgctgatggaacttctagagcagtgtgccgatggtctctggaaggcagagcgttacgaactgatcgccgatatttataagctaattataccgatttatgaaaaacggcgagactttgaacggctggcacacctgtatgataccctgcatcgcgcttattctaaagtgactgaggtgatgcactccggaagaaggctgctggggacatactttagagtcgccttttttggccaagggtttttcgaagatgaggatggcaaggagtatatctacaaagagcccaaacttacccccctctccgaaattagccagaggttgttaaagctctactctgacaagtttggctcggagaatgtcaagatgattcaggactcggggaaggtcaacccaaaggacctggactcgaagtatgcatatatccaggtcactcatgtcattccgtttttcgacgaaaaggaactacaggagcgaaaaaccgaattcgagagaagccataacattcgtcgctttatgtttgaaatgcctttcacgcagacaggcaagcgccaggggggagtcgaagaacagtgcaagcgcaggactatcctcactgctattcactgttttccttatgtcaagaagagaattcctgtgatgtatcagcatcatactgatcttaaccctattgaggtggccattgacgagatgagcaaaaaagtagctgagttgcgacagttatgctcctcagcagaggttgatatgataaagcttcagctcaagctccagggtagcgtttctgtccaggtgaatgcgggaccgttagcatacgccagagcctttctggacgataccaatacgaagcgatatccagataataaagtaaaactccttaaggaggtttttagacagttcgtggaggcctgcggccaggcattggctgtaaacgagcgcctgatcaaagaagaccagttggagtaccaagaagagatgaaagccaattatcgggagatggcaaaggaactctccgagatcatgcatgagcagatatgtccccttgaggagaaaactagcgtgctgcctaattccctgcacatctttaatgctataagtggcactccaacatccacgatggtacacggcatgacttcttccagcagtgtggttta

SEQ ID NO: 55501 - DNA, 1275 bp, Artificial Sequence
  Description of Artificial Sequence: Synthetic coding sequence
atgatgcacgcgaggctgcagcaactgggctctctggataattcccttaccttcaatcatagctatggccatagtgacgccgacgtgctgcatcagagcctgctggaagcaaacatagccaccgaggtttgtctgaccgctctggatacactctctctgttcacattggcttttaagaaccagcttcttgccgatcacggccataacccgcttatgaagaaagtgtttgatgtttacctctgctttttacagaagcaccagtcagaaacagcactcaaaaatgtcttcaccgcgctccggagtctaatctacaagtttccttctactttttacgaggggagagctgacatgtgcgccgcactttgttatgaaatattgaaatgctgcaactctaagctgagctccattcggacagaggcgtcccagctactgtacttcctgatgcgcaacaatttcgactatactgggaagaaatcctttgtacgtacacaccttcaagtgatcatttccgtatcacagctcatagctgacgttgtcgggattgggggaactcgatttcagcagagtctgtcaattattaacaattgtgccaattccgaccgactcatcaaacatacgtcctttagtagcgacgttaaggaccttactaagcgcattcggacagtattaatggctactgcacagatgaaggaacacgagaatgacccggaaatgctggtggacctccagtactctcttgcgaagtcttatgcctccaccccagagctccgaaagacctggctggatagtatggcgagaatccacgtgaagaatggcgacctctcagaggcagccatgtgttacgtgcacgtgaccgccctggtggcggaatatctcactagaaaaggcgtcttccgacagggctgtacagcttttagggtgatcacgcccaatatcgatgaggaggctagcatgatggaagacgtgggaatgcaggatgtgcactttaacgaggacgtgctgatggaactgctcgaacaatgtgctgatggcctctggaaggcagaaaggtatgagcttatagccgatatttataaactaattatccccatctacgagaagaggagggacttcgagcgactggcgcacctgtatgacacactccaccgggcttacagcaaggtgacagaggttatgcactccggcaggaggttgctgggaacctatttccgggtggctttcttcggccaggttagtctactaagtattctgcaaacagtcctaagcccattatag

SEQ ID NO: 55502 - DNA, 6308 bp, Artificial Sequence
  Description of Artificial Sequence: Synthetic coding sequence
atgtctcagccgccattattacccgctagtgctgagactaggaagtttactcgcgctttgtctaagcccggtacagctgcagaattgcgacagagcgtctcagaagtagtgagagggtccgtgttgctcgccaagccaaaactgatcgaacccttggattacgagaatgtgatcgtgcaaaagaaaacgcaaattctgaacgattgccttcgcgagatgctgctgttcccatacgacgatttccagaccgcaatcctgaggcgccaggggaggtacatctgctcaaccgtacctgccaaagctgaggaggaggctcagagtctgtttgtgacagaatgcatcaaaacctacaattccgactggcaccttgtgaactacaaatacgaagattattctggagagtttaggcagctcccaaataaagtcgttaaattggacaaactcccggtacacgtctacgaggttgacgaggaagttgacaaggatgaagatgccgctagcctgggaagtcagaagggagggatcactaaacatggctggctgtacaaaggcaatatgaattctgccattagcgtaacaatgcgctcatttaagcgaaggttcttccatctgattcagctgggtgacgggagctacaacctcaacttttacaaggacgaaaagatctccaaggagcctaagggaagcattttcttagactcttgcatgggtgtggttcagaacaataaagtgagacgatttgcctttgaactcaagatgcaggacaagtctagctatctgctggcggcagacagtgaggtggaaatggaggaatggatcaccatccttaacaaaattctccaactgaatttcgaggcagccatgcaggaaaaacggaatggcgactcccatgaggacgatgaacagtccaagctcgagggatctggaagcggactggattcctatctgcccgagctggccaagtctgcccgagaggctgaaattaagctgaaatctgagtctagagtgaagctgttctatctcgatccggacgcacagaaactggatttctcttctgccgagccggaagtcaagtcctttgaagagaagttcgggaaacgcatcctggtgaaatgtaacgatctgtcttttaaccttcaatgttgtgtggcagagaacgaggaggggcctaccactaatgtcgaaccgttctttgttacactttctctgtttgatatcaagtataatagaaagatctccgcagattttcacgtggaccttaaccactttagtgtccggcagatgcttgccactacttcaccagcactgatgaatggctccggtcagtctcctagtgttttgaaggggatcttacacgaggctgccatgcagtaccctaaacagggtatcttttccgtcacgtgtccccaccccgacatatttttagttgccaggattgagaaagttctccaggggtccattacacattgtgcggaaccatatatgaagtcctctgatagctctaaggtggcccagaaggtgctcaagaatgcgaagcaggcatgccaacgcctgggacagtaccggatgcccttcgcgtgggccgctcgaactttgttcaaagacgcctcagggaatctggacaagaatgcgaggttttcagccatctaccggcaggattcgaacaaactgtccaacgatgatatgcttaagctcctggctgacttccggaaacccgagaagatggccaagttacccgttattctgggtaatttggatataacaatagacaacgtgtcttccgatttccctaattacgtcaatagctcatatataccaactaagcagtttgagacctgtagcaagacaccaatcacatttgaagtcgaggagtttgttccgtgtatccctaaacatacccaaccctacacgatatacactaaccatctgtacgtttatccgaaatatctgaaatatgattctcaaaaatctttcgccaaggctcgaaatatcgccatctgcatcgaattcaaagactccgacgaggaagactcacagccactgaaatgcatctacggtcgaccaggcggtcccgtgttcactcgctctgcattcgcagccgtcttgcaccatcatcagaatcctgagttttacgacgaaattaaaatagagctcccaacccagctacacgagaaacatcacctgctacttacatttttccatgtatcttgcgacaacagcagtaaagggtcaactaagaaacgagacgtcgtggagacacaagtaggttattcttggctgccactcctcaaggacggacgcgtcgttacatccgaacagcacatccccgtctctgccaacttaccaagtggctacctaggctaccaggagttggggatggggcgacactacggacctgagatcaagtgggtggacggcggaaaacctctgttgaagatcagtacccatctggtcagcactgtttatacacaggatcaacacctgcataacttctttcaatactgccagaaaacagagagcggcgcacaggccctgggtaatgaactggtaaaataccttaagtctctccacgcaatggaaggacacgtgatgattgccttcctcccaaccattttgaatcagttgttcagggttctcacccgtgcaacccaggaggaggtcgccgtcaacgtgacacgcgttattatccatgtggttgcacaatgtcacgaggaggggctggagagtcacttaagatcatatgtcaagtatgcatacaaagccgagccttacgtagcttcagagtataagacagtgcacgaagagctaactaagagcatgacaacaatcctcaagccgtctgccgactttttgaccagcaacaagctgctgaagtactcatggttctttttcgacgtcctgatcaagagcatggctcagcacttgatagagaacagcaaggtaaagctgctgcgcaatcagcggttcccagcgagctatcaccacgccgttgaaacagtagtaaacatgcttatgccccatatcacacagaagtttcgggataacccggaggccagtaagaatgctaaccatagcctggctgtctttattaagagatgcttcaccttcatggatagaggcttcgtcttcaaacagattaataactatatttcgtgtttcgcccctggggaccccaaaactctcttcgagtacaaattcgagttcttacgcgtagtgtgcaatcatgagcactatattcccctcaatttgcccatgccctttggcaagggccgtatccagcggtatcaggaccttcagctagactactcactgactgacgagttttgccgtaatcactttctcgttggcctgctgctacgcgaggtcggcacagctctgcaggaatttcgagaagttcggctcattgcaatttccgtgctaaagaatcttctcataaagcactctttcgacgacaggtatgccagccgttctcaccaggctcggatcgccacactgtacttgcccctattcggtctcctgatcgagaatgtccagcgaattaacgtgcgagacgtaagcccattcccagttaacgccggtatgactgtgaaggacgaatccttagctctcccagctgtgaatccactcgtcacacctcagaaggggtctacactagataattcccttcataaagaccttttgggggctatatctgggatagcctcgccttacactacctccaccccaaatataaacagtgtccgtaatgcagacagcaggggatctctaatctctacggactccgggaatagccttcccgaacgcaatagcgagaagagcaatagtctggacaagcatcagcaaagcagtacattgggaaatagcgtggtgcggtgtgataagctggatcagagtgagatcaagtccctactgatgtgtttcttatatattctcaaatcaatgagcgacgatgccctgttcacgtactggaataaggcttcaacttccgagctgatggatttttttaccattagcgaagtctgccttcatcaatttcagtatatgggcaaaaggtacattgcccgaaccggaatgatgcacgctagactgcaacaactggggagccttgacaactccctgaccttcaatcactcatatggccactctgacgctgatgtcctgcatcagagtctgctggaagcaaacatcgccacagaggtgtgcctgactgccttagatacactgagcttgtttaccttggccttcaagaatcagcttctcgctgatcatggacacaaccccctaatgaagaaagtgtttgatgtctatttgtgcttcctccagaagcaccagagcgaaactgcgcttaaaaacgtgtttactgcattaagaagcctgatctataagttcccttcaaccttctatgaaggaagagccgatatgtgtgccgctctgtgctatgagattctgaaatgctgtaatagcaagctttcctccatacgaaccgaggcttcacagttactgtattttctgatgagaaacaactttgactatactggcaagaagagtttcgtgcgaacacatttacaggtaattatcagcgtgtcccagttaatcgctgatgttgtggggattgggggtacaaggttccagcagagcctgtctattattaataattgtgctaacagcgaccgcctaataaagcacacgtcgttcagctctgatgtgaaggacctgactaaacgtattagaacagtgctgatggccaccgcccagatgaaagagcatgagaacgatccggagatgctggtcgacctccagtactctctagcgaagagttacgcctctactcctgagctgcggaagacctggctcgactcaatggccagaatccacgtaaaaaacggagacctttcagaagcagctatgtgctacgtgcacgttactgccctggtggcagagtacttgacgaggaaagaagctgtccaatgggagccacctctattgcctcactctcacagcgcatgtctgcggaggtctcgaggcggagtgtttcggcagggttgtacagccttccgcgtgataacaccaaacatcgatgaggaagccagcatgatggaggacgtcggtatgcaagacgttcactttaatgaggatgtccttatggagctgctggaacagtgcgcagatggcctgtggaaagccgagagatatgaattaatcgctgacatctataaactgatcattcccatatatgaaaaacggagagatttcgagcgtttggcccacctgtatgataccttgcatcgtgcctactcaaaagtgaccgaggtgatgcattccgggaggcgcctgcttgggacctacttcagagtcgcgttcttcgggcaggctgcacagtaccagtttactgacagtgaaaccgatgtggagggtttctttgaagatgaggacggaaaagagtatatttacaaggagccaaagttgacccctctcagtgagatcagccagcggttgctgaagctctacagcgacaaattcggttctgaaaatgtcaaaatgatccaagattcaggcaaagtgaacccaaaggacctggattctaagtacgcctacattcaagtcactcatgtgataccattttttgatgagaaggaactgcaagagaggaagaccgagttcgagcgatcccataatattagacggtttatgtttgaaatgccatttacccaaactggcaaacggcaggggggagtggaggagcagtgcaagcgccgaacaattctgacagcaatccattgctttccctacgtgaagaaacgaatccccgtgatgtatcagcatcataccgatttgaacccgatcgaggttgccatcgatgagatgagtaaaaaggtggccgagttgcgccagttatgcagcagcgcagaggtagatatgataaaactccagctcaaactgcagggatcggtgtcagtgcaggttaatgcgggtcccctggcatacgcccgtgcattcctagacgataccaataccaaaagatatcctgacaataaagtgaagctgttaaaggaagtctttcgccagtttgtagaagcttgcggccaggccctcgcagtaaacgagagacttatcaaggaagatcagcttgaatatcaggaggagatgaaagctaattaccgagaaatggctaaggaactctctgaaattatgcatgaacaagtccggagatcagccccttggaggcgtagacgcgctagttatcgcatcccctttacctcctccacccccagtgtcggcttgcagcaggcccagtggtttacagggta

SEQ ID NO: 55503 - DNA, 2175 bp, Artificial Sequence
  Description of Artificial Sequence: Synthetic coding sequence
atgcatgccagactgcaacagctggggtcactggacaattctcttactttcaaccacagctacggccacagcgacgccgacgtgttgcaccagagccttctggaggctaatatagcaacagaagtgtgtcttacagcccttgacacactgagtctgttcacacttgcttttaaaaaccagctgctggcggatcatggtcacaaccccctgatgaagaaggtcttcgacgtctacttgtgtttcctgcaaaagcaccagtctgagaccgcgctgaagaatgtgtttacagccctccgctctctgatatacaagtttcctagcaccttctatgaagggagagccgacatgtgtgccgctttgtgttatgagatacttaagtgctgtaattcaaaattatcctcaattaggaccgaggcatcccagctactgtactttcttatgcggaacaactttgattacactgggaaaaagtcgttcgtacgcacccatttgcaggtcatcattagcgtgagtcagctgatagcggatgtggtgggcatcggtggcacccgctttcagcagtcactcagcataatcaacaattgtgccaactccgatcggctgattaaacacacatccttctccagcgatgtgaaggaccttaccaagaggatcaggaccgttttgatggcgaccgcacagatgaaggagcacgagaatgaccccgaaatgttggttgacttacagtatagtttggcaaagtcatatgcctccacccctgagctgcgtaaaacgtggttggactccatggctcgcatccacgtcaagaatggagatctgagcgaagcagccatgtgctacgtccacgtgaccgccttggtagccgagtatctgacacgcaagggagtgtttagacagggctgcaccgcttttagagtgatcactccaaatatagatgaagaagccagcatgatggaggatgtcggcatgcaggatgtccacttcaacgaagacgttttgatggagctgctggaacaatgtgcagatgggctctggaaagcagaaagatatgagcttatagccgatatctataaactgatcattcccatctacgaaaaaaggagggattttgagaggctcgctcatctttacgacacgcttcaccgcgcttattcaaaggtgacagaggtgatgcactcggggaggaggctgctgggtacctacttccgtgttgccttctttggccagcagtaccagttcactgattcagagaccgatgtggagggcttcttcgaagacgaggacggaaaggagtacatttataaagagcccaaactcactccactcagcgagatctctcagaggctcctcaaactttatagtgacaagtttggcagcgagaacgtcaagatgatccaggactccggaaaggtgaacccaaaggatctggattccaagtatgcatacattcaggtgacccatgtgatccccttcttcgatgagaaggaattacaggagcggaaaaccgagttcgagcgcagccacaacatccgcagatttatgttcgagatgccatttacgcagactgggaaacggcagggcggtgtggaggaacagtgcaaaagaagaaccatcctaactgctattcattgtttcccttacgtgaagaagcgaatccctgtgatgtaccaacatcatacagatttgaatcctattgaagtcgccattgacgaaatgagcaagaaggtggccgaactcaggcagttgtgctcttccgctgaagtggacatgataaaattacagctgaagctgcagggcagcgttagtgtgcaagtgaatgctggaccgcttgcctacgctcgtgcgtttctggacgacaccaatactaagaggtatccggacaataaagtcaagctcttaaaggaggtgtttcgccaattcgtcgaggcttgcggccaggcattagcagtcaatgaaaggctgatcaaagaagatcagctagagtatcaggaagagatgaaggctaattatcgagagatggcaaaggaactgagtgagatcatgcacgagcaaatttgccctttggaagagaaaacgtctgtactgcccaactctctgcacatcttcaacgccatttcagggactcctacttccaccatggtgcacggcatgacctcgagtagctccgtggtttag

SEQ ID NO: 55504 - DNA, 6284 bp, Artificial Sequence
  Description of Artificial Sequence: Synthetic coding sequence
atgtcccaaccaccactgctgcccgcttccgcagaaactcgtaagtttacaagggctctgtcaaaacctggtaccgctgctgagctgaggcaatccgtgtccgaggtcgttcgtgggtctgttctccttgcaaagccaaagctaatcgagccactcgattacgagaatgtgatcgtgcagaagaagactcaaattctcaacgattgcctgagggagatgctcctcttcccctacgatgactttcagaccgctatcctccggaggcagggtcggtacatctgctcaaccgtcccagccaaagcagaggaggaagctcagagcctcttcgtgacagaatgtatcaaaacctataacagtgactggcatctcgtaaactacaaatacgaggattactccggcgagttcaggcagctgcccaataaggttgttaaactggataagttaccagtgcacgtgtacgaagtagatgaggaggtggacaaagacgaagacgctgcgtcactgggctcccagaagggaggtatcaccaaacatggctggctgtataaggggaatatgaattcagccatttctgtgacgatgaggagcttcaaaagacgcttctttcatctaattcagctgggcgacggaagctataatctaaacttctataaagacgagaagattagcaaggagcctaaaggttcgatcttcttggacagctgcatgggggtggttcaaaacaacaaggtgaggaggtttgcatttgagctgaaaatgcaggacaagtcatcttacctccttgccgctgattcagaagtggaaatggaggaatggattaccattctgaacaaaattctccagctgaacttcgaagccgctatgcaggaaaaacgtaacggagacagccatgaagatgacgaacagtcgaagttagaaggtagcgggagtggcctggacagctacctgcccgagctagccaagtctgccagggaagcagaaattaagctgaagtcagagagtcgcgtcaaattattctatttagatccagatgcccaaaagctggacttctcttccgccgaacctgaggtgaagtcctttgaggagaagttcggcaaaagaatcctggtcaagtgcaacgacttgtctttcaacctgcaatgctgcgtcgccgaaaacgaggaagggcctactacaaacgtggagcccttctttgtcacccttagcctcttcgacatcaaatataatcgaaagatctcggccgactttcacgttgaccttaaccacttttctgtccgccagatgctcgctaccactagcccagccctgatgaacgggtcaggccagtctcccagcgtgttgaaggggattctccacgaggctgcaatgcaataccctaaacaggggatcttttctgtgacctgccctcaccctgacatcttcctggttgccagaattgaaaaggtgttacagggctctattacacactgtgctgaaccatacatgaagtcttctgactcttccaaggtggcacaaaaggtgctaaaaaacgcaaaacaggcatgccagcgtctcgggcagtacaggatgccatttgcttgggcggctagaacattgtttaaggacgccagcgggaatctagacaaaaacgcaaggttttccgctatctaccgccaagattcaaataagctcagcaacgatgacatgttaaaattactggctgactttcggaaacccgagaaaatggcaaagctccctgtgatcctgggcaatttagacataaccatagataacgtctcgtccgatttccctaattacgtgaattcctcctatatcccgaccaaacagttcgaaacatgtagtaagacacccatcactttcgaggtggaggagtttgtgccgtgcataccaaagcatacgcagccctatactatatacactaatcacctgtacgtgtatcctaaatatctgaaatacgactcccagaaatcatttgccaaagctcgcaacattgctatctgtatcgaatttaaggactccgatgaagaagattcacaacccctgaagtgtatctatggcagacccggaggacccgtgtttacaaggtcagcatttgccgcagttcttcaccaccaccaaaaccccgaattctacgacgagatcaagatagagctacccacacagctgcatgagaagcatcatctgttactgacgtttttccacgtgagttgcgataatagtagtaaaggttctactaagaagcgggatgtcgtggagacccaagtcggctactcatggctgccattgctcaaggatgggagggtggtaacatccgaacaacatattcctgtgagtgccaatctgcctagcggttacctaggatatcaggagctaggcatggggagacattatggcccagaaataaagtgggtggatggcggaaagcccctattgaaaattagtacccatctcgtgtccaccgtgtatacccaagaccagcatttacataatttctttcagtattgtcagaaaacagaatccggggcacaggcattgggcaatgaactcgtgaagtacctcaagtccctgcatgctatggagggccacgtgatgatagccttcctgcccaccatattaaatcagctctttagagtgctaaccagagccacacaggaggaagtagccgtcaacgtgactagagtaatcatccacgtcgttgcccagtgtcacgaggagggactggagtctcatcttcgctcttatgtcaagtacgcctacaaggcagagccatacgttgccagcgaatacaaaactgtgcacgaggaactaaccaagtctatgaccaccatcctgaaacctagtgcagatttccttacctccaacaaactgctgaagtatagttggttctttttcgatgtgctgatcaagtccatggcacagcacctcatcgaaaattcaaaggtgaaattactgcgcaaccagcggttcccagcatcttaccatcatgctgtggaaactgttgtgaatatgctgatgccacacatcacacaaaagttccgtgacaatccagaggcttctaagaatgccaatcatagtctggctgtcttcatcaagcgatgttttacatttatggacaggggttttgtattcaaacaaatcaataactacatatcttgtttcgctcctggagatcccaagacgctgtttgagtataaatttgagttcctgcgagtagtctgcaaccacgagcattacattccactcaatctgcccatgccatttggaaagggtcgtatccagcgctaccaggacctgcagctggattattccctgaccgacgaattctgtcggaatcactttttggtgggacttctgctccgagaagtcggcacagcactccaggagttccgtgaagtgcgtctaatcgcgatcagcgtgctgaaaaatctcctgatcaaacactcttttgacgaccgctacgcgagccggtctcaccaggcacgcatagctactctgtatctcccgttgtttgggctgctgatcgagaacgttcagcgcataaatgtgcgcgacgtgtctccctttcccgttaatgctgggatgactgtcaaagacgagtcactggcccttccagccgttaatccacttgtgactccccagaaaggaagcacattagacaatagtctgcataaggatctcctcggtgctataagcggcattgcgtccccctacaccactagcacaccgaatatcaacagtgtgcgcaacgcagattcacgagggtcccttatctctactgactcaggaaacagcctcccagaaagaaattcagagaaaagcaacagccttgataagcaccagcaaagcagcaccttgggcaactcagttgttcggtgtgacaagctggaccaaagtgaaatcaaatccctattgatgtgtttcctctacattctgaaatcaatgagcgacgacgccttattcacatactggaataaggcatccacgtccgagctgatggattttttcaccatctctgaggtttgtctgcatcagttccaatacatgggaaaaagatacattgcctcagtgcggaaaatctcatccgttcttggcattagcgttgacaatggctacggacacagcgatgccgacgtattacatcagagtctgctcgaggcgaacattgcaactgaagtatgcttaaccgctcttgatacattaagtttatttacactggcattcaaaaatcagttactagcagaccacggacataatccgttaatgaagaaggtctttgacgtctacctctgcttcctgcaaaagcaccaatccgagaccgccctgaagaacgtcttcacagccctgcgcagtttgatatataaattcccatccacattttacgagggccgtgcagatatgtgcgccgctctttgctacgagatcctcaagtgctgcaattccaaattgagctccattcgaaccgaggcctcgcagcttctgtatttcctgatgcgtaacaattttgactataccggcaagaagagttttgtgcggacccacttacaggtgataatctctgtttcccagttgattgccgacgtggttggaatagggggtactcgatttcaacagagcctttctatcatcaataattgcgcaaattctgacagactgatcaaacatacctcattttcttccgacgtcaaagacctcacaaagcgcatcagaactgtgctaatggcgaccgcccaaatgaaggaacacgagaacgaccccgagatgctcgtcgaccttcagtactccctggctaagtcttacgcctccacacccgagctcaggaagacatggctggactcgatggcacgaatacacgtcaagaatggcgacctttccgaggcggctatgtgttatgtgcatgtgacggctctggttgccgaatatctgaccagaaaagaggccgtccaatgggaacccccacttcttccgcatagccacagcgcatgcctgcgaaggagccgcggtggggtatttagacaaggctgtacagcctttagagtgatcaccccaaacattgacgaagaagcttctatgatggaagacgtgggcatgcaagacgtccattttaacgaagatgtgcttatggagctcctcgagcagtgcgcggatgggttgtggaaggctgagcgctacgagctcatagccgacatctacaaactgatcattcccatctatgaaaaacgacgagacttcgagcgactggctcacctctatgatacccttcacagggcgtattcaaaggtaactgaggtcatgcatagcggcaggagacttctcggcacctatttcagagtggccttttttgggcaggctgcgcaataccagtttacggattctgaaaccgacgtcgaggggttctttgaggatgaggatggtaaagaatacatctacaaggaaccaaagctgacacctcttagcgagatcagtcagaggctgctgaaactgtactctgataaattcggtagtgagaatgttaaaatgattcaagacagtggcaaagttaaccctaaggacctggattccaaatacgcgtatatccaagtcacccatgtgatcccattttttgatgagaaagagctgcaggaacgaaagacggaattcgaaaggtcacataacatacgaaggttcatgttcgaaatgcccttcacgcagaccgggaaacgtcaagggggagtcgaagaacaatgtaagagacgcactatcctcaccgccattcattgcttcccttacgtgaagaagagaatcccggtcatgtaccaacatcacactgacctgaacccgattgaggtcgcgattgatgagatgtccaagaaggtggccgagctgcgccagctttgcagttcggcagaagtggacatgattaagctacagcttaagctacagggctctgtatccgttcaagtgaacgctgggcctctcgcttacgcgagagcattcctggacgacacaaataccaagaggtaccccgataataaagtgaaactactaaaagaggtctttcggcagttcgttgaagcctgcggccaagcgcttgccgtgaatgagagactgataaaagaagatcagttggagtaccaggaagagatgaaagcaaactatagggagatggctaaggaactgtcagaaatcatgcacgagcaggtacgtagatctgccccttggcgcagacggagggcctcctaccgcatccccttcaccagctctaccccaagcgtggggctgcagcaggcccagtggtttacgggcta

SEQ ID NO: 55505 - DNA, 6207 bp, Artificial Sequence
  Description of Artificial Sequence: Synthetic coding sequence
atgcaggcagataagtgccgcactagctcacggagcgtcaaaaaagaacttgttatcgaatctcccctacagtacaaggatgcagctcagggggaagtggaagccgagtcacctggtcctgtgcccgcaaaacctaaactaattgaacccctggactatgagaatgttattgtgcagaagaaaactcagatcctcaatgattgcctgcgagagatgctattattcccatatgatgacttccaaaccgccattctgagaaggcaagggcgttatatctgttctactgtgccggctaaggcagaggaggaagctcaatccctgtttgtgactgagtgtatcaaaacgtacaattctgattggcatttggttaactataaatatgaagattactctggagaatttaggcagctgcccaacaaagtggtaaaacttgacaagttacccgtgcacgtctacgaagttgacgaggaagtggacaaggacgaagacgctgcttctttaggatctcaaaagggcggaattaccaagcatggctggctctataagggaaatatgaactccgcaattagcgtcaccatgaggtcctttaaacgacgattttttcacctgattcagctgggcgacgggtcttataacctgaacttctacaaggatgaaaaaatttcaaaagaacctaagggttctatcttcctcgactcctgtatgggagtagtacagaacaataaggtgcgacggttcgcattcgaactgaagatgcaggataagagttcgtatcttcttgcagcggattctgaggttgaaatggaagagtggattactattctgaataagatcctacagcttaattttgaggccgcaatgcaggagaaaagaaatggggattcccatgaagatgatgaacaatcaaagctcgaaggtagcggctccggactggactcatacttgcctgagctcgcaaaatccgccagagaagccgagataaagctgaaatccgagtcacgcgtgaagctcttttacctggaccctgacgcccagaagctagatttcagttccgccgaacctgaagtgaaaagcttcgaggagaagtttgggaagagaatcctggtgaagtgcaacgatctgagttttaacctccagtgttgtgtggctgaaaacgaagaaggcccaacaaccaacgtcgagccattttttgtcacgctttcactcttcgacataaaatataatagaaagatttctgccgacttccatgtggacctgaatcacttctcagtgcgtcagatgctggccactaccagtccagcacttatgaacgggtcagggcagtccccctccgtgctcaaaggcatcctccatgaagcggctatgcagtatcccaaacaggggatctttagtgtcacatgcccacaccctgacatctttcttgtagcaaggattgagaaggtcctccaagggagcattacacattgtgcagagccctatatgaagtccagtgacagtagcaaggtcgctcagaaagtgctgaaaaacgcaaagcaggcgtgccagcgactgggccaataccggatgccatttgcttgggctgctagaacactatttaaggacgcctctgggaacttggacaagaacgcccgattttcagctatttacagacaagacagcaataaactatccaatgatgacatgttgaagctcctggctgatttccgaaaaccggaaaagatggctaagctccctgtgattcttggaaatctggacatcactatagataatgtctcctctgacttccctaattacgtgaacagttcttacattcctacaaagcagtttgaaacttgcagcaagacacccattaccttcgaagtggaagaatttgtgccctgcatccctaagcacacgcagccttatacaatatataccaaccatctttacgtatatcctaaatatctgaagtacgactctcaaaagtcctttgctaaggccaggaatattgccatctgcattgagtttaaagactcggacgaggaggacagtcagccactaaaatgcatctatggtaggccaggtggccctgttttcactcgctctgcattcgccgcagtgttgcatcaccatcagaatccagagttctacgatgagatcaagatcgaattacccacacaactgcatgaaaagcaccatttgttgctgacattcttccacgtgagttgtgacaattcctcaaaagggtccactaaaaaaagagacgtcgtcgaaacacaggttggctatagctggcttccattgctgaaggacggtagagtggtgacaagcgaacagcatattcccgtctcggcgaacctgcccagcggatacttaggctatcaggaactgggtatgggacgccactacggcccagagatcaaatgggtggatggcggtaagccactgctgaaaatttccacccatctggtgtcgacagtgtacacacaggaccaacaccttcataacttcttccaatattgtcaaaagacagaaagtggcgctcaggccctgggcaacgaactagtgaagtacctcaagagcttgcacgccatggagggccatgtcatgattgcgttcctccccactatattgaaccagctgttcagagtgctgacccgggctacccaggaggaggtggccgtgaacgtgacacgggttatcattcacgtcgtcgcacagtgtcatgaggagggcttagagtcccacttacggtcttacgtgaagtacgcgtacaaggctgagccttacgttgcctcagagtataaaaccgtgcacgaggaacttacaaagtcaatgaccacgatattgaagccgagtgcagattttctgaccagcaacaagctgttaaaatacagctggttcttttttgacgtgcttataaagtctatggcccagcatctcatcgaaaacagcaaagtgaagttgctgaggaatcagagattcccagcctcataccatcacgccgtcgaaaccgtggttaatatgctgatgccgcatatcacccagaaattccgcgataatcccgaagccagcaagaacgccaaccactctctggctgtttttattaagcggtgtttcacatttatggacagggggtttgtgttcaagcagataaacaactatatttcctgctttgctcctggcgaccccaaaacactgttcgaatacaagtttgagttcctccgggtggtctgcaatcacgagcattacatcccactgaatcttcctatgccctttggcaaagggagaattcagaggtatcaggacctacagctcgactatagccttaccgacgaattctgccggaatcatttcctcgtgggactgctgttgcgcgaagttggtaccgctttacaggagtttagagaggtccgtctgatagccatttccgtgctgaaaaacctgttgattaaacactcgttcgacgaccgatatgcaagtcggagtcaccaggccaggatagcaaccctctacctccctctgtttggattactgatcgagaacgtgcaaaggattaacgtcagggatgtgtcaccctttcctgtgaacgcaggcatgaccgtgaaggatgaatcgctggccctgcctgccgttaaccctctggttaccccgcagaagggtagcaccctggataatagcttgcacaaagacctcctgggggctatatcaggcattgcctccccttacactaccagtacgcctaatatcaatagcgttcgcaacgccgatagccgaggttccctgattagcacagactctggaaactctttgccagaaagaaactcagagaagtctaatagccttgacaagcaccagcagtcctccaccctcggaaattctgtggtgcgttgtgacaaactcgaccagagcgaaattaaaagcctgctgatgtgcttcctttatattttaaagtctatgagcgatgatgccctctttacctactggaataaggcctcaaccagcgaactgatggattttttcacaatttcagaggtgtgtctgcaccagttccagtacatgggaaaacggtatattgccaggacaggcatgatgcatgctaggctccagcagctgggttcactggacaatagcctaacttttaaccattcatatgggcattccgacgccgatgtcctacaccagtccctactcgaggctaacatcgctacagaggtttgtctgactgccctggacacattatctttgttcacactggcattcaaaaatcagttactggccgaccacggccataaccctctgatgaagaaggtctttgacgtgtatctgtgcttcctgcaaaagcaccaaagcgagaccgcgctcaagaatgtcttcacagccctgcgctcactaatttacaagttccccagtacgttctacgaaggccgtgctgatatgtgcgccgctctctgctacgaaattcttaaatgctgtaatagcaagctgtcctctattaggaccgaggcatcgcagctgctgtattttctgatgcgcaacaacttcgactatactgggaaaaagtctttcgtccgcacccacctgcaggtgataataagcgtcagtcaactgattgccgacgtggtgggtattggcggtacgcgattccagcagagcctctccatcattaacaattgtgccaattctgataggctgatcaagcacaccagtttctcttctgacgtaaaggatttgactaagaggatacgtactgtgctcatggcaacagcacagatgaaggagcatgaaaacgaccctgaaatgcttgtagatctccagtactctctggcaaaatcatatgcctccacccctgagctcaggaagacttggctggattccatggccaggatccacgtaaagaacggagacctctccgaggctgctatgtgctatgtccatgtgactgccctggtggctgaatatcttaccagaaaagaagctgtacaatgggaacctcccttgctaccccattctcacagcgcctgtctccgccgatctagaggtggggtgttcaggcaagggtgtacagctttccgagtgatcactccaaacatcgacgaggaagccagcatgatggaggatgttggtatgcaggacgtccattttaacgaggatgtcctgatggagctactggaacagtgcgcggatggactctggaaggccgagcgttatgaactgattgctgacatttacaagctgatcatcccaatctatgaaaaacggcgtgactttgagaggttggctcacctctacgacactctgcacagagcatactccaaggtgacggaagtaatgcattccggcagaagattgctgggtacctacttccgggtcgccttcttcgggcaggccgcacagtatcagtttaccgacagcgaaaccgatgtcgagggatttttcgaggatgaagacggcaaagagtacatctacaaggagcctaaactgactccactgagtgaaattagccaacgactgctgaaactgtactccgacaagtttggctccgaaaacgtgaagatgatacaggactcgggcaaagtgaatccaaaggatctggacagcaaatatgcctacatccaggtgacacacgtaatcccattcttcgacgagaaggagctccaggaacggaaaaccgagtttgaacgctcccacaacattagacgcttcatgttcgaaatgccattcacacagacaggaaaacggcagggaggagtggaggaacagtgtaaaagaagaacaattctcacagcaattcattgcttcccgtacgttaaaaaaagaatccccgtgatgtatcagcatcataccgacctgaatccaattgaggtggctattgacgagatgagtaaaaaggtggcggagttgcgacaactttgctcttccgctgaggtcgatatgatcaagctgcaactcaagctgcaagggagtgtatccgttcaggtcaacgcgggtcctctggcctatgctagagcctttctcgatgataccaacacaaagcgctatccggataacaaggttaaactcctcaaagaggtgtttcgccagtttgttgaggcgtgtggccaggccctcgccgtgaacgagaggctcatcaaagaagatcagctggagtaccaagaggagatgaaggccaattacagggaaatggccaaggaactctctgagataatgcacgagcagctgggctaa

SEQ ID NO: 55506 - DNA, 3030 bp, Artificial Sequence
  Description of Artificial Sequence: Synthetic coding sequence
atgccctttggaaagggccgaatccagaggtaccaggcgtttctctcaccgactgtggagtctaacgacacccccgtcgacctacaactggattatagtctgacggatgagttttgtcggaaccatttccttgtggggctgctcttaagggaagttgggactgctctgcaggagtttagagaagtcagattaattgctattagtgttctgaaaaacttgctgattaagcacagcttcgacgatcgatacgccagcaggtcccaccaggcacgcattgccactctgtacctgcctctgtttggactgctgatcgagaacgtgcagaggattaatgtgagagatgtgtccccttttcccgtgaacgcgggtatgaccgttaaggacgaatccctcgcattgccagccgtgaacccactcgtcacccctcaaaaaggcagtacactcgataacagtctgcacaaggacctgctgggtgctatctctggcatagccagcccctacacaactagtacccccaacattaattcagtcaggaacgccgactcaagaggtagccttatatcgacagattcaggcaatagcctgccagaacggaattccgaaaaaagcaatagtcttgacaagcaccagcagtccagcaccctggggaattctgttgtgcgttgcgataaattagaccagtccgagattaagagcctcctcatgtgttttctgtacatcctgaagtcaatgtctgacgacgccctgttcacttattggaacaaggcttcgactagcgagctgatggatttcttcactatttctgaagtctgtctccaccagttccaatacatggggaagcggtacatcgccaggacggggatgatgcacgcgcgactgcagcagctgggtagcttggacaactcactcacatttaatcactcctatggccacagcgatgcagacgtcttacaccagtccctgcttgaagcgaacattgcaaccgaagtgtgtctgaccgccttggataccctcagtttatttaccctggcgttcaagaaccagctgctcgcagatcacgggcataatcctcttatgaaaaaggttttcgacgtttatctttgttttctgcagaaacatcagagtgaaacagccctcaaaaacgtgttcaccgcactcaggagcctcatatacaaattcccaagcaccttttacgaaggcagggctgatatgtgcgcggctttgtgctacgaaatcttgaagtgttgtaatagcaagctgagttccatccgcacagaagcaagccagctcctctattttctgatgcgcaacaactttgactatactggaaagaaatcattcgtcagaacccacctacaagtcatcataagtgtgagtcaactcattgctgatgtggtaggaataggaggcaccaggttccagcaaagcctgtccatcattaacaactgtgcaaactcggaccgtctcatcaaacacaccagcttctcttcagacgtgaaggacctgactaaaaggattcgcacagtcctgatggctactgcccagatgaaggaacatgagaatgaccctgagatgctggtggacctgcagtactcattagcaaagagctacgcttcaactccggaactccggaagacctggttggacagtatggctcgcattcatgtaaaaaatggggatttaagcgaagcagccatgtgctacgtgcatgtgactgccctcgtcgcggagtacctcacccggaaaggcgtgttccgccagggatgcaccgcattccgcgtaattacgccaaacattgacgaggaggcctcaatgatggaggatgtcggcatgcaggacgttcatttcaacgaggacgtattgatggaactcttggagcagtgcgccgatggcctgtggaaagctgagcggtatgagctgatcgcggacatctataaactgatcatccctatctatgaaaagaggagggacttcgaaagacttgcccatttgtacgacaccctacatcgcgcttactctaaagtaactgaagtcatgcactccggccgtagattgctcggcacctatttccgagtggcttttttcgggcaggcagcacaatatcagtttacagactccgaaacagacgtggaagggttttttgaggacgaggatggaaaggaatatatttacaaagaacctaaacttactccattgagtgagatctcacagaggctccttaagctgtacagtgataagttcggcagtgaaaatgtcaaaatgatccaggacagcgggaaggtgaatcctaaggacctggactctaaatatgcttatattcaggtgacacatgtgatccccttcttcgatgagaaagagctgcaggaaaggaagacggaatttgaacgctcacacaatatacgccgattcatgttcgaaatgcctttcacccagaccggaaaaagacaaggtggtgtagaagagcagtgcaagcgcaggaccatcctgacagccatccactgttttccatacgtaaaaaagaggataccggtaatgtatcagcatcacactgatctaaaccccatcgaagtggccatcgatgagatgtccaaaaaagtcgctgaactgcgacagttatgctcctctgctgaggtggacatgattaagctccagcttaagttgcagggctccgtcagtgtgcaagtgaacgccggaccactcgcctacgcaagggccttcttagacgatacgaatacgaagagatatccagacaacaaggttaagctcttaaaagaagttttcaggcagtttgtagaggcttgcgggcaggctctggccgtgaacgagcggctgatcaaggaggaccagttggagtatcaagaagaaatgaaggctaattatagggagatggctaaggaattgtccgagatcatgcacgagcaagtcaggagaagcgccccttggcgccgtcgcagggcgtcataccgtatcccgtttactagctcaaccccgtccgtgggattacagcaagcacagtggtttacaggctag

SEQ ID NO: 55507 - DNA, 2010 bp, Artificial Sequence
  Description of Artificial Sequence: Synthetic coding sequence
tgattcaagaatcagttgcttgctgaccatggtcacaaccctcttatgaagaaggtgttcgatgtctatctgtgcttcctccagaagcaccagagtgagacagcactgaaaaacgtcttcacagccttaagatccttgatatataaatttcctagcaccttctatgaaggtcgcgctgacatgtgtgccgcactttgctacgaaatcctgaagtgctgtaattcgaaactgtccagcattcgtaccgaggctagccagctcttatattttcttatgcgaaacaatttcgattatacaggtaaaaaaagttttgtgcgaacccatctgcaagtgatcattagcgtctctcaactcatagccgacgtagtgggcatagggggaacgcgcttccagcagagcctgtccataatcaacaactgtgcaaattccgataggttgatcaagcacacgtctttctcctctgatgtcaaggatctgactaaaagaatccggaccgtgctcatggccactgcccagatgaaggagcacgagaacgatccagaaatgctggtcgaccttcagtacagtctcgccaagtcttatgcctcaacacctgaactgagaaagacatggttagattccatggcgaggatccatgtgaaaaatggcgatttgagcgaggcggcaatgtgttatgtgcacgtgacggccttagtggctgagtatctgactcgaaaaggggtcttccgccaggggtgtacagctttccgtgtcatcacacccaacattgatgaagaggccagcatgatggaagacgtgggtatgcaggacgtgcatttcaatgaagacgtgctgatggagttgctcgaacaatgtgccgacggcctgtggaaagccgagcgctacgagctgatcgcagatatttataagctgattatccccatctatgaaaaaagaagagatttcgagaggctggcccacttgtacgataccctgcatcgtgcctacagcaaagtgaccgaggtcatgcacagcggtaggagactgttggggacatacttcagggtagcttttttcggacagcagtatcaattcaccgatagcgagacggacgttgaggggtttttcgaggacgaagacggcaaagagtacatctataaggagcccaagctcactcccctgtcagagatctctcagcgcctgctgaagttgtactccgataaattcgggagcgaaaacgtaaaaatgatacaggattccggcaaagtaaaccccaaggacttggattcaaagtatgcttacatccaagttacccacgttattcctttctttgatgaaaaggagctccaggagcgaaagacagaatttgaaagatcccacaacattcgcagatttatgttcgagatgccctttacgcagacaggaaaacgccaaggtggtgtggaggaacaatgtaaaagacgcaccattctgaccgcgatccattgcttcccttatgtgaagaaacggatcccggttatgtaccaacaccacacagacctgaatcctatagaggttgccatcgatgagatgtccaaaaaagtcgccgagctcagacaactgtgttcaagcgccgaggtcgacatgatcaagctccagctcaagttacaaggcagtgtgagtgttcaggtcaacgctggtccactcgcctacgcccgtgcctttctggacgacaccaacaccaaacgttaccctgataacaaagttaagctacttaaggaggttttccggcaattcgtcgaagcgtgtgggcaggctctggccgtgaacgagcgcctgattaaggaggaccagctggaatatcaggaggaaatgaaggcaaattatagagagatggcaaaagagctatctgagatcatgcatgagcaaatttgccccctggaagagaagacatcagtgctgccaaactctctgcacatctttaacgcgatcagtgggacccctacgtctactatggtccacggcatgacctcttcatccagcgtggtatag

SEQ ID NO: 55508 - DNA, 6239 bp, Artificial Sequence
  Description of Artificial Sequence: Synthetic coding sequence
atgagccagcccccactgctgccagcaagcgccgagacccgaaagtttactcgtgccctctcgaaaccgggtaccgctgccgagctccggcagtctgtgagcgaagtcgttcggggttccgtgctgctcgccaaaccgaagctgatcgaacccttggattacgagaatgtgatagtacagaaaaaaactcagattcttaatgactgcttgcgtgagatgctgctgttcccctatgatgatttccaaacagccatcttaaggcgccagggcagatatatctgctcgactgtgcccgcaaaagctgaagaggaggcacaaagcctttttgttactgaatgcattaagacatacaactccgactggcacctagtgaactataagtatgaggattactcgggggaattccgccagttgcccaataaggtcgttaaattggacaaactcccagtccatgtgtatgaagtggacgaagaagttgataaggacgaggatgccgcttccttggggagccaaaagggcggtattaccaaacatggctggctgtacaagggcaacatgaactccgccatctccgtgacaatgcgaagctttaaacgaagatttttccatctgatccaattaggggacgggtcatacaatctgaatttttataaagacgagaaaatctcaaaggaaccaaaaggtagcatcttcctggactcatgtatgggggtggtgcagaacaataaggtgcgtagatttgccttcgaattaaaaatgcaggataagtcctcttacctgctggccgcagactctgaagtggaaatggaagagtggatcaccatcttaaataaaatcctgcagctaaactttgaggcagccatgcaggaaaagcgcaatggcgattcacacgaggacgacgagcagtctaaactcgagggctctgggagcggcctcgattcatacctgcctgagctcgccaagtctgcccgagaagctgagattaagctgaaaagcgagagccgcgtgaagctgttctatctggatccagatgctcagaagttggacttttcctcggcagagccggaggtcaagtccttcgaggagaagtttggcaagcggatcctcgtcaaatgtaacgacctgagcttcaatctgcagtgctgcgtcgccgagaacgaggagggtccaacgactaatgtagagccattctttgtaaccctctcactgttcgatattaagtacaacagaaaaatatccgccgactttcatgtggacctgaatcacttcagcgtcagacagatgctggcaaccacaagtcctgctctgatgaatggaagcggtcagagcccgagtgtgctcaagggaatcctccacgaggcggctatgcagtatcctaaacaaggcatattctcagtcacctgtcctcaccctgacattttccttgtggcccgaatcgagaaagtgcttcagggaagtataacccattgcgccgaaccttatatgaagtctagcgactctagcaaggtggcacaaaaagttctgaagaacgctaagcaggcatgtcagagactggggcaataccgtatgccatttgcctgggcggctcgcaccctgtttaaggacgccagcggtaacttggacaaaaatgctcggtttagtgctatttacaggcaggattctaataagctgtcaaatgacgacatgttaaaacttttagccgattttcgtaagccggagaaaatggcgaagctcccagtgatactgggcaatttggatataacaattgacaacgtaagttctgactttcccaattatgtgaattcctcctacatccccaccaaacaattcgagacatgctcaaagactcccattacattcgaggttgaggagttcgtgccctgcataccaaaacacacccagccctacaccatctacactaaccatctctacgtctatccaaagtacctgaaatatgactcccagaaatctttcgcaaaggccagaaacatcgcaatctgcattgaatttaaggattccgatgaggaagacagtcagcccctgaaatgtatctatgggaggcccggaggccctgtcttcacccggagcgcctttgcagccgtattgcatcaccatcaaaatcccgagttctacgatgagatcaagattgagctgcccacgcagttgcacgaaaagcatcatttgctgctgaccttctttcacgtctcctgtgataatagttctaagggatcgaccaaaaaaagagacgtggttgagacccaggtgggctattcgtggttgcctctgctgaaggatggtagagtagtcacgtccgaacagcacattcccgtttcggcgaacttgccgagcggatatttggggtatcaagagctaggcatgggcaggcattatgggccagaaattaaatgggtggatggaggcaagcccctgcttaagatttcgacacatctggtttctaccgtttacacccaggatcaacatttacacaactttttccaatattgtcaaaagacggagagcggcgctcaggcacttgggaacgaactggttaagtaccttaaatccttacatgccatggaaggtcatgtgatgatagctttcttacctactatcttgaatcagctcttcagggtcctgacgagggcaacacaggaggaagtggccgtgaatgtcacaagggtcattatccatgtcgtggctcagtgccatgaggagggattggaatcccatctccgaagctacgtaaagtacgcatacaaggcagaaccatatgtagcttccgaatataagactgtgcacgaagagctcaccaagtccatgaccacaatccttaaaccttcggcagattttttaacctcaaataagctcctgaaatatagctggtttttctttgacgtccttattaagtccatggctcaacatctcatcgaaaacagtaaggttaaactactgcgtaatcagaggttcccagcgtcctaccaccatgctgtagagactgtcgtcaatatgctgatgccacacattacgcaaaagttccgtgataacccggaggctagcaagaatgctaaccattctttggctgtgtttatcaaaaggtgcttcacctttatggatagggggttcgtctttaagcagataaacaactatattagctgcttcgctccgggtgatcccaaaaccctctttgagtacaaatttgagttcctgagggtcgtctgcaaccatgagcactacatccctttaaacctgcctatgccgttcgggaaaggcaggatccagcggtaccaggacctgcagttagattatagtctgacggatgagttctgtaggaaccacttcttggttggcctgttgctacgggaggtgggcacagcacttcaggaattccgggaggtgcgtctaattgcaatctccgtccttaaaaatctgctgataaagcatagtttcgatgacagatatgcttctcgatcccaccaggctcgtatagcgacgctgtacctgccattattcggccttctgatcgagaatgtccagaggatcaatgtgcgtgatgtgtccccatttcccgtcaatgccggtatgacagtgaaagatgagtccctggctcttccggctgtgaaccccttggtgactccccagaaggggagcacactggacaacagccttcataaggatctgctaggcgctatatccggaattgctagtccctacacaaccagtaccccgaacatcaactccgtacgcaacgccgatagccggggtagcttaatatcgacagactccggcaattccctcccggagcgcaactcagaaaagagcaatagcctggacaaacatcagcagtcttccaccctgggcaattcggtcgtcagatgtgataaactcgatcagtcagaaataaagtccctcctgatgtgcttcctttacatcctcaaaagtatgtcagacgacgccctgtttacatactggaacaaagcttctacaagcgaacttatggatttttttaccatttcagaagtgtgtctgcatcagtttcaatacatgggaaaaaggtacatcgccaggactggaatgatgcacgccaggttgcaacagctggggtccctcgataacagtctgacctttaatcatagttacgggcacagcgatgccgatgtgctgcaccagagcctcctggaggcaaatatcgcaacggaggtgtgtcttactgcactggacaccctgtcactatttactcttgccttcaagaaccagctgctggccgaccatggccacaaccctttgatgaagaaagtttttgacgtctacctctgctttctccagaagcatcagagcgagaccgcgctgaaaaacgtctttacggccctacgatcccttatctataaatttccctctaccttctatgaaggcagagccgacatgtgtgcggcactctgctatgagattttgaaatgctgcaatagcaagctctcgagcattcggaccgaggcaagtcagcttttatatttcctcatgagaaacaatttcgattacaccggcaagaagtccttcgtcagaacacacctgcaggtgatcatctccgtgagccagctcatcgccgacgtggttggtatcggcggaacgcgcttccagcagagtctctcaattatcaacaactgtgccaatagcgaccgactgattaagcacacaagcttctcttccgatgtgaaagacctcacaaaaaggatccggacggtcctgatggcgacagcccagatgaaagaacacgagaatgatccggaaatgttggtggacctgcaatactctcttgcgaagtcatacgcttcaacccccgagttgagaaagacctggctggatagcatggcgaggattcacgtaaaaaatggcgatctgtcagaggcagctatgtgttatgtgcatgtcactgccctggtcgccgagtacctcactcgcaagggggtgtttcgtcaaggatgtaccgcatttcgggtaataacgcctaatatcgatgaagaggcgagtatgatggaggacgtcggcatgcaggacgtacatttcaatgaagacgtccttatggagctcctggagcaatgcgcggatggactgtggaaggcagaaaggtacgagcttatcgctgacatttacaaactgattatccccatctatgagaaacgcagagactttgagaggctggcacatctctacgacaccctgcatagggcctactcaaaggttaccgaggtgatgcactccggcaggagactgttagggacttattttcgggtggcgttcttcggacaagcagcccagtatcagttcaccgatagtgagacagacgtcgagggattctttgaagacgaagatggaaaggagtatatttacaaggagccgaaactcaccccactctcggaaattagccaacgtctcttaaagttgtacagcgataagttcgggagcgaaaatgttaaaatgattcaggatagtggcaaagtcaatcccaaagacctcgatagcaagtatgcctacatccaggtaacccacgtcatcccattctttgacgagaaagagctccaggaacgtaaaactgagttcgagaggagccataatatacgcagatttatgtttgagatgccgtttacccagactgggaaacgtcagggcggtgtggaagaacaatgtaagaggagaactattttaactgctatccactgtttcccatacgtcaagaaaagaatccctgtgatgtaccaacatcatactgacctcaatcccatcgaggtggccatcgacgaaatgtccaaaaaggtcgccgaactccggcaactttgcagctctgccgaggtggacatgatcaagcttcagctgaagctgcagggcagcgttagcgtgcaagtgaatgccggtccgctcgcgtatgccagggccttcctggacgacacaaataccaagcggtatcctgataataaggttaaactgctgaaggaagtctttagacagtttgtggaggcatgtggacaagccctagccgttaatgagcggctgatcaaggaggaccaattggaatatcaggaagaaatgaaggctaattatagagagatggctaaagagctgagtgagattatgcacgaacaggtccgtagaagtgctccgtggcgtcgtcgacgagccagctatcgcataccatttacttcaagtacccccagtgtggggttgcagcaggcgcagtggttcacaggata

SEQ ID NO: 55509 - DNA, 1173 bp, Artificial Sequence
  Description of Artificial Sequence: Synthetic coding sequence
tgacagatgaaagaacacgaaaacgaccccgaaatgctagtggatctgcaatattctctggcgaagagttatgccagtacaccagagctaaggaagacctggctcgacagcatggctaggattcacgtgaagaacggcgatctctcagaggctgctatgtgctacgttcacgtcacagctctggtggcagaataccttactaggaaggaggccgtgcagtgggaaccgccactgctgccccactctcattccgcctgcctgagaaggagcagagggggtgtgtttcggcagggctgtaccgcatttcgcgttattacaccgaacatcgatgaggaggcatccatgatggaagacgtggggatgcaagacgtacatttcaatgaggatgtcttaatggagctgctggaacagtgtgctgacggactgtggaaggccgagcgctatgaactgattgcggacatttacaagctgatcattcccatatatgagaagaggcgcgactttgagcgcctggcccatctctacgacacactgcatcgggcttattcaaaggttaccgaagtcatgcactccgggaggcgcttgctcggaacatacttccgtgtagcattctttggccagggcttcttcgaggatgaggacgggaaagaatacatctacaaggagcccaagttgaccccactaagcgagattagccagcgactacttaagctgtattccgacaaatttggaagtgagaatgtgaaaatgatccaggactctggaaaggtcaatcccaaggatctggattccaaatatgcctacattcaggtaactcatgtgatcccctttttcgatgaaaaagaattgcaggagagaaagaccgagttcgaacgtagtcataacatcaggagattcatgttcgagatgccatttacacagaccggcaaacgtcagggtggcgttgaggagcaatgtaaaagacgtacaatattaaccgccattcattgcttcccgtatgttaaaaaacgaattccggttatgtatcagcatcacactgatttgaatccaattgaggtggccatcgacgaaatgagtaaaaaagtggctgaacttcgccagctctgtagctctgctgaggtggacatgattaagcttcagctgaagttgcagggaagtgtgtccgtccagtag

SEQ ID NO: 55510 - DNA, 588 bp, Artificial Sequence
  Description of Artificial Sequence: Synthetic coding sequence
atgagtcagccaccactgctgcctgcctccgccgaaacccggaaatttactagggcccttagcaagcccggtacagcggctgaactgcgccagtctgtgagcgaggttgtgagggggtccgtgcttttagccaagcccaaattaattgaacctctggactatgaaaacgtcatcgtgcagaagaaaactcagattttaaatgattgtctgagagagatgctgctcttcccttatgacgatttccagactgctattctgagacggcaggggagatacatctgcagtaccgtgcctgctaaggcagaagaggaagcacagtccttgttcgtcactgaatgcataaaaacatataacagcgactggcacttggtcaattacaagtacgaagactattctggggagttccggcagcttcctaacaaagtggtaaagctggacaaactgcccgtacacgtgtacgaagtcgacgaggaagtagataaggatgaggacgccgctagccttgggagccaaaaaggagggattaccaaacacggttggctttacaaaggcaacatgaattccgccattagcgtgacaatgagatag

SEQ ID NO: 55511 - DNA, 6305 bp, Artificial Sequence
  Description of Artificial Sequence: Synthetic coding sequence
atgcaggccgacaagtgccggacctcaagccgaagcgtgaaaaaggaacttgttattgagagccctctgcagtacaaggatgctgcgcagggagaagtcgaagccgagtctccgggtccagtgcccgcaaagcccaagttgattgagcctctagactacgagaacgtaatcgttcagaagaagacgcagatattgaatgattgcctacgcgagatgttgctgtttccgtacgatgacttccaaacagcaatcttgaggcgtcagggtcgatacatctgctcaaccgtccctgccaaagccgaggaggaggctcagagtttattcgtcacagagtgcatcaagacatataactcggattggcatctggtgaattacaagtacgaagactattctggggagtttaggcagcttccaaataaggtggtcaaactcgacaaacttcctgttcatgtctacgaagttgatgaggaagtagacaaggatgaggacgccgcatcactgggttctcaaaaggggggaatcacaaagcacgggtggctgtataagggaaacatgaatagcgcaataagcgttacaatgagatcttttaaacggcgtttcttccacctgatccagcttggcgacggcagttataaccttaatttctacaaggacgagaagatatccaaagagcccaagggctccatttttctggactcttgtatgggggtggtccagaataataaagtccgacgctttgccttcgagctcaagatgcaagacaagagcagttatctgctagccgcagactcagaggtcgaaatggaggagtggattaccatcctcaataaaattctgcagctaaattttgaggccgctatgcaggagaagcgaaacggtgattctcacgaggacgatgagcagagcaaactggaaggttccggaagtggactcgacagctatttgcctgagctggccaagtcagccagggaggctgagatcaagctgaagagtgaatctcgcgtgaagctcttctacctggacccagacgcccagaaactcgatttcagtagcgccgagcccgaagtgaagtcatttgaagagaaatttggtaagcgcatcctcgtcaagtgcaatgacctcagcttcaacctgcaatgctgcgtggcggagaacgaggaggggcctacaaccaacgtggaaccttttttcgttactctgtctctttttgacatcaagtacaaccgtaaaattagcgcagattttcacgtggatctgaaccatttctccgttcgccagatgctggcgacaacttcccctgcactgatgaacgggagcggtcagtccccgtctgtcttgaaaggcatcctgcatgaggccgcaatgcagtatccaaagcagggtattttcagtgtcacttgcccacaccccgacatctttctggttgctagaattgagaaggtactacaggggagcattacacattgcgctgaaccatatatgaaatctagcgattcctcaaaggtggcccagaaggtgttgaaaaacgctaaacaggcatgccagcgcctggggcagtatcggatgcccttcgcttgggccgctcggaccctcttcaaggatgccagtggaaacttggataagaacgcacggttctctgccatataccgccaggattcaaacaagctgtcgaatgacgacatgctcaaattgttagccgatttccggaaaccggaaaaaatggccaagctcccggttatattgggcaatttggacatcacgattgacaacgtctcaagtgactttcccaactacgttaatagctcatacattccgactaagcaatttgaaacatgttcgaaaactccgataactttcgaggtcgaagagtttgtgccttgcatccctaagcacacgcagccgtataccatatacacaaaccatctgtacgtgtaccctaagtatcttaagtacgatagccaaaaatcgttcgctaaagccaggaatatcgcaatctgcattgaatttaaagatagtgacgaggaggactcacagccactgaagtgcatttacggcaggcccggaggtcccgtattcacacgctccgcttttgccgcagtactgcatcatcaccaaaatcctgagttttacgacgagattaagattgaactgcctacccaactgcacgaaaagcatcacctgctgctgacgtttttccacgtcagctgcgataactcatcaaaggggtccacaaagaagcgggacgtggtcgagacgcaagtaggctatagttggctaccattgctcaaagacggtagagtggtaacatctgaacagcacatacctgtgagcgccaatctgccaagcggctatctcggatatcaggagttaggaatgggcagacattacgggcctgagatcaagtgggtcgacggcggtaaacctttactgaaaatttccacccacctcgtttcaactgtttacacacaggaccagcacctgcataatttcttccagtactgccagaaaacagaatcaggagcccaggccttaggcaacgagctagtgaaataccttaagagtttacatgcgatggagggacatgtcatgattgccttcttgcctacaatcctgaatcaactcttcagggtgttgactcgagcaacccaggaggaagtcgccgtcaacgtgacgagagtcattattcacgtggttgcccagtgccacgaggaagggctggagtctcatctgcgctcatacgtcaaatatgcttacaaagcagaaccctatgtggcaagtgaatacaagaccgtccatgaagagctcacaaaatctatgactaccatccttaagccttccgccgattttttaacaagtaacaaactgctgaagtactcctggttttttttcgatgtgttaattaagtccatggcccagcacctgatcgaaaactcaaaggtaaaactgctccgcaatcagagatttccggcaagttaccatcatgccgtggaaaccgttgtgaacatgctgatgccccacattactcagaaattccgcgacaatcccgaggccagcaagaatgctaaccactctttagcagtgttcattaaaagatgcttcacatttatggatcgtggattcgtattcaagcaaatcaataattacatcagctgtttcgcaccgggagacccaaagaccctgtttgaatataaattcgaatttctgcgggtggtttgcaatcatgagcattacatccccctgaatctccctatgccattcggcaagggacgaatccaacggtatcaagatttgcagctcgattactctctgacagatgagttttgtcgtaatcattttctggtgggtctattgcttagggaggtcggtactgctctgcaggagttccgcgaagtccgtttgattgccatatcagtgctgaaaaacctgctgattaaacattcattcgacgatcggtatgcctccaggtcgcaccaggctaggatcgcaacattatatctgccattatttggacttctgatagagaacgtccagagaattaatgtcagggacgtgtcgccattccccgtaaatgcgggtatgaccgtgaaagacgaatccctggccctgcctgctgtcaatcccttagtcaccccccagaagggttccaccctggataactcactgcacaaagatctgcttggggcaatctctgggatcgccagcccctatactacatctactcccaatataaacagtgtccggaatgccgattctcgcggatctctcatttcaaccgatagcggaaattcacttcccgaacgaaattccgagaagtctaatagtctagataaacaccagcaatcttccacgctggggaattccgtagtgagatgcgacaaacttgatcagtctgaaataaagagcctgctaatgtgttttttatatatcctaaagtctatgtctgacgacgccctgttcacatactggaacaaggcatctaccagcgaactcatggatttcttcacaataagcgaagtgtgcctgcaccaatttcagtacatgggcaagcgatatatcgccagaacaggcatgatgcacgcgaggcttcagcagcttggcagcctggataactctctgacttttaatcatagctatggtcacagcgatgccgacgtcctgcaccagtcgctgctcgaggccaatattgctacagaggtgtgtttaactgcgctggatacactcagcctcttcacgctggctttcaagaaccaattgctcgccgatcatggccacaacccgctgatgaagaaggtgttcgacgtttatctgtgcttcctgcagaaacatcaatcagaaaccgcccttaaaaacgtgtttacagcactgcgcagtctgatctataagttccctagcaccttctacgaaggaagggcggatatgtgcgcagccctttgctacgagatactgaagtgctgtaatagtaaattatcttccatccgcacagaagcgtcccaactgctgtacttcctgatgcgcaacaacttcgattacacagggaaaaaatcgttcgtcagaactcatctgcaggtaataatctctgtgtcacagctgatcgcggacgtagtcggaattgggggtacacgcttccagcagtcactctccataatcaacaattgtgctaattcggatcggctgattaaacatacaagtttctcgagcgacgtgaaggaccttactaagagaattcgtactgtgctgatggctaccgcgcagatgaaggagcatgagaacgatcccgaaatgctcgtcgaccttcaatattccctggccaagtcttatgcgagcacccccgaattgagaaagacttggctcgatagcatggccagaatccacgtcaagaacggggatctgagcgaggccgctatgtgctacgttcacgtcaccgccctggtcgcagaatatctcacacggaaggaagcagtccaatgggaaccacccttgctcccgcactcacactctgcctgccttaggagatcacgtggtggcgtctttcgacagggatgtacagcttttagggttattacacctaatatcgacgaggaggccagcatgatggaagacgtcggaatgcaggacgtccacttcaatgaggacgtattgatggagttgctggagcagtgcgccgacggactttggaaagctgagcggtacgagcttattgctgacatctataaactcataatacctatctacgagaagcggagggatttcgagcgcctggctcatctgtacgacacactgcatcgggcatactctaaagtgaccgaggtaatgcacagtggcaggcggttgttagggacatatttcagagtggctttcttcgggcaagcggcacaatatcaattcactgattctgagacggacgtggaaggtttctttgaggatgaagacggcaaggaatacatctataaagagcctaaactgacccctctctctgagattagccagaggctgctgaaactgtacagcgataaattcggcagcgagaatgtgaaaatgattcaggacagtggcaaggtcaatcctaaagacttggattccaaatatgcctatatacaggttactcacgtcattccttttttcgatgagaaggagctgcaggaacgaaaaactgagtttgagcggagtcataacataagacggttcatgttcgagatgccttttactcagactggaaagagacagggaggagtggaggagcagtgcaaaagaagaactatactcacagccatccactgcttcccctatgtgaaaaagcgcatcccggtgatgtaccagcaccacacagacctcaatccaatcgaggtggcaatagacgaaatgtctaagaaagtggctgagttgaggcagctgtgcagtagtgctgaggtagacatgatcaagctccaactgaaactgcaaggcagcgtttctgtgcaagtaaacgcaggtcctttggcatacgcaagagcgttccttgatgacaccaacacaaagaggtatcccgataacaaggtgaagttactgaaagaggtgtttcgtcagttcgtcgaagcctgtgggcaggccctcgcggtcaacgaacgtctgattaaggaggaccagctcgaataccaggaagagatgaaagctaattaccgagaaatggccaaggagctctctgagatcatgcatgaacaggtgagacggtctgcaccctggcggaggagacgggcttcgtataggattccctttacgtcatccactccaagtgttggtctgcagcaggcccaatggttcaccggcta

SEQ ID NO: 55512 - DNA, 3762 bp, Artificial Sequence
  Description of Artificial Sequence: Synthetic coding sequence
atgcaggccgacaagtgccggacgtcaagtaggtcggtaaagaaggaactggttattgaatccccgctgcagtacaaagacgcagcccagggcgaggtcgaggcggagtctcccggtccagtgccggcaaaaccaaaactcattgaacctctggattatgagaatgtcatcgtgcaaaaaaagacccagattctgaatgattgcctccgggagatgttattgttcccgtatgacgacttccagaccgccatcctcagacggcagggacggtacatttgttcaacagttccagcaaaagctgaggaagaggcccaaagcctcttcgtcaccgagtgtattaaaacctacaattccgactggcatttggtgaattataagtacgaggattactctggggaatttaggcagctgcccaacaaagtggtgaagcttgataagctgccagtgcacgtctatgaagttgatgaggaggttgacaaggatgaggatgctgccagcctggggtcccagaagggaggcattacaaaacatgggtggctttacaagggaaatatgaactctgccataagtgtgacaatgcgatcctttaaacgcaggtttttccacctgatccagctgggcgacggcagttacaatctgaatttttacaaggatgagaagatctccaaggagcctaaggggagcatatttctggacagttgtatgggggtggtgcaaaataacaaggtgaggcggttcgcttttgaattgaaaatgcaagataaatcctcctatttgctggctgccgactccgaagtggagatggaagagtggattaccattcttaacaagatcctgcagctgaatttcgaggcggctatgcaagagaagagaaatggcgatagccacgaagatgacgaacagtctaagctggaagggtccggtagcggcctggactcctatctacccgaactggccaagagtgcccgagaggccgagatcaagcttaaatcagaaagtcgggtgaagctattctatcttgatccggacgcacaaaaattggacttttcttctgctgagcctgaggtgaagtcgttcgaagagaagttcggcaagaggattctggtcaagtgcaacgacctgtcctttaatctccagtgctgtgtggccgaaaatgaagaggggcctaccacgaacgtcgagcccttcttcgtcactctcagccttttcgacattaagtacaaccgaaagatttcagccgacttccacgtcgacctaaaccatttcagtgtcagacagatgttggctactacttcaccagccttgatgaatggaagtgggcagagtccaagtgttctaaagggaatactgcatgaagccgctatgcagtacccaaagcagggaatcttttccgttacgtgtcctcatcccgacatttttcttgtggcacgcatcgagaaggtgctgcagggatccataactcattgcgcggagccctatatgaagtcctctgactccagtaaagtcgctcagaaggtgctcaagaacgccaagcaggcgtgccaacgtctagggcagtacaggatgcccttcgcttgggccgcacggaccttgtttaaagatgcaagcgggaacctcgataaaaacgcgcgattcagcgctatataccgccaggactcaaacaagctatccaatgacgatatgttaaaactgctcgcagacttcagaaagcccgaaaagatggccaagttacccgtcatcttgggtaatctggacattactatcgacaacgtaagctccgattttcccaactacgtgaactctagctacatcccaacgaaacagttcgaaacgtgtagcaaaacccctattaccttcgaggtggaggagtttgtgccttgcatacctaagcacacccagccttacaccatttatactaatcatctctatgtctatcccaaatacctgaaatatgactcacaaaagagcttcgccaaagcgcgaaacattgctatctgcatagagttcaaggactctgatgaggaggattctcaacccttaaagtgtatctacggcagacccggaggacctgtgttcactcggtcggctttcgcagctgttttgcatcaccaccagaaccctgaattctatgacgagattaagatcgaactacccacccagctccatgagaagcaccacctgctcctcacgttcttccacgtgtcttgtgataactcttccaagggaagtaccaagaaacgcgacgtggttgaaactcaggtgggatactcatggcttcccctattgaaggatgggagagtggttactagtgagcagcacatcccagttagtgccaacctccccagcggctatctgggatatcaggaacttggcatgggccgtcattacgggcctgagattaaatgggttgatggaggtaaacccttactgaagattagtactcatctggtatccacagtgtatactcaagaccagcacttgcataatttcttccaatattgtcagaaaacggagtcaggagcgcaggccttaggcaatgagctggtgaaatacctcaaatctcttcatgctatggaaggccatgtcatgatagcctttctgcccacaatcctcaatcaactgtttcgggtgctgacacgcgctacgcaagaggaggttgccgtgaatgtaacccgggtaattattcatgttgtggcacaatgtcatgaggagggtctggagagccaccttcggagctacgtcaaatatgcttacaaagccgagccctatgtcgcctcagaatacaagactgtccacgaagaactgaccaaaagtatgacaaccatactaaagcctagcgcagacttcctgacctctaataaactactgaaatactcttggttcttcttcgacgtgcttatcaagagcatggcccagcatttgattgagaattccaaggtaaagctgctgagaaatcagcgcttccccgcttcctatcaccacgctgtagaaaccgtagtgaatatgctgatgccacatattacgcagaagttccgcgacaatcctgaagcgtccaaaaacgctaaccatagcctggccgtcttcataaagaggtgcttcactttcatggatagagggttcgtcttcaagcaaattaataactatatctcttgctttgctccaggcgatcccaaaacgctgttcgagtacaaatttgagttcctgcgggtggtttgtaatcacgagcactatattcctttgaacctgcccatgcccttcggtaagggccgaattcagcgttatcaggatctccagttggactactccctgacggacgagttttgcagaaaccattttttggtggggctacttctgcgcgaagtaggtacagctctgcaggaattcagggaagtccgtctgatcgcaatcagcgttctgaagaatttactgattaaacattctttcgatgacagatacgccagtcggtcacatcaggctcgtatcgcaaccctgtatctccctttatttggcttactgatagagaacgtccagaggataaacgtgcgggacgttagcccatttcctgttaacgccggtatgacagtgaaggatgaaagtctcgctctgccggcagtcaatcctctggtaaccccccagaaaggctcgaccctggataactcgttacataaagatttgctgggagctatttcgggaattgggaatgccccatgcagttgcggcttactgagcaccatcaccctcaaagtgtcatggagtcaatag

SEQ ID NO: 55513 - DNA, 4182 bp, Artificial Sequence
  Description of Artificial Sequence: Synthetic coding sequence
atgggctgcaccacatccgttattctttttaaaggaatccgcaccgtgtttgaaaggaattgcgcatatatgtgtaaacaacagggtgagaacaatgcactcgagtatacagcctataactggaccaaggaggattctgagctgttgattagttcttggctggccaaacctaagctgatagagccactggactacgagaacgtgattgttcagaaaaagacccagattctgaatgattgccttcgggagatgctgctttttccctacgatgacttccaaaccgcaatcctccgaagacagggcagatatatctgcagtacggtgccagcgaaggctgaagaggaagctcaaagcctgttcgtaacagagtgcatcaagacctacaattccgactggcacctggtcaactataagtacgaagactactcaggagagttccggcaactgcctaataaggtcgtgaaactggacaaattaccagtccacgtgtatgaggtcgacgaggaagtcgataaggatgaggatgctgcgtctctgggctcccagaaaggtggcataactaagcatggatggctatacaaaggaaacatgaactcagcaatatctgtaacgatgcggtccttcaagcgcaggttctttcatttgattcagttgggcgatggatcttacaacctcaatttttacaaagatgaaaagatctccaaagagccgaagggcagcatttttcttgattcatgtatgggggtcgtccagaataataaagtcaggcgatttgcttttgagctgaagatgcaggacaagtccagctacttactcgcagcggattctgaggtggaaatggaagaatggatcaccatcttgaacaagatcttgcagcttaactttgaagcagccatgcaggaaaagaggaacggagactcccatgaggacgatgaacaaagtaaactggagggcagcggaagtggactcgattcctacttgcccgagctggccaagtccgcccgagaggcagagatcaagctgaagtctgaatccagagtaaagctcttctatttggatccagacgcccaaaagctggatttctcttccgccgaacccgaggtgaagagtttcgaggagaagtttgggaagagaattctagtcaagtgtaacgacctcagctttaacttacaatgctgcgtagcagagaatgaagaagggccaactactaacgtggaaccgtttttcgttactttgtcccttttcgacattaagtacaatcggaagatttctgcggatttccacgtggacttgaaccacttttctgtccgccagatgcttgccacgacgtcacccgctctcatgaatggaagtggtcaatctccctctgtgctaaaagggattctgcatgaggccgctatgcagtatcccaaacaagggatcttttccgttacctgtccacatccggatatatttttggtagccaggatcgagaaggttttgcaggggtccatcacacattgtgcagaaccctacatgaaaagctctgactcaagtaaggtggcccagaaggtgctcaagaacgcgaaacaagcatgtcagcgtctcggtcagtatcgtatgccgttcgcatgggccgctaggacactattcaaggacgccagtgggaatttggataagaatgctcgcttttccgctatttacagacaggactctaacaagctatctaacgacgatatgctgaagctcctggccgacttcagaaagcccgagaagatggctaaactgcctgtgatactgggcaatctcgatatcaccatcgacaacgtgtcaagtgacttcccaaattatgtgaattcgagttacatcccgaccaagcaatttgagacatgctccaaaacacccatcacgttcgaggtcgaggagtttgtgccctgtatccccaagcacacacagccttacaccatctatacaaaccacctgtacgtataccctaaatacctgaagtacgacagccagaagtcttttgcaaaagccaggaacatcgctatttgcattgaattcaaggacagtgatgaagaggactcacagccgctgaagtgtatctacgggcgaccagggggtcctgtgttcactagaagcgcattcgccgcagtgttgcaccaccaccagaacccagagttctatgacgagataaagattgaattgccaactcagctccatgagaaacaccacctgctcctcacatttttccatgtcagttgcgataatagctctaaagggtctactaagaaaagagacgttgtggagactcaggtcggatactcctggttaccacttttgaaggatggcagggtggtcacctctgagcagcacatcccagtctcagccaacttgccttctggctatttgggctatcaggaactgggcatgggcaggcactatggacccgaaattaaatgggtggacggcggaaagccactgctaaaaatatcgacacatttggtctctactgtctatacacaggatcagcatctacataacttctttcaatactgtcagaaaacggagagcggagctcaggccctggggaatgaacttgtgaagtacctgaagagcctgcatgcaatggaagggcacgtgatgatcgctttcctccctactatcctgaaccagctgtttcgcgtactgactcgggctacccaggaagaggtggcagttaacgtcacaagggttatcattcacgtcgtagcccaatgccacgaggaagggttagagtcccacctcaggtcatacgtgaaatatgcctataaagcagagccgtatgtggctagcgagtataagactgttcacgaagaactaacgaagtccatgacaaccatcttgaaacccagcgcagatttccttacctctaataaactacttaaatactcctggttctttttcgacgtacttattaagtcaatggctcaacatctcattgagaattctaaggtgaagctactccgcaaccagcgatttcccgcaagttaccaccacgccgtggagacagtagttaatatgttgatgcctcacatcacacagaagtttcgcgacaaccccgaggcttccaagaatgctaaccattctctcgctgtcttcattaaaagatgcttcacatttatggaccgcggattcgtgtttaagcagatcaataactacatctcgtgctttgcaccgggagaccctaagaccctgtttgagtataaatttgagttcctgagagtagtctgtaaccacgagcattacataccactgaatctgccaatgccattcggcaagggccgaatccagaggtaccaggaccttcagctggattattccctcaccgatgagttttgtagaaatcattttctcgtcggcctgttacttcgcgaggtgggtactgccctccaggaatttagagaagtgcgactgattgcaatctctgtattgaaaaacctcctaattaagcattcatttgacgacaggtacgctagcagaagtcaccaggctcggatcgcaactctttacttgcccctgtttggcctcctgatcgaaaacgttcagaggattaacgtcagggatgtgtcccccttccctgtgaacgcagggatgactgttaaagacgagagcctggccctgcccgcagtgaatccactggtaacgccccaaaaggggtcgacactggacaatagcctgcacaaagatctgctgggcgctatctctggcatcgcctccccttataccacgtccacccccaatattaatagtgttcggaatgccgattcccggggaagtctgatctcaactgactcaggaaatagcctacctgagcggaactccgagaagtccaactctctggataagcaccagcaatcgtcgacacttggcaacagcgttgtcagatgcgacaaactcgatcagtcggaaatcaagagcctcttgatgtgctttctctacatccttaagtccatgagcgacgacgccctgtttacatactggaacaaagcctctacgtccgagttaatggactttttcaccatttctgaggtgtgtctccaccagtttcagtacatggggaaacgttatattgcatccctgaccaaatgtgtcgccctgttactaccggcatggaacagaaacgatgcctgccaaattgctgctgcagggcagccgggatag

SEQ ID NO: 55514 - DNA, 753 bp, Artificial Sequence
  Description of Artificial Sequence: Synthetic coding sequence
gcggatagtcgcggttcactaatttctactgatagtggaaacagcttgccagagcgcaatagcgaaaagagcaatagtctggacaagcatcaacagtcatccacacttggcaatagtgtggtgcggtgtgacaagcttgaccagtccgagataaaaagcctgctaatgtgcttcttatatatcctgaagagtatgtcagatgatgcattgttcacatattggaataaagctagcacttcagaactgatggactttttcactatatcagaggtctgccttcatcagttccagtacatgggcaaacgatacatagcctcagtgcgcaaaatcagttcagtcctcgggatctccgtggataacggctacgggcactctgatgctgacgtcttacatcagagtctcctagaagctaacatcgctaccgaagtgtgtctcacggcgcttgataccttgtcgctctttaccctggccttcaaaaatcagttgctcgcggatcacgggcacaatccccttatgaagaaggtctttgatgtttacttgtgctttctgcagaaacatcagtccgaaaccgctctgaagaacgtgttcacggccctgcggtcgctgatctacaaattcccctcaactttctacgaaggtcgagcggacatgtgcgccgcactgtgttatgaaatactgaagtgttgcaatagtaagttgtcatcaataaggacggaggccagtcagctgctgtactttcttatgaggaattag

SEQ ID NO: 55515 - DNA, 351 bp, Artificial Sequence
  Description of Artificial Sequence: Synthetic coding sequence
taatcggaactgatggatttttttaccatctcagaagtatgcttacaccagtttcagtatatgggtaaaaggtatattgctcggaatcaggaggggctgggccctatcgtgcatgaccgcaaatcccagacattgcctgtgtctagaaaccggacaggaatgatgcatgctaggttacagcagttgggatctttggacaactcgttaacgttcaatcattcatacggacactccgatgccgatgttttgcaccagtccttactggaggcaaacatagccactgaagtgtgtctgacagccttggatacactctcactcttcactctggcctttaagaatcagctcctctag

SEQ ID NO: 55516 - DNA, 612 bp, Artificial Sequence
  Description of Artificial Sequence: Synthetic coding sequence
aggaaaacctggttggattccatggctcggatccatgtaaaaaatggcgatctctccgaagccgctatgtgttacgtgcacgttaccgctcttgtggctgagtacttgacccgcaaaggggtattccgccaaggctgcactgccttccgcgtgataaccccaaatattgatgaggaggcttctatgatggaggacgttgggatgcaggatgtgcattttaacgaggatgtgctgatggagctcctggagcagtgtgccgacggtctatggaaagcagagcggtacgaactcatcgccgatatatataagcttataattccaatttatgagaagcggagggattttgagcggctggcacatttgtacgacacactgcaccgggcatactctaaggtgactgaggtcatgcactcaggccgtcgactgctgggcacttacttccgggtagctttcttcgggcaaggttttttcgaagacgaggacggaaaggagtacatctacaaggagcctaagcttaccccgctttcagaaattagccaaaggctcctgaaactgtatagcgacaagttcggaagtgaaaatgtcaagatgattcaagacagcggaaaatag

SEQ ID NO: 55517 - DNA, 1122 bp, Artificial Sequence
  Description of Artificial Sequence: Synthetic coding sequence
atggccgaaacacgtgaagaggaaacggtatccgccgaagcaagcgggttttctgatctgagcgactccgagttcctcgagtttctcgatttggaagacgcgcaggagtccaaagctctggttaacatgcccggtccatcaagcgaatcgcttggaaaagacgacaagccaattagtcttcaaaactggaagaggggactggatatactgtctcctatggagagattccacctgaagtacctctacgttacagacctggctacccaaaactggtgtgaattgcaaaccgcatatggcaaagaattacctggatttctggcccctgagaaagccgctgtcctggataccggcgctagtatccacctagcccgagagctggagctgcacgatttggtcacagtgccggtgacaactaaggaggatgcctgggctattaagttcttgaacattctccttctgattcccaccctccagagcgaggggcacattcgggagtttcccgtgttcggcgaaggagaaggggtgctcctggttggagttatcgacgaacttcattatactgccaaaggcgagcttgagctggctgaactgaaaacccgtagaagaccaatgctgccactagaggctcagaaaaagaaggattgctttcaggtgtccctgtataagtacatattcgacgccatggtgcagggaaaggttacacccgcaagtttgattcatcatactaaactttgtctggagaaacccttaggaccaagcgtcctaagacacgcacagcaaggtggctttagtgtcaagtccctgggagacctcatggagctcgtttttctcagtttgacacttagcgacttgccggtaatcgatatacttaagatcgagtacatccaccaggaaacagccacagttctgggtaccgagatcgtggctttcaaggaaaaggaagttcgtgctaaagtgcagcactatatggcctactggatgggccacagagagccccagggggtggatgtggaggaagcttggaaatgccgcacatgtacttacgcggacatctgcgagtggaggaagggttccggggtgctctctagcaccctggctccccaagttaagaaggccaagtag

SEQ ID NO: 55518 - DNA, 1122 bp, Artificial Sequence
  Description of Artificial Sequence: Synthetic coding sequence
atggcagaaacccgtgaagaagagaccgtgtctgctgaggcatccggctttagcgaccttagtgatagtgaatttcttgaattccttgacctggaggacgcgcaagagtcgaaagctctggtcaacatgcccggtccttcttcagagagcttgggcaaggatgacaagccaattagtctgcaaaactggaagcggggtctcgacatattatcaccaatggagaggtttcacctgaagtacctttatgtgactgacctcgccactcagaattggtgtgaactccagactgcttatgggaaggagctccccggtttcctggcgcctgagaaggcggcagtgttggatacaggtgcttccattcacctggcccgagagttggagttgcatgatctggtgactgtacctgtgacgaccaaagaggacgcctgggctattaaattcctcaatatccttcttctgatccccacactccaaagcgagggacacatccgtgagttccccgtcttcggcgagggcgagggcgttctcctggtgggagtcatagacgaactgcattatacagccaaaggagaattggaactcgccgaactcaaaactagacggcgtcccatgctgcctctggaggcccagaagaaaaaggactgtttccaggtatctctgtacaaatatatcttcgatgctatggtccaaggcaaagtgacaccagcctcactaatccaccacactaaactgtgtttagagaagccactggggccatctgtgctgcgccacgctcagcaaggtggattctctgtgaagtcactgggtgacctcatggagctggtctttttgtctctgacccttagtgacttgcctgtgatagacatactgaaaatcgaatacatacaccaggaaaccgccacagtcctggggaccgaaattgtcgccttcaaagagaaagaagtgagggccaaggtgcaacattatatggcatattggatgggacaccgcgagccacagggcgttgacgtggaggaagcttggaagtgtcgcacctgtacctacgcagacatatgcgaatggcgcaaagggtccggcgtattgagtagtacactggctccacaagtcaaaaaagccaagtag

SEQ ID NO: 55519 - DNA, 1122 bp, Artificial Sequence
  Description of Artificial Sequence: Synthetic coding sequence
atggcagagacgcgtgaggaagaaactgtgagcgctgaggccagcggattctcggacttgtccgattctgaatttctggaattcctggacctggaagatgcccaggagtccaaggccttggtgaatatgcccggtccatcctccgagtcattaggaaaggacgacaagcccatttccttacagaattggaagaggggcttggacatactgagtcctatggagaggttccacttgaagtacctctacgtaaccgacctggcaactcagaattggtgtgagctacagacagcatacgggaaggaactgcccggtttcttggcaccggaaaaggcagctgtgctagatactggagcttctattcacctagcgcgagaactggaactgcacgatcttgtgacagtgccagtgaccacaaaggaggatgcatgggctatcaagttcttgaatattctccttctcatcccgacgctgcagtccgaagggcacatcagagaatttcccgtgttcggcgaaggtgagggggtgctactggttggtgtgattgacgaattgcattataccgccaagggcgagctggaactagcggagctcaagaccaggcggaggcccatgctgcctctggaggcgcagaaaaaaaaagattgctttcaagtctccctttacaagtacatcttcgatgccatggtgcaggggaaagtgacaccggcaagcctcattcatcacactaaactgtgccttgagaagccactgggaccatccgtactgaggcacgctcagcagggcggattcagcgttaaaagtctgggggatttgatggaattggtgttcctaagtctaacactatcagacctccccgtgatcgacatcctcaagatagagtatattcatcaagagacagcgaccgtgttgggaactgagattgtcgctttcaaggaaaaggaagtaagggccaaagtgcagcattatatggcttactggatgggccaccgggaacctcagggagtggatgtggaggaagcctggaagtgccgaacatgtacctatgccgacatttgtgaatggagaaaaggctccggggttttgtcttcgactcttgcgcctcaggttaagaaagccaagtag

SEQ ID NO: 55520 - DNA, 486 bp, Artificial Sequence
  Description of Artificial Sequence: Synthetic coding sequence
atggcagagacacgtgaagaagagactgtatctgcggaagcaagcggttttagcgacctgagcgatagtgagttcctagaattccttgacctagaggatgcccaggagtccaaggctctggttaacatgcccggtccttcaagcgagagcctagggaaagacgataaaccgataagcctccagaactggaagaggggattagatattctgtctcccatggagcggtttcacctgaaatacctgtatgttacagatctggccacccaaaattggtgcgagctacaaactgcttatgggaaggagctccccggattcctggccccagagaaggcagctgttctggacacaggtgcttccattcacctggctcgtgaactggaactgcacgacctggtaacagtgcctgtgacaaccaaggaagacgcctgggctattaaatttttaaacatcttactcctgataccaactctgcagagcgaaggctag

SEQ ID NO: 55521 - DNA, 675 bp, Artificial Sequence
  Description of Artificial Sequence: Synthetic coding sequence
atggccgaaactagagaggaggaaacggtgagcgccgaggcctccgggttctccgacttatctgactccgagtttttggagtttctagacctcgaagacgcccaggagtctaaggctcttgtgaacatgcccggaccatccagtgagtccctgggcaaggatgataaaccaatctctctgcagaattggaaacggggactggacatcctttccccaatggagagatttcacctgaagtatctgtacgtcacggatctagccacacaaaactggtgtgagctccaaactgcttatggtaaggaactgcctggatttctcgccccagagaaggctgcagttctggatacgggcgcttcaatccacctggctcgggaactggagctgcatgatctggttaccgtgcccgtcaccacgaaagaggacgcatgggctatcaagttccttaacattcttctcctgattccaactctgcaaagcgagggccacatccgggagtttcctgtgtttggcgaaggcgaaggggtgctgttggtcggagtgattgatgagctgcattacaccgcgaagggcgagctggaactggcggagttaaagacacgacggcgtcccatgttacccctggaggctcaaaaaaagaaagattgttttcaagtaagcctgtacaaatatatctag

SEQ ID NO: 55522 - DNA, 744 bp, Artificial Sequence
  Description of Artificial Sequence: Synthetic coding sequence
atggccgaaacgagagaagaagagaccgtttccgcggaggcctccgggttttctgacctgtctgattctgagtttttagagtttctggaccttgaggacgcccaggagagtaaggccctcgtcaatatgcctggtcctagcagcgaaagcctggggaaggatgacaaaccaatctctctgcagaactggaaacggggactggatatcctgagtccaatggaacgatttcatctgaaatatctgtacgtgaccgacctggccactcagaattggtgtgagctgcagaccgcgtacgggaaggagctgcccggatttctggccccagagaaggccgctgttctggatactggcgcttccattcacctggccagagagttggagcttcacgatttggtgactgtgcccgtgaccacgaaggaagacgcgtgggctatcaagtttctgaacatactgctgttaattccaaccttacagtctgaaggccatataagggaatttcccgtattcggagagggcgagggagtgctcctggtaggagtgattgacgagttacattataccgctaaaggtgaattggagctcgccgagctgaaaacccgcaggaggcccatgcttccactggaagcacagaagaaaaaggattgcttccaagtgagtttatataaatatatctttgatgcgatggttcaagggaaagtgacacctgcttcactgatccaccacactaagctgtgcctggagtag

SEQ ID NO: 55523 - DNA, 681 bp, Artificial Sequence
  Description of Artificial Sequence: Synthetic coding sequence
atggcagagacacgggaagaagagaccgtctccgcagaggcgtctggctttagcgatctcagcgattctgaattcctggagttccttgacctggaagacgcccaggagagcaaggctctcgtaaatatgcccggaccttcaagcgagagtctgggtaaggatgacaagccgattagtcttcaaaactggaagcggggactggacatcttgtcaccaatggagcgctttcacctgaaatacctatacgtcaccgacctcgccacacagaattggtgcgagctccagacggcttatggtaaagagctgccagggttcctcgctcccgaaaaagccgcagtcttggatacaggggcatcaattcatctggctagagagttggaacttcacgatttggtgacagtgcccgtaacaactaaggaggatgcttgggcaattaagtttctgaatattctgcttctgattcccaccctgcagtctgaaggtcacatcagagagttccctgtgttcggagaaggagaaggagtactccttgttggagtcatcgacgagttgcattacaccgcaaaaggggagttggagctggccgaattaaaaacccggaggagacccatgctgccactggaagctcaaaagaagaaagactgttttcaggtctccctctataaatacatcttcgattag

SEQ ID NO: 55524 - DNA, 303 bp, Artificial Sequence
  Description of Artificial Sequence: Synthetic coding sequence
atggccgaaactcgggaggaagaaacggtcagcgccgaagccagcggattctctgacctatcagactctgaattcctcgaatttctcgatctggaggacgcgcaagagagcaaggccctcgtcaatatgcccggaccaagctcggagtccttgggaaaggatgacaagccgatctcattgcagaattggaagagaggtctggatatcctcagtccaatggagaggtttcatctcaagtatctgtatgttactgatctggccacccagaactggtgcgagctccagacggcctatggcaagtag

SEQ ID NO: 55525 - DNA, 744 bp, Artificial Sequence
  Description of Artificial Sequence: Synthetic coding sequence
atggccgagactcgtgaagaggaaacagtgagtgccgaggcatcaggcttttcagacctgtccgactcagagttcttggagttccttgacctggaggacgcccaggaatctaaagctctggttaacatgcctggcccatcctctgaaagcctgggcaaggatgacaaaccaatctccttgcaaaactggaagagaggactggatatcttgagccccatggagcgcttccacctgaagtacttgtacgtgaccgatttggcaactcaaaattggtgcgagttacaaacggcctatggcaaggaattgccagggtttctggctcctgaaaaagccgcagtccttgacaccggcgcttctattcatctggccagggaacttgagctccacgatttggttaccgtgccagtgacaacgaaggaagacgcatgggcgatcaagtttctgaatatcctgctgctcattcctactctacaatcagaggggcacataagggagtttcccgtcttcggagaaggagaaggagtcctgctcgtgggggttattgacgaactgcattatactgccaagggagagctggaactggcagaactaaagacaaggagacggcctatgctgccattagaggcccagaagaagaaagattgttttcaggtctccctgtataaatatatattcgacgctatggtgcagggaaaagtcacccctgcaagcctgatacaccatactaagctctgtctggagtag

SEQ ID NO: 55526 - DNA, 129 bp, Artificial Sequence
  Description of Artificial Sequence: Synthetic coding sequence
tgccgcagccagaaatcctgctggattatcaagggacattgcaggaagaattgtaagcccggagaacaggtgaagaaaccatgtaagaacggagactactgttgcattcctagtaacacggacagttag

SEQ ID NO: 55527 - DNA, 876 bp, Artificial Sequence
  Description of Artificial Sequence: Synthetic coding sequence
atggtgagagagcagtacaccactgccactgaagggatctgcatcgagagacccgaaaaccagtatgtctataagattggcatatacggttggaggaagcgctgcctgtacctcttcgtcctgctcttgctgataatcctcgtggttaatctggcgctcactatctggattctgaaggtgatgtggttctctccagctgggatggggcacctttgcgtgacgaaggatgggctccggcttgagggcgaaagcgagttcctgttccccctctatgctaaggagattcattcacgggtcgacagcagcctgttgttgcaaagcacacagaacgtaacagtgaacgcacgcaatagcgagggtgaggtcactggccgattaaaggtcggtcccaagatggtcgaggtgcagaatcagcagttccagataaatagtaacgatggaaaaccactatttacggtagacgagaaagaagtggttgtgggtaccgacaagttgcgcgtcaccgggcctgagggtgcccttttcgagcattcagttgaaacaccactggtgcgcgcagatccatttcaggacctgcggttggaaagccccacacggtctctctccatggatgcgccaaggggggtccatattcaagcacatgctggtaagatagaagctctgtctcagatggatattttatttcatagtagtgatgggatgctcgtgctggacgcagagaccgtgtgcctgcccaagctggtgcaaggcacctggggcccatccggctcaagtcagagtttatatgagatctgtgtgtgtccagacggaaagctgtacctcagcgtggccggagtcagtaccacgtgtcaggaacataaccacatttgcctgtag

SEQ ID NO: 55528 - DNA, 816 bp, Artificial Sequence
  Description of Artificial Sequence: Synthetic coding sequence
atgaacttgcacgttaaaacgctgtccctcatgacatggcgatctaggtttctcgaggaaagcttttggagtctggaggagacggctgccctggctaaacagctccccttaaagtccccaagcgagaacatttttcttcacatcgttgacctttcagaccctaaacaaatttggaaattcgtggagaacttcaagcaggagcacaagctccatgtgctcatcaacaacgccggatgcatggttaataaacgagaactgactgaggacgggctcgagaaaaattttgcagccaacactctcggcgtatatattctgacaacaggcctgatacccgtgctcgaaaaggagcatgaccctcgggtgatcaccgtgtccagtggaggtatgctcgtacagaaactgaacaccaatgacctgcagtcagaaagaacaccttttgacgggacgatggtctatgctcagaacaaacgccagcaggttgtcctaaccgagagatgggcacaaggacaccctgcgattcacttcagctcaatgcacccaggatgggcagatactcctgacagaaacgaacaggaacttagaaaagtggtgggggaggcacagactgccagccctctgccaaggtttctggagatcatgatgcatgaaggcaagtgtcagccacaagggcactcaagcaacgacctggaggcttgttggtcctcagggggaggagagcaaaatagcctcccagactggccccatcagctacacgacttacggcagctgacttgggccctctgttcaagcttcctcctgtacaagcaaggaaactag

SEQ ID NO: 55529 - DNA, 954 bp, Artificial Sequence
  Description of Artificial Sequence: Synthetic coding sequence
atgagcctttaccgcagcgtagtttggtttgccaaaggacttcgggaatatactaaaagcggatacgaatctgcttgtaaagacttcgttcctcatgatttggaagttcagatccccggacgggtttttctcgtaaccggcggaaattctggcataggaaaggcgaccgcgcttgagatcgcgaagcgtggcggtaccgtgcatctcgtttgcagagatcaggcacccgcagaagacgccagaggtgaaatcatccgagaatccggaaaccagaatatattcctgcacatcgtcgacctatccgatcccaagcagatctggaaattcgtcgaaaatttcaagcaagaacacaagttgcacgtactgattaataacgccggatgtatggtcaataagcgtgagctaacggaggacgggctggagaagaactttgccgctaacacccttggcgtgtatattttgaccactgggcttattcctgtgttggaaaaagaacatgaccccagggtcataaccgttagcagcgggggtatgctggttcagaagttaaacacgaacgatctgcagtctgagagaacacccttcgacgggacaatggtttacgcccagaacaagcgccagcaggtagtgcttacggagcgctgggcccagggacatcctgcgatccatttctcctccatgcaccctggatgggccgacacccccggtgttcgtcaagccatgcctggcttccacgcccgttttggagacaggcttcggagtgaagcccagggagccgacacaatgctctggctcgccctttcttctgcggctgcagctcagccctccggaagattttttcaagataggaaacctgtctcaacccacttgccgctggccaccgcttcgtcgtcccccgcagaagaggaaaagctgatcgagatattagagcagctcgcccagactttcaagtag

SEQ ID NO: 55530 - DNA, 699 bp, Artificial Sequence
  Description of Artificial Sequence: Synthetic coding sequence
atgcagatggccaggctgcttggcttgtgtgcctgggctcggaagtccgtgagaatggcctcctctaggatgacaaggcgtgatcctctaaccaataaagtcgcgctcgtgacagcctctactgatggcattggcttcgcgatcgcaagacggctcgcccaggaccgagcccatgttgtggtcagcagccgcaaacaacagaatgtggatcaggccgtggccaccctacagggcgaagggctatccgtgacagggactgtgtgccacgttggtaaagcagaggatcgagagagactggtggccatggccgtcaagctccatggtggaatcgacatcctcgtaagtaatgctgcggtaaatcccttctttggatctcttatggacgtcacggaggaggtgtgggacaaaacactggatattaacgtcaaggctcccgcattgatgacgaaagccgtggtgcccgaaatggaaaagaggggcggtggatcggtggtaattgtaagtagcatcgcagcattctcaccatcaccaggcttttccccctataatgtgagtaagaccgctctgctcggactcaacaacacacttgctattgaacttgccccacgtaatatcagagtgaactgtctgcaccttgacctaagccgactggcaagtgccggatgcagcggttggaccagaaaaaaacgaaaagcctag

SEQ ID NO: 55531 - DNA, 648 bp, Artificial Sequence
  Description of Artificial Sequence: Synthetic coding sequence
atgcctttcccatgcctgtccctgccatcatcctgggattaccgtattggtttcgctattgctaggcggctggcccaggacagggcacatgtggtggtttctagccggaagcagcagaatgtggatcaagccgtcgctacactccaaggtgagggcctgagcgtgaccggcactgtgtgccacgtgggaaaagcagaagatcgagagagactggtggccatgaccctagacataaacgttaaggccccagcactcatgacgaaagccgtggtcccggaaatggagaaaagaggtggaggttctgtagtgatcgtcagcagcattgccgcattttcacctagtcctggattctcaccttataacgtgagtaagaccgcactcctcggtttgaataatacattggctattgaattagcgcctagaaatattagagttaattgcctgccgggtctcatcaagacctctttcagtagaatgctttggatggataaggagaaggaggagagcatgaaggagactctcagaatccgcagactgggcgagcctgaagactgcgccggaatagtctcctttctgtgtagtgaggacgcgagttacattaccggcgaaaccgtggtggtgggaggcggaacacccagccgcctctag

SEQ ID NO: 55532 - DNA, 774 bp, Artificial Sequence
  Description of Artificial Sequence: Synthetic coding sequence
atggcccgattgttaggtttatgcgcctgggccagaaaaagtgtgagaatggcctcttctcgcatgactcgccgagaccccctcaccaacaaagttgccctcgttacagcatctaccgatgggatcgggtttgcgatcgctcggaggttagcgcaggatagggcccatgtagtcgtcagctcccgtaagcaacagaacgtggaccaggccgtcgcaacactgcagggcgaaggcctaagcgtaacaggcacggtctgccacgttggcaaggctgaggacagggaaaggcttgtcgctatggccgtgaagctgcatggagggatcgacatcctggtctccaatgcagccgtgaaccccttctttggctctctgatggacgttaccgaggaagtgtgggacaagactctcgacatcaatgtcaaagctccggcactcatgaccaaggctgtggtgcccgagatggagaagaggggaggaggctcagtggtcatcgtatcctccatcgctgcgttcagcccctcgccgggtttctcaccatataatgtatccaaaactgccctcttaggcttgaataataccttggccatagaacttgcaccccgaaatatcagagtcaattgccttcaccttgatctgtcgaggctcgcctccgcaggctggttgggcgaaccagaagactgtgccggaattgtgtctttcctctgctcagaagatgctagctatatcacaggggaaacagtcgtcgtgggaggaggcactccttctcgactatag

SEQ ID NO: 55533 - DNA, 276 bp, Artificial Sequence
  Description of Artificial Sequence: Synthetic coding sequence
atggccgtaaagctccatggaggtattgatatcctagtgtctaatgcagcagtcaatcctttttttggtagcctgatggacgtgacagaagaagtctgggacaagctgtggatggataaagaaaaggaggagagcatgaaggagaccctccgcatcaggagattaggtgagccagaagattgtgccggtatcgtttcattcctgtgctctgaggatgctagctacatcaccggtgaaaccgtggtggtgggaggcggaacacctagtcgcctgtag

SEQ ID NO: 55534 - DNA, 174 bp, Artificial Sequence
  Description of Artificial Sequence: Synthetic coding sequence
atgctgtggatggataaagagaaggaagaatccatgaaggagactctgcgcatccgccgtctgggcgagcctgaggactgtgctggcatagtctcctttctgtgcagcgaagatgctagttatattacaggggagaccgtggtcgtcggaggcggaacgccttctcgactatag

SEQ ID NO: 55535 - DNA, 468 bp, Artificial Sequence
  Description of Artificial Sequence: Synthetic coding sequence
atgcagatggccagactgcttggactgtgcgcctgggccaggaagtcagtgaggatggccagctcaaggatgactcggagggatcccctgaccaacaaggtggccctagtaaccgcatcgactgacgggatagggtttgccatcgccagacggcttgcccaggaccgcgctcatgtggttgtctcaagtagaaaacagcagaacgttgatcaggcagtggcaaccctccagggggaagggctctccgtgaccgggaccgtttgccatgtcggaaaggcggaagaccgcgagcgcctggtggccatggccgtcaagctccatgggggaattgacatattagtcagtaacgctgccgtcaacccattcttcggttccctgatggatgttaccgaggaggtgtgggacaagctctggatggacaaggagaaagaagagtcgatgaaggaaacgcttagaatcaggcgctag

SEQ ID NO: 55536 - DNA, 993 bp, Artificial Sequence
  Description of Artificial Sequence: Synthetic coding sequence
atgtccccactgagcgccgctagggccgctctgagggtatacgctgttggcgcagcggtgattttggcccaacttttgcgtagatgtcggggaggcttccttgaacctgtgttcccgcctaggccagatcgcgtcgccatagtcactgggggaacagatggaattggctacagcacagctaaacacctggctagattagggatgcatgtgattatcgcgggtaacaatgactccaaagcaaagcaggtagttagcaagatcaaggaggagacacttaatgacaaagttgaattcctgtactgcgatctggctagcatgaccagtatccggcagtttgtgcagaagttcaagatgaagaagataccactgcatgtgctaattaacaatgccggagtcatgatggtaccacagaggaagaccagggacggattcgaggagcacttcgggctaaattacctgggccacttcctcctgactaatctcctcttagacaccctgaaagaatccggctcaccaggccatagcgcgcgtgtggtaaccgtgtcttctgctactcactatgtggcagagctgaacatggacgacctccagtcatcagcctgttactcacctcacgcggcttacgcccagtctaaattagcattagtcttatttacgtatcacctgcagcgactgctggccgcagagggctctcacgtgacagccaacgtggttgaccccggtgtcgttaataccgacgtttataagcacgtgttttgggccactaggctggccaagaagctactggggtggcttctcttcaagactccagacgagggcgcatggactagcatctatgcagctgtaaccccagaactggaaggggtaggcggtcattacctctataatgagaaggaaacaaagtcgttgcatgtgacctacaaccaaaagctgcaacagcagctttggtccaagtcatgtgagatgaccggcgttttagacgtcacattgtag

SEQ ID NO: 55537 - DNA, 168 bp, Artificial Sequence
  Description of Artificial Sequence: Synthetic coding sequence
atgaagatgtcctttgaacgatgcaccgcaaggaacaaaatgttcgtgaactccgcttttacaaaagtcgataattattgtacattcctgatggaaaaagtattgttcaaggtgttattcctggtggaatattatcagaagggcaagaaaaatgatttaaacttttag

SEQ ID NO: 55538 - DNA, 168 bp, Artificial Sequence
  Description of Artificial Sequence: Synthetic coding sequence
atgaaaatgtcatttgagcgctgtacggctagaaataaaatgtttgtgaactctgcgtttacaaaggtcgacaattactgcacattcctgatggagaaggttctctttaaggtactgtttctggtggagtattaccagaagggtaaaaagaatgatcttaatttctag

SEQ ID NO: 55539 - DNA, 483 bp, Artificial Sequence
  Description of Artificial Sequence: Synthetic coding sequence
atggctagccctgcccctttggtggccagcataagtcatcaaatggtcgcacttcagacactgcaactgttgcagcaagagtgggggtggggagacggtccagtggcaccgggaaatccgagagatcctgaccacgtctccaccgctcctgcaagaaggtccggacctcccagagccagacctgggcctggcagggaagagagagggggtggtgtgggcacgagatccagacgcactgctgccagggcaaactcccctgaagaggaggtcgtgcggggtgctgaggggggtgctgagctcctcccctttccacgtgacagaggcccatgcacattggcacagatggccatgcgtagcgccctggcgagagtggtagatagcacctccgagctggtgtctgtggaacagaccctactgggtcccctccaacaggaaaggagtttccccattcacctgaagctgcagctgttagcaaatgaatag

SEQ ID NO: 55540 - DNA, 525 bp, Artificial Sequence
  Description of Artificial Sequence: Synthetic coding sequence
atggcgtctcctgcaccactcgtggcctccatctcccaccagatggtcgccctccaaacacttcagcttctgcaacaagagtggggctggggagatgctgccagagcaaattcccctgaagaggaggttgttaggggcgctgaagggggagcagaactcttgccctttccacgcgatcgcggaccatgcactctagcccaaatggccatgagaagtgctttggcgcgagtggtcgactcaaccagcgagctggtctctgtggagcagaccctgctcggtcctctccagcaggaaagatcctttcccatccatttgaaagatagtgttgaattccggaacatatgctcacatttagccctgcagattgagggtcagcaatttgaccgggatttaaacgccgctcatcagtgcctcaagaccatcgttaaaaaactgattcagtcactggccaatttccctagcgatgcacatatggttgcttgtgcttctcttcggcagattctgcagaacctgcccgacatatag

SEQ ID NO: 55541 - DNA, 666 bp, Artificial Sequence
  Description of Artificial Sequence: Synthetic coding sequence
atggcctctcctgcgccacttgtagcctccatctcgcatcagatggtggccctccagacacttcaactgttgcagcaggaatggggatggggcgatggacctgtggccccaggcaaccctcgggaccctgatcatgtttcaactgcacctgctagacgcagtggaccaccacgggctcgccctggtccaggtcgggaggaacgcggaggaggagtaggaacccgttcccggcgaacagcagccagggcaaacagcccagaggaggaggtcgttagaggtgccgagggaggagctgagttgttaccctttccaagggaccgcggaccctgtacactcgctcagatggctatgagaagtgctctggcacgcgtggtggacagcacgtcagagcttgtgtcagttgaacagactctgctcgggccacttcagcaggaacgctcttttccgattcatctgaaagacagtgttgagtttcggaacatctgctcacatcttgccttacagatagagggccagcaatttgatcgggatctgaacgccgctcaccaatgcctgaagacaattgtaaagaagttgattcagtccctggcaaatttcccctccgatgctcatatggttgcgtgtgccagcctgcgccaaatcctgcagaaccttccagatatctag

SEQ ID NO: 55542 - DNA, 513 bp, Artificial Sequence
  Description of Artificial Sequence: Synthetic coding sequence
atggccgtgacaggctggctggagtcactccgtaccgcccagaagacggcactgctgcaagacggaaggagaaaagtgcactacctgtttcctgacgggaaagaaatggcggaagaatacgacgagaagacgtcggagcttttagtgcggaaatggagagtgaagtccgcgctgggtgccatgggtcagtggcagttggaagtgggagatcccgctccactgggagctggcaatcttggcccagagctgattaaagagtctaacgcaaacccaatttttatgcgcaaggacacaaagatgtcattccaatggcgcatcagaaacttgccgtatccaaaagacgtctacagcgtctcagtggaccagaaagagcgttgtattattgttaggacaactaacaagaaacggaccggatggagattgctatggactcccctagctatgcgctgcgccggtgtacacgggaccccctccgagatcgacacctcctacctgtggatgacgccttgttag

SEQ ID NO: 55543 - DNA, 513 bp, Artificial Sequence
  Description of Artificial Sequence: Synthetic coding sequence
atggccgtgacaggctggcttgagtctctgcggactgcacagaaaacagccttattgcaagatggtcgacggaaagtgcattatttattcccagacggcaaggagatggccgaagagtacgacgagaaaacttcggagctattagtccggaagtggcgagtgaagagtgcccttggagctatgggacagtggcagcttgaggtgggagacccagctccccttggggcaggcaatctcgggccagagcttattaaggagtctaatgctaaccctatctttatgaggaaggacaccaaaatgagctttcagtggaggatcaggaatcttccatatccaaaggacgtatattctgtgagcgtagaccagaaagaacgctgtatcattgtacgtactacaaacaaaaagaggactgggtggcggctattatggacacctctggccatgcgctgcgccggagtacatggaaccccttcggagattgacacgtcttacctgtggatgaccccatgttag

SEQ ID NO: 55544 - DNA, 354 bp, Artificial Sequence
  Description of Artificial Sequence: Synthetic coding sequence
atggctgaggaatacgacgagaagaccagcgaacttctggtccgaaagtggagagtgaagtccgcccttggggctatgggccagtggcagttggaagtcggtgaccccgcacccctgggagcagggaatttaggacccgagttgatcaaggagtctaacgcgaatcccatttttatgcggaaagacactaaaatgtccttccagtggcgaatcagaaacctgccatacccaaaagatgtgtattctgtttctgtggaccaaaaggagcggtgcatcatagtgagaaccacaaataagaataccagatctcagcgccgactgtggtggccctccctctcttaccggagaaactag

SEQ ID NO: 55545 - DNA, 612 bp, Artificial Sequence
  Description of Artificial Sequence: Synthetic coding sequence
atggcagttacaggctggctagagagcctgagaacagcacaaaagaccgccttacttcaggacgggagaaggaaggtacattatttattcccagatggtaaagagatggctgaagagtacgacgagaaaacctccgagttactggtgcggaagtggcgggtaaagagtgctcttggcgcaatgggccaatggcagttggaggtgggcgaccccgctccactcggggctggaaatctggggcctgagctgatcaaggaatctaacgcaaacccaatatttatgagaaaagacacaaagatgagttttcagtggcgcatccggaacctgccttatccaaaggacgtatatagcgtgagcgtggaccaaaaggagcgttgcataatagtcagaacaactaacaagaagtactacaagaagttctccataccagacctggaccggcaccagctccccttggacgacgccctgctttcatttgcacacgctaactgcaccctcattatttcctaccagaagcctaaagaagttgtggttgctgaatctgagcttcaaaaggagctgaaaaaggtcaaaaccgcacattccaatgacggggactgtaaaactcagtag

SEQ ID NO: 55546 - DNA, 741 bp, Artificial Sequence
  Description of Artificial Sequence: Synthetic coding sequence
atggaaacccggaggggccgacgcagaacattcggcggtgaatgggagcggcctgcacccgtgctcgtcagcgctagccgccacggcggtgctcaaagaaggtcctgtggcgagatgggtcatgggagatcccggtgcggagagccgtccggaaacggtggagtgtcacagttgcgagtgaagagtcgagctggcgctgtctacagcccttgtactcagctggcgcaggcgagggagagtcagctcggagccaggcgaaagctcgaatgtccaacccccgcaccgcgagtctctccaaccccacgggtcggccctagggttgggagcacaactggacaggcttcacaccccggagtcggccgtaaccgacctctgacgtctagggccaacgagtcaggcaggcggggagagggtggacaaatggcgcgaattgcctctgaatctgccggtagcgatcctcttgagcggctgccttggcagcgtttgggcgtgctgctgagtcgcggaaagatggctgtgaccggctggctggagtcactgagaacagcgcaaaaaacagcccttcttcaggatggcaactctcgggttcccactggcagttttgtcttcttcccccagggccctgccttacgtgagggaccgcaaggcttggggcgacagagctggaaagggttggggggtcagcccggacaggtgcttcatctgcaaatgagacggctgaggtttacagagatgacatag

SEQ ID NO: 55547 - DNA, 351 bp, Artificial Sequence
  Description of Artificial Sequence: Synthetic coding sequence
gcagaggaatatgacgaaaaaacttcggaacttctggtacgaaagtggcgtgtgaagtctgctcttggggcaatgggccagtggcagcttgaagtcggggatcccgcacccctcggggcaggcaacctgggaccagagctgataaaagagtcgaatgcaaatccaatcttcatgagaaaggacacaaagatgtcattccagtggcggatccgaaacttgccataccccaaggacgtgtattcagtgtcagtggaccagaaggaaagatgcattattgtgaggaccacgaataagaatactagatcacaacgtcgcctgtggtggccttccctctcatacagacgaaattag

SEQ ID NO: 55548 - DNA, 3030 bp, Artificial Sequence
  Description of Artificial Sequence: Synthetic coding sequence
atggacatgttcagcctggatatgattatctccgatcccgctgccgaggcatccagagcaggcaaaaagcagctgcggggtgttcagaacccatgtccctccgccagagcgagacccagacacaaaagcttgaacattaaggacaagatcagtgagtgggagggtaagaaggaggtgccgacacctgcaccaagccggagggctgatggtcaggaagactatctgcccagttctaccgtggagagacggtcttccgatggcgtgcgaacacaagtgacagaagctaaaaatggaatgagaccaggcactgagtccaccgagaaggagagaaataaaggggctgtcaatgtggggggacaggacccagaacccggacaggacctgagtcaacctgagagggaggtcgatccttcatggggtagggggagagagccaagactggggaagctgagatttcagaatgaccccctaagcgtgctcaagcaagtgaagaagctggagcaggccctcaaggacggcagtgctggtttagatccgcagttacccggaacctgctactctccgcactgccctcccgataaagccgaggcgggatctactctccctgagaacctgggcggtggcagcggctctgaggttagtcagcgcgttcatccatcagacctggagggcagagagccaacccccgaactggttgaggaccggaagggaagctgccgaagaccctgggatcggagcctggagaacgtctatcgaggcagcgagggcagtccaactaagccgttcattaatcctcttcccaagcccagacgcacattcaaacacgccggagagggtgacaaggacggaaaaccagggatcggatttcgaaaagagaaaaggaacctgccacccctgccaagcctgccgcctccccctctgccttctagccccccaccttctagcgtcaaccgcaggctgtggacaggcaggcagaaaagtagcgccgaccatcgaaaatcatatgaatttgaggatttattgcagtcctcttcagaatcctcacgcgtggactggtatgcccagacgaagctggggcttactcggacgctgagcgaggaaaacgtgtacgaggacattctggacccgccaatgaaggagaatccatacgaagacattgaactgcacgggcgatgtctggggaaaaagtgcgtactgaatttccctgcctcaccaacttctagcatcccggacaccctcactaagcagtctctgtctaaaccggcatttttccgacaaaacagcgaaagacgtaattttaagttgctggacactaggaagttgagtcgcgatgggacgggatcgccaagcaagatctctccacctagcaccccaagcagtcccgatgacattttttttaatctgggggacccccagaacggcaggaagaaaaggaagatccccaaactagttctccggatcaacgccatttacgaggttcgaagaggcaaaaagcgcgtcaagaggctgagtcaatccatggagtcaaattcaggtaaagtgactgacgaaaactctgagagcgatagcgatacagaggagaaattaaaagctcacagtcaaaggctggtaaatgttaagagcagattgaagcaagcaccgagatacccatcattggccagagagcttatcgagtatcaagaaagacagttgttcgaatatttcgtggtagtttctctccacaagaaacaggctggtgccgcatacgtgcctgaattgacacagcagtttccattgaaacttgagcggtcgtttaaattcatgagggaagcagaggaccagctcaaagcgatacctcagttctgctttccagatgctaaagattgggtgccggtacaacaatttacttccgaaacgttctcttttgtgctgacgggcgaagacggttcccgaagatttgggtattgtcggcgactgctgcctggcggtaaggggaaacggttgccagaggtttactgtatagtgagcagactgggctgcttttccctgtttagtaggattctggatgaagtggagaagcggagaggcatcagcccagcactggtgcagccattgatgcggagtgttatggaagcaccttttccggcactgggcaagacaattctggtcaaaaattttctacctggctctgggacagaggtgattgaattgtgtaggccgctcgacagtaggctcgaacacgtggatttcgaaagcctgtttagttccctgtccgtccgtcatcttgtgtgtgtgttcgctagcctgctgctggaacggagagtgatctttatcgccgataagctctccatcctgtcaaaatgttgtcatgccatggtggctctgatatacccttttgcttggcagcacacatacattcccgtgttgccgccagctatggtggacattgtatgcagcccgacacctttcttaattgggctactgtccagttccttgcctctgcttagagaactcccactggaagaagtgttggtggtagatctcgtgaattctcggtttttacggcaaatggatgatgaggactctatactacccaggaaactgcaggtcgctctggaacatatcctcgagcagaggaacgagctcgcatgtgagcaggacgaagggcctcttgatgggcgtcacggtcctgagagctctccgttgaacgaggtcgtctctgaggcctttgtcaggttttttgtagaaatcgtaggacattacagtctgttcttgactagcggagagagagaggaaaggactttacaacgggaagccttccgaaaggctgtctcttcaaagagcctgcggcatttcctagaggtgtttatggagacacagatgttcagggggttcattcaagagcgggagctaagacggcaggatgcgaaggggctcttcgaggtgcgtgctcaggagtatcttgagactctgccctcaggggaacattccggcgtcaataaatttctgaagggcctgggaaataaaatgaaattcctgcataagaaatag

SEQ ID NO: 55549 - DNA, 240 bp, Artificial Sequence
  Description of Artificial Sequence: Synthetic coding sequence
atggatatgttcagtttggacatgatcattagcgaccctgccgctgaggccagcagagccggtaaaaaacaactgcgaggcgtccagaacccatgtccatctgcaagagctcggcctcgccacaagagtctgaacattaaggacaagatatcagaatgggaaggaaaaaaagaagttcccacaccagcgccttcccgtagagccgacggccaagaagattatctgcctagcagcacctag

SEQ ID NO: 55550 - DNA, 273 bp, Artificial Sequence
  Description of Artificial Sequence: Synthetic coding sequence
atggacatgttctccctcgacatgattatctctgaccccgctgccgaagcttccagggctggcaaaaaacagttgcgaggcgttcaaaatccttgcccttcagccagggccagaccccgacacaaaagtttgaacatcaaggataaaatctctgaatgggaaggaaaaaaagaggttccaacacccgctcccagcagaagggcagacggccaagaagattatttaccatcttcgaccgtagagagacgcagctccgacggcgtaagaacatag

SEQ ID NO: 55551 - DNA, 477 bp, Artificial Sequence
  Description of Artificial Sequence: Synthetic coding sequence
atggatatgttctctcttgacatgatcatctccgatccggctgccgaggcctcccgtgccggtaaaaagcagctccggggagtgcagaatccttgcccttcagccagggccaggcccagacacaagtctcttaacatcaaagataagatcagcgaatgggagggcaaaaaagaggtgccgacccctgccccttcaaggcgcgctgatggccaggaggactacttgcctagctcaaccgtcgaaaggagatcctctgacggggtccgcactcaggtgaccgaggcaaagaatggtatgcgccctggtaccgagtctacagagaaagagaggaataaaggcgctgtcaacgttggcggacaagaccccgagccaggccaggacctgtctcagccagaaagggaggtcgacccgtcctggggtagaggaagagaaccccgactggggaaattgagattccaaaatgaccccctgtcctag

SEQ ID NO: 55552 - DNA, 2388 bp, Artificial Sequence
  Description of Artificial Sequence: Synthetic coding sequence
atggatatgttcagtctcgacatgatcatttctgatccagcagcagaggcctcccgcgctgggaagaaacagctgcggggagttcagaatccttgtccttctgctcgcgctcgcccacgccacaagagtctgaacatcaaagataagatcagtgagtgggaggggaaaaaagaagttcctacacccgctccttcccgcagggccgacggtcaggaagattatctgccatcctctacggtggagaggaggtctagtgacggcgtgaggacgcaggtaaccgaggctaagaatggaatgcgacccggtacagaaagtactgagaaggaaaggaacaagggggctgtcaacgtcggagggcaggaccctgagccagggcaagatctatcccaaccagaacgggaggtggatccttcctggggacgcggaagggagcccaggctaggtaagctgaggtttcagaatgacccactgtccgtgctcaagcaggttaaaaagctggagcaggccttgaaggatggaagcgcgggtctagacccgcagttacccggtacctgttattccccacattgcccaccagataaagcagaagcaggaagcactttacccgagaatctcggcggtggtagtggcagcgaagtgagtcagcgagtgcacccctctgacctggagggtcgagaacctacacctgaactcgtggaagacagaaagggaagttgccgacggccatgggacaggagtctggagaacgtgtaccgcggaagcgagggatcacccacgaaaccgttcattaatccactcccaaaacctcgacgaacctttaaacacgcaggggaaggtgacaaagatgggaagcctggaattgggttccggaaggagaagcgcaatctgcccccactgccaagtctccctccccctccattaccttcctctcctccaccgtcatcagtgaacaggcgcctatggaccgggcgtcagaaatcctctgccgaccataggaaatcctacgaattcgaagatctcctgcagtcttcaagcgaaagttccagagtcgactggtacgcccagactaaactaggtctcactcggaccctgtcggaggaaaatgtgtacgaagatattctcgatcccccaatgaaggagaacccctatgaggatattgaattgcacggcagatgccttgggaagaagtgtgttctgaatttcccagcatcgcctaccagtagcatccctgacaccctcactaagcagtcattatcaaagccagcgtttttccgtcaaaactctgaacgacgcaacttcaagttactggacacccggaagttgtccagggatggaactggctcaccgtcaaaaatctcgcctccctctacaccctcctctccggatgacatctttttcaacttaggcgatccgcaaaatgggcgtaaaaagaggaagatccccaagctggtcctgcggataaacgcaatatacgaggtgcgcagaggcaaaaagagagtcaagaggctgagtcagtccatggagagtaatagtggaaaagtgaccgatgaaaatagtgaatccgattccgataccgaggagaagctgaaagcccattcccagcgtttggttaatgttaagtccagattgaaacaggcaccaaggtatccttccctcgcccgagaactaatcgagtatcaggaacggcagctgtttgagtacttcgtggtggtaagtctccataagaaacaggccggagcagcctacgtccccgagctcactcagcaatttccgctaaaactggagaggtctttcaaatttatgagagaggccgaggaccagttgaaggcaatccctcaattctgctttcctgacgctaaggattgggtgcccgtgcagcagtttacctctgagacgttcagttttgtgttaacgggggaagatggctctcgcagatttgggtactgtaggagattgcttcctggagggaaagggaagcggctccccgaagtgtattgcatcgtgagcagactcggctgtttttcgctcttctctcgcatcctggatgaagtggagaaaaggcgagggatatccccagctttagtccaaccactgatgaggtccgtgatggaggcgccttttccagccttgggtaagactattctggtgaagaactttttaccgggtagtggaaccgaagtaatcgaattgtgcagaccgctggattccaggctcgaacacgtggatttcgagagtctcttcagctccctctcagtacggcacctggtgtgcgttttcgcgagtctcctgctcgagcggcgtgtgatatttatagccgataaactgagatacccgccttggttactgttattgaaaagacttaacgacagtcgtagttggaccctgtag

SEQ ID NO: 55553 - DNA, 3030 bp, Artificial Sequence
  Description of Artificial Sequence: Synthetic coding sequence
atggatatgtttagtttggatatgataatcagtgaccccgcagctgaggcctcaagggccggaaagaagcagctgcgcggtgtccagaatccatgcccatccgcaagggccaggccacggcataaatctttgaacatcaaggataaaatatcagaatgggaaggcaaaaaggaggtacccactcctgcgccaagcaggcgggctgatggccaggaggactatttacctagctctaccgtcgaacgcaggtcaagtgacggtgtgagaacccaggtaactgaagcaaagaacggtatgcgccctggaactgagtctactgagaaagaacgcaataaaggggcagtaaacgtgggagggcaggacccagagccgggtcaggatctgagtcaacccgagcgcgaggtagatcctagttggggtcgagggcgtgagcccagactcggaaaactgcggtttcaaaacgaccctctgtctgtgctgaaacaggtgaagaaacttgaacaggccctcaaagacggatctgctggcctggatccgcagctgcctggtacgtgctactcccctcactgcccaccagacaaagctgaggcagggagtacactccctgagaatctcggcggaggttcgggatctgaagtgtcccagagggtgcaccccagtgacttagaggggagggagcccacccccgaactggtcgaggataggaaaggctcttgcaggcggccttgggacagaagcctggagaacgtttatcggggatctgaggggagcccaacaaaacccttcattaatcctctgcctaagccccgacgcaccttcaaacacgccggagagggagataaggacggaaagccaggaatcgggtttcggaaagaaaaacgaaacctgcccccacttcctagcctgccaccgccacccctcccatcgtccccaccaccttcgagtgtgaaccgacggctgtggaccggacgccaaaagtcttctgctgaccaccgcaagagctacgaatttgaagatctgctccagtcctccagcgaaagtagcagagtggactggtatgctcagactaagttgggcctgacacggacactctctgaggagaacgtgtatgaagacatcctggaccctcccatgaaggaaaacccatacgaggacatcgaattacacggaaggtgccttggcaagaaatgtgtgctgaacttcccagcaagccccaccagttctatacccgataccctcaccaagcagtccctcagtaaacctgcttttttcagacaaaattcggagcgacggaattttaaacttctggacaccaggaagctgtccagagatggaacaggcagtcccagcaagatcagtcctccttctactccaagttcgcccgatgatattttcttcaacttaggcgatcctcagaacgggagaaaaaagcgtaagataccgaagctcgtgctgagaatcaatgccatctatgaggtaagacgaggcaagaaacgcgtcaagcgactgtcccagtccatggagtctaatagcgggaaagtcactgatgaaaactcggagagtgactccgacacagaggaaaagctgaaggcccactcacagcgtcttgttaatgtgaaatcgagactcaaacaggctcctcggtatccttcgctcgcaagggagttaatcgagtatcaggagaggcagctgttcgaatatttcgtggttgtgtctctgcataagaagcaggccggtgccgcttacgtgcccgagttgactcaacagtttcccttaaaacttgaacggtcatttaagttcatgcgggaggcggaagaccaacttaaggccatcccgcagttttgctttcccgatgctaaggattgggtgccagtacaacagttcacgtctgagaccttcagctttgtgctcaccggcgaagacgggtcaagacggtttgggtactgtaggcggctgctgcccggagggaagggcaaacgactgccagaggtgtactgtattgtatccaggctgggatgctttagtctgttcagtcgcatcctagacgaggtcgagaaacggaggggcatcagtcctgccctagtccagcccctcatgagatcagtgatggaggcaccctttcccgctctcggaaagacaatcctggtgaaaaactttctccccggatctggcactgaagtgatcgaactgtgtaggccccttgacagtcgccttgaacatgtggactttgaatcccttttttccagtttaagcgtcagacacctggtttgcgtgttcgcctccctgttactggagagacgagtaatctttatcgcagataagttgtcaattcttagtaaatgctgccatgccatggtagcgctgatttatccatttgcttggcaacatacttacattcccgtgttgcctcccgcaatggtggacatagtgtgtagccccaccccattcctgatcggactgctctcctcttctctgcctcttcttcgcgagctgccccttgaggaagtactggtggtggacttggtgaattctaggttcctcaggcagatggatgatgaggattcaatcctgcctcgcaagcttcaggtggcccttgagcacatcctcgaacaacggaacgaactcgcttgcgagcaagatgagggacccctggacggtcggcacgggcctgaaagcagtcccctgaacgaggttgttagcgaggccttcgtgcgcttcttcgtcgagatcgtgggccactacagcctattcctaaccagtggagagagggaggaacgtaccctccagcgcgaagctttcagaaaggccgtgtcgtccaaaagtctccggcacttcctagaggtattcatggagacccagatgtttcggggatttatccaggagcgggaattaagacgtcaggacgccaaaggcctgttcgaggtcagagcccaggaatatctggaaaccctgccctccggagagcattcaggcgtcaataagttcctgaaaggtctcggaaataagatgaagttcctgcataagaagtag

SEQ ID NO: 55554 - DNA, 3030 bp, Artificial Sequence
  Description of Artificial Sequence: Synthetic coding sequence
atggacatgttcagcttagatatgatcatttccgaccctgctgcagaagcttccagggcaggtaaaaaacagctgcggggtgtgcagaacccgtgccccagtgctagggcacgcccacgacacaaaagtctgaatattaaagataagatttctgagtgggaagggaagaaagaagtcccaaccccagctccgtcacgtcgcgctgacggccaggaggactacctgccctcttctacagtggagagaaggtcgagtgatggggtcagaacacaggtcaccgaagccaaaaacggcatgaggccaggcaccgagtctacagagaaagaacggaataagggcgctgtgaatgtgggcggtcaggaccccgagccgggtcaggatttgtcccagcctgagcgtgaggtcgatcccagctggggaaggggtagggagcccaggctcggtaaacttcggttccagaatgaccccctgtccgtgctgaaacaggttaagaagctggaacaggctctcaaggatggatccgcaggtctcgatcctcagctccccggtacctgctatagcccccactgcccgccagacaaggccgaggcagggtcgactctccctgaaaacctgggcggtggatccggatctgaagtgtcccagcgcgtccacccatccgatctcgaaggtcgcgaacctacaccagagcttgttgaggaccgtaagggatcctgtaggcgaccatgggacaggtccttggagaacgtctatcggggtagcgaggggtcccccaccaaacccttcatcaacccattacccaaacccagaagaaccttcaagcacgcgggagagggggacaaggatggtaagcctggcatcggctttcgcaaggagaaacggaatttgcctccactacccagcctgcctcctccacccctcccttcctccccacccccttcttctgtgaacagacggctgtggaccggtcggcagaaaagctcagccgatcaccggaaatcatacgagtttgaggacctgcttcagtcatccagcgagtcctctcgagtggactggtacgcccaaaccaagttaggccttactagaacactgtctgaggagaacgtgtatgaagacatcctcgatccaccaatgaaggagaacccgtatgaggatattgagttgcacgggcgttgcctggggaaaaagtgtgtcttgaactttcctgcctcgcctacctcctctatcccggacaccctcaccaaacaaagcctgtcaaaacccgctttttttaggcaaaatagtgagcggagaaactttaagctgctcgacacccggaagctgtctcgcgacggaaccggctcccccagtaaaatatctcctccgtctaccccttcctcccccgatgatatcttcttcaacttgggggatccacagaacggcagaaagaagcgaaagattccaaagctggttctcagaatcaacgccatatatgaagttaggaggggaaagaagagggtgaagaggctatctcagagtatggagagtaattccgggaaagtgacggacgagaactctgagagcgattctgacacagaagagaaactgaaagcccactcccaacggctcgtcaatgttaaaagtcggctaaagcaagccccaaggtacccttccctggcacgagagttgattgagtaccaggagaggcagctgttcgagtattttgtcgtggtgtccctccacaaaaagcaagcaggcgcagcttatgttcccgaattgacgcagcagttccctctcaaacttgagcgttcttttaagttcatgcgcgaggccgaggaccaattgaaagcgattcctcagttctgttttccggacgcaaaggattgggtgcccgtgcagcagttcacgtctgagaccttctccttcgttctgaccggtgaagatggctcgcgtagattcggatattgtaggaggcttctcccgggtggcaagggcaagcgtttacccgaggtctattgcatcgtaagtagacttggctgcttcagcctgttcagcaggatcttggatgaggtggagaagcgccgtggcatcagccccgcactggtgcagcctctcatgaggtccgttatggaagcccctttccccgctcttgggaaaactatcctcgtgaagaactttcttccgggatccgggactgaagtcattgagctttgcaggcccctggacagcagattggagcacgttgattttgagtctctgttttcctctctgagcgtgagacacctggtgtgcgtgttcgccagcctcctgctggagaggcgcgtgatcttcattgcggacaaattgtcgatcctgagtaagtgctgtcatgcaatggtggcccttatatacccatttgcttggcagcacacatatatccctgtcctgccacctgcaatggtcgatatcgtttgctctcctaccccgtttttgattggactgctatcatcaagccttccgctcctgcgggaactcccactggaggaggtgcttgtcgtcgaccttgtcaacagtcgcttcctccggcagatggacgacgaggacagtatcctccccagaaagctgcaagttgcgttggagcatattcttgagcagagaaatgagctagcctgcgagcaggacgagggccctctggatggccgacacggtcccgaatcttctccactgaatgaggtcgtcagcgaggccttcgtgcgcttttttgtagaaattgttggtcactatagccttttcctgacttccggcgaacgagaagagcggacacttcaaagggaagcatttcgaaaggctgttagcagtaagtccttacgacattttcttgaggtgtttatggagacccagatgttcaggggtttcatccaagaacgggagctgaggcgacaggacgcaaaaggtttattcgaagtcagagctcaggagtacctcgaaacactcccaagcggagagcactctggcgtcaacaagttcttgaagggtcttggcaataagatgaaattcttgcacaagaagtag

SEQ ID NO: 55555 - DNA, 2787 bp, Artificial Sequence
  Description of Artificial Sequence: Synthetic coding sequence
atggatgtggggtttagcaggaccacagtccagactctgtctagaagccactgcaaaaacatcaaacaaaaaatctcccagtgggagggcagagccaatggaattagcaacccggagaagtggtgtcctaaagactttggcgttcggtacaattgccaccaagaaattagattaaagaagaaccccattgctgagcgcaagagcaaaaatcttgacgtcacttcccgagaaaacgtaggtttagacatcaatgagaatacgaagtcacacgaccagtcagaaaatgaaaacaagaagcacgaatacgacgacacacattttttcaaaaatgaaagcgagagcaattgggtgtgtagccgagtcaaggagatagaatcatgcaaggaagacgtgctcgaccccgagacatctctgcctcccggaaacttttatacatctcagattctttggaagaaaatcgaggccctgccgcctgacaagttgctcaatctggccctcgaacattgcgacagcagcgagaaggaactgaatttccgggtcctcgactcctcttatggcattactaaaagtctggagaatatttacagtgagccagagggtcaggagtgtggtccttccatcaatcctttgccaaagcctagacgcacgtttcgctatctgtcagagagtggcgtcactccttacaaggagcggaattgtgataaaaaatactgtgaaaataattcttgtgctcaatcttccctggcctccagtcaggagccagagccaaagaaatacgggggaaagatccgtggaagatccaagcgcaagtcatttgaatttgaggacattcagcattttaggaaccggaattctcaaactattcgcgaggaactggggagaaacagcggttctgctctgtactacactcagagcgaggacaatatctatgaagatatcatttaccccacaaaggaaaacccttatgaggacattccagtccaacctctccccatgtggcgcagtccctcggcctggaaactccctcctgccaagagcgcgtttaaggctccaaaactgcctccaaaaccccaatttctgcaccgaaaaaccatggaagtaaagaactcacaggcctacctacgcagtaaactgacaaaggacacaactttacctgtcaccctgactgagtggaaactcttccgcgctggagaggtggccaatacgaagcggaaaaatctgcctcgcctagtcctgaagattgacgacatcttcgagtccaagaggggcaagaaaaaggtcaagctccattcttatactggcaaggagctcccccctactaaaggggaaaccagcggcaacgaaagcgatgccgagtatctgcccaagaatagacataaacggctcgcccagttgcagccatcctcaaaaagaaatcctcattatcagacactggaacgcgatcttatcgagctgcaggagcagcagctcttcgagctgtttgttgtggtctcgttgcaaaagaaacccagtgggataagttacatccctcaggtgatccagcaatttcctggcaaggatgatcatggttataagcaatcaaaagacatggaagagcgcctgaaagtgatcccaaagttttgttttcccgattcaaaggattggatgccaacctcagaattgaaaagcgagaccttcagttttgtgttgaccggcgaggacgggagcaggtggtttgggtattgcaagaaattgttacccgtgggaaagggcaagcgactgcccgaagtgtactgcatggtgtcgagattgggatgctttaatctcttctcgaagatcctcgacgaagttgagaaacgccgtgaaatgtctcccgctctcgtgtatccgttcatgaggtctgtaatggaggcgcctttcccagcacccggtcggacaatcactgttaaatcctatcttcctggggcaggggacgaatctatagagctctgtcggcctcttgacagcagattggagcatgttgattttaagtgtttattcaagtgcctgtcagtttgccatctgattagggtatgcgcttcactgctactggaaaggcgagtcattttcgtggcgaattcattaagcactctgtctaagtgtggacatgccgtagtggccacactttatccctttacatggcaacacacctacatcccagtgcttcctgccagcatgatcgacattgtgtgttctcctaccccattccttattggtatcttgtcctgctcgctcccccagctccaggacctgcctatcgaggaagtgctgattgtggatctgtgtgcagacaagttccttcaggaggttagtgatgaagacgagattctgccccctaaactgcaggccgcactcatgcagatcctagaggagagaaacgagattctaacacaggaacagaacttttctcaagatgtcaccctgaacagcctggtgtccgaagcctttgtgagatttttcgtggagttggttggccattactctttgaacatgacggttactgagaggggagaacgcgtgttccagcgcgagcccttccgcaaaagccacacctcgcgatctgtgcggcatttcttggatttgttcatggaaactcaaatgttcgctggattcattcaggaccgggagctgagaaagtcaggggtgaaagggctgtttgagatccgcgcaattcagtacctcgagactataccagagtccgagccctccggaatgaatcggatccttcgctctcttggtagtaagatgaagtttctgcaaaaaaagtag

SEQ ID NO: 55556 - DNA, 2787 bp, Artificial Sequence
  Description of Artificial Sequence: Synthetic coding sequence
atggacgttggtttctcccggacaacagtgcagacactcagccgatctcactgtaagaatataaaacagaaaatttcccagtgggaggggagagcaaatgggatatccaatcctgagaagtggtgtcccaaggatttcggggtgaggtataactgtcaccaggaaattcgacttaaaaaaaatcctattgcagaaagaaaatcaaagaacctcgacgtgacctcaagagaaaacgtcgggcttgatataaatgaaaatactaaatcccacgaccaatccgagaatgagaacaaaaagcatgagtacgacgatacccacttcttcaaaaatgaaagcgagagtaattgggtgtgcagccgggttaaagagattgagtcttgtaaggaagacgtgctagaccctgagacctctctgccccctgggaacttctacacatcccaaatcctttggaaaaagattgaggctctgcccccagataaactgttaaatctagctctggagcactgcgacagttccgaaaaagagcttaattttagggtgttggacagttcctatgggataactaagtcactcgaaaatatatactccgaacctgagggccaagagtgcggcccttcaattaaccccctgcccaagccaagaagaacctttagatacttgtcggagtccggcgtcaccccgtataaagagaggaattgtgacaaaaaatattgtgaaaataactcttgtgcgcaatccagcttggcttcatcacaggaacctgagcctaaaaagtacggtggaaagatacgaggtagaagcaaacgcaaatcctttgagttcgaggatatccaacattttcgaaacaggaactcacagaccatccgggaagaacttggaagaaacagtggctccgcactatactatacccagtctgaggataacatatacgaagatatcatctaccctaccaaagagaacccatatgaggacattcccgttcagccactccctatgtggaggagcccttctgcttggaagctgcctcctgctaaatcagcctttaaggcgcctaaacttccccctaaacctcaatttctgcacagaaaaactatggaagtgaagaactctcaggcgtatttgcgcagcaagctgacgaaggatacaaccttacccgttaccctcacagaatggaaactgtttcgagcgggagaggtggccaacacaaagagaaaaaatttgcctcggctggtgctcaagatcgatgatatctttgagagcaaacgcggaaagaaaaaggtcaagctgcatagctatacgggcaaggaattgcctccaacaaagggagagacatcaggcaatgagtccgacgcagaatatttgccaaagaatagacacaaacggcttgcccagcttcagccatccagcaaaagaaatcctcattaccagacattggaacgcgatttgatcgagctccaggagcagcagctctttgaactgttcgtggtggtttcactccagaaaaagccatctggcatttcgtatatcccccaggtgatccaacagttccccggtaaagatgatcacggctataagcagagcaaagatatggaggaacggctgaaagtgatccctaaattttgctttcccgacagcaaagactggatgcctactagcgagttaaagtctgaaaccttcagttttgtgttgacaggggaagacgggtcccggtggtttgggtactgcaagaaactgctccctgttggtaaggggaaaagactgccagaggtctactgcatggtgtctagactcggatgcttcaacctgttctccaagattcttgatgaggttgagaagcggagggagatgagtcctgccttggtttaccccttcatgcgaagtgtgatggaagccccattcccagcaccaggccgaacaattaccgtgaaatcctacctccccggagctggggacgaatcaattgagttgtgtcggccactggactctcggctggaacatgttgactttaaatgtctgttcaaatgcctatccgtatgccacctcataagagtttgcgctagcttactgctcgagcgcagggtgattttcgtggcaaatagcctctctactctgtccaagtgtggacacgccgtggtggccacgctgtacccctttacctggcaacatacttatatcccagtgttgccagctagcatgatcgatatcgtgtgcagccctacaccttttttaatcgggatcctttcatgttcattgccccaattgcaagatcttcctattgaggaggtcttaatagtggacctttgtgctgataagttcttgcaggaggtgtcagacgaagacgaaattcttccccctaaattacaagcggcactgatgcagatcttggaggagagaaatgagatactcacgcaagaacaaaacttttcccaggacgtgaccttaaattcactggtttcagaagccttcgtgcgcttctttgtcgagctggtgggacactacagcctgaatatgaccgtgactgagcgcggtgagcgcgtgttccagagagagcctttccgaaaatcccatacgtctcgctccgttcgccacttcttggacctgtttatggagacccagatgttcgccggtttcatccaagaccgggaactgcgtaagtccggtgtgaaggggctctttgaaatccgggctattcaatacctcgaaaccatccccgagagtgagccgtctggcatgaacaggattctccggtcactgggtagtaaaatgaaatttttacagaaaaagtag

SEQ ID NO: 55557 - DNA, 2616 bp, Artificial Sequence
  Description of Artificial Sequence: Synthetic coding sequence
atggatgtcgggttcagtaggactacagttcaaactctaagccgaagtcattgcaaaaacatcaagcaaaaaataagccaatgggaggggagggccaacggaatctctaatcccgagaagtggtgtccaaaggatttcggtgtgcgctacaactgccaccaagagattaggcttaagaaaaaccctattgcggaaagaaaatctaaaaacctggatgtgacaagtcgcgaaaatgtgggactggacatcaacgaaaataccaaatcacatgaccagtctgagaacgagaataaaaaacacgagtacgatgatactcacttctttaaaaatgaaagcgaaagtaactgggtatgctctcgagtgaaggagatcgagtcttgtaaagaggacgttttggacccagaaacatcccttccccctgggaatttctacacatcgcagattctctggaagaaaatagaagcactccctcccgataaacttttgaatctggcacttgagcactgcgactcttccgaaaaagaactgaacttccgggtgcttgatagctcgtatggaatcactaagtcgcttgagaacatatattctgagcctgaaggccaggaatgcggaccttcgatcaatccacttcctaaaccgagaaggacttttcgctatctgagtgaatccggggtcactccctataaggagcggaactgcgacaagaagtattgtgaaaacaatagctgtgcccagtcttccctggcttccagccaggagccagagccgaagaagtatgggggtaaaatccggggaaggagcaagagaaagagctttgagttcgaggacatccagcactttcgtaatagaaactcccaaaccattcgggaagaactgggaagaaactctgggagcgccctgtactacacccagtctgaggacaacatttacgaggacattatttaccctaccaaagagaatccgtacgaagacatcccagtccagccgcttccaatgtggagatctcccagtgcatggaaactgcccccagcaaagtccgcctttaaagcaccaaaactggtccttaagatcgatgatatattcgagagcaaaagaggcaaaaagaaggtgaagctccatagctatacaggtaaagaactacccccaaccaaaggggaaactagcggcaacgaaagtgacgcagagtacctgccaaagaatcgccataagcgcctggcgcaattacagccctctagcaagcggaacccccactaccaaacactggaaagagaccttattgagctacaagaacaacagttgttcgagttgtttgtggtggtgagccttcagaaaaagccatcaggcattagttacattcctcaggtgatacagcagtttccaggaaaggacgaccacggctacaaacaatctaaggatatggaggaaagactgaaggtgattccaaaattttgtttcccggacagtaaggattggatgccgacctctgagcttaaatctgagacgttttcattcgttttgaccggcgaggatgggtcccggtggttcggttattgcaaaaagctgctgcctgtggggaaaggcaagaggctgcccgaggtgtactgcatggtttcaagactgggatgctttaatctgttctcaaagattctggacgaagtcgagaagaggcgtgagatgagtcccgctctcgtatacccctttatgcgttccgtgatggaagcaccttttcccgcacccggaaggaccataacggtaaagagctaccttcctggtgccggagatgaaagtatagagctctgccgcccactagacagcaggttggaacacgtagacttcaagtgtctgttcaagtgcctgtctgtttgtcatctcatccgggtctgcgcttctctgctcctggaacggagggtgattttcgtggctaactcactgtcaacgctgagcaagtgcggccacgccgtggtggcaacgctctatccgttcacctggcaacacacttatatcccggtcctgcccgcaagtatgatcgacattgtctgcagtcctacacccttcctgattggcattctaagctgttctcttcctcagttgcaggacctgcctattgaggaggtgctgattgtggatctatgcgctgataagttcctgcaggaggtatccgatgaggacgaaatcctaccgccaaaacttcaggctgctctcatgcagatcctcgaggaacgcaacgagatactcacacaggaacagaactttagccaggacgtcacactaaatagcctggtatccgaggccttcgtgcgtttcttcgtcgaactcgtaggacactattccctgaacatgacagtgactgaacgtggtgagcgagtgtttcaaagagagcctttccgaaaatcccacaccagccggagcgtgcggcactttctggaccttttcatggaaacccagatgttcgctgggtttatccaggaccgagagctgcgtaaaagtggagtcaagggcctctttgagattcgggctattcagtatctcgagacaatcccagagtctgaaccctccggtatgaaccgcatacttcgcagcttaggctccaagatgaagttcctgcagaagaagtag

SEQ ID NO: 55558 - DNA, 2451 bp, Artificial Sequence
  Description of Artificial Sequence: Synthetic coding sequence
atggacgtgggtttttcccgcacgactgtccagactctaagccgcagtcactgtaaaaatatcaagcaaaagatttcccagtgggagggcagagcaaacgggattagcaaccccgagaaatggtgtcccaaggattttggcgtgaggtacaattgtcaccaggaaatcagacttaagaagaatcctatcgccgaaaggaaaagcaaaaacttggacgtaacaagccgcgagaatgttggtctcgatattaacgagaataccaaatcccacgatcagagcgagaacgaaaataagaagcatgagtatgatgacacacacttcttcaaaaacgagagcgagagtaactgggtatgcagtcgggtcaaggagatagagtcctgtaaggaggatgtccttgaccccgaaacctcccttccccctggcaacttctacacttcacaaatcctttggaagaagatagaagctctccctcccgacaagctgcttaatctggcccttgaacactgtgattcttccgaaaaggaattgaactttagagtgctggactccagctacggcataacgaagagccttgaaaatatctatagcgagcccgaaggtcaggagtgcggcccaagcatcaacccattgccgaagcctcgcagaacgtttagataccttagtgaaagcggagtgactccttataaagagcgcaattgcgacaagaaatattgcgagaataattcttgtgcacaatcaagcctggccagctcgcaggagccagagcccaaaaagtacggaggaaagatcagaggacggagtaagaggaaatccttcgagttcgaggacattcagcattttcgcaatagaaactcccagaccattcgcgaagaattgggcaggaactccggcagcgcactgtactacacgcagagcgaagataatatatacgaggacatcatttacccgactaaggagaacccgtacgaagatatacctgttcagcctctgccaatgtggcgatctccaagcgcatggaaactaccacccgcaaaaagtgcctttaaagccccaaagctccccccaaaaccacagttcctacataggaagaccatggaggtaaaaaattcccaggcttatctgcgctcaaaacttacgaaggacacaactttgcctgtcactctgactgagtggaaattattccgggctggtgaggtggcgaataccaaaaggaagaatctcccgcgtctagtgttaaagatagacgatatttttgaatccaagcgcggaaaaaaaaaggtcaaattgcacagttatactgggaaagaactgccacctacaaagggcgagacgtctggaaacgagtccgacgccgaatatctgcccaaaaatcggcataagagactcgcccagctacaaccctcctctaagcgcaacccccattaccagacactggagcgagatctcatcgaacttcaggagcaacagcttttcgagttgttcgtggtcgtatctctgcagaaaaagccttcgggaatttcttacatacctcaggtgattcagcagttcccaggcaaggacgaccacggatataagcaatcaaaggatatggaggagaggctgaaggtgattcctaagttttgctttcccgattctaaagactggatgccaacatcagaactcaagagtgaaacatttagttttgtgctgactggcgaggacggcagcagatggttcggatactgtaagaagctccttcccgtgggaaagggcaaacgcctccccgaggtctactgtatggtgtcacgattgggctgttttaacctcttttctaaaatcctggatgaggttgaaaagagacgggagatgtcccccgctctagtctaccctttcatgcggtctgtgatggaggctcctttccccgctcccggtcgcactatcactctccaggacttgcccattgaagaggtgctgatcgtcgacttatgtgccgataagtttctgcaagaagtgtctgatgaggacgaaattcttcctcccaagttacaggctgctcttatgcagattctggaggagaggaacgaaatcctgacccaggagcagaatttcagccaagatgttactctgaactccctggtctccgaagctttcgttaggttcttcgtggaactcgttgggcattatagccttaacatgacagtgaccgaaaggggagagcgggtcttccagagggagccttttcgtaaatctcatacgagccgctctgttaggcactttctcgatttatttatggagacgcaaatgtttgccggattcattcaggaccgggaactgagaaagagcggagtgaagggcctgttcgagatcagagctatacagtacctagagacaattccggaatcggaaccctcagggatgaatcggattctgcgaagtctgggctacaagatgaagttccttcaaaagaagtag

SEQ ID NO: 55559 - DNA, 1416 bp, Artificial Sequence
  Description of Artificial Sequence: Synthetic coding sequence
atggaagggcaggtagtgggtcgagtatttcggctgttccagcggagacttctgcaactgcgcgctggaccaccgcaagataacagcggtgaagccttaaaggagccagagagggcccaagagcactctctgcccaactttgcagggggtcagcactttttcgagtatttgctggtcgtaagtctgaaaaaaaaacggtccgaggatgactatgagccaattattacctatcagttccctaagagagagaacttgctcagaggacagcaggaggaggaagagcgacttctcaaggccatcccgctgttttgttttccagacggaaacgaatgggcctccttgactgagtatcctagggaaactttttccttcgtgttgactaacgttgatgggtccaggaaaatcggctactgccgcagattactgcctgcagggccaggccctaggctccccaaggtctattgtatcataagttgcatcgggtgctttggattattttccaagatattggacgaggtggagaaacgccaccagatttcaatggctgttatttaccctttcatgcaggggctacgggaagccgctttccccgctcccggaaagacggtaactcttaagagcttcattccagattccggcaccgaattcattagtcttaccaggccactggattcccatctcgaacacgtggacttttccagccttctgcactgcctgtctttcgaacagattctgcagatctttgccagtgccgtattggaacgcaaaattatcttcctggccgagggcctctccacactgtctcaatgcatccacgctgccgcagcactgctttaccccttttcatgggcccacacatatattccagtggtgccagagtctttgctggcaaccgtatgttgtcccacgccttttatggtaggagtacaaatgagattccagcaggaggttatggattcccctatggaggaagtgcttttggtaaacctctgcgagggaactttcctcatgtctgttggtgatgagaaagacatcctgcctccaaaactgcaggacgacatcctggacagcctaggccagggcattaacgaattgaagacagcagagcaaattaacgagcacgtgagtggaccattcgtgcaattcttcgtgaagattgttggccattacgccagctacatcaagagggaggctaatggccaaggtcactttcaagagagatccttttgcaaagccctcacaagcaaaaccaataggcggtttgttaagaagttcgttaagactcagctgttctcactctttattcaagaggccgaaaaatcaaaaaacccgcctgctgggtacttccagcagaagatcctggaatacgaggagcagaaaaaacaaaagaaacccagggagaagactgttaagtag

SEQ ID NO: 55560 - DNA, 1407 bp, Artificial Sequence
  Description of Artificial Sequence: Synthetic coding sequence
atggacggactgggccgtcgattgcgggcttcattgagactgaagaggggacacggcggacccccacaagataatagtggcgaggctctgaaagaacctgagcgagctcaggaacattccttgcccaactttgcaggcggacagcacttcttcgaatacttgctcgtcgttagcctcaagaagaaacggtctgaagatgattatgagcctataattacataccagttccccaagcgggagaatcttctgagaggccaacaggaagaggaagaacgcctgctcaaggccattccccttttctgcttcccggatgggaacgagtgggcttctctgactgagtatccacgcgaaactttttccttcgtgctcaccaatgtggatgggagcaggaaaattggctactgccggagactgctgccggctgggcctggccctcggctacctaaggtgtattgcataatttcatgtatcggctgttttggactgttctctaaaatactcgacgaagtcgaaaagcgtcatcagatcagtatggcggtgatttacccttttatgcaaggactcagagaggcagcatttcccgctccaggaaaaaccgtgactctaaagtcatttatccctgattctggcaccgaattcattagtctcactaggccgctggactcacacctggaacatgttgatttctcttctctactccactgtctgtcattcgagcagattctgcaaatttttgcatccgctgtgctggagcgtaagattatcttcctggcagagggactgagtaccttgtcacagtgcattcacgcagccgctgccctactgtaccccttctcttgggcgcatacctacattccagttgttcccgagtcacttctggccacagtatgttgtcccacaccatttatggttggcgttcagatgcggtttcagcaggaagtcatggattctccgatggaggaagtgttgttggttaatctttgtgagggtactttcctgatgagtgtgggagatgaaaaagacatcctgcccccaaagctgcaggacgatatcctggacagtctgggacaagggatcaatgaacttaagacagccgaacaaatcaacgagcacgtgtccgggcctttcgtccagttcttcgttaagatcgtggggcactatgcctcgtacattaagcgcgaggccaacggccaaggacactttcaggagcggagcttttgtaaagcactgaccagcaaaactaacaggagattcgtgaagaagttcgtcaagacccagcttttcagcttattcattcaggaagccgagaaaagtaaaaatccccctgcagggtatttccagcaaaaaatcctggagtacgaagagcagaaaaaacagaagaaaccacgtgaaaagaccgtcaagtag

SEQ ID NO: 55561 - DNA, 3597 bp, Artificial Sequence
  Description of Artificial Sequence: Synthetic coding sequence
atgcggtcattacgaaagaaaagagagaaacctcgtccagagcaatggaagggactgcccggaccgccaagggctccagaacccgaagacgtagctgttcccggtggtgtagacttgctgactttaccgcagctctgttttcctggcggtgtatgcgtcgccacggagcctaaggaggactgtgtccatttcttagtgctgaccgacgtgtgtgggaacagaacctacggagttgtcgcacaatattaccggccactccacgacgaatactgtttttacaacggaaagacacaccgtgagtgccccggttgcttcgtgcctttcgccgtatgtgtggtcagcaggtttccgtactacaattccctgaaagactgtttatcatgtctgctggctctgctcaaaccatgcaaagattttgaggtggatagtcatatcaaggattttgcagccaagctgtcgctcattccttctccgccacccggacccctgcatctggtcttcaatatgaaatcgctgcagattgttctaccagcgcgtgcagatcccgaaagccctatcctggacctggatcttcatctcccactgctatgctttcgcccagagaaggttctccagattctcacttgcatcctgacagaacaaaggatagttttcttctcgagcgactgggctctcctaacactggtaacggagtgttttatggcctacctataccctctacaatggcaacacccctttgtccctattctgtcagaccagatgcttgattttgtcatggcacccacgtcctttctaatgggctgtcatcttgatcactttgaagaggtgtccaaagaagcagacgggttagtcttgattaacattgatcatggttcgatcacatatagtaagtctacagatgacaatgtcgatatacctgacgtccccctgctggctgcgcagacttttatccaaagagtgcaaagtctccagctgcaccacgagctgcacgcggcacatcttctttccagcacagatctgaaggaggggagggcacataggagaagctggcagcaaaagttgaactgtcagatacagcaaacgacactacagctccttgtcagcatctttcgagatgtcaagaatcacttaaattacgaacatcgcgtcttcaattcagaggagttcttgaagacccgagccccaggggaccaccagttctacaagcaggtcctggacacttatatgttccactcctttctgaaagcaagactaaaccggcgaatggacgctttcgcacagatggatctggacacacaatcagaggaggaccgcattaatggaatgctgctgtctccccgacggcctacagtagagaagcgcgctagcagaaagtcgtcccacttacacgtgacacatcggaggatggtagtgtccatgccgaacctacaggatatcgcgatgccagagctggctcctcgcaattcatccttgagactgaccgacaccgcaggatgtcggggttcttcggccgttttgaacgtcactccaaagagcccatacaccttcaaaatacctgagattcactttcccctggaatctaagtgtgtgcaggcgtatcacgcacattttgtctcaatgttgagtgaagccatgtgctttctggctcccgataattcgctcttattggccaggtacctatatttacggggtttagtatacctgatgcagggccagctgcttaatgctttgttggactttcagaacctgtataagaccgatatccgcatattccccactgacctcgtgaagagaacagtcgagagtatgagcgcccctgagtgggaaggcgctgaacaggctcctgagcttatgcgcctcatttctgagatcctggacaagcctcacgaagccagcaaactggatgatcacgtgaaaaaattcaaattgccaaaaaagcatatgcagctgggtgattttatgaagcgtgtacaggaaagcggaatagtaaaagacgcctcgatcatccacagactgttcgaagcgctcacagtgggccaggagaaacagattgacccggagaccttcaaggatttctataattgctggaaagaaacagaggcagaggcccaagaagttagtcttccatggctggtcatggaacacttagataagaacgagtgtgtgtgcaagttgagtagttcagtgaaaacaaacttgggggttgggaaaattgcgatgacgcaaaaacggctcttcctactcacagaaggcagacccggttacctcgaaatctcaactttccggaacatcgaggaggtgcgcagaactacaactacatttttgcttcgccgtatccccaccctgaagattcgagttgcctctaagaaggaagtttttgaggccaacctgaaaactgagtgtgatctctggcacctgatggtgaaggagatgtgggccggaaagaaacttgctgatgaccacaaggatccacactacgtgcagcaggccctgacaaatgtgctcctgatggatgcagtcgtagggaccttgcaaagcccgggagcaatttatgccgcatccaagttaagttattttgacaagatgtccaatgaaatgcccatgaccttgcctgagaccacacttgagactctcaagcacaaaatcaatccatcagccggtgaggcctttcctcaggctgtggacgtgctcctctacactcctggacacctcgacccagccgagaaagtcgaagatgcgcatccaaagctttggtgcgccctatcggagggtaaggttacagtttttaatgccagctcttggacaatccaccaacattcctttaaggttggcaccgcgaaagtcaactgtatggttatggcggatcagaaccaggtgtgggttggaagcgaggattcagtgatctatatcatcaatgtacattctatgagctgcaataaacaacttacggcccattgctcatctgttaccgatctgattgtacaggatgggcaggaagccccatctaacgtgtacagttgctccatggatggaatggtactggtttggaatgtatcaaccctgcaagtcacgtctcgatttcagctccccaggggcggactgacctccatccgcctgcatgggggtaggctttggtgttgcaccggcaattccataatggtaatgaaaatgaatggcagccttcaccaggaactgaagattgaagaaaactttaaagacacctctacgtcttttctggctttccagctcctccccgaggaagaacaattgtgggccgcttgtgctggcaggtccgaagtatatatctggtcattgaaggacctggctcagccacctcaaagggtccccttagaggactgctccgagatcaattgtatgattagagtcaagaagcaggtctgggtggggagtaggggactgggacaggggacgcctaaaggcaagatctacgtcatcgacgccgaacggaagaccgtagaaaaagaacttgtggcgcacatggatacagtccgaaccctttgctccgccgaggatcgctatgtcctaagtggatctggtagggaagaaggaaaggtggcgatttggaaaggagagtag

SEQ ID NO: 55562 - DNA, 3441 bp, Artificial Sequence
  Description of Artificial Sequence: Synthetic coding sequence
atgcgtagtctcagaaagaaacgtgaaaagccccgtcccgaacagtggaaggggcttcctgggccaccaagggcacctgaacccgaggatgtggccgtccctggaggagtggacctgctaaccctgccacagttatgcttcccaggaggcgtgtgcgttgcaacggagccaaaagaggactgtgtgcactttctcgtcctgaccgacgtgtgcggcaataggacttacggggtggttgcccagtactacagaccccttcacgacgagtattgcttctataacggtaaaacacacagggagtgcccgggttgtttcgttccatttgccgtctgcgtggtatcacggttcccatactataacagcctgaaggattgcctctcatgcttgctggcactgttaaaaccatgcaaggactttgaggtggattcacacatcaaggacttcgccgctaaactcagcctgattccatccccccctcccggtcccttgcatctcgttttcaacatgaaatcgcttcagatagtgctccccgctagggctgatccggaatctccgatactggacttagacctccatctgccactcttatgcttcagacccgagaaagtactgcagattctgacctgcatcttgacagaacagcggatcgttttcttctcttccgactgggccctgctgactctggttacagagtgctttatggcctacctctacccccttcagtggcagcatcccttcgtgccaattctcagtgatcagatgctggacttcgtaatggcccctactagcttcttgatgggatgtcatttggaccacttcgaggaagtcagcaaggaggctgatgggctggtgctgatcaacattgatcatggaagcatcacatattcaaagtcaaccgatgataacgtggatatccctgatgtaccactgctggccgctcaaacattcatccagcgcgatgtgaaaaatcacttaaattatgagcaccgcgtttttaatagcgaagagtttctgaagacccgtgctcccggtgatcatcagttctacaagcaggttctagacacttatatgtttcattcctttctcaaagcacgactaaaccgtaggatggatgcgtttgcacagatggatctcgacactcaaagtgaagaggatagaattaacgggatgctattaagtccccgtaggcccacagtagaaaaaagagcgtctaggaagagttcacacctgcatgtgactcacagacgcatggtcgtctctatgcccaatcttcaggatattgctatgcctgagctggcaccccgaaacagtagcttaagactgactgacacggctggatgccgcggttcgtcggccgtcttgaatgtcaccccgaagtctccttacactttcaagattcctgagattcactttccattggaaagcaaatgcgtgcaggcctatcatgctcacttcgtatcaatgctgtcagaggcaatgtgtttcttggccccagataacagcctgctcctggccaggtatttatacctgaggggtctggtctacctgatgcagggacagctacttaacgcacttctggacttccagaatctatataaaacagacatccgcatattccccacagacctggtcaaaaggaccgtagagtcaatgagcgcgcctgagtgggaaggtgcagaacaggcccctgagttgatgcgactgatctctgagatcctagacaaacctcacgaggcctccaagcttgatgaccacgttaaaaagtttaagttgcccaagaaacacatgcagctgggtgacttcatgaagcgtgtgcaggagagcggcatcgtaaaggatgcaagtattattcacaggctgttcgaggccctcaccgtgggccaagagaagcagatcgaccctgagacttttaaagatttctataactgttggaaagaaacagaagctgaggcccaagaagtgtctcttccgtggctggtgatggagcacttagacaaaaatgagtgcgtgtgcaagctgtcttccagcgtcaagaccaacctaggagtgggcaagattgctatgactcagaagagactcttcctactgacagagggtaggcccggttacctcgagatctccacctttagaaacatcgaggaagttcggcgtacaactacaaccttccttttgcggagaatccctactctgaagatcagagtggcttccaaaaaagaggtcttcgaagcgaatctaaagaccgaatgcgacctgtggcatcttatggtcaaggagatgtgggctggaaagaagctggctgatgatcacaaggatccccactacgtgcagcaggcattaacaaacgttctgcttatggacgcggtcgtgggcactctgcagtccccaggggcaatctacgctgccagcaagctgtcatacttcgacaagatgtcgaatgaaatgccgatgacactgcctgaaacaactttagagacattgaaacacaagataaatccgtcagccggtgaagcttttcctcaggccgtagatgtcctcctgtatactcccggtcacctcgacccagctgagaaggtggaggacgctcatcctaagctgtggtgcgccctctctgaaggtaaggtaaccgtcttcaacgcctccagctggacaatccatcagcacagctttaaagtgggcaccgccaaggtcaactgcatggtgatggcggaccagaaccaggtatgggtgggatcagaagattccgtcatttacattatcaacgtccacagtatgtcttgtaacaaacagctgactgcccactgtagcagcgttactgaccttatagtccaggatggccaggaagcaccctccaatgtgtactcctgctcaatggatggcatggtgctagtttggaacgtaagtactctccaggtaacctctcggttccaactgcccagagggggtctgaccagcattagactacacgggggaaggctttggtgttgtactggtaactcaatcatggtgatgaaaatgaatggctccttgcaccaagagctcaagatcgaagagaatttcaaggatactagcacctcttttctggcctttcaacttctgccagaggaggaacagttatgggcggcttgtgccggacggagcgaggtgtacatctggtccctgaaggacctcgctcagccccctcagcgcgtgccccttgaggactgcagcgagattaactgtatgattcgggttaagaagcaagtgtgggtgggcagcagaggattaggtcaaggtacacccaagggcaaaatctacgttatcgatgccgaacgcaagaccgtcgaaaaggaactagtggctcacatggacacagtgagaaccctctgttctgccgaagatcgctacgtgctgtcagggtcagggagggaagagggcaaagtggccatttggaaaggcgagtag

SEQ ID NO: 55563 - DNA, 4491 bp, Artificial Sequence
  Description of Artificial Sequence: Synthetic coding sequence
atggccgaagaacgccctccacggttggtcgactactttgtcgtggcaggactggctgggaatggcgctcccatcccagaggagacctgggtcccagagcccagcggcccattgagaccacctaggcctgctgagcccatcaccgatgttgcagttatagcaagggcactcggcgaagaagttccccagggctacacctgcatacaagcctccgccggtggacacccactggagcttagcgccggactcctcggtggaacacaacccgtgatctgttacaggcggggacgtgacaagccccctctggtggagctgggcgtgctgtacgagggcaaggaaaggcctaaacctggcttccaggtgcttgataccacgccttatagccacagcgctaatctcgctcccccaggacctggacacccgcgaacttatctcacttaccgccgagccgcagagggtgctggactccacgcactgggcatcaccgatttatgcctggtgttacctagcaagggagagggcacacctcatacgtactgccgcttaccacggaaccttaaccccggaatgtggggaccagcagtttatctgtgttacaaggtcggcctcgccaaggctaatactctcgtttatgaggccgagctgcttggacgctatcctgaggaagacaacgaggcctttcccctcccagagtccgtgcccgtcttctgcctcccgatgggcgcaacgattgaatgctggcctgctcagacgaagtacccagtgccagtgttctccacctttgtactgaccggggcagctggtgataaggtgtacggcgctgctctgcagttctatgaggcctttcccagggctagacttagcgagagacaggccagagcactgggattgctgtccgccgttgagagagggagggccctgggcggtagggccgtcagaagcaggcgcgctattgccgtgctgagtaggtggcccgcatttcctgccttcagggctttcctgacatttctctaccggtattctgtgtccggacctcatagactgccgctggaagcacacatatcccactttatacataatgtcccctttccttctccccagaggcccaggatactggtacagatgagcccttacgataacctcctgttatgccagccggtgagcagccctctgcccctttctggagcgagctttttgcaacttctgcagagtttgggccctgagctggccattaccttattgctcgcggtgctcaccgagcacaagcttttggtgcactcacttcgcccagacctgctgacctctgtatgtgaagctctggtgtccatgatttttcctctgcattggcagtgcccttatatccccctttgtccactggtgctggctgacgtactttccgcgccagtgccgttcattgtgggtatccacagttcctattttgaccttcatgatccacctgctgatgtgatctgtgtggaccttgacactaataccctcttccaaactgaggagaaaaagctgttaagtccccgaacgctaccacgccgaccctacaaggtactcctcgccacactgactaatctgtatcagcagctggatcagacatatacggggccagaagaggaggccagtttggaattcctgctcactgattatgaggcagtttgcggtcgcagagcaaggcttgagagagaggtgcagggcgcatttctgcgctttatggcctgcctattaaaaggatatcgggtgtttctgaggcccctaacgcaggcaccttccgaaggggcacgggatgttgacaatctttttttcctgcaggggttcctgaagagtcgcgagcgctcttctcacaagttgtattctcagctgctgcatacacagatgtttagccagtttattgaagagtgttcttttggaagcgccagacacgcagccctggaattcttcgattcctgcgtggaaaaagtccaccccgagcaagagaagcccgaaccaactcctctggtggaactcgaagaactatcaggctccgagttgactgttttcatcacacctcccgaggagcctgcgctgcctgagggcagtgagtcaacgccgcaatattgttacgatggcttccccgagctgagggctgagctctttgagagtctgcaggaacagcccggagctctcccggtgccagggccttctcggtccgccccaagctctccagccccacggagaacaaaacaggagatgaaggtggctcaaagaatggcgcagaagagcgcggcagtgcccgagctttgggctaggtgcctgctgggacactgctatggattgtggtttttatgtctgcccgcatatgtcaggagtgccccatccagagtccaagccttgcacactgcgtaccacgttctgagacagatggagagcggtaaggtggttttacccgacgaggtctgttatagggtcctcatgcagctctgtagtcactacggccagcctgtgctttctgtgagggttatgttagaaatgaggcaagcagggatcgttcctaacaccattacttatggctattataacaaggctgttctcgagagcaagtggccttcaggcacgcccggaggtaggctccgctgggccaaacttcgcaacgtggtcctcggcgctgcgcaattcagacagccactccgtgaaagacaacagcagcagcaacagcagcagcaacagcagcagcagcagcagcaagaacaggtgtccgcgcaccaggaagcagggagctcacaagctgagccttacttggagagaccaagcccaactcggccattgcagagacaaactacatgggcagggaggtccctgagagaccccgcttcgccacccggtagactggtgaagtcaggatccctcggcagcgcaaggggggctcagcccacagtagaagccggagtcgcacatatgatagaggccttgggagtcctggagccccgtggcagcccagttccctggcacgatggaagtttatctgatctctccttaaccggcgaggagccattgcctgggggaagcccgggagggagcggaagcgcccttagcgcccaaagcaccgaagctcttgagggtcttagcgggaggggccctaaggccggagggaggcaagacgaagcgggtacaccaaggaggggtctgggcgctcgccttcagcagctgctcaccccatcgaggcattcacccgcaagtagaatcccacctcctgagttgcctccagacctcccacctcccgcaaggcggagccccatggactctctcctgcatcccagagagcgccctggttcaacagcctcagagagttcagcctcccttggatccgaatgggatctctcagagagcagcttgtccaatctgtcgttgcggcgaagttctgagcgattgtccgacactcctggtagctttcagtctccctccttagaaatactactcagcagttgtagcctgtgccgtgcctgtgattctctggtgtacgatgaggagatcatggctggttgggcacctgatgacagcaacctgaatacaacctgccctttctgcgcttgtccatttgttcctctcttaagtgtacagaccctggactcgcggccaagtgtcccctcgccaaagtctgcaggggcttcaggttcaaaggacgctccagtgccaggcggacccggacccgtgctcagcgatcgcaggctgtgtttagcactggatgaacctcagctgtgcaatggtcatatggggggtgcttcaagacgagtggaaagcggtgcatgggcctatctcagtccactggtgcttcggaaagaactcgagtctctcgtggaaaacgaggggagcgaggtactcgcactgcccgagctgcctagcgctcacccaatcatattctggaacttgctctggtatttccagcggctcaggttaccaagcatcctcccagggctagtgctcgcatcttgtgacggaccatcccactcacaagccccatccccctggttaaccccagatcccgcatcagttcaggtgcgactgttgtgggatgtgctgactccagatccaaactcgtgtcctcctctgtacgtgctttggagggtgcacagccagatcccccagcgggtggtgtggcccggtccagtgcctgcatcactgagcctggccttactggagtcagtcttgcgccacgtgggcctcaatgaggtgcataaggccgttggcctcctactggagaccctgggcccaccccctacaggactacacttacagagaggaatttatagagaaatcctgttcctgactatggctgcactcggaaaagatcatgtagatattgtagcatttgataagaagtacaaaagtgcctttaataaactggcaagctccatgggcaaggaggaacttcgtcacagacgtgcacaaatgcctacacctaaggctattgactgcagaaagtgttttggtgctcctcctgaatgctag

SEQ ID NO: 55564 - DNA, 1002 bp, Artificial Sequence
  Description of Artificial Sequence: Synthetic coding sequence
atggtcccgggagaagagcccgcaagagagctcatggcagttttgctgacaccgaggttcagacgtctggtttcacagaacgagcttccaggaccaggcctcaatgggccaagttctcggaacagaagggatgggttttgtcggaaacggaggacaggagttcacctatgtcaagttctaatgaatcataaggtgtttgagccagtgggtatgaagaagctgtttaaaaaagaaaaagaattagaatttgaagattctaacatatcattgtacagatttctcggaaacaaaagttcttacgattgctgtaaaaggcagaaggatgctgaaaatgaatttaacgaaacgctccggcctggctacgaaatgatatccaatcccctggcacaggaaattggggaagagcgaatcgaagagttaattcacaccattaacggaaatccagctctttgccctaatataaccgtgcaaaagcctttcctgagactcagcaaagaaggggtgtccttctatactgccatcacaagtgacaagacggatgtttggaaagaacagacactgctttgtctactgcagttaatccatctccctttcctcgacaatatcctggagcccccagtgaagacccagaatctccaacttaataaggaggaggacctagtcataacaaatacctgcctggatcgggaactgattccttccttatgtcttcctgaaatagataactggctgaacgccgctatcgaatgcctcgaatactttcctgaccagctgatcgtgacagtgtcacaacagctgatgcagaatcggaatgaggagactcgccttaactcacagaagaagatcctgtttgatgtcattgcgaaatactacgcccaggaacgcgactgtctgcttactgatgagtactttgacatccacagcggcataattgagctcctggaaaacgagaaaagagccgaggcactcgaagcaacacaattgtacctgcgcttactttag

SEQ ID NO: 55565 - DNA, 885 bp, Artificial Sequence
  Description of Artificial Sequence: Synthetic coding sequence
atggtgcccggtgaggaacctgcgagggaattgatggcggtgctccttacgcccaggtttcgcaggctagtcagccagaacgagctgcctggacctggcctgaacgggcctagttctagaaatcggcgagatggcttctgtcgcaagagacgcacgggttgttcgggcccattccaggcgacacagctgtgggacggcataattcattccctccaggcgcaggttgaaatcaaacgcaggcgacatcacctccaaacctataaggactgcttcacaggctctgatgccgtggatgtggtgctcagtcatctgatgcaaaacacgtgtctcagttctaatgacatctcctgtctcaaaggcgtgcacctgtgtcaagttttaatgaatcacaaggtgtttgaacccgtcggtatgaagaaactgttcaagaaggagaaggagctggaattcgaggactccaatatatctctgtatcgttttcttgggaacaagtcaagctacgattgctgcaaaagacaaaaagacgccgagaatgagttcaacgagacattacggcctgggtatgagatgatatccaatcctcttgcgcaggaaattggtgaagagcgaatcgaagaactgatccacactatcaacggcaaccctgctctgtgccctaatattaccgttcagaaaccatttctgaggcttagtaaagaggatgtttggaaggaacagactttattgtgcttgctgcagctgattcacctgccatttctggataacattctggagccacccgtgaagacacagaatttacagctgaacaaggaggaggaccttgtgatcaccaacacctgtttggacagggaactcatacctagcctgtgccttccagagaagtag

SEQ ID NO: 55566 - DNA, 1164 bp, Artificial Sequence
  Description of Artificial Sequence: Synthetic coding sequence
atggtccctggggaagaaccggctagggaactgatggccgtgctcctgacccccaggttcaggagactggtttcgcagaacgaactccctggtcctggtctcaacggccctagtagccgaaaccgcagggatggtttctgcaggaaacgaaggacagggtgttctgggccatttcaggcaacccagctgtgggatgggatcatccactcgcttcaagcacaggttgaaatcaaaaggagacggcaccatttacagacatataaagactgcttcacaggatcagacgccgtggatgttgttttgtcccacctgatgcagaatacgtgtcttagtagcaatgatatcagctgtctgaagggggtgcacctatgtcaggtcctgatgaatcacaaggtattcgaaccagtaggcatgaaaaaattgtttaagaaggagaaagagctggagtttgaggattcaaacataagcctgtatagatttctcggaaacaaatccagttatgattgctgtaagcggcagaaggatgccgagaacgagttcaatgagacgcttcgtcccggatacgagatgataagtaacccactggcgcaggaaatcggggaggagcggattgaggaactgattcacacaatcaatggcaaccccgcactgtgccctaatattaccgtgcaaaagcccttccttaggttatctaaggaggatgtgtggaaagaacagacactcctctgcctgttgcaactgatccatttgccattcctggacaacattctcgagccacccgttaagacgcaaaacctccaactgaacaaggaggaagatttggtgatcactaatacttgtttggatcgcgaactgatcccatctctatgcctgccggaaatcgataattggttaaatgctgccatcgagtgtcttgaatactttcctgaccagctgattgtcactgtttcacaacagctgatgcaaaatagaaatgaggagactcggcttaacagccagaagaaaattctcttcgacgttattgccaaatattatgcacaggaacgcgattgcctgctcaccgacgaatactttgacattcatagcggaataatagagctactggagaacgaaaaaagggccgaggccttggaggctacccagctgtatctgcgccttttgtag

SEQ ID NO: 55567 - DNA, 309 bp, Artificial Sequence
  Description of Artificial Sequence: Synthetic coding sequence
atggcggatttcctgaagggactgccggtgtacaataaatccaatttttcaaggttccatgcagattcggtgtgtaaggcttctaacaggcggccatctgtatatcttccgaccagggaatacccaagcgagcagattattgtgactgagaagaccaatattcttctgcggtacctgcatcagcagtgggataaaaagaacgccgcaaagaaaagggaccaggaacaggtggagctggaaggcgagtcttccgcaccacccaggaaggtggcccgaaccgactctccagacatgcatgaggacacgtag

SEQ ID NO: 55568 - DNA, 528 bp, Artificial Sequence
  Description of Artificial Sequence: Synthetic coding sequence
atggatatagctatacatcatccatggatacggcgtcccttctttcctttccactctcccagcagactgtttgaccagtttttcggtgagcatttgctggagagcgacttgttccccacctctacgtccctgagccccttctacctgagaccacctagtttccttcgcgcaccaagctggtttgatacgggtctgtctgaaatgcgcttagagaaagatagattttcagttaacctcgatgtgaagcacttcagtcctgaggagctcaaagttaaggtcttgggtgatgtgattgaggttcacgggaaacatgaagagcggcaggacgagcacggtttcataagtcgcgagtttcacagaaaataccggatccccgctgatgtcgaccccttgactatcacctccagtctgtcctctgatggtgtccttactgtcaacggcccacgaaagcaagtgtccggtcccgagcgcacaattcccataactcgcgaagaaaaaccagctgtgactgctgcacctaagaaatag

SEQ ID NO: 55569 - DNA, 1032 bp, Artificial Sequence
  Description of Artificial Sequence: Synthetic coding sequence
atgatgttccctgggctgctggcccctcctgctggttatcctagtcttctccgtccaacacctacactcactcttccgcagtctctccagtctgctttcagcggacatagctcattcctggtggaggacctgatccgaatttcgcgaccccctgcatacctcccaaggagcgtcccaaccgctagcatgtcccctccccgtcaaggtgccccaacagcattaacggatactggagcttctgatctgggatctcccggtcctggttccagacggggtggcagccctcctactgctttcagtcctgcctctgagaccactttcctcaaattcggtgttaatgctattctcagttctggacccaggactgaaacttcacccgcactgcttcaatccgtcccacccaagaccttcgctttcccctatttcgaagggtcttttcagcccttcataagatcaagctacttccccgcttcctccagtgttgtgccaatacctggaacatttagctggcccctggctgctagagggaaaccccgacgcggaatgctgagacgggcagtatttagcgacgttcagcgcaaagctcttgaaaaaatgttccagaaacagaagtacattagtaaacctgatcgaaaaaagctggccgctaaacttgggcttaaagattcacaggtcaaaatctggttccagaaccgcaggatgaaatggaggaatagcaaggagagggagctcctcagcagcggtgggtgcagggagcagacgctccccaccaaactgaacccacatccagatcttagcgatgtgggacaaaaggggccaggaaatgaggaagaggaagaagggcctggaagcccaagccatcgcctggcctaccacgcctcaagtgacccacagcatttgagggacccgagactccctggacctctgcccccttcccccgcacacagtagcagccctgggaagccgagcgacttctcagattcggaagaggaggaggaaggcgaggaacaggaggagattactgtctcgtag

SEQ ID NO: 55570 - DNA, 288 bp, Artificial Sequence
  Description of Artificial Sequence: Synthetic coding sequence
atgctgggcgctcgggtggcggcacatcttgatgctcttggacccctagtcccatacgtcccacctccacttctgccctccatgttttacgtcggcctattttttgtgaatgttctcatcctatattatgctttcctcatggaatatatcgttctcaacgtcgggctcgttttcctaccagaggatatggatcaagcactcgtggacttaggtgtgcttagcgaccccggaagtggcctctacgacgcagactcagaacttgatgtgttcgatgcctatctggaatag

SEQ ID NO: 55571 - DNA, 3816 bp, Artificial Sequence
  Description of Artificial Sequence: Synthetic coding sequence
atggacaggggcgcagcagcagctcagggcaccgcgccacctcaggatggcgaacagcctgctgagtcacctgaacccccacccccatggccacccccaccgccaccaccagcgccacctcctgctcccccactgttgagcgaagcctcacctgagcctatacccgagccctgccctgaactagcgccaggcccttgcccagaggcaacttccgagtcggccactgagttgtatactgaacctacccctgagccagccacggagccagctagtgaaccggctcccgaaccagcgaccgagccggcacctgaacctgcaaccgaacctgccccagagcctgcgccagagcccgcaaccgaatccgcaccggagcccacccccgaacccgctttggagtcggtgcccgagcccgctcctgagctcacccccgaagtcgcacccgagctcgcccctgagcctacgcctgaacctgtcacagagctggccccagaattctgtcccgaggccgcacctgaattccgcccaagccccgctccttgcttgcttcagtgtcctgtcgacactcgcgaacggggtctgaagaccagtccaagtccttctcctagtcctagtcccaggacccccatgtcttggagcaggataaagaaaatcttaaaggagggacccatgctgaaaaactgcaactcatttaagcggtggaagctaagatacttcctcgtgcagggacagaaactgtacttcgcacaccaccccgctttcgctcattttgagacaatcgacctgagtcaggctacagtcgcagagagttcttgcagaaatctgtgccactctttttgtgtgattacaccccaacggaagatcaccctcgctgccccaaaccgcaaggatatggaggagtggattaacattatcaagaccattcaacaaggcgagatctacaagatccccgctgcagagaacaatccctttctggttggaatgcattgctggtactcatcatactcacacaggacacagcactgcaacgtgtgcagggaaagcattcccgcactgagtagagatgcaattatctgtgaagtgtgcaaagttaagtcccatcgcctgtgcgcactgcgggcttctaaggactgcaagtggaatacactgagcatcactgatgatctcctccttcctgcagacgaggtgaacatgccccaccagtgggttgagggaaatatgcctgtttctagccaatgtgccgtgtgtcatgaaagttgtggctcatatcaaagactgcaggactttaggtgcctctggtgcaacagtacggtccacgatgattgtcgtcggagattttcaaaggaatgctgtttcagaagccaccggtccagtgtcattccacctacggcgttgagtgatcccaaaggagacggacagctggtggtgtcatctgacttttggaatctggactggtcctccgcttgctcctgtccgttgttaatcttcataaattcaaagtccggagatcaccaaggtatcgtttttttgcggaaattcaaacagtatttgaacccctcgcaagtttttgacctcctgaagggcggaccagaagctggacttagcatgtttaagaacttcgctcggttcaggattcttgtgtgtggcggagatggtagcgtcagctgggttctcagcctaatcgatgcctttggcttgcacgaaaagtgtcagcttgcggtaattccactcgggacaggaaatgacctcgccagggttcttggttggggggcattttggaacaagtcaaagtcgcctcttgacatattgaacagagtggagcaggcgtccgttcgcattcttgacaggtggtccgtgatgatccgagaaactcctcgccaaacacccttgctcaaaggccaggtggagatggacgtacccaggttcgaggccgcagccatccagcatctggaatccgctgcgacagagttgaacaaaatccttaaggcgaaatacccaactgaaatgattatcgccacacgcttcttgtgtagtgctgtggaagattttgttgttgacattgttaaggcgtgggggcagatcaagcagaacaatacagccatagtgagtgtaatcttgaaatcagacctgatgtacgaccgattgtccgttttgatcgatgtactggccgaagaggccgcagctactagcgccgagaagagcgcgaccgagtacgctgattcctccaaggctgacagaaaacctttcatcccacagattgatcacatcgctaaatgcaagctcgaacttgcaacaaaagcccagtctcttcagaaatctcttaagctaatcatctttcaggtggagcaggcgctagatgaggagagtcgacagaccatttccgtcaagaactttagcagcaccttctttctcgaggacgatcccgaagatattaatcagacctcccccaggcgccgtagtcggagaggaaccctttcttcgatcagctcattaaagtctgaggatctggataacctcaacctggaccatttgcactttacaccggagtccatccgatttaaagaaaagtgtgttatgaacaattactttggcataggactcgacgcaaaaatttcactcgatttcaacacgcggagggacgagcaccccggtcagtacaacagcagattgaagaacaagatgtggtacggtctcctggggacaaaagagctgctccagagaagttatagaaagctggaggagcgcgtgcacctcgagtgtgacggcgagactatatccctgccaaatctacaggggatcgttgtattaaacattacctcatatgctgggggaataaacttctggggttcaaacactgcaaccacagagtacgaggcacccgcaatcgatgatgggaagttagaggtcgttgctatatttggctccgtgcagatggcaatgtctaggatcattaatcttcatcatcatcgtattgcacaatgccatgaggtgatgataacaattgacggcgaggagggaatccccgtgcaggtggacggagaggcttggatacagcgcccaggactaataaaaattcgttacaagaatgcggctcagatgctgacccgcgacagagattttgaaaattccatgaaaatgtgggagtacaaacataccgagatccaggccgctccgcaaccacaactagactttcaggactctcaggaatctctgagtgatgaggagtatgctcaaatgcaacacctggccagactagccgagaacctcatcagcaaactcaatgacctctccaagatccaccagcacgtgtccgtcctcatgggctccgttaacgcgtcagccaacatactcaacgatatcttttatggtcaggacagtggcaacgagatgggagcagcctcctgtatcccgatcgagaccctcagcaggaatgacgcggtggacgtgactttcagcctcaaaggcctctacgacgacacaaccgctttcctggacgagaagctgctaaggtctgcagaagatgagactgcgttgcaaagcgctttggatgctatgaacaaggaattcaaaaaattgagcgagatcgattggatgaaccctatctttgtgccggaagaaaagtctagcgatacagatagtcggagcttgcgattgaagattaaatttcccaagctgggaaaaaagaaggtggaggaagaaaggaagccgaaaagcggacaaagcgtgcagtcattcattggaaacctctggcacaggcgacacagagaggatgaagccgagggcgatgatcctcttacccccagcaggtctcagctttag

SEQ ID NO: 55572 - DNA, 2550 bp, Artificial Sequence
  Description of Artificial Sequence: Synthetic coding sequence
atgagtgaggaaagatccctgagtctcctggcgaaggcagtagatcctcgacacccgaacatgatgaccgacgtggttaagctcttatccgctgtgtgcatagtgggcgaagagtcaatcctagaggaggtgcttgaggctctgacctcagcaggtgaagaaaaaaagatcgaccggtttttttgcattgttgaggggctgaggcacaacagcgtccaattgcaggttgcctgcatgcagctgatcaacgccttggtgaccagcccagacgacctggactttcgtcttcacatcagaaatgaatttatgcgctgcggcctgaaggagattctcccaaaccttaagtgtattaagaatgatggcttggacatccagttgaaagtctttgatgaacacaaggaagaggacttgttcgaactgtcccataggctggaggatattcgagcggaactggatgaggcctacgatgtttataacatggtgtggtccacagtcaaggagacaagggctgagggatatttcatttcgattctccagcatttactcctgatcagaaacgactatttcattagacagcagtactttaaactaatcgacgaatgtgtgtcacagatcgtgcttcaccgggatgggatggatcccgacttcacatacagaaaacgcctcgatcttgacctgacacagtttgtcgatatttgcatcgaccaggccaaactggaggaattcgaggaaaaggcctccgagctctataaaaaattcgagaaagaatttacagatcatcaggagacccaggctgaattgcagaagaaggaggccaaaatcaacgaactccaggccgagcttcaggcgttcaagtcccaatttggggctttgcctgccgattgtaatatcccgcttcctcctagtaaggagggcggtaccggccactccgccctgccgccacctccaccactgcctagcggtggaggagttccacctcccccaccccctcctcctcctccgccactacctggcatgagaatgcctttttccggccctgtacccccaccgccacctctagggtttttagggggacaaaactcaccacccctacctatactgccattcgggctgaaacctaaaaaggagttcaagcccgaaatctcaatgaggagactgaactggctgaagatccgcccacacgagatgaccgagaattgcttttggattaaagttaatgaaaacaagtatgaaaacgttgatctgctatgcaaacttgaaaacactttttgttgtcagcagaaggaaaggagagaggaagaagacatcgaggagaagaaatcaatcaagaagaagatcaaagagttgaagttcttggacagcaagattgctcagaacttatctatctttctgtcatccttccgtgttccctacgaagagatccgcatgatgatactagaagtggacgagactagattggccgagtcaatgattcagaatctgattaagcatctcccagaccaggagcagctcaactccttgagtcagtttaagagtgaatattcgaacctttgtgaacccgagcaattcgtagtggtcatgagcaacgtgaagcgcctccgaccgaggctctctgccattctcttcaagttgcagtttgaagagcaggtgaacaacattaagccagacatcatggccgtgagcaccgcttgcgaggaaatcaagaagtctaagagcttctccaagttgctcgagctggtcctgctgatgggcaactacatgaatgccggtagtcggaacgctcaaaccttcggcttcaacctcagttctctctgcaaactgaaagacacaaagagcgccgatcagaagacaaccttgctgcacttcctggtcgagatttgcgaagaaaaatacccggacatcctgaactttgtagacgatctggaacctctggacaaggctagcaaggttagtgtggaaacactggaaaagaacctgaggcagatgggaagacagcttcagcaactcgaaaaggagctagagaccttcccacccccagaggacttgcacgacaaatttgtgaccaaaatgagcatcttcgttatctctgctaaagagcaatacgagaccttatccaagctccacgaaaatatggagaagttataccagtcaatcattggctactacgctatcgacgttaagaaggtaagcgtggaggatttcctaacagatctgaacaattttaggactacattcatgcaagccatcaaggagaatattaaaaagagggaagctgaggagaaagagaagagggtgcggatcgctaaagaactggcggagcgggagagattggagcgacagcagaagaaaaagagactgctggaaatgaagacagaaggtgacgaaaccggagttatggataatctcctggaagctttacagagcggtgccgcatttagggaccgcagaaaacgcacacctatgcccaaggatgtgcgccagtccctttctccaatgagccaaaggcctgttctgaaagtgtgtaaccacggtaacaagccttacctgtag

SEQ ID NO: 55573 - DNA, 3582 bp, Artificial Sequence
  Description of Artificial Sequence: Synthetic coding sequence
atggaaagacaccagccgagactgcaccatcctgctcaaggaagcgccgctggcactccatacccctcttcagcctcgctgcggggttgtcgggaaagtaagatgcctcgcagaaagggcccacagcacccgcctcctccttctggtccagaggagcccggagagaagcgacctaagttccaccttaatatccgtactctcacagacgatatgctggataagttcgctagtatccgcatcccagggtccaaaaaagaacggcctccactacccaacttaaaaacggcctttgcctcctccgattgctctgctgctccactcgagatgatggaaaattttcctaagccactgagcgagaatgagttgctcgagctgttcgaaaaaatgatggaggatatgaatttaaacgaggataagaaggcccctctccgagaaaaagatttctccataaagaaagaaatggtgatgcagtacatcaacacagccagtaaaaccgggtctttgaagaggagtcggcagatttcgccccaggagtttatccacgagctcaagatgggctcagctgacgaacgactggtgacatgtttagagtctctgcgggtgtcactaacatctaatccagtgtcttgggtggaatcttttggacacgaaggcctgggcctgctgctcgacatcctggaaaagctcatatctggtaaaatccaggaaaaggtggttaaaaagaaccaacacaaggtgatacagtgcctgaaggctctcatgaatacccaatatggattggagaggattatgagcgaggagagatctctgtcgctgctcgcaaaggccgtcgaccccaggcatcccaatatgatgacagacgtggtgaagctcctctctgcagtgtgcatcgtgggagaagagtccatcttggaagaagtgctggaggcactcacctctgcaggcgaagaaaagaagatagatcggttcttttgcattgtcgaaggcctccgccataattctgtccaactgcaggtggcttgcatgcagctgatcaatgctttggtgacgtcacctgacgaccttgatttccgactgcatatacgcaacgaatttatgcggtgcgggctcaaagagatcctaccaaacctcaagtgtattaaaaatgatgggctggatattcagctgaaggtctttgatgaacacaaggaagaggacctctttgagctgtctcaccgactggaagatatccgagccgaactggatgaggcctacgatgtgtataacatggtgtggtccaccgtgaaggaaactcgcgcagaaggttatttcattagcatcctgcagcacctattgttgatcagaaacgattattttattagacaacagtacttcaaactgatcgacgagtgtgtatcacaaatagtgttacacagggacggtatggatcccgattttacgtatcggaagcgtctggacctggatctcacgcagttcgtcgacatatgcatagaccaagcaaagttggaagagtttgaggaaaaggcctctgagctttataagaaattcgagaaggaattcaccgaccatcaggaaactcaggcagaactgcagaagaaggaggctaaaatcaacgaactccaggctgagttacaggctttcaagtcccaatttggagcactccccgctgactgcaacattcccctgcctcccagtaaggaaggagggaccggtcacagcgctctgccacctcccccacctctcccctccgggggtggagtgccccctccccctccgccaccacccccacctcccttgccaggtatgaggatgcccttctcaggacctgtgcctccccctcctccacttggcttcctaggaggacagaactcgcccccactccctattctcccttttggtctaaagccaaaaaaggagttcaaacctgagatatctatgaggagactgaactggctgaaaatacgacctcatgagatgactgaaaattgcttctggataaaggtcaatgaaaataaatatgagaatgttgatcttctatgtaagttggaaaacacattttgctgccagcagaaggagaggcgcgaggaagaggacatcgaggaaaaaaaatcaattaagaagaaaatcaaggaactgaagtttcttgattccaagatcgcccagaatctttcaatctttctatcctctttcagggttccttatgaagagattagaatgatgattctggaagttgacgagactagactcgccgagagtatgatacagaacctgattaagcatcttcctgaccaggagcagctgaatagtttatcacagtttaaatccgaatatagcaacttatgtgagcccgagcaattcgtggttgtaatgagtaatgtgaaacggctccggcctcggttatctgcaatcctgttcaaattacagttcgaggagcaagtgaataacattaaacctgacatcatggccgtttccactgcttgtgaggaaatcaagaaatccaaaagcttttctaagctcttggaactggttctgctgatgggaaattacatgaacgcgggaagccgcaatgcacagacttttggtttcaatctctcctcattgtgcaagctcaaggataccaagtccgcggatcagaagaccaccctgctccacttccttgtggaaatctgtgaagaaaaataccctgacatcctgaactttgttgatgacctcgagccgctggataaagcctcgaaagttagtgtagaaacgctcgaaaagaatctccgacagatggggagacagctgcaacagttagaaaaagagctggaaacattcccaccacctgaagacttacatgacaaatttgtgaccaaaatgagcaggtttgtgatctcagctaaggagcagtacgaaacactgtctaaattacatgaaaatatggaaaaattgtaccaatcaatcattggatactacgctatcgacgtaaagaaggtctcagtggaggattttctgaccgatttgaacaactttcgcacaacattcatgcaggccatcaaggaaaacataaagaagcgagaagcggaagagaaagaaaaacgggtgagaattgccaaagagttggctgaaagagagaggctcgagcgccagcagaagaaaaagcggctgctcgaaatgaaaacagaaggggacgagacgggagttatggacaacctgctggaagccttgcaatctggtgctgcctttagggaccggaggaagcggactcccatgcccaaggatgtacgccagagcctctccccgatgagccagagaccagtcctgaaggtgtgcaaccacgagaatcagaaagtgcagctcaccgaggggagcaggtcccattataacattaattgtaattccacacgcacccccgtggcaaaggagctcaattataacttggacacccatacttctactgggaggatcaaggccgctgagaaaaaagaagcatgtaatgtggagtctaacagaaaaaaagagacagagttgctgggcagcttttccaagaacgaaagcgtgcctgaagtggaggcactgttggcgcgactccgggcactgtag

SEQ ID NO: 55574 - DNA, 3549 bp, Artificial Sequence
  Description of Artificial Sequence: Synthetic coding sequence
atggaaaggcaccagcccaggttgcaccatcctgcccaagggagtgcagcgggtaccccatatcctagcagcgcctctctcagggggtgtagggagagtaagatgccgagacggaagggccctcagcatccacctcccccaagcggtcccgaggaacccggagaaaagaggcccaagttccttgacaagttcgcttcgatccggattccgggatctaaaaaggagcgccctccactgccaaacctgaaaactgcgttcgccagcagtgattgctctgccgctcctctcgaaatgatggaaaatttccccaagccactgtccgaaaatgaactgctagagttgttcgagaaaatgatggaggatatgaacttaaatgaagacaaaaaggcccctctgcgagagaaagacttctccattaagaaagagatggttatgcagtatattaataccgcaagcaaaaccggctccttgaaacggagcagacaaatttcccctcaggagtttattcacgagctgaaaatgggcagcgccgatgaaagattagtgacttgcctggagagcctgcgagtatctctgacaagcaaccccgtgagctgggtggaaagtttcgggcacgaaggcctcggactgctgttagacattcttgaaaaactcatatcaggaaaaatccaggaaaaggtggttaagaagaaccagcacaaggtgatccaatgtctgaaggctctgatgaacacccaatatgggctggagagaattatgagcgaggagcggtctttgtcactcctcgcgaaagcggtggatcccaggcatcctaacatgatgaccgatgtggtcaaactactgtcagcggtttgcatcgtgggcgaggaatccattttagaggaagtactggaggcccttacctcagctggtgaggaaaaaaaaattgaccgatttttttgtatcgtggagggactgagacacaacagcgtccagctgcaggtcgcatgtatgcagctaatcaacgcccttgtgaccagccccgacgatctggactttaggctgcatatcagaaacgaattcatgaggtgtggcctcaaggagattctgccgaacctgaaatgcatcaagaatgatggacttgacatccagcttaaggtttttgacgaacataaggaggaagacctgtttgagttgagccaccgccttgaagatattcgtgctgaactggatgaggcctacgacgtgtacaacatggtatggtcgacggtgaaggagacccgcgcagaagggtactttatcagtattctgcagcatttgttgttaatccgaaacgactactttataaggcagcaatattttaaacttattgatgagtgcgtgagtcagatcgtgctgcaccgggacgggatggaccctgatttcacatataggaaaagacttgatctggacctgactcaattcgtcgatatttgtattgaccaggcgaagttagaggaattcgaggagaaggcatctgaactgtacaaaaagttcgagaaagagttcaccgatcaccaggagacccaggccgagctgcaaaaaaaggaggctaaaattaacgaattgcaggctgagttacaggcgttcaaatctcagttcggagcgctgccggcagattgtaacattccactgccccctagtaaagaggggggaacggggcactctgcactgccacctccccctccactgccctcaggtggcggtgtgccaccccctcctcctccccctcccccacccccactccccggtatgcggatgccattctcgggcccagtgcctcctcctccacctttggggtttctaggagggcaaaacagccctccccttcccatcctgccatttgggctgaagccaaagaaggagtttaaaccagaaattagcatgaggagattgaactggctcaaaatcagaccgcatgagatgacagagaactgcttctggatcaaagtgaatgagaacaaatacgaaaacgtagatctcttgtgtaagctggagaatactttttgctgccagcagaaggagcggagagaggaagaggacatcgaagagaagaagtctatcaagaagaaaattaaggaattgaagtttttagattccaagatcgcccagaacctaagcatctttttgtcctcattcagagttccctacgaagaaatcagaatgatgatcctggaggtggacgagaccagactcgcggaatctatgattcagaatctgattaaacacctgcctgaccaggagcagctgaacagcctctctcagtttaagtctgaatactcaaacctatgcgaacccgaacagtttgtggtggtcatgtctaatgtcaagcgattacgcccaaggttgtcggcaatacttttcaagctccagttcgaagagcaggtcaataacataaagccagacattatggctgtctcaaccgcttgtgaggagatcaagaaatctaagagctttagcaaactgctcgagttagtgttgttgatggggaactacatgaatgccggttctcgcaacgcccagacattcggttttaatttaagtagcctttgcaagttaaaagacaccaaatctgctgaccagaagaccacgttgctccattttcttgtcgaaatctgcgaggagaaatacccggacatactaaacttcgtggacgacctcgagcccttggataaagcctccaaagtgagcgtcgaaactctagaaaagaacttgaggcaaatgggtcgacagctgcagcagttggaaaaggaactcgagaccttcccaccgcctgaggatctgcacgacaaattcgtgaccaaaatgtccatttttgttatttcagcaaaagaacaatatgaaactctgagtaagttgcacgagaatatggagaaactctatcagagtataatcgggtactatgctatcgacgtcaagaaggtcagcgtggaagattttctgactgatctcaataatttccgtaccacctttatgcaggctataaaagagaatatcaaaaagagagaggctgaggagaaggagaagcgtgtgcgcatcgcaaaagagctggccgagcgggaacggctcgaacgacagcagaagaagaaaagactcctcgaaatgaaaaccgagggcgatgagactggtgtcatggataatctcttggaagcactgcagtccggtgctgccttccgcgacaggcggaaaaggacaccgatgcccaaagacgtccgccaaagtctatcaccgatgtctcagagacctgtactgaaagtttgcaaccatgaaaaccagaaagtgcagctgaccgaagggtctagaagccactataacatcaattgcaactctacaaggactcccgtcgccaaggaactgaactataacctggacactcacaccagcaccggcaggatcaaggcagccgaaaaaaaggaggcatgcaacgtggaatctaacaggaaaaaggagacagagctgctgggatcattttccaaaaatgagtctgtgcccgaagtcgaagccttgctggccagactgagggcgctctag

SEQ ID NO: 55575 - DNA, 3372 bp, Artificial Sequence
  Description of Artificial Sequence: Synthetic coding sequence
atggagaggcaccaaccaaggcttcaccatcccgcacagggtagtgcagcgggaactccgtacccatcttccgcttctttacgcggttgtcgtgagagcaagatgcccaggcgcaaaggtcctcagcatcccccacccccttccgggccagaggaaccaggcgaaaaaagaccaaagttcgaggatatgaaccttaatgaagataaaaaggctcctctgcgggagaaggacttcagcattaaaaaggagatggttatgcagtatatcaatacagcctccaagacaggctccctcaaacgttctcgccagatctccccacaggagttcatccacgaactgaagatgggcagcgcggatgagcgcctcgtgacgtgtcttgagagcctacgggtaagccttacaagcaacccagtgtcttgggtggaaagctttggtcatgaggggcttggactcctactggacattttggaaaagctcatcagcggcaagatacaggagaaggtagtcaaaaaaaaccagcataaggtgatccagtgcctgaaagcactcatgaatacccaatacggcctcgagcgcatcatgtctgaggagcgctccctgagccttctcgccaaggctgtggacccgcgacatccaaacatgatgacggacgttgttaaactcctgtctgccgtgtgtatcgtcggtgaggagtccattttggaagaggtcctcgaagctctgactagtgcgggagaagaaaagaaaattgacagattcttctgcattgtggagggactacggcataacagcgtgcagctgcaagtcgcgtgtatgcagctgatcaacgcactggttacatcacccgacgacttagacttccggctccacattcgcaatgaatttatgagatgtggattgaaagaaatcctaccgaacctcaagtgtatcaaaaatgatggccttgacatacagctcaaggtgtttgatgaacacaaagaggaagacctgttcgaactctctcatcggctggaagacattcgggctgagttagatgaagcgtacgacgtgtataacatggtatggtcaaccgtgaaagaaacaagggcagaggggtatttcatcagtattttgcagcacctccttctgattcggaacgactacttcatacgccagcaatacttcaagctcattgacgagtgtgtatcacagatcgtgcttcacagagacggaatggacccagattttacctacagaaagcgcctagacctcgatttgacccagtttgtcgacatttgcatagatcaggccaaattggaagagtttgaagagaaggccagcgaactctataaaaaatttgaaaaagagtttacagatcaccaggagacccaggcggagctgcaaaaaaaagaagcaaagatcaatgaactgcaggccgagctgcaagccttcaagagtcagttcggggctctcccagcagattgcaacattcccttacctccctctaaagagggcggaaccggacactctgccctaccaccccctcctccccttccgtccggtgggggagtgccacccccaccccctccacctccaccccctcctttgcctgggatgcgcatgccattctcgggcccagtaccacccccacctccgctagggttcttgggcggacagaattccccacccctgcctattcttccattcggcttaaagcctaagaaagagtttaaaccagaaatcagcatgcgtaggttgaattggctcaagattcgacctcacgaaatgaccgaaaactgtttctggataaaagtcaacgagaacaaatacgaaaacgtcgacctgctgtgcaaattggagaacactttttgttgtcagcagaaggaaaggagggaagaggaagatatcgaggaaaagaagagtattaagaaaaagattaaagaactgaaatttctcgatagcaagatagcacagaatttgagtatcttcctgtctagcttcagggtgccatacgaagagatcagaatgatgatcttggaagtagacgaaactcgactggccgagtccatgatccaaaatctgatcaaacacttacccgatcaggaacagctgaactcgcttagtcaattcaagtccgagtattccaatctgtgcgaaccagagcaattcgtggtggtgatgagtaacgtgaaacggctgaggcctcgactctcagccatactgttcaagcttcaattcgaggagcaggtgaataacattaagccagacatcatggcggtgtctaccgcatgtgaggaaatcaaaaaatcgaagagcttcagtaagcttctcgagttagtcttgctgatgggaaattatatgaatgctgggtctcgcaatgcccagacattcggctttaacttaagtagtttatgcaagctgaaagataccaagagcgccgaccagaaaactacccttctccattttctggtcgaaatttgtgaagagaagtaccccgatattctgaacttcgtcgatgacctggaaccattggataaggctagcaaggtgagtgtcgagactctggaaaagaacctgaggcagatgggcaggcagctgcagcagttggagaaagaactagaaaccttccctccaccagaagacctgcacgacaagttcgtcactaaaatgtcaatctttgtgatatctgcaaaggagcagtatgagacactgtccaaattgcatgaaaacatggaaaagctgtatcagtccattatcgggtactatgcaattgacgttaaaaaagtgtctgtggaagactttcttaccgatctaaataactttcgcaccacgtttatgcaggctatcaaggagaacatcaagaaacgggaggcagaggagaaggagaaaagggtcaggatagccaaagaactggccgaacgggagagacttgagagacagcagaagaagaagaggcttctcgagatgaagaccgaaggtgatgaaaccggtgttatggacaacctgttggaggctctacaatccggagccgctttccgagaccgcaggaagcgcaccccaatgcccaaggatgtaagacagagcctctcccccatgtcacagcgccctgtactgaaggtatgcaatcacgaaaaccagaaggtgcagctgactgagggctcgcgatctcactataacattaattgtaactccacaaggacccctgtggcaaaggaactgaactacaacctcgacactcatacgtccaccggacgcatcaaggctgctgagaaaaaagaggcgtgcaatgtggaaagcaataggaaaaaggagacagagctcctcggaagcttctctaaaaatgagagcgtgcctgaggtcgaggcactgttggctaggctgagggctttgtag

SEQ ID NO: 55576 - DNA, 3582 bp, Artificial Sequence
  Description of Artificial Sequence: Synthetic coding sequence
atggagcgtcaccagcctcgcctgcatcaccccgcacaaggttctgccgctggaacaccatacccctcctccgcatcactcaggggttgccgggaatctaagatgccaagaaggaagggccctcaacaccctccacccccaagtgggcctgaagagcccggagagaagagacccaaatttcaccttaacattcgcactttgaccgatgacatgctggacaagtttgcctccattcgaatcccaggctcaaagaaagaaaggccacctctgccgaacctgaagacagcctttgcctccagtgactgctcagctgcgcctcttgagatgatggagaacttcccaaagccactttctgaaaacgagctgctagagttgtttgagaagatgatggaggatatgaatctcaacgaggacaaaaaggcacctctgcgagaaaaggatttctctatcaaaaaagaaatggtcatgcagtatatcaacactgcttctaaaaccgggtcacttaaacgatctcggcaaatttcgccccaggagttcattcacgaactcaaaatgggaagtgctgacgaaagacttgtcacttgccttgagagcttaagagtcagccttacgtcaaaccctgtgagctgggtcgaatccttcgggcatgagggactgggcttgctcctggatatcctggagaagctgatcagcggtaaaatccaagaaaaggtggtgaagaaaaaccagcacaaagtgatacagtgccttaaggccttaatgaacacccaatacgggctggaacggatcatgagtgaggagagatccctgtccctgctcgcaaaagccgtggacccacgacatcctaacatgatgacagacgtcgtcaaattactctctgctgtgtgcattgtcggcgaagaatccatcctcgaggaagtcctggaggccctaacaagcgcaggcgaggagaagaaaatagatcggtttttttgtattgtggaagggttaaggcataactccgtgcagcttcaggtcgcttgtatgcagctgatcaacgctctggtaacctcccccgatgatcttgatttcagactccacattcgcaatgagtttatgaggtgcggcttgaaggagatcctccctaatctaaagtgcattaagaatgatgggcttgatatccagctgaaggtgttcgatgagcacaaagaagaagacctgtttgagctgagtcacagattggaagatatacgagcagaattagacgaggcctacgacgtctacaatatggtctggagtactgttaaagagacacgggcagaaggctatttcatcagcattctgcagcatctccttctgattaggaacgattatttcatccgtcagcagtatttcaagctcatcgatgagtgcgtgtcacagattgtgttacacagggatggaatggaccctgactttacttatcgtaagagactcgatcttgatttaacccagtttgtagacatctgcattgaccaagccaagctggaggagttcgaagaaaaggcatcagagctttacaagaagttcgaaaaggagtttacagatcaccaggaaactcaagcagagctgcagaagaaggaggcaaaaataaacgaacttcaggcagagttgcaggcctttaagtcccaatttggcgcactgcccgcagattgcaacattcccctcccccctagcaaagaggggggaaccggtcatagcgccctgcctccaccaccacccctcccctctgggggaggggtccccccaccacccccaccccctccaccccctcccctgcctggcatgcgcatgccattcagcgggccagtgcctccgccaccgcctctagggttcttgggcggtcaaaactcaccacctctgccgatcctccccttcggattgaagccgaagaaggagtttaaaccagagatatctatgcgaagactgaattggctaaaaatccgcccacatgaaatgactgagaactgtttctggatcaaggtgaacgaaaataaatatgagaacgtcgatctgctgtgtaagctggagaacactttctgctgtcaacaaaaagaacgacgagaagaggaagatatcgaggagaaaaagagtatcaagaagaaaattaaagagcttaaattcctggactccaagattgcacagaacttgagcatctttcttagttcgtttcgggtcccgtacgaggaaattagaatgatgatcctggaggtggatgagactagactcgcagagagcatgattcagaacttaattaagcacttgcccgatcaggaacagttgaatagcctcagccagttcaagtccgagtactccaacctctgcgaacccgagcagtttgtggtggtcatgtcgaacgtgaaaaggctgcggccacgtttgtccgcaattttgttcaagcttcagtttgaggaacaggttaataatattaagcctgatattatggctgtaagcactgcttgcgaggaaatcaaaaagagtaagtcattctctaaactcctggaactggtgctgcttatgggcaactacatgaatgccggatccaggaacgcccaaaccttcgggtttaatctgtcttcactgtgtaagctaaaggataccaaaagcgcagaccaaaagacgactctcttgcacttcctagtggagatatgtgaggagaaatacccagacatcctcaactttgtagatgatctggagcctcttgacaaggcgagtaaggttagtgttgaaacacttgaaaagaatcttcggcagatggggagacagctgcagcagctcgaaaaagaattggagacgttccctcctcctgaagatctgcacgacaagttcgtgaccaagatgtccattttcgttatctcagcgaaggaacaatatgaaactttatctaagttacacgagaacatggagaagctgtaccagtctattataggctattacgcaatcgacgtgaagaaagtttctgtggaagattttctgactgatctgaacaattttaggaccacgtttatgcaggcaataaaagagaacattaagaaaagagaagctgaggagaaagaaaaacgcgtccggatcgctaaagaactggctgagcgggagcgcctggagcgccagcagaaaaagaaacgccttctcgagatgaaaactgaaggtgacgagactggcgttatggataacctgctagaggctctccagtctggcgcagccttcagggaccgcaggaagagaacacccatgcccaaggacgtaagacagtctttgtctcctatgtcccagcgcccagttttaaaggtgtgcaaccacgagaatcagaaagtgcagcttaccgaaggatcccggagccattataatattaactgcaacagtacaagaacacctgtggctaaggagcttaactataacctagacactcacacctctacggggaggattaaggccgcagaaaaaaaagaggcctgtaacgtggaaagtaacaggaaaaaagaaaccgaattgctgggtagcttcagcaagaacgagtctgtgcccgaagtggaggcgctgctggccagactccgagctctgtag

SEQ ID NO: 55577 - DNA, 3444 bp, Artificial Sequence
  Description of Artificial Sequence: Synthetic coding sequence
atggagcgccaccaaccccgattgcaccatcccgctcaggggagtgccgcaggtactccatatccttcatccgccagcctgcgcggatgtcgggagagcaaaatgccgcgtagaaaagggccacagcacccccctcccccatcaggtccagaagagcccggagagaaaagacctaagtttctggataaattcgcttcaattaggattcctggctcaaagaaagagcgcccacctctgcctaacctgaaaacggcttttgcctccagcgactgtagcgccgcacctctggagatgatggagaactttcctaagcctcttagcgaaaatgagttactggagctcttcgagaagatgatgggcagcctgaagagatcccgccagattagccctcaagagtttatacacgagctcaagatggggtcagctgacgaaaggctcgtgacatgtctagagagtctgagggtgtccctgaccagcaaccctgtatcctgggtggagtcattcggccatgaaggcctgggcctcttgctcgacatcttagagaaacttatatcaggcaagattcaagagaaagttgtgaagaagaatcagcataaagtgattcagtgcctgaaggctttaatgaatacccagtacggccttgagagaatcatgtccgaggaacgtagcctgtctctgttggcaaaagcagtggaccctcgccacccaaacatgatgacagacgtcgtgaaattattgtccgcagtgtgcatcgtcggcgaggagtcaatcctcgaggaggtcctggaagctctgacttcagcaggcgaggagaaaaagatagaccggttcttttgcatagtggagggcttgcggcacaactctgtgcagttgcaggtggcatgtatgcagcttattaacgctctggttacatcacccgacgaccttgactttcgcttgcatattcggaacgaatttatgcggtgtggcctaaaagagatcctgcctaatttgaagtgtataaaaaacgatggtctcgacatccaattgaaggtctttgacgagcataaagaagaggatctgttcgagctgagtcatagactggaagatattagagcggaactggatgaggcttatgacgtatataatatggtgtggtctaccgttaaagaaactagggcggaagggtacttcatttctatcctgcagcacctgttactcattcggaacgactatttcatcagacagcagtattttaagctgattgacgagtgtgttagccagatcgtgcttcatcgagacggtatggaccctgactttacttatcgcaagcgtctggatctagacctgacccagtttgtggatatctgcattgaccaggctaaactcgaagagttcgaggaaaaagccagtgaactgtacaagaaattcgagaaagaattcacggatcaccaggagactcaagccgagcttcaaaagaaagaggccaagattaacgagctccaagccgagctgcaggctttcaaaagccaattcggggctctgcccgcagactgcaacattcccttgcctccctccaaggagggcggtaccgggcactctgctctgccaccacctccacccctgccctcaggtggaggagtcccccctcccccacctccccctccacctcctccacttcctggtatgcgcatgccattctctgggcctgtgcctccgcctcctcccctgggattcctgggcggacagaatagcccgccactccccatcctgccatttgggttgaaacctaagaaggagtttaaacccgagatatccatgcgtagactcaactggctgaaaatcaggccccacgagatgacagaaaattgtttctggatcaaggtgaatgaaaacaaatacgagaatgtggatctcctgtgtaaattggaaaatactttttgctgccagcagaaagaacgccgtgaggaggaggatatagaagagaaaaagagtatcaagaagaagattaaagagctaaagtttttggatagcaagatcgctcagaatctttctatctttctctccagtttcagggtgccatatgaagaaattagaatgatgatcctggaggtagacgagacaaggctggccgagtctatgatccagaatctgatcaagcacctgcctgaccaggagcagttgaactcactgtcacagttcaagtcagaatattccaatttgtgcgagccggaacaattcgtggttgtcatgtcaaatgtgaaacgcctgaggccacgccttagcgcaattctctttaagctacagttcgaggaacaagtgaataatattaagcctgacataatggccgtgtctactgcttgcgaagaaatcaagaagagtaagagttttagcaagctgctggaacttgtcctcttgatgggcaactatatgaatgcgggttcaagaaatgcccagacatttggattcaatctctcaagtctttgtaaactaaaagacacgaagagcgcggaccagaaaaccacactactccactttctagtggaaatctgcgaagaaaagtaccccgacatcctcaactttgttgatgacctagaaccactcgacaaagcctctaaagtgtctgtagagactctggagaaaaatctgcgccaaatggggaggcagctgcagcagcttgaaaaagagttagaaacctttcctccacctgaggatctacacgacaaattcgtgaccaaaatgtccatctttgttatttctgccaaagagcagtatgagacactctccaagcttcacgaaaatatggagaaattgtatcagtccatcatcggctactacgctatcgatgtcaaaaaagtttctgttgaagattttctgacagacttgaacaattttcggacaacttttatgcaggctattaaggagaatatcaagaaaagggaggcagaggagaaagagaagcgcgttcggatagccaaggaattggccgaaagggaacgccttgagcgccagcagaaaaagaaaaggctgctcgagatgaagactgaaggagatgaaactggtgtgatggataatctgttggaggctttgcagtcaggcgcagcgttccgtgacaggcggaaaaggacgcctatgcccaaggacgtgcgccagtccctgagccccatgtctcagcgacccgtgctcaaggtgtgtaaccacgaaaaccagaaggtgcagctaactgaaggctccaggagtcactacaacattaactgcaacagtacccggacacctgtcgctaaagaacttaattacaatctggatactcacacatctaccggtcgcatcaaagccgctgagaagaaggaggcctgtaatgtagagtctaacaggaagaaagaaacagagctgctcggatccttttcaaaaaacgaaagtgttcctgaggtcgaagctctgttggccagacttagagcattgtag

SEQ ID NO: 55578 - DNA, 3051 bp, Artificial Sequence
  Description of Artificial Sequence: Synthetic coding sequence
atggagagacaccagccacggctgcaccatccggctcagggaagcgccgcaggcacgccttacccgagcagcgcatccctacgtggctgtagagagagcaaaatgcctcggagaaagggtccacagcatccccctcctccttcagggcctgaagagccgggagaaaaaaggcctaaatttcacctcaatatcaggaccctgaccgacgatatgttggacaagtttgctagtatacgtattcccggttccaagaaagagagaccacctctgccaaacctcaagacagcgttcgcctcttcagattgctcagccgctcccctcgaaatgatggagaatttcccaaaaccgctgtcagagaacgaactgctcgaattattcgaaaaaatgatggaggacatgaatctgaacgaagacaagaaggccccactaagggaaaaggatttctccattaagaaggagatggtgatgcagtatattaatacagccagtaaaacagggtcactcaagcgcagtaggcagatctcccctcaagaattcatccacgagcttaagatggggagtgcagacgagcgactggtcacttgcctggaaagtctcagggtcagtctaacatctaatccggtttcgtgggttgaatccttcggtcacgaaggcttgggtctgctccttgatattctagagaagctgattagtggcaagattcaagaaaaagtggtgaagaaaaatcagcacaaggtgatccagtgcctgaaagcactgatgaacacacagtacgggctggaaaggatcatgtctgaggagagatctctgtcattgcttgcaaaggctgtggatcctaggcatccaaacatgatgactgatgtggtaaaactcctctccgctgtttgtatcgttggagaagaaagtattctggaggaggtactggaagccttaacttccgccggagaggaaaaaaagatcgataggttcttctgtatcgttgaagggttgcggcataacagtgtgcagttacaggtcgcctgcatgcaactaatcaatgctctggtcaccagcccagacgacttagactttcggctacacatccgcaatgagttcatgcgctgcggattgaaggaaattctgcctaatttgaagtgtatcaaaaacgacggcttagacatccagttgaaggtatttgatgaacataaagaggaagacctgttcgagttgagccatcgtttggaggatatccgcgcagaactagatgaagcttacgacgtgtataacatggtttggagtaccgtcaaggagactcgtgcagagggctacttcatctcaatccttcagcatctgctgctgattcgtaatgattactttatcaggcaacagtactttaagttgatagacgagtgcgtttcacaaatcgtgttgcatagagacgggatggaccccgatttcacttatagaaaacgccttgaccttgatctgacgcagttcgtcgacatctgtattgatcaggcaaagcttgaggagttcgaggagaaagctagtgaattatataagaagtttgaaaaagaattcaccgaccatcaagagacgcaggctgaattgcaaaaaaaagaagctaagatcaacgaactccaggcagaattgcaggcgttcaagtctcagtttggggctctacccgctgattgtaatattccgctgcccccttctaaagaaggtgggacaggtcactctgctctgccccctccacctcctctgccttcagggggtggcgtcccgcctcctcctccccctccgccaccgccaccgttgcctggtatgaggatgcccttctcaggcccagttcctcctccacctccactggggtttctcggaggtcagaattcacccccacttcccatactgccgttcggcctcaaacctaaaaaggagtttaaacctgagatctcaatgcgcagactaaactggctaaagattaggcctcacgagatgacagaaaactgcttctggatcaaggtaaacgagaataaatacgagaatgtggatctgctctgcaagttggagaatacattctgttgccagcagaaggagcgcagggaggaggaggacatcgaggagaagaagtctattaagaagaaaatcaaggaactgaaatttctggacagcaagatagcccagaacctgtccatttttttatcctcttttcgggtgccgtacgaggagattcggatgatgattttggaggttgatgaaacccgcctggcggagtctatgattcagaacctgataaagcatttaccggaccaagaacagcttaattccctgtcccaatttaagtcagaatattccaacctgtgcgagcctgagcagtttgtggtcgtgatgagtaacgttaagcggctgaggccacgcctcagcgcgatcttgtttaagttacaattcgaagagcaggtcaataatataaaaccggacattatggctgtatctactgcttgcgaagagataaaaaagagtaaaagcttctccaaactcctggagctcgtgctattaatgggcaactacatgaatgccggaagcagaaatgcacagacatttgggtttaacctgtccagcctatgcaagttgaaggatactaagtcagcagaccagaagacaacacttttgcattttctcgtggagatctgtgaggagaaatatcccgacatcctcaattttgtcgacgacctggaaccccttgataaagcctcaaaggtctccgtggagacgcttgaaaagaacctgagacaaatgggccgacagctgcagcaacttgagaaggagctggaaacttttcccccacctgaggatctgcatgacaagtttgttacaaagatgagcatcttcgtgatctctgcaaaggagcagtacgagacgttatctaagctgcatgagaacatggaaaaattgtatcagtcaattatcgggtattatgcgatcgacgtgaagaaggtgtccgtggaggactttttaaccgacttgaacaattttcgcacaactttcatgaaagcaattaaatttcaaatatag

SEQ ID NO: 55579 - DNA, 3339 bp, Artificial Sequence
  Description of Artificial Sequence: Synthetic coding sequence
atggagaggcaccaacccagattacaccacccagctcagggtagcgctgccggaaccccatacccgagctcggccagtttacggggatgccgagagtctaaaatgccacgacgcaagggtccacaacaccctcctccacccagtggccctgaggaaccaggggagaaacgcccaaagtttcatctgaacatccgtaccctgactgacgatatgctcgataagttcgccagcatcagaatcccgggttctaagaaggaacgtccccctcttcccaacttaaagacagcattcgcttctagtgactgctcagctgcgcctttggagatgatggaaaacttccccaagcccttgtccgagaatgagttgcttgagctattcgaaaaaatgatggaggacatgaatctgaacgaggacaagaaggcacccttaagggagaaagattttagtatcaaaaaggagatggtgatgcaatacatcaatacggcttctaagacgggtagcctcaagagatctagacagatttctccgcaagagttcatccacgaattgaagatgggatccgccgatgagcgcttggtgacatgtctggagtctttgcgagtgtcactgacttcaaacccggtcagttgggttgagagcttcggtcacgaaggcctcggacttctgctggacatccttgaaaaactaatctctggaaagattcaggaaaaagttgtgaagaaaaaccagcataaggtgatccagtgcctgaaggccctgatgaatactcagtatgggctggaaagaataatgtcagaagagagaagcctgagcctcttagccaaggccgtggacccgagacaccccaatatgatgactgacgtagtcaagctgctttccgcggtctgtatagtgggagaggagtcaattctggaggaggtcctggaggccctaactagcgctggagaagaaaagaagatcgaccgtttcttctgtatcgtggaaggcctacggcacaatagcgtacagctccaagtcgcctgcatgcagttaataaatgctctcgtcacatccccggacgatcttgatttccggttgcacattcggaatgaatttatgcggtgcggcctgaaggagattctgcccaaccttaaatgtataaagaacgacggcctggatatccagctgaaggtttttgacgaacacaaggaggaggacctgtttgagttgtcccaccgtctcgaggacatccgcgctgagttggatgaagcgtacgacgtatataatatggtctggtccacagtcaaagaaacacgcgcagagggatacttcatctctatactccagcacctgcttcttatccggaacgactattttatacggcagcagtatttcaagttgattgacgagtgtgtgtcacagatcgtgctacaccgtgacggcatggaccccgacttcacgtatagaaagaggttggatttggatcttactcagttcgtggatatctgtatagatcaggctaagctggaggaattcgaagagaaggccagcgaactttacaaaaagttcgaaaaagagtttaccgaccaccaagaaacacaagccgagctgcagaagaaagaagccaagatcaatgagttgcaagctgaactgcaagcattcaagagtcagttcggagcccttccggcagactgcaacatccccttacctccctcaaaggagggcggaacgggacatagtgcattgcctccgccacctcctctgccttccggcggaggcgtgccgccacccccaccaccaccccctcctccaccactccccggaatgcggatgcccttcagcggaccggtgcctccacccccaccacttggcttcttgggtggccagaactctcctccactccccatactcccttttggcttaaaaccaaaaaaggaattcaagcctgagatttctatgcgaagactcaattggctcaagattcggcctcatgaaatgactgaaaattgtttttggatcaaagtgaatgagaataaatacgagaacgttgacctgctgtgtaagcttgaaaataccttctgctgccagcagaaagaaaggagggaagaggaagatatcgaggaaaagaagtcaatcaagaagaagatcaaagaactcaagttcttggacagcaagattgcgcaaaatctgtcaatcttcctgtcctcttttcgagttccttatgaagaaattcggatgatgatcctcgaggtagatgagacccgtttagccgaatcgatgattcaaaacctgatcaaacatctgccagaccaggagcagctcaacagtcttagccagttcaagtctgaatactctaatctgtgtgaacctgagcagttcgtggttgtgatgagcaatgttaagcgtctacggcctcggctctctgcaattctatttaagctccaattcgaggaacaggtcaacaacatcaaacccgatattatggccgtctctactgcctgtgaagaaatcaaaaagtcaaaatcattctctaaacttttggaactcgtcctgctgatgggtaactacatgaacgcaggatcacggaatgcccagactttcggcttcaatctgtccagcctgtgcaagctgaaagacactaagagtgcagatcagaagaccaccctgctgcattttcttgtagagatatgcgaggagaaataccctgatattttgaatttcgtcgatgatcttgaaccccttgacaaagcttctaaagtgtccgtggaaaccctggaaaaaaatctaaggcaaatgggcagacaactgcagcaactagaaaaagagctcgaaaccttcccgcctccagaggaccttcatgacaagtttgtcactaaaatgagtcgattcgtgatctctgccaaagagcaatatgagaccctctccaagctccatgaaaacatggaaaaactttaccagtccataattgggtactatgccatcgatgtcaaaaaagtgagcgtggaagatttcttaactgacctgaataactttagaactacctttatgcaggccatcaaggaaaacataaagaaaagagaagccgaggagaaggaaaagcgtgtgcgaattgcgaaagaactggccgaaagggagagactggaaagacaacagaagaagaagcggctgctggagatgaagaccgagggcgatgagaccggagtgatggataatttactggaggcactgcagagcggggcagctttcagggataggcgcaaaaggacgcccatgcctaaggacgtgcgccaaagcttgagccccatgtctcagcgaccagttttgaaggtttgtaaccacggtaataagccttacctgtag

SEQ ID NO: 55580 - DNA, 1866 bp, Artificial Sequence
  Description of Artificial Sequence: Synthetic coding sequence
atgtgctctgggtggagcagcagcgtgatctggagacatactcagtttgcggtagagcgatgtggcttttgtgggagtagtggtccaggcgcaccactggagccctctacactaggctctaagcacttgccttgggaggccgtcagcgcagggtttgcggacaggaacagaaacatggatggagccatgtggctttctctctgtccagataacgaagacttgctatggcggaagaaacacaagctactgcaggctaggggaaaaggggacctcgctctgcaaagacgcgctgatgcgaaactttggaaaaattatcagctgcagagactggccgaagagctgcgaaggggctatcaggaagctcagcacctgcatgtaggaggtcttgaccgtcttcagagcgctcggctcttaggttggggcggagggagagctcgggagaacgagcccgatagccaaggacctatacagaggcgatcagcccgaccccctcgtgccaaggagaagcacagagccgcactgagcgaggagcgaagctgtagagaggaactcggccagcagcatccaagacactcaaggccccgaaaaactgccgctagccccgagaagccacagacaacgaaggcaacaggcagaatgaatagccacttggcccctcctgaaaagcggaaaggccgacctgagccctctacaaagtcgggcggagggagatgcgcgattcatcccaggagaagcaagggtgccgacctggagaggagtaatcccctggtagcggcagtcggggagatcgggctggtggaagagaaagagaagggaacggctcgggcagggaggcgacagctgggtaagggagcggtatgcttcgtccccgcacttacttccaggtctcagggacagagcctggagggtaagttaagggacctgggccagctgtggcctgctgattcctcctgtcgtcgtgaagctgtctcccccgcttcccagtgtacactgagggagaagaacaaatggcaaaaggaattggaactcgctttcgaggagctgttcaacatcaaccggaaactcaagaaacacctctgcctgtacctggcccttaaacccaggatggatcagagacctggagagggacacgcattttcggaaatgcaggagtgcggagccggaacacccaggggcaagaaaatggccgaccccgaaatgctgcccgcaggagagcctagaagtccagctgaagaggaggcacaacaagctgccagtaagacagatctcaagacgtttatggggaaagcccaaaaccagaaatatcaagggacagtgaaaccaaccttccggaacggtagccagaccctcagcccagaggcaggcatcttcattaacaaagaagacagcctcctttacagcaccgagtcaggccaagagactcccaaactcgggactctcgccgagggcagcttgcagctgcatctccaggatcaggctgatcgagtgggaagcaccgcatctagacagaggcagaaggcggagatggagcaacggagacagaagcaacttgagagtcttgaacagatggaacatccggatatgagtttggagatccactataaggccgaacttgagaaagaaaggcgggagcagcgcagggcgagacttgcgcaccttaaaagttcttccactagagcccaggagagagagagagggtcagagctcagcaccacaagtccttcagggacctccctggccgacgacgaccgccacagccaaatgattagggatcagcaacaacaaatcctgcagcaaaatcgcctacataagcagtttctcgaagaagcaaggaaatgtctgcgcgagttccagaacatctgctag

SEQ ID NO: 55581 - DNA, 1539 bp, Artificial Sequence
  Description of Artificial Sequence: Synthetic coding sequence
atggcgatcctatccctgcgggcacccggtccctggcaagctatgcaggtctgggcagaccgaaccctgcttaccccccacaccggcgtcacctctcaggtactgggcgttgccgctgcagtgatgacccctctgccgggtggccacgcggctggcagaactagggaagcgaggtgggacgcaatggagtatgatgaaaaattagcacgcttcaggcaggctcacttgaaccccttcaacaaacaatcgggcccacgacagcacgaacagggccctggggaggaggttcctgacgtgaccccagaggaagctctgcctgagctcccccctggagagcccgagtttcgctgtcctgaacgagtgatggacctgggcctatccgaagatcacttttcacggcctgtgggcttgttcctggcaagcgatgtgcagcagttgcggcaggcaatcgaggaatgcaagcaggtgatattggagctgcccgaacagtccgagaagcagaaagatgccgtggtgcgcctcatccacctcagacttaagcttcaagagctcaaagacccaaacgaggacgaacctaacataagagtgctgttggagcaccgattctataaggaaaagtccaaaagcgtgaagcagacctgtgataagtgcaatactatcatctggggattaattcagacctggtacacttgcacgggatgctactacaggtgtcactccaagtgtctgaacttgatctctaaaccatgtgtgagcagtaaggtgtcccatcaagcggaatatgaactaaacatatgtccagaaaccggtctagatagccaggattatcgctgcgcagagtgtcgtgccccaattagcctgagaggtgtcccctccgaggctagacaatgcgattatacgggacagtactattgttcacactgccattggaacgacctggctgtcataccggcacgcgtagtgcataattgggattttgagccacgcaaggtgtctaggtgcagcatgagatatttggcactgatggtgagcaggcctgtgttgcgcctgcgagagatcaaccctctgttgttttcttacgtcgaagaactagtggagatcagaaagcttcgtcaggatattttgctaatgaagccatactttatcacttgcagggaggccatggaggcaagactgctgctccagctccaggatcggcagcatttcgttgaaaatgatgaaatgtatagtgtgcaagacctgctggacgtgcatgctggtaggcttgggtgcagtctgaccgaaatccacacactgtttgccaagcacatcaaacttgattgcgagcggtgtcaagctaaaggatttgtctgcgaactctgccgggaaggagacgtgttgtttccattcgatagccacacctccgtgtgcgcagattgcagcgctgtctttcaccgcgactgttactatgacaactctactacttgcccaaagtgtgcacgcctatcacttagaaagcagagtctctttcaggagcctggcccagacgtggaggcttag

SEQ ID NO: 55582 - DNA, 594 bp, Artificial Sequence
  Description of Artificial Sequence: Synthetic coding sequence
atggaatacgatgaaaaattggcccgttttcgacaggctcacttgaaccctttcaataaacagagtgggcctcgccagcacgaacaaggacccggagaggaggtgcccgatgtgactcccgaagaagccctgccagagctgccacccggtgaaccagagttcaggtgccccgagcgggtgatggacttgggtctgagtgaggaccatttttccaggcctgtgggattgtttttagccagcgacgtacagcagctacgccaggccatcgaggaatgcaagcaggtcatcctagagcttccggagcagtctgagaagcagaaagacgcggtcgtaaggttaattcaccttcgactcaaactgcaggaactgaaggatcccaacgaggatgagccgaacattagggtcctgctggagcaccggttctataaagagaagagcaaatccgtgaaacagacatgcgacaagtgtaacaccattatctggggtctcatacaaacctggtatacctgcaccggaggccctagaccacggaggggggtcagaaatgagcgggatcagtcctcttgtttgcgttgggcacatatccaaatgtag

SEQ ID NO: 55583 - DNA, 1356 bp, Artificial Sequence
  Description of Artificial Sequence: Synthetic coding sequence
atggaatacgacgagaaactcgcacgattcagacaggcccacctcaacccttttaataaacaatcggggccacgacaacatgaacaaggccctggggaggaggttcccgacgtgactcccgaggaagccctgcctgaactcccgccaggggagccagagttccgctgtccggagagagtgatggacctcggactttctgaggatcactttagtaggccagttggactcttcctcgcatcagacgtccagcagctgcggcaggcaattgaagaatgtaagcaggtgatcctcgagctgcccgagcagagtgagaagcagaaggatgccgtagtcagactgatacatttgagactcaagctgcaggagttgaaagacccaaacgaggatgaaccaaatatcagagtactgctggagcatcgattttataaggaaaaatcaaaatctgtcaaacagacatgcgacaagtgcaataccatcatttgggggctgatacaaacgtggtatacatgcactggatgttactacagatgccatagcaagtgtctgaacttgatcagtaaaccctgcgtttcttctaaggtgtctcaccaggcagaatatgagctgaacatttgtcccgagactggtctagactcccaggactacaggtgtgccgagtgtcgtgctcctatttcactgcgtggagtcccttcagaagcaagacagtgtgattacaccgggcagtattattgcagtcactgtcactggaatgacctagcggtgatccccgcacgcgtcgttcataactgggattttgaacctcgcaaagtttcacggtgctctatgcgatacctcgcgctcatggtgtcccgacccgtcctgcgtcttcgggagattaatccacttctgtttagctacgttgaagagttggttgaaattagaaaactcagacaggatattcttctaatgaagccatacttcatcacctgcagagaggccatggaagccagactgctgctccagctgcaagatagacaacatttcgtcgaaaacgatgaaatgtattccgtgcaggatctgctggatgttcacgccggacgattagggtgttcactgaccgaaattcacaccttgtttgccaaacatattaaattggattgtgagagatgccaggctaaaggtttcgtgtgtgagttatgccgggagggcgacgtattgttccctttcgacagccatacctccgtgtgtgccgattgctctgcggtgttccatcgggattgttactatgataacagtactacctgtcccaagtgtgcaagactttccctgaggaaacagtctctgttccaagaacccggaccagatgtggaggcgtag

SEQ ID NO: 55584 - DNA, 1326 bp, Artificial Sequence
  Description of Artificial Sequence: Synthetic coding sequence
atggagtatgacgaaaaactggccaggttccgccaggcccacctcaatccattcaacaagcagagcgggccacgacagcatgagcagggcccaggggaagaggtcccagacgtgacacccgaggaagccctgcccgaacttcctcccggagaaccagaattcagatgtcccgagcgtgtgatggatctgggcctgtctgaagaccatttcagccggcctgtcctgcgtcaggctatcgaagaatgtaaacaggtgattttagagctgccggaacagtctgaaaagcaaaaagacgctgtagtgagactcatccacctgcgtttaaaactccaggagcttaaagatccgaacgaggatgaacctaatattagagtgcttctcgagcacagattctataaagagaagagcaagtctgtcaagcagacctgtgataagtgtaatactattatttgggggctgattcaaacttggtacacctgcactggctgctattataggtgtcactcaaaatgtctgaatttgattagcaagccttgtgtttcctccaaagttagtcatcaggcagagtacgaactgaatatctgtcccgagacgggtctagactcccaggattatagatgcgcagagtgtagggctcccatttctctgcgaggagtgcctagcgaagccaggcagtgcgattacacagggcagtactactgttctcactgtcactggaacgacttagctgtcataccagctcgggtcgtccataattgggactttgagcccaggaaagtgagtcgctgctcaatgcgctacctcgcattaatggtatctcgccctgtcctgcgcctgcgcgagatcaacccgcttttgttctcctacgtcgaagagttagtcgaaattaggaagctgaggcaggatatcctacttatgaagccatacttcatcacttgccgcgaagccatggaggccaggctgctgctgcagctgcaggacagacagcactttgtagaaaatgacgagatgtactctgttcaagatctgctagatgtccatgccggaaggctaggatgtagcctgacagaaattcatacactgttcgcgaaacacatcaagttagactgcgagcgctgtcaagctaagggctttgtctgtgaattgtgcagggagggcgacgtgcttttccccttcgattcacatacttccgtctgtgctgactgctccgctgttttccatagagattgttactacgataactcaactacgtgtccaaaatgtgcacgactgagtctgcgtaaacagagcctgtttcaggagccgggacctgatgtggaagcctag

SEQ ID NO: 55585 - DNA, 1563 bp, Artificial Sequence
  Description of Artificial Sequence: Synthetic coding sequence
atgagtcaagacaatgataccctgatgcgcgacatccttggtcacgagctcgcagcaatgcggttacaaaaattagaacagcagcgacgcttgtttgaaaagaagcagcgccagaaacgacaggaactgctgatggtgcaggctaacccagatgcaagcccatggctgtggagatcatgcttaagagaagaacgcctgcttggtgacaggggactcggtaatccattcttgaggaaaaaggtgtctgaggctcacttaccatcggggatccatagcgcactggggaccgtgtcttgtggtggagacggaaggggagaacgcggtctgcctaccccccgaacagaagcggtcttcagaaatctgggccttcagagtcctttcttgagctggcttcctgataacagcgatgcagagctggaggaggtctctgtggaaaatgggtcagtgagcccaccgccattcaaacagtcaccacggatccgaagaaaaggctggcaggcgcatcaacgtcccggtacacgtgcggaaggcgagagcgattcccaggatatgggtgacgcacataagtcgcccaatatgggtccaaaccccggaatggacggggattgcgtttatgagaatctcgcctttcaaaaggaagaagatcttgaaaaaaagagggaagctagcgaatccacaggaactaactctagtgccgctcacaatgaagagctgtctaaggcacttaaaggcgaggggggaaccgactcagaccacatgaggcatgaggcctccctggccatcagatctccatgccctggcctggaggaggacatggaggcatacgtgttgcggccagcattgccaggaaccatgatgcagtgctacctgacaagggacaaacatggggtagataaaggcctctttccgctctattatctttacctggagacttccgattccctgcagaggttcttactcgcaggtaggaagcgtcgcagatccaagacctccaattatctgatctcactcgaccccacgcacctctcccgggatggcgacaactttgtgggcaaagtccgctcaaatgtgttttctacaaagttcaccatcttcgacaatggagttaatcccgaccgcgaacacttaactcgcaataccgcccgaatcagacaggaattgggagccgtctgctatgagccaaatgtcctgggctatcttggccctcggaaaatgaccgtcatcctgcccggtactaactctcagaatcagcgcattaacgtccagcctctgaacgaacaggagagcttgctcagcaggtatcagcgcggagacaagcagggcctccttctcctccacaataaaacacccagttgggacaaggagaacggcgtgtatactcttaatttccatggacgcgtgaccagggcaagtgtcaagaattttcagatcgtagatcctaagcatcaagaacatctcgtcctgcagttcgggagagtgggtccagacacttttactatggacttctgcttccccttttctcccctgcaagcattttccatttgcctgtcttcctttaactag

SEQ ID NO: 55586 - DNA, 1422 bp, Artificial Sequence
  Description of Artificial Sequence: Synthetic coding sequence
atgcccaagcttcagggatttgagttttggtcccgaacgctgagaggtgctagacatgtagtcgccccaatggtggaccaatcagagctcgcatggagacttctatcccggcgacacggagcccagctctgttatacccccatgcttcatgctcaagtattcgtcagagatgctaactatcggaaggagaacttgtattgtgaagtttgccccgaggatcggccactaatcgtccagttttgtgccaacgatccggaagtctttgttcaagcagccctccttgcccaagattattgcgacgccatcgacttgaacctgggatgtccacagatgatcgcaaagaggggtcactatggagcattcctccaagatgaatgggacctccttcaaaggatgattctgctggctcatgaaaaactgagcgtcccagtaacatgcaaaatcagggtgtttcccgaaatcgataagactgtccgttacgcacagatgctggagaaagctggctgccagctattgactgtccatggccgaacaaaagaacagaagggtcccctttcaggagctgcatcctgggagcatatcaaggccgttaggaaagcagtggccattccagtgttcgctaacggaaacatccaatgtctgcaagacgtggaacgctgtctgagagacacgggggtgcagggcgtgatgtcggcagaagggaacctgcacaatccagccttatttgaaggacgctctccagccgtgtgggagctcgccgaagagtacctggacattgtgcgcgagcatccctgtcccttgagttacgttcgtgcacacctgtttaagctatggcaccacactcttcaggtgcaccaggagttgcgcgaggagctggcaaaggtcaagacgctagagggcatcgcagccgtcagtcaggaactgaagttgcggtgccaggaagagatctccaggcaggaaggcgctaagcccaccggcgacctgcctttccattggatttgtcaaccctatatccgacccggtccacgggagggctccaaggaaaaagccggtgcaagatccaaacgagccttagaagaagaagaaggcggtacagaggtgctgtcaaagaataagcagaagaagcagctcagaaacccgcataaaaccttcgatcccagcttgaaacccaagtacgctaagtgtgaccaatgtggcaacccaaagggcaacagatgcgtgttctccttatgtcgcggttgctgcaagaagcgcgcttctaaagagacagctgactgcccaggacacggactgttatttaaaaccaagctggagaagagcctggcctggaaggaggcccagccagagcttcaggaaccccagcctgccgctccaggaaccccaggagggttctctgaagttatggggagtgcactggcttag

SEQ ID NO: 55587 - DNA, 1422 bp, Artificial Sequence
  Description of Artificial Sequence: Synthetic coding sequence
atgcccaaacttcaaggcttcgaattctggtccaggactctccgcggtgctcgtcacgtcgtcgcccctatggttgatcaatcggagctagcctggagattactgagccgcagacacggcgctcagctgtgttacactcctatgctgcatgctcaagtgttcgtgagggacgcaaattaccgaaaggagaacctgtactgtgaagtgtgtcccgaagatcgccctcttattgtgcaattctgtgccaatgatccagaagtcttcgtgcaggctgccctgttagcccaggattactgcgacgccatcgacctcaaccttggctgtcctcagatgatcgcaaagcgcggacattatggagcttttctccaggacgaatgggacttgctccagagaatgatcttactggcccacgaaaagctgtccgtaccagtgacttgcaagatcagggtattccccgagatcgataagacggtgcgctacgcacagatgctggagaaagccggttgtcagctgctaaccgtccatgggagaaccaaggaacaaaagggaccacttagcggcgcagccagctgggaacacattaaggctgtccgaaaagccgtagctatccctgtattcgccaatggcaacatccagtgcctccaggatgtagaaaggtgcctccgagatacaggcgtccaaggagtgatgtctgcagaagggaatttacacaatcctgcgctttttgaaggccgttcccctgctgtgtgggagctggcagaggaatatttggacatcgtcagagagcacccatgtcccctgtcatacgtgagggcacatctgttcaaactttggcatcacacactgcaggtccaccaggagctcagagaggaattagcgaaagtaaaaacacttgaagggatcgctgcagtgagccaggagctgaaactacggtgccaagaagagatctcccggcaagagggagctaagccaacgggcgatttgccgttccactggatttgccagccttacattcggcctggaccaagggaaggcagcaaagagaaggcaggcgcacgcagcaagcgtgccctcgaagaagaggagggcggaaccgaggtgctgagcaaaaacaagcagaagaaacagcttcggaatccgcataaaacctttgatccatctttgaagcccaagtacgcaaagtgcgatcagtgtgggaaccctaaagggaaccgatgtgtgtttagcctgtgccggggatgctgcaaaaaacgagcatctaaggaaaccgcagattgtccgggacatggactcctgttcaagacaaagctggagaagtccctggcgtggaaagaggcccaacccgaattacaggaaccacagccggctgctcccggaactcctggcggattcagcgaagttatgggaagcgcacttgcttag

SEQ ID NO: 55588 - DNA, 894 bp, Artificial Sequence
  Description of Artificial Sequence: Synthetic coding sequence
cctagttttgccggaccaagagagaccttaccagtcacttgcaagatccgagtttttccagagatagataagacagttcgatacgcacagatgctggaaaaggcaggctgccaattattaacagtgcacggtagaaccaaagaacagaaaggaccattatctggagccgctagttgggagcatatcaaagcagtacggaaagcggtggcgatcccggtattcgcaaatggtaatatccagtgcctgcaggacgtcgaaaggtgcttgcgggataccggagtgcagggcgtgatgagtgctgaggggaatctgcataaccccgcactgttcgaggggagatccccggctgtgtgggaactggctgaagagtacctggacatagttcgcgagcacccatgtccactttcctacgtgcgggctcatctctttaaactgtggcaccacactctgcaagttcaccaggagttgcgtgaagaattggctaaagtcaagactctcgaaggtattgccgctgtttcccaagagctcaaacttcgctgccaggagatttcacggcaagaaggcgcaaaacccacaggggacttacctttccactggatctgtcagccctacattagaccaggtcctcgggagggatctaaggagaaagcaggcgctagatctaaaagagctcttgaagaggaggaggggggtaccgaggtgttgtcaaagaataaacagaagaagcagctgaggaacccacacaaaacctttgacccttcattgaagcccaagtatgcaaagtgtgatcagtgcggcaacccgaagatgtgcgttcagcctgtccctagattactccaagaggcatctttacagagagactgtcgcttgccacgcagccgaattgcgttttag

SEQ ID NO: 55589 - DNA, 1011 bp, Artificial Sequence
  Description of Artificial Sequence: Synthetic coding sequence
atgatcgccaaaagggtgctgctggctcacgagaagctgagtgtgccagtcacatgcaagattagagtgttccctgagattgacaagactgtgcgttacgcccagatgctcgagaaagccggttgtcagctgttaactgtgcacggccgtacgaaggagcaaaaaggccctctgtcaggtgcggcatcttgggagcacatcaaggctgttcggaaggctgtcgcaatccccgtgttcgccaacgggaacatacagtgtctccaggacgtcgagaggtgcctccgcgacaccggggttcagggagtcatgtccgccgagggtaacctccacaaccctgccctattcgagggacggtctcccgctgtttgggaactcgctgaggagtacctcgacatcgtacgagcccacctgttcaagctctggcaccacacccttcaagtgcaccaagagctccgggaagaacttgctaaagttaaaaccctcgaagggattgcagctgtctctcaggagttgaaactgcggtgccaggaagagatttcacggcaggaaggtgccaagccaacaggggacctgccgttccactggatttgccaaccttacatccggcctgggcctcgagagggtagcaaggagaaagcaggtgctcggagcaagcgagcactggaggaggaagaggggggaaccgaggtccttagcaaaaataaacagaagaagcaactgcgtaacccccataaaacctttgacccctcccttaagcctaaatatgctaagtgtgaccagtgtggcaatccgaaggggaataggtgcgtcttttccctgtgtcggggatgctgcaagaaacgcgcttcaaaggagaccgccgactgtcccggacacggccttctgttcaaaaccaagttggagaagtctctcgcttggaaagaagcccagccagagcttcaggaacctcagccagccgcacctggcactcctggaggattctccgaggtgatggggtctgccctggcatag

SEQ ID NO: 55590 - DNA, 1953 bp, Artificial Sequence
  Description of Artificial Sequence: Synthetic coding sequence
atggcggaaggaaccgccgaagcccctttggaaaatggtggcggtggagattcaggtgctggcgctttggagcggggagtggccccaattaagaggcagtacctgacaaccaaagagcagttccaccagtttctggaggcaaaggggcaggagaagacgtgtcgggaaacggaagtaggggacccagctggaaacgaactcgctgagcctgaagccaaacggatccggctggaagacggccaaaccgcggacgggcagacagaggaggccgctgagccaggggagcagctccagactcaaaaacgggcacggggacaaaacaaggggagaccgcatgtgaaaccgactaactacgataagaaccggctgtgcccctccctgattcaggagtccgcagcaaaatgtttttttggcgatcggtgtaggttcttgcacgatgtagggaggtacctcgaaaccaaaccagcagatctaggtcccaggtgcgtcctgtttgaaacttttgggagatgcccctacggagttacctgcagatttgctggggctcatctgaggcctgaggggcagaatctggtccaggaggagctggcagctcggggaacgcaaccaccgagcattcgaaacgggctcgacaaggccctacagcaacaactccgaaagcgcgaagtaaggtttgagcgcgcagagcaagcacttagacggttcagccagggccctactccagctgcagccgtgcccgaaggaacggccgctgaaggcgcacccaggcaagaaaactgcggcgcacaacaagttccagcagggccagggacatccaccccccctagcagccccgttcggacatgcggaccactgacggacgaggacgttgtgaggcttaggccttgtgagaagaaaagacttgacatcaggggtaagctgtatctggcccctctgactacttgtggcaatctgccttttcgaaggatctgcaagagatttggcgctgacgtcacctgtggagagatggccgtatgcacaaacttacttcagggccagatgtcggagtgggctctgctcaagcgccaccagtgtgaggatatatttggggtgcaactagaaggggcattcccagataccatgacaaaatgtgccgagttactgagtagaactgttgaggtggattttgtcgacattaacgtcggctgtccaatcgatctcgtctacaagaagggagggggttgtgcactgatgaaccgaagtacaaaatttcaacagattgtgcggggaatgaatcaagtactggatgtgccactgactgtcaaaatccggacaggcgtgcaggaacgagttaatctggctcatcgactgctacctgaactgagagactggggcgtagccttagtgacactgcacggcagatctcgggaacagagatacacaaagctggccgattggcagtatattgaggaatgcgtacaagctgcgagtcccatgccattgttcggaaacggagacattttatcttttgaagacgccaaccgtgccatgcagaccggcgtaaccggcatcatgattgcgcgtggtgccttgctcaagccttggctatttacagaaatcaaagaacagcgacattgggacatcagttcttctgaacgcctcgatatcctccgagatttcacgaattatggattagaacattggggatctgacacccagggcgttgaaaaaacaaggcgattcctactggagtggctgtcattcctttgccggtatgttcccgtaggactgttggagagactgcctcaacggataaatgaaaggccaccatattatctggggagagactaccttgagactcttatggcatcccaaaaagctgcagactggatccggatttcggaaatgctcctggggccagtgcccccaagcttcgccttcctgcctaagcacaaggcgaacgcctataagtag

SEQ ID NO: 55591 - DNA, 1227 bp, Artificial Sequence
  Description of Artificial Sequence: Synthetic coding sequence
atggccgagggcaccgctgaggcacccttggagaatggaggaggcggagacagcggggcaggggctctggaacgcggtgtggcccctatcaagcgacagtatctcaccaccaaggagcagttccatcagtttcttgaagccaaaggacaagagaaaacttgtcgggagacagaattggacattcgtggtaagctgtacctggcacccctgactacctgcggaaatctgccattccggaggatatgcaagcggtttggcgcagacgtgacatgcggagagatggcagtgtgcacaaacctgttgcagggccagatgagtgagtgggccctgctgaaaagacatcagtgcgaagacatatttggtgttcagctggaaggtgccttcccagacacgatgacaaaatgcgcagaacttttgtcaagaaccgtggaggttgatttcgtcgacatcaatgtcggctgtcccattgatctagtttacaaaaaaggcggaggatgcgcgttgatgaacagatctactaaattccagcagatcgttaggggaatgaaccaggtattagacgtgccactgacggtcaagatccggactggcgtacaggaacgcgtgaacctggcccaccggctgctcccagaactgcgtgactggggtgtggccctggttacactacacggtcgcagcagagagcagcggtacacaaagctggccgactggcagtacatcgaggagtgtgttcaggccgcttcccccatgcctctgttcggaaatggtgacatccttagctttgaggatgccaatagggcaatgcagaccggcgtcacaggcatcatgatagcacggggagcactgctcaaaccttggttgtttacagagattaaagagcagagacattgggatatttcttccagtgaacgtctggatattctccgagactttaccaattatggcctggaacactggggatcagatacgcaaggggttgagaaaactaggaggttcctactggaatggctgtcgttcctctgtagatacgtacccgtggggttactggaaaggctccctcagcgcatcaatgagagacccccatactacctgggtcgcgactatctcgagaccctcatggcttcccagaaggccgcagactggataaggatttctgagatgctcttgggtccagtgccaccatcctttgctttcttgcctaagcacaaggccaatgcctataagtag

SEQ ID NO: 55592 - DNA, 954 bp, Artificial Sequence
  Description of Artificial Sequence: Synthetic coding sequence
atgaaatctgattgtatgcagactacaatttgccaggagcggaaaaaggaccccattgagatgttccatagcgggcaactggttaaagtgtgcgccccaatggtcagatattccaagttggccttcaggacactcgttcgcaagtattcttgtgacctgtgctatactcctatgattgtggccgctgattttgtgaaatcaattaaggccagagattcagagttcactacgaaccagggggattgtcctcttatagtgcagttcgccgcaaacgatgcccgactgctttccgatgctgcccgaattgtttgcccatacgccaatggaatcgatatcaattgtggatgcccccagcggtgggccatggcagagggatacggggcttgtctgattaacaaacccgagctcgttcaagacatggttaagcaagtgcggaatcaggttgagacacctggtttttctgtgtctataaaaattcgtattcatgacgatcttaaacggacggttgacctgtgccagaaagctgaggccaccggcgtttcctggataacggtacatggcaggacagctgaggaacgacaccaaccggtccattacgatagcatcaagatcattaaagagaatatgagtattcccgtcatcgcaaacggcgatatccgatccctgaaggaggctgagaacgtgtggcgtattaccggcacagatggcgtcatggtcgctcggggactgctggcaaatcctgccatgtttgccggttacgaagaaaccccccttaaatgcatctgggactgggtggacatcgctttggagctagggaccccctacatgtgttttcaccaacacctgatgtatatgatggaaaaaatcaccagcagacaggagaagcgagtgttcaatgccctcagctccactagcgctataatcgactaccttacagaccattatggcatctag

SEQ ID NO: 55593 - DNA, 591 bp, Artificial Sequence
  Description of Artificial Sequence: Synthetic coding sequence
atggctgaagggtatggagcctgcctcatcaataagcccgagctggttcaagacatggtcaagcaggttcgaaaccaggtggagacgccagggttctctgtttccatcaaaattcgaatccatgatgatctgaaaagaaccgtggatctgtgccagaaggcagaagcaactggtgttagttggataaccgtccacgggcgtaccgctgaagaacgtcaccagccagtgcactatgactctatcaagatcatcaaagaaaatatgtcaatcccagttatcgcaaacggcgatattcgaagtctcaaggaagcagaaaacgtgtggagaattaccggcactgacggggttatggtcgcgagagggctgctggccaacccagccatgtttgctggttatgaggagacaccgttgaagtgcatctgggactgggttgatatcgccctggaactcgggactccgtacatgtgcttccatcagcatctcatgtacatgatggagaaaattacgagccgccaggaaaagagagtgttcaacgctctgagcagcacttccgcaataatcgactatcttacagaccactatggtatctag

SEQ ID NO: 55594 - DNA, 3669 bp, Artificial Sequence
  Description of Artificial Sequence: Synthetic coding sequence
atgtccgaggcccctagattcttcgtggggccagaggatactgaaattaaccccggtaattaccgacactttttccaccacgcggatgaggacgatgaggaagaggacgattccccacccgaaagacagatcgtagtgggcatctgcagcatggccaaaaagtccaagtctaaacctatgaaggagattttggaacgaatatctttattcaagtacatcacggtggtggtgttcgaggaggaagtgatcctaaatgaaccagtggagaactggcctttatgtgattgcttaatatcctttcactcgaagggatttccccttgataaggcggtcgcctatgcaaaactgcggaacccatttgtgattaacgatctgaatatgcaatatctcatccaggacagacgggaagtctattccattctacaagccgaaggtatcctgctcccgcgatacgccatattgaaccgagacccaaataaccccaaggagtgcaatctgatcgaaggcgaggatcatgtggaagtgaacggtgaggtattccagaaacccttcgtggagaaaccagtgagcgccgaggaccataacgtatacatatattatcctacctccgccggagggggatcacagcgtctgtttcgcaagattgggtcaaggtctagtgtatatagcccagagtcaaacgtgcggaagactggctcctatatctacgaagaattcatgcccactgatggcactgatgtgaaggtatataccgtcggccctgactacgcccatgccgaagctcgcaagtctccagccctggacgggaaggtcgaacgagattcggaaggaaaagaagtccgctacccagtaatcctgaatgcacgggaaaaactgattgcgtggaaggtgtgtctggcatttaagcagaccgtgtgcggcttcgacttattgagggcaaacggccaatcctatgtgtgtgatgtgaacggattttcctttgttaaaaactctatgaaatattacgacgactgtgctaagatcttaggcaatattgtgatgcgcgaattggctccccagttccatattccttggagtatccccctggaggcagaagacatccctattgttcctaccactagcggaacgatgatggagcttcggtgcgtgattgctgttataagacacggggaccgtacccccaaacaaaagatgaagatggaagttagacatcagaaattctttgacctgttcgagaagtgtgatggctataagagcgggaaactgaaattaaagaagccaaagcagttacaagaggttctggatattgccagacaattgctaatggaacttggacagaacaacgacagtgagatcgaagagaacaagcctaagctggagcagctgaaaacagtgctggagatgtacggacatttctcgggaatcaacagaaaagtgcagctcacatatctgccccatgggtgtccaaagaccagctcggaggaggaagacagtcgcagagaggagccgtctctactgctggtgctgaagtggggaggcgaattgacccccgctggacgggtccaagccgaggagctggggagggcattcaggtgcatgtacccgggaggtcaaggggattatgctggattccctggatgcgggctcctgcgcctgcatagcacttacagacacgacctgaaaatatatgccagcgacgagggcagagttcagatgacggccgcagcatttgctaaaggcctactggctttggaaggtgagttaactccaatccttgtacagatggtgaagtcagcaaatatgaacggactattggacagcgattccgattccctcagctcctgtcagcagcgagtgaaagcccgacttcatgaaatcctgcagaaggatcgagatttcacagcagaagattatgaaaagctaaccccatcaggtagcatctccctgattaaaagcatgcatctgatcaagaaccccgtcaagacttgtgacaaagtttactccctaatccaatccctgacttcacagatcagacaccggatggaagatcccaaaagcagtgacatccagctgtatcactcagagaccctcgagttaatgctgcggagatggagcaaactggagaaagacttcaagaccaaaaatggcaggtatgatatctctaaaatacctgacatctatgactgcattaaatacgacgtccagcacaatgggtcactgaagctggagaatacaatggagctgtatcggctttccaaggcactggccgatatcgtgattccccaagagtatggaattaccaaggccgagaaactggaaattgctaagggctactgcactccactcgtgaggaagatacgttccgacctccagagaacccaagatgatgataccgtgaataagctgcacccagtttacagccgcggagtgctgtcacccgaaaggcacgtgaggactaggctctactttacatcagagagtcatgtccatagcttgctgtccattctgcgttacggtgccctatgcaacgagtctaaggacgaacaatggaaacgagctatggactacctcaacgtcgtcaacgagttgaattatatgacacagattgtgatcatgttgtatgaggacccaaacaaggacctaagttctgaagaacggtttcatgtggagttgcacttttcccctggcgctaagggatgcgaagaggacaagaatctgccgagcggctacggatataggccagcaagcagagaaaacgaaggcagacggccatttaagatagataatgacgacgagccacacacctccaagagggatgaagtcgaccgggcagtgattctgtttaaaccaatggtgagcgagccgattcacatccaccggaagagcccactcccaagaagcagaaagactgctacgaacgatgaggagagccctctctctgtctcctcgcctgagggcaccggcacttggttgcattacacctcaggcgtgggcacaggcagaagacggcgacgctcaggcgagcagataacctcatctcccgttagccccaaatcactcgccttcacctcttctatcttcggcagttggcaacaagtggtgagtgaaaatgccaactatctccggactccgagaactctagtcgaacagaagcagaatcccactgtggggtctcattgtgcaggcctgttcagtactagtgtgcttggtggttcctcttcagcgccaaaccttcaggactacgccaggacccataggaagaaactgacgtcatctggttgcattgatggtttcgagctgtattcaatggtgccgagcatttgtcccctcgaaaccctgcacaacgctctttcgctaaaacaggttgatgaatttctagcttccattgcatcaccttcgagtgatgtgccgcgtaagacagccgaaataagctccacagcactccgttcatcccctataatgcgtaagaaagtgagcttgaatacatatacacctgctaagattttgcccactcccccagcaacactgaaatcaactaaggcttccagcaagccagctacctccggaccctctagcgccgtcgttcccaataccagttctagaaagaagaatatcacatcgaagaccgaaacccatgagcataaaaagaatactggtaaaaagaaatag

SEQ ID NO: 55595 - DNA, 2970 bp, Artificial Sequence
  Description of Artificial Sequence: Synthetic coding sequence
atgaaagggcttggcgacagtcgaccccgacacctgtccgactcccttgatccaccacacgagcctttattcgcgggaacggaccgaaatccctacctactcagcccgacagaggccttcgctagggaagctcgttttccaggtcagaatacattgccaggggacgggctctttccattaaataaccagcttcctccgccttcatccacatttcccagaattcactataactctcattttgaagtgcccgaggagtcccccttccccagtcacgcccaggcgacaaagattaaccgactcccggcaaatttgctggaccagtttgaaaaacaactgccaattcacagagacggatttagcactctacagttcccacgaggggaggcgaaagccaggggggagagtccaggcagaattaggcacctggtacacagcgtgcaacgtctgttctttaccaaagccccaagcctcgaggggacagctggaaaggtaggaggaaatggatccaagaaggggggaatggaggacggaaagggcagacgagccaagtctaaggaaagggccaaagctggcgagcctaaacggagatcacgttccaatatttcaggatggtggtcttcagacgacaatctcgatggcgaggccggtgctttccgcagttcaggtcccgcaagcggcctgatgactttgggacgccaggccgaacggtcgcagccccgatactttatgcacgcctataacacaatttcaggccacatgctcaagactacaaagaacaatactacagagctaaccgccccaccgccaccacccgctcccccagcaacctgccctagcctgggggtgggtacagatacaaattatgttaagcggggttcatggtctacactcactctctcccatgcacacgaagtgtgtcagaagacgtcagcaactctcgacaagtccctgctgaaaagcaagagttgtcatcagggtttagcctaccactacctccaagtcccgggtggcggaggggagtggtcgactacgctgctttctcccagagaaactgatgccgctgcggaaggccctatcccatgtcggcgaatgagatccggctcatatattaaggccatgggcgacgaggattccgacgagtccgggggatcacccaaaccctcccccaagaccgcggctaggcgacagagctacctgagagctacacagcagagcctgggggagcagagcaatccacgacgttctctagatcggctggattctgttgacatgcttctgccctctaagtgcccaagttgggaggaggactacacccctgtcagtgattcactgaatgactcttcatgcatttctcagatcttcggtcaagcctccctcattccccagttgtttggccatgaacaacaagtgcgggaggccgaattgtcagaccaatacgaagctgcatgtgagagcgcatgttctgaggctgagagcaccgcagccgagaccctagatttgcccctgcctagctacttccgctctaggtctcacagttacctgcgcgctatccaggctggttgtagccaggaggaagattcagtgtccctgcagtctctcagcccccctccatctaccggaagcctgagcaactcacgcacacttcctagcagttcatgcctggtggcttacaaaaaaacgcccccacccgtgccccctcgcaccacatctaaacctttcatcagcgtgaccgtgcagtctagtaccgaatctgcccaggacacgtaccttgacagccaggatcacaagtccgaggttacatctcagtctggcctcagtaatagctccgactccttagacagtagtacacgtccaccctcagtgacccgtgggggagttgcaccagcccctgaggctcctgaacccccacccaaacacgctgccttgaaatctgagcagggcacccttacgtcctccgagtcacacccagaggccgctccaaagcgaaaacttagcagtatcggtattcaggagaggaccagacggaacggatctcatctgtcagaggacaacggccctaaggctatagacgtgatggcaccaagctccgaatcttctgttcctagccactctatgagtagtcggagggacacggactcagacacgcaggacgcaaacgacagttcatgtaagtcctccgagcgatccttacctgattgcacaccacaccccaattccatttctatcgacgcaggtccacgtcaggctcctaagatcgcgcagatcaaaagaaacctgagttacggcgataactcagaccccgcacttgaggcgtcatccctgccgccaccggacccatggctggaaacctcttcatcctcccctgctgagcccgctcagccaggagcctgccggcgtgatgggtattggttcctgaagctgcttcaggctgagaccgagaggttggagggttggtgctgccagatggataaggaaaccaaagagaataacttgtccgaggaggtccttggtaaggtacttagtgcagtggggtccgcccagctgctgatgtcacagaagtttcagcagtttcgaggcctttgcgagcagaatttaaaccccgatgcaaaccccaggccaaccgcccaagatctggccggattttgggatctgctacaactgagcatcgaggatatatccatgaagttcgatgagctctaccacctgaaagctaatagctggcaactggtggaaacgcctgagaaacgcaaagaagaaaaaaaacctcccccacccgtgcccaaaaagccagctaaaagtaagcctgccgtgtctcgggataaggcgtccgacgcatccgataaacagaggcaggaagccaggaagcgcctgctcgcagccaagcgcgcagcctccgtaaggcagaactccgccaccgagagcgcagactcaatagaaatctacgtccctgaagcacaaacacgcctgtag

SEQ ID NO: 55596 - DNA, 2979 bp, Artificial Sequence
  Description of Artificial Sequence: Synthetic coding sequence
atgaaagggctaggtgattctagaccccgacatctgagcgacagcctcgatcctccacacgaacccctgtttgctggtacggatagaaatccctacctactgagccctactgaggctttcgcacgggaagcaaggtttcctggccagaacactctgccaggagatggcctctttcctctgaataaccagctgccacccccatcttcaactttccctagaattcattataactcccacttcgaagtgcctgaggaatccccatttccttcccatgcccaggccacaaagattaaccgccttcccgctaatctgctcgatcaattcgagaaacaattgcccatacatcgggacggcttctcaacattacagttcccacgcggagaagccaaggctaggggggaatcgccgggtagaatcaggcacctggtgcatagtgtacagagactgttctttactaaagcaccaagtctcgagggcacagcaggtaaggtggggggaaatgggagcaagaaaggcggaatggaggatggaaagggaagacgcgctaagtcaaaggaaagagccaaagctggagagcctaagcgtcgaagtagatctaatattagtggttggtggagttctgacgataacctagatggcgaggctggcgctttcaggagctcaggccctgcgtcaggcctgatgacacttggcagacaggcagaacgcagtcagcccagatattttatgcacgcatataataccatcagcgggcacatgctaaagacaaccaagaataatacgactgagctcacagctccacccccacccccagcgccaccagctacctgtcctagtttaggcgtggggaccgacacaaattatgtcaagaggggctcctggtccacgctcactctcagtcacgctcacgaggtctgccagaagacttccgccaccctagataaaagcctgctgaaatcgaagtcgtgccaccagggactggcatatcactacttgcaggtccccggaggaggcggtgagtggtctaccaccctactgagccctagagaaactgacgccgctgccgaagggccaatcccctgccgccgtatgcgttctggcagctatatcaaggcaatgggagacgaagacagtgatgaatcgggaggatctcctaaaccttctcctaagacagcagcgcgtcgccagagctacttgagagcaactcaacaatcactgggagagcaatcaaaccctagacgctcactggatcgactcgattccgtggacatgttgctgcctagcaagtgtcccagttgggaggaagactacacacctgtttccgatagtctgaacgattcatcatgcatttcacagatcttcggacaggccagccttatcccccagctgttcggccatgagcagcaggtgagagaagccgagctgagcgatcagtatgaagctgcgtgtgaaagcgcctgttcagaagccgagtcaaccgccgctgagacactcgatctcccactgccttcctattttagatccaggtcccactcttatctccgagcgatccaggcaggctgctcccaggaagaggattcagtttccctccagagcctgagcccaccacccagtacaggcagcctctcaaatagccgcacactgccgtcaagtagctgtttggtggcctataagaagaccccacctcccgtccctccccgaaccacctcaaaacctttcatctcagtgaccgtgcaaagcagcaccgaaagcgcccaggacacctatctcgactcacaggatcacaagtctgaagtcacctctcagtctggactctccaattcatcagattctctggatagttctacaaggcccccatcagttacgagggggggagtggcacctgccccagaggccccagagccgccaccaaaacacgcagccttgaagtcagagcagggaacattgacttccagcgaatcacaccccgaagcggcaccaaaacgtaaactgtccagtatcggtatccaggtggattgtatccaaccagtgcctaaggaagaaccatcgcccgcaactaagttccaatcgatcggcgttcaggtggaggacgattggcgctcctccgttccttctcactctatgtcatcccggcgagacactgacagcgacacccaggatgccaacgattcatcttgtaagtcatccgagagatctttgcccgattgcactccccaccccaatagcatcagcattgatgctggtccgaggcaggccccaaagatcgctcagatcaagcgcaatcttagctacggcgacaacagtgatccagcccttgaggcctctagtcttccaccaccagatccctggttggaaacctcatctagcagtcctgccgagcctgcgcagcctggggcatgcaggagggacgggtactggttcctgaaattattgcaagccgaaactgaacggcttgagggctggtgttgtcaaatggataaagaaacaaaggagaataatctttccgaagaggtgctgggcaaggtactgagcgccgtgggatcggcccagttgcttatgtcacaaaaattccagcagtttcgtggcttgtgtgagcagaatctgaacccagacgcgaacccacggccaaccgctcaggacctcgcagggttctgggatttgctgcagctcagtatcgaagatatctcaatgaagttcgatgagttatatcatctgaaggcgaacagctggcaattggtcgagacccctgaaaagcgaaaggaggagaagaagccccctccgccagtgcctaagaaaccagcaaagtccaagccagccgtctccagggataaggcatccgacgccagcgataaacagagacaggaggccagaaaaagactgctggccgcaaaaagagccgcatcagttcgccagaattctgccacagagagcgcagacagtatcgaaatctatgtgcccgaggcccagactcgtctgtag

SEQ ID NO: 55597 - DNA, 2979 bp, Artificial Sequence
  Description of Artificial Sequence: Synthetic coding sequence
atgaaaggattgggcgactcaagaccccgtcacctctccgatagtctggatccaccccacgagccgctcttcgcgggaacggataggaatccttacctgctgagtccgacggaggcttttgctagggaagcacgctttccaggacagaacactctcccaggcgacggcctgttccccctgaacaaccagttgcctcctcccagttctacctttccgagaatacattataattctcatttcgaggtgccggaggaaagcccatttccttctcatgctcaggccacaaagatcaacaggctgcccgctaacctcttagatcagttcgagaagcagctccccattcacagagacggtttcagcacgctgcaattccctcgcggagaggccaaggctcgaggtgagagtcccggaagaattcgccatctcgtccactccgtgcagcggctgtttttcactaaggcaccatccctagagggaaccgctgggaaggtggggggaaacggctcaaaaaagggaggtatggaggatggcaaaggccgaagggctaaaagtaaggagagagccaaagccggtgaacccaaaagacgttcacgctctaacatctctggatggtggtcctctgatgacaacctggatggtgaagcgggtgctttccgcagctccggacccgcaagcggactgatgactttgggcaggcaggccgagcgcagccagcccagatatttcatgcacgcttacaataccatctccggccatatgctcaaaactactaaaaacaatacgacagagctaactgctcccccacccccaccggcacccccagccacatgtcctagcttaggagtgggcacagacacaaactatgtgaaaagggggtcctggagtacccttactctgagccacgcccacgaagtatgccaaaagacatctgcgacacttgataagagcttgctaaagagcaagagttgtcaccaggggcttgcttaccattatcttcaggtgcccggaggtggaggcgagtggtctaccactctgttatccccaagagaaactgacgctgccgctgagggtcccattccctgtcggcgaatgcggtccgggagttatatcaaggcaatgggggacgaagatagtgatgagagtgggggtagccctaaacccagccccaagaccgccgctcgcaggcaaagctatctacgggcaactcagcagtcactgggcgaacagagcaacccgcgaagaagtttagatcgactggacagtgtcgatatgctcctgccttcgaaatgcccttcctgggaggaggactacacgccagtgtccgattctttgaacgactctagctgtatttcacagatcttcgggcaggcgagtttaatcccgcagctgttcgggcatgagcagcaggtcagggaggccgaattgtccgaccagtacgaagcagcatgcgaatccgcgtgctccgaagcggagtcaacagctgccgaaactctggatctcccactaccgagctacttcagatctcggtcacacagctacctccgcgcaattcaggctggctgcagccaggaagaggactcagttagcttacagtctctttccccaccaccaagtaccggcagcctgtctaactcccgaacattgcccagctccagttgtttagtggcctataagaaaacacctcctcccgtcccgcctaggacaacatcaaagcctttcatatctgtcacagtccagtctagcaccgaatcggcccaggatacatacctcgactctcaagaccacaagtccgaagtgacaagtcagtccgggctctccaacagcagtgatagcctggatagctccaccaggcctccatctgtgacgcgaggcggtgttgcgcctgcccctgaagcccctgagcctccacccaagcacgctgccctgaaaagcgaacagggcactctgacctcctccgagtctcatcctgaggccgcaccgaaaaggaaattaagctccatcggcattcaagtcgactgcattcaaccggtgcccaaggaggagccatcccccgcaacaaaatttcagagtatcggcgtccaggtagaggatgactggagatcatctgtcccatcacattctatgtcctccagaagagacactgactcagacacacaggatgcaaatgattccagctgtaagtctagcgagaggagcctgcctgattgtaccccacatcccaattccatctccatcgatgctgggccacggcaggcccctaagattgcacagatcaagaggaatttgtcatatggcgataattctgatcccgctttggaggcatcatctcttccaccacccgatccgtggctggaaacgagtagcagctctcctgctgagcctgctcaacctggggcttgtagacgagacggctattggttcctcaagctgttgcaagcggaaactgagcgcctggagggctggtgttgtcagatggacaaggaaaccaaagagaataacctgagcgaggaagtgctcggcaaggtactgtctgccgtgggatcagctcagctattgatgtctcagaagttccagcagtttagaggtctgtgtgaacaaaatctaaacccggacgccaacccccgaccaactgcacaggacctcgccggtttctgggatttgctgcaactgagtattgaagacatctctatgaaattcgacgagctctatcacttgaaagcaaattcatggcagctggtggagacgcctgagaaacggaaggaagaaaagaaacccccaccaccggtgcccaagaagcccgcaaaatccaaaccagctgtgagcagagataaggcctcagacgcgtcggataaacagcgtcaggaagctaggaaaagactcctggccgctaaacgagcggcaagtgtgcgccagaattcagcaacagagtccgcagattccattgagatatacgtcccggaagcacagactcgactgtag

SEQ ID NO: 55598 - DNA, 1362 bp, Artificial Sequence
  Description of Artificial Sequence: Synthetic coding sequence
atggccctttgcctagagctgctcaaacaatgttcatcatgcctagtggcgtataaaaagacacctccccctgtcccccctagaaccacttcaaaaccatttatttccgtgaccgtgcagtcttcaacagagagcgctcaagacacctacctggactcacaagatcacaaatctgaagtgacatcgcagtcgggcctgagtaatagttcagacagccttgactcctcaactcggcctcctagcgtcaccaggggcggagtggcacccgctcccgaggcacctgagccaccgcctaagcatgccgctctaaaatctgaacagggaaccctaactagcagcgaaagccaccccgaagctgccccaaaacgtaaactgtcctctatcggcattcaagttgattgcatccagccggtgccgaaggaagagccgtcacccgcaaccaaattccagtccattggcgtacaggtggaggacgactggaggtcttcggtcccatcccatagcatgtccagccgccgagacactgatagcgacacccaggacgcaaacgatagcagctgcaagtcatctgaaaggtctctgccagactgtacaccacaccccaacagtatatcgatcgatgctggacctcgacaggcgccaaaaattgcgcagatcaaacggaatctgagttacggagacaactcagaccctgccctcgaggcatcgagtttacctccgcctgacccatggcttgaaacctcctcctcaagtcctgctgagccggctcaaccaggcgcttgcagacgcgatggttattggttcctgaaattgctccaggctgagaccgaaagactcgagggatggtgttgccaaatggataaggagaccaaggagaataacctgagcgaagaagtgctaggcaaggttcttagtgccgtgggttcggcacagcttctgatgagccagaagtttcagcagttccgcggtctgtgcgaacagaatctgaaccccgacgccaatccccgacctacagcgcaggacctggccggattctgggatttactccaactgtctatagaggacatttccatgaagttcgacgagttatatcacctcaaagcaaattcctggcaactcgtggaaaccccagaaaagcgcaaggaggaaaagaagccaccgccacctgtgcctaaaaagcctgcaaagagcaagcccgcagtctctagagacaaggcttctgacgcctcagacaagcagcgtcaggaggccagaaagagactgcttgccgcaaagagggccgcttcagtgagacagaactctgccactgagtctgcggatagtatcgaaatctacgtgcccgaggcccagacaagactgtag

SEQ ID NO: 55599 - DNA, 2979 bp, Artificial Sequence
  Description of Artificial Sequence: Synthetic coding sequence
atgaaggggctcggcgattccagacccagacacttgagcgattctctggacccaccacatgagccactctttgccggtacagataggaacccgtacctgctgtctcccacagaagccttcgccagggaagctaggttccctgggcaaaacaccctgccaggggatggcctgttcccgctgaataaccaactcccccctccgagttcaaccttcccccgaattcactataacagtcatttcgaagttccagaggaatccccttttcccagccacgcccaggcgactaagattaataggctccccgctaatctcctcgatcagttcgaaaagcagctccccatccacagagacggtttcagcactctccagtttcccaggggagaagcaaaggctagaggcgaaagtccagggcgaatccgacatctggtgcactctgtgcaacggctcttcttcacgaaagcccctagtctagaaggcactgcaggaaaagtaggcggtaatgggagcaaaaaagggggtatggaggacgggaaaggaagacgggcaaaatccaaggaacgagcgaaagcaggtgagccaaaacggcgtagcaggtccaatatttctggatggtggtcatccgacgataatttggatggggaggcgggtgcatttcgcagcagcgggccagcctctggcttgatgactctcggtagacaggcagagaggtcgcaaccacggtacttcatgcacgcgtacaataccatctctggacacatgcttaaaacgacaaagaataacaccacggaattgactgcgcctccccctcctcccgctcctccagctacttgcccaagtctgggagtgggcaccgatacgaactatgtcaaaaggggcagttggtctactctgacactgagccatgcccacgaggtgtgtcaaaaaacaagtgcaacgctcgacaaatcactcctgaaatctaaaagctgccaccagggacttgcctatcattatctccaggtcccgggagggggtggcgaatggtccacaaccttgctaagccccagggagaccgatgcggctgcagaggggccaatcccgtgcagacgcatgcggagtggctcgtatataaaggccatgggggatgaggatagtgatgaatccgggggatctcccaagcccagccctaagactgccgcacgtagacagagctatctacgagcgactcagcagtccctgggcgaacaatctaaccccagaaggtcccttgacaggcttgatagcgtcgacatgcttctcccttctaaatgccccagctgggaggaggactacaccccagtgagtgactcgttgaatgacagtagttgtatctctcagattttcggccaagccagtctcattcctcaactttttggccatgaacagcaggtgcgagaggccgaactaagtgaccagtatgaggccgcatgtgaatcagcatgctctgaggctgagtccaccgccgctgagaccctggatctgccgctgccctcatacttccgctcccgcagccattcttatctgcgtgccattcaggcgggatgcagtcaggaagaagacagcgtgtcccttcaatccctatctccacctccttcgactggtagtctgtctaacagtaggactttaccgtcatcttcatgtcttgtagcctacaaaaagaccccccctcccgtaccacccagaaccaccagtaagcccttcatttccgtcacagtacagagctccacagagtctgctcaggacacctatctcgattcccaggaccataagtctgaggtgacatctcaatcgggactgtctaatagtagcgacagtctcgattcctcaacacgaccgccatctgtgactaggggcggtgtcgcccctgcacccgaggcgcctgagcctcccccaaaacacgccgcattgaaatccgagcagggtacattgacttcctccgagtcacaccctgaggccgctccaaagcggaaactaagctctattggcattcaggtggattgtatccagcccgtccccaaggaggagccttcacctgcgactaagtttcaatctatcggagtgcaggtggaggacgattggagatcatccgtgccttcccatagcatgtctagccgtagagatacggactccgacacccaggatgctaatgactctagttgcaaatcttccgagagatctctacccgactgtactcctcaccccaactcaatctccatcgatgccggaccccgtcaggctcccaaaatagcacagataaaaaggaacctgtcttacggtgataattctgaccccgcattagaggcgtcaagcctgccccctccagatccctggctcgaaacctcatcctcaagccctgccgagcccgctcagcccggtgcctgcagacgggatgggtattggttcctaaaactcctgcaggctgaaacagaaagactcgagggatggtgttgtcagatggacaaagaaaccaaggagaacaacttatcagaggaggttctggggaaggtgctgagcgcggtgggaagcgcacagctgctgatgagccagaaatttcagcagttccgaggcttgtgcgaacagaacttgaacccggacgctaacccaaggcctacggcccaggatctagctgggttttgggatctcttgcagctgagcatagaagatatttcaatgaaatttgatgagctgtaccatttgaaagcaaacagctggcagcttgttgagacgccggagaaaaggaaagaagaaaagaagccccctccacctgtgccaaagaaaccagccaaatcaaaacccgctgtttccagagataaagctagtgatgcctctgacaagcagcggcaggaagccagaaagcgtctgttggccgctaaacgtgccgcatccgtgcggcagaactctgccacagagtctgccgattctatagagatctacgtgcccgaagcccaaaccagactgtag

SEQ ID NO: 55600 - DNA, 2970 bp, Artificial Sequence
  Description of Artificial Sequence: Synthetic coding sequence
atgaagggtctgggagatagccgccctagacacttgtcagattctctggaccctccgcacgaacctctctttgcaggcactgacaggaatccctatctgttaagcccaacggaagcttttgctcgagaagcccgattccccggtcagaacactctgccaggtgatggcctttttcccctgaacaaccagctgcccccaccctcttccacctttccaagaattcattacaacagtcatttcgaggtgccggaggagtctccattcccttcacacgcccaagctacaaagataaataggcttcccgcaaaccttctcgatcaatttgaaaagcaattaccgatccacagagatggcttttccacattacagtttccgagaggggaggcgaaggcaaggggagagtcgccaggaagaatacgacacctcgtgcattccgttcagaggttgttttttacaaaagccccaagccttgagggtaccgccggaaaagtcggtgggaatgggagcaagaagggcggtatggaagacggcaaaggaagaagagccaagtctaaggagcgcgctaaagctggtgagcccaagcggagaagcaggagtaatattagcgggtggtggtcctctgatgacaacctagacggcgaggcaggcgcttttcggtcttcaggacctgcctctggccttatgaccttagggagacaagctgaaagatcacagcccagatacttcatgcacgcctacaacacaatttcaggccacatgcttaagaccactaaaaataacacaaccgagttgactgcccctcccccaccgcctgcaccaccagccacttgtccttctcttggagtgggaaccgacactaactacgtgaaaagggggtcctggagcaccctgaccttaagccatgcccatgaggtgtgccaaaaaaccagtgctaccttggacaaaagcctgctcaaatcaaagtcttgccatcagggcctcgcctatcactatctacaagtgcccggagggggtggcgagtggagtaccacattgctgtccccgagagagactgacgcagccgctgaggggccaattccctgtcgccgaatgcggtccgggagctacatcaaggccatgggggatgaggactctgacgaaagcggcggttctcctaagcccagtccaaaaacagccgctcggagacaaagttacctgagagccacacagcagtctctcggcgagcagtccaatcctcggaggtcactcgacaggctcgacagtgtggacatgctcctcccctccaaatgtcccagttgggaggaggactacactccagtgagcgatagcctgaacgactcttcgtgtattagtcagatttttgggcaggcctctctaataccccagctgtttgggcatgaacaacaggtccgtgaagcagaattatctgatcagtatgaggctgcctgtgagagcgcctgctcagaggctgagagcaccgccgctgagacactcgatctgccacttccgagctatttccgaagccggtcgcattcttacctgagagctatccaggccggatgcagccaggaagaggattctgtatcactgcagagtctatcgcctcctcccagcaccggcagcctgagcaatagccgcactttaccatcttcctcttgtctggttgcctataagaaaacacctccacctgtgccacccaggaccacatcgaaaccatttattagtgttacagttcagtcctcaactgagtctgctcaggatacatatctcgattcccaggaccacaagtcggaggtcacctcccaaagcggactgtccaactcgagtgatagcctcgacagctccaccaggcctcctagcgtcaccagggggggtgtggcacccgctccagaggccccagaaccccctcctaagcacgcagcgctcaagagcgagcagggcaccttgacctcatccgagtcccaccccgaagcggctccaaagcgcaagctatcctctattggcattcaggaaagaacccgcagaaatggttcacacctgtccgaggacaacggtcctaaggccattgatgtcatggcacctagcagtgagtctagcgtgccttctcactccatgagcagccgtcgggacaccgacagcgatacacaggatgcaaatgattctagctgcaagtcctcagagcgtagcttgccagactgtacaccacatcccaattccattagcatagacgctggaccgagacaagccccaaaaatcgcccaaataaaacgtaacctttcgtatggtgataacagtgaccccgctctggaggcctcaagtttgcctccaccggacccatggttagagaccagttcgagcagtcccgctgaaccagcccaacccggagcctgccgacgagacggctattggttcttgaagttgcttcaggccgaaactgagagactcgaagggtggtgttgccagatggacaaagagaccaaggaaaataatctgtctgaagaggtgctcggaaaggtcctatctgcggttggctctgcacaactcctgatgtctcagaagtttcagcaatttcggggtctctgtgagcaaaatctcaatcctgatgccaacccccgaccgacagctcaggacttggccggtttctgggacctactgcagctgagtatcgaggatattagtatgaagtttgatgagctgtatcatctgaaagcaaatagctggcagctagtggaaactcccgagaagaggaaagaggaaaaaaagcccccaccccctgtgcctaagaaaccagctaagagcaaaccagccgtctcgagggacaaggcaagcgatgccagcgataaacagcgccaggaggccaggaagcggctactggcggcaaaacgggcagcttcagtcagacagaactctgccacagagagtgccgatagtattgaaatctatgtcccagaagctcaaactcgcctgtag

SEQ ID NO: 55601 - DNA, 2970 bp, Artificial Sequence
  Description of Artificial Sequence: Synthetic coding sequence
atgaagggactgggtgattcaagaccgagacacctgagcgacagcctcgacccccctcacgaaccgctgtttgcgggtacagatcgaaacccgtatttgcttagcccaacagaggctttcgccagagaggcacgattccctgggcagaacaccttacccggagatgggttgttccccctgaataaccagctccccccaccatctagtacgttcccacgtattcactataatagccactttgaggtgcccgaggagtcccctttcccttcccatgcacaggccacgaaaataaaccgcctgcccgctaatctcctcgaccagttcgaaaagcagctgccaattcacagagacgggttttctacactacagtttccaagaggggaggcaaaggcacgtggagaatctcccggtcggattcgccacctcgtacatagcgtccagaggctgtttttcacaaaagccccatcactggagggaaccgcaggtaaggttggcggaaacggaagcaagaaggggggaatggaggacggaaagggtcgcagggcgaaatccaaggagagggctaaagctggagaacccaaacggagaagcagaagcaacattagtggttggtggtcttcagatgataacctagatggagaagcaggagcctttaggtcgtccggtcctgctagtggcctcatgacattgggtcgccaagcggagcgcagtcagccgcgttattttatgcacgcatataatactatttccggccatatgttgaaaacaactaagaataacaccacagaacttaccgcaccccctccccctcccgctcctcccgcaacctgccctagcctgggagttggtactgacacgaactacgttaagcgaggctcctggtcgactctgactctttcacatgcacacgaagtgtgccaaaagacatcggcaaccctagataagagcctgttgaaatctaagtcctgccaccaaggattggcttatcactacctgcaggtccccggagggggtggagaatggtccaccacgctgttgtcgccccgagaaactgacgcagccgctgagggacctatcccctgcagacggatgcggagtggcagctatattaaagccatgggcgatgaggacagtgatgagtcagggggtagtccaaagccaagccctaaaacagccgctagaagacagtcttacctgagggccacccagcagtccctgggcgagcagtcaaatccaagaagatccctggatagattagacagtgtggatatgctgcttccaagcaagtgtccaagttgggaggaggactatacacccgtctctgacagcctaaatgactcctcatgcatctctcaaatctttggtcaggctagcctcatccctcagttatttgggcatgagcagcaggtccgcgaagctgagcttagtgatcagtacgaggccgcatgtgagagcgcctgcagcgaagccgaaagcactgcagccgagacactcgacttgccacttccaagctacttccgatccagaagccacagttaccttcgcgctattcaggcagggtgtagccaggaagaagactcagtcagcctgcagtctctgagtccccctccttcaaccgggtctttatctaattcccgaaccttgcccagctcatcctgcctggtggcctataaaaagactcctccacctgtccctcctagaaccaccagcaaacccttcatcagcgttaccgtgcagtcatcaacagagtcagcccaggatacctatctggactcccaggaccataagtcagaggtgacctcgcagagcggcttatctaattcctccgattcactggactcgagcaccaggcccccttccgtgacacggggaggagtcgcgcctgccccagaagcaccagaaccacctcccaagcatgcagccctgaagtccgaacagggcacattaacttcttctgagtcccatcctgaggccgcacctaaacgtaagttatcctcgattggtatccaagagcgaacccggaggaacggttctcatctgtcggaagacaacggccctaaagccatcgacgtgatggcccctagctccgaatccagtgttccatctcattctatgtctagcaggcgagacaccgacagtgacacccaagacgcaaacgattcgagttgtaagtcttctgagcggtctcttccggactgcacaccccaccccaacagtatctccatcgatgcagggcctagacaggctcctaaaattgcgcagatcaagcgaaacctgagctacggcgataacagcgatccggctttggaggcctccagtctgcccccaccagacccttggcttgaaacatcttcctccagcccagccgaacccgcacagccgggagcttgtcgcagggacggttactggtttttgaagctgctccaggcagagaccgaaaggctggagggctggtgttgtcagatggataaagaaactaaagagaataatctgtctgaggaggtgcttggaaaggttctcagcgccgtaggaagcgcccaacttctcatgtcacagaagttccaacagttcaggggattgtgcgagcaaaacctgaaccctgacgccaatcctcgccctactgcacaggacctcgccggattttgggatcttctacaacttagcattgaagacatttccatgaagtttgatgaactgtaccatctgaaagctaattcctggcagttggtggagacccctgaaaagcgcaaagaggagaagaaaccccctccacctgtgccgaagaagcctgctaagagtaaacctgcagtgtccagagacaaggctagcgatgcaagcgacaaacagcgccaggaggctcgcaagcgccttctcgctgccaagagagctgcaagtgttcgtcaaaattccgcgaccgaaagcgcagactccatcgagatctatgtgcccgaggcccagacacgcctctag

SEQ ID NO: 55602 - DNA, 576 bp, Artificial Sequence
  Description of Artificial Sequence: Synthetic coding sequence
atgcccggtagcgaggacttgagaaagggaaaggatcagatgcactcccatcgcaaacgcacgatgtttaccaagaagcagttggaagacctgaatattctcttcaatgagaatccttacccaaacccctcactgcaaaaagagatggcctccaagatcgacatccaccctaccgtccttcaagtctggttcaaaaatcatcgtgctaagctaaagaaggctaaatgcaagcatatccaccagaaacaagaaacacctcagccaccaataccagaaggaggcgtaagcacatccgttggtcttcgcaacgctgatacattgcctaggctgcctaacgccgctcatccaattggccttgtatacacaggccatcgcgtgcctagtttccaattgatcctttaccctaacctgaaggtaccagccaatgatttcatcggacatcgaatagttcacttcgggtgctgcagagatccgaacatctattgcctgtaccccattttggaatcccaggtgtgtgccccatcctttcacagtgggagccctgcttgtagctccaatcagtcgagggagaggtag

SEQ ID NO: 55603 - DNA, 2052 bp, Artificial Sequence
  Description of Artificial Sequence: Synthetic coding sequence
atgttggcttgcttgaccagaggaaacctgctggacgttcttcaggagggatttaacgagcagcagcttcaggcctatgttgcttgggtaaatgctcagcttaagaaaagaccggcagtgaagcctgttcaggacctgaggcaggatctgcgggatggagttattcttgcatacctcatcgaaatcgtggctggggagaagttgtcaggagtgcagttgtcacccggaaaccagcaagagatgaaaaacaatgttgagaaggtgttgcagtttgtcgccagtaaaaagatccggatgcatcagactagcgctaaagacattgtggatgggaacctgaaaagcatcatgaggctggtccttgccctggccgctcacttcaagccaggctcttcccgtacagtcaaccagggcagggactcaagggcgcctttacagtctcatagaccccactgcgcgaccgccgtcgcccaaggtgcagctgccgcactggcagacgtctgccacgatatgtccaggagcgggagagatgtgtttcgttacaggcaacgcaatagcagtatggacgaggaaattgaaaacccctactggagtgtgcgtgccctggtgcagcagtacgagggacagcaacggagtccttcagagtcatcctgctcatccttgacctcgccaagccccatccatagtgctaaaagcgaatccataattactcagtccgaggaaaaggcggatttcgttataatcccggctgaaggcatcgagaaccgcaccgagggtacagactcccctctctcgcgcgattggcgacccggtagtccgggaacatacctggaaacgagctgggaggaacaactcctcgagcagcaggagtacctcgaaaaagagatggaggaagcgaagaagatgatctccggtcttcaggctctccttctgaatggcagcctgcctgaagacgaacaggaacggcctctggctttatgcgagccgggagtgaaccccgaagagcagctcatcattattcagtctaggctggatcagagcatggaagagaaccaagatctgaagaaggaacttttgaagtgcaaacaagaagcccgaaacttgcaaggaatcaaggatgcactgcagcagcgcctcactcagcaggatacttccgtgctgcagctgaaacaggagctgcttagggcaaatatggacaaagacgaactccataatcagaatgtcgatctccagaggaagctggacgagcgcaatcgactcctaggagagtataagaaagagctggggcagaaagatcgcctcctacagcagcatcaggccaaactggaagaggcactgcggaaactgtctgacgttagctatcatcaagtggacctcgagcgcgaactcgaacacaaggatgtgctgcttgcgcattgcatgaagagagaggccgacgaagcgacaaattacaacagccataactcccagtccaatggtttcctgcttccgaccgccggaaaaggtgctaccagtgtctctaacagagggaccagcgatctgcagctggtgagagacgccctcaggagcctgcgcaacagctttagcggtcacgacccccagcatcacacaatagacagcctggaacaggggattagctccctcatggagcgcctccatgtgatggaaacacagaaaaaacaagaaagaaaggtcagggtgaagtccccaagaacacaggtcggatctgagtaccgggaaagctggccaccaaactctaagcttccccactcacagagttcccctaccgtgagctccacttgtacgaaggtgctttactttaccgatcggtccctaacaccctttatggtgaatattccgaagaggctggaggaagtgacactgaaagatttcaaagccgctattgatcgggaggggaatcatagataccattttaaggcgttagatccggagtttggtactgtgaaggaggagatcttccatgacgatgacgccattcccggttgggagggtaagattgtcgcctgggtggaggaggatcacggcgagaattag

SEQ ID NO: 55604 - DNA, 384 bp, Artificial Sequence
  Description of Artificial Sequence: Synthetic coding sequence
atggccgcaccacctaaggccccaatacgcgtgcgaaatttaacaatacgcgcaggcgctttgaccgggaaagagaacaacatgctccagcccgaaacacacatcttcaccgctccagaggaagttcccaaggttagtgatcaagccctggtgtctgcccatagcgagtggcagcgcaaactcgaggccgcagaggctctcctgaccctgcgaaacagtgcacaggccccaccagatagcatcagcctgcaccagccttgtaacccgccagccccagccggtgacaagggctttcagccaccttctccgtccctccggcctagacctgcttcctcaatatccctgcccattggccacctgggctgtatctccctgcttagctag

SEQ ID NO: 55605 - DNA, 579 bp, Artificial Sequence
  Description of Artificial Sequence: Synthetic coding sequence
atggccgcacccccaaaagcccctatacgggtgcgtaacttgaccatccgggcaggcgcactgaccggaaaggagaacaatatgctgcagcctgaaactcacatctttactgcacccgaggaggggtctagtcagggtgccctgctgctcggccaggccccagaaccattgagtctgccttgtacgccagtcaccctggagcagcaacttgtgtcaccttccggagaccctcacagggctcccgcactgcccagtatctgttccacattgattctccaaccctgtgcaaccctggacccgctcttgttgcagccacaggttcccaaagtcagtgatcaggctcttgtttctgctcacagcgagtggcagcgtaaattggaggcggctgaagcactcttaacattacggaactctgcacaagcccctcccgacagtatttcactgcaccagccatgtaaccctccagcccctgcgggagacaagggcttccagcccccaagtcctagcctgcgtccccgtcctgcttcatctatctcccttccaattggccacttaggatgcatttcactgctgagctag

SEQ ID NO: 55606 - DNA, 384 bp, Artificial Sequence
  Description of Artificial Sequence: Synthetic coding sequence
atggctgcgcctcctaaggccccaattagggttaggaacttgaccatcagagccggtgcattgactggcaaggaaaacaacatgctccagcctgagacgcatatttttactgccccagaagaagtccctaaggtctcagaccaagcactcgtgagcgcccactcggaatggcagcgcaaattagaagcggcagaagcactgctgacactgcgcaatagcgcacaggcgcctccggacagcatctcccttcaccagccatgcaatccacccgctccggcaggtgacaaagggttccagccacccagccccagtctgagaccaagacctgccagctccatttccctccccattggccacctcggatgcatatccctgctgtcatag

SEQ ID NO: 55607 - DNA, 579 bp, Artificial Sequence
  Description of Artificial Sequence: Synthetic coding sequence
atggccgctcctcctaaggccccaattcgtgtgcgcaacctgactattcgcgcaggcgcactcaccggaaaggagaataacatgttgcagcctgagacccacatcttcaccgcacctgaggaaggttcttcgcaaggcgcactgctcctgggacaggctccagagcccctgtccctcccatgcacccccgtgactttagagcagcaattggtgagtccgtcaggagatcctcatcgggctcccgcactgccgtccatttgtagtactcttatccttcagccctgcgctaccttggatccactgctccttcaaccgcaagtccctaaggtttccgaccaggctttagtttctgctcattctgaatggcagaggaagctggaagcggctgaggccttgctgaccctccgcaatagtgcacaggcaccgcctgatagtatatctctgcaccagccatgcaaccctcctgcgccagcaggcgacaaaggctttcagcccccatctcccagcctgaggccaagaccagcctcatctatcagcctcccaattggacatcttgggtgtatctcacttctgtcctag

SEQ ID NO: 55608 - DNA, 579 bp, Artificial Sequence
  Description of Artificial Sequence: Synthetic coding sequence
atggctgcgcctcctaaggcccctatcagagtcaggaacctgacaatccgggctggtgccctgactggcaaagagaacaatatgttacaaccggaaacgcatatctttaccgctccagaagaaggctcgtcccagggagccctgcttttgggccaggccccagagcccctgagtttgccatgtacccccgtgacgcttgaacagcagctggtgtccccatcaggagatccacatagagctcccgcactgcctagtatctgcagtacccttattctccaaccctgcgcaacactcgacccccttctgctgcagccgcaagtaccgaaggtgagtgatcaggccctcgtcagcgcccacagtgagtggcagcgcaaactagaagctgctgaagcccttttaacgctgcggaactcggctcaggccccacccgacagtatttccctgcaccagccatgtaatcctcccgctcctgctggggataaggggtttcagccaccttcaccatccctccggccacgcccagcatcatctatctctctccctataggacacctggggtgtatatctctgttgagctag

SEQ ID NO: 55609 - DNA, 384 bp, Artificial Sequence
  Description of Artificial Sequence: Synthetic coding sequence
atggccgcaccacctaaggctcccattcgcgtcagaaatctcactataagggcaggggcactgactggtaaagagaataacatgctgcagcccgagactcacatattcaccgcacctgaggaggttccaaaggtgagcgaccaggccctggtgagcgctcattcggagtggcagagaaagctcgaagcagccgaagcacttttgacgctacgaaattccgcccaggcccctcctgattcaatcagccttcaccagccgtgcaacccccctgcccctgcgggagataagggatttcagcctcccagtcccagcctcagaccccgtccggcttcctcaatctcactccccattggtcacctgggatgcatcagcctcctcagctag

SEQ ID NO: 55610 - DNA, 195 bp, Artificial Sequence
  Description of Artificial Sequence: Synthetic coding sequence
atggctgcccctcctaaagcaccaatccgtgttaggaatttaacgatccgtgctggcgctcttacagggaaagagaataacatgctccagcccgaaactcatatatttactgcccctgaagaggggagctcccaaggggctttgttgctggggcaggctccggagcctctctccctgccttgcaccccagtatag

SEQ ID NO: 55611 - DNA, 306 bp, Artificial Sequence
  Description of Artificial Sequence: Synthetic coding sequence
atggccgctcctccgaaagccccaattagagtcaggaatttaaccattagggctggagcgctgaccggcaaggagaacaatatgttgcaacccgagacccacattttcaccgctcctgaagagggtagctctcagggcgcattattgctggggcaagcacccgagccactctccttgccatgcacgccagtcaccttggaacagcagctggtctcgccctcaggggaccctcacagggctcctgctctcccctctatctgcagcacgctgatcctacaaccctgtgctacgctggatccattatag

SEQ ID NO: 55612 - DNA, 579 bp, Artificial Sequence
  Description of Artificial Sequence: Synthetic coding sequence
atggctgccccaccgaaggcaccgattagagtgcgaaatctgactatccgggcaggagctctaacaggcaaggaaaacaacatgctccagcccgagacacatatcttcacggcacctgaagaggggtcttctcagggagctctgttgttggggcaagccccagagcctctgtccttaccatgtactccagtcactctggaacagcagttagtaagtccaagcggagatcctcatcgggctcctgccctgccgtctatctgtagcacattgattctgcagccatgtgctactctggacccactgctgttgcagccgcaggttcccaaggtctcagaccaggcactggtgtctgcgcattctgagtggcagcggaagttagaggcagctgaagccctactgaccctaagaaatagtgcccaggcacctcctgatagcatcagcctgcaccaaccttgtaatccccctgcaccagcaggcgataagggctttcagccaccctcaccctctctccgtccccgtccagcctcttccatcagcctgccaataggacaccttggatgcatctccctgttgagttag

SEQ ID NO: 55613 - DNA, 1191 bp, Artificial Sequence
  Description of Artificial Sequence: Synthetic coding sequence
atgctgatcaccgtttactgcgtgagaagagatctatcagaagtcacattctccctccaagtcagccccgattttgaactcaggaactttaaggttctttgcgaagcagagagccgcgttcctgtggaagaaatccagattatccacatggagagactgctaattgaagaccactgcagtttgggaagctatgggctgaaggatggcgacatagtggtgttgctccagaaggataacgtcgggccacgcgctcctggcagagcacctaatcagccacgagtggacttctcaggcatcgctgtccctggtacctctagcagcaggccccaacatcctgggcagcagcagcaacgtacaccagctgcacaaaggagccagggtctggcgtcgggagagaaggtggctggcctgcagggactaggtagcccagccttgataaggtcaatgctcttgagcaatccccacgatttgtctttactcaaggagcgcaacccaccgctggcagaggccctcctaagcggaagcctggagaccttctcccaggtactcatggagcagcagcgtgaaaaggccttgcgcgagcaggagagactcagactgtatactgctgatcccctagatagggaggcgcaagctaagattgaggaggagatcagacagcagaacatcgaagagaacatgaacatagccattgaggaggcaccagagagctttggtcaggtcactatgctgtatataaactgcaaggtcaacggacaccccttgaaggcattcgttgactccggagcacagatgaccatcatgtctcaggcttgtgcggaaagatgtaacattatgcggctggtcgacagaaggtgggccggtgttgcaaagggcgtcggcacccagcgaatcattggcagagtacatctggcccaaattcagattgaaggcgatttccttcaatgttcattctcaattctagaagatcagcctatggatatgcttctgggcctggatatgttacgcaggcaccaatgttctattgatctgaaaaaaaacgtgcttgtcataggaaccactggaacgcagacatactttctcccagagggtgaactgccgctttgcagccgcatggtatctggacaagacgaatcttctgataaggagattacgcactccgtcatggactcaggcaggaaggaacattag

SEQ ID NO: 55614 - DNA, 1200 bp, Artificial Sequence
  Description of Artificial Sequence: Synthetic coding sequence
atgttactgaccgtgtactgcgtgaggcgagacctctcagaagtcacctttagcctacaggtagacgctgactttgagctgcataacttcagagcgctctgtgaactcgaatccggcattcctgcagcggagagccagatcgtatacgctgagcgcccactgactgataatcatagatctctggccagctacgggctgaaggatggcgatgtggtgattctgagacagaaggaaaacgccgacccacgccctccggtgcagtttcctaacctgcctcgaattgacttcagtagcattgctgtccctggaacttcttctcctcggcagcgtcagcctccaggaacacaacagtcacacagcagcccaggtgagataacctcaagcccgcagggactggataaccccgctctactccgcgatatgcttcttgccaatccacacgagctgagcctgcttaaggagcgcaatccccctctggctgaggcactcttgtccggagatcttgaaaagttttcacgagtattggtggagcagcagcaggacagggcgagacgcgagcaggaacgcatcagacttttttcggccgacccgttcgacctggaggcacaggctaagatagaagaggatatccgtcagcagaatatcgaggagaatatgacaattgcaatggaagaggccccagagagctttggtcaagttgtaatgctgtacattaattgcaaggtgaatggccacccggtgaaggctttcgttgactctggagctcagatgaccattatgtctcaggcttgtgcggagcgctgtaacattatgcggctggtggatcgccgatgggctgggattgccaagggtgtcggcactcagaagatcattggaagagtgcacttggcccaggtacaaattgaaggggatttcctgccatgttcattttcaattcttgaagaacaacccatggacatgttgctgggactcgacatgctgaagagacatcagtgctcaatcgacctcaaaaagaacgtgctggtgattggaactactggcagccagactacatttctgccagaaggcgaactgccagaatgcgccagattggcgtacggggcaggcagagaagacgtgagacccgaagaaatagccgatcaggaactcgcagaggccctccagaaatcggccgaagacgccgaacggcagaagccttag

SEQ ID NO: 55615 - DNA, 1167 bp, Artificial Sequence
  Description of Artificial Sequence: Synthetic coding sequence
atgaatactatgtatgtgatgatggcacagattttgcgaagtcacctcataaaagccaccgtcatcccaaatagagtcaagatgctcccatattttgggatcattcggaacagaatgatgtctacccataaaagtaagaaaaagatccgtgagtactaccgactgcttaatgtcgaagagggttgctcggccgatgaggtgagggaatcctttcacaagctggctaaacaatatcaccctgatagtggctccaacaccgccgactccgccacgtttatacggatcgagaaagcctacagaaaggtgctgtcccatgtcatagagcagacaaatgcctctcaaagtaagggagaggaagaagaagatgtggagaagttcaaatataaaactccccaacaccgccattaccttagtttcgaagggatcggattcggcacccctacccaacgcgagaagcattacaggcagtttagagccgatagagcggctgagcaggtcatggagtaccaaaagcagaaactgcagagtcagtacttccctgacagtgtgatcgtgaaaaacatcaggcagagcaaacagcagaaaatcacacaagctattgaacgcctggtagaagatctcattcaggaaagcatggctaagggcgatttcgataacctctctggcaagggcaagccactgaaaaaatttagtgattgcagctacatagatcctatgacgcacaatctcaatagaattctcattgacaacggttaccaacctgagtggattctcaaacagaaagaaatcagtgatactatcgagcaactcagagaggccatcctagtgagccgcaagaagctgggtaaccccatgactcctaccgagaagaaacagtggaatcatgtgtgcgaacagtttcaggaaaatatcagaaagctgaacaagcggatcaatgactttaacttgatcgtccccattctaacccgccagaaggtgcatttcgatgcccagaaggagatcgtcagagcccaaaaaatctacgagacgttaattaaaaccaaggaggtcacagacagaaacccaaacaatctggatcagggggagggagagaagacccctgagattaaaaaaggattcctgaattggatgaacttgtggaaatttatcaagattaggtctttttag

SEQ ID NO: 55616 - DNA, 1167 bp, Artificial Sequence
  Description of Artificial Sequence: Synthetic coding sequence
atgaataccatgtatgtgatgatggcacagatcctgcgatcacacctcattaaggccaccgtcatccctaacagggtgaagatgcttccttattttggaattattcgtaaccgaatgatgtctactcacaaatccaaaaagaagatccgagagtattatagactcctaaatgtggaggagggctgcagcgccgacgaagtccgggagtcctttcacaaacttgccaagcagtaccacccagattcagggtccaataccgctgattctgcgacctttattcggattgaaaaggcttataggaaggtgctgagtcatgtgatcgagcagactaatgcctcccagtccaagggtgaagaagaagaggacgttgagaagtttaagtataagaccccgcagcataggcattatctctcgttcgaggggataggttttggtactcctactcagagggagaagcactaccggcagtttcgcgctgaccgggcagccgaacaggtcatggaatatcaaaagcagaagctgcagtcgcagtatttccccgatagcgtaatagttaaaaacatacggcagtctaaacagcagaagattacccaggccatcgaaaggttggtggaagatttgatccaggagagcatggcaaagggcgacttcgataatctctcaggtaaaggcaagccgctgaaaaaattcagtgattgctcctacatagatcccatgacacacaacctcaaccgaatacttattgacaatgggtaccagcctgaatggatcctgaaacagaaggagatctctgataccatcgagcaactacgcgaggccatcctggtgtcccgcaagaagctcgggaatcctatgactcctaccgagaaaaagcagtggaatcacgtgtgcgagcagtttcaggaaaatatacggaagctcaataaacgcattaacgacttcaacctgatagtcccaattttaacacggcagaaagttcacttcgacgctcagaaagagatagtccgggctcagaagatctacgaaaccctgatcaaaaccaaagaggtcaccgaccggaaccccaataatttagaccagggtgagggcgagaagacccctgagatcaagaaggggtttcttaactggatgaacctctggaagtttattaaaattagaagtttttag

SEQ ID NO: 55617 - DNA, 1194 bp, Artificial Sequence
  Description of Artificial Sequence: Synthetic coding sequence
atggtaaaagagacaacctattacgatgtcctgggggtcaagccgaacgctacccaggaagagctgaagaaggcttatcgaaaactggctcttaagtatcaccccgacaagaaccccaacgagggtgagaagttcaagcagatttcccaggcgtacgaagtgctgagcgatgcaaaaaagagggaactgtatgacaaggggggagagcaggcaatcaaagagggaggagcagggggaggttttggctctccaatggacatattcgatatgttttttggcggaggtggcagaatgcagagagagcgaagggggaagaacgttgtgcaccagctgtctgtgaccctggaggacttgtataacggcgctacccggaagcttgcactgcagaaaaatgtcatctgtgataaatgcgaaggcagaggtggaaaaaaaggcgctgtcgagtgttgcccaaactgccggggaactggcatgcaaatccgtatccatcagattggccctggaatggtgcagcagattcagtccgtatgtatggaatgccagggccacggcgagcgcatctctcctaaggaccgatgcaagagctgcaatggcagaaaaatcgttagagagaaaaaaatcctcgaggttcacatcgataaggggatgaaggacggccagaagattaccttccatggagagggggatcaggaaccaggactggaaccgggagacatcattatcgtcttagaccaaaaggaccacgccgtatttacccgcaggggcgaggatctttttatgtgtatggatatccaactagtcgaggcactttgcggttttcagaagccaatatccaccttagataaccgaacaattgtgatcacgagtcacccaggtcagattgttaagcacggagacatcaaatgtgtgcttaatgagggtatgcccatttacaggcggccttacgaaaaggggcgactaataatcgagtttaaggtcaacttccctgagaacggctttctttctcctgacaagttgtccttactcgagaaactcctgccagaaagaaaagaagtcgaagaaaccgacgaaatggaccaggtagagctagtggacttcgaccctaaccaggaacggagacgccactacaacggcgaagcgtacgaggacgacgagcaccatcccagaggtggtgtgcagtgtcagacttcttag

SEQ ID NO: 55618 - DNA, 774 bp, Artificial Sequence
  Description of Artificial Sequence: Synthetic coding sequence
atgcaaattcggatccaccagattggtcccggtatggtacagcaaatccagtccgtctgtatggagtgccaaggacatggtgaaaggatcagtcccaaggatagatgtaagagctgcaacggcaggaaaattgttcgagaaaaaaagattctggaggtgcacatcgataaggggatgaaggatggccagaagatcacctttcatggcgagggcgaccaggaaccaggcttggaaccgggagatattatcatcgtgctggaccagaaggatcatgcagtttttaccaggagaggagaagatctgtttatgtgtatggatatccagcttgtcgaggccttgtgtggattccaaaagccaatttctacactcgataatcgtaccatcgtcatcacctcacaccctggccaaatagtgaaacacggcgacattaaatgtgtactgaacgaaggtatgcccatttatcgtcggccttatgaaaaagggagattgataatcgaatttaaggttaacttcccagagaacggcttcttaagtccggacaaactgagcctcctagagaaattgctccccgagcggaaagaagtcgaagaaaccgatgagatggatcaggttgaattagtagatttcgacccaaaccaggagcggcgtagacactacaacggtgaggcttacgaagacgacgaacaccacccccgtggcggagtacaatgccagaccagtaatggccctgtcaacaatacacactgttggcacctcatgtgctcatccgagtag

SEQ ID NO: 55619 - DNA, 723 bp, Artificial Sequence
  Description of Artificial Sequence: Synthetic coding sequence
atgcagattcgcatccatcaaattggtccaggcatggtgcagcaaatccaatccgtttgcatggaatgtcaagggcatggcgaaaggatctccccaaaggaccgttgtaagtcgtgtaatggccgtaagatagtgcgcgagaagaagatcttggaggttcatattgataagggtatgaaggatgggcagaagatcacattccatggagaaggcgaccaggagcctggcttagaacctggagatataatcatcgtgttagaccagaaggaccatgccgtctttacacgtagaggcgaagatttattcatgtgcatggacatccagctcgtggaggccctgtgcggctttcagaagccaatttccaccctggacaaccggaccatagtgatcacttcacatcctgggcagatcgtgaagcatggggatatcaagtgtgttctgaatgaggggatgccaatttaccgtcggccttacgagaagggcaggctgattatcgagtttaaggtcaattttccggaaaacgggttcttgtcaccagacaagctctctctgctcgagaagctactccccgagcggaaagaggtggaggagactgacgagatggatcaggtggagcttgtggatttcgaccccaaccaggaaagacgacggcactacaacggagaagcctacgaagacgacgagcatcacccaagaggcggagtccagtgtcagacaagctag

SEQ ID NO: 55620 - DNA, 1194 bp, Artificial Sequence
  Description of Artificial Sequence: Synthetic coding sequence
atggttaaagaaacccaatactacgatatcctcggcgttaaaccctctgccagcccagaggagattaagaaggcttatcggaaattggccctgaagtatcaccccgacaagaatcctgacgagggagagaagtttaagcttatttcccaggcatacgaggtgctctccgatccaaaaaagcgggacgtctacgatcagggcggtgagcaggctatcaaggaagggggtagcgggtccccctcattctcatcccccatggacatttttgatatgttttttggaggaggcggtcgaatggccagggagcgacgtgggaaaaacgtggtccaccagctcagtgttacactggaggacctgtacaatggggtaaccaaaaagttagccttgcagaaaaacgttatttgtgagaaatgcgagggtgtgggaggcaagaaagggagtgtagaaaagtgccctctgtgcaaagggcgagggatgcagattcatattcagcagatcgggccaggtatggtccagcagatccagactgtttgtatcgaatgtaaaggccagggagagcgcatcaatcctaaagacagatgcgaaagttgctcaggagctaaggtgattcgtgagaagaagatcattgaagtgcatgtcgagaaaggaatgaaggacggccaaaaaatcctttttcacggggaaggtgaccaggaacccgagctggagcccggagatgtgatcattgtactggaccagaaggaccatagtgtctttcaaaggcgtggccacgatcttattatgaagatgaaaattcagttgtctgaagctttatgcggattcaaaaaaaccattaagacattggataaccgaattctggtcataaccagtaaggctggcgaggtcattaaacatggggacctgcggtgcgtcagggacgaaggcatgccaatatacaaagccccattggagaaaggtatcctgataatacagtttctggtgattttcccagagaaacattggttatccctggaaaagcttcctcagttggaagccctgctgccgcctcgccaaaaggtgcgtatcaccgatgacatggaccaggttgagctgaaagagttctgccccaacgaacaaaattggcggcagcaccgcgaggcttatgaagaggatgaggatgggccacaggctggcgtgcagtgccagaccgcctag

SEQ ID NO: 55621 - DNA, 1194 bp, Artificial Sequence
  Description of Artificial Sequence: Synthetic coding sequence
atggtgaaagagacgcagtactacgatatactcggcgtgaagcccagcgcttcacctgaggagatcaaaaaagcctacagaaagcttgctttgaaataccacccagataaaaaccccgacgagggtgagaagtttaagctgatctcacaagcctatgaagtcctcagcgatccaaagaaacgagacgtgtacgatcagggcggtgagcaggcgatcaaggaagggggtagcggatccccttcattttcaagccccatggacattttcgacatgttttttggaggaggcggaaggatggctagagagcggagaggtaagaatgtagtacaccagttatcagttactctcgaggacctgtacaatggcgtgaccaaaaaactcgcactgcagaagaacgttatttgcgagaaatgcgagggtgtcggcggtaaaaaaggcagcgtggagaaatgcccactgtgcaaaggccgagggatgcagatacatatccagcagattgggccaggtatggttcagcaaatccagactgtatgtattgagtgcaaaggccagggggagaggattaaccctaaggaccggtgcgaatcatgtagtggagccaaggtgattcgtgagaaaaagattatagaggtgcatgtcgagaaagggatgaaagacggccagaaaatactgtttcacggtgagggggaccaggagcccgagctcgagcccggtgatgtgattatagtgctggatcagaaggatcatagtgttttccagcgccgaggccatgatctaattatgaagatgaagatccagcttagtgaggccctgtgcggtttcaagaaaacaattaaaacactggataataggatactcgtcatcacctccaaggcaggagaggtgattaagcacggcgacctgcgttgcgtgagagacgaagggatgcctatttacaaagccccactggagaaaggcatcttaattatccagttccttgtcatatttccggagaagcattggctgtctctggaaaaactgccccagcttgaggcccttttgcccccacgccagaaagtgcggatcacagacgacatggaccaggtggaattgaaagaattttgtccaaacgagcagaactggaggcagcacagagaagcctacgaggaggacgaggacggcccacaggccggagttcagtgccagaccgcctag

SEQ ID NO: 55622 - DNA, 1281 bp, Artificial Sequence
  Description of Artificial Sequence: Synthetic coding sequence
atggcccgaggaggatcacagtcctggagcagcggcgaatccgacggccaacccaaagagcagactcctgagaaaccacggcacaaaatggtgaaagagacccaatactatgacattctaggagtgaagcctagcgcgagcccagaggagatcaaaaaggcctatcgcaagctggccctcaaataccaccctgacaagaatccggacgaaggcgagaagttcaagcttatcagccaggcttacgaagttctgtccgacccaaagaagagggatgtctatgatcagggaggagaacaagccattaaggagggcggtagtgggtctccttctttctcatctccaatggacatctttgatatgttcttcgggggtggcggtcgaatggcaagggagcgccgaggaaaaaatgtggtgcatcagctctccgtcacacttgaggatctgtacaacggcgtgaccaagaaattagccctacagaagaatgtgatttgcgagaagtgcgagggagtgggaggaaagaaggggagtgtggaaaagtgtccgctgtgtaaaggtagaggcatgcagatacatatccagcagattggcccagggatggtgcagcagattcaaactgtgtgcattgaatgcaagggccagggggagcgaataaacccaaaagacagatgtgagagctgcagtggcgctaaggtgattcgtgagaaaaaaattatcgaggtccatgttgagaagggaatgaaggatggccagaagatattatttcatggagagggtgaccaggaaccagaactggaacctggtgatgtaataatcgtgctggaccagaaggaccatagcgtgtttcaacggaggggccatgatttgataatgaaaatgaagatccagctctcagaagctctgtgtggtttcaagaaaacaattaagactctggacaatagaatcctggtgattacttcaaaggccggagaagtgataaaacatggtgaccttcggtgcgtcagggacgagggcatgcctatatacaaagcccctttggagaaaggaattcttattatacagttcttggtgatcttcccagagaaacactggttgtcactagagaaactgccacaacttgaggccctgctgcccccaaggcaaaaggtcaggatcacagacgacatggaccaagtggagctgaaggaattttgcccaaatgaacagaattggcgacagcaccgggaggcttatgaagaggacgaggatggtccccaagcaggcgtgcagtgccagaccgcatag

SEQ ID NO: 55623 - DNA, 1113 bp, Artificial Sequence
  Description of Artificial Sequence: Synthetic coding sequence
atgtgggaatctctgacccttgattccggacagatctccgccctcactcgttttaagttgatttcccaggcatatgaggtcctctccgatcccaaaaaaagggatgtgtacgaccagggcggagaacaagccataaaggaaggcggtagtggttcgccaagtttcagcagccctatggacatctttgatatgtttttcgggggaggcggacgcatggctagagagcgccgtggaaagaacgtggtgcatcagctgtctgtgacactggaggacttgtacaacggtgtgacgaaaaaactggcactccagaagaatgttatttgtgagaaatgtgaaggggtcgggggtaagaaaggttctgtcgagaaatgtccactctgcaaaggcagaggcatgcagatacatatccaacagattggccctggcatggtgcagcagattcaaactgtgtgtatcgagtgtaaggggcagggagagagaatcaaccctaaagaccgctgtgagtcttgttcaggggcaaaagtgattagggaaaagaaaatcattgaagtgcacgtggagaagggtatgaaagatggtcagaaaattctatttcatggtgagggagatcaggaacccgagctggaacccggtgatgttatcattgtcctcgaccagaaagaccactctgtgttccagcgcagaggccatgatcttatcatgaagatgaaaatccagctgtccgaggccctatgcgggtttaaaaaaacaataaaaactttggacaatagaattctggtgatcacgagcaaagctggcgaggtgattaagcacggcgacctgaggtgtgtgcgagacgaaggtatgcctatctacaaggcccctcttgagaagggtatcctcataatccagttcctcgttatattccctgaaaagcattggttaagcctggagaaactacctcagctagaggcgcttctccccccacggcaaaaggttagaatcacggacgacatggatcaagtcgaacttaaggagttctgtcctaacgaacagaattggagacaacatcgcgaggcttacgaagaagatgaagacggacctcaggcaggtgtacagtgtcaaacagcctag

SEQ ID NO: 55624 - DNA, 951 bp, Artificial Sequence
  Description of Artificial Sequence: Synthetic coding sequence
atgggccaggattactactcagttctcggtattacgagaaatagcgaagacgcgcagattaaacaggcttacaggcgcctcgccctaaagcatcatcctctaaaatcaaacgagccatccagtgccgaaatatttcgccagatcgcagaggcttacgatgtactcagcgatccgatgaagcgaggcatctatgataaattcggggaggagggactgaagggaggcatcccactagagtttggcagccaaaccccatggacaactgggtatgtgtttcatggcaagcccgaaaaggttttccatgaattcttcggagggaataaccctttctcagagttcttcgacgccgaggggtcggaggtggacttgaactttgggggactgcaggggagaggtgtgaagaagcaagatccccaggtcgaacgggacctgtacctgagcctggaagacctgttctttgggtgtaccaagaagatcaaaatatctcgtagggttctgaacgaggacggttattcgagcaccatcaaggataagatcctaacgatcgatgtgaagcctggctggcgacaaggtaccagaatcacttttgagaaagaaggcgatcaaggcccaaacatcattcccgctgacattatatttatagttaaagagaagttacatcccagattcagaagagaaaacgataacctgtttttcgtgaatcctatcccacttggaaaggctcttacatgctgtacagtcgaagttagaacgctggacgatcgcttgctgaatatcccaatcaatgacatcatccatccgaagtacttcaagaaggtgcccggtgaggggatgccattgcccgaggacccaactaaaaagggcgatctctttatctttttcgatattcaattccccacgaggctcacgcctcagaagaaacagatgttgcgccaggccctgctcacatag

SEQ ID NO: 55625 - DNA, 426 bp, Artificial Sequence
  Description of Artificial Sequence: Synthetic coding sequence
atggaaacctccaggggtaggaacctggctaaggtgaccaggcctaccagtccttgccacctgttggcaagcccggctcaggggcctaatatcatccctgcggacatcatatttatcgtgaaagagaaacttcatcccagattccggagggaaaatgacaatctctttttcgtcaatccaatccccctcggtaaggcattaacttgttgtaccgtagaggtacgcacattggacgataggctcctcaatattcccatcaacgatattatacacccaaagtactttaaaaaagttccaggcgaggggatgcccctgcctgaagatcctaccaagaagggggatcttttcatcttctttgacattcagttcccaactaggttgactcctcagaagaagcaaatgctgagacaggctctgctaacatag

SEQ ID NO: 55626 - DNA, 426 bp, Artificial Sequence
  Description of Artificial Sequence: Synthetic coding sequence
atggagaccagtaggggtagaaatttggcaaaggtaactcgccctacctctccgtgccacctgcttgcctctcccgcacaaggccctaatatcattcccgctgacataatctttattgtaaaggaaaagctgcacccacgatttaggcgcgagaatgacaacctctttttcgtgaatccaatcccactgggaaaggcgctgacttgctgtacggttgaggtgagaaccttagatgatcggctgctgaacattcccattaatgatattattcatcccaagtactttaagaaagtgcccggtgaaggcatgcctttgcccgaggatccaaccaaaaaaggggatctcttcatctttttcgatattcagttccccacgcgcctgaccccacagaaaaaacaaatgcttcgccaggcattactcacctag

SEQ ID NO: 55627 - DNA, 930 bp, Artificial Sequence
  Description of Artificial Sequence: Synthetic coding sequence
atggtggattattacgaggttctgggactacaacgctatgcgtcccctgaggatattaagaaagcctaccacaaagtagctctgaagtggcatccggataaaaatcccgaaaacaaggaggaagccgaaaggaaattcaaggaggtagcagaagcttacgaggttctgtcaaatgatgaaaaaagagacatttatgataagtacggaactgagggcttgaacggcggaggatcacattttgacgacgaatgtgagtatgggttcactttccacaagccagacgacgtgttcaaagagatcttccacgaacgggatcctttctctttccatttctttgaagacagcttggaggatctgctgaatagaccaggcagctcttacggaaaccggaaccgtgacgcaggctactttttcagtaccgctagcgagtacccaattttcgagaagttttcctcatacgatacagggtacaccagtcagggatctctggggcacgagggattaacctccttctcttcactcgctttcgataacagcgggatggacaattatatctcagtaacaacttccgataagattgtaaacgggcgtaatatcaataccaaaaagattattgagtcggaccaggaacgcgaggctgaagacaacggagaactgacttttttcctggttaactctgtggctaacgaggagggctttgctaaggagtgttcctggcggacccagagctttaataattattccccgaattctcacagcagtaagcacgtcagccagtacaccttcgttgataacgacgaaggaggaatctcttgggtaaccagtaacagggacccacccatcttctcggccggtgttaaagagggcggaaaaagaaagaagaagaaaaggaaggaagtccagaagaagtctaccaagagaaactgctag

SEQ ID NO: 55628 - DNA, 699 bp, Artificial Sequence
  Description of Artificial Sequence: Synthetic coding sequence
atggctaattactatgaggtcctgggtgtccaggcaagcgcgagcccagaagatattaaaaaggcatatagaaaactcgctttgcgttggcatcctgacaaaaatcctgataataaggaagaagcagagaagaaatttaagctggtgtccgaggcttacgaggtcctgtcagattctaaaaagcggtccctttatgatcgggcaggttgtgatagttggcgcgctggcggtggcgcatcgaccccataccattcaccctttgatactggctatacgtttcggaatcctgaggacatcttccgcgagtttttcggagggctggatcccttctccttcgagttctgggacagtccctttaatagcgatcgtggcggtagaggacatgggctgcgcggtgccttcagcgctgggttcggcgaatttcccgctttcatggaggcctttagcagtttcaatatgctcgggtgttccgggggtagtcacacaacattctcaagcacttcctttggcggatctagttcggggtccagcggctttaagtccgttatgtcctcaacagaaatgattaatggccacaaagtcacgaccaagagaatagttgaaaatggacaggagcgggtagaagtagaggaagatggtcagcttaagtctgttactgttaacgggaaggagcagctcaaatggatggacagcaagtag

SEQ ID NO: 55629 - DNA, 699 bp, Artificial Sequence
  Description of Artificial Sequence: Synthetic coding sequence
atggctaattattacgaagttcttggagttcaggcttctgcatcccctgaagatatcaagaaggcgtatcgtaagcttgcccttcgctggcacccagacaagaatccggacaataaggaggaagccgaaaaaaaattcaagctggtgtccgaggcatacgaggtgttaagcgatagcaaaaaaagatcgctatacgatcgtgccggttgcgatagttggcgcgctggtggaggagccagcactccttaccactccccatttgacaccggatacacattccggaatcctgaggatatctttcgagaatttttcggcggactggatcccttttcatttgagttctgggacagcccgttcaactctgatcggggtggccgtggccatgggcttcgaggggcatttagtgcaggcttcggggaattccctgccttcatggaagctttctcatctttcaacatgctgggatgctcgggcggttcacataccaccttctcttctacctccttcgggggatctagctctggatcttctggcttcaagtctgtgatgtcaagtactgagatgatcaatggtcataaggttactactaagaggatcgtggagaacgggcaggagcgcgtggaggtggaggaagatggccagctaaagtccgttacagtaaatggcaaagagcaactgaagtggatggattccaagtag

SEQ ID NO: 55630 - DNA, 1107 bp, Artificial Sequence
  Description of Artificial Sequence: Synthetic coding sequence
atgcagccaggctcatctcgatgtgaagaagaaacccccagcctgctgtgggggctggaccccgtattcttagctttcgccaagctatatattcgagatatcctggacatgaaggagtcccggcaggttcctggcgtgtttctctacaatgggcacccaataaagcaagtcgacgttttggggaccgtcattggagtgagggaaagagatgccttttactcttatggcgtcgatgattcgactggcgtgattaattgcatctgctggaagaagctaaatacagagagtgtgagcgcggcaccatcagcggcaagagaactgtcgttaacatcccagcttaagaagctgcaggagacgatcgagcaaaaaacaaagatcgagattggagacacaatcagggttcgcggatcgatacgaacctacagagaggagagagaaatccacgccacaacctactacaaggttgatgatcctgtgtggaatatccagattgccaggatgttggagttgccgacaatctaccggaaggtctatgatcagcctttccattctagtgccctcgagaaggaggaagcactaagcaatccaggtgccctcgatctgccatccctcacctctcttcttagcgaaaaggcgaaagagtttcttatggagaacagagtccagtcgttctatcaacaggaattagagatggtcgagagtctcctcagtctggccaaccagcctgtcatacattccgcatccagcgaccaggtaaactttaagaaagataccacgagcaaagccattcattcgatattcaagaatgcaatacagctgcttcaggaaaaggggctggttttccaaaaggatgacggttttgacaatttatattatgtgacccgcgaagataaggatctccatagaaagatccaccgaattatccagcaagattgtcagaagccaaaccatatggagaagggctgccatttcttgcacattttggcctgcgctaggctgtctatcagacctgggttgtccgaggccgtgcttcagcaggtcttagagctcctggaagaccaaagcgacatcgtgagtacaatggagcattattatacagctttctag

SEQ ID NO: 55631 - DNA, 324 bp, Artificial Sequence
  Description of Artificial Sequence: Synthetic coding sequence
atggatgcaatcctgaactataggtcagaggacaccgaggattattacacccttttgggatgtgacgaactgtccagcgtggagcaaatcctcgccgaattcaaagtcagggccctcgaatgtcaccctgacaaacatcctgaaaatccaaaagctgtcgaaacgttccagaaactgcagaaggccaaggaaatcctcacaaatgaagagagcagggccagatacgatcattggcgacgcagtcagatgagcatgccttttcagcaatgggaggcacttaatgacagcgtgaagaccgtcgggttctcccttggcgcaacatag

SEQ ID NO: 55632 - DNA, 1407 bp, Artificial Sequence
  Description of Artificial Sequence: Synthetic coding sequence
atgggctttttgggaacaggtacctggattctggtgctggtgctgcctattcaggcgttccctaaacctggaggcagccaggataaaagtctccataacagggaactcagcgccgagaggcccctcaatgaacagatagctgaagcggaagaggacaagatcaaaaagacatacccaccagagaataaacccggtcagtcaaactattccttcgtcgataatcttaacctacttaaggctattacagaaaaggagaagatagagaaggaaagacagagcatccgcagctcacccctggacaacaaactaaatgttgaggacgttgatagcacaaaaaaccgcaaactcatagatgattacgattccacaaaaagtggcctcgatcacaaatttcaggatgacccagatggactgcaccaactcgatgggacccccttaaccgcagaggatatcgtgcacaagattgccgcacgaatttacgaggagaatgatagggctgtctttgataagatcgtctctaaattgctgaacctggggctgatcaccgagagtcaggcccataccttggaggatgaagtcgccgaagtgctccagaagctgatctccaaagaggctaataattatgaggaagacccaaataagcccacctcttggaccgaaaatcaggcaggcaaaattccagagaaagtaacacctatggccgctatccaggacggactggcaaagggggagaacgatgagaccgtgtcaaataccctgaccctgactaacggacttgagagaagaaccaaaacttactcagaagacaacttcgaggaattgcagtacttccctaacttttatgctctgcttaaaagtattgactctgaaaaggaggctaaggagaaggagaccctaattacgattatgaagaccttgatcgactttgtaaaaatgatggtcaaatatggcactatcagtccggaggaaggagtgtcttatctggagaatttggatgagatgatcgcgctgcaaaccaaaaataagctggagaagaacgcaacggacaacatcagcaaactttttccggctccaagcgaaaaatcgcatgaagagaccgatagcacaaaggaggaggcagccaagatggagaaagagtacggatctcttaaggatagtacaaaagacgacaattcgaacccgggtggcaaaactgacgagcccaagggcaagaccgaagcgtatctggaggccatccgcaagaatatcgagtggctcaagaaacacgacaaaaaaggaaataaggaggactatgatctcagcaaaatgcgggattttattaataagcaggccgatgcctatgtagaaaaaggcatacttgataaagaggaggcagaggccatcaaacgcatctactcatctctgtag

SEQ ID NO: 55633 - DNA, 450 bp, Artificial Sequence
  Description of Artificial Sequence: Synthetic coding sequence
atgatggccgtggagcagatgcctaaaaaggactggtattcaatccttggagctgacccctcagccaacatttccgatttaaagcaaaagtaccaaaaactgattttgatgtaccaccctgataagcagtctactgacgtcccagcaggcaccgttgaggagtgtgtccaaaagtttatagagattgaccaggcatggaaaatcttaggtaacgaagagactaagagggaatatgacctgcaacgctgtgaggacgacctgcgcaacgttggtccggtggacgcccaggtgtatctggaagagatgtcctggaacgagggggaccacagcttctacttgagctgcaggtgtggaggcaaatatagcgtgtctaaggatgaagccgaggaagtgtcattaattagttgcgacacctgttccctaataattgaacttcttcactataactag

SEQ ID NO: 55634 - DNA, 255 bp, Artificial Sequence
  Description of Artificial Sequence: Synthetic coding sequence
atggccgtggagcagatgccaaagaaggactggtacagcattctgggcgcagaccctagcgcaaatatttcggacctcaaacagaagtatcaaaagcttatcctgatgtaccacccagacaagcaaagcactgacgtgcccgctgggacagtggaggagtgcgttcagaagttcatagagatcgaccaggcttggaagattcttggtaatgaggagactaagcgtgagtacgacttgcagagatgcggctcctag

SEQ ID NO: 55635 - DNA, 1167 bp, Artificial Sequence
  Description of Artificial Sequence: Synthetic coding sequence
atgaacacaatgtacgtgatgatggcccagatcctacgctcacatttgatcaaggctacagtgatccccaatcgcgtaaaaatgttgccttacttcggcatcattagaaaccgaatgatgtctacacataagtctaaaaagaaaatccgcgaatactacaggctacttaacgtggaagaaggatgttctgcagacgaagtgagggaatccttccataagctcgccaagcagtatcaccctgatagcggctctaataccgccgactcagctacattcattaggatcgaaaaggcttataggaaggtgctctcccacgttatcgagcagaccaatgcgtctcagtcgaagggcgaggaagaagaagacgtagagaagttcaaatataaaacacctcagcataggcactacctatcattcgaaggtattggattcggtacccctacgcagagggagaaacattatagacagttccgcgctgatagagccgctgagcaggtgatggagtatcaaaagcaaaagctgcaaagccagtattttcccgactcagtgattgtgaagaacatccggcagtccaaacaacagaagatcactcaagccattgaaaggctcgtggaagacctcattcaggagtctatggcaaagggagattttgataatctgagtggcaagggaaagcccctgaagaagttttcagattgcagttatatagaccctatgactcataacctgaatagaatcttaatagataacgggtatcagcctgagtggatcctaaaacagaaggaaatctctgatactattgaacagctgcgggaggccatcctggtatcccgcaaaaaattggggaatcctatgaccccaacagagaagaaacagtggaatcacgtttgcgaacagtttcaagaaaatatccgcaagcttaataaacgaatcaatgacttcaatttgattgtcccaattttgacacggcagaaggtgcactttgatgcacagaaggagattgtccgcgctcaaaagatctatgagacattgatcaaaacaaaggaggtgactgaccggaatccgaataatttggaccagggcgaaggtgagaaaactcccgaaatcaagaaggggttcttaaactggatgaacctatggaaattcattaagatccgcagcttttag

SEQ ID NO: 55636 - DNA, 1167 bp, Artificial Sequence
  Description of Artificial Sequence: Synthetic coding sequence
atgaataccatgtacgtgatgatggcccagatcctaaggtcacatctgatcaaggctaccgtcatccctaaccgggtgaagatgcttccttactttggtattatccggaacaggatgatgtctacacacaagtcgaagaagaagatcagagagtactaccggctgctgaatgtagaggaagggtgttctgctgacgaggtgcgggagtcgttccacaaattagccaaacagtaccaccctgattcaggaagcaataccgcagattcagccacattcataagaatcgaaaaggcataccgaaaggttctcagccatgtgatcgagcagaccaacgcctcgcaaagtaaaggtgaagaagaagaagacgttgaaaagttcaaatataaaaccccgcaacacaggcactatttgagctttgagggaattgggttcggcactcccacacagcgcgaaaagcactaccgccagttccgagctgaccgagcggcagaacaggttatggagtaccaaaagcaaaagctgcaaagccagtactttccagattctgtgatcgtgaaaaatatccgccagagcaaacaacagaagatcacccaggctatagaacggctggttgaagacctgatacaggagtcaatggctaaaggcgattttgacaacctgtccggaaaaggaaagcctctgaagaagttctcagactgtagctacatagatccaatgactcataatttaaatagaatattgatcgacaacggctatcagccagagtggattctgaaacagaaagaaatttccgatactattgagcaactgagggaagctatactggtgtcccgaaaaaaactcggcaatccaatgaccccaacagagaagaagcagtggaatcatgtgtgtgaacagttccaggagaacataaggaagctgaataaacggataaacgatttcaatcttatagtgcctatcttgacccggcagaaggtgcatttcgacgctcaaaaggaaatcgtcagggctcagaagatttacgagactcttattaagactaaagaggtgaccgacagaaatccaaacaacctggatcaaggtgagggtgagaagacgccagaaattaaaaagggctttcttaactggatgaacctgtggaagtttattaagatcagatctttctag

SEQ ID NO: 55637 - DNA, 1167 bp, Artificial Sequence
  Description of Artificial Sequence: Synthetic coding sequence
atgaacacaatgtatgtgatgatggctcaaattctgaggagtcacctaattaaagccacggtgattcctaacagagttaaaatgctgccgtatttcgggatcataaggaaccgcatgatgtccacccataaatccaagaaaaaaattcgggaatactaccggttgctgaatgttgaagaaggttgcagcgcagacgaggtgcgagagtcttttcacaagctggcaaagcagtaccacccagattcgggcagcaataccgccgactccgcaacatttatccgcatcgaaaaggcctatagaaaggtgctgtcacacgtcattgaacaaacgaacgcatctcagtccaaaggcgaagaagaagaggacgtcgagaagttcaagtataaaaccccacagcatagacactatctgtccttcgaaggcattggattcggcacccctactcagagggaaaaacactacaggcagtttcgcgctgatagagccgctgaacaggtcatggagtatcagaagcaaaaactgcaatcccagtactttcccgatagcgtgattgtcaaaaatattcgtcagagcaaacagcagaaaatcacgcaggcaattgagcggctggtggaagatttgatccaggagtctatggcaaagggcgactttgacaatctctctgggaaggggaagcctctgaagaaattcagtgactgttcatacatcgatccaatgacgcataatctgaaccgtatccttattgataatggatatcaaccagagtggatcttaaagcagaaggagattagtgataccatcgagcaactccgggaggcgattctcgtgagcagaaagaagttaggcaaccccatgacaccgacagaaaagaagcagtggaatcacgtttgcgagcagtttcaggaaaatatccgtaagcttaataagcgcattaatgatttcaatctgatagtacctattctgactagacagaaggtgcactttgatgctcagaaggaaattgttagggctcaaaagatctacgaaaccctgattaaaacgaaggaggtcacagataggaatccgaacaacctggaccagggagagggggagaaaacaccagagatcaaaaaaggattcttgaattggatgaatctgtggaagttcatcaagatccggtctttctag

SEQ ID NO: 55638 - DNA, 462 bp, Artificial Sequence
  Description of Artificial Sequence: Synthetic coding sequence
atgggcgcaccattgttgtcccctggctggggggctggcgctgcaggacgcagatggtggatgcttttggcgccactgttgcctgctttattattggtgaggccagcaggggcactggtagagggactatactgtggtactcgagattgctatgaggtcttgggcgtgtctagatccgctgggaaagccgagatagcaagggcctatcggcagcttgctcggagataccatcccgatagatatcgaccacagcctggtgatgaaggtccgggaagaacaccccaatccgcggaagaagccttcctgctggtggcgaccgcatacgaaaccctgaaggtatcccaagccgcagcagaactgcagcagtattgtatgcagaatgcctgcaaagatgccctgttagtaggcgtgcccgcaggctctaacccatttagagagcccaggagctgtgctctgctctag

SEQ ID NO: 55639 - DNA, 996 bp, Artificial Sequence
  Description of Artificial Sequence: Synthetic coding sequence
atggctagcaatttcaatgatattgtcaagcaaggatacgttaaaatacggagcaggaagctaggcattttccgacgctgttggctcgtcttcaaaaaggccagcagcaagggtccaagacggcttgagaagtttcctgatgaaaaagcagcctatttcaggaactttcacaaggtgactgagttacataacataaagaatatcacacgcctgccaagagagactaagaagcacgctgtcgctatcatctttcatgacgaaacaagtaagacatttgcttgtgaaagcgaactggaagctgaagaatggtgtaagcacctgtgcatggaatgccttggcacccggctgaacgatatcagtttgggagagcccgacctgctcgcagccggagtccaaagggaacagaacgaaagattcaacgtgtatctcatgccgacacctaacctggatatctatggcgagtgtaccatgcaaataacccatgagaacatatacctttgggacatacacaatgcgaaggtgaagctggtaatgtggcctctttccagcctgcggagatacggaagggattccacttggttcacatttgaaagtggaaggatgtgcgatacgggcgagggcctgttcacatttcagactagggaaggggaaatgatctatcagaaggtgcacagcgctactctggctatcgcggaacagcatgaacgcttgatgctcgagatggaacagaaagctcgtctgcagaccagtctcaccgaaccaatgaccctgtccaaatcaatcagccttccacgatctgcatactggcaccatatcactagacagaatagtgtcggggagatttactcacttcaaggccatggatttggctcatccaagatgtctagagcacagactttcccaagctacgcaccagagcagagcgaggaagctcagcagcccctctcaagaagcagcagctatggcttctcgtactcgagcagtctcatccagtag

SEQ ID NO: 55640 - DNA, 615 bp, Artificial Sequence
  Description of Artificial Sequence: Synthetic coding sequence
atggcagaagacacttacagtcataaaatggtcaagacgaatcatagacgctgtcgcactaaattcacagaagaacagctcaaaattctcatcaacacctttaaccaaaagccctatcccggatacgctaccaagcagaaactcgctctagagattaacaccgaagagagcaggatccagatctggtttcagaacagacgggcacgccacggctttcagaaacggccagaggccgagacactcgagagcagccagtcgcaggggcaggatcagccaggagtggagtttcaaagcagggaagctcggagatgcagaactacctattctgctagtcagttacacacgttaatcaaagccttcatgaagaatccatatccgggtatcgactccagagaggagctggcgaaggaaataggcgtgccagagtcgcgggtgcagatttggttccagaacagacggtcaagattgcttctgcaacggaagcgcgaaccggtggcaagcctagagcaggaagaacaggggaagatacccgagggcctgcagggggcagaggatacgcagaatggaactaatttcacaagtgattcacacttttctggtgcaaggacctggtag
